United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 19

SEQ ID NO: 772380 - DNA, 13 bp, Homo sapiens
ccccagtctcccc

SEQ ID NO: 772381 - DNA, 22 bp, Homo sapiens
ccccagtgcggttcctcatctg

SEQ ID NO: 772382 - DNA, 17 bp, Homo sapiens
ccccagtggggacaggg

SEQ ID NO: 772383 - DNA, 21 bp, Homo sapiens
ccccagttcctgtggctccct

SEQ ID NO: 772384 - DNA, 22 bp, Homo sapiens
ccccagttcctgtggctccctc

SEQ ID NO: 772385 - DNA, 18 bp, Homo sapiens
ccccagttctgctcctct

SEQ ID NO: 772386 - DNA, 23 bp, Homo sapiens
ccccagtttgcagaaaagcacct

SEQ ID NO: 772387 - DNA, 17 bp, Homo sapiens
ccccataataaccctgc

SEQ ID NO: 772388 - DNA, 13 bp, Homo sapiens
ccccatacacaca

SEQ ID NO: 772389 - DNA, 18 bp, Homo sapiens
ccccataccccttattgc

SEQ ID NO: 772390 - DNA, 22 bp, Homo sapiens
ccccataccccttattgctgcc

SEQ ID NO: 772391 - DNA, 14 bp, Homo sapiens
ccccatcaccatgg

SEQ ID NO: 772392 - DNA, 17 bp, Homo sapiens
ccccatcactcgcagga

SEQ ID NO: 772393 - DNA, 14 bp, Homo sapiens
ccccatcagctccc

SEQ ID NO: 772394 - DNA, 15 bp, Homo sapiens
ccccatcagctgcca

SEQ ID NO: 772395 - DNA, 14 bp, Homo sapiens
ccccatcagtgctc

SEQ ID NO: 772396 - DNA, 13 bp, Homo sapiens
ccccatccagcca

SEQ ID NO: 772397 - DNA, 14 bp, Homo sapiens
ccccatccagccac

SEQ ID NO: 772398 - DNA, 15 bp, Homo sapiens
ccccatccagccacg

SEQ ID NO: 772399 - DNA, 17 bp, Homo sapiens
ccccatccagccacgga

SEQ ID NO: 772400 - DNA, 14 bp, Homo sapiens
ccccatcccagggt

SEQ ID NO: 772401 - DNA, 12 bp, Homo sapiens
ccccatcctcca

SEQ ID NO: 772402 - DNA, 15 bp, Homo sapiens
ccccatcctccagct

SEQ ID NO: 772403 - DNA, 17 bp, Homo sapiens
ccccatcctccagcttc

SEQ ID NO: 772404 - DNA, 18 bp, Homo sapiens
ccccatcctccagcttct

SEQ ID NO: 772405 - DNA, 13 bp, Homo sapiens
ccccatcctcccc

SEQ ID NO: 772406 - DNA, 18 bp, Homo sapiens
ccccatcctccccttccc

SEQ ID NO: 772407 - DNA, 19 bp, Homo sapiens
ccccatcctccccttccct

SEQ ID NO: 772408 - DNA, 13 bp, Homo sapiens
ccccatcctccct

SEQ ID NO: 772409 - DNA, 14 bp, Homo sapiens
ccccatcctccctc

SEQ ID NO: 772410 - DNA, 19 bp, Homo sapiens
ccccatcgccccaactcca

SEQ ID NO: 772411 - DNA, 15 bp, Homo sapiens
ccccatcggccaaga

SEQ ID NO: 772412 - DNA, 14 bp, Homo sapiens
ccccatcggccctg

SEQ ID NO: 772413 - DNA, 19 bp, Homo sapiens
ccccatctcatcctggcac

SEQ ID NO: 772414 - DNA, 21 bp, Homo sapiens
ccccatctcatgcccctggct

SEQ ID NO: 772415 - DNA, 16 bp, Homo sapiens
ccccatctccccaggc

SEQ ID NO: 772416 - DNA, 18 bp, Homo sapiens
ccccatctccccaggcct

SEQ ID NO: 772417 - DNA, 20 bp, Homo sapiens
ccccatctccccaggcctcc

SEQ ID NO: 772418 - DNA, 19 bp, Homo sapiens
ccccatctccctgcctggc

SEQ ID NO: 772419 - DNA, 16 bp, Homo sapiens
ccccatctctccctcc

SEQ ID NO: 772420 - DNA, 12 bp, Homo sapiens
ccccatctctgt

SEQ ID NO: 772421 - DNA, 14 bp, Homo sapiens
ccccatctctgtct

SEQ ID NO: 772422 - DNA, 20 bp, Homo sapiens
ccccatctctgtctggggct

SEQ ID NO: 772423 - DNA, 13 bp, Homo sapiens
ccccatctgagct

SEQ ID NO: 772424 - DNA, 14 bp, Homo sapiens
ccccatctgagctg

SEQ ID NO: 772425 - DNA, 14 bp, Homo sapiens
ccccatctgggtcc

SEQ ID NO: 772426 - DNA, 14 bp, Homo sapiens
atgaagcaaggaag

SEQ ID NO: 772427 - DNA, 13 bp, Homo sapiens
atgaagcagcttt

SEQ ID NO: 772428 - DNA, 20 bp, Homo sapiens
atgaagcctccttagaaaaa

SEQ ID NO: 772429 - DNA, 12 bp, Homo sapiens
atgaagcctttg

SEQ ID NO: 772430 - DNA, 17 bp, Homo sapiens
atgaagctgagcttttg

SEQ ID NO: 772431 - DNA, 22 bp, Homo sapiens
atgaagctgtataattaattgt

SEQ ID NO: 772432 - DNA, 13 bp, Homo sapiens
atgaaggaattac

SEQ ID NO: 772433 - DNA, 22 bp, Homo sapiens
atgaaggaatttgattgctttg

SEQ ID NO: 772434 - DNA, 22 bp, Homo sapiens
atgaaggcaaaaactgtactgt

SEQ ID NO: 772435 - DNA, 22 bp, Homo sapiens
atgaaggcagaaaaatgtcatt

SEQ ID NO: 772436 - DNA, 20 bp, Homo sapiens
atgaccctctgtccccaggc

SEQ ID NO: 772437 - DNA, 14 bp, Homo sapiens
atgacccttttcat

SEQ ID NO: 772438 - DNA, 20 bp, Homo sapiens
atgacctacagtgctgtgta

SEQ ID NO: 772439 - DNA, 21 bp, Homo sapiens
atgacctacagtgctgtgtac

SEQ ID NO: 772440 - DNA, 18 bp, Homo sapiens
atgacctagttttccatg

SEQ ID NO: 772441 - DNA, 19 bp, Homo sapiens
atgacctcccctccccagc

SEQ ID NO: 772442 - DNA, 19 bp, Homo sapiens
atgacgacgacaacgatga

SEQ ID NO: 772443 - DNA, 21 bp, Homo sapiens
atgacgccagataaaatgttc

SEQ ID NO: 772444 - DNA, 22 bp, Homo sapiens
atgacgccagataaaatgttca

SEQ ID NO: 772445 - DNA, 14 bp, Homo sapiens
atgacgcggctcaa

SEQ ID NO: 772446 - DNA, 19 bp, Homo sapiens
atgacggtaagtgttctca

SEQ ID NO: 772447 - DNA, 13 bp, Homo sapiens
atgactaaagaga

SEQ ID NO: 772448 - DNA, 16 bp, Homo sapiens
atgactaaagagagaa

SEQ ID NO: 772449 - DNA, 17 bp, Homo sapiens
atgactaaagagagaat

SEQ ID NO: 772450 - DNA, 18 bp, Homo sapiens
atgactaaagagagaatg

SEQ ID NO: 772451 - DNA, 20 bp, Homo sapiens
atgactaatgctttttagaa

SEQ ID NO: 772452 - DNA, 18 bp, Homo sapiens
atgactacctcagaacat

SEQ ID NO: 772453 - DNA, 21 bp, Homo sapiens
atgactactaacaaatgtaaa

SEQ ID NO: 772454 - DNA, 15 bp, Homo sapiens
atgactatgtaaact

SEQ ID NO: 772455 - DNA, 15 bp, Homo sapiens
atgactatgtccaga

SEQ ID NO: 772456 - DNA, 17 bp, Homo sapiens
atgactcacatgatgca

SEQ ID NO: 772457 - DNA, 17 bp, Homo sapiens
atgactcgaaactgaca

SEQ ID NO: 772458 - DNA, 13 bp, Homo sapiens
atgactctctcca

SEQ ID NO: 772459 - DNA, 12 bp, Homo sapiens
atgactctgaga

SEQ ID NO: 772460 - DNA, 17 bp, Homo sapiens
atgactcttggagcctc

SEQ ID NO: 772461 - DNA, 18 bp, Homo sapiens
atgactcttggagcctct

SEQ ID NO: 772462 - DNA, 20 bp, Homo sapiens
atgactctttctgaaggaag

SEQ ID NO: 772463 - DNA, 13 bp, Homo sapiens
atgactgattact

SEQ ID NO: 772464 - DNA, 16 bp, Homo sapiens
atgactgcacccagct

SEQ ID NO: 772465 - DNA, 14 bp, Homo sapiens
atgactgctgattt

SEQ ID NO: 772466 - DNA, 15 bp, Homo sapiens
atgactggctgtctg

SEQ ID NO: 772467 - DNA, 20 bp, Homo sapiens
atgactgtgaactgggcatt

SEQ ID NO: 772468 - DNA, 17 bp, Homo sapiens
atgactgtgaccacctt

SEQ ID NO: 772469 - DNA, 21 bp, Homo sapiens
atgactgtttcttttgtaaag

SEQ ID NO: 772470 - DNA, 22 bp, Homo sapiens
atgactgtttttcggacagttt

SEQ ID NO: 772471 - DNA, 21 bp, Homo sapiens
atgacttagcgtcaagacatt

SEQ ID NO: 772472 - DNA, 23 bp, Homo sapiens
atgacttagcgtcaagacatttg

SEQ ID NO: 772473 - DNA, 16 bp, Homo sapiens
atgacttattatgcat

SEQ ID NO: 772474 - DNA, 18 bp, Homo sapiens
atgacttatttctgctct

SEQ ID NO: 772475 - DNA, 21 bp, Homo sapiens
atgacttatttctgctctgga

SEQ ID NO: 772476 - DNA, 22 bp, Homo sapiens
atgacttatttctgctctggaa

SEQ ID NO: 772477 - DNA, 13 bp, Homo sapiens
atgacttcagtga

SEQ ID NO: 772478 - DNA, 16 bp, Homo sapiens
atgacttccctgctcc

SEQ ID NO: 772479 - DNA, 13 bp, Homo sapiens
atgacttgattgt

SEQ ID NO: 772480 - DNA, 17 bp, Homo sapiens
atgacttgattgtactt

SEQ ID NO: 772481 - DNA, 15 bp, Homo sapiens
atgacttgctgtcca

SEQ ID NO: 772482 - DNA, 23 bp, Homo sapiens
atgacttggtggcttttccttga

SEQ ID NO: 772483 - DNA, 23 bp, Homo sapiens
atgactttatatggatgattcag

SEQ ID NO: 772484 - DNA, 16 bp, Homo sapiens
atgactttattgcatc

SEQ ID NO: 772485 - DNA, 18 bp, Homo sapiens
atgactttcctcagaaca

SEQ ID NO: 772486 - DNA, 15 bp, Homo sapiens
atgacttttctgccc

SEQ ID NO: 772487 - DNA, 13 bp, Homo sapiens
atgactttttata

SEQ ID NO: 772488 - DNA, 17 bp, Homo sapiens
atgacttttttaaacta

SEQ ID NO: 772489 - DNA, 14 bp, Homo sapiens
atgagaaactgcat

SEQ ID NO: 772490 - DNA, 21 bp, Homo sapiens
atgagaaacttaaatgttatt

SEQ ID NO: 772491 - DNA, 19 bp, Homo sapiens
atgagaaagcttttattcc

SEQ ID NO: 772492 - DNA, 18 bp, Homo sapiens
atgagaaagggagaggaa

SEQ ID NO: 772493 - DNA, 18 bp, Homo sapiens
atgagaacaaagctgtta

SEQ ID NO: 772494 - DNA, 18 bp, Homo sapiens
atgagaagagggcctgtg

SEQ ID NO: 772495 - DNA, 14 bp, Homo sapiens
atgagaatatacct

SEQ ID NO: 772496 - DNA, 16 bp, Homo sapiens
atgagaatcatgcact

SEQ ID NO: 772497 - DNA, 13 bp, Homo sapiens
atgagaattttat

SEQ ID NO: 772498 - DNA, 23 bp, Homo sapiens
atgagacagggtcttgctctgtc

SEQ ID NO: 772499 - DNA, 16 bp, Homo sapiens
atgagactgaactgtg

SEQ ID NO: 772500 - DNA, 18 bp, Homo sapiens
atgagactttttcagtgg

SEQ ID NO: 772501 - DNA, 13 bp, Homo sapiens
atgagagcataat

SEQ ID NO: 772502 - DNA, 16 bp, Homo sapiens
atgagagccaagtagt

SEQ ID NO: 772503 - DNA, 13 bp, Homo sapiens
atgagagtcactt

SEQ ID NO: 772504 - DNA, 19 bp, Homo sapiens
atgagagttccttctcact

SEQ ID NO: 772505 - DNA, 16 bp, Homo sapiens
atgagatactttgcat

SEQ ID NO: 772506 - DNA, 23 bp, Homo sapiens
atgagatctaagcctttccataa

SEQ ID NO: 772507 - DNA, 19 bp, Homo sapiens
atgagatgcgttgttacag

SEQ ID NO: 772508 - DNA, 12 bp, Homo sapiens
atgagatgctgg

SEQ ID NO: 772509 - DNA, 16 bp, Homo sapiens
atgagatggttaaaaa

SEQ ID NO: 772510 - DNA, 22 bp, Homo sapiens
atgagatggttaaaaaggccaa

SEQ ID NO: 772511 - DNA, 20 bp, Homo sapiens
atgagatgttattactgttt

SEQ ID NO: 772512 - DNA, 22 bp, Homo sapiens
atgagattgttttatcatgaca

SEQ ID NO: 772513 - DNA, 16 bp, Homo sapiens
atgagatttgccagca

SEQ ID NO: 772514 - DNA, 19 bp, Homo sapiens
atgagatttgccagcacag

SEQ ID NO: 772515 - DNA, 16 bp, Homo sapiens
atgagatttttaaaaa

SEQ ID NO: 772516 - DNA, 20 bp, Homo sapiens
atgagatttttaaaaaatat

SEQ ID NO: 772517 - DNA, 22 bp, Homo sapiens
atgagcacatctctctgccctc

SEQ ID NO: 772518 - DNA, 13 bp, Homo sapiens
atgagcagaggga

SEQ ID NO: 772519 - DNA, 22 bp, Homo sapiens
atgagcatttgtttgaccccag

SEQ ID NO: 772520 - DNA, 16 bp, Homo sapiens
atgagccaaaatgact

SEQ ID NO: 772521 - DNA, 19 bp, Homo sapiens
atgagccaaaatgactttg

SEQ ID NO: 772522 - DNA, 20 bp, Homo sapiens
atgagccaaaatgactttga

SEQ ID NO: 772523 - DNA, 21 bp, Homo sapiens
atgagccaaaatgactttgaa

SEQ ID NO: 772524 - DNA, 18 bp, Homo sapiens
atgagccatcactagaag

SEQ ID NO: 772525 - DNA, 22 bp, Homo sapiens
atgagccctggctcccacctgt

SEQ ID NO: 772526 - DNA, 16 bp, Homo sapiens
atgagcctgcccgctg

SEQ ID NO: 772527 - DNA, 17 bp, Homo sapiens
atgagcctgctggaagc

SEQ ID NO: 772528 - DNA, 20 bp, Homo sapiens
atgagcctgctggaagccca

SEQ ID NO: 772529 - DNA, 11 bp, Homo sapiens
atgagcctggc

SEQ ID NO: 772530 - DNA, 13 bp, Homo sapiens
atgagcctggcaa

SEQ ID NO: 772531 - DNA, 21 bp, Homo sapiens
atgagctacaacaaaaggact

SEQ ID NO: 772532 - DNA, 17 bp, Homo sapiens
atgagctagtgtcttat

SEQ ID NO: 772533 - DNA, 23 bp, Homo sapiens
atgagctatttccattccagaat

SEQ ID NO: 772534 - DNA, 17 bp, Homo sapiens
atgagctccagaccccc

SEQ ID NO: 772535 - DNA, 21 bp, Homo sapiens
atgagctccagacccccagca

SEQ ID NO: 772536 - DNA, 22 bp, Homo sapiens
atgagctccagacccccagcaa

SEQ ID NO: 772537 - DNA, 14 bp, Homo sapiens
atgagctctgaaca

SEQ ID NO: 772538 - DNA, 13 bp, Homo sapiens
atgagctgagggg

SEQ ID NO: 772539 - DNA, 23 bp, Homo sapiens
atgagctgccagaatcaggtttc

SEQ ID NO: 772540 - DNA, 22 bp, Homo sapiens
atgagctgctcattacagttct

SEQ ID NO: 772541 - DNA, 18 bp, Homo sapiens
atgagctgtatctgtaat

SEQ ID NO: 772542 - DNA, 16 bp, Homo sapiens
atgagcttcaatataa

SEQ ID NO: 772543 - DNA, 21 bp, Homo sapiens
atgagctttgtctacttcaaa

SEQ ID NO: 772544 - DNA, 21 bp, Homo sapiens
atgaggaaaataatgtaattg

SEQ ID NO: 772545 - DNA, 12 bp, Homo sapiens
atgaggaatgta

SEQ ID NO: 772546 - DNA, 17 bp, Homo sapiens
atgaggaatgtatatgt

SEQ ID NO: 772547 - DNA, 13 bp, Homo sapiens
atgaggacatgtt

SEQ ID NO: 772548 - DNA, 15 bp, Homo sapiens
atgaggactcatata

SEQ ID NO: 772549 - DNA, 13 bp, Homo sapiens
atgaggaggggag

SEQ ID NO: 772550 - DNA, 14 bp, Homo sapiens
atgaggcacttctg

SEQ ID NO: 772551 - DNA, 13 bp, Homo sapiens
atgaggcatttgt

SEQ ID NO: 772552 - DNA, 14 bp, Homo sapiens
atgaggcatttgtt

SEQ ID NO: 772553 - DNA, 21 bp, Homo sapiens
atgaggcatttgtttgaactg

SEQ ID NO: 772554 - DNA, 17 bp, Homo sapiens
atgaggccatctcagga

SEQ ID NO: 772555 - DNA, 21 bp, Homo sapiens
atgaggccgctagaggcctga

SEQ ID NO: 772556 - DNA, 14 bp, Homo sapiens
cccccgactgcctg

SEQ ID NO: 772557 - DNA, 18 bp, Homo sapiens
cccccgcacagccacccg

SEQ ID NO: 772558 - DNA, 18 bp, Homo sapiens
atgattctattatatatt

SEQ ID NO: 772559 - DNA, 14 bp, Homo sapiens
atgattctctgtgg

SEQ ID NO: 772560 - DNA, 14 bp, Homo sapiens
atgattcttaacac

SEQ ID NO: 772561 - DNA, 15 bp, Homo sapiens
atgattcttctcttg

SEQ ID NO: 772562 - DNA, 21 bp, Homo sapiens
ccccgggctctggccaccctg

SEQ ID NO: 772563 - DNA, 20 bp, Homo sapiens
ccccgggctggccctgtgca

SEQ ID NO: 772564 - DNA, 22 bp, Homo sapiens
ccccggggcatggacagggcca

SEQ ID NO: 772565 - DNA, 17 bp, Homo sapiens
ccccgggggaggaaggg

SEQ ID NO: 772566 - DNA, 18 bp, Homo sapiens
ccccgggtttggcgggcc

SEQ ID NO: 772567 - DNA, 24 bp, Homo sapiens
ccccggtcccttgagacctcagcc

SEQ ID NO: 772568 - DNA, 22 bp, Homo sapiens
ccccggttgctggtcaggtccc

SEQ ID NO: 772569 - DNA, 21 bp, Homo sapiens
ccccgtactaggttggacagc

SEQ ID NO: 772570 - DNA, 13 bp, Homo sapiens
ccccgtcagggag

SEQ ID NO: 772571 - DNA, 16 bp, Homo sapiens
ccccgtcagggagagg

SEQ ID NO: 772572 - DNA, 17 bp, Homo sapiens
ccccgtcccctgcagcc

SEQ ID NO: 772573 - DNA, 19 bp, Homo sapiens
ccccgtcccctgcagcctg

SEQ ID NO: 772574 - DNA, 16 bp, Homo sapiens
ccccgtccctgtcccc

SEQ ID NO: 772575 - DNA, 21 bp, Homo sapiens
ccccgtccctgtcccccagca

SEQ ID NO: 772576 - DNA, 22 bp, Homo sapiens
ccccgtccctgtcccccagcat

SEQ ID NO: 772577 - DNA, 19 bp, Homo sapiens
ccccgtcggactgccccca

SEQ ID NO: 772578 - DNA, 21 bp, Homo sapiens
ccccgtctggggttcagcccc

SEQ ID NO: 772579 - DNA, 14 bp, Homo sapiens
ccccgtggctctgg

SEQ ID NO: 772580 - DNA, 19 bp, Homo sapiens
ccccgtttcagtggaccct

SEQ ID NO: 772581 - DNA, 13 bp, Homo sapiens
ccccgttttgggg

SEQ ID NO: 772582 - DNA, 19 bp, Homo sapiens
cccctaaagcctcaaaaca

SEQ ID NO: 772583 - DNA, 14 bp, Homo sapiens
cccctaagactgcc

SEQ ID NO: 772584 - DNA, 16 bp, Homo sapiens
cccctaagactgcctt

SEQ ID NO: 772585 - DNA, 17 bp, Homo sapiens
cccctaagactgccttc

SEQ ID NO: 772586 - DNA, 20 bp, Homo sapiens
cccctaagactgccttcagt

SEQ ID NO: 772587 - DNA, 13 bp, Homo sapiens
cccctacccaccg

SEQ ID NO: 772588 - DNA, 17 bp, Homo sapiens
cccctacccctggctgt

SEQ ID NO: 772589 - DNA, 17 bp, Homo sapiens
cccctaggatgctgcag

SEQ ID NO: 772590 - DNA, 19 bp, Homo sapiens
cccctaggatgctgcagca

SEQ ID NO: 772591 - DNA, 22 bp, Homo sapiens
cccctaggatgctgcagcagag

SEQ ID NO: 772592 - DNA, 22 bp, Homo sapiens
cccctaggattccccctgccct

SEQ ID NO: 772593 - DNA, 16 bp, Homo sapiens
cccctatccacccagc

SEQ ID NO: 772594 - DNA, 17 bp, Homo sapiens
cccctatccacccagcc

SEQ ID NO: 772595 - DNA, 20 bp, Homo sapiens
cccctatccacccagcccat

SEQ ID NO: 772596 - DNA, 12 bp, Homo sapiens
cccctatcctct

SEQ ID NO: 772597 - DNA, 15 bp, Homo sapiens
cccctatcctctgag

SEQ ID NO: 772598 - DNA, 16 bp, Homo sapiens
cccctatcctctgagt

SEQ ID NO: 772599 - DNA, 15 bp, Homo sapiens
cccctcaacaccctg

SEQ ID NO: 772600 - DNA, 18 bp, Homo sapiens
cccctcaacaccctgctt

SEQ ID NO: 772601 - DNA, 11 bp, Homo sapiens
cccctcacatc

SEQ ID NO: 772602 - DNA, 18 bp, Homo sapiens
cccctcacatcctctcca

SEQ ID NO: 772603 - DNA, 20 bp, Homo sapiens
cccctcacatcctctccagg

SEQ ID NO: 772604 - DNA, 12 bp, Homo sapiens
cccctcacctcc

SEQ ID NO: 772605 - DNA, 14 bp, Homo sapiens
cccctcacctcctc

SEQ ID NO: 772606 - DNA, 18 bp, Homo sapiens
cccctcacctgggccttt

SEQ ID NO: 772607 - DNA, 18 bp, Homo sapiens
cccctcacgcaagtgcca

SEQ ID NO: 772608 - DNA, 21 bp, Homo sapiens
cccctcactccccagggagct

SEQ ID NO: 772609 - DNA, 15 bp, Homo sapiens
cccctcactctgtca

SEQ ID NO: 772610 - DNA, 22 bp, Homo sapiens
cccctcactctgtcagccagcc

SEQ ID NO: 772611 - DNA, 21 bp, Homo sapiens
cccctcagatgatctctccac

SEQ ID NO: 772612 - DNA, 16 bp, Homo sapiens
cccctcagcctgccca

SEQ ID NO: 772613 - DNA, 21 bp, Homo sapiens
cccctcagcgcaggctgcaga

SEQ ID NO: 772614 - DNA, 13 bp, Homo sapiens
cccctcagctccc

SEQ ID NO: 772615 - DNA, 18 bp, Homo sapiens
cccctcagggggccagct

SEQ ID NO: 772616 - DNA, 21 bp, Homo sapiens
cccctcagggggccagctggg

SEQ ID NO: 772617 - DNA, 17 bp, Homo sapiens
cccctcattcagagact

SEQ ID NO: 772618 - DNA, 19 bp, Homo sapiens
cccctccaaacctccagcc

SEQ ID NO: 772619 - DNA, 21 bp, Homo sapiens
cccctccaccccccactcagt

SEQ ID NO: 772620 - DNA, 19 bp, Homo sapiens
cccctccacgcctcctggc

SEQ ID NO: 772621 - DNA, 11 bp, Homo sapiens
cccctccactg

SEQ ID NO: 772622 - DNA, 13 bp, Homo sapiens
cccctccagaccc

SEQ ID NO: 772623 - DNA, 14 bp, Homo sapiens
cccctccaggagag

SEQ ID NO: 772624 - DNA, 19 bp, Homo sapiens
cccctccatccccatcggc

SEQ ID NO: 772625 - DNA, 15 bp, Homo sapiens
cccctcccacggtgc

SEQ ID NO: 772626 - DNA, 19 bp, Homo sapiens
cccctcccagacaggccct

SEQ ID NO: 772627 - DNA, 21 bp, Homo sapiens
cccctcccagacaggccctcc

SEQ ID NO: 772628 - DNA, 21 bp, Homo sapiens
cccctcccaggggagccagct

SEQ ID NO: 772629 - DNA, 22 bp, Homo sapiens
cccctcccaggggagccagctg

SEQ ID NO: 772630 - DNA, 23 bp, Homo sapiens
cccctcccaggggagccagctgc

SEQ ID NO: 772631 - DNA, 11 bp, Homo sapiens
cccctcccatc

SEQ ID NO: 772632 - DNA, 11 bp, Homo sapiens
cccctcccatt

SEQ ID NO: 772633 - DNA, 18 bp, Homo sapiens
cccctccccagccagccc

SEQ ID NO: 772634 - DNA, 16 bp, Homo sapiens
cccctccccagcccaa

SEQ ID NO: 772635 - DNA, 13 bp, Homo sapiens
cccctccccatgc

SEQ ID NO: 772636 - DNA, 14 bp, Homo sapiens
cccctcccccagcc

SEQ ID NO: 772637 - DNA, 17 bp, Homo sapiens
cccctcccctcagagcc

SEQ ID NO: 772638 - DNA, 13 bp, Homo sapiens
cccctccctaccc

SEQ ID NO: 772639 - DNA, 14 bp, Homo sapiens
cccctccctcccac

SEQ ID NO: 772640 - DNA, 14 bp, Homo sapiens
cccctccctcttcc

SEQ ID NO: 772641 - DNA, 20 bp, Homo sapiens
cccctccctcttccttcccc

SEQ ID NO: 772642 - DNA, 14 bp, Homo sapiens
cccctccctgccca

SEQ ID NO: 772643 - DNA, 16 bp, Homo sapiens
cccctccctgcccaaa

SEQ ID NO: 772644 - DNA, 15 bp, Homo sapiens
cccctccctgcctgc

SEQ ID NO: 772645 - DNA, 12 bp, Homo sapiens
cccctccctggc

SEQ ID NO: 772646 - DNA, 17 bp, Homo sapiens
cccctccctggcctgtt

SEQ ID NO: 772647 - DNA, 13 bp, Homo sapiens
cccctccctgggt

SEQ ID NO: 772648 - DNA, 13 bp, Homo sapiens
cccctccctgtca

SEQ ID NO: 772649 - DNA, 19 bp, Homo sapiens
cccctccctgtcccagggc

SEQ ID NO: 772650 - DNA, 17 bp, Homo sapiens
cccctccgccctgccac

SEQ ID NO: 772651 - DNA, 18 bp, Homo sapiens
cccctccgccctgccact

SEQ ID NO: 772652 - DNA, 19 bp, Homo sapiens
cccctccgccctgccactc

SEQ ID NO: 772653 - DNA, 13 bp, Homo sapiens
cccctcctagcac

SEQ ID NO: 772654 - DNA, 12 bp, Homo sapiens
cccctcctccag

SEQ ID NO: 772655 - DNA, 22 bp, Homo sapiens
cccctcctcccagggcctcctg

SEQ ID NO: 772656 - DNA, 15 bp, Homo sapiens
cccctcctccccctt

SEQ ID NO: 772657 - DNA, 16 bp, Homo sapiens
cccctcctgctgggcg

SEQ ID NO: 772658 - DNA, 11 bp, Homo sapiens
cccctcctggc

SEQ ID NO: 772659 - DNA, 12 bp, Homo sapiens
cccctcctggca

SEQ ID NO: 772660 - DNA, 18 bp, Homo sapiens
cccctcctggcaatcaat

SEQ ID NO: 772661 - DNA, 13 bp, Homo sapiens
cccctccttgcaa

SEQ ID NO: 772662 - DNA, 13 bp, Homo sapiens
cccctccttgggc

SEQ ID NO: 772663 - DNA, 15 bp, Homo sapiens
cccctccttgggcac

SEQ ID NO: 772664 - DNA, 19 bp, Homo sapiens
cccctcgaggcctacagag

SEQ ID NO: 772665 - DNA, 22 bp, Homo sapiens
cccctcgcaaccctgcctgtca

SEQ ID NO: 772666 - DNA, 20 bp, Homo sapiens
cccctcgcacacagggctca

SEQ ID NO: 772667 - DNA, 14 bp, Homo sapiens
cccctcgccagctt

SEQ ID NO: 772668 - DNA, 18 bp, Homo sapiens
cccctcgccagcttggct

SEQ ID NO: 772669 - DNA, 18 bp, Homo sapiens
cccctcgctgctgctact

SEQ ID NO: 772670 - DNA, 14 bp, Homo sapiens
cccctcggagcctg

SEQ ID NO: 772671 - DNA, 23 bp, Homo sapiens
cccctcgtgtcagctcaggcagc

SEQ ID NO: 772672 - DNA, 19 bp, Homo sapiens
cccctcgtgtgactctctt

SEQ ID NO: 772673 - DNA, 16 bp, Homo sapiens
cccctctcacgccacc

SEQ ID NO: 772674 - DNA, 17 bp, Homo sapiens
cccctctcacgccaccc

SEQ ID NO: 772675 - DNA, 13 bp, Homo sapiens
cccctctcagaac

SEQ ID NO: 772676 - DNA, 20 bp, Homo sapiens
cccctctccaggcgccggcg

SEQ ID NO: 772677 - DNA, 17 bp, Homo sapiens
cccctctccccttggtt

SEQ ID NO: 772678 - DNA, 16 bp, Homo sapiens
cccctctcccttccct

SEQ ID NO: 772679 - DNA, 11 bp, Homo sapiens
cccctctcctc

SEQ ID NO: 772680 - DNA, 15 bp, Homo sapiens
cccctctcctcccag

SEQ ID NO: 772681 - DNA, 20 bp, Homo sapiens
cccctgtgctcccctgccac

SEQ ID NO: 772682 - DNA, 19 bp, Homo sapiens
cccctgtgctccgtgcctc

SEQ ID NO: 772683 - DNA, 19 bp, Homo sapiens
cccctgtggccaactgcaa

SEQ ID NO: 772684 - DNA, 20 bp, Homo sapiens
cccctgtggccaactgcaaa

SEQ ID NO: 772685 - DNA, 17 bp, Homo sapiens
cccctgtggccctggcc

SEQ ID NO: 772686 - DNA, 18 bp, Homo sapiens
cccctgtggccctggcca

SEQ ID NO: 772687 - DNA, 12 bp, Homo sapiens
cccctgtgggga

SEQ ID NO: 772688 - DNA, 21 bp, Homo sapiens
cccctgtggggatctcagggg

SEQ ID NO: 772689 - DNA, 19 bp, Homo sapiens
cccctgtgtattcaccacc

SEQ ID NO: 772690 - DNA, 16 bp, Homo sapiens
cccctgttcccctctc

SEQ ID NO: 772691 - DNA, 13 bp, Homo sapiens
cccctgttgaggt

SEQ ID NO: 772692 - DNA, 22 bp, Homo sapiens
ccccttaatcttgctttcttta

SEQ ID NO: 772693 - DNA, 20 bp, Homo sapiens
ccccttagccagttgtatat

SEQ ID NO: 772694 - DNA, 22 bp, Homo sapiens
atgcagacatctctggagccag

SEQ ID NO: 772695 - DNA, 19 bp, Homo sapiens
atgcagacctcatgcccag

SEQ ID NO: 772696 - DNA, 21 bp, Homo sapiens
atgcagacctcatgcccagct

SEQ ID NO: 772697 - DNA, 15 bp, Homo sapiens
atgcagaggcctggg

SEQ ID NO: 772698 - DNA, 18 bp, Homo sapiens
atgcagaggcctggggga

SEQ ID NO: 772699 - DNA, 23 bp, Homo sapiens
atgcagaggtaaaagtgtgagca

SEQ ID NO: 772700 - DNA, 17 bp, Homo sapiens
atgcagaggtccacaac

SEQ ID NO: 772701 - DNA, 17 bp, Homo sapiens
atgcagaggtctccaaa

SEQ ID NO: 772702 - DNA, 16 bp, Homo sapiens
atgcagattacactga

SEQ ID NO: 772703 - DNA, 17 bp, Homo sapiens
atgcagattacactgat

SEQ ID NO: 772704 - DNA, 21 bp, Homo sapiens
atgcagattcctgggcctgtc

SEQ ID NO: 772705 - DNA, 22 bp, Homo sapiens
atgcagattcctgggcctgtcc

SEQ ID NO: 772706 - DNA, 20 bp, Homo sapiens
atgcagccacgattggagaa

SEQ ID NO: 772707 - DNA, 16 bp, Homo sapiens
atgcagcccaccagga

SEQ ID NO: 772708 - DNA, 23 bp, Homo sapiens
atgcagcccaccaggagcacctg

SEQ ID NO: 772709 - DNA, 18 bp, Homo sapiens
atgcagcccctgggccct

SEQ ID NO: 772710 - DNA, 21 bp, Homo sapiens
atgcagcctaaggctgtatga

SEQ ID NO: 772711 - DNA, 20 bp, Homo sapiens
atgcagcgccgtgtcctctc

SEQ ID NO: 772712 - DNA, 16 bp, Homo sapiens
atgcagctactggaat

SEQ ID NO: 772713 - DNA, 16 bp, Homo sapiens
atgcagctgcctgggg

SEQ ID NO: 772714 - DNA, 18 bp, Homo sapiens
atgcagctgcctggggcc

SEQ ID NO: 772715 - DNA, 19 bp, Homo sapiens
atgcagctgcctggggccc

SEQ ID NO: 772716 - DNA, 15 bp, Homo sapiens
atgcagctgttgaga

SEQ ID NO: 772717 - DNA, 16 bp, Homo sapiens
atgcaggaagaggccc

SEQ ID NO: 772718 - DNA, 19 bp, Homo sapiens
atgcaggaggctcaggtga

SEQ ID NO: 772719 - DNA, 20 bp, Homo sapiens
atgcaggaggtggagaaaat

SEQ ID NO: 772720 - DNA, 22 bp, Homo sapiens
atgcaggaggtggagaaaattg

SEQ ID NO: 772721 - DNA, 22 bp, Homo sapiens
atgcaggccctttgaagcctca

SEQ ID NO: 772722 - DNA, 23 bp, Homo sapiens
atgcagggaagagggcagtacct

SEQ ID NO: 772723 - DNA, 15 bp, Homo sapiens
atgcagggaggccac

SEQ ID NO: 772724 - DNA, 15 bp, Homo sapiens
atgcagggcagtcat

SEQ ID NO: 772725 - DNA, 17 bp, Homo sapiens
atgcagggggctcctgg

SEQ ID NO: 772726 - DNA, 17 bp, Homo sapiens
atgcaggtgaacttttt

SEQ ID NO: 772727 - DNA, 19 bp, Homo sapiens
atgcagtacaggacatata

SEQ ID NO: 772728 - DNA, 16 bp, Homo sapiens
atgcagtatctcttac

SEQ ID NO: 772729 - DNA, 17 bp, Homo sapiens
atgcagtcagtgtttct

SEQ ID NO: 772730 - DNA, 21 bp, Homo sapiens
atgcagtcagtgtttctttta

SEQ ID NO: 772731 - DNA, 20 bp, Homo sapiens
atgcagtcctcatctccagc

SEQ ID NO: 772732 - DNA, 11 bp, Homo sapiens
atgcagtcctg

SEQ ID NO: 772733 - DNA, 16 bp, Homo sapiens
atgcagtgaattgtga

SEQ ID NO: 772734 - DNA, 13 bp, Homo sapiens
atgcagtgcttcc

SEQ ID NO: 772735 - DNA, 18 bp, Homo sapiens
atgcagttcattattttg

SEQ ID NO: 772736 - DNA, 14 bp, Homo sapiens
atgcagttcctggc

SEQ ID NO: 772737 - DNA, 15 bp, Homo sapiens
atgcatacaataaaa

SEQ ID NO: 772738 - DNA, 21 bp, Homo sapiens
atgcatacaataaaagagctt

SEQ ID NO: 772739 - DNA, 16 bp, Homo sapiens
atgcataggattccaa

SEQ ID NO: 772740 - DNA, 18 bp, Homo sapiens
atgcatataatgaataaa

SEQ ID NO: 772741 - DNA, 19 bp, Homo sapiens
atgcatataatgaataaat

SEQ ID NO: 772742 - DNA, 17 bp, Homo sapiens
atgcatatcctgagcca

SEQ ID NO: 772743 - DNA, 14 bp, Homo sapiens
atgcatatttgcca

SEQ ID NO: 772744 - DNA, 12 bp, Homo sapiens
atgcatatttgt

SEQ ID NO: 772745 - DNA, 18 bp, Homo sapiens
atgcatcgggaaagaaga

SEQ ID NO: 772746 - DNA, 19 bp, Homo sapiens
atgcatcgggaaagaagaa

SEQ ID NO: 772747 - DNA, 23 bp, Homo sapiens
atgcatcgggaaagaagaaactc

SEQ ID NO: 772748 - DNA, 13 bp, Homo sapiens
atgcatctgagaa

SEQ ID NO: 772749 - DNA, 14 bp, Homo sapiens
atgcatcttactga

SEQ ID NO: 772750 - DNA, 16 bp, Homo sapiens
atgcatgaagtaatat

SEQ ID NO: 772751 - DNA, 15 bp, Homo sapiens
atgcatgatgccctc

SEQ ID NO: 772752 - DNA, 13 bp, Homo sapiens
atgcatgccaggc

SEQ ID NO: 772753 - DNA, 17 bp, Homo sapiens
atgcatgccaggctggg

SEQ ID NO: 772754 - DNA, 19 bp, Homo sapiens
atgcatgggaggaattcat

SEQ ID NO: 772755 - DNA, 14 bp, Homo sapiens
atgcatgtcttaaa

SEQ ID NO: 772756 - DNA, 18 bp, Homo sapiens
atgcatgtcttaaatgct

SEQ ID NO: 772757 - DNA, 16 bp, Homo sapiens
atgcatgtgaagaaag

SEQ ID NO: 772758 - DNA, 16 bp, Homo sapiens
atgcatgtgctgtctc

SEQ ID NO: 772759 - DNA, 15 bp, Homo sapiens
atgcattaaaagaaa

SEQ ID NO: 772760 - DNA, 16 bp, Homo sapiens
atgcattaaaagaaaa

SEQ ID NO: 772761 - DNA, 23 bp, Homo sapiens
atgcattcacatttagaaaagtg

SEQ ID NO: 772762 - DNA, 17 bp, Homo sapiens
atgcattccagaacaaa

SEQ ID NO: 772763 - DNA, 21 bp, Homo sapiens
atgcattccagaacaaattgt

SEQ ID NO: 772764 - DNA, 19 bp, Homo sapiens
atgcattccctgaatctgt

SEQ ID NO: 772765 - DNA, 14 bp, Homo sapiens
atgcattcttctct

SEQ ID NO: 772766 - DNA, 15 bp, Homo sapiens
atgcattgaaagaat

SEQ ID NO: 772767 - DNA, 16 bp, Homo sapiens
atgcattgaaagaatt

SEQ ID NO: 772768 - DNA, 15 bp, Homo sapiens
atgcattgctctgga

SEQ ID NO: 772769 - DNA, 16 bp, Homo sapiens
atgcattgtcttgtgg

SEQ ID NO: 772770 - DNA, 15 bp, Homo sapiens
atgcattgttgaggt

SEQ ID NO: 772771 - DNA, 16 bp, Homo sapiens
atgcattgttgaggtg

SEQ ID NO: 772772 - DNA, 15 bp, Homo sapiens
atgcatttaataaag

SEQ ID NO: 772773 - DNA, 16 bp, Homo sapiens
atgcatttaataaaga

SEQ ID NO: 772774 - DNA, 21 bp, Homo sapiens
atgcatttaataaagatgagt

SEQ ID NO: 772775 - DNA, 13 bp, Homo sapiens
atgcatttcattc

SEQ ID NO: 772776 - DNA, 12 bp, Homo sapiens
atgcatttctgt

SEQ ID NO: 772777 - DNA, 14 bp, Homo sapiens
atgcattttcttca

SEQ ID NO: 772778 - DNA, 18 bp, Homo sapiens
atgcattttcttcacagt

SEQ ID NO: 772779 - DNA, 15 bp, Homo sapiens
atgcattttcttcag

SEQ ID NO: 772780 - DNA, 13 bp, Homo sapiens
atgcattttgcag

SEQ ID NO: 772781 - DNA, 18 bp, Homo sapiens
atgccaaaaaaaaataca

SEQ ID NO: 772782 - DNA, 23 bp, Homo sapiens
atgccaaagatcacttgttgttt

SEQ ID NO: 772783 - DNA, 19 bp, Homo sapiens
atgccaaagatgtttgaaa

SEQ ID NO: 772784 - DNA, 21 bp, Homo sapiens
atgccaaatgttaactgccaa

SEQ ID NO: 772785 - DNA, 13 bp, Homo sapiens
atgccaacttccc

SEQ ID NO: 772786 - DNA, 16 bp, Homo sapiens
atgccaacttcccaca

SEQ ID NO: 772787 - DNA, 20 bp, Homo sapiens
atgccaagggggtgactgga

SEQ ID NO: 772788 - DNA, 23 bp, Homo sapiens
atgccaagtggacttggagctgc

SEQ ID NO: 772789 - DNA, 17 bp, Homo sapiens
atgccaatattaaatct

SEQ ID NO: 772790 - DNA, 14 bp, Homo sapiens
atgccaatttcctc

SEQ ID NO: 772791 - DNA, 15 bp, Homo sapiens
atgccaatttcctct

SEQ ID NO: 772792 - DNA, 16 bp, Homo sapiens
atgccacacagagtgg

SEQ ID NO: 772793 - DNA, 19 bp, Homo sapiens
atgccaccaacttacaaaa

SEQ ID NO: 772794 - DNA, 14 bp, Homo sapiens
atgccaccctcaca

SEQ ID NO: 772795 - DNA, 15 bp, Homo sapiens
atgccaccctcacac

SEQ ID NO: 772796 - DNA, 17 bp, Homo sapiens
atgccaccctcacacac

SEQ ID NO: 772797 - DNA, 19 bp, Homo sapiens
atgccaccctgttttcagc

SEQ ID NO: 772798 - DNA, 21 bp, Homo sapiens
atgccacgttccacagttgcc

SEQ ID NO: 772799 - DNA, 12 bp, Homo sapiens
atgccactccct

SEQ ID NO: 772800 - DNA, 14 bp, Homo sapiens
atgccactccctac

SEQ ID NO: 772801 - DNA, 18 bp, Homo sapiens
atgccactcctccctccg

SEQ ID NO: 772802 - DNA, 15 bp, Homo sapiens
atgccactgccaggc

SEQ ID NO: 772803 - DNA, 21 bp, Homo sapiens
atgccttgattagacctaatt

SEQ ID NO: 772804 - DNA, 23 bp, Homo sapiens
atgccttgtataaaatccaaaat

SEQ ID NO: 772805 - DNA, 22 bp, Homo sapiens
atgcctttctagtcctattcta

SEQ ID NO: 772806 - DNA, 17 bp, Homo sapiens
atgcctttgctgtttag

SEQ ID NO: 772807 - DNA, 15 bp, Homo sapiens
atgcctttgtaagtt

SEQ ID NO: 772808 - DNA, 21 bp, Homo sapiens
atgccttttcccaaaatgttg

SEQ ID NO: 772809 - DNA, 19 bp, Homo sapiens
atgcgaaccacccaaaaca

SEQ ID NO: 772810 - DNA, 14 bp, Homo sapiens
atgcgagactctga

SEQ ID NO: 772811 - DNA, 21 bp, Homo sapiens
atgcgattcagttcaccgcta

SEQ ID NO: 772812 - DNA, 15 bp, Homo sapiens
atgcgcagatgaggg

SEQ ID NO: 772813 - DNA, 18 bp, Homo sapiens
atgcgcagatgaggggcc

SEQ ID NO: 772814 - DNA, 17 bp, Homo sapiens
atgcgctttattgccca

SEQ ID NO: 772815 - DNA, 20 bp, Homo sapiens
atgcggagccagcaggcctc

SEQ ID NO: 772816 - DNA, 18 bp, Homo sapiens
atgcggctttctctgcct

SEQ ID NO: 772817 - DNA, 22 bp, Homo sapiens
atgcggctttctctgcctctgg

SEQ ID NO: 772818 - DNA, 14 bp, Homo sapiens
atgcggggacaggc

SEQ ID NO: 772819 - DNA, 20 bp, Homo sapiens
atgcggtagccagcacacag

SEQ ID NO: 772820 - DNA, 15 bp, Homo sapiens
atgcggtgggtgctg

SEQ ID NO: 772821 - DNA, 14 bp, Homo sapiens
ccccttatccagga

SEQ ID NO: 772822 - DNA, 16 bp, Homo sapiens
ccccttatccaggact

SEQ ID NO: 772823 - DNA, 17 bp, Homo sapiens
ccccttattgctgccaa

SEQ ID NO: 772824 - DNA, 17 bp, Homo sapiens
ccccttcacttctgacc

SEQ ID NO: 772825 - DNA, 19 bp, Homo sapiens
ccccttcacttctgaccac

SEQ ID NO: 772826 - DNA, 14 bp, Homo sapiens
ccccttcagctcct

SEQ ID NO: 772827 - DNA, 15 bp, Homo sapiens
ccccttcagctcctg

SEQ ID NO: 772828 - DNA, 14 bp, Homo sapiens
ccccttccatgtgg

SEQ ID NO: 772829 - DNA, 12 bp, Homo sapiens
ccccttcccacg

SEQ ID NO: 772830 - DNA, 13 bp, Homo sapiens
ccccttccccact

SEQ ID NO: 772831 - DNA, 23 bp, Homo sapiens
ccccttccccactgcctgcccac

SEQ ID NO: 772832 - DNA, 16 bp, Homo sapiens
ccccttccccagccct

SEQ ID NO: 772833 - DNA, 12 bp, Homo sapiens
ccccttccccct

SEQ ID NO: 772834 - DNA, 14 bp, Homo sapiens
ccccttccccgtcc

SEQ ID NO: 772835 - DNA, 13 bp, Homo sapiens
ccccttcccctgc

SEQ ID NO: 772836 - DNA, 18 bp, Homo sapiens
ccccttccctgcaaacat

SEQ ID NO: 772837 - DNA, 13 bp, Homo sapiens
ccccttcccttgg

SEQ ID NO: 772838 - DNA, 22 bp, Homo sapiens
ccccttcctaattccacagctg

SEQ ID NO: 772839 - DNA, 10 bp, Homo sapiens
ccccttcctg

SEQ ID NO: 772840 - DNA, 14 bp, Homo sapiens
ccccttcctgtcct

SEQ ID NO: 772841 - DNA, 16 bp, Homo sapiens
ccccttcctgtcctgc

SEQ ID NO: 772842 - DNA, 18 bp, Homo sapiens
ccccttcctgtcctgcct

SEQ ID NO: 772843 - DNA, 13 bp, Homo sapiens
ccccttcctttcc

SEQ ID NO: 772844 - DNA, 14 bp, Homo sapiens
ccccttcctttcct

SEQ ID NO: 772845 - DNA, 15 bp, Homo sapiens
ccccttcctttcctc

SEQ ID NO: 772846 - DNA, 19 bp, Homo sapiens
ccccttcgacatgctgcca

SEQ ID NO: 772847 - DNA, 14 bp, Homo sapiens
ccccttcgctcctc

SEQ ID NO: 772848 - DNA, 16 bp, Homo sapiens
ccccttctcagaatct

SEQ ID NO: 772849 - DNA, 12 bp, Homo sapiens
ccccttctccca

SEQ ID NO: 772850 - DNA, 13 bp, Homo sapiens
ccccttctcccac

SEQ ID NO: 772851 - DNA, 16 bp, Homo sapiens
ccccttctcccacact

SEQ ID NO: 772852 - DNA, 17 bp, Homo sapiens
ccccttctccccttcct

SEQ ID NO: 772853 - DNA, 21 bp, Homo sapiens
ccccttctccccttcctggac

SEQ ID NO: 772854 - DNA, 15 bp, Homo sapiens
ccccttctctcctcc

SEQ ID NO: 772855 - DNA, 12 bp, Homo sapiens
ccccttctctgc

SEQ ID NO: 772856 - DNA, 14 bp, Homo sapiens
ccccttctgtgtca

SEQ ID NO: 772857 - DNA, 12 bp, Homo sapiens
ccccttcttccc

SEQ ID NO: 772858 - DNA, 19 bp, Homo sapiens
ccccttcttcccgccccac

SEQ ID NO: 772859 - DNA, 20 bp, Homo sapiens
ccccttcttcctcccctcaa

SEQ ID NO: 772860 - DNA, 13 bp, Homo sapiens
ccccttgcaagcc

SEQ ID NO: 772861 - DNA, 21 bp, Homo sapiens
ccccttgcccagggctcagcc

SEQ ID NO: 772862 - DNA, 16 bp, Homo sapiens
ccccttgcccatcagc

SEQ ID NO: 772863 - DNA, 13 bp, Homo sapiens
ccccttgccctcc

SEQ ID NO: 772864 - DNA, 23 bp, Homo sapiens
ccccttgccctccgcctgggatc

SEQ ID NO: 772865 - DNA, 17 bp, Homo sapiens
ccccttgcccttgccct

SEQ ID NO: 772866 - DNA, 24 bp, Homo sapiens
ccccttgcccttgccctgacctcc

SEQ ID NO: 772867 - DNA, 20 bp, Homo sapiens
ccccttgctgatgctcctcc

SEQ ID NO: 772868 - DNA, 21 bp, Homo sapiens
ccccttggaaatgtctgctgg

SEQ ID NO: 772869 - DNA, 14 bp, Homo sapiens
ccccttggctggat

SEQ ID NO: 772870 - DNA, 16 bp, Homo sapiens
ccccttggttctgcac

SEQ ID NO: 772871 - DNA, 18 bp, Homo sapiens
ccccttggttctgcactg

SEQ ID NO: 772872 - DNA, 17 bp, Homo sapiens
ccccttgtcctgaagcc

SEQ ID NO: 772873 - DNA, 19 bp, Homo sapiens
ccccttgtcctgaagccca

SEQ ID NO: 772874 - DNA, 21 bp, Homo sapiens
ccccttgtcctgaagcccagc

SEQ ID NO: 772875 - DNA, 14 bp, Homo sapiens
ccccttgtcttccc

SEQ ID NO: 772876 - DNA, 15 bp, Homo sapiens
ccccttgtcttcccc

SEQ ID NO: 772877 - DNA, 19 bp, Homo sapiens
ccccttgtcttcccccctc

SEQ ID NO: 772878 - DNA, 22 bp, Homo sapiens
ccccttgtcttcccccctctcc

SEQ ID NO: 772879 - DNA, 20 bp, Homo sapiens
cccctttaccctctttgctg

SEQ ID NO: 772880 - DNA, 13 bp, Homo sapiens
cccctttcccggg

SEQ ID NO: 772881 - DNA, 23 bp, Homo sapiens
cccctttcctccccatacacaca

SEQ ID NO: 772882 - DNA, 22 bp, Homo sapiens
cccctttcctctaactcactgc

SEQ ID NO: 772883 - DNA, 22 bp, Homo sapiens
cccctttcctggacactcagac

SEQ ID NO: 772884 - DNA, 23 bp, Homo sapiens
cccctttcctggacactcagacc

SEQ ID NO: 772885 - DNA, 20 bp, Homo sapiens
cccctttccttcactgcccc

SEQ ID NO: 772886 - DNA, 13 bp, Homo sapiens
cccctttcttctc

SEQ ID NO: 772887 - DNA, 16 bp, Homo sapiens
cccctttgcctctgtc

SEQ ID NO: 772888 - DNA, 20 bp, Homo sapiens
cccctttgcctctgtcctcc

SEQ ID NO: 772889 - DNA, 14 bp, Homo sapiens
cccctttggggtag

SEQ ID NO: 772890 - DNA, 14 bp, Homo sapiens
cccctttgtcctgc

SEQ ID NO: 772891 - DNA, 22 bp, Homo sapiens
cccctttgtcctgcgttttctc

SEQ ID NO: 772892 - DNA, 22 bp, Homo sapiens
ccccttttccagttgctgtgga

SEQ ID NO: 772893 - DNA, 16 bp, Homo sapiens
ccccttttctccccac

SEQ ID NO: 772894 - DNA, 19 bp, Homo sapiens
ccccttttctctgctcttg

SEQ ID NO: 772895 - DNA, 15 bp, Homo sapiens
ccccttttcttttct

SEQ ID NO: 772896 - DNA, 14 bp, Homo sapiens
ccccttttgcctgg

SEQ ID NO: 772897 - DNA, 15 bp, Homo sapiens
ccccttttgcctggc

SEQ ID NO: 772898 - DNA, 19 bp, Homo sapiens
ccccttttgcctggctgtg

SEQ ID NO: 772899 - DNA, 19 bp, Homo sapiens
cccctttttactccccttg

SEQ ID NO: 772900 - DNA, 19 bp, Homo sapiens
cccgaacctcacctgacct

SEQ ID NO: 772901 - DNA, 17 bp, Homo sapiens
cccgaagagtcagcccc

SEQ ID NO: 772902 - DNA, 23 bp, Homo sapiens
cccgaagccatcacttctccccg

SEQ ID NO: 772903 - DNA, 22 bp, Homo sapiens
cccgaagtcctgtcactgagca

SEQ ID NO: 772904 - DNA, 14 bp, Homo sapiens
cccgaagtgtaggg

SEQ ID NO: 772905 - DNA, 19 bp, Homo sapiens
cccgacactgctgcaccag

SEQ ID NO: 772906 - DNA, 13 bp, Homo sapiens
cccgacagcccat

SEQ ID NO: 772907 - DNA, 19 bp, Homo sapiens
cccgacaggtgggcctggg

SEQ ID NO: 772908 - DNA, 14 bp, Homo sapiens
cccgacagtggctc

SEQ ID NO: 772909 - DNA, 17 bp, Homo sapiens
cccgaccaatccccagc

SEQ ID NO: 772910 - DNA, 15 bp, Homo sapiens
cccgacccagccagc

SEQ ID NO: 772911 - DNA, 17 bp, Homo sapiens
cccgacccagccagctg

SEQ ID NO: 772912 - DNA, 14 bp, Homo sapiens
cccgacggctgtga

SEQ ID NO: 772913 - DNA, 17 bp, Homo sapiens
cccgactccagccagcg

SEQ ID NO: 772914 - DNA, 14 bp, Homo sapiens
cccgactccaggct

SEQ ID NO: 772915 - DNA, 16 bp, Homo sapiens
cccgacttcctgactc

SEQ ID NO: 772916 - DNA, 18 bp, Homo sapiens
cccgagaaatttgtcttt

SEQ ID NO: 772917 - DNA, 12 bp, Homo sapiens
cccgagcacata

SEQ ID NO: 772918 - DNA, 18 bp, Homo sapiens
cccgagccctgactcctg

SEQ ID NO: 772919 - DNA, 20 bp, Homo sapiens
cccgagccctgactcctgga

SEQ ID NO: 772920 - DNA, 22 bp, Homo sapiens
cccgagctactctcttgccagc

SEQ ID NO: 772921 - DNA, 14 bp, Homo sapiens
cccgagctcctctt

SEQ ID NO: 772922 - DNA, 11 bp, Homo sapiens
cccgagctggg

SEQ ID NO: 772923 - DNA, 14 bp, Homo sapiens
cccgagctggtgca

SEQ ID NO: 772924 - DNA, 15 bp, Homo sapiens
cccgaggagctgggc

SEQ ID NO: 772925 - DNA, 19 bp, Homo sapiens
cccgaggagctgggcccct

SEQ ID NO: 772926 - DNA, 21 bp, Homo sapiens
cccgcttagttcttgaattgt

SEQ ID NO: 772927 - DNA, 22 bp, Homo sapiens
cccgcttattctcctccctgtt

SEQ ID NO: 772928 - DNA, 18 bp, Homo sapiens
cccgcttgtccagcgcct

SEQ ID NO: 772929 - DNA, 20 bp, Homo sapiens
cccgctttcttgctggttgt

SEQ ID NO: 772930 - DNA, 19 bp, Homo sapiens
cccgcttttgcagcagagg

SEQ ID NO: 772931 - DNA, 20 bp, Homo sapiens
cccgcttttgcagcagagga

SEQ ID NO: 772932 - DNA, 13 bp, Homo sapiens
cccggacctacct

SEQ ID NO: 772933 - DNA, 14 bp, Homo sapiens
cccggacctacctc

SEQ ID NO: 772934 - DNA, 19 bp, Homo sapiens
cccggagattggacggcct

SEQ ID NO: 772935 - DNA, 13 bp, Homo sapiens
cccggagcacagc

SEQ ID NO: 772936 - DNA, 12 bp, Homo sapiens
cccggagcagca

SEQ ID NO: 772937 - DNA, 19 bp, Homo sapiens
cccggagccatcaccctca

SEQ ID NO: 772938 - DNA, 22 bp, Homo sapiens
cccggagctaagtcacccagag

SEQ ID NO: 772939 - DNA, 14 bp, Homo sapiens
cccggaggaaatct

SEQ ID NO: 772940 - DNA, 22 bp, Homo sapiens
cccggaggaaatctgcagaggg

SEQ ID NO: 772941 - DNA, 17 bp, Homo sapiens
cccggaggagctgggcc

SEQ ID NO: 772942 - DNA, 14 bp, Homo sapiens
cccggatcagagca

SEQ ID NO: 772943 - DNA, 15 bp, Homo sapiens
cccggatcagagcag

SEQ ID NO: 772944 - DNA, 16 bp, Homo sapiens
cccggatcagagcagg

SEQ ID NO: 772945 - DNA, 18 bp, Homo sapiens
cccggatgtgtgtctcac

SEQ ID NO: 772946 - DNA, 13 bp, Homo sapiens
cccggcactccag

SEQ ID NO: 772947 - DNA, 14 bp, Homo sapiens
cccggcagggcggg

SEQ ID NO: 772948 - DNA, 21 bp, Homo sapiens
cccggccaagtaaaatgtttt

SEQ ID NO: 772949 - DNA, 18 bp, Homo sapiens
cccggccacacccagcgg

SEQ ID NO: 772950 - DNA, 16 bp, Homo sapiens
cccggccacagctgct

SEQ ID NO: 772951 - DNA, 19 bp, Homo sapiens
cccggccacagctgctgga

SEQ ID NO: 772952 - DNA, 21 bp, Homo sapiens
cccggccacagctgctggaga

SEQ ID NO: 772953 - DNA, 21 bp, Homo sapiens
atgctgtacttgtggttctct

SEQ ID NO: 772954 - DNA, 12 bp, Homo sapiens
atgctgtatttc

SEQ ID NO: 772955 - DNA, 13 bp, Homo sapiens
atgctgtatttct

SEQ ID NO: 772956 - DNA, 19 bp, Homo sapiens
atgctgtccctatacacta

SEQ ID NO: 772957 - DNA, 16 bp, Homo sapiens
atgctgtccctgcact

SEQ ID NO: 772958 - DNA, 16 bp, Homo sapiens
atgctgtctggccctg

SEQ ID NO: 772959 - DNA, 17 bp, Homo sapiens
atgctgtctggccctgg

SEQ ID NO: 772960 - DNA, 13 bp, Homo sapiens
atgctgtctttgt

SEQ ID NO: 772961 - DNA, 14 bp, Homo sapiens
atgctgtctttgtg

SEQ ID NO: 772962 - DNA, 23 bp, Homo sapiens
atgctgtgacacatggcccctcc

SEQ ID NO: 772963 - DNA, 17 bp, Homo sapiens
atgctgtgctatgaatt

SEQ ID NO: 772964 - DNA, 18 bp, Homo sapiens
atgctgtgctctttgaag

SEQ ID NO: 772965 - DNA, 21 bp, Homo sapiens
atgctgtggcatgggtgaaga

SEQ ID NO: 772966 - DNA, 19 bp, Homo sapiens
atgctgtgggggactggct

SEQ ID NO: 772967 - DNA, 15 bp, Homo sapiens
atgctgtgtgcccaa

SEQ ID NO: 772968 - DNA, 14 bp, Homo sapiens
atgctgttgcctca

SEQ ID NO: 772969 - DNA, 16 bp, Homo sapiens
atgctgttgcctcatc

SEQ ID NO: 772970 - DNA, 18 bp, Homo sapiens
atgctgttgcctcatcta

SEQ ID NO: 772971 - DNA, 16 bp, Homo sapiens
atgctgtttatgaatt

SEQ ID NO: 772972 - DNA, 20 bp, Homo sapiens
atgctgtttctaagaaaatg

SEQ ID NO: 772973 - DNA, 21 bp, Homo sapiens
atgcttaaaaaaaaaaaattt

SEQ ID NO: 772974 - DNA, 17 bp, Homo sapiens
atgcttaaaataagcag

SEQ ID NO: 772975 - DNA, 20 bp, Homo sapiens
atgcttaaaatatgtatgtc

SEQ ID NO: 772976 - DNA, 14 bp, Homo sapiens
atgcttaaatttta

SEQ ID NO: 772977 - DNA, 20 bp, Homo sapiens
atgcttaataaaagaacatg

SEQ ID NO: 772978 - DNA, 21 bp, Homo sapiens
atgcttaataaacatgtcaca

SEQ ID NO: 772979 - DNA, 13 bp, Homo sapiens
atgcttactgata

SEQ ID NO: 772980 - DNA, 23 bp, Homo sapiens
atgcttactgatatattttacaa

SEQ ID NO: 772981 - DNA, 15 bp, Homo sapiens
atgcttactttttaa

SEQ ID NO: 772982 - DNA, 15 bp, Homo sapiens
atgcttagagcatgt

SEQ ID NO: 772983 - DNA, 11 bp, Homo sapiens
atgcttagctt

SEQ ID NO: 772984 - DNA, 15 bp, Homo sapiens
atgcttagtccctca

SEQ ID NO: 772985 - DNA, 21 bp, Homo sapiens
atgcttagtccctcatgcaaa

SEQ ID NO: 772986 - DNA, 16 bp, Homo sapiens
atgcttcaagtgttgc

SEQ ID NO: 772987 - DNA, 19 bp, Homo sapiens
atgcttcatcattccctct

SEQ ID NO: 772988 - DNA, 20 bp, Homo sapiens
atgcttcattattcaagaat

SEQ ID NO: 772989 - DNA, 17 bp, Homo sapiens
atgcttcattcaatatt

SEQ ID NO: 772990 - DNA, 21 bp, Homo sapiens
atgcttcattcaatattgaca

SEQ ID NO: 772991 - DNA, 16 bp, Homo sapiens
atgcttcatttgtatg

SEQ ID NO: 772992 - DNA, 21 bp, Homo sapiens
atgcttcatttgtatgtcaaa

SEQ ID NO: 772993 - DNA, 15 bp, Homo sapiens
atgcttcctgacaat

SEQ ID NO: 772994 - DNA, 22 bp, Homo sapiens
atgcttcctgacaatcaactct

SEQ ID NO: 772995 - DNA, 20 bp, Homo sapiens
atgcttcctttctctcctgg

SEQ ID NO: 772996 - DNA, 19 bp, Homo sapiens
atgcttctaagtaaataca

SEQ ID NO: 772997 - DNA, 20 bp, Homo sapiens
atgcttctaagtaaatacaa

SEQ ID NO: 772998 - DNA, 21 bp, Homo sapiens
atgcttctaagtaaatacaat

SEQ ID NO: 772999 - DNA, 17 bp, Homo sapiens
atgcttctctccttgcc

SEQ ID NO: 773000 - DNA, 15 bp, Homo sapiens
atgcttcttccttac

SEQ ID NO: 773001 - DNA, 17 bp, Homo sapiens
atgcttgacatacctac

SEQ ID NO: 773002 - DNA, 12 bp, Homo sapiens
atgcttgagcaa

SEQ ID NO: 773003 - DNA, 20 bp, Homo sapiens
atgcttgcctagggcctggt

SEQ ID NO: 773004 - DNA, 20 bp, Homo sapiens
atgcttgcggcaaaaggaaa

SEQ ID NO: 773005 - DNA, 22 bp, Homo sapiens
atgcttgggctgacccagcatc

SEQ ID NO: 773006 - DNA, 17 bp, Homo sapiens
atgcttgtaacaagaaa

SEQ ID NO: 773007 - DNA, 18 bp, Homo sapiens
atgcttgtaacaagaaaa

SEQ ID NO: 773008 - DNA, 15 bp, Homo sapiens
atgcttgtacataat

SEQ ID NO: 773009 - DNA, 13 bp, Homo sapiens
atgcttgtgtata

SEQ ID NO: 773010 - DNA, 14 bp, Homo sapiens
atgctttatttgta

SEQ ID NO: 773011 - DNA, 15 bp, Homo sapiens
atgctttatttgtaa

SEQ ID NO: 773012 - DNA, 16 bp, Homo sapiens
atgctttatttgtaaa

SEQ ID NO: 773013 - DNA, 15 bp, Homo sapiens
atgctttccaaaacc

SEQ ID NO: 773014 - DNA, 23 bp, Homo sapiens
atgctttgaatgcaaaagaaatt

SEQ ID NO: 773015 - DNA, 15 bp, Homo sapiens
atgctttgggaggcc

SEQ ID NO: 773016 - DNA, 16 bp, Homo sapiens
atgctttgtgtgattg

SEQ ID NO: 773017 - DNA, 22 bp, Homo sapiens
atgcttttaatgaatttaaggc

SEQ ID NO: 773018 - DNA, 20 bp, Homo sapiens
atgcttttagttttaaaagt

SEQ ID NO: 773019 - DNA, 19 bp, Homo sapiens
atgcttttatattctaata

SEQ ID NO: 773020 - DNA, 20 bp, Homo sapiens
atgcttttctgtctctgcct

SEQ ID NO: 773021 - DNA, 15 bp, Homo sapiens
atgcttttgctgctg

SEQ ID NO: 773022 - DNA, 16 bp, Homo sapiens
atgcttttgctgctgc

SEQ ID NO: 773023 - DNA, 18 bp, Homo sapiens
atgcttttggaagttaaa

SEQ ID NO: 773024 - DNA, 22 bp, Homo sapiens
atgctttttattattattattt

SEQ ID NO: 773025 - DNA, 19 bp, Homo sapiens
atgctttttatttctgcat

SEQ ID NO: 773026 - DNA, 23 bp, Homo sapiens
atgctttttatttctgcatatgt

SEQ ID NO: 773027 - DNA, 22 bp, Homo sapiens
atgctttttgaatgttatttgt

SEQ ID NO: 773028 - DNA, 14 bp, Homo sapiens
atggaaaaatcctt

SEQ ID NO: 773029 - DNA, 16 bp, Homo sapiens
atggaaaaattgacaa

SEQ ID NO: 773030 - DNA, 19 bp, Homo sapiens
atggaaaaattgacaaaaa

SEQ ID NO: 773031 - DNA, 17 bp, Homo sapiens
atggaaaacctggggga

SEQ ID NO: 773032 - DNA, 19 bp, Homo sapiens
atggaaaagattgaaaatg

SEQ ID NO: 773033 - DNA, 14 bp, Homo sapiens
atggaaaataaaca

SEQ ID NO: 773034 - DNA, 15 bp, Homo sapiens
atggaaaataaacat

SEQ ID NO: 773035 - DNA, 20 bp, Homo sapiens
atggaaaatgccatgaatta

SEQ ID NO: 773036 - DNA, 20 bp, Homo sapiens
atggaaaattttctccttgg

SEQ ID NO: 773037 - DNA, 21 bp, Homo sapiens
atggaaaattttctccttggt

SEQ ID NO: 773038 - DNA, 23 bp, Homo sapiens
atggaaacattttatactgtaca

SEQ ID NO: 773039 - DNA, 23 bp, Homo sapiens
atggaaacctgaaaaaaagttta

SEQ ID NO: 773040 - DNA, 21 bp, Homo sapiens
atggaaacgcacttacaagtg

SEQ ID NO: 773041 - DNA, 17 bp, Homo sapiens
atggaaagaatctaata

SEQ ID NO: 773042 - DNA, 15 bp, Homo sapiens
atggaaatgtgagaa

SEQ ID NO: 773043 - DNA, 13 bp, Homo sapiens
atggaaatgttta

SEQ ID NO: 773044 - DNA, 15 bp, Homo sapiens
atggaaatttaaagc

SEQ ID NO: 773045 - DNA, 17 bp, Homo sapiens
atggaaatttaaagcag

SEQ ID NO: 773046 - DNA, 16 bp, Homo sapiens
atggaaattttgctat

SEQ ID NO: 773047 - DNA, 18 bp, Homo sapiens
atggatattattagaaat

SEQ ID NO: 773048 - DNA, 16 bp, Homo sapiens
atggatcctggaggat

SEQ ID NO: 773049 - DNA, 12 bp, Homo sapiens
atggatctgatc

SEQ ID NO: 773050 - DNA, 13 bp, Homo sapiens
atggatctgattt

SEQ ID NO: 773051 - DNA, 13 bp, Homo sapiens
atggatgattcag

SEQ ID NO: 773052 - DNA, 21 bp, Homo sapiens
atggatgattcagaaattgga

SEQ ID NO: 773053 - DNA, 16 bp, Homo sapiens
atggatgcatcacact

SEQ ID NO: 773054 - DNA, 13 bp, Homo sapiens
atggatgccaata

SEQ ID NO: 773055 - DNA, 15 bp, Homo sapiens
atggatggcacaatg

SEQ ID NO: 773056 - DNA, 21 bp, Homo sapiens
atggatggcacaatgaatgta

SEQ ID NO: 773057 - DNA, 20 bp, Homo sapiens
atggatgtggggtccccatc

SEQ ID NO: 773058 - DNA, 22 bp, Homo sapiens
atggatgttttagccattgttg

SEQ ID NO: 773059 - DNA, 17 bp, Homo sapiens
atggattaaaaactgct

SEQ ID NO: 773060 - DNA, 15 bp, Homo sapiens
atggattaaactcag

SEQ ID NO: 773061 - DNA, 16 bp, Homo sapiens
atggattaaactcagt

SEQ ID NO: 773062 - DNA, 21 bp, Homo sapiens
atggattatgttgacattttc

SEQ ID NO: 773063 - DNA, 12 bp, Homo sapiens
atggattctaaa

SEQ ID NO: 773064 - DNA, 13 bp, Homo sapiens
atggattctaaaa

SEQ ID NO: 773065 - DNA, 14 bp, Homo sapiens
atggattctcagat

SEQ ID NO: 773066 - DNA, 17 bp, Homo sapiens
atggattctcagatatt

SEQ ID NO: 773067 - DNA, 19 bp, Homo sapiens
atggattctcagatattta

SEQ ID NO: 773068 - DNA, 13 bp, Homo sapiens
atggattgccaca

SEQ ID NO: 773069 - DNA, 14 bp, Homo sapiens
atggattgccacag

SEQ ID NO: 773070 - DNA, 15 bp, Homo sapiens
atggattgccacagc

SEQ ID NO: 773071 - DNA, 21 bp, Homo sapiens
atggattgccacagctcaact

SEQ ID NO: 773072 - DNA, 15 bp, Homo sapiens
atggatttccagcca

SEQ ID NO: 773073 - DNA, 17 bp, Homo sapiens
atggatttctttgaaaa

SEQ ID NO: 773074 - DNA, 15 bp, Homo sapiens
atggatttgaagcaa

SEQ ID NO: 773075 - DNA, 20 bp, Homo sapiens
atggatttgaagtttgccaa

SEQ ID NO: 773076 - DNA, 14 bp, Homo sapiens
atggatttgcctgt

SEQ ID NO: 773077 - DNA, 16 bp, Homo sapiens
atggatttttctttaa

SEQ ID NO: 773078 - DNA, 20 bp, Homo sapiens
atggatttttctttaactgc

SEQ ID NO: 773079 - DNA, 14 bp, Homo sapiens
atggcaaaaaaaaa

SEQ ID NO: 773080 - DNA, 18 bp, Homo sapiens
atggcaaaaaaaaaaaag

SEQ ID NO: 773081 - DNA, 22 bp, Homo sapiens
atggcaaatcaggggccagaga

SEQ ID NO: 773082 - DNA, 23 bp, Homo sapiens
atggcaaatcctgtcggtctcca

SEQ ID NO: 773083 - DNA, 13 bp, Homo sapiens
ccctacagcctag

SEQ ID NO: 773084 - DNA, 21 bp, Homo sapiens
ccctaccagcgcccgctgggc

SEQ ID NO: 773085 - DNA, 15 bp, Homo sapiens
ccctaccagctcctc

SEQ ID NO: 773086 - DNA, 23 bp, Homo sapiens
ccctaccagctcctccagccctg

SEQ ID NO: 773087 - DNA, 16 bp, Homo sapiens
ccctacccaatgtctc

SEQ ID NO: 773088 - DNA, 20 bp, Homo sapiens
ccctacccaatgtctcccac

SEQ ID NO: 773089 - DNA, 14 bp, Homo sapiens
ccctacccatatcc

SEQ ID NO: 773090 - DNA, 19 bp, Homo sapiens
ccctaccccacaccaggcc

SEQ ID NO: 773091 - DNA, 14 bp, Homo sapiens
ccctaccccaccac

SEQ ID NO: 773092 - DNA, 14 bp, Homo sapiens
ccctaccccatgct

SEQ ID NO: 773093 - DNA, 14 bp, Homo sapiens
ccctaccccctcat

SEQ ID NO: 773094 - DNA, 13 bp, Homo sapiens
ccctacccctgcc

SEQ ID NO: 773095 - DNA, 13 bp, Homo sapiens
ccctacctcaggc

SEQ ID NO: 773096 - DNA, 18 bp, Homo sapiens
ccctacctccctcctcag

SEQ ID NO: 773097 - DNA, 22 bp, Homo sapiens
ccctacctccctcctcaggggc

SEQ ID NO: 773098 - DNA, 12 bp, Homo sapiens
ccctacctgctt

SEQ ID NO: 773099 - DNA, 18 bp, Homo sapiens
ccctactccactgccctg

SEQ ID NO: 773100 - DNA, 21 bp, Homo sapiens
ccctactccactgccctggca

SEQ ID NO: 773101 - DNA, 15 bp, Homo sapiens
ccctactccctgcag

SEQ ID NO: 773102 - DNA, 20 bp, Homo sapiens
ccctactgaaccctgcctct

SEQ ID NO: 773103 - DNA, 18 bp, Homo sapiens
ccctacttccaagaaaaa

SEQ ID NO: 773104 - DNA, 19 bp, Homo sapiens
ccctacttcttttgctctt

SEQ ID NO: 773105 - DNA, 13 bp, Homo sapiens
ccctacttgataa

SEQ ID NO: 773106 - DNA, 22 bp, Homo sapiens
ccctacttgataatattagtga

SEQ ID NO: 773107 - DNA, 15 bp, Homo sapiens
ccctactttgcttcc

SEQ ID NO: 773108 - DNA, 14 bp, Homo sapiens
ccctagaaagccat

SEQ ID NO: 773109 - DNA, 20 bp, Homo sapiens
ccctagaaagccatattcca

SEQ ID NO: 773110 - DNA, 15 bp, Homo sapiens
ccctagaagaaaacc

SEQ ID NO: 773111 - DNA, 22 bp, Homo sapiens
ccctagaagaaaacccgaggga

SEQ ID NO: 773112 - DNA, 13 bp, Homo sapiens
ccctagaccctcc

SEQ ID NO: 773113 - DNA, 18 bp, Homo sapiens
ccctagacctccccctca

SEQ ID NO: 773114 - DNA, 13 bp, Homo sapiens
ccctagactgcat

SEQ ID NO: 773115 - DNA, 19 bp, Homo sapiens
ccctagagggttcctgtag

SEQ ID NO: 773116 - DNA, 22 bp, Homo sapiens
ccctagatctttctattccaaa

SEQ ID NO: 773117 - DNA, 17 bp, Homo sapiens
ccctagccagcacttgt

SEQ ID NO: 773118 - DNA, 18 bp, Homo sapiens
ccctagccattcctggta

SEQ ID NO: 773119 - DNA, 19 bp, Homo sapiens
ccctagcccttccagcctg

SEQ ID NO: 773120 - DNA, 14 bp, Homo sapiens
ccctagccttgctt

SEQ ID NO: 773121 - DNA, 17 bp, Homo sapiens
ccctagctttagaccct

SEQ ID NO: 773122 - DNA, 21 bp, Homo sapiens
ccctagctttagaccctgggt

SEQ ID NO: 773123 - DNA, 23 bp, Homo sapiens
ccctagctttatatatggacatg

SEQ ID NO: 773124 - DNA, 23 bp, Homo sapiens
ccctaggataaaaagccagggct

SEQ ID NO: 773125 - DNA, 17 bp, Homo sapiens
ccctagggtgctctgaa

SEQ ID NO: 773126 - DNA, 17 bp, Homo sapiens
ccctaggttcccggtcc

SEQ ID NO: 773127 - DNA, 19 bp, Homo sapiens
ccctaggttccctgttctt

SEQ ID NO: 773128 - DNA, 19 bp, Homo sapiens
ccctagttctacctcaggc

SEQ ID NO: 773129 - DNA, 23 bp, Homo sapiens
ccctatatgtagtataaagaaaa

SEQ ID NO: 773130 - DNA, 17 bp, Homo sapiens
ccctatctaaccctccc

SEQ ID NO: 773131 - DNA, 21 bp, Homo sapiens
ccctatctattaaagtgactt

SEQ ID NO: 773132 - DNA, 20 bp, Homo sapiens
ccctatctcctgacagaagg

SEQ ID NO: 773133 - DNA, 14 bp, Homo sapiens
ccctatctgtattc

SEQ ID NO: 773134 - DNA, 14 bp, Homo sapiens
ccctatctgtgatt

SEQ ID NO: 773135 - DNA, 13 bp, Homo sapiens
ccctatcttgtcc

SEQ ID NO: 773136 - DNA, 19 bp, Homo sapiens
ccctatcttgtcctggaat

SEQ ID NO: 773137 - DNA, 16 bp, Homo sapiens
ccctatggatgtgggg

SEQ ID NO: 773138 - DNA, 18 bp, Homo sapiens
ccctatggggatggtcca

SEQ ID NO: 773139 - DNA, 21 bp, Homo sapiens
ccctattctatccatctcctg

SEQ ID NO: 773140 - DNA, 15 bp, Homo sapiens
ccctatttaaatgaa

SEQ ID NO: 773141 - DNA, 23 bp, Homo sapiens
ccctatttaacagggtctctagt

SEQ ID NO: 773142 - DNA, 20 bp, Homo sapiens
ccctatttagatgataaaga

SEQ ID NO: 773143 - DNA, 17 bp, Homo sapiens
ccctcaaaattgataat

SEQ ID NO: 773144 - DNA, 15 bp, Homo sapiens
ccctcaaaccctgtg

SEQ ID NO: 773145 - DNA, 18 bp, Homo sapiens
ccctcaaactgcacatct

SEQ ID NO: 773146 - DNA, 20 bp, Homo sapiens
ccctcaaatgacccaaagac

SEQ ID NO: 773147 - DNA, 15 bp, Homo sapiens
ccctcaacaccctgc

SEQ ID NO: 773148 - DNA, 20 bp, Homo sapiens
ccctcaagagcaaagtagat

SEQ ID NO: 773149 - DNA, 17 bp, Homo sapiens
ccctcaaggggcaggga

SEQ ID NO: 773150 - DNA, 18 bp, Homo sapiens
ccctcacacacacagctg

SEQ ID NO: 773151 - DNA, 23 bp, Homo sapiens
ccctcacacacacagctgggcaa

SEQ ID NO: 773152 - DNA, 22 bp, Homo sapiens
ccctcacacacacccccccaca

SEQ ID NO: 773153 - DNA, 16 bp, Homo sapiens
ccctcacatcctctcc

SEQ ID NO: 773154 - DNA, 18 bp, Homo sapiens
ccctcacatcctctccag

SEQ ID NO: 773155 - DNA, 12 bp, Homo sapiens
ccctcaccaaca

SEQ ID NO: 773156 - DNA, 9 bp, Homo sapiens
ccctcaccc

SEQ ID NO: 773157 - DNA, 14 bp, Homo sapiens
ccctcaccccagct

SEQ ID NO: 773158 - DNA, 15 bp, Homo sapiens
ccctcaccccagctc

SEQ ID NO: 773159 - DNA, 18 bp, Homo sapiens
ccctcaccccctcctggc

SEQ ID NO: 773160 - DNA, 17 bp, Homo sapiens
ccctcaccctctgtccc

SEQ ID NO: 773161 - DNA, 15 bp, Homo sapiens
ccctcaccctgagcc

SEQ ID NO: 773162 - DNA, 22 bp, Homo sapiens
ccctcaccctgagccccttcct

SEQ ID NO: 773163 - DNA, 13 bp, Homo sapiens
ccctcaccctgcc

SEQ ID NO: 773164 - DNA, 16 bp, Homo sapiens
ccctcacctgggcctt

SEQ ID NO: 773165 - DNA, 21 bp, Homo sapiens
ccctcacctgtagcagccagt

SEQ ID NO: 773166 - DNA, 20 bp, Homo sapiens
ccctcacgtttcttccccaa

SEQ ID NO: 773167 - DNA, 21 bp, Homo sapiens
ccctcactattcttggaccat

SEQ ID NO: 773168 - DNA, 12 bp, Homo sapiens
ccctcactcccc

SEQ ID NO: 773169 - DNA, 21 bp, Homo sapiens
ccctccctgactccctgtggg

SEQ ID NO: 773170 - DNA, 17 bp, Homo sapiens
ccctccctgcctgaggg

SEQ ID NO: 773171 - DNA, 15 bp, Homo sapiens
ccctccctgcctgct

SEQ ID NO: 773172 - DNA, 12 bp, Homo sapiens
ccctccctgggt

SEQ ID NO: 773173 - DNA, 16 bp, Homo sapiens
ccctccctgggttcag

SEQ ID NO: 773174 - DNA, 13 bp, Homo sapiens
ccctccctgtcct

SEQ ID NO: 773175 - DNA, 16 bp, Homo sapiens
ccctccctgtctccag

SEQ ID NO: 773176 - DNA, 14 bp, Homo sapiens
ccctcccttcacag

SEQ ID NO: 773177 - DNA, 16 bp, Homo sapiens
ccctcccttctccctg

SEQ ID NO: 773178 - DNA, 18 bp, Homo sapiens
ccctcccttgctcagtgc

SEQ ID NO: 773179 - DNA, 21 bp, Homo sapiens
ccctcccttggaaacctgccc

SEQ ID NO: 773180 - DNA, 18 bp, Homo sapiens
ccctcccttgtccttgaa

SEQ ID NO: 773181 - DNA, 13 bp, Homo sapiens
ccctccgccctgc

SEQ ID NO: 773182 - DNA, 19 bp, Homo sapiens
ccctccgccctgccactca

SEQ ID NO: 773183 - DNA, 13 bp, Homo sapiens
ccctccgcctcca

SEQ ID NO: 773184 - DNA, 13 bp, Homo sapiens
ccctccgccttct

SEQ ID NO: 773185 - DNA, 18 bp, Homo sapiens
ccctccggaggagcagcc

SEQ ID NO: 773186 - DNA, 22 bp, Homo sapiens
ccctccgggcaggggagccagg

SEQ ID NO: 773187 - DNA, 16 bp, Homo sapiens
ccctccgtgtggagca

SEQ ID NO: 773188 - DNA, 18 bp, Homo sapiens
ccctcctaaatgtcagct

SEQ ID NO: 773189 - DNA, 17 bp, Homo sapiens
ccctcctaccctgcgcc

SEQ ID NO: 773190 - DNA, 21 bp, Homo sapiens
ccctcctatcacctcccctcc

SEQ ID NO: 773191 - DNA, 13 bp, Homo sapiens
ccctcctcacccc

SEQ ID NO: 773192 - DNA, 14 bp, Homo sapiens
ccctcctcaccccg

SEQ ID NO: 773193 - DNA, 12 bp, Homo sapiens
ccctcctcacct

SEQ ID NO: 773194 - DNA, 13 bp, Homo sapiens
ccctcctcacctc

SEQ ID NO: 773195 - DNA, 16 bp, Homo sapiens
ccctcctcacctctgg

SEQ ID NO: 773196 - DNA, 18 bp, Homo sapiens
ccctcctccagcccctgt

SEQ ID NO: 773197 - DNA, 14 bp, Homo sapiens
ccctcctccagtac

SEQ ID NO: 773198 - DNA, 13 bp, Homo sapiens
ccctcctcccagg

SEQ ID NO: 773199 - DNA, 20 bp, Homo sapiens
ccctcctcccatgtcactgc

SEQ ID NO: 773200 - DNA, 19 bp, Homo sapiens
ccctcctccccctttgggg

SEQ ID NO: 773201 - DNA, 23 bp, Homo sapiens
ccctcctccctccaagcctggca

SEQ ID NO: 773202 - DNA, 15 bp, Homo sapiens
ccctcctctagccat

SEQ ID NO: 773203 - DNA, 16 bp, Homo sapiens
ccctcctctagccatc

SEQ ID NO: 773204 - DNA, 18 bp, Homo sapiens
ccctcctctagctgtggg

SEQ ID NO: 773205 - DNA, 16 bp, Homo sapiens
ccctcctctcccatcc

SEQ ID NO: 773206 - DNA, 17 bp, Homo sapiens
ccctcctctgctgggaa

SEQ ID NO: 773207 - DNA, 12 bp, Homo sapiens
ccctcctctggc

SEQ ID NO: 773208 - DNA, 23 bp, Homo sapiens
ccctcctcttcccttagcctctc

SEQ ID NO: 773209 - DNA, 14 bp, Homo sapiens
ccctcctcttccga

SEQ ID NO: 773210 - DNA, 18 bp, Homo sapiens
ccctcctcttccgagctg

SEQ ID NO: 773211 - DNA, 20 bp, Homo sapiens
ccctcctcttccgagctgct

SEQ ID NO: 773212 - DNA, 16 bp, Homo sapiens
ccctcctgacaaatat

SEQ ID NO: 773213 - DNA, 20 bp, Homo sapiens
ccctcctgagggaggacctg

SEQ ID NO: 773214 - DNA, 14 bp, Homo sapiens
atgggaacctcata

SEQ ID NO: 773215 - DNA, 13 bp, Homo sapiens
atgggaacgcagc

SEQ ID NO: 773216 - DNA, 15 bp, Homo sapiens
atgggaaggagggga

SEQ ID NO: 773217 - DNA, 18 bp, Homo sapiens
atgggaatagggagacag

SEQ ID NO: 773218 - DNA, 19 bp, Homo sapiens
atgggaatagggagacagg

SEQ ID NO: 773219 - DNA, 15 bp, Homo sapiens
atgggaatttgtcag

SEQ ID NO: 773220 - DNA, 21 bp, Homo sapiens
atgggaccgtgccccacctcc

SEQ ID NO: 773221 - DNA, 12 bp, Homo sapiens
atgggacctggc

SEQ ID NO: 773222 - DNA, 13 bp, Homo sapiens
atgggacctggcc

SEQ ID NO: 773223 - DNA, 22 bp, Homo sapiens
atgggactcattgtagaaagga

SEQ ID NO: 773224 - DNA, 19 bp, Homo sapiens
atgggagaagtgggggcag

SEQ ID NO: 773225 - DNA, 20 bp, Homo sapiens
atgggagactctttgaaatg

SEQ ID NO: 773226 - DNA, 15 bp, Homo sapiens
atgggagagtagatg

SEQ ID NO: 773227 - DNA, 23 bp, Homo sapiens
atgggagagtagatggtgaaatt

SEQ ID NO: 773228 - DNA, 11 bp, Homo sapiens
atgggagccag

SEQ ID NO: 773229 - DNA, 18 bp, Homo sapiens
atgggagccagaattcac

SEQ ID NO: 773230 - DNA, 19 bp, Homo sapiens
atgggagccagctgctttt

SEQ ID NO: 773231 - DNA, 22 bp, Homo sapiens
atgggagccccagggtcttccc

SEQ ID NO: 773232 - DNA, 20 bp, Homo sapiens
atgggagctggttagaaatg

SEQ ID NO: 773233 - DNA, 23 bp, Homo sapiens
atgggaggagagccactgggccc

SEQ ID NO: 773234 - DNA, 13 bp, Homo sapiens
atgggaggaggaa

SEQ ID NO: 773235 - DNA, 23 bp, Homo sapiens
atgggaggctcacccccttctcc

SEQ ID NO: 773236 - DNA, 18 bp, Homo sapiens
atgggagggaggctcagg

SEQ ID NO: 773237 - DNA, 15 bp, Homo sapiens
atgggagggatcagc

SEQ ID NO: 773238 - DNA, 16 bp, Homo sapiens
atgggagggatcagcc

SEQ ID NO: 773239 - DNA, 20 bp, Homo sapiens
atgggagggggcttgaagcc

SEQ ID NO: 773240 - DNA, 14 bp, Homo sapiens
atgggagtgggcac

SEQ ID NO: 773241 - DNA, 15 bp, Homo sapiens
atgggagtgggcacc

SEQ ID NO: 773242 - DNA, 20 bp, Homo sapiens
atgggatcctctccaccctc

SEQ ID NO: 773243 - DNA, 14 bp, Homo sapiens
atgggatgagaaaa

SEQ ID NO: 773244 - DNA, 23 bp, Homo sapiens
atgggattcagtgcttcttaaag

SEQ ID NO: 773245 - DNA, 15 bp, Homo sapiens
atgggcaaagcttgt

SEQ ID NO: 773246 - DNA, 19 bp, Homo sapiens
atgggcagttctcccaggg

SEQ ID NO: 773247 - DNA, 22 bp, Homo sapiens
atgggcagttctcccagggagt

SEQ ID NO: 773248 - DNA, 21 bp, Homo sapiens
atgggcatcttttgtattaag

SEQ ID NO: 773249 - DNA, 18 bp, Homo sapiens
atgggcattgggctgaca

SEQ ID NO: 773250 - DNA, 17 bp, Homo sapiens
atgggcatttattttat

SEQ ID NO: 773251 - DNA, 19 bp, Homo sapiens
atgggcatttattttataa

SEQ ID NO: 773252 - DNA, 20 bp, Homo sapiens
atgggcatttattttataac

SEQ ID NO: 773253 - DNA, 12 bp, Homo sapiens
atgggccaccgg

SEQ ID NO: 773254 - DNA, 14 bp, Homo sapiens
atgggcccaggcct

SEQ ID NO: 773255 - DNA, 11 bp, Homo sapiens
atgggcctctc

SEQ ID NO: 773256 - DNA, 14 bp, Homo sapiens
atgggcctgcccaa

SEQ ID NO: 773257 - DNA, 18 bp, Homo sapiens
atgggcctgccgggctga

SEQ ID NO: 773258 - DNA, 22 bp, Homo sapiens
atgggcctgccgggctgagggc

SEQ ID NO: 773259 - DNA, 13 bp, Homo sapiens
atgggcctgctgc

SEQ ID NO: 773260 - DNA, 17 bp, Homo sapiens
atgggcctgggcctgct

SEQ ID NO: 773261 - DNA, 19 bp, Homo sapiens
atgggccttgctttgggct

SEQ ID NO: 773262 - DNA, 20 bp, Homo sapiens
atgggccttttcttgaataa

SEQ ID NO: 773263 - DNA, 17 bp, Homo sapiens
atgggcgcaggcccagt

SEQ ID NO: 773264 - DNA, 19 bp, Homo sapiens
atgggcgcaggcccagtga

SEQ ID NO: 773265 - DNA, 15 bp, Homo sapiens
atgggcgggggtggt

SEQ ID NO: 773266 - DNA, 23 bp, Homo sapiens
atgggctagtgtgagtggcagcc

SEQ ID NO: 773267 - DNA, 17 bp, Homo sapiens
atgggctctacctctct

SEQ ID NO: 773268 - DNA, 14 bp, Homo sapiens
atgggctcttcact

SEQ ID NO: 773269 - DNA, 19 bp, Homo sapiens
atgggctggggcaggggcc

SEQ ID NO: 773270 - DNA, 21 bp, Homo sapiens
atgggctgggggccagggctg

SEQ ID NO: 773271 - DNA, 22 bp, Homo sapiens
atgggctgggggccagggctgg

SEQ ID NO: 773272 - DNA, 15 bp, Homo sapiens
atgggcttctgttct

SEQ ID NO: 773273 - DNA, 20 bp, Homo sapiens
atgggctttgtacgttcctt

SEQ ID NO: 773274 - DNA, 21 bp, Homo sapiens
atggggaaggcagaggctggc

SEQ ID NO: 773275 - DNA, 23 bp, Homo sapiens
atggggaccctccaaaggaaggg

SEQ ID NO: 773276 - DNA, 11 bp, Homo sapiens
atggggagaaa

SEQ ID NO: 773277 - DNA, 16 bp, Homo sapiens
atggggagaaagggag

SEQ ID NO: 773278 - DNA, 18 bp, Homo sapiens
atggggagaaagggagcg

SEQ ID NO: 773279 - DNA, 13 bp, Homo sapiens
atggggaggagac

SEQ ID NO: 773280 - DNA, 14 bp, Homo sapiens
atggggaggcagca

SEQ ID NO: 773281 - DNA, 14 bp, Homo sapiens
atggggaggccctg

SEQ ID NO: 773282 - DNA, 16 bp, Homo sapiens
atggggatagaggaaa

SEQ ID NO: 773283 - DNA, 22 bp, Homo sapiens
atggggatctggggggtgggga

SEQ ID NO: 773284 - DNA, 15 bp, Homo sapiens
atggggcaagacaga

SEQ ID NO: 773285 - DNA, 14 bp, Homo sapiens
atggggcaagccag

SEQ ID NO: 773286 - DNA, 19 bp, Homo sapiens
atggggcaagccagggccc

SEQ ID NO: 773287 - DNA, 20 bp, Homo sapiens
atggggcaagccagggccca

SEQ ID NO: 773288 - DNA, 14 bp, Homo sapiens
atggggcagaggct

SEQ ID NO: 773289 - DNA, 18 bp, Homo sapiens
atggggctcccagctcct

SEQ ID NO: 773290 - DNA, 19 bp, Homo sapiens
atggggctgaacggggaga

SEQ ID NO: 773291 - DNA, 22 bp, Homo sapiens
atggttctcagatcttgacagt

SEQ ID NO: 773292 - DNA, 16 bp, Homo sapiens
atggttcttctccagt

SEQ ID NO: 773293 - DNA, 14 bp, Homo sapiens
atggttgatggaaa

SEQ ID NO: 773294 - DNA, 16 bp, Homo sapiens
atggttgatggaaaat

SEQ ID NO: 773295 - DNA, 18 bp, Homo sapiens
atggttgatggaaaataa

SEQ ID NO: 773296 - DNA, 22 bp, Homo sapiens
atggttgatggaaaataaacat

SEQ ID NO: 773297 - DNA, 17 bp, Homo sapiens
atggttgccaccccaac

SEQ ID NO: 773298 - DNA, 20 bp, Homo sapiens
atggttgccaccccaaccca

SEQ ID NO: 773299 - DNA, 23 bp, Homo sapiens
atggttgccaccccaacccaata

SEQ ID NO: 773300 - DNA, 18 bp, Homo sapiens
atggttgccttaaagaaa

SEQ ID NO: 773301 - DNA, 18 bp, Homo sapiens
atggttggagagccctgg

SEQ ID NO: 773302 - DNA, 18 bp, Homo sapiens
atggttgggacaatggca

SEQ ID NO: 773303 - DNA, 22 bp, Homo sapiens
atggttgggacaatggcaatag

SEQ ID NO: 773304 - DNA, 17 bp, Homo sapiens
atggttgggggaatgca

SEQ ID NO: 773305 - DNA, 20 bp, Homo sapiens
atggttgggggaatgcacct

SEQ ID NO: 773306 - DNA, 13 bp, Homo sapiens
atggttggtttta

SEQ ID NO: 773307 - DNA, 21 bp, Homo sapiens
atggttggttttatttgtcag

SEQ ID NO: 773308 - DNA, 17 bp, Homo sapiens
atggttgtagcatttaa

SEQ ID NO: 773309 - DNA, 23 bp, Homo sapiens
atggtttattcccaagtatgcct

SEQ ID NO: 773310 - DNA, 12 bp, Homo sapiens
atggtttcctct

SEQ ID NO: 773311 - DNA, 15 bp, Homo sapiens
atggtttcctctgga

SEQ ID NO: 773312 - DNA, 20 bp, Homo sapiens
atggtttctgaaaatgttta

SEQ ID NO: 773313 - DNA, 12 bp, Homo sapiens
atggtttggttt

SEQ ID NO: 773314 - DNA, 15 bp, Homo sapiens
atggtttgtcctgat

SEQ ID NO: 773315 - DNA, 14 bp, Homo sapiens
atggttttaaactt

SEQ ID NO: 773316 - DNA, 15 bp, Homo sapiens
atggttttcaaaata

SEQ ID NO: 773317 - DNA, 13 bp, Homo sapiens
atgtaaaaaagaa

SEQ ID NO: 773318 - DNA, 14 bp, Homo sapiens
atgtaaaaatgaag

SEQ ID NO: 773319 - DNA, 18 bp, Homo sapiens
atgtaaaaatgaaggaat

SEQ ID NO: 773320 - DNA, 14 bp, Homo sapiens
atgtaaaaatgctt

SEQ ID NO: 773321 - DNA, 13 bp, Homo sapiens
atgtaaaacacat

SEQ ID NO: 773322 - DNA, 14 bp, Homo sapiens
atgtaaaacattta

SEQ ID NO: 773323 - DNA, 15 bp, Homo sapiens
atgtaaaacatttat

SEQ ID NO: 773324 - DNA, 21 bp, Homo sapiens
atgtaaaacatttattttgac

SEQ ID NO: 773325 - DNA, 19 bp, Homo sapiens
atgtaaaactccattcata

SEQ ID NO: 773326 - DNA, 21 bp, Homo sapiens
atgtaaaagagtcatctggta

SEQ ID NO: 773327 - DNA, 23 bp, Homo sapiens
atgtaaaaggattattactaatt

SEQ ID NO: 773328 - DNA, 20 bp, Homo sapiens
atgtaaaatatgtaaaacta

SEQ ID NO: 773329 - DNA, 13 bp, Homo sapiens
atgtaaaatgagt

SEQ ID NO: 773330 - DNA, 17 bp, Homo sapiens
atgtaaaatgttgaata

SEQ ID NO: 773331 - DNA, 17 bp, Homo sapiens
atgtaaacagtgcctgc

SEQ ID NO: 773332 - DNA, 23 bp, Homo sapiens
atgtaaacataattcttgtatat

SEQ ID NO: 773333 - DNA, 17 bp, Homo sapiens
atgtaaactatttgtgg

SEQ ID NO: 773334 - DNA, 14 bp, Homo sapiens
atgtaaactgccat

SEQ ID NO: 773335 - DNA, 20 bp, Homo sapiens
atgtaaagaacttaaattat

SEQ ID NO: 773336 - DNA, 20 bp, Homo sapiens
atgtaaaggagtcaaaacta

SEQ ID NO: 773337 - DNA, 19 bp, Homo sapiens
atgtaaaggtatattgtga

SEQ ID NO: 773338 - DNA, 14 bp, Homo sapiens
atgtaaagtatgtt

SEQ ID NO: 773339 - DNA, 16 bp, Homo sapiens
atgtaaagtatgtttt

SEQ ID NO: 773340 - DNA, 15 bp, Homo sapiens
atgtaaatacaaatt

SEQ ID NO: 773341 - DNA, 20 bp, Homo sapiens
atgtaaataccaagagcaat

SEQ ID NO: 773342 - DNA, 16 bp, Homo sapiens
atgtaaatactcatga

SEQ ID NO: 773343 - DNA, 22 bp, Homo sapiens
atgtaaatactcatgaatgaaa

SEQ ID NO: 773344 - DNA, 14 bp, Homo sapiens
atgtaaatagatga

SEQ ID NO: 773345 - DNA, 19 bp, Homo sapiens
ccctctggattctgaatct

SEQ ID NO: 773346 - DNA, 12 bp, Homo sapiens
ccctctggctcc

SEQ ID NO: 773347 - DNA, 12 bp, Homo sapiens
ccctctgggaac

SEQ ID NO: 773348 - DNA, 19 bp, Homo sapiens
ccctctgggaacctcccag

SEQ ID NO: 773349 - DNA, 12 bp, Homo sapiens
ccctctggggac

SEQ ID NO: 773350 - DNA, 15 bp, Homo sapiens
ccctctggtcccaca

SEQ ID NO: 773351 - DNA, 20 bp, Homo sapiens
ccctctggtcgctcctgccc

SEQ ID NO: 773352 - DNA, 12 bp, Homo sapiens
ccctctggttat

SEQ ID NO: 773353 - DNA, 20 bp, Homo sapiens
ccctctgtcatcactccctg

SEQ ID NO: 773354 - DNA, 14 bp, Homo sapiens
ccctctgtcttttc

SEQ ID NO: 773355 - DNA, 17 bp, Homo sapiens
ccctctgtcttttctcc

SEQ ID NO: 773356 - DNA, 15 bp, Homo sapiens
ccctctgtggcctgt

SEQ ID NO: 773357 - DNA, 20 bp, Homo sapiens
ccctctgtgtatttgctttt

SEQ ID NO: 773358 - DNA, 24 bp, Homo sapiens
ccctctgttctctcccctcacatc

SEQ ID NO: 773359 - DNA, 14 bp, Homo sapiens
ccctcttcaaagca

SEQ ID NO: 773360 - DNA, 22 bp, Homo sapiens
ccctcttcactgtggccacagc

SEQ ID NO: 773361 - DNA, 14 bp, Homo sapiens
ccctcttcccttcc

SEQ ID NO: 773362 - DNA, 16 bp, Homo sapiens
ccctcttcccttcctc

SEQ ID NO: 773363 - DNA, 20 bp, Homo sapiens
ccctcttcccttcctccatt

SEQ ID NO: 773364 - DNA, 20 bp, Homo sapiens
ccctcttcctaccctgcctc

SEQ ID NO: 773365 - DNA, 12 bp, Homo sapiens
ccctcttcctcc

SEQ ID NO: 773366 - DNA, 16 bp, Homo sapiens
ccctcttcctccctgg

SEQ ID NO: 773367 - DNA, 15 bp, Homo sapiens
ccctcttcctctcca

SEQ ID NO: 773368 - DNA, 17 bp, Homo sapiens
ccctcttctctcctcag

SEQ ID NO: 773369 - DNA, 18 bp, Homo sapiens
ccctcttctctcctcagt

SEQ ID NO: 773370 - DNA, 15 bp, Homo sapiens
ccctcttctgctcct

SEQ ID NO: 773371 - DNA, 13 bp, Homo sapiens
ccctcttgccagc

SEQ ID NO: 773372 - DNA, 16 bp, Homo sapiens
ccctcttgccagcctc

SEQ ID NO: 773373 - DNA, 17 bp, Homo sapiens
ccctcttgccagcctcc

SEQ ID NO: 773374 - DNA, 20 bp, Homo sapiens
ccctcttgccagcctccttg

SEQ ID NO: 773375 - DNA, 22 bp, Homo sapiens
ccctcttgccagcctccttgct

SEQ ID NO: 773376 - DNA, 14 bp, Homo sapiens
ccctcttgccatcc

SEQ ID NO: 773377 - DNA, 19 bp, Homo sapiens
ccctcttgccatcctgatg

SEQ ID NO: 773378 - DNA, 21 bp, Homo sapiens
ccctcttgccatcctgatgga

SEQ ID NO: 773379 - DNA, 23 bp, Homo sapiens
ccctcttggagaagtctcagcta

SEQ ID NO: 773380 - DNA, 12 bp, Homo sapiens
ccctcttgtaag

SEQ ID NO: 773381 - DNA, 13 bp, Homo sapiens
ccctcttgtctcc

SEQ ID NO: 773382 - DNA, 15 bp, Homo sapiens
ccctcttgtctcccc

SEQ ID NO: 773383 - DNA, 18 bp, Homo sapiens
ccctctttaatgctgtct

SEQ ID NO: 773384 - DNA, 17 bp, Homo sapiens
ccctctttcccaccctc

SEQ ID NO: 773385 - DNA, 18 bp, Homo sapiens
ccctctttcccaccctcc

SEQ ID NO: 773386 - DNA, 14 bp, Homo sapiens
ccctctttctcttt

SEQ ID NO: 773387 - DNA, 14 bp, Homo sapiens
ccctctttgctgca

SEQ ID NO: 773388 - DNA, 15 bp, Homo sapiens
ccctctttgctgcag

SEQ ID NO: 773389 - DNA, 19 bp, Homo sapiens
ccctctttgctgcagagaa

SEQ ID NO: 773390 - DNA, 19 bp, Homo sapiens
ccctctttggctcccctgt

SEQ ID NO: 773391 - DNA, 13 bp, Homo sapiens
ccctcttttctta

SEQ ID NO: 773392 - DNA, 14 bp, Homo sapiens
ccctcttttggcct

SEQ ID NO: 773393 - DNA, 17 bp, Homo sapiens
ccctcttttggccttgt

SEQ ID NO: 773394 - DNA, 21 bp, Homo sapiens
ccctcttttgttaaataatat

SEQ ID NO: 773395 - DNA, 14 bp, Homo sapiens
ccctgaaaacccag

SEQ ID NO: 773396 - DNA, 15 bp, Homo sapiens
ccctgaaaacccaga

SEQ ID NO: 773397 - DNA, 17 bp, Homo sapiens
ccctgaaaacccagaga

SEQ ID NO: 773398 - DNA, 19 bp, Homo sapiens
ccctgaaaacgaaggggcc

SEQ ID NO: 773399 - DNA, 22 bp, Homo sapiens
ccctgaaaatgtttttctgcca

SEQ ID NO: 773400 - DNA, 21 bp, Homo sapiens
ccctgaaacctagtactgccc

SEQ ID NO: 773401 - DNA, 15 bp, Homo sapiens
ccctgaaagcctcac

SEQ ID NO: 773402 - DNA, 13 bp, Homo sapiens
ccctgaaccacga

SEQ ID NO: 773403 - DNA, 14 bp, Homo sapiens
ccctgaaccacgag

SEQ ID NO: 773404 - DNA, 16 bp, Homo sapiens
ccctgaaccacgaggc

SEQ ID NO: 773405 - DNA, 17 bp, Homo sapiens
ccctgaacccacacctg

SEQ ID NO: 773406 - DNA, 19 bp, Homo sapiens
ccctgaacccacacctggg

SEQ ID NO: 773407 - DNA, 17 bp, Homo sapiens
ccctgaacccctggcca

SEQ ID NO: 773408 - DNA, 15 bp, Homo sapiens
ccctgaacgttttct

SEQ ID NO: 773409 - DNA, 12 bp, Homo sapiens
ccctgaagcctc

SEQ ID NO: 773410 - DNA, 22 bp, Homo sapiens
ccctgaatttcttcttttcctg

SEQ ID NO: 773411 - DNA, 15 bp, Homo sapiens
ccctgacatgctaac

SEQ ID NO: 773412 - DNA, 19 bp, Homo sapiens
ccctgaccctgtggaagca

SEQ ID NO: 773413 - DNA, 11 bp, Homo sapiens
ccctgacctcc

SEQ ID NO: 773414 - DNA, 22 bp, Homo sapiens
atgtatggaatcccactgtatg

SEQ ID NO: 773415 - DNA, 21 bp, Homo sapiens
atgtatgggtagggtaaatca

SEQ ID NO: 773416 - DNA, 15 bp, Homo sapiens
atgtatgtaaaaatg

SEQ ID NO: 773417 - DNA, 22 bp, Homo sapiens
atgtatgtaaataggtttctaa

SEQ ID NO: 773418 - DNA, 16 bp, Homo sapiens
atgtatgtatgtatta

SEQ ID NO: 773419 - DNA, 15 bp, Homo sapiens
atgtatgtgcactgt

SEQ ID NO: 773420 - DNA, 17 bp, Homo sapiens
atgtatgtgtaataaat

SEQ ID NO: 773421 - DNA, 13 bp, Homo sapiens
atgtatgtgtgaa

SEQ ID NO: 773422 - DNA, 19 bp, Homo sapiens
atgtatgttcagaagaaat

SEQ ID NO: 773423 - DNA, 13 bp, Homo sapiens
atgtatgtttaca

SEQ ID NO: 773424 - DNA, 14 bp, Homo sapiens
atgtatgtttctct

SEQ ID NO: 773425 - DNA, 18 bp, Homo sapiens
atgtattaagccaaacat

SEQ ID NO: 773426 - DNA, 19 bp, Homo sapiens
atgtattaagccaaacatg

SEQ ID NO: 773427 - DNA, 18 bp, Homo sapiens
atgtattacatgactgtt

SEQ ID NO: 773428 - DNA, 18 bp, Homo sapiens
atgtattagtatggttca

SEQ ID NO: 773429 - DNA, 13 bp, Homo sapiens
atgtattagtgtc

SEQ ID NO: 773430 - DNA, 14 bp, Homo sapiens
atgtattatcacat

SEQ ID NO: 773431 - DNA, 12 bp, Homo sapiens
atgtattatgaa

SEQ ID NO: 773432 - DNA, 15 bp, Homo sapiens
atgtattatgagcca

SEQ ID NO: 773433 - DNA, 15 bp, Homo sapiens
atgtattatgctgtt

SEQ ID NO: 773434 - DNA, 12 bp, Homo sapiens
atgtattatgtc

SEQ ID NO: 773435 - DNA, 20 bp, Homo sapiens
atgtattatgtcctgtgaga

SEQ ID NO: 773436 - DNA, 13 bp, Homo sapiens
atgtattattctg

SEQ ID NO: 773437 - DNA, 14 bp, Homo sapiens
atgtattattctgc

SEQ ID NO: 773438 - DNA, 16 bp, Homo sapiens
atgtattattctgcag

SEQ ID NO: 773439 - DNA, 17 bp, Homo sapiens
atgtattattctgcagc

SEQ ID NO: 773440 - DNA, 14 bp, Homo sapiens
atgtattcaaatac

SEQ ID NO: 773441 - DNA, 15 bp, Homo sapiens
atgtattcccttgta

SEQ ID NO: 773442 - DNA, 14 bp, Homo sapiens
atgtattgtaatct

SEQ ID NO: 773443 - DNA, 12 bp, Homo sapiens
atgtatttaaaa

SEQ ID NO: 773444 - DNA, 23 bp, Homo sapiens
atgtatttaagatgtacatttaa

SEQ ID NO: 773445 - DNA, 17 bp, Homo sapiens
atgtatttaccaaaaat

SEQ ID NO: 773446 - DNA, 22 bp, Homo sapiens
atgtatttaccaaaaattttgt

SEQ ID NO: 773447 - DNA, 20 bp, Homo sapiens
atgtatttataatttaaatg

SEQ ID NO: 773448 - DNA, 21 bp, Homo sapiens
atgtatttataatttaaatga

SEQ ID NO: 773449 - DNA, 15 bp, Homo sapiens
atgtatttcagggac

SEQ ID NO: 773450 - DNA, 16 bp, Homo sapiens
atgtatttcagggacc

SEQ ID NO: 773451 - DNA, 23 bp, Homo sapiens
atgtatttcagggacctcagggg

SEQ ID NO: 773452 - DNA, 19 bp, Homo sapiens
atgtatttcctggatgttt

SEQ ID NO: 773453 - DNA, 19 bp, Homo sapiens
atgtatttgtagtgttatt

SEQ ID NO: 773454 - DNA, 21 bp, Homo sapiens
atgtatttgtagtgttattgc

SEQ ID NO: 773455 - DNA, 12 bp, Homo sapiens
atgtattttatg

SEQ ID NO: 773456 - DNA, 14 bp, Homo sapiens
atgtattttatgat

SEQ ID NO: 773457 - DNA, 18 bp, Homo sapiens
atgtattttcagctcaat

SEQ ID NO: 773458 - DNA, 15 bp, Homo sapiens
atgtattttcatagt

SEQ ID NO: 773459 - DNA, 19 bp, Homo sapiens
atgtattttggttgctgat

SEQ ID NO: 773460 - DNA, 20 bp, Homo sapiens
atgtcaaagagaaaacttat

SEQ ID NO: 773461 - DNA, 15 bp, Homo sapiens
atgtcaaatggagct

SEQ ID NO: 773462 - DNA, 12 bp, Homo sapiens
atgtcaaattga

SEQ ID NO: 773463 - DNA, 23 bp, Homo sapiens
atgtcaatgaccattcaattagt

SEQ ID NO: 773464 - DNA, 16 bp, Homo sapiens
atgtcaatttctgtgt

SEQ ID NO: 773465 - DNA, 14 bp, Homo sapiens
atgtcaatttgtat

SEQ ID NO: 773466 - DNA, 16 bp, Homo sapiens
atgtcaatttgtatat

SEQ ID NO: 773467 - DNA, 18 bp, Homo sapiens
atgtcacaaattgatcaa

SEQ ID NO: 773468 - DNA, 12 bp, Homo sapiens
atgtcacagcat

SEQ ID NO: 773469 - DNA, 15 bp, Homo sapiens
atgtcacatttgaat

SEQ ID NO: 773470 - DNA, 16 bp, Homo sapiens
atgtcacatttgaatt

SEQ ID NO: 773471 - DNA, 15 bp, Homo sapiens
atgtcaccagtcctg

SEQ ID NO: 773472 - DNA, 18 bp, Homo sapiens
atgtcaccggtcagtgcc

SEQ ID NO: 773473 - DNA, 19 bp, Homo sapiens
atgtcaccggtcagtgcct

SEQ ID NO: 773474 - DNA, 22 bp, Homo sapiens
atgtcaccggtcagtgcctttt

SEQ ID NO: 773475 - DNA, 17 bp, Homo sapiens
atgtcacctcagctgat

SEQ ID NO: 773476 - DNA, 18 bp, Homo sapiens
atgtcacgaacttgaaag

SEQ ID NO: 773477 - DNA, 15 bp, Homo sapiens
atgtcactatatctt

SEQ ID NO: 773478 - DNA, 16 bp, Homo sapiens
atgtcactgtggtcct

SEQ ID NO: 773479 - DNA, 15 bp, Homo sapiens
atgtcacttctggat

SEQ ID NO: 773480 - DNA, 13 bp, Homo sapiens
ccctgcctgaggg

SEQ ID NO: 773481 - DNA, 19 bp, Homo sapiens
ccctgcctgagggcccctc

SEQ ID NO: 773482 - DNA, 14 bp, Homo sapiens
ccctgcctgccatg

SEQ ID NO: 773483 - DNA, 12 bp, Homo sapiens
ccctgcctgccc

SEQ ID NO: 773484 - DNA, 13 bp, Homo sapiens
ccctgcctgccca

SEQ ID NO: 773485 - DNA, 15 bp, Homo sapiens
ccctgcctgcccact

SEQ ID NO: 773486 - DNA, 18 bp, Homo sapiens
ccctgcctgccgctgcac

SEQ ID NO: 773487 - DNA, 15 bp, Homo sapiens
ccctgcctgcctctt

SEQ ID NO: 773488 - DNA, 13 bp, Homo sapiens
ccctgcctggccc

SEQ ID NO: 773489 - DNA, 17 bp, Homo sapiens
ccctgcctggcccccaa

SEQ ID NO: 773490 - DNA, 20 bp, Homo sapiens
ccctgcctgtcacctgggag

SEQ ID NO: 773491 - DNA, 17 bp, Homo sapiens
ccctgcctgtgcccgca

SEQ ID NO: 773492 - DNA, 11 bp, Homo sapiens
ccctgccttcc

SEQ ID NO: 773493 - DNA, 19 bp, Homo sapiens
ccctgccttcctctgagga

SEQ ID NO: 773494 - DNA, 22 bp, Homo sapiens
ccctgccttgccgctccccttg

SEQ ID NO: 773495 - DNA, 19 bp, Homo sapiens
ccctgcgaaggggccctgg

SEQ ID NO: 773496 - DNA, 21 bp, Homo sapiens
ccctgcgaaggggccctggtc

SEQ ID NO: 773497 - DNA, 21 bp, Homo sapiens
ccctgcgaagtggctctcagg

SEQ ID NO: 773498 - DNA, 17 bp, Homo sapiens
ccctgcgcctccagagg

SEQ ID NO: 773499 - DNA, 21 bp, Homo sapiens
ccctgcgcctccagaggtcct

SEQ ID NO: 773500 - DNA, 15 bp, Homo sapiens
ccctgcgcctgtgat

SEQ ID NO: 773501 - DNA, 13 bp, Homo sapiens
ccctgcggcctcc

SEQ ID NO: 773502 - DNA, 16 bp, Homo sapiens
ccctgcgggccacagg

SEQ ID NO: 773503 - DNA, 15 bp, Homo sapiens
ccctgcgggccaggg

SEQ ID NO: 773504 - DNA, 22 bp, Homo sapiens
ccctgcgttggagccactcctg

SEQ ID NO: 773505 - DNA, 17 bp, Homo sapiens
ccctgctactcctgtgc

SEQ ID NO: 773506 - DNA, 21 bp, Homo sapiens
ccctgctactcctgtgctctg

SEQ ID NO: 773507 - DNA, 22 bp, Homo sapiens
ccctgctactcctgtgctctgg

SEQ ID NO: 773508 - DNA, 12 bp, Homo sapiens
ccctgctcagca

SEQ ID NO: 773509 - DNA, 15 bp, Homo sapiens
ccctgctcatccact

SEQ ID NO: 773510 - DNA, 19 bp, Homo sapiens
ccctgctccaccagcagca

SEQ ID NO: 773511 - DNA, 20 bp, Homo sapiens
ccctgctccaccagcagcat

SEQ ID NO: 773512 - DNA, 17 bp, Homo sapiens
ccctgctcccagcctgc

SEQ ID NO: 773513 - DNA, 14 bp, Homo sapiens
ccctgctcccattc

SEQ ID NO: 773514 - DNA, 16 bp, Homo sapiens
ccctgctcccctttgg

SEQ ID NO: 773515 - DNA, 16 bp, Homo sapiens
ccctgctccctctggg

SEQ ID NO: 773516 - DNA, 15 bp, Homo sapiens
ccctgctcctccctg

SEQ ID NO: 773517 - DNA, 18 bp, Homo sapiens
ccctgctcctcctgccct

SEQ ID NO: 773518 - DNA, 21 bp, Homo sapiens
ccctgctctacccatgagcct

SEQ ID NO: 773519 - DNA, 23 bp, Homo sapiens
ccctgctctacccatgagcctgc

SEQ ID NO: 773520 - DNA, 12 bp, Homo sapiens
ccctgctgactc

SEQ ID NO: 773521 - DNA, 21 bp, Homo sapiens
ccctgctgagtcccaggctga

SEQ ID NO: 773522 - DNA, 14 bp, Homo sapiens
ccctgctgccacag

SEQ ID NO: 773523 - DNA, 16 bp, Homo sapiens
ccctgctgccacagca

SEQ ID NO: 773524 - DNA, 13 bp, Homo sapiens
ccctgctgcccag

SEQ ID NO: 773525 - DNA, 23 bp, Homo sapiens
ccctgctgccgcctcccagcctg

SEQ ID NO: 773526 - DNA, 16 bp, Homo sapiens
ccctgctgcctcccca

SEQ ID NO: 773527 - DNA, 13 bp, Homo sapiens
ccctgctgcttgg

SEQ ID NO: 773528 - DNA, 10 bp, Homo sapiens
ccctgctggg

SEQ ID NO: 773529 - DNA, 12 bp, Homo sapiens
ccctgctggggc

SEQ ID NO: 773530 - DNA, 20 bp, Homo sapiens
ccctgctgtgccatgctggg

SEQ ID NO: 773531 - DNA, 14 bp, Homo sapiens
ccctgctgtgggag

SEQ ID NO: 773532 - DNA, 14 bp, Homo sapiens
ccctgcttccagga

SEQ ID NO: 773533 - DNA, 16 bp, Homo sapiens
ccctgcttccaggaaa

SEQ ID NO: 773534 - DNA, 13 bp, Homo sapiens
ccctgcttctccc

SEQ ID NO: 773535 - DNA, 18 bp, Homo sapiens
ccctgcttctcccgggga

SEQ ID NO: 773536 - DNA, 21 bp, Homo sapiens
ccctgcttctcccggggacgc

SEQ ID NO: 773537 - DNA, 17 bp, Homo sapiens
ccctgggggaagccctg

SEQ ID NO: 773538 - DNA, 18 bp, Homo sapiens
ccctgggggaagccctgg

SEQ ID NO: 773539 - DNA, 15 bp, Homo sapiens
ccctgggggattcct

SEQ ID NO: 773540 - DNA, 19 bp, Homo sapiens
ccctgggggattcctgagc

SEQ ID NO: 773541 - DNA, 21 bp, Homo sapiens
ccctggggtaccatgtggcca

SEQ ID NO: 773542 - DNA, 21 bp, Homo sapiens
ccctggggtgggatctgagct

SEQ ID NO: 773543 - DNA, 23 bp, Homo sapiens
ccctggggtgggatctgagctcc

SEQ ID NO: 773544 - DNA, 16 bp, Homo sapiens
ccctggggtgtgtctc

SEQ ID NO: 773545 - DNA, 15 bp, Homo sapiens
ccctgggtctgggga

SEQ ID NO: 773546 - DNA, 16 bp, Homo sapiens
ccctgggtctggggac

SEQ ID NO: 773547 - DNA, 23 bp, Homo sapiens
ccctgggtctggggacaggcccg

SEQ ID NO: 773548 - DNA, 23 bp, Homo sapiens
ccctgggtgggtggtggggaggg

SEQ ID NO: 773549 - DNA, 20 bp, Homo sapiens
ccctggtcaccaaggcagtg

SEQ ID NO: 773550 - DNA, 18 bp, Homo sapiens
ccctggtcctggcctcct

SEQ ID NO: 773551 - DNA, 18 bp, Homo sapiens
ccctggtctgtggagatg

SEQ ID NO: 773552 - DNA, 12 bp, Homo sapiens
ccctggtgcctc

SEQ ID NO: 773553 - DNA, 12 bp, Homo sapiens
ccctggtgctcc

SEQ ID NO: 773554 - DNA, 17 bp, Homo sapiens
ccctggtgctcctgccc

SEQ ID NO: 773555 - DNA, 19 bp, Homo sapiens
ccctggtgctcctgcccag

SEQ ID NO: 773556 - DNA, 14 bp, Homo sapiens
ccctggtgctgcca

SEQ ID NO: 773557 - DNA, 15 bp, Homo sapiens
ccctggtgctgccac

SEQ ID NO: 773558 - DNA, 16 bp, Homo sapiens
ccctggtgctgccaca

SEQ ID NO: 773559 - DNA, 21 bp, Homo sapiens
ccctggtgctgccacacttca

SEQ ID NO: 773560 - DNA, 17 bp, Homo sapiens
ccctggtgggctgttca

SEQ ID NO: 773561 - DNA, 18 bp, Homo sapiens
ccctggtgggctgttcag

SEQ ID NO: 773562 - DNA, 16 bp, Homo sapiens
ccctggtggttgctgt

SEQ ID NO: 773563 - DNA, 12 bp, Homo sapiens
ccctggttgcct

SEQ ID NO: 773564 - DNA, 15 bp, Homo sapiens
ccctggttgcctctc

SEQ ID NO: 773565 - DNA, 17 bp, Homo sapiens
ccctggttgcctctctt

SEQ ID NO: 773566 - DNA, 13 bp, Homo sapiens
ccctgtacagtgt

SEQ ID NO: 773567 - DNA, 19 bp, Homo sapiens
ccctgtacccaccccagca

SEQ ID NO: 773568 - DNA, 14 bp, Homo sapiens
ccctgtacccagct

SEQ ID NO: 773569 - DNA, 19 bp, Homo sapiens
ccctgtaccttttgaggag

SEQ ID NO: 773570 - DNA, 19 bp, Homo sapiens
ccctgtagactagtgccgt

SEQ ID NO: 773571 - DNA, 14 bp, Homo sapiens
ccctgtagctcagt

SEQ ID NO: 773572 - DNA, 16 bp, Homo sapiens
ccctgtagctcagtca

SEQ ID NO: 773573 - DNA, 13 bp, Homo sapiens
ccctgtagggaaa

SEQ ID NO: 773574 - DNA, 21 bp, Homo sapiens
ccctgtagggaaaccttggag

SEQ ID NO: 773575 - DNA, 15 bp, Homo sapiens
ccctgtatatagccc

SEQ ID NO: 773576 - DNA, 18 bp, Homo sapiens
ccctgtatatagcccagc

SEQ ID NO: 773577 - DNA, 12 bp, Homo sapiens
ccctgtcacaca

SEQ ID NO: 773578 - DNA, 15 bp, Homo sapiens
ccctgtcacacactg

SEQ ID NO: 773579 - DNA, 16 bp, Homo sapiens
ccctgtcacacactgg

SEQ ID NO: 773580 - DNA, 19 bp, Homo sapiens
ccctgtcaccaagctcaca

SEQ ID NO: 773581 - DNA, 13 bp, Homo sapiens
ccctgtcagaggc

SEQ ID NO: 773582 - DNA, 14 bp, Homo sapiens
ccctgtcagaggct

SEQ ID NO: 773583 - DNA, 22 bp, Homo sapiens
ccctgtcagtgcagcccgtgtg

SEQ ID NO: 773584 - DNA, 15 bp, Homo sapiens
ccctgtcatcaccag

SEQ ID NO: 773585 - DNA, 20 bp, Homo sapiens
ccctgtcatttgaacctgga

SEQ ID NO: 773586 - DNA, 20 bp, Homo sapiens
ccctgtccaggatggagggt

SEQ ID NO: 773587 - DNA, 18 bp, Homo sapiens
ccctgtcccaccaactct

SEQ ID NO: 773588 - DNA, 24 bp, Homo sapiens
ccctgtcccaccaactctgcactc

SEQ ID NO: 773589 - DNA, 15 bp, Homo sapiens
ccctgtcccatgcag

SEQ ID NO: 773590 - DNA, 20 bp, Homo sapiens
ccctgtcccatgcaggccct

SEQ ID NO: 773591 - DNA, 23 bp, Homo sapiens
ccctgtcccatgcaggccctttg

SEQ ID NO: 773592 - DNA, 19 bp, Homo sapiens
ccctgtccccaggcccagc

SEQ ID NO: 773593 - DNA, 16 bp, Homo sapiens
ccctgtccccagtccc

SEQ ID NO: 773594 - DNA, 17 bp, Homo sapiens
ccctgtcccccagctct

SEQ ID NO: 773595 - DNA, 21 bp, Homo sapiens
ccctgtccccctcccctccca

SEQ ID NO: 773596 - DNA, 16 bp, Homo sapiens
ccctgtccctgtcccc

SEQ ID NO: 773597 - DNA, 22 bp, Homo sapiens
ccctgtccggcccagtgccact

SEQ ID NO: 773598 - DNA, 14 bp, Homo sapiens
ccctgtcctcctcg

SEQ ID NO: 773599 - DNA, 16 bp, Homo sapiens
ccctgtcctcctcgga

SEQ ID NO: 773600 - DNA, 22 bp, Homo sapiens
ccctgtcctgatggtcagctcc

SEQ ID NO: 773601 - DNA, 15 bp, Homo sapiens
ccctgtccttctaca

SEQ ID NO: 773602 - DNA, 15 bp, Homo sapiens
ccctgtcgagacact

SEQ ID NO: 773603 - DNA, 12 bp, Homo sapiens
ccctgtcgccca

SEQ ID NO: 773604 - DNA, 15 bp, Homo sapiens
ccctgtcgcccaccc

SEQ ID NO: 773605 - DNA, 16 bp, Homo sapiens
ccctgtcgcccaccca

SEQ ID NO: 773606 - DNA, 20 bp, Homo sapiens
ccctgtcgcccacccagctg

SEQ ID NO: 773607 - DNA, 22 bp, Homo sapiens
ccctgtctccagctgcctgggc

SEQ ID NO: 773608 - DNA, 23 bp, Homo sapiens
ccctgtctccagggcccccaccg

SEQ ID NO: 773609 - DNA, 22 bp, Homo sapiens
ccctgtctctaaggagcagcgg

SEQ ID NO: 773610 - DNA, 23 bp, Homo sapiens
ccctgtctctactaaaaatgcaa

SEQ ID NO: 773611 - DNA, 20 bp, Homo sapiens
atgtcttggaacattggaat

SEQ ID NO: 773612 - DNA, 17 bp, Homo sapiens
atgtcttgtcatacaaa

SEQ ID NO: 773613 - DNA, 15 bp, Homo sapiens
atgtcttgtgcataa

SEQ ID NO: 773614 - DNA, 22 bp, Homo sapiens
atgtctttaggcagcagctttt

SEQ ID NO: 773615 - DNA, 19 bp, Homo sapiens
atgtctttccacttctctg

SEQ ID NO: 773616 - DNA, 20 bp, Homo sapiens
atgtctttccacttctctgg

SEQ ID NO: 773617 - DNA, 13 bp, Homo sapiens
atgtctttggaaa

SEQ ID NO: 773618 - DNA, 23 bp, Homo sapiens
atgtctttgttggaaaagaatac

SEQ ID NO: 773619 - DNA, 21 bp, Homo sapiens
atgtcttttcccatttatcta

SEQ ID NO: 773620 - DNA, 19 bp, Homo sapiens
atgtcttttgatgaataga

SEQ ID NO: 773621 - DNA, 12 bp, Homo sapiens
atgtgaaaaaaa

SEQ ID NO: 773622 - DNA, 15 bp, Homo sapiens
atgtgaaaaaaatga

SEQ ID NO: 773623 - DNA, 13 bp, Homo sapiens
atgtgaaaaagga

SEQ ID NO: 773624 - DNA, 15 bp, Homo sapiens
atgtgaaaaaggaat

SEQ ID NO: 773625 - DNA, 17 bp, Homo sapiens
atgtgaaaaattaactt

SEQ ID NO: 773626 - DNA, 19 bp, Homo sapiens
atgtgaaaaattaactttt

SEQ ID NO: 773627 - DNA, 18 bp, Homo sapiens
atgtgaaaaggcaaaaag

SEQ ID NO: 773628 - DNA, 13 bp, Homo sapiens
atgtgaaaatcat

SEQ ID NO: 773629 - DNA, 19 bp, Homo sapiens
atgtgaaacacatgccagt

SEQ ID NO: 773630 - DNA, 20 bp, Homo sapiens
atgtgaaaggatatgaatct

SEQ ID NO: 773631 - DNA, 18 bp, Homo sapiens
atgtgaaatgcttttata

SEQ ID NO: 773632 - DNA, 13 bp, Homo sapiens
atgtgaacccggg

SEQ ID NO: 773633 - DNA, 15 bp, Homo sapiens
atgtgaactttatta

SEQ ID NO: 773634 - DNA, 14 bp, Homo sapiens
atgtgaagaaaaag

SEQ ID NO: 773635 - DNA, 21 bp, Homo sapiens
atgtgaagcatgctttgctgc

SEQ ID NO: 773636 - DNA, 12 bp, Homo sapiens
atgtgaagccaa

SEQ ID NO: 773637 - DNA, 17 bp, Homo sapiens
atgtgaagctcacactg

SEQ ID NO: 773638 - DNA, 21 bp, Homo sapiens
atgtgaagctcacactgatgg

SEQ ID NO: 773639 - DNA, 19 bp, Homo sapiens
atgtgaagttttccttgct

SEQ ID NO: 773640 - DNA, 12 bp, Homo sapiens
atgtgaatcaga

SEQ ID NO: 773641 - DNA, 21 bp, Homo sapiens
atgtgaatcagaccctacccc

SEQ ID NO: 773642 - DNA, 14 bp, Homo sapiens
atgtgaattattga

SEQ ID NO: 773643 - DNA, 16 bp, Homo sapiens
atgtgaattattgaca

SEQ ID NO: 773644 - DNA, 18 bp, Homo sapiens
atgtgaattgcctgcaga

SEQ ID NO: 773645 - DNA, 12 bp, Homo sapiens
atgtgaattttt

SEQ ID NO: 773646 - DNA, 16 bp, Homo sapiens
atgtgaatttttaagc

SEQ ID NO: 773647 - DNA, 19 bp, Homo sapiens
atgtgaatttttaagctgc

SEQ ID NO: 773648 - DNA, 18 bp, Homo sapiens
atgtgacaattttgtaca

SEQ ID NO: 773649 - DNA, 16 bp, Homo sapiens
atgtgacaggtaaact

SEQ ID NO: 773650 - DNA, 21 bp, Homo sapiens
atgtgacattaacaaataaaa

SEQ ID NO: 773651 - DNA, 19 bp, Homo sapiens
atgtgacattccatgacga

SEQ ID NO: 773652 - DNA, 18 bp, Homo sapiens
atgtgacattttacatta

SEQ ID NO: 773653 - DNA, 19 bp, Homo sapiens
atgtgaccattctgcctct

SEQ ID NO: 773654 - DNA, 12 bp, Homo sapiens
atgtgaccctcc

SEQ ID NO: 773655 - DNA, 20 bp, Homo sapiens
atgtgacctttaattcaggt

SEQ ID NO: 773656 - DNA, 16 bp, Homo sapiens
atgtgacttgcgctta

SEQ ID NO: 773657 - DNA, 15 bp, Homo sapiens
atgtgacttttctga

SEQ ID NO: 773658 - DNA, 19 bp, Homo sapiens
atgtgactttttttggtat

SEQ ID NO: 773659 - DNA, 16 bp, Homo sapiens
atgtgtatcagtgttt

SEQ ID NO: 773660 - DNA, 11 bp, Homo sapiens
atgtgtatgtg

SEQ ID NO: 773661 - DNA, 14 bp, Homo sapiens
atgtgtatgtgtct

SEQ ID NO: 773662 - DNA, 15 bp, Homo sapiens
atgtgtatgtgtgtg

SEQ ID NO: 773663 - DNA, 16 bp, Homo sapiens
atgtgtatgtgtgtga

SEQ ID NO: 773664 - DNA, 17 bp, Homo sapiens
atgtgtatgtgtgtgag

SEQ ID NO: 773665 - DNA, 14 bp, Homo sapiens
atgtgtatttatac

SEQ ID NO: 773666 - DNA, 20 bp, Homo sapiens
atgtgtatttccagtgcaat

SEQ ID NO: 773667 - DNA, 20 bp, Homo sapiens
atgtgtcaactgagagtcat

SEQ ID NO: 773668 - DNA, 11 bp, Homo sapiens
atgtgtcccct

SEQ ID NO: 773669 - DNA, 15 bp, Homo sapiens
atgtgtcccctcact

SEQ ID NO: 773670 - DNA, 17 bp, Homo sapiens
atgtgtcctcagggagc

SEQ ID NO: 773671 - DNA, 13 bp, Homo sapiens
atgtgtcctggtt

SEQ ID NO: 773672 - DNA, 16 bp, Homo sapiens
atgtgtctcccagaac

SEQ ID NO: 773673 - DNA, 15 bp, Homo sapiens
atgtgtctctgcttt

SEQ ID NO: 773674 - DNA, 19 bp, Homo sapiens
atgtgtctctgctttcctt

SEQ ID NO: 773675 - DNA, 16 bp, Homo sapiens
atgtgtctgggagagc

SEQ ID NO: 773676 - DNA, 17 bp, Homo sapiens
atgtgtctgggagagcc

SEQ ID NO: 773677 - DNA, 23 bp, Homo sapiens
atgtgtctgggagagcctggcaa

SEQ ID NO: 773678 - DNA, 19 bp, Homo sapiens
atgtgtctgtgttgcttca

SEQ ID NO: 773679 - DNA, 23 bp, Homo sapiens
atgtgtctgtgttgcttcaaatt

SEQ ID NO: 773680 - DNA, 19 bp, Homo sapiens
atgtgtctttatagatgta

SEQ ID NO: 773681 - DNA, 18 bp, Homo sapiens
atgtgtgaattctgcaac

SEQ ID NO: 773682 - DNA, 19 bp, Homo sapiens
atgtgtgagcatcctgcaa

SEQ ID NO: 773683 - DNA, 15 bp, Homo sapiens
atgtgtgaggagctg

SEQ ID NO: 773684 - DNA, 15 bp, Homo sapiens
atgtgtgcaggagcc

SEQ ID NO: 773685 - DNA, 21 bp, Homo sapiens
atgtgtgcaggagcctccctg

SEQ ID NO: 773686 - DNA, 17 bp, Homo sapiens
atgtgtgcatgtgagca

SEQ ID NO: 773687 - DNA, 20 bp, Homo sapiens
atgtgtgccatagagtttaa

SEQ ID NO: 773688 - DNA, 16 bp, Homo sapiens
atgtgtgcctgtggca

SEQ ID NO: 773689 - DNA, 16 bp, Homo sapiens
atgtgtgctttattga

SEQ ID NO: 773690 - DNA, 15 bp, Homo sapiens
atgtgtgctttccca

SEQ ID NO: 773691 - DNA, 14 bp, Homo sapiens
atgtgtggcctgca

SEQ ID NO: 773692 - DNA, 16 bp, Homo sapiens
atgtgtgggtgctgat

SEQ ID NO: 773693 - DNA, 18 bp, Homo sapiens
atgtgtgggtgctgataa

SEQ ID NO: 773694 - DNA, 19 bp, Homo sapiens
atgtgtggtggcctcagct

SEQ ID NO: 773695 - DNA, 21 bp, Homo sapiens
atgtgtgtagactgtaacttt

SEQ ID NO: 773696 - DNA, 17 bp, Homo sapiens
atgtgtgtaggttatct

SEQ ID NO: 773697 - DNA, 21 bp, Homo sapiens
atgtgtgtccacgactgtctc

SEQ ID NO: 773698 - DNA, 11 bp, Homo sapiens
atgtgtgtgag

SEQ ID NO: 773699 - DNA, 16 bp, Homo sapiens
atgtgtgtgcaagtgt

SEQ ID NO: 773700 - DNA, 15 bp, Homo sapiens
atgtgtgtgtatgtt

SEQ ID NO: 773701 - DNA, 15 bp, Homo sapiens
atgtgtgttgtgtga

SEQ ID NO: 773702 - DNA, 19 bp, Homo sapiens
atgtgtgtttaaataaagt

SEQ ID NO: 773703 - DNA, 14 bp, Homo sapiens
atgtgttaatctta

SEQ ID NO: 773704 - DNA, 21 bp, Homo sapiens
atgtgttagcactgatagtcc

SEQ ID NO: 773705 - DNA, 23 bp, Homo sapiens
atgtgttcttctttctctgtatt

SEQ ID NO: 773706 - DNA, 14 bp, Homo sapiens
atgtgttgtgatag

SEQ ID NO: 773707 - DNA, 12 bp, Homo sapiens
atgtgtttcaaa

SEQ ID NO: 773708 - DNA, 13 bp, Homo sapiens
atgtgtttctgta

SEQ ID NO: 773709 - DNA, 14 bp, Homo sapiens
atgtgtttctgtaa

SEQ ID NO: 773710 - DNA, 15 bp, Homo sapiens
atgtgtttcttgctg

SEQ ID NO: 773711 - DNA, 14 bp, Homo sapiens
atgtgtttgctgcc

SEQ ID NO: 773712 - DNA, 16 bp, Homo sapiens
atgtgtttgctgcctt

SEQ ID NO: 773713 - DNA, 17 bp, Homo sapiens
atgtgttttcatcattt

SEQ ID NO: 773714 - DNA, 15 bp, Homo sapiens
atgtgttttgcacgt

SEQ ID NO: 773715 - DNA, 21 bp, Homo sapiens
atgttaaaaaaataagaagaa

SEQ ID NO: 773716 - DNA, 16 bp, Homo sapiens
atgttaaaaatagcag

SEQ ID NO: 773717 - DNA, 17 bp, Homo sapiens
atgttaaaaatagcagt

SEQ ID NO: 773718 - DNA, 17 bp, Homo sapiens
atgttaaaatgtacttt

SEQ ID NO: 773719 - DNA, 19 bp, Homo sapiens
atgttaaagcatcagagat

SEQ ID NO: 773720 - DNA, 12 bp, Homo sapiens
atgttaaagctt

SEQ ID NO: 773721 - DNA, 21 bp, Homo sapiens
atgttaaatactgtgcagaat

SEQ ID NO: 773722 - DNA, 22 bp, Homo sapiens
atgttaaatactgtgcagaata

SEQ ID NO: 773723 - DNA, 23 bp, Homo sapiens
atgttaaatactgtgcagaataa

SEQ ID NO: 773724 - DNA, 13 bp, Homo sapiens
atgttaaatgact

SEQ ID NO: 773725 - DNA, 23 bp, Homo sapiens
atgttaaccagaataaagttctg

SEQ ID NO: 773726 - DNA, 21 bp, Homo sapiens
atgttaacctcagtgtcattt

SEQ ID NO: 773727 - DNA, 22 bp, Homo sapiens
atgttaactgagctactagaga

SEQ ID NO: 773728 - DNA, 23 bp, Homo sapiens
atgttaagaatgaagttctgcta

SEQ ID NO: 773729 - DNA, 14 bp, Homo sapiens
atgttaagcattta

SEQ ID NO: 773730 - DNA, 15 bp, Homo sapiens
atgttaagctcttta

SEQ ID NO: 773731 - DNA, 23 bp, Homo sapiens
atgttaagcttctattttttact

SEQ ID NO: 773732 - DNA, 15 bp, Homo sapiens
atgttaatctcccag

SEQ ID NO: 773733 - DNA, 20 bp, Homo sapiens
atgttaattttttggtacaa

SEQ ID NO: 773734 - DNA, 16 bp, Homo sapiens
atgttacaacaactat

SEQ ID NO: 773735 - DNA, 12 bp, Homo sapiens
atgttacaagtt

SEQ ID NO: 773736 - DNA, 17 bp, Homo sapiens
atgttacaagtttgcta

SEQ ID NO: 773737 - DNA, 21 bp, Homo sapiens
atgttacaagtttgctaaaag

SEQ ID NO: 773738 - DNA, 23 bp, Homo sapiens
atgttacaagtttgctaaaagaa

SEQ ID NO: 773739 - DNA, 14 bp, Homo sapiens
atgttacattgttt

SEQ ID NO: 773740 - DNA, 21 bp, Homo sapiens
atgttacgtgaagaaataaat

SEQ ID NO: 773741 - DNA, 23 bp, Homo sapiens
atgttactaaatggtgttacatt

SEQ ID NO: 773742 - DNA, 14 bp, Homo sapiens
cccttcccctgctg

SEQ ID NO: 773743 - DNA, 16 bp, Homo sapiens
cccttcccctgctgac

SEQ ID NO: 773744 - DNA, 19 bp, Homo sapiens
cccttcccgacccagccag

SEQ ID NO: 773745 - DNA, 16 bp, Homo sapiens
cccttccctctgggca

SEQ ID NO: 773746 - DNA, 12 bp, Homo sapiens
cccttccctgca

SEQ ID NO: 773747 - DNA, 13 bp, Homo sapiens
cccttccctgcaa

SEQ ID NO: 773748 - DNA, 13 bp, Homo sapiens
cccttccctggcc

SEQ ID NO: 773749 - DNA, 13 bp, Homo sapiens
cccttccctgggg

SEQ ID NO: 773750 - DNA, 20 bp, Homo sapiens
cccttccctggggagccctc

SEQ ID NO: 773751 - DNA, 22 bp, Homo sapiens
cccttccctggggagccctcag

SEQ ID NO: 773752 - DNA, 15 bp, Homo sapiens
cccttccctgtccct

SEQ ID NO: 773753 - DNA, 18 bp, Homo sapiens
cccttcccttggagggag

SEQ ID NO: 773754 - DNA, 17 bp, Homo sapiens
cccttccgaccctctgg

SEQ ID NO: 773755 - DNA, 21 bp, Homo sapiens
cccttccgaccctctgggaac

SEQ ID NO: 773756 - DNA, 13 bp, Homo sapiens
cccttcctaattc

SEQ ID NO: 773757 - DNA, 19 bp, Homo sapiens
cccttcctattctcctgcc

SEQ ID NO: 773758 - DNA, 22 bp, Homo sapiens
cccttcctcctgaagcctctgc

SEQ ID NO: 773759 - DNA, 20 bp, Homo sapiens
cccttcctcctgatggagtg

SEQ ID NO: 773760 - DNA, 21 bp, Homo sapiens
cccttcctcggtggctctggg

SEQ ID NO: 773761 - DNA, 13 bp, Homo sapiens
cccttcctctcca

SEQ ID NO: 773762 - DNA, 16 bp, Homo sapiens
cccttcctctccactg

SEQ ID NO: 773763 - DNA, 16 bp, Homo sapiens
cccttcctcttcctgc

SEQ ID NO: 773764 - DNA, 16 bp, Homo sapiens
cccttcctcttcggcc

SEQ ID NO: 773765 - DNA, 15 bp, Homo sapiens
cccttcctctttggt

SEQ ID NO: 773766 - DNA, 21 bp, Homo sapiens
cccttcctgccactgccgcct

SEQ ID NO: 773767 - DNA, 12 bp, Homo sapiens
cccttcctggaa

SEQ ID NO: 773768 - DNA, 13 bp, Homo sapiens
cccttcctggaaa

SEQ ID NO: 773769 - DNA, 21 bp, Homo sapiens
cccttcctggaaacagcatga

SEQ ID NO: 773770 - DNA, 15 bp, Homo sapiens
cccttcctggcccag

SEQ ID NO: 773771 - DNA, 18 bp, Homo sapiens
cccttcctggcctcactg

SEQ ID NO: 773772 - DNA, 19 bp, Homo sapiens
cccttcctgtcctgcctcc

SEQ ID NO: 773773 - DNA, 21 bp, Homo sapiens
cccttcctgtcctgcctcctc

SEQ ID NO: 773774 - DNA, 14 bp, Homo sapiens
cccttccttgggca

SEQ ID NO: 773775 - DNA, 15 bp, Homo sapiens
cccttccttgggcag

SEQ ID NO: 773776 - DNA, 16 bp, Homo sapiens
cccttccttgggcaga

SEQ ID NO: 773777 - DNA, 18 bp, Homo sapiens
cccttccttgggcgtctc

SEQ ID NO: 773778 - DNA, 13 bp, Homo sapiens
cccttcctttcct

SEQ ID NO: 773779 - DNA, 21 bp, Homo sapiens
cccttccttttccctgcttcc

SEQ ID NO: 773780 - DNA, 22 bp, Homo sapiens
cccttccttttccctgcttcca

SEQ ID NO: 773781 - DNA, 19 bp, Homo sapiens
cccttttttgtcccccaac

SEQ ID NO: 773782 - DNA, 21 bp, Homo sapiens
cccttttttgtcccccaactt

SEQ ID NO: 773783 - DNA, 15 bp, Homo sapiens
ccgaaaaatcctctt

SEQ ID NO: 773784 - DNA, 18 bp, Homo sapiens
ccgaaagcatcactgcct

SEQ ID NO: 773785 - DNA, 20 bp, Homo sapiens
ccgaacatatcatttgtgaa

SEQ ID NO: 773786 - DNA, 22 bp, Homo sapiens
ccgaagatggtggccacagact

SEQ ID NO: 773787 - DNA, 19 bp, Homo sapiens
ccgaagccccttggagaga

SEQ ID NO: 773788 - DNA, 22 bp, Homo sapiens
ccgaagccccttggagagagag

SEQ ID NO: 773789 - DNA, 17 bp, Homo sapiens
ccgaagctctggctgaa

SEQ ID NO: 773790 - DNA, 23 bp, Homo sapiens
ccgaagggaattaaaaagaagat

SEQ ID NO: 773791 - DNA, 19 bp, Homo sapiens
ccgaaggtgtctctggtct

SEQ ID NO: 773792 - DNA, 14 bp, Homo sapiens
ccgaagtcctgtca

SEQ ID NO: 773793 - DNA, 14 bp, Homo sapiens
ccgaatatattact

SEQ ID NO: 773794 - DNA, 16 bp, Homo sapiens
ccgaatcccctccctg

SEQ ID NO: 773795 - DNA, 15 bp, Homo sapiens
ccgaatgtgtcttta

SEQ ID NO: 773796 - DNA, 19 bp, Homo sapiens
ccgaatttagtcacaccat

SEQ ID NO: 773797 - DNA, 18 bp, Homo sapiens
ccgacaaccgatgctcca

SEQ ID NO: 773798 - DNA, 23 bp, Homo sapiens
ccgacacacggggctcgggcctt

SEQ ID NO: 773799 - DNA, 14 bp, Homo sapiens
ccgacactgctgca

SEQ ID NO: 773800 - DNA, 13 bp, Homo sapiens
ccgacagcctggc

SEQ ID NO: 773801 - DNA, 21 bp, Homo sapiens
ccgacagcggccttgaagaca

SEQ ID NO: 773802 - DNA, 20 bp, Homo sapiens
ccgacagtcggtgaccccat

SEQ ID NO: 773803 - DNA, 23 bp, Homo sapiens
ccgacagtcggtgaccccatcac

SEQ ID NO: 773804 - DNA, 16 bp, Homo sapiens
ccgacagtggctctcc

SEQ ID NO: 773805 - DNA, 15 bp, Homo sapiens
ccgacattgtctccc

SEQ ID NO: 773806 - DNA, 13 bp, Homo sapiens
ccgaccaactgcc

SEQ ID NO: 773807 - DNA, 15 bp, Homo sapiens
ccgaccaactgccct

SEQ ID NO: 773808 - DNA, 18 bp, Homo sapiens
ccgaccaatccccagcct

SEQ ID NO: 773809 - DNA, 15 bp, Homo sapiens
ccgacccagccagct

SEQ ID NO: 773810 - DNA, 21 bp, Homo sapiens
ccgacccagccagctgcaggg

SEQ ID NO: 773811 - DNA, 13 bp, Homo sapiens
ccgacccccctac

SEQ ID NO: 773812 - DNA, 15 bp, Homo sapiens
ccgacccgaggccca

SEQ ID NO: 773813 - DNA, 17 bp, Homo sapiens
ccgacccgaggcccaga

SEQ ID NO: 773814 - DNA, 15 bp, Homo sapiens
ccgaccctctgggaa

SEQ ID NO: 773815 - DNA, 16 bp, Homo sapiens
ccgaccctctgggaac

SEQ ID NO: 773816 - DNA, 18 bp, Homo sapiens
ccgaccctctgggaacct

SEQ ID NO: 773817 - DNA, 12 bp, Homo sapiens
ccgacctcagcc

SEQ ID NO: 773818 - DNA, 13 bp, Homo sapiens
ccgacctcagcct

SEQ ID NO: 773819 - DNA, 14 bp, Homo sapiens
ccgacctcagcctt

SEQ ID NO: 773820 - DNA, 13 bp, Homo sapiens
ccgacctcgtcct

SEQ ID NO: 773821 - DNA, 12 bp, Homo sapiens
ccgacctctctc

SEQ ID NO: 773822 - DNA, 18 bp, Homo sapiens
ccgacctctctcggcccc

SEQ ID NO: 773823 - DNA, 22 bp, Homo sapiens
ccgacgacacatatacatatga

SEQ ID NO: 773824 - DNA, 23 bp, Homo sapiens
ccgacgccgtcccaccagcttca

SEQ ID NO: 773825 - DNA, 21 bp, Homo sapiens
ccgacggcctccaggaggggc

SEQ ID NO: 773826 - DNA, 22 bp, Homo sapiens
ccgacggctgtgacgcagccgg

SEQ ID NO: 773827 - DNA, 16 bp, Homo sapiens
ccgactaccccagtcc

SEQ ID NO: 773828 - DNA, 17 bp, Homo sapiens
ccgactaccccagtccc

SEQ ID NO: 773829 - DNA, 14 bp, Homo sapiens
ccgactagcaggca

SEQ ID NO: 773830 - DNA, 11 bp, Homo sapiens
ccgactccagc

SEQ ID NO: 773831 - DNA, 20 bp, Homo sapiens
ccgactcctgggttgagctg

SEQ ID NO: 773832 - DNA, 12 bp, Homo sapiens
ccgactgcccag

SEQ ID NO: 773833 - DNA, 13 bp, Homo sapiens
ccgactgcccctg

SEQ ID NO: 773834 - DNA, 18 bp, Homo sapiens
ccgactgcccctgctgtg

SEQ ID NO: 773835 - DNA, 16 bp, Homo sapiens
ccgactgctttggacc

SEQ ID NO: 773836 - DNA, 13 bp, Homo sapiens
ccgacttgaatat

SEQ ID NO: 773837 - DNA, 23 bp, Homo sapiens
ccgacttgctgttttgttctgtg

SEQ ID NO: 773838 - DNA, 24 bp, Homo sapiens
ccgacttggagactcctggtctgt

SEQ ID NO: 773839 - DNA, 14 bp, Homo sapiens
ccgagaatgccgag

SEQ ID NO: 773840 - DNA, 20 bp, Homo sapiens
ccgagacagaccctctgccg

SEQ ID NO: 773841 - DNA, 17 bp, Homo sapiens
ccgagaccgcagaggga

SEQ ID NO: 773842 - DNA, 17 bp, Homo sapiens
ccgagacctcactttat

SEQ ID NO: 773843 - DNA, 13 bp, Homo sapiens
ccgagagaggcgc

SEQ ID NO: 773844 - DNA, 14 bp, Homo sapiens
ccgagagcctgctc

SEQ ID NO: 773845 - DNA, 15 bp, Homo sapiens
ccgagagcctgctcc

SEQ ID NO: 773846 - DNA, 20 bp, Homo sapiens
ccgagagcctgctcccccac

SEQ ID NO: 773847 - DNA, 17 bp, Homo sapiens
ccgagaggccagttgat

SEQ ID NO: 773848 - DNA, 22 bp, Homo sapiens
ccgagagtagccgagagcctgc

SEQ ID NO: 773849 - DNA, 18 bp, Homo sapiens
ccgagatccccagggcag

SEQ ID NO: 773850 - DNA, 19 bp, Homo sapiens
ccgagatccccagggcagc

SEQ ID NO: 773851 - DNA, 15 bp, Homo sapiens
ccgagattgcaccac

SEQ ID NO: 773852 - DNA, 21 bp, Homo sapiens
ccgagcaaagatcaaaataaa

SEQ ID NO: 773853 - DNA, 23 bp, Homo sapiens
ccgagcaaagatcaaaataaaaa

SEQ ID NO: 773854 - DNA, 18 bp, Homo sapiens
ccgagccacgcagtgcct

SEQ ID NO: 773855 - DNA, 23 bp, Homo sapiens
ccgagccacgcagtgcctggagt

SEQ ID NO: 773856 - DNA, 16 bp, Homo sapiens
ccgagcccagctacat

SEQ ID NO: 773857 - DNA, 18 bp, Homo sapiens
ccgagcccagctacattc

SEQ ID NO: 773858 - DNA, 20 bp, Homo sapiens
ccgagcccagctacattcct

SEQ ID NO: 773859 - DNA, 21 bp, Homo sapiens
ccgagcccagctacattcctc

SEQ ID NO: 773860 - DNA, 22 bp, Homo sapiens
ccgagcccaggcagctatttca

SEQ ID NO: 773861 - DNA, 18 bp, Homo sapiens
ccgagccctgactcctgg

SEQ ID NO: 773862 - DNA, 23 bp, Homo sapiens
ccgagccctgactcctggactcc

SEQ ID NO: 773863 - DNA, 16 bp, Homo sapiens
ccgagccgggcctggg

SEQ ID NO: 773864 - DNA, 19 bp, Homo sapiens
ccgagcgacggctcctccc

SEQ ID NO: 773865 - DNA, 20 bp, Homo sapiens
ccgagcgacggctcctcccc

SEQ ID NO: 773866 - DNA, 21 bp, Homo sapiens
ccgagcgacggctcctccccg

SEQ ID NO: 773867 - DNA, 18 bp, Homo sapiens
ccgagcgctttctggaaa

SEQ ID NO: 773868 - DNA, 16 bp, Homo sapiens
ccgagctactctcttg

SEQ ID NO: 773869 - DNA, 21 bp, Homo sapiens
ccgagctactctcttgccagc

SEQ ID NO: 773870 - DNA, 17 bp, Homo sapiens
ccgagctcctcttccat

SEQ ID NO: 773871 - DNA, 13 bp, Homo sapiens
ccgagctcctggg

SEQ ID NO: 773872 - DNA, 16 bp, Homo sapiens
ccgagctcctggggag

SEQ ID NO: 773873 - DNA, 12 bp, Homo sapiens
atgtttacattt

SEQ ID NO: 773874 - DNA, 15 bp, Homo sapiens
atgtttacctggtgc

SEQ ID NO: 773875 - DNA, 17 bp, Homo sapiens
atgtttacctggtgctc

SEQ ID NO: 773876 - DNA, 23 bp, Homo sapiens
atgtttagaaaagtattcgttac

SEQ ID NO: 773877 - DNA, 17 bp, Homo sapiens
atgtttagattccagga

SEQ ID NO: 773878 - DNA, 18 bp, Homo sapiens
atgtttatgccacagaat

SEQ ID NO: 773879 - DNA, 19 bp, Homo sapiens
atgtttattaaatgcttca

SEQ ID NO: 773880 - DNA, 20 bp, Homo sapiens
atgtttattaaatgcttcat

SEQ ID NO: 773881 - DNA, 15 bp, Homo sapiens
atgtttattacaatt

SEQ ID NO: 773882 - DNA, 14 bp, Homo sapiens
atgtttattcctga

SEQ ID NO: 773883 - DNA, 17 bp, Homo sapiens
atgtttattccttctgt

SEQ ID NO: 773884 - DNA, 14 bp, Homo sapiens
atgtttattccttg

SEQ ID NO: 773885 - DNA, 15 bp, Homo sapiens
atgtttattctagtt

SEQ ID NO: 773886 - DNA, 23 bp, Homo sapiens
atgtttattctagttaaggaaat

SEQ ID NO: 773887 - DNA, 22 bp, Homo sapiens
atgtttattgttttttaaagaa

SEQ ID NO: 773888 - DNA, 14 bp, Homo sapiens
atgtttatttcagg

SEQ ID NO: 773889 - DNA, 23 bp, Homo sapiens
atgtttatttcataaagaattgt

SEQ ID NO: 773890 - DNA, 17 bp, Homo sapiens
atgtttcacacaaacaa

SEQ ID NO: 773891 - DNA, 16 bp, Homo sapiens
atgtttcactcctgct

SEQ ID NO: 773892 - DNA, 17 bp, Homo sapiens
atgtttcactcctgctt

SEQ ID NO: 773893 - DNA, 18 bp, Homo sapiens
atgtttcaggaggctgga

SEQ ID NO: 773894 - DNA, 19 bp, Homo sapiens
atgtttccagcagaagaca

SEQ ID NO: 773895 - DNA, 15 bp, Homo sapiens
atgtttccatagttt

SEQ ID NO: 773896 - DNA, 18 bp, Homo sapiens
atgtttccatcatttctg

SEQ ID NO: 773897 - DNA, 18 bp, Homo sapiens
atgtttccccatctctgt

SEQ ID NO: 773898 - DNA, 20 bp, Homo sapiens
atgtttccccatctctgtct

SEQ ID NO: 773899 - DNA, 20 bp, Homo sapiens
atgtttcctctagttctttg

SEQ ID NO: 773900 - DNA, 17 bp, Homo sapiens
atgtttccttaaacatg

SEQ ID NO: 773901 - DNA, 23 bp, Homo sapiens
atgtttctctttgattatttgca

SEQ ID NO: 773902 - DNA, 15 bp, Homo sapiens
attaaaccacatcat

SEQ ID NO: 773903 - DNA, 21 bp, Homo sapiens
attaaacccacaagctgcctc

SEQ ID NO: 773904 - DNA, 22 bp, Homo sapiens
attaaacccacaagctgcctct

SEQ ID NO: 773905 - DNA, 14 bp, Homo sapiens
attaaaccctggat

SEQ ID NO: 773906 - DNA, 16 bp, Homo sapiens
attaaacctgtctcca

SEQ ID NO: 773907 - DNA, 20 bp, Homo sapiens
attaaacctgtctccactgt

SEQ ID NO: 773908 - DNA, 21 bp, Homo sapiens
attaaacgtatgcatgtgaag

SEQ ID NO: 773909 - DNA, 19 bp, Homo sapiens
attaaacgtgtaaattgca

SEQ ID NO: 773910 - DNA, 12 bp, Homo sapiens
attaaactcagt

SEQ ID NO: 773911 - DNA, 15 bp, Homo sapiens
attaaactgattcca

SEQ ID NO: 773912 - DNA, 13 bp, Homo sapiens
attaaactgttaa

SEQ ID NO: 773913 - DNA, 16 bp, Homo sapiens
attaaacttaatctaa

SEQ ID NO: 773914 - DNA, 21 bp, Homo sapiens
attaaacttaatctaaatgga

SEQ ID NO: 773915 - DNA, 17 bp, Homo sapiens
attaaacttccaaagaa

SEQ ID NO: 773916 - DNA, 15 bp, Homo sapiens
attaaacttccttct

SEQ ID NO: 773917 - DNA, 14 bp, Homo sapiens
attaaagaagacct

SEQ ID NO: 773918 - DNA, 15 bp, Homo sapiens
attaaagaagacctg

SEQ ID NO: 773919 - DNA, 21 bp, Homo sapiens
attaaagaagacctgagaatg

SEQ ID NO: 773920 - DNA, 22 bp, Homo sapiens
attaaagacaggagacaaaaga

SEQ ID NO: 773921 - DNA, 15 bp, Homo sapiens
attaaagactccagt

SEQ ID NO: 773922 - DNA, 15 bp, Homo sapiens
attaaagcatttaga

SEQ ID NO: 773923 - DNA, 22 bp, Homo sapiens
attaaagccctgtgttaagtgt

SEQ ID NO: 773924 - DNA, 17 bp, Homo sapiens
attaaagctcttcattt

SEQ ID NO: 773925 - DNA, 20 bp, Homo sapiens
attaaagctcttcatttctg

SEQ ID NO: 773926 - DNA, 18 bp, Homo sapiens
attaaagcttaaactgaa

SEQ ID NO: 773927 - DNA, 19 bp, Homo sapiens
attaaagcttaaactgaat

SEQ ID NO: 773928 - DNA, 13 bp, Homo sapiens
attaaaggaagga

SEQ ID NO: 773929 - DNA, 17 bp, Homo sapiens
attaaaggtcctgccct

SEQ ID NO: 773930 - DNA, 14 bp, Homo sapiens
attaaagtctgaat

SEQ ID NO: 773931 - DNA, 17 bp, Homo sapiens
attaaagtgactttcta

SEQ ID NO: 773932 - DNA, 18 bp, Homo sapiens
attaaagtgatactgaaa

SEQ ID NO: 773933 - DNA, 13 bp, Homo sapiens
attaaataaattt

SEQ ID NO: 773934 - DNA, 18 bp, Homo sapiens
attaaataacttgaagag

SEQ ID NO: 773935 - DNA, 13 bp, Homo sapiens
attaaatacatat

SEQ ID NO: 773936 - DNA, 13 bp, Homo sapiens
attaaatataaat

SEQ ID NO: 773937 - DNA, 15 bp, Homo sapiens
attaaatataatatg

SEQ ID NO: 773938 - DNA, 16 bp, Homo sapiens
attaaatatatgtatg

SEQ ID NO: 773939 - DNA, 16 bp, Homo sapiens
attaaatctagacatt

SEQ ID NO: 773940 - DNA, 18 bp, Homo sapiens
attaaatctagacattct

SEQ ID NO: 773941 - DNA, 19 bp, Homo sapiens
attaaatctagacattctt

SEQ ID NO: 773942 - DNA, 17 bp, Homo sapiens
attaaatcttaaacaat

SEQ ID NO: 773943 - DNA, 18 bp, Homo sapiens
attaaatcttaaacaatg

SEQ ID NO: 773944 - DNA, 15 bp, Homo sapiens
attaaatgccttgta

SEQ ID NO: 773945 - DNA, 17 bp, Homo sapiens
attaaatgccttgtata

SEQ ID NO: 773946 - DNA, 21 bp, Homo sapiens
attaaatgtagcttcagtcat

SEQ ID NO: 773947 - DNA, 15 bp, Homo sapiens
attaaatgtctgaca

SEQ ID NO: 773948 - DNA, 16 bp, Homo sapiens
attaaatgtgtcattg

SEQ ID NO: 773949 - DNA, 13 bp, Homo sapiens
attaaattaagac

SEQ ID NO: 773950 - DNA, 22 bp, Homo sapiens
attaaattactatagcaaagta

SEQ ID NO: 773951 - DNA, 18 bp, Homo sapiens
attaaattaggaataaat

SEQ ID NO: 773952 - DNA, 11 bp, Homo sapiens
attaaattatg

SEQ ID NO: 773953 - DNA, 13 bp, Homo sapiens
attaaattcacaa

SEQ ID NO: 773954 - DNA, 18 bp, Homo sapiens
attaaattcacaaacttt

SEQ ID NO: 773955 - DNA, 18 bp, Homo sapiens
attaaattcttgcaaagt

SEQ ID NO: 773956 - DNA, 13 bp, Homo sapiens
attaaatttaact

SEQ ID NO: 773957 - DNA, 18 bp, Homo sapiens
attaaatttcaaatgcag

SEQ ID NO: 773958 - DNA, 20 bp, Homo sapiens
attaaatttcaaatgcagaa

SEQ ID NO: 773959 - DNA, 19 bp, Homo sapiens
attaaattttttttacatt

SEQ ID NO: 773960 - DNA, 12 bp, Homo sapiens
attaacaaaagt

SEQ ID NO: 773961 - DNA, 18 bp, Homo sapiens
attaacaaaatgtatgtc

SEQ ID NO: 773962 - DNA, 14 bp, Homo sapiens
attaacaaattatg

SEQ ID NO: 773963 - DNA, 15 bp, Homo sapiens
attaacaaatttctt

SEQ ID NO: 773964 - DNA, 18 bp, Homo sapiens
attaacaaatttctttgt

SEQ ID NO: 773965 - DNA, 18 bp, Homo sapiens
attaacaattaattgtct

SEQ ID NO: 773966 - DNA, 13 bp, Homo sapiens
attaacacaaagg

SEQ ID NO: 773967 - DNA, 18 bp, Homo sapiens
attaacacagtgtttcaa

SEQ ID NO: 773968 - DNA, 19 bp, Homo sapiens
attaacacagtgtttcaat

SEQ ID NO: 773969 - DNA, 15 bp, Homo sapiens
attaacagtatttct

SEQ ID NO: 773970 - DNA, 14 bp, Homo sapiens
attaacagttttcc

SEQ ID NO: 773971 - DNA, 21 bp, Homo sapiens
attaacagttttccatgaaaa

SEQ ID NO: 773972 - DNA, 23 bp, Homo sapiens
attaacagttttccatgaaaacg

SEQ ID NO: 773973 - DNA, 18 bp, Homo sapiens
attaaccacttcagctga

SEQ ID NO: 773974 - DNA, 20 bp, Homo sapiens
attaaccacttcagctgact

SEQ ID NO: 773975 - DNA, 15 bp, Homo sapiens
attaaccatagatgt

SEQ ID NO: 773976 - DNA, 16 bp, Homo sapiens
attaaccatttaataa

SEQ ID NO: 773977 - DNA, 18 bp, Homo sapiens
attaaccccataattaga

SEQ ID NO: 773978 - DNA, 13 bp, Homo sapiens
attaacctctgca

SEQ ID NO: 773979 - DNA, 16 bp, Homo sapiens
attaacctggtgctgg

SEQ ID NO: 773980 - DNA, 17 bp, Homo sapiens
attaacctggtgctgga

SEQ ID NO: 773981 - DNA, 21 bp, Homo sapiens
attaaccttttttgtcttatt

SEQ ID NO: 773982 - DNA, 22 bp, Homo sapiens
attaaccttttttgtcttattg

SEQ ID NO: 773983 - DNA, 23 bp, Homo sapiens
attaaccttttttgtcttattga

SEQ ID NO: 773984 - DNA, 17 bp, Homo sapiens
attaacgggcatgtatt

SEQ ID NO: 773985 - DNA, 18 bp, Homo sapiens
attaacgggcatgtatta

SEQ ID NO: 773986 - DNA, 14 bp, Homo sapiens
attaacggtgctaa

SEQ ID NO: 773987 - DNA, 15 bp, Homo sapiens
attaacggtgctaaa

SEQ ID NO: 773988 - DNA, 17 bp, Homo sapiens
attaactaatctattgg

SEQ ID NO: 773989 - DNA, 17 bp, Homo sapiens
attaactactgaataat

SEQ ID NO: 773990 - DNA, 17 bp, Homo sapiens
attaactccctccacca

SEQ ID NO: 773991 - DNA, 23 bp, Homo sapiens
attaactccctccaccagcctgc

SEQ ID NO: 773992 - DNA, 22 bp, Homo sapiens
attaactgagtagctctcctga

SEQ ID NO: 773993 - DNA, 19 bp, Homo sapiens
attaactgctccaaattta

SEQ ID NO: 773994 - DNA, 23 bp, Homo sapiens
attaactgctccaaatttaacca

SEQ ID NO: 773995 - DNA, 22 bp, Homo sapiens
attaactgggtaatgaaacaaa

SEQ ID NO: 773996 - DNA, 13 bp, Homo sapiens
attaacttaactg

SEQ ID NO: 773997 - DNA, 14 bp, Homo sapiens
attaacttaactga

SEQ ID NO: 773998 - DNA, 14 bp, Homo sapiens
attaacttatttag

SEQ ID NO: 773999 - DNA, 17 bp, Homo sapiens
attaacttatttagaga

SEQ ID NO: 774000 - DNA, 18 bp, Homo sapiens
attaacttatttagagat

SEQ ID NO: 774001 - DNA, 13 bp, Homo sapiens
attaacttttaat

SEQ ID NO: 774002 - DNA, 14 bp, Homo sapiens
attaacttttaatg

SEQ ID NO: 774003 - DNA, 15 bp, Homo sapiens
attaacttttaatgg

SEQ ID NO: 774004 - DNA, 16 bp, Homo sapiens
ccgccccacctcccat

SEQ ID NO: 774005 - DNA, 18 bp, Homo sapiens
ccgccccagagtggccca

SEQ ID NO: 774006 - DNA, 14 bp, Homo sapiens
ccgccccagccctc

SEQ ID NO: 774007 - DNA, 11 bp, Homo sapiens
ccgccccaggc

SEQ ID NO: 774008 - DNA, 14 bp, Homo sapiens
ccgcccccacccct

SEQ ID NO: 774009 - DNA, 20 bp, Homo sapiens
ccgcccccaccgggctgcag

SEQ ID NO: 774010 - DNA, 14 bp, Homo sapiens
ccgcccccagccta

SEQ ID NO: 774011 - DNA, 19 bp, Homo sapiens
ccgccccccacacttccct

SEQ ID NO: 774012 - DNA, 13 bp, Homo sapiens
ccgccccccagag

SEQ ID NO: 774013 - DNA, 15 bp, Homo sapiens
ccgccccccagagcc

SEQ ID NO: 774014 - DNA, 20 bp, Homo sapiens
ccgccccccagagccagggc

SEQ ID NO: 774015 - DNA, 12 bp, Homo sapiens
ccgccccctcct

SEQ ID NO: 774016 - DNA, 18 bp, Homo sapiens
ccgccccgggctggccct

SEQ ID NO: 774017 - DNA, 22 bp, Homo sapiens
ccgccccggggactcgcagcac

SEQ ID NO: 774018 - DNA, 16 bp, Homo sapiens
ccgcccctccacccat

SEQ ID NO: 774019 - DNA, 21 bp, Homo sapiens
ccgcccctcgctgctgctact

SEQ ID NO: 774020 - DNA, 17 bp, Homo sapiens
ccgcccctgcctgccat

SEQ ID NO: 774021 - DNA, 18 bp, Homo sapiens
ccgcccctgtggccctgg

SEQ ID NO: 774022 - DNA, 17 bp, Homo sapiens
ccgccctctgcctcctc

SEQ ID NO: 774023 - DNA, 13 bp, Homo sapiens
ccgccctcttcct

SEQ ID NO: 774024 - DNA, 13 bp, Homo sapiens
ccgccctgccact

SEQ ID NO: 774025 - DNA, 11 bp, Homo sapiens
ccgctgccacc

SEQ ID NO: 774026 - DNA, 22 bp, Homo sapiens
ccgctgccaccacgtctgccag

SEQ ID NO: 774027 - DNA, 24 bp, Homo sapiens
ccgctgccacccacctccctgcct

SEQ ID NO: 774028 - DNA, 12 bp, Homo sapiens
ccgctgccagca

SEQ ID NO: 774029 - DNA, 15 bp, Homo sapiens
ccgctgccagcacag

SEQ ID NO: 774030 - DNA, 16 bp, Homo sapiens
ccgctgccagcacaga

SEQ ID NO: 774031 - DNA, 16 bp, Homo sapiens
ccgctgcccctccccg

SEQ ID NO: 774032 - DNA, 15 bp, Homo sapiens
ccgctgccctttggc

SEQ ID NO: 774033 - DNA, 21 bp, Homo sapiens
ccgctgccctttggccaacag

SEQ ID NO: 774034 - DNA, 15 bp, Homo sapiens
ccgctgccgctgcac

SEQ ID NO: 774035 - DNA, 17 bp, Homo sapiens
ccgctgccgctgcacca

SEQ ID NO: 774036 - DNA, 18 bp, Homo sapiens
ccgctgccgctgcaccac

SEQ ID NO: 774037 - DNA, 12 bp, Homo sapiens
ccgctgcctcct

SEQ ID NO: 774038 - DNA, 13 bp, Homo sapiens
ccgctgcctcttg

SEQ ID NO: 774039 - DNA, 22 bp, Homo sapiens
ccgctgcctcttggcttctcag

SEQ ID NO: 774040 - DNA, 19 bp, Homo sapiens
ccgctgcgtgccatcactc

SEQ ID NO: 774041 - DNA, 18 bp, Homo sapiens
ccgctgctccttggctta

SEQ ID NO: 774042 - DNA, 16 bp, Homo sapiens
ccgctgctgctgctgc

SEQ ID NO: 774043 - DNA, 13 bp, Homo sapiens
ccgctgctgtgct

SEQ ID NO: 774044 - DNA, 13 bp, Homo sapiens
ccgctggagccca

SEQ ID NO: 774045 - DNA, 12 bp, Homo sapiens
ccgctggaggat

SEQ ID NO: 774046 - DNA, 21 bp, Homo sapiens
ccgctggaggatgtgggcagc

SEQ ID NO: 774047 - DNA, 20 bp, Homo sapiens
ccgctgggtggttttttccc

SEQ ID NO: 774048 - DNA, 16 bp, Homo sapiens
ccgctgtcgccccagg

SEQ ID NO: 774049 - DNA, 22 bp, Homo sapiens
ccgctgtcgccccaggccctcc

SEQ ID NO: 774050 - DNA, 15 bp, Homo sapiens
ccgctgtgagcccct

SEQ ID NO: 774051 - DNA, 18 bp, Homo sapiens
ccgctgtgagcccctggt

SEQ ID NO: 774052 - DNA, 23 bp, Homo sapiens
ccgctgtgtagggaccagtggga

SEQ ID NO: 774053 - DNA, 16 bp, Homo sapiens
ccgcttagcctgcctc

SEQ ID NO: 774054 - DNA, 18 bp, Homo sapiens
ccgcttagcctgcctcac

SEQ ID NO: 774055 - DNA, 12 bp, Homo sapiens
ccgcttcaagct

SEQ ID NO: 774056 - DNA, 15 bp, Homo sapiens
ccgcttcaagctctc

SEQ ID NO: 774057 - DNA, 16 bp, Homo sapiens
ccgcttcaagctctct

SEQ ID NO: 774058 - DNA, 18 bp, Homo sapiens
ccgcttcacccctgcact

SEQ ID NO: 774059 - DNA, 15 bp, Homo sapiens
ccgcttggagcagag

SEQ ID NO: 774060 - DNA, 17 bp, Homo sapiens
ccgcttggagcagaggg

SEQ ID NO: 774061 - DNA, 18 bp, Homo sapiens
ccgcttggagcagagggg

SEQ ID NO: 774062 - DNA, 17 bp, Homo sapiens
ccgcttggtggcctggg

SEQ ID NO: 774063 - DNA, 16 bp, Homo sapiens
ccgcttgtccagcgcc

SEQ ID NO: 774064 - DNA, 19 bp, Homo sapiens
ccgcttgtggggacccagg

SEQ ID NO: 774065 - DNA, 21 bp, Homo sapiens
ccgcttgtggggacccaggct

SEQ ID NO: 774066 - DNA, 13 bp, Homo sapiens
ccggaactgggct

SEQ ID NO: 774067 - DNA, 21 bp, Homo sapiens
ccggaaggaatgtcagggcca

SEQ ID NO: 774068 - DNA, 23 bp, Homo sapiens
ccggaaggaggccaaccagcccg

SEQ ID NO: 774069 - DNA, 12 bp, Homo sapiens
ccggaaggaggg

SEQ ID NO: 774070 - DNA, 19 bp, Homo sapiens
ccggaatagagcctcgtct

SEQ ID NO: 774071 - DNA, 13 bp, Homo sapiens
ccggacaggtggg

SEQ ID NO: 774072 - DNA, 22 bp, Homo sapiens
ccggacccggccgccgccagga

SEQ ID NO: 774073 - DNA, 19 bp, Homo sapiens
ccggaccgccgatcccagg

SEQ ID NO: 774074 - DNA, 13 bp, Homo sapiens
ccggacctacctc

SEQ ID NO: 774075 - DNA, 15 bp, Homo sapiens
ccggacttttctgca

SEQ ID NO: 774076 - DNA, 20 bp, Homo sapiens
ccggagagctggtgactttg

SEQ ID NO: 774077 - DNA, 17 bp, Homo sapiens
ccggagattggacggcc

SEQ ID NO: 774078 - DNA, 20 bp, Homo sapiens
ccggagattggacggcctga

SEQ ID NO: 774079 - DNA, 21 bp, Homo sapiens
ccggagattggacggcctgat

SEQ ID NO: 774080 - DNA, 17 bp, Homo sapiens
ccggagcaaactctgct

SEQ ID NO: 774081 - DNA, 19 bp, Homo sapiens
ccggagcaaactctgctgt

SEQ ID NO: 774082 - DNA, 13 bp, Homo sapiens
ccggagcacagcc

SEQ ID NO: 774083 - DNA, 15 bp, Homo sapiens
ccggagcacagccct

SEQ ID NO: 774084 - DNA, 22 bp, Homo sapiens
ccggagccatcaccctcaccca

SEQ ID NO: 774085 - DNA, 19 bp, Homo sapiens
ccggagctaagtcacccag

SEQ ID NO: 774086 - DNA, 14 bp, Homo sapiens
ccggaggaaatctg

SEQ ID NO: 774087 - DNA, 18 bp, Homo sapiens
ccggaggactgagccccc

SEQ ID NO: 774088 - DNA, 19 bp, Homo sapiens
ccggaggactgagccccca

SEQ ID NO: 774089 - DNA, 20 bp, Homo sapiens
ccggaggactgagcccccac

SEQ ID NO: 774090 - DNA, 22 bp, Homo sapiens
ccggaggactgagcccccaccg

SEQ ID NO: 774091 - DNA, 14 bp, Homo sapiens
ccggaggagcagcc

SEQ ID NO: 774092 - DNA, 17 bp, Homo sapiens
ccggaggagcagcctcg

SEQ ID NO: 774093 - DNA, 15 bp, Homo sapiens
ccggaggaggagatg

SEQ ID NO: 774094 - DNA, 17 bp, Homo sapiens
ccggaggcagcagacac

SEQ ID NO: 774095 - DNA, 23 bp, Homo sapiens
ccggagggacgcggaggaggaag

SEQ ID NO: 774096 - DNA, 16 bp, Homo sapiens
ccggaggggcctggca

SEQ ID NO: 774097 - DNA, 18 bp, Homo sapiens
ccggagggtgtttatgta

SEQ ID NO: 774098 - DNA, 21 bp, Homo sapiens
ccggagtaatcaggcagcctt

SEQ ID NO: 774099 - DNA, 13 bp, Homo sapiens
ccggatcagagca

SEQ ID NO: 774100 - DNA, 19 bp, Homo sapiens
ccggatcagagcaggacct

SEQ ID NO: 774101 - DNA, 20 bp, Homo sapiens
ccggatcagagcaggacctc

SEQ ID NO: 774102 - DNA, 16 bp, Homo sapiens
ccggatctgagggaga

SEQ ID NO: 774103 - DNA, 13 bp, Homo sapiens
ccggatgtgcttt

SEQ ID NO: 774104 - DNA, 20 bp, Homo sapiens
ccggcaaccccagttctgct

SEQ ID NO: 774105 - DNA, 22 bp, Homo sapiens
ccggcaaccccagttctgctcc

SEQ ID NO: 774106 - DNA, 18 bp, Homo sapiens
ccggcaagcgagcacagt

SEQ ID NO: 774107 - DNA, 19 bp, Homo sapiens
ccggcacagatgctccagg

SEQ ID NO: 774108 - DNA, 19 bp, Homo sapiens
ccggcacagggtctgctct

SEQ ID NO: 774109 - DNA, 20 bp, Homo sapiens
ccggcacagggtctgctctt

SEQ ID NO: 774110 - DNA, 16 bp, Homo sapiens
ccggcagccagatggc

SEQ ID NO: 774111 - DNA, 20 bp, Homo sapiens
ccggcagccagatggccccg

SEQ ID NO: 774112 - DNA, 15 bp, Homo sapiens
ccggcatccttgcct

SEQ ID NO: 774113 - DNA, 20 bp, Homo sapiens
ccggcatccttgcctgtcta

SEQ ID NO: 774114 - DNA, 14 bp, Homo sapiens
ccggcatgggaaag

SEQ ID NO: 774115 - DNA, 18 bp, Homo sapiens
ccggccaatggaaacctc

SEQ ID NO: 774116 - DNA, 14 bp, Homo sapiens
ccggccacagctgc

SEQ ID NO: 774117 - DNA, 19 bp, Homo sapiens
ccggcccagagaccccttc

SEQ ID NO: 774118 - DNA, 21 bp, Homo sapiens
ccggccccaccccctgggcag

SEQ ID NO: 774119 - DNA, 13 bp, Homo sapiens
ccggccccagcca

SEQ ID NO: 774120 - DNA, 17 bp, Homo sapiens
ccggccccagccagagt

SEQ ID NO: 774121 - DNA, 18 bp, Homo sapiens
ccggccccagccagagtt

SEQ ID NO: 774122 - DNA, 16 bp, Homo sapiens
ccggccccggccccag

SEQ ID NO: 774123 - DNA, 13 bp, Homo sapiens
ccggcccctcacc

SEQ ID NO: 774124 - DNA, 15 bp, Homo sapiens
ccggcccctcaccct

SEQ ID NO: 774125 - DNA, 19 bp, Homo sapiens
ccggcccctcaccctctgt

SEQ ID NO: 774126 - DNA, 15 bp, Homo sapiens
ccggcccctggcagc

SEQ ID NO: 774127 - DNA, 16 bp, Homo sapiens
ccggcccctggcagca

SEQ ID NO: 774128 - DNA, 19 bp, Homo sapiens
ccggccctcccccagctcc

SEQ ID NO: 774129 - DNA, 18 bp, Homo sapiens
ccggccgccttctcccct

SEQ ID NO: 774130 - DNA, 19 bp, Homo sapiens
ccggccggacctctgagca

SEQ ID NO: 774131 - DNA, 18 bp, Homo sapiens
ccggcctctctggcctcc

SEQ ID NO: 774132 - DNA, 15 bp, Homo sapiens
ccggcctctgctgcc

SEQ ID NO: 774133 - DNA, 19 bp, Homo sapiens
ccggcctctgctgccccct

SEQ ID NO: 774134 - DNA, 21 bp, Homo sapiens
ccggcctctgctgcccccttc

SEQ ID NO: 774135 - DNA, 13 bp, Homo sapiens
attacaattttat

SEQ ID NO: 774136 - DNA, 22 bp, Homo sapiens
attacaatttttaataaattga

SEQ ID NO: 774137 - DNA, 18 bp, Homo sapiens
attacacaataaagcagt

SEQ ID NO: 774138 - DNA, 17 bp, Homo sapiens
attacacttgtctttac

SEQ ID NO: 774139 - DNA, 22 bp, Homo sapiens
attacagagaggagaaacacat

SEQ ID NO: 774140 - DNA, 15 bp, Homo sapiens
attacagaggaagtt

SEQ ID NO: 774141 - DNA, 23 bp, Homo sapiens
attacagagggctcattttctac

SEQ ID NO: 774142 - DNA, 15 bp, Homo sapiens
attacagctggagaa

SEQ ID NO: 774143 - DNA, 20 bp, Homo sapiens
attacaggcatgtgccacca

SEQ ID NO: 774144 - DNA, 16 bp, Homo sapiens
attacagggtgactca

SEQ ID NO: 774145 - DNA, 22 bp, Homo sapiens
attacagtatccaatgtctttt

SEQ ID NO: 774146 - DNA, 15 bp, Homo sapiens
attacagtgcagttt

SEQ ID NO: 774147 - DNA, 22 bp, Homo sapiens
attagcaattgactgtcactgt

SEQ ID NO: 774148 - DNA, 14 bp, Homo sapiens
attagcagaatgga

SEQ ID NO: 774149 - DNA, 19 bp, Homo sapiens
attagcaggtgcaccttct

SEQ ID NO: 774150 - DNA, 13 bp, Homo sapiens
attagcatgcaag

SEQ ID NO: 774151 - DNA, 23 bp, Homo sapiens
attagcatgcaagcttggtcaaa

SEQ ID NO: 774152 - DNA, 15 bp, Homo sapiens
attagccctgcattt

SEQ ID NO: 774153 - DNA, 17 bp, Homo sapiens
attagccctgcattttc

SEQ ID NO: 774154 - DNA, 18 bp, Homo sapiens
attagctcactgaatctt

SEQ ID NO: 774155 - DNA, 20 bp, Homo sapiens
attagctttactgtttgtta

SEQ ID NO: 774156 - DNA, 14 bp, Homo sapiens
attagctttctcct

SEQ ID NO: 774157 - DNA, 15 bp, Homo sapiens
attaggaaaatatgg

SEQ ID NO: 774158 - DNA, 19 bp, Homo sapiens
attaggaaccttgcaacgg

SEQ ID NO: 774159 - DNA, 22 bp, Homo sapiens
attaggagaaacacattcttat

SEQ ID NO: 774160 - DNA, 17 bp, Homo sapiens
attaggagtaactttca

SEQ ID NO: 774161 - DNA, 11 bp, Homo sapiens
attaggcaaag

SEQ ID NO: 774162 - DNA, 20 bp, Homo sapiens
attaggcaaagtacaaaatt

SEQ ID NO: 774163 - DNA, 18 bp, Homo sapiens
attaggccagcaacgctt

SEQ ID NO: 774164 - DNA, 14 bp, Homo sapiens
attaggctgtaact

SEQ ID NO: 774165 - DNA, 21 bp, Homo sapiens
attaggctgtaactactttat

SEQ ID NO: 774166 - DNA, 22 bp, Homo sapiens
attaggctgtaactactttata

SEQ ID NO: 774167 - DNA, 12 bp, Homo sapiens
attaggctgttg

SEQ ID NO: 774168 - DNA, 23 bp, Homo sapiens
attagggaaaatggatatagaaa

SEQ ID NO: 774169 - DNA, 20 bp, Homo sapiens
attaggtcgttttccaaaga

SEQ ID NO: 774170 - DNA, 19 bp, Homo sapiens
attaggtggaaattttata

SEQ ID NO: 774171 - DNA, 16 bp, Homo sapiens
attaggttgaaacata

SEQ ID NO: 774172 - DNA, 20 bp, Homo sapiens
attagtaaatatgtgaagaa

SEQ ID NO: 774173 - DNA, 17 bp, Homo sapiens
attagtaacatgtgtta

SEQ ID NO: 774174 - DNA, 16 bp, Homo sapiens
attagtagaaatgcca

SEQ ID NO: 774175 - DNA, 18 bp, Homo sapiens
attagtagaaatgccaga

SEQ ID NO: 774176 - DNA, 22 bp, Homo sapiens
attagtagaaatgccagaaaca

SEQ ID NO: 774177 - DNA, 13 bp, Homo sapiens
attagtataatat

SEQ ID NO: 774178 - DNA, 19 bp, Homo sapiens
attagtataatatttctta

SEQ ID NO: 774179 - DNA, 21 bp, Homo sapiens
attagtatggttcaagattgt

SEQ ID NO: 774180 - DNA, 13 bp, Homo sapiens
attagtatgtctg

SEQ ID NO: 774181 - DNA, 13 bp, Homo sapiens
attagtattcagg

SEQ ID NO: 774182 - DNA, 18 bp, Homo sapiens
attagtattcaggcactg

SEQ ID NO: 774183 - DNA, 13 bp, Homo sapiens
attagtattgttg

SEQ ID NO: 774184 - DNA, 15 bp, Homo sapiens
attagtattgttgtc

SEQ ID NO: 774185 - DNA, 21 bp, Homo sapiens
attagtctatcaaatgaaact

SEQ ID NO: 774186 - DNA, 18 bp, Homo sapiens
attagtcttttgtaatat

SEQ ID NO: 774187 - DNA, 13 bp, Homo sapiens
attagtgaagatg

SEQ ID NO: 774188 - DNA, 18 bp, Homo sapiens
attagtgaccattattca

SEQ ID NO: 774189 - DNA, 17 bp, Homo sapiens
attagtgattctgattt

SEQ ID NO: 774190 - DNA, 22 bp, Homo sapiens
attagtgattctgatttcagtt

SEQ ID NO: 774191 - DNA, 23 bp, Homo sapiens
attagtgcagccaagtagcctct

SEQ ID NO: 774192 - DNA, 20 bp, Homo sapiens
attagtgccacttaatgtat

SEQ ID NO: 774193 - DNA, 21 bp, Homo sapiens
attagtgccacttaatgtatg

SEQ ID NO: 774194 - DNA, 17 bp, Homo sapiens
attagtggtcataaaat

SEQ ID NO: 774195 - DNA, 20 bp, Homo sapiens
attagtggtcataaaataga

SEQ ID NO: 774196 - DNA, 13 bp, Homo sapiens
attagtgtccccc

SEQ ID NO: 774197 - DNA, 20 bp, Homo sapiens
attagtgtgacagtttccaa

SEQ ID NO: 774198 - DNA, 15 bp, Homo sapiens
attagttaaaacaca

SEQ ID NO: 774199 - DNA, 20 bp, Homo sapiens
attagttccagtttctcctt

SEQ ID NO: 774200 - DNA, 18 bp, Homo sapiens
attagttccccaaataca

SEQ ID NO: 774201 - DNA, 20 bp, Homo sapiens
attagttggctttcataaat

SEQ ID NO: 774202 - DNA, 20 bp, Homo sapiens
attagtttacctcatccatg

SEQ ID NO: 774203 - DNA, 18 bp, Homo sapiens
attagtttcctttttaat

SEQ ID NO: 774204 - DNA, 20 bp, Homo sapiens
attagtttcctttttaatat

SEQ ID NO: 774205 - DNA, 20 bp, Homo sapiens
attataaaaaatgtaacatc

SEQ ID NO: 774206 - DNA, 15 bp, Homo sapiens
attataaaaacactt

SEQ ID NO: 774207 - DNA, 16 bp, Homo sapiens
attataaaaacactta

SEQ ID NO: 774208 - DNA, 13 bp, Homo sapiens
attataaaaatat

SEQ ID NO: 774209 - DNA, 15 bp, Homo sapiens
attataaaaattaca

SEQ ID NO: 774210 - DNA, 18 bp, Homo sapiens
attataaactataaactt

SEQ ID NO: 774211 - DNA, 19 bp, Homo sapiens
attataaactataaactta

SEQ ID NO: 774212 - DNA, 21 bp, Homo sapiens
attataaagccaattatctga

SEQ ID NO: 774213 - DNA, 18 bp, Homo sapiens
attataaaggataaagaa

SEQ ID NO: 774214 - DNA, 22 bp, Homo sapiens
attataaaggataaagaaggat

SEQ ID NO: 774215 - DNA, 15 bp, Homo sapiens
attataacagttata

SEQ ID NO: 774216 - DNA, 14 bp, Homo sapiens
attataactagaca

SEQ ID NO: 774217 - DNA, 18 bp, Homo sapiens
attataagccctgcataa

SEQ ID NO: 774218 - DNA, 20 bp, Homo sapiens
attataagccctgcataatg

SEQ ID NO: 774219 - DNA, 21 bp, Homo sapiens
attataagccctgcataatgt

SEQ ID NO: 774220 - DNA, 23 bp, Homo sapiens
attataagggagagctgagccag

SEQ ID NO: 774221 - DNA, 15 bp, Homo sapiens
attataagggccctg

SEQ ID NO: 774222 - DNA, 19 bp, Homo sapiens
attataatactaaaactca

SEQ ID NO: 774223 - DNA, 18 bp, Homo sapiens
attataatcaaagctcat

SEQ ID NO: 774224 - DNA, 14 bp, Homo sapiens
attataatctcaaa

SEQ ID NO: 774225 - DNA, 13 bp, Homo sapiens
attataattgttg

SEQ ID NO: 774226 - DNA, 23 bp, Homo sapiens
attataatttttttcaatattta

SEQ ID NO: 774227 - DNA, 22 bp, Homo sapiens
attatacagaccgaactgttgt

SEQ ID NO: 774228 - DNA, 18 bp, Homo sapiens
attataccatgtgtgcta

SEQ ID NO: 774229 - DNA, 17 bp, Homo sapiens
attatactaagaaaaga

SEQ ID NO: 774230 - DNA, 19 bp, Homo sapiens
attatactaagaaaagata

SEQ ID NO: 774231 - DNA, 20 bp, Homo sapiens
attatactgtagctgatgaa

SEQ ID NO: 774232 - DNA, 23 bp, Homo sapiens
attatactgtagctgatgaaact

SEQ ID NO: 774233 - DNA, 15 bp, Homo sapiens
attatactgtgtgtg

SEQ ID NO: 774234 - DNA, 16 bp, Homo sapiens
attatactgtgtgtga

SEQ ID NO: 774235 - DNA, 12 bp, Homo sapiens
attatacttgag

SEQ ID NO: 774236 - DNA, 21 bp, Homo sapiens
attatagaaaattatttgtat

SEQ ID NO: 774237 - DNA, 14 bp, Homo sapiens
attatagaattgca

SEQ ID NO: 774238 - DNA, 20 bp, Homo sapiens
attatagacaacgatgaatt

SEQ ID NO: 774239 - DNA, 23 bp, Homo sapiens
attatagacaacgatgaatttct

SEQ ID NO: 774240 - DNA, 17 bp, Homo sapiens
attataggatcatttgt

SEQ ID NO: 774241 - DNA, 19 bp, Homo sapiens
attatataactgtatttga

SEQ ID NO: 774242 - DNA, 14 bp, Homo sapiens
attatatatttaca

SEQ ID NO: 774243 - DNA, 17 bp, Homo sapiens
attatatatttacagaa

SEQ ID NO: 774244 - DNA, 19 bp, Homo sapiens
attatatatttacagaaga

SEQ ID NO: 774245 - DNA, 20 bp, Homo sapiens
attatatgggtatatattca

SEQ ID NO: 774246 - DNA, 14 bp, Homo sapiens
attatattcacaga

SEQ ID NO: 774247 - DNA, 14 bp, Homo sapiens
attatattctctta

SEQ ID NO: 774248 - DNA, 21 bp, Homo sapiens
attatatttctacagagaaaa

SEQ ID NO: 774249 - DNA, 18 bp, Homo sapiens
attatatttgaaatcgtt

SEQ ID NO: 774250 - DNA, 20 bp, Homo sapiens
attatatttgaattgacagg

SEQ ID NO: 774251 - DNA, 20 bp, Homo sapiens
attatatttgacatgggtat

SEQ ID NO: 774252 - DNA, 13 bp, Homo sapiens
attatatttgcat

SEQ ID NO: 774253 - DNA, 17 bp, Homo sapiens
attatatttgcattatg

SEQ ID NO: 774254 - DNA, 18 bp, Homo sapiens
attatatttgcattatgt

SEQ ID NO: 774255 - DNA, 17 bp, Homo sapiens
attatcaatatctaata

SEQ ID NO: 774256 - DNA, 16 bp, Homo sapiens
attatcaatattgagg

SEQ ID NO: 774257 - DNA, 23 bp, Homo sapiens
attatcacattaatctcaaagag

SEQ ID NO: 774258 - DNA, 15 bp, Homo sapiens
attatcagcaaagaa

SEQ ID NO: 774259 - DNA, 20 bp, Homo sapiens
attatcatggtatttgacca

SEQ ID NO: 774260 - DNA, 12 bp, Homo sapiens
attatcattgct

SEQ ID NO: 774261 - DNA, 19 bp, Homo sapiens
attatccattacgtgcatt

SEQ ID NO: 774262 - DNA, 20 bp, Homo sapiens
attatccattacgtgcattt

SEQ ID NO: 774263 - DNA, 21 bp, Homo sapiens
attatcctcctgttctgaaac

SEQ ID NO: 774264 - DNA, 22 bp, Homo sapiens
ccggtcccttgagacctcagcc

SEQ ID NO: 774265 - DNA, 19 bp, Homo sapiens
ccggtcgggcagccagcag

SEQ ID NO: 774266 - DNA, 20 bp, Homo sapiens
ccggtcgggcagccagcaga

SEQ ID NO: 774267 - DNA, 22 bp, Homo sapiens
ccggtctatgtcgagagctggc

SEQ ID NO: 774268 - DNA, 15 bp, Homo sapiens
ccgtggcacagctgg

SEQ ID NO: 774269 - DNA, 21 bp, Homo sapiens
ccgtggcctggcatctgtgcg

SEQ ID NO: 774270 - DNA, 16 bp, Homo sapiens
ccgtggctctgggaga

SEQ ID NO: 774271 - DNA, 17 bp, Homo sapiens
ccgtggctctgggagag

SEQ ID NO: 774272 - DNA, 22 bp, Homo sapiens
ccgtggcttgggctggtcagag

SEQ ID NO: 774273 - DNA, 17 bp, Homo sapiens
ccgtgggtcattacaaa

SEQ ID NO: 774274 - DNA, 15 bp, Homo sapiens
ccgtggtatgtctgc

SEQ ID NO: 774275 - DNA, 18 bp, Homo sapiens
ccgtggtatgtctgccat

SEQ ID NO: 774276 - DNA, 14 bp, Homo sapiens
ccgtgtcccaagga

SEQ ID NO: 774277 - DNA, 15 bp, Homo sapiens
ccgtgtcccaaggag

SEQ ID NO: 774278 - DNA, 13 bp, Homo sapiens
ccgtgtcctcctc

SEQ ID NO: 774279 - DNA, 14 bp, Homo sapiens
ccgtgtctcagcct

SEQ ID NO: 774280 - DNA, 19 bp, Homo sapiens
ccgtgtctcagcctctgcc

SEQ ID NO: 774281 - DNA, 20 bp, Homo sapiens
ccgtgtctcgcgcgactgag

SEQ ID NO: 774282 - DNA, 23 bp, Homo sapiens
ccgtgtctcgcgcgactgagaac

SEQ ID NO: 774283 - DNA, 14 bp, Homo sapiens
ccgtgtgaatgtag

SEQ ID NO: 774284 - DNA, 22 bp, Homo sapiens
ccgtgtgagaagtgaatgctgg

SEQ ID NO: 774285 - DNA, 22 bp, Homo sapiens
ccgtgtgagtgtgacagggcca

SEQ ID NO: 774286 - DNA, 15 bp, Homo sapiens
ccgtgtggccccttc

SEQ ID NO: 774287 - DNA, 16 bp, Homo sapiens
ccgtgtggccccttca

SEQ ID NO: 774288 - DNA, 22 bp, Homo sapiens
ccgtgtggtaccttcagccctg

SEQ ID NO: 774289 - DNA, 23 bp, Homo sapiens
ccgtgtggtaccttcagccctgg

SEQ ID NO: 774290 - DNA, 11 bp, Homo sapiens
ccgtgtgtcca

SEQ ID NO: 774291 - DNA, 19 bp, Homo sapiens
ccgtgtgtcccagatgctg

SEQ ID NO: 774292 - DNA, 22 bp, Homo sapiens
ccgtgtgtcccagatgctgtca

SEQ ID NO: 774293 - DNA, 16 bp, Homo sapiens
ccgtgttcaggacaca

SEQ ID NO: 774294 - DNA, 14 bp, Homo sapiens
ccgttactctccaa

SEQ ID NO: 774295 - DNA, 15 bp, Homo sapiens
ccgttagctcctgtg

SEQ ID NO: 774296 - DNA, 20 bp, Homo sapiens
ccgttcaagaggcgtgtgca

SEQ ID NO: 774297 - DNA, 22 bp, Homo sapiens
ccgttcaagaggcgtgtgcagg

SEQ ID NO: 774298 - DNA, 22 bp, Homo sapiens
ccgttccaccccaagagaactc

SEQ ID NO: 774299 - DNA, 16 bp, Homo sapiens
ccgttccctgcgcttc

SEQ ID NO: 774300 - DNA, 13 bp, Homo sapiens
ccgttccctgtca

SEQ ID NO: 774301 - DNA, 12 bp, Homo sapiens
ccgtttcagaag

SEQ ID NO: 774302 - DNA, 13 bp, Homo sapiens
ccgtttcttccct

SEQ ID NO: 774303 - DNA, 17 bp, Homo sapiens
ccgttttaccaataaac

SEQ ID NO: 774304 - DNA, 20 bp, Homo sapiens
ccgttttcacttgtctcctt

SEQ ID NO: 774305 - DNA, 18 bp, Homo sapiens
cctaaaaaagatatatta

SEQ ID NO: 774306 - DNA, 16 bp, Homo sapiens
cctaaaactggcctga

SEQ ID NO: 774307 - DNA, 23 bp, Homo sapiens
cctaaaaggaaatctcaccccat

SEQ ID NO: 774308 - DNA, 15 bp, Homo sapiens
cctaaaagtaacaat

SEQ ID NO: 774309 - DNA, 17 bp, Homo sapiens
cctaaaattgtatgaaa

SEQ ID NO: 774310 - DNA, 16 bp, Homo sapiens
cctaaaccaaaaactg

SEQ ID NO: 774311 - DNA, 15 bp, Homo sapiens
cctaaacccctgtcc

SEQ ID NO: 774312 - DNA, 17 bp, Homo sapiens
cctaaacccctgtccca

SEQ ID NO: 774313 - DNA, 18 bp, Homo sapiens
cctaaactacctttttgt

SEQ ID NO: 774314 - DNA, 14 bp, Homo sapiens
cctaaactgcagcc

SEQ ID NO: 774315 - DNA, 14 bp, Homo sapiens
cctaaactttagac

SEQ ID NO: 774316 - DNA, 12 bp, Homo sapiens
cctaaagaaaaa

SEQ ID NO: 774317 - DNA, 22 bp, Homo sapiens
cctaaagaaaaatatcttggcc

SEQ ID NO: 774318 - DNA, 16 bp, Homo sapiens
cctaaagccaaagttt

SEQ ID NO: 774319 - DNA, 20 bp, Homo sapiens
cctaaagccaaagtttctgt

SEQ ID NO: 774320 - DNA, 14 bp, Homo sapiens
cctaaagtgtattt

SEQ ID NO: 774321 - DNA, 23 bp, Homo sapiens
cctaaataaacacatagattcac

SEQ ID NO: 774322 - DNA, 14 bp, Homo sapiens
cctaaatattttca

SEQ ID NO: 774323 - DNA, 20 bp, Homo sapiens
cctaaatattttcaagaaaa

SEQ ID NO: 774324 - DNA, 12 bp, Homo sapiens
cctaaatgcaaa

SEQ ID NO: 774325 - DNA, 13 bp, Homo sapiens
cctaaatgcaaag

SEQ ID NO: 774326 - DNA, 18 bp, Homo sapiens
cctaacacagcatgtgta

SEQ ID NO: 774327 - DNA, 22 bp, Homo sapiens
cctaacaccccctagcaaaact

SEQ ID NO: 774328 - DNA, 17 bp, Homo sapiens
cctaacattcgatctca

SEQ ID NO: 774329 - DNA, 12 bp, Homo sapiens
cctaacccccag

SEQ ID NO: 774330 - DNA, 16 bp, Homo sapiens
cctaacccccagtcct

SEQ ID NO: 774331 - DNA, 17 bp, Homo sapiens
cctaacccccagtcctc

SEQ ID NO: 774332 - DNA, 15 bp, Homo sapiens
cctaacccctttcct

SEQ ID NO: 774333 - DNA, 14 bp, Homo sapiens
cctaacttttcaat

SEQ ID NO: 774334 - DNA, 12 bp, Homo sapiens
cctaagaatttt

SEQ ID NO: 774335 - DNA, 22 bp, Homo sapiens
cctaagacatgtgaggaggaaa

SEQ ID NO: 774336 - DNA, 15 bp, Homo sapiens
cctaagactgccttc

SEQ ID NO: 774337 - DNA, 17 bp, Homo sapiens
cctaagactgccttcag

SEQ ID NO: 774338 - DNA, 18 bp, Homo sapiens
cctaagactgccttcagt

SEQ ID NO: 774339 - DNA, 13 bp, Homo sapiens
cctaagagattta

SEQ ID NO: 774340 - DNA, 17 bp, Homo sapiens
cctaagagatttatctt

SEQ ID NO: 774341 - DNA, 18 bp, Homo sapiens
cctaagagatttatcttt

SEQ ID NO: 774342 - DNA, 18 bp, Homo sapiens
cctaagagtggaggagga

SEQ ID NO: 774343 - DNA, 16 bp, Homo sapiens
cctaagagtgtttaat

SEQ ID NO: 774344 - DNA, 21 bp, Homo sapiens
cctaagatctcggtttgccaa

SEQ ID NO: 774345 - DNA, 14 bp, Homo sapiens
cctaagcacttcta

SEQ ID NO: 774346 - DNA, 18 bp, Homo sapiens
cctaagcctgtccccaga

SEQ ID NO: 774347 - DNA, 16 bp, Homo sapiens
cctaaggaaccttcct

SEQ ID NO: 774348 - DNA, 16 bp, Homo sapiens
cctaaggaagccagtc

SEQ ID NO: 774349 - DNA, 16 bp, Homo sapiens
cctaaggatctctcag

SEQ ID NO: 774350 - DNA, 17 bp, Homo sapiens
cctaaggatctctcagg

SEQ ID NO: 774351 - DNA, 19 bp, Homo sapiens
cctaaggatctctcaggag

SEQ ID NO: 774352 - DNA, 22 bp, Homo sapiens
cctaaggatctctcaggagcac

SEQ ID NO: 774353 - DNA, 23 bp, Homo sapiens
cctaaggatctctcaggagcaca

SEQ ID NO: 774354 - DNA, 23 bp, Homo sapiens
cctaaggcacccacaaataaatg

SEQ ID NO: 774355 - DNA, 12 bp, Homo sapiens
cctaaggctgca

SEQ ID NO: 774356 - DNA, 18 bp, Homo sapiens
cctaagggatcctgcctg

SEQ ID NO: 774357 - DNA, 20 bp, Homo sapiens
cctaagggcagccctccatg

SEQ ID NO: 774358 - DNA, 21 bp, Homo sapiens
cctaagggcagccctccatgg

SEQ ID NO: 774359 - DNA, 22 bp, Homo sapiens
cctaagggcagccctccatggt

SEQ ID NO: 774360 - DNA, 22 bp, Homo sapiens
cctaagggtagaaaactccagg

SEQ ID NO: 774361 - DNA, 23 bp, Homo sapiens
cctaagggtagaaaactccaggg

SEQ ID NO: 774362 - DNA, 20 bp, Homo sapiens
cctaaggttttgttgtgttc

SEQ ID NO: 774363 - DNA, 20 bp, Homo sapiens
cctaagtaagtttcttcctg

SEQ ID NO: 774364 - DNA, 21 bp, Homo sapiens
cctaagtaagtttcttcctgc

SEQ ID NO: 774365 - DNA, 13 bp, Homo sapiens
cctaagtctctgt

SEQ ID NO: 774366 - DNA, 15 bp, Homo sapiens
cctaagtctctgtga

SEQ ID NO: 774367 - DNA, 18 bp, Homo sapiens
cctaagtggattggcttt

SEQ ID NO: 774368 - DNA, 20 bp, Homo sapiens
cctaagtttcagttgatttt

SEQ ID NO: 774369 - DNA, 22 bp, Homo sapiens
cctaataaacatccttcaagaa

SEQ ID NO: 774370 - DNA, 20 bp, Homo sapiens
cctaataatatcccactggg

SEQ ID NO: 774371 - DNA, 17 bp, Homo sapiens
cctaatcacatgtgctg

SEQ ID NO: 774372 - DNA, 17 bp, Homo sapiens
cctaatcaggctgaggt

SEQ ID NO: 774373 - DNA, 15 bp, Homo sapiens
cctaatgagagtgca

SEQ ID NO: 774374 - DNA, 13 bp, Homo sapiens
cctaatgctggcc

SEQ ID NO: 774375 - DNA, 18 bp, Homo sapiens
cctaatgtctcactgttc

SEQ ID NO: 774376 - DNA, 19 bp, Homo sapiens
cctaatgtctcactgttct

SEQ ID NO: 774377 - DNA, 13 bp, Homo sapiens
cctaatgtgttta

SEQ ID NO: 774378 - DNA, 19 bp, Homo sapiens
cctaatgtttatgagccag

SEQ ID NO: 774379 - DNA, 13 bp, Homo sapiens
cctaattccacag

SEQ ID NO: 774380 - DNA, 14 bp, Homo sapiens
cctaattccacagc

SEQ ID NO: 774381 - DNA, 21 bp, Homo sapiens
cctaattcctggcatgacact

SEQ ID NO: 774382 - DNA, 18 bp, Homo sapiens
cctaattcgatgaaggct

SEQ ID NO: 774383 - DNA, 21 bp, Homo sapiens
cctaattcttttatctttatt

SEQ ID NO: 774384 - DNA, 16 bp, Homo sapiens
cctaatttctcctccc

SEQ ID NO: 774385 - DNA, 18 bp, Homo sapiens
cctaatttctcctccctt

SEQ ID NO: 774386 - DNA, 18 bp, Homo sapiens
cctaattttaaataattt

SEQ ID NO: 774387 - DNA, 16 bp, Homo sapiens
cctacaaccccagcct

SEQ ID NO: 774388 - DNA, 19 bp, Homo sapiens
cctacaagatttagaaaaa

SEQ ID NO: 774389 - DNA, 20 bp, Homo sapiens
cctacaagatttagaaaaaa

SEQ ID NO: 774390 - DNA, 19 bp, Homo sapiens
cctagcagacagaaactgg

SEQ ID NO: 774391 - DNA, 21 bp, Homo sapiens
cctagcagcaccgttctgtgc

SEQ ID NO: 774392 - DNA, 19 bp, Homo sapiens
cctagcatacgtacacatt

SEQ ID NO: 774393 - DNA, 21 bp, Homo sapiens
cctagcatacgtacacatttt

SEQ ID NO: 774394 - DNA, 16 bp, Homo sapiens
cctagcatggggtcag

SEQ ID NO: 774395 - DNA, 23 bp, Homo sapiens
cctagcatggggtcagccccaag

SEQ ID NO: 774396 - DNA, 12 bp, Homo sapiens
cctagccagctg

SEQ ID NO: 774397 - DNA, 15 bp, Homo sapiens
cctagccattcctgg

SEQ ID NO: 774398 - DNA, 16 bp, Homo sapiens
attcagccaacatgtg

SEQ ID NO: 774399 - DNA, 15 bp, Homo sapiens
attcagccagcttaa

SEQ ID NO: 774400 - DNA, 19 bp, Homo sapiens
attcagccagcttaaaccc

SEQ ID NO: 774401 - DNA, 17 bp, Homo sapiens
attcagctagaatttct

SEQ ID NO: 774402 - DNA, 20 bp, Homo sapiens
attcagcttcatttgtgtca

SEQ ID NO: 774403 - DNA, 22 bp, Homo sapiens
attcaggacttaacggctccag

SEQ ID NO: 774404 - DNA, 16 bp, Homo sapiens
attcaggcagcactga

SEQ ID NO: 774405 - DNA, 20 bp, Homo sapiens
attcaggccagcccagccag

SEQ ID NO: 774406 - DNA, 23 bp, Homo sapiens
attcaggccagcccagccaggcc

SEQ ID NO: 774407 - DNA, 15 bp, Homo sapiens
attcaggggaagggc

SEQ ID NO: 774408 - DNA, 15 bp, Homo sapiens
attcaggggctttgg

SEQ ID NO: 774409 - DNA, 16 bp, Homo sapiens
attcaggggctttggg

SEQ ID NO: 774410 - DNA, 17 bp, Homo sapiens
attcaggggctttgggc

SEQ ID NO: 774411 - DNA, 19 bp, Homo sapiens
attcaggggctttgggccc

SEQ ID NO: 774412 - DNA, 21 bp, Homo sapiens
attcaggggctttgggcccaa

SEQ ID NO: 774413 - DNA, 23 bp, Homo sapiens
attcaggggctttgggcccaaga

SEQ ID NO: 774414 - DNA, 20 bp, Homo sapiens
attcaggtacagaaaacatg

SEQ ID NO: 774415 - DNA, 13 bp, Homo sapiens
attcaggtatgtt

SEQ ID NO: 774416 - DNA, 18 bp, Homo sapiens
attcaggtatgttgcctt

SEQ ID NO: 774417 - DNA, 21 bp, Homo sapiens
attcagtacaacccataatca

SEQ ID NO: 774418 - DNA, 18 bp, Homo sapiens
attcagtcctaagaaaga

SEQ ID NO: 774419 - DNA, 15 bp, Homo sapiens
attcagtgagggtct

SEQ ID NO: 774420 - DNA, 17 bp, Homo sapiens
attcagtgcttcttaaa

SEQ ID NO: 774421 - DNA, 22 bp, Homo sapiens
attcagttcccaccatctgatt

SEQ ID NO: 774422 - DNA, 13 bp, Homo sapiens
attcagtttctaa

SEQ ID NO: 774423 - DNA, 15 bp, Homo sapiens
attcagttttcattt

SEQ ID NO: 774424 - DNA, 20 bp, Homo sapiens
attcagtttttgtatcttgg

SEQ ID NO: 774425 - DNA, 16 bp, Homo sapiens
attcataaagtaatga

SEQ ID NO: 774426 - DNA, 21 bp, Homo sapiens
attcataatgaattataacag

SEQ ID NO: 774427 - DNA, 20 bp, Homo sapiens
attcatacttaaaaatttat

SEQ ID NO: 774428 - DNA, 18 bp, Homo sapiens
attcatagtaacttctta

SEQ ID NO: 774429 - DNA, 20 bp, Homo sapiens
attcatagtctttggagaaa

SEQ ID NO: 774430 - DNA, 15 bp, Homo sapiens
attcatattaagaca

SEQ ID NO: 774431 - DNA, 23 bp, Homo sapiens
attcatattaagacagtgtacaa

SEQ ID NO: 774432 - DNA, 18 bp, Homo sapiens
attcatatttacttctta

SEQ ID NO: 774433 - DNA, 19 bp, Homo sapiens
attcatcactccaaaaaca

SEQ ID NO: 774434 - DNA, 14 bp, Homo sapiens
attcatcagcattt

SEQ ID NO: 774435 - DNA, 12 bp, Homo sapiens
attcatctctgg

SEQ ID NO: 774436 - DNA, 22 bp, Homo sapiens
attcatctctggttttcttgcc

SEQ ID NO: 774437 - DNA, 15 bp, Homo sapiens
attcatgacattatg

SEQ ID NO: 774438 - DNA, 14 bp, Homo sapiens
attcatgccatctg

SEQ ID NO: 774439 - DNA, 13 bp, Homo sapiens
attcatgtaactc

SEQ ID NO: 774440 - DNA, 19 bp, Homo sapiens
attcatgtaactctccagc

SEQ ID NO: 774441 - DNA, 18 bp, Homo sapiens
attcatgtgagaaagcta

SEQ ID NO: 774442 - DNA, 22 bp, Homo sapiens
attcatgttatatttaatgcat

SEQ ID NO: 774443 - DNA, 13 bp, Homo sapiens
attcatgtttctt

SEQ ID NO: 774444 - DNA, 15 bp, Homo sapiens
attcatgtttcttaa

SEQ ID NO: 774445 - DNA, 13 bp, Homo sapiens
attcattattcct

SEQ ID NO: 774446 - DNA, 15 bp, Homo sapiens
attcattattcctca

SEQ ID NO: 774447 - DNA, 18 bp, Homo sapiens
attcattctgcattgcta

SEQ ID NO: 774448 - DNA, 14 bp, Homo sapiens
attcattgtgttac

SEQ ID NO: 774449 - DNA, 13 bp, Homo sapiens
attcatttaaaat

SEQ ID NO: 774450 - DNA, 17 bp, Homo sapiens
attcatttaaaatgatt

SEQ ID NO: 774451 - DNA, 13 bp, Homo sapiens
attcatttcctgc

SEQ ID NO: 774452 - DNA, 13 bp, Homo sapiens
attcatttggtga

SEQ ID NO: 774453 - DNA, 20 bp, Homo sapiens
attcatttgtattgcttatt

SEQ ID NO: 774454 - DNA, 14 bp, Homo sapiens
attcattttctaga

SEQ ID NO: 774455 - DNA, 13 bp, Homo sapiens
attcatttttaag

SEQ ID NO: 774456 - DNA, 16 bp, Homo sapiens
attccaaaaagcacat

SEQ ID NO: 774457 - DNA, 15 bp, Homo sapiens
attccaaaatattat

SEQ ID NO: 774458 - DNA, 14 bp, Homo sapiens
attccaaaccaaat

SEQ ID NO: 774459 - DNA, 13 bp, Homo sapiens
attccaaagcaaa

SEQ ID NO: 774460 - DNA, 15 bp, Homo sapiens
attccaaagctttat

SEQ ID NO: 774461 - DNA, 15 bp, Homo sapiens
attccaaatatgtat

SEQ ID NO: 774462 - DNA, 20 bp, Homo sapiens
attccaaatgtcttttagaa

SEQ ID NO: 774463 - DNA, 19 bp, Homo sapiens
attccaaatttttttctta

SEQ ID NO: 774464 - DNA, 14 bp, Homo sapiens
attccaacagtgag

SEQ ID NO: 774465 - DNA, 14 bp, Homo sapiens
attccaacttgaag

SEQ ID NO: 774466 - DNA, 17 bp, Homo sapiens
attccaacttgaaggat

SEQ ID NO: 774467 - DNA, 15 bp, Homo sapiens
attccaagaaaatat

SEQ ID NO: 774468 - DNA, 19 bp, Homo sapiens
attccaaggaaaattgaaa

SEQ ID NO: 774469 - DNA, 22 bp, Homo sapiens
attccaaggaaaattgaaagta

SEQ ID NO: 774470 - DNA, 22 bp, Homo sapiens
attccaagggtatgggaagcca

SEQ ID NO: 774471 - DNA, 21 bp, Homo sapiens
attccaataccctagaagaaa

SEQ ID NO: 774472 - DNA, 18 bp, Homo sapiens
attccaatatgatgactc

SEQ ID NO: 774473 - DNA, 13 bp, Homo sapiens
attccaattctaa

SEQ ID NO: 774474 - DNA, 15 bp, Homo sapiens
attccaattctaaat

SEQ ID NO: 774475 - DNA, 12 bp, Homo sapiens
attccacagctg

SEQ ID NO: 774476 - DNA, 16 bp, Homo sapiens
attccaccattcacat

SEQ ID NO: 774477 - DNA, 16 bp, Homo sapiens
attccaccttaaatta

SEQ ID NO: 774478 - DNA, 18 bp, Homo sapiens
attccaccttaaattaaa

SEQ ID NO: 774479 - DNA, 19 bp, Homo sapiens
attccaccttaaattaaac

SEQ ID NO: 774480 - DNA, 13 bp, Homo sapiens
attccactgaaaa

SEQ ID NO: 774481 - DNA, 21 bp, Homo sapiens
attccagaagaagagaagctg

SEQ ID NO: 774482 - DNA, 13 bp, Homo sapiens
attccagaatctt

SEQ ID NO: 774483 - DNA, 21 bp, Homo sapiens
attccagaatcttgactttct

SEQ ID NO: 774484 - DNA, 18 bp, Homo sapiens
attccagagagtggctcc

SEQ ID NO: 774485 - DNA, 19 bp, Homo sapiens
attccagagcgtgtagtga

SEQ ID NO: 774486 - DNA, 19 bp, Homo sapiens
attccagaggactctgctt

SEQ ID NO: 774487 - DNA, 21 bp, Homo sapiens
attccagaggactctgcttaa

SEQ ID NO: 774488 - DNA, 14 bp, Homo sapiens
attccagcaataag

SEQ ID NO: 774489 - DNA, 18 bp, Homo sapiens
attccagcaataagaaat

SEQ ID NO: 774490 - DNA, 19 bp, Homo sapiens
attccagcaataagaaatg

SEQ ID NO: 774491 - DNA, 20 bp, Homo sapiens
attccagcaataagaaatga

SEQ ID NO: 774492 - DNA, 21 bp, Homo sapiens
attccagcaataagaaatgaa

SEQ ID NO: 774493 - DNA, 11 bp, Homo sapiens
attccagcagc

SEQ ID NO: 774494 - DNA, 12 bp, Homo sapiens
attccagcagct

SEQ ID NO: 774495 - DNA, 13 bp, Homo sapiens
attccagcagctg

SEQ ID NO: 774496 - DNA, 17 bp, Homo sapiens
attccagccagggtgac

SEQ ID NO: 774497 - DNA, 12 bp, Homo sapiens
attccagctctg

SEQ ID NO: 774498 - DNA, 16 bp, Homo sapiens
attccaggaaccaaaa

SEQ ID NO: 774499 - DNA, 13 bp, Homo sapiens
attccaggagaag

SEQ ID NO: 774500 - DNA, 13 bp, Homo sapiens
attccagggctgg

SEQ ID NO: 774501 - DNA, 14 bp, Homo sapiens
attccagtaacttt

SEQ ID NO: 774502 - DNA, 17 bp, Homo sapiens
attccagtaactttttt

SEQ ID NO: 774503 - DNA, 20 bp, Homo sapiens
attccagtcaaatctgggct

SEQ ID NO: 774504 - DNA, 17 bp, Homo sapiens
attccatagtggaccac

SEQ ID NO: 774505 - DNA, 21 bp, Homo sapiens
attccatatcttgcgaatcca

SEQ ID NO: 774506 - DNA, 22 bp, Homo sapiens
attccatatcttgcgaatccaa

SEQ ID NO: 774507 - DNA, 23 bp, Homo sapiens
attccatatcttgcgaatccaag

SEQ ID NO: 774508 - DNA, 16 bp, Homo sapiens
attccatgaatgtatc

SEQ ID NO: 774509 - DNA, 21 bp, Homo sapiens
attccatgagctgctcattac

SEQ ID NO: 774510 - DNA, 16 bp, Homo sapiens
attccatggaaataaa

SEQ ID NO: 774511 - DNA, 16 bp, Homo sapiens
attccatgtcagataa

SEQ ID NO: 774512 - DNA, 20 bp, Homo sapiens
attccttttgatggggagaa

SEQ ID NO: 774513 - DNA, 21 bp, Homo sapiens
attccttttgatggggagaaa

SEQ ID NO: 774514 - DNA, 14 bp, Homo sapiens
attcctttttctat

SEQ ID NO: 774515 - DNA, 17 bp, Homo sapiens
attcctttttcttcact

SEQ ID NO: 774516 - DNA, 21 bp, Homo sapiens
attcgaagggtcttaaagaat

SEQ ID NO: 774517 - DNA, 23 bp, Homo sapiens
attcgaatggggtagaaacattg

SEQ ID NO: 774518 - DNA, 22 bp, Homo sapiens
attcgaggtgtcaccctgcaga

SEQ ID NO: 774519 - DNA, 15 bp, Homo sapiens
attcgatgcccccct

SEQ ID NO: 774520 - DNA, 23 bp, Homo sapiens
attcgcccacccgagtacctcca

SEQ ID NO: 774521 - DNA, 22 bp, Homo sapiens
attcggacggccaatggtgctt

SEQ ID NO: 774522 - DNA, 16 bp, Homo sapiens
attcggggcctgctgg

SEQ ID NO: 774523 - DNA, 21 bp, Homo sapiens
attcggtatccccccatcttg

SEQ ID NO: 774524 - DNA, 12 bp, Homo sapiens
attcggtgtgaa

SEQ ID NO: 774525 - DNA, 14 bp, Homo sapiens
attcgtgagctggg

SEQ ID NO: 774526 - DNA, 17 bp, Homo sapiens
attcgtggcatgttttg

SEQ ID NO: 774527 - DNA, 14 bp, Homo sapiens
attcgtgttatgaa

SEQ ID NO: 774528 - DNA, 12 bp, Homo sapiens
cctatatgccag

SEQ ID NO: 774529 - DNA, 17 bp, Homo sapiens
cctatcacctatttcca

SEQ ID NO: 774530 - DNA, 16 bp, Homo sapiens
cctatcacctcccctc

SEQ ID NO: 774531 - DNA, 17 bp, Homo sapiens
cctatcacctcccctcc

SEQ ID NO: 774532 - DNA, 13 bp, Homo sapiens
cctatccacccag

SEQ ID NO: 774533 - DNA, 15 bp, Homo sapiens
cctatccgctgccag

SEQ ID NO: 774534 - DNA, 12 bp, Homo sapiens
cctatcctcccc

SEQ ID NO: 774535 - DNA, 22 bp, Homo sapiens
cctatctagcatttatttctct

SEQ ID NO: 774536 - DNA, 20 bp, Homo sapiens
cctatctattaaagtgactt

SEQ ID NO: 774537 - DNA, 17 bp, Homo sapiens
cctatctcagggaggga

SEQ ID NO: 774538 - DNA, 13 bp, Homo sapiens
cctatctcctgac

SEQ ID NO: 774539 - DNA, 16 bp, Homo sapiens
cctatctcctgacaga

SEQ ID NO: 774540 - DNA, 16 bp, Homo sapiens
cctatctcgtgggaga

SEQ ID NO: 774541 - DNA, 17 bp, Homo sapiens
cctatctcgtgggagag

SEQ ID NO: 774542 - DNA, 21 bp, Homo sapiens
cctatctttaaacatttcaat

SEQ ID NO: 774543 - DNA, 20 bp, Homo sapiens
cctatgacttttttaaacta

SEQ ID NO: 774544 - DNA, 20 bp, Homo sapiens
cctatgagatggccatgctc

SEQ ID NO: 774545 - DNA, 15 bp, Homo sapiens
cctatgagcatcctg

SEQ ID NO: 774546 - DNA, 16 bp, Homo sapiens
cctatgagcatcctga

SEQ ID NO: 774547 - DNA, 22 bp, Homo sapiens
cctatgagcatcctgagccccg

SEQ ID NO: 774548 - DNA, 17 bp, Homo sapiens
cctatgatattttctgt

SEQ ID NO: 774549 - DNA, 17 bp, Homo sapiens
cctatgcaaaccagctt

SEQ ID NO: 774550 - DNA, 23 bp, Homo sapiens
cctatgcagggaggccacgtccc

SEQ ID NO: 774551 - DNA, 15 bp, Homo sapiens
cctatgcccaggtac

SEQ ID NO: 774552 - DNA, 21 bp, Homo sapiens
cctatgcccaggtaccaccct

SEQ ID NO: 774553 - DNA, 21 bp, Homo sapiens
cctatgccctgcccttcctca

SEQ ID NO: 774554 - DNA, 14 bp, Homo sapiens
cctatgcctgtggt

SEQ ID NO: 774555 - DNA, 22 bp, Homo sapiens
cctatgctggggtacacagtga

SEQ ID NO: 774556 - DNA, 14 bp, Homo sapiens
cctatggctgagcc

SEQ ID NO: 774557 - DNA, 17 bp, Homo sapiens
cctatgggcctgccggg

SEQ ID NO: 774558 - DNA, 19 bp, Homo sapiens
cctatgggcctgccgggct

SEQ ID NO: 774559 - DNA, 16 bp, Homo sapiens
cctatggggaggccct

SEQ ID NO: 774560 - DNA, 17 bp, Homo sapiens
cctatggggatggtcca

SEQ ID NO: 774561 - DNA, 15 bp, Homo sapiens
cctatgtacagagct

SEQ ID NO: 774562 - DNA, 17 bp, Homo sapiens
cctatgtacagagcttt

SEQ ID NO: 774563 - DNA, 17 bp, Homo sapiens
cctatgtattttcctaa

SEQ ID NO: 774564 - DNA, 22 bp, Homo sapiens
cctatgtcctaaggacacacta

SEQ ID NO: 774565 - DNA, 24 bp, Homo sapiens
cctatgtcctaaggacacactaat

SEQ ID NO: 774566 - DNA, 16 bp, Homo sapiens
cctattagagaagaga

SEQ ID NO: 774567 - DNA, 17 bp, Homo sapiens
cctattagagaagagat

SEQ ID NO: 774568 - DNA, 22 bp, Homo sapiens
cctattaggtggaaattttata

SEQ ID NO: 774569 - DNA, 17 bp, Homo sapiens
cctattatctgtcagct

SEQ ID NO: 774570 - DNA, 15 bp, Homo sapiens
cctattcaccctcca

SEQ ID NO: 774571 - DNA, 16 bp, Homo sapiens
cctattcaccctccac

SEQ ID NO: 774572 - DNA, 17 bp, Homo sapiens
cctattcaccctccact

SEQ ID NO: 774573 - DNA, 21 bp, Homo sapiens
cctattctatccatctcctgg

SEQ ID NO: 774574 - DNA, 15 bp, Homo sapiens
cctattctcaccagg

SEQ ID NO: 774575 - DNA, 13 bp, Homo sapiens
cctattctcctgc

SEQ ID NO: 774576 - DNA, 14 bp, Homo sapiens
cctattctcctgcc

SEQ ID NO: 774577 - DNA, 14 bp, Homo sapiens
cctatttattgact

SEQ ID NO: 774578 - DNA, 15 bp, Homo sapiens
cctatttcatcacaa

SEQ ID NO: 774579 - DNA, 14 bp, Homo sapiens
cctatttctgatga

SEQ ID NO: 774580 - DNA, 12 bp, Homo sapiens
cctatttgtgtg

SEQ ID NO: 774581 - DNA, 16 bp, Homo sapiens
cctattttcatttgta

SEQ ID NO: 774582 - DNA, 17 bp, Homo sapiens
cctattttcatttgtac

SEQ ID NO: 774583 - DNA, 23 bp, Homo sapiens
cctatttttttagattgagaaat

SEQ ID NO: 774584 - DNA, 13 bp, Homo sapiens
cctcaaaccactt

SEQ ID NO: 774585 - DNA, 18 bp, Homo sapiens
cctcaaaccacttgcctg

SEQ ID NO: 774586 - DNA, 18 bp, Homo sapiens
cctcaaacgacagaggag

SEQ ID NO: 774587 - DNA, 20 bp, Homo sapiens
cctcaaacgacagaggagct

SEQ ID NO: 774588 - DNA, 18 bp, Homo sapiens
cctcaaactgcacatcta

SEQ ID NO: 774589 - DNA, 14 bp, Homo sapiens
cctcaaagaaagtg

SEQ ID NO: 774590 - DNA, 14 bp, Homo sapiens
cctcaaagcaaccc

SEQ ID NO: 774591 - DNA, 22 bp, Homo sapiens
cctcaaagcaacccgctggagc

SEQ ID NO: 774592 - DNA, 20 bp, Homo sapiens
cctcaaagcttggattaaat

SEQ ID NO: 774593 - DNA, 16 bp, Homo sapiens
cctcaaaggcccgctc

SEQ ID NO: 774594 - DNA, 14 bp, Homo sapiens
cctcaaagggcagt

SEQ ID NO: 774595 - DNA, 16 bp, Homo sapiens
cctcaaatgacccaaa

SEQ ID NO: 774596 - DNA, 14 bp, Homo sapiens
cctcaaatgtcaga

SEQ ID NO: 774597 - DNA, 18 bp, Homo sapiens
cctcaaatgtcagagcta

SEQ ID NO: 774598 - DNA, 22 bp, Homo sapiens
cctcaaattttttgactttttt

SEQ ID NO: 774599 - DNA, 15 bp, Homo sapiens
cctcaacaagggaga

SEQ ID NO: 774600 - DNA, 17 bp, Homo sapiens
cctcaacaccctgcttc

SEQ ID NO: 774601 - DNA, 21 bp, Homo sapiens
cctcaaccctccctcagcccc

SEQ ID NO: 774602 - DNA, 23 bp, Homo sapiens
cctcaaccctccctcagcccctc

SEQ ID NO: 774603 - DNA, 12 bp, Homo sapiens
cctcaacctctt

SEQ ID NO: 774604 - DNA, 17 bp, Homo sapiens
cctcaacctcttctggc

SEQ ID NO: 774605 - DNA, 13 bp, Homo sapiens
cctcaacctgtga

SEQ ID NO: 774606 - DNA, 18 bp, Homo sapiens
cctcaacgtattgtttcg

SEQ ID NO: 774607 - DNA, 15 bp, Homo sapiens
cctcaactgcctact

SEQ ID NO: 774608 - DNA, 17 bp, Homo sapiens
cctcaagatgaaggcaa

SEQ ID NO: 774609 - DNA, 21 bp, Homo sapiens
cctcaagcaataattgtttcc

SEQ ID NO: 774610 - DNA, 14 bp, Homo sapiens
cctcaagcctgtgg

SEQ ID NO: 774611 - DNA, 15 bp, Homo sapiens
cctcaagcctgtggg

SEQ ID NO: 774612 - DNA, 13 bp, Homo sapiens
cctcaaggacttg

SEQ ID NO: 774613 - DNA, 19 bp, Homo sapiens
cctcaaggacttgaaagca

SEQ ID NO: 774614 - DNA, 16 bp, Homo sapiens
cctcaagggacaggga

SEQ ID NO: 774615 - DNA, 15 bp, Homo sapiens
cctcaaggggcaggg

SEQ ID NO: 774616 - DNA, 21 bp, Homo sapiens
cctcaaggtccattattttgt

SEQ ID NO: 774617 - DNA, 19 bp, Homo sapiens
cctcaagtctcttttctgc

SEQ ID NO: 774618 - DNA, 15 bp, Homo sapiens
cctcaagttcttgga

SEQ ID NO: 774619 - DNA, 19 bp, Homo sapiens
cctcaagttcttggaccag

SEQ ID NO: 774620 - DNA, 14 bp, Homo sapiens
cctcaatgccctgc

SEQ ID NO: 774621 - DNA, 16 bp, Homo sapiens
cctcaatgctgggccc

SEQ ID NO: 774622 - DNA, 21 bp, Homo sapiens
cctcaatttttgtctcagaag

SEQ ID NO: 774623 - DNA, 14 bp, Homo sapiens
cctcaatttttgtt

SEQ ID NO: 774624 - DNA, 17 bp, Homo sapiens
cctcacacaccctgagg

SEQ ID NO: 774625 - DNA, 13 bp, Homo sapiens
cctcacacccctg

SEQ ID NO: 774626 - DNA, 22 bp, Homo sapiens
cctcacatacccacacattcca

SEQ ID NO: 774627 - DNA, 14 bp, Homo sapiens
cctcacatcctcct

SEQ ID NO: 774628 - DNA, 16 bp, Homo sapiens
cctcacatcctcctgc

SEQ ID NO: 774629 - DNA, 14 bp, Homo sapiens
cctcacatcctctc

SEQ ID NO: 774630 - DNA, 21 bp, Homo sapiens
cctcaccacacccaggtctct

SEQ ID NO: 774631 - DNA, 14 bp, Homo sapiens
cctcaccaccccca

SEQ ID NO: 774632 - DNA, 15 bp, Homo sapiens
cctcaccagaaccag

SEQ ID NO: 774633 - DNA, 12 bp, Homo sapiens
cctcaccattcc

SEQ ID NO: 774634 - DNA, 12 bp, Homo sapiens
cctcagcctgga

SEQ ID NO: 774635 - DNA, 19 bp, Homo sapiens
cctcagcctggagaggcct

SEQ ID NO: 774636 - DNA, 20 bp, Homo sapiens
cctcagcctggagaggcctg

SEQ ID NO: 774637 - DNA, 19 bp, Homo sapiens
cctcagcctggggctctct

SEQ ID NO: 774638 - DNA, 21 bp, Homo sapiens
cctcagcctggggctctctga

SEQ ID NO: 774639 - DNA, 13 bp, Homo sapiens
cctcagccttcca

SEQ ID NO: 774640 - DNA, 15 bp, Homo sapiens
cctcagccttctgag

SEQ ID NO: 774641 - DNA, 15 bp, Homo sapiens
cctcagcgagaggca

SEQ ID NO: 774642 - DNA, 16 bp, Homo sapiens
cctcagcgagaggcag

SEQ ID NO: 774643 - DNA, 21 bp, Homo sapiens
cctcagcgagaggcagcaagg

SEQ ID NO: 774644 - DNA, 15 bp, Homo sapiens
cctcagcgcaggctg

SEQ ID NO: 774645 - DNA, 17 bp, Homo sapiens
cctcagcgcaggctgca

SEQ ID NO: 774646 - DNA, 20 bp, Homo sapiens
cctcagcgcaggctgcagag

SEQ ID NO: 774647 - DNA, 23 bp, Homo sapiens
cctcagcgcaggctgcagagccc

SEQ ID NO: 774648 - DNA, 15 bp, Homo sapiens
cctcagcggaggggt

SEQ ID NO: 774649 - DNA, 12 bp, Homo sapiens
cctcagctctgg

SEQ ID NO: 774650 - DNA, 16 bp, Homo sapiens
cctcagctctgggaga

SEQ ID NO: 774651 - DNA, 21 bp, Homo sapiens
cctcagctgcatggagcctgg

SEQ ID NO: 774652 - DNA, 15 bp, Homo sapiens
cctcagctgcctcac

SEQ ID NO: 774653 - DNA, 13 bp, Homo sapiens
cctcagctgctcc

SEQ ID NO: 774654 - DNA, 14 bp, Homo sapiens
cctcagctgctccc

SEQ ID NO: 774655 - DNA, 12 bp, Homo sapiens
cctcagctgtca

SEQ ID NO: 774656 - DNA, 17 bp, Homo sapiens
cctcagctgtcacctgc

SEQ ID NO: 774657 - DNA, 21 bp, Homo sapiens
cctcagcttcttcacaggcac

SEQ ID NO: 774658 - DNA, 21 bp, Homo sapiens
cctcagcttgggcttcttcct

SEQ ID NO: 774659 - DNA, 12 bp, Homo sapiens
cctcaggagccg

SEQ ID NO: 774660 - DNA, 11 bp, Homo sapiens
attctgggtga

SEQ ID NO: 774661 - DNA, 16 bp, Homo sapiens
attctgggtttgccca

SEQ ID NO: 774662 - DNA, 17 bp, Homo sapiens
attctgggtttgcccag

SEQ ID NO: 774663 - DNA, 14 bp, Homo sapiens
attctggtatacat

SEQ ID NO: 774664 - DNA, 18 bp, Homo sapiens
attctggtgaccagactt

SEQ ID NO: 774665 - DNA, 23 bp, Homo sapiens
attctggtgaccagacttttgct

SEQ ID NO: 774666 - DNA, 16 bp, Homo sapiens
attctggttccagggt

SEQ ID NO: 774667 - DNA, 14 bp, Homo sapiens
attctgtaaaatgt

SEQ ID NO: 774668 - DNA, 16 bp, Homo sapiens
attctgtaattacata

SEQ ID NO: 774669 - DNA, 17 bp, Homo sapiens
attctgtagattctgtg

SEQ ID NO: 774670 - DNA, 15 bp, Homo sapiens
attctgtccctgtcc

SEQ ID NO: 774671 - DNA, 18 bp, Homo sapiens
attctgtccctgtccctg

SEQ ID NO: 774672 - DNA, 23 bp, Homo sapiens
attctgtcttgttcattttgagt

SEQ ID NO: 774673 - DNA, 20 bp, Homo sapiens
attctgtgcctccaggacca

SEQ ID NO: 774674 - DNA, 17 bp, Homo sapiens
attctgtggaacaagcc

SEQ ID NO: 774675 - DNA, 20 bp, Homo sapiens
attctgtggttctataataa

SEQ ID NO: 774676 - DNA, 21 bp, Homo sapiens
attctgtggttctataataag

SEQ ID NO: 774677 - DNA, 14 bp, Homo sapiens
attctgtgtctctg

SEQ ID NO: 774678 - DNA, 14 bp, Homo sapiens
attctgtgttgaac

SEQ ID NO: 774679 - DNA, 22 bp, Homo sapiens
attctgtgttgaacacaattga

SEQ ID NO: 774680 - DNA, 20 bp, Homo sapiens
attctgttgttccattttat

SEQ ID NO: 774681 - DNA, 21 bp, Homo sapiens
attctgttgttccattttatg

SEQ ID NO: 774682 - DNA, 21 bp, Homo sapiens
attctgtttattcttccagaa

SEQ ID NO: 774683 - DNA, 22 bp, Homo sapiens
attctgtttgcgtacttgtaat

SEQ ID NO: 774684 - DNA, 12 bp, Homo sapiens
attctgttttgc

SEQ ID NO: 774685 - DNA, 22 bp, Homo sapiens
attctgttttgttaatataccc

SEQ ID NO: 774686 - DNA, 19 bp, Homo sapiens
attctgtttttaatgctat

SEQ ID NO: 774687 - DNA, 22 bp, Homo sapiens
attcttaaaattcaagaaaata

SEQ ID NO: 774688 - DNA, 20 bp, Homo sapiens
attcttaacacagccttcct

SEQ ID NO: 774689 - DNA, 21 bp, Homo sapiens
attcttaacacagccttcctt

SEQ ID NO: 774690 - DNA, 15 bp, Homo sapiens
attcttaagcacttt

SEQ ID NO: 774691 - DNA, 22 bp, Homo sapiens
attcttaagcactttgaaaata

SEQ ID NO: 774692 - DNA, 22 bp, Homo sapiens
attcttaattctctgcaacact

SEQ ID NO: 774693 - DNA, 18 bp, Homo sapiens
attcttatttaatgaaag

SEQ ID NO: 774694 - DNA, 18 bp, Homo sapiens
attcttccacctcagcct

SEQ ID NO: 774695 - DNA, 16 bp, Homo sapiens
attcttccagaatgct

SEQ ID NO: 774696 - DNA, 15 bp, Homo sapiens
attcttccatcatca

SEQ ID NO: 774697 - DNA, 12 bp, Homo sapiens
attcttcctagt

SEQ ID NO: 774698 - DNA, 13 bp, Homo sapiens
attcttcctcctc

SEQ ID NO: 774699 - DNA, 14 bp, Homo sapiens
attcttcctcctct

SEQ ID NO: 774700 - DNA, 23 bp, Homo sapiens
attcttctaaagcactggtttca

SEQ ID NO: 774701 - DNA, 21 bp, Homo sapiens
attcttctcttccttttatca

SEQ ID NO: 774702 - DNA, 21 bp, Homo sapiens
attcttctgaactcaaactga

SEQ ID NO: 774703 - DNA, 16 bp, Homo sapiens
attcttctgtatttct

SEQ ID NO: 774704 - DNA, 15 bp, Homo sapiens
attcttctgtcctga

SEQ ID NO: 774705 - DNA, 16 bp, Homo sapiens
attcttctgttctctg

SEQ ID NO: 774706 - DNA, 13 bp, Homo sapiens
attcttcttgcta

SEQ ID NO: 774707 - DNA, 13 bp, Homo sapiens
attcttcttttgg

SEQ ID NO: 774708 - DNA, 21 bp, Homo sapiens
attcttgagttttgataaagt

SEQ ID NO: 774709 - DNA, 13 bp, Homo sapiens
attcttgatctct

SEQ ID NO: 774710 - DNA, 14 bp, Homo sapiens
attcttgcaaagta

SEQ ID NO: 774711 - DNA, 15 bp, Homo sapiens
attcttgcaaagtat

SEQ ID NO: 774712 - DNA, 19 bp, Homo sapiens
attcttggaccatgccaga

SEQ ID NO: 774713 - DNA, 18 bp, Homo sapiens
attcttggcttaatcatt

SEQ ID NO: 774714 - DNA, 13 bp, Homo sapiens
attcttggttgtt

SEQ ID NO: 774715 - DNA, 19 bp, Homo sapiens
attcttggttgttaattta

SEQ ID NO: 774716 - DNA, 13 bp, Homo sapiens
attcttgtacagt

SEQ ID NO: 774717 - DNA, 12 bp, Homo sapiens
attcttgtatat

SEQ ID NO: 774718 - DNA, 19 bp, Homo sapiens
attcttgtatttctagcat

SEQ ID NO: 774719 - DNA, 17 bp, Homo sapiens
attcttgtcacaataaa

SEQ ID NO: 774720 - DNA, 12 bp, Homo sapiens
attcttgtgctt

SEQ ID NO: 774721 - DNA, 19 bp, Homo sapiens
attcttgtgggagacagca

SEQ ID NO: 774722 - DNA, 17 bp, Homo sapiens
attcttgttagaatctg

SEQ ID NO: 774723 - DNA, 19 bp, Homo sapiens
attcttgttgctgtacaaa

SEQ ID NO: 774724 - DNA, 20 bp, Homo sapiens
attcttgttgctgtacaaaa

SEQ ID NO: 774725 - DNA, 22 bp, Homo sapiens
attcttgttgctgtacaaaagc

SEQ ID NO: 774726 - DNA, 19 bp, Homo sapiens
attcttgttggtagcatgt

SEQ ID NO: 774727 - DNA, 21 bp, Homo sapiens
attctttaaacaaatatgaaa

SEQ ID NO: 774728 - DNA, 17 bp, Homo sapiens
attctttataaaatgta

SEQ ID NO: 774729 - DNA, 13 bp, Homo sapiens
attctttattctt

SEQ ID NO: 774730 - DNA, 12 bp, Homo sapiens
attctttcactt

SEQ ID NO: 774731 - DNA, 23 bp, Homo sapiens
attctttcacttgatgtttgtta

SEQ ID NO: 774732 - DNA, 18 bp, Homo sapiens
attctttcagctgtgtct

SEQ ID NO: 774733 - DNA, 16 bp, Homo sapiens
attctttccattatga

SEQ ID NO: 774734 - DNA, 21 bp, Homo sapiens
attctttccattatgattctt

SEQ ID NO: 774735 - DNA, 17 bp, Homo sapiens
attctttgaacatgaac

SEQ ID NO: 774736 - DNA, 20 bp, Homo sapiens
attctttgacatttggtggt

SEQ ID NO: 774737 - DNA, 21 bp, Homo sapiens
attctttggagttaaaatgca

SEQ ID NO: 774738 - DNA, 17 bp, Homo sapiens
attctttggttgtgaat

SEQ ID NO: 774739 - DNA, 16 bp, Homo sapiens
attcttttaaaattca

SEQ ID NO: 774740 - DNA, 18 bp, Homo sapiens
attcttttaaattagaaa

SEQ ID NO: 774741 - DNA, 19 bp, Homo sapiens
attcttttaaattagaaaa

SEQ ID NO: 774742 - DNA, 23 bp, Homo sapiens
attcttttaaattagaaaatatt

SEQ ID NO: 774743 - DNA, 22 bp, Homo sapiens
attcttttaattgtttcagaat

SEQ ID NO: 774744 - DNA, 22 bp, Homo sapiens
attcttttatactcagctttct

SEQ ID NO: 774745 - DNA, 13 bp, Homo sapiens
attcttttgtaat

SEQ ID NO: 774746 - DNA, 16 bp, Homo sapiens
attcttttgtaattta

SEQ ID NO: 774747 - DNA, 17 bp, Homo sapiens
attcttttgtaatttaa

SEQ ID NO: 774748 - DNA, 14 bp, Homo sapiens
attcttttgtttcc

SEQ ID NO: 774749 - DNA, 16 bp, Homo sapiens
attcttttgtttccat

SEQ ID NO: 774750 - DNA, 17 bp, Homo sapiens
attcttttgtttccatg

SEQ ID NO: 774751 - DNA, 18 bp, Homo sapiens
attcttttgtttccatgg

SEQ ID NO: 774752 - DNA, 14 bp, Homo sapiens
attctttttaaagt

SEQ ID NO: 774753 - DNA, 22 bp, Homo sapiens
attctttttcttttttaaatta

SEQ ID NO: 774754 - DNA, 15 bp, Homo sapiens
attgaaaaaaaaaat

SEQ ID NO: 774755 - DNA, 18 bp, Homo sapiens
attgaaaaaaaaaatgtt

SEQ ID NO: 774756 - DNA, 18 bp, Homo sapiens
cctcatgtggctggaaga

SEQ ID NO: 774757 - DNA, 22 bp, Homo sapiens
cctcatgttctcttcccaggcc

SEQ ID NO: 774758 - DNA, 13 bp, Homo sapiens
cctcatgttctta

SEQ ID NO: 774759 - DNA, 16 bp, Homo sapiens
cctcattatcaaacag

SEQ ID NO: 774760 - DNA, 13 bp, Homo sapiens
cctcattcaggaa

SEQ ID NO: 774761 - DNA, 15 bp, Homo sapiens
cctcattcaggaaaa

SEQ ID NO: 774762 - DNA, 13 bp, Homo sapiens
cctcattcatctt

SEQ ID NO: 774763 - DNA, 15 bp, Homo sapiens
cctcattcccctcgt

SEQ ID NO: 774764 - DNA, 20 bp, Homo sapiens
cctcattccggccacatcat

SEQ ID NO: 774765 - DNA, 19 bp, Homo sapiens
cctcattgacaagaactga

SEQ ID NO: 774766 - DNA, 14 bp, Homo sapiens
cctcattgcctcct

SEQ ID NO: 774767 - DNA, 22 bp, Homo sapiens
cctcattgctgtcttgccccag

SEQ ID NO: 774768 - DNA, 13 bp, Homo sapiens
cctcattgtgcca

SEQ ID NO: 774769 - DNA, 18 bp, Homo sapiens
cctcattgtgccaagcct

SEQ ID NO: 774770 - DNA, 20 bp, Homo sapiens
cctcattgtgccaagccttc

SEQ ID NO: 774771 - DNA, 21 bp, Homo sapiens
cctcatttaaacccaatcaga

SEQ ID NO: 774772 - DNA, 19 bp, Homo sapiens
cctcatttcttcctctgca

SEQ ID NO: 774773 - DNA, 20 bp, Homo sapiens
cctcatttgaatgtgtgaat

SEQ ID NO: 774774 - DNA, 22 bp, Homo sapiens
cctcatttttataacctggcaa

SEQ ID NO: 774775 - DNA, 14 bp, Homo sapiens
cctccaaacctcca

SEQ ID NO: 774776 - DNA, 16 bp, Homo sapiens
cctccaaacctccagc

SEQ ID NO: 774777 - DNA, 15 bp, Homo sapiens
cctccaaaggaaggg

SEQ ID NO: 774778 - DNA, 12 bp, Homo sapiens
cctccaaccctg

SEQ ID NO: 774779 - DNA, 18 bp, Homo sapiens
cctccaaccctgccgtca

SEQ ID NO: 774780 - DNA, 18 bp, Homo sapiens
cctccaacgcccctgtgg

SEQ ID NO: 774781 - DNA, 20 bp, Homo sapiens
cctccaacgcccctgtggcc

SEQ ID NO: 774782 - DNA, 23 bp, Homo sapiens
cctccaacgcccctgtggccaac

SEQ ID NO: 774783 - DNA, 14 bp, Homo sapiens
cctccaactggatg

SEQ ID NO: 774784 - DNA, 13 bp, Homo sapiens
cctccaagcacag

SEQ ID NO: 774785 - DNA, 17 bp, Homo sapiens
cctccaagcatttcatg

SEQ ID NO: 774786 - DNA, 14 bp, Homo sapiens
cctccaagcctggc

SEQ ID NO: 774787 - DNA, 19 bp, Homo sapiens
cctccaagcctggcaccca

SEQ ID NO: 774788 - DNA, 20 bp, Homo sapiens
cctccaagcctggcacccac

SEQ ID NO: 774789 - DNA, 23 bp, Homo sapiens
cctccaagcctggcacccaccgt

SEQ ID NO: 774790 - DNA, 14 bp, Homo sapiens
attgccaccaggag

SEQ ID NO: 774791 - DNA, 15 bp, Homo sapiens
attgccaccaggaga

SEQ ID NO: 774792 - DNA, 21 bp, Homo sapiens
attgccaccaggagaaccact

SEQ ID NO: 774793 - DNA, 14 bp, Homo sapiens
attgccagcaaata

SEQ ID NO: 774794 - DNA, 22 bp, Homo sapiens
attgccatgaatttctaccaga

SEQ ID NO: 774795 - DNA, 21 bp, Homo sapiens
attgcccatgggatatgtggt

SEQ ID NO: 774796 - DNA, 15 bp, Homo sapiens
attgccccagagccc

SEQ ID NO: 774797 - DNA, 18 bp, Homo sapiens
attgccccatctagacta

SEQ ID NO: 774798 - DNA, 18 bp, Homo sapiens
attgcccgcgctcaggag

SEQ ID NO: 774799 - DNA, 22 bp, Homo sapiens
attgcctataatacttgcaact

SEQ ID NO: 774800 - DNA, 22 bp, Homo sapiens
attgcctcatttcttcctctgc

SEQ ID NO: 774801 - DNA, 21 bp, Homo sapiens
attgcctcctgttctgcccac

SEQ ID NO: 774802 - DNA, 22 bp, Homo sapiens
attgcctctactttgattctga

SEQ ID NO: 774803 - DNA, 14 bp, Homo sapiens
attgcctgcagaga

SEQ ID NO: 774804 - DNA, 16 bp, Homo sapiens
attgcctgcagagaga

SEQ ID NO: 774805 - DNA, 17 bp, Homo sapiens
attgcctgcagagagaa

SEQ ID NO: 774806 - DNA, 22 bp, Homo sapiens
attgccttatttgtctgtaaaa

SEQ ID NO: 774807 - DNA, 14 bp, Homo sapiens
attgccttcctcgt

SEQ ID NO: 774808 - DNA, 22 bp, Homo sapiens
attgccttcctcgtgcagagct

SEQ ID NO: 774809 - DNA, 23 bp, Homo sapiens
attgccttcctcgtgcagagctg

SEQ ID NO: 774810 - DNA, 22 bp, Homo sapiens
attgcctttaatattttgtaat

SEQ ID NO: 774811 - DNA, 14 bp, Homo sapiens
attgcctttccagg

SEQ ID NO: 774812 - DNA, 22 bp, Homo sapiens
attgcctttccagggttattta

SEQ ID NO: 774813 - DNA, 16 bp, Homo sapiens
attgcctttgaatgtt

SEQ ID NO: 774814 - DNA, 17 bp, Homo sapiens
attgcctttgaatgtta

SEQ ID NO: 774815 - DNA, 18 bp, Homo sapiens
attgcctttgaatgttaa

SEQ ID NO: 774816 - DNA, 21 bp, Homo sapiens
attgcgcctttgtattataaa

SEQ ID NO: 774817 - DNA, 15 bp, Homo sapiens
attgcgtagaggcta

SEQ ID NO: 774818 - DNA, 23 bp, Homo sapiens
attgctaaaaaataaataaaagc

SEQ ID NO: 774819 - DNA, 11 bp, Homo sapiens
attgctaaaag

SEQ ID NO: 774820 - DNA, 15 bp, Homo sapiens
attgctaaaagtgca

SEQ ID NO: 774821 - DNA, 18 bp, Homo sapiens
attgctaaaagtgcattt

SEQ ID NO: 774822 - DNA, 16 bp, Homo sapiens
attgctaatgttgctg

SEQ ID NO: 774823 - DNA, 18 bp, Homo sapiens
attgctaatgttgctgga

SEQ ID NO: 774824 - DNA, 21 bp, Homo sapiens
attgctactgatgctgtcatg

SEQ ID NO: 774825 - DNA, 18 bp, Homo sapiens
attgctagccagcattcc

SEQ ID NO: 774826 - DNA, 22 bp, Homo sapiens
attgctatcgccctcctttccc

SEQ ID NO: 774827 - DNA, 22 bp, Homo sapiens
attgctatctggaggccttcca

SEQ ID NO: 774828 - DNA, 15 bp, Homo sapiens
attgctatgttacta

SEQ ID NO: 774829 - DNA, 20 bp, Homo sapiens
attgctatgttactattttc

SEQ ID NO: 774830 - DNA, 21 bp, Homo sapiens
attgctccaagatgttctcct

SEQ ID NO: 774831 - DNA, 22 bp, Homo sapiens
attgctcctgcatgcaactaat

SEQ ID NO: 774832 - DNA, 14 bp, Homo sapiens
attgctctgcccca

SEQ ID NO: 774833 - DNA, 19 bp, Homo sapiens
attgctcttagtcccaagc

SEQ ID NO: 774834 - DNA, 16 bp, Homo sapiens
attgctgaaattttat

SEQ ID NO: 774835 - DNA, 15 bp, Homo sapiens
attgctgaactctta

SEQ ID NO: 774836 - DNA, 18 bp, Homo sapiens
attgctgaatcccatcag

SEQ ID NO: 774837 - DNA, 23 bp, Homo sapiens
attgctgagagaaatatggaact

SEQ ID NO: 774838 - DNA, 22 bp, Homo sapiens
attgctgagcctctgctcccca

SEQ ID NO: 774839 - DNA, 10 bp, Homo sapiens
attgctgcca

SEQ ID NO: 774840 - DNA, 21 bp, Homo sapiens
attgctgccaaaaccacatgg

SEQ ID NO: 774841 - DNA, 22 bp, Homo sapiens
attgctgccaaaaccacatggg

SEQ ID NO: 774842 - DNA, 23 bp, Homo sapiens
attgctgccaaggtggagggaag

SEQ ID NO: 774843 - DNA, 21 bp, Homo sapiens
attgctgccccatcagtgctc

SEQ ID NO: 774844 - DNA, 22 bp, Homo sapiens
attgctgcctttgtccccacac

SEQ ID NO: 774845 - DNA, 13 bp, Homo sapiens
attgctgcttgga

SEQ ID NO: 774846 - DNA, 21 bp, Homo sapiens
attgctggtagagacccccag

SEQ ID NO: 774847 - DNA, 21 bp, Homo sapiens
attgctgtaccacatctgctc

SEQ ID NO: 774848 - DNA, 12 bp, Homo sapiens
attgctgtctgg

SEQ ID NO: 774849 - DNA, 17 bp, Homo sapiens
attgctgtcttgcccca

SEQ ID NO: 774850 - DNA, 11 bp, Homo sapiens
attgctgtgcc

SEQ ID NO: 774851 - DNA, 15 bp, Homo sapiens
attgctgtgtctcct

SEQ ID NO: 774852 - DNA, 17 bp, Homo sapiens
attgctgttgtccctct

SEQ ID NO: 774853 - DNA, 16 bp, Homo sapiens
attgcttaaaatagca

SEQ ID NO: 774854 - DNA, 21 bp, Homo sapiens
attgcttacatttttacaata

SEQ ID NO: 774855 - DNA, 22 bp, Homo sapiens
attgcttacatttttacaataa

SEQ ID NO: 774856 - DNA, 14 bp, Homo sapiens
attgcttactgata

SEQ ID NO: 774857 - DNA, 16 bp, Homo sapiens
attgcttactgatatt

SEQ ID NO: 774858 - DNA, 14 bp, Homo sapiens
attgcttattttat

SEQ ID NO: 774859 - DNA, 16 bp, Homo sapiens
attgcttcaattaaaa

SEQ ID NO: 774860 - DNA, 23 bp, Homo sapiens
attgcttgagcctggctgtccaa

SEQ ID NO: 774861 - DNA, 10 bp, Homo sapiens
attgctttga

SEQ ID NO: 774862 - DNA, 13 bp, Homo sapiens
attgctttgctgc

SEQ ID NO: 774863 - DNA, 14 bp, Homo sapiens
attgctttgctgca

SEQ ID NO: 774864 - DNA, 20 bp, Homo sapiens
attgctttgtggttatcact

SEQ ID NO: 774865 - DNA, 20 bp, Homo sapiens
attgcttttgttgtgacttt

SEQ ID NO: 774866 - DNA, 20 bp, Homo sapiens
attgctttttctaatgtggt

SEQ ID NO: 774867 - DNA, 15 bp, Homo sapiens
attgcttttttgtat

SEQ ID NO: 774868 - DNA, 18 bp, Homo sapiens
attgcttttttgtattgg

SEQ ID NO: 774869 - DNA, 15 bp, Homo sapiens
attggaaagtgattt

SEQ ID NO: 774870 - DNA, 15 bp, Homo sapiens
attggaaatgtactt

SEQ ID NO: 774871 - DNA, 16 bp, Homo sapiens
attggaagacttgggt

SEQ ID NO: 774872 - DNA, 16 bp, Homo sapiens
attggaagcctgagca

SEQ ID NO: 774873 - DNA, 23 bp, Homo sapiens
attggaaggtatttttttaaatt

SEQ ID NO: 774874 - DNA, 14 bp, Homo sapiens
attggaatctgata

SEQ ID NO: 774875 - DNA, 15 bp, Homo sapiens
attggaatcttcacc

SEQ ID NO: 774876 - DNA, 19 bp, Homo sapiens
attggaatcttcacctcag

SEQ ID NO: 774877 - DNA, 22 bp, Homo sapiens
attgtcagccatcgtcctggga

SEQ ID NO: 774878 - DNA, 13 bp, Homo sapiens
attgtcagctact

SEQ ID NO: 774879 - DNA, 16 bp, Homo sapiens
attgtcataagtaaac

SEQ ID NO: 774880 - DNA, 19 bp, Homo sapiens
attgtcatctttttctaga

SEQ ID NO: 774881 - DNA, 13 bp, Homo sapiens
attgtcatttata

SEQ ID NO: 774882 - DNA, 13 bp, Homo sapiens
attgtcctccttt

SEQ ID NO: 774883 - DNA, 13 bp, Homo sapiens
attgtcctgtagc

SEQ ID NO: 774884 - DNA, 14 bp, Homo sapiens
attgtcctgtagct

SEQ ID NO: 774885 - DNA, 12 bp, Homo sapiens
attgtcctgtga

SEQ ID NO: 774886 - DNA, 12 bp, Homo sapiens
attgtcctgtgt

SEQ ID NO: 774887 - DNA, 18 bp, Homo sapiens
attgtcgctatgtgactt

SEQ ID NO: 774888 - DNA, 21 bp, Homo sapiens
attgtctactcctagaagaac

SEQ ID NO: 774889 - DNA, 12 bp, Homo sapiens
attgtctattta

SEQ ID NO: 774890 - DNA, 14 bp, Homo sapiens
attgtctatttatc

SEQ ID NO: 774891 - DNA, 18 bp, Homo sapiens
attgtctcctatatattt

SEQ ID NO: 774892 - DNA, 20 bp, Homo sapiens
attgtctcctatatatttct

SEQ ID NO: 774893 - DNA, 15 bp, Homo sapiens
attgtctctgggctg

SEQ ID NO: 774894 - DNA, 18 bp, Homo sapiens
attgtctgaacttgcatt

SEQ ID NO: 774895 - DNA, 14 bp, Homo sapiens
attgtctgtaaatc

SEQ ID NO: 774896 - DNA, 20 bp, Homo sapiens
attgtcttgcaacttcagtt

SEQ ID NO: 774897 - DNA, 20 bp, Homo sapiens
attgtcttgttatgtacaaa

SEQ ID NO: 774898 - DNA, 21 bp, Homo sapiens
attgtcttgttatgtacaaac

SEQ ID NO: 774899 - DNA, 23 bp, Homo sapiens
attgtcttgttatgtacaaacta

SEQ ID NO: 774900 - DNA, 19 bp, Homo sapiens
attgtctttaaaaactgtt

SEQ ID NO: 774901 - DNA, 20 bp, Homo sapiens
attgtctttaaaaactgttt

SEQ ID NO: 774902 - DNA, 13 bp, Homo sapiens
attgtctttgaat

SEQ ID NO: 774903 - DNA, 15 bp, Homo sapiens
attgtcttttagaca

SEQ ID NO: 774904 - DNA, 21 bp, Homo sapiens
attgtcttttagacaactaga

SEQ ID NO: 774905 - DNA, 13 bp, Homo sapiens
attgtgaatattt

SEQ ID NO: 774906 - DNA, 17 bp, Homo sapiens
attgtgaatatttggaa

SEQ ID NO: 774907 - DNA, 18 bp, Homo sapiens
attgtgacttcactgtat

SEQ ID NO: 774908 - DNA, 16 bp, Homo sapiens
attgtgacttggagat

SEQ ID NO: 774909 - DNA, 17 bp, Homo sapiens
attgtgaggcttctaat

SEQ ID NO: 774910 - DNA, 23 bp, Homo sapiens
attgtgatcagaccataatgtta

SEQ ID NO: 774911 - DNA, 14 bp, Homo sapiens
attgtgatgtatat

SEQ ID NO: 774912 - DNA, 14 bp, Homo sapiens
attgtgatgttttg

SEQ ID NO: 774913 - DNA, 24 bp, Homo sapiens
attgtgattacgtgtatgtttctt

SEQ ID NO: 774914 - DNA, 18 bp, Homo sapiens
attgtgattctgcctttg

SEQ ID NO: 774915 - DNA, 15 bp, Homo sapiens
attgtgattctgttt

SEQ ID NO: 774916 - DNA, 15 bp, Homo sapiens
attgtgcaatgtaaa

SEQ ID NO: 774917 - DNA, 17 bp, Homo sapiens
attgtgcaatgtaaata

SEQ ID NO: 774918 - DNA, 20 bp, Homo sapiens
attgtgcaatgtaaatattt

SEQ ID NO: 774919 - DNA, 20 bp, Homo sapiens
attgtgcagaaaagctcaga

SEQ ID NO: 774920 - DNA, 21 bp, Homo sapiens
cctcccactttgtctgtacat

SEQ ID NO: 774921 - DNA, 21 bp, Homo sapiens
cctcccagaaaaactggctct

SEQ ID NO: 774922 - DNA, 13 bp, Homo sapiens
cctcccagacagg

SEQ ID NO: 774923 - DNA, 20 bp, Homo sapiens
cctcccagacaggccctccc

SEQ ID NO: 774924 - DNA, 11 bp, Homo sapiens
cctcccagagg

SEQ ID NO: 774925 - DNA, 16 bp, Homo sapiens
cctcccagagtgctgg

SEQ ID NO: 774926 - DNA, 15 bp, Homo sapiens
cctcccagcccattg

SEQ ID NO: 774927 - DNA, 21 bp, Homo sapiens
cctcccagcccattgctgcca

SEQ ID NO: 774928 - DNA, 12 bp, Homo sapiens
cctcccagccct

SEQ ID NO: 774929 - DNA, 13 bp, Homo sapiens
cctcccagctgct

SEQ ID NO: 774930 - DNA, 15 bp, Homo sapiens
cctcccagctgcttt

SEQ ID NO: 774931 - DNA, 20 bp, Homo sapiens
cctcccagcttgtaggagct

SEQ ID NO: 774932 - DNA, 22 bp, Homo sapiens
cctcccaggaccctccactcac

SEQ ID NO: 774933 - DNA, 23 bp, Homo sapiens
cctcccaggaccctccactcact

SEQ ID NO: 774934 - DNA, 24 bp, Homo sapiens
cctcccaggaccctccactcactg

SEQ ID NO: 774935 - DNA, 15 bp, Homo sapiens
cctcccaggggactg

SEQ ID NO: 774936 - DNA, 21 bp, Homo sapiens
cctcccaggggagccagctgc

SEQ ID NO: 774937 - DNA, 19 bp, Homo sapiens
cctcccagtctcatctcct

SEQ ID NO: 774938 - DNA, 19 bp, Homo sapiens
cctcccagtgagactgccc

SEQ ID NO: 774939 - DNA, 13 bp, Homo sapiens
cctcccatccagc

SEQ ID NO: 774940 - DNA, 16 bp, Homo sapiens
cctcccatccagcgtc

SEQ ID NO: 774941 - DNA, 15 bp, Homo sapiens
cctcccatccagggc

SEQ ID NO: 774942 - DNA, 15 bp, Homo sapiens
cctcccatcctccag

SEQ ID NO: 774943 - DNA, 16 bp, Homo sapiens
cctcccatctgggagt

SEQ ID NO: 774944 - DNA, 15 bp, Homo sapiens
cctcccatgtcactg

SEQ ID NO: 774945 - DNA, 16 bp, Homo sapiens
cctcccatgtcactgc

SEQ ID NO: 774946 - DNA, 23 bp, Homo sapiens
cctcccattctgcaccacacctg

SEQ ID NO: 774947 - DNA, 20 bp, Homo sapiens
cctccccaaatcaatacact

SEQ ID NO: 774948 - DNA, 16 bp, Homo sapiens
cctccccaaccctgcc

SEQ ID NO: 774949 - DNA, 20 bp, Homo sapiens
cctccccacacacaggcctt

SEQ ID NO: 774950 - DNA, 18 bp, Homo sapiens
cctccccacacctcccta

SEQ ID NO: 774951 - DNA, 20 bp, Homo sapiens
cctccccacccaagagagga

SEQ ID NO: 774952 - DNA, 16 bp, Homo sapiens
cctccccaccttcccc

SEQ ID NO: 774953 - DNA, 23 bp, Homo sapiens
cctccccaccttccccagactca

SEQ ID NO: 774954 - DNA, 14 bp, Homo sapiens
cctccccagccagc

SEQ ID NO: 774955 - DNA, 14 bp, Homo sapiens
cctccccagctccg

SEQ ID NO: 774956 - DNA, 14 bp, Homo sapiens
cctccccaggctgg

SEQ ID NO: 774957 - DNA, 22 bp, Homo sapiens
cctccccaggctggagaccccc

SEQ ID NO: 774958 - DNA, 13 bp, Homo sapiens
cctccccatacac

SEQ ID NO: 774959 - DNA, 12 bp, Homo sapiens
cctccccatgca

SEQ ID NO: 774960 - DNA, 16 bp, Homo sapiens
cctccccatggagcca

SEQ ID NO: 774961 - DNA, 20 bp, Homo sapiens
cctccccattagagtcagcc

SEQ ID NO: 774962 - DNA, 15 bp, Homo sapiens
cctccccatttccca

SEQ ID NO: 774963 - DNA, 22 bp, Homo sapiens
cctccccatttcccatctgcac

SEQ ID NO: 774964 - DNA, 21 bp, Homo sapiens
cctcccccaacacctgctgcg

SEQ ID NO: 774965 - DNA, 18 bp, Homo sapiens
cctcccccaacccccacc

SEQ ID NO: 774966 - DNA, 12 bp, Homo sapiens
cctcccccagaa

SEQ ID NO: 774967 - DNA, 14 bp, Homo sapiens
cctcccccagcaga

SEQ ID NO: 774968 - DNA, 21 bp, Homo sapiens
cctcccccagccatgccagct

SEQ ID NO: 774969 - DNA, 16 bp, Homo sapiens
cctcccccagctcctt

SEQ ID NO: 774970 - DNA, 15 bp, Homo sapiens
cctcccccatcccca

SEQ ID NO: 774971 - DNA, 13 bp, Homo sapiens
cctccccccactg

SEQ ID NO: 774972 - DNA, 14 bp, Homo sapiens
cctccccccactgc

SEQ ID NO: 774973 - DNA, 15 bp, Homo sapiens
cctccccccactgca

SEQ ID NO: 774974 - DNA, 17 bp, Homo sapiens
cctccccccactgcagg

SEQ ID NO: 774975 - DNA, 19 bp, Homo sapiens
cctccccccagaccccgcc

SEQ ID NO: 774976 - DNA, 14 bp, Homo sapiens
cctccccccagact

SEQ ID NO: 774977 - DNA, 13 bp, Homo sapiens
cctccccccagct

SEQ ID NO: 774978 - DNA, 22 bp, Homo sapiens
cctccccccagctccctgcacc

SEQ ID NO: 774979 - DNA, 13 bp, Homo sapiens
cctcccccgcctc

SEQ ID NO: 774980 - DNA, 16 bp, Homo sapiens
cctccccctacccata

SEQ ID NO: 774981 - DNA, 17 bp, Homo sapiens
cctccccctcccccttc

SEQ ID NO: 774982 - DNA, 13 bp, Homo sapiens
cctccccctgcca

SEQ ID NO: 774983 - DNA, 14 bp, Homo sapiens
cctccccctgccag

SEQ ID NO: 774984 - DNA, 14 bp, Homo sapiens
cctcccccttcccc

SEQ ID NO: 774985 - DNA, 14 bp, Homo sapiens
cctccccctttggg

SEQ ID NO: 774986 - DNA, 14 bp, Homo sapiens
cctccccgcccctg

SEQ ID NO: 774987 - DNA, 21 bp, Homo sapiens
cctccccgcgcgttccttcgc

SEQ ID NO: 774988 - DNA, 22 bp, Homo sapiens
cctcccctatccacccagccca

SEQ ID NO: 774989 - DNA, 16 bp, Homo sapiens
cctcccctcagagccc

SEQ ID NO: 774990 - DNA, 13 bp, Homo sapiens
cctcccctcagcc

SEQ ID NO: 774991 - DNA, 19 bp, Homo sapiens
cctcccctcagcctgccca

SEQ ID NO: 774992 - DNA, 16 bp, Homo sapiens
cctcccctcccagtcc

SEQ ID NO: 774993 - DNA, 12 bp, Homo sapiens
cctcccctgcca

SEQ ID NO: 774994 - DNA, 13 bp, Homo sapiens
cctcccctgccag

SEQ ID NO: 774995 - DNA, 14 bp, Homo sapiens
cctcccctgccatt

SEQ ID NO: 774996 - DNA, 14 bp, Homo sapiens
cctcccctgcccta

SEQ ID NO: 774997 - DNA, 16 bp, Homo sapiens
cctcccctgccctggt

SEQ ID NO: 774998 - DNA, 15 bp, Homo sapiens
cctcccctgggcagg

SEQ ID NO: 774999 - DNA, 18 bp, Homo sapiens
cctccccttttaccactc

SEQ ID NO: 775000 - DNA, 18 bp, Homo sapiens
atttaactggtgcacttt

SEQ ID NO: 775001 - DNA, 23 bp, Homo sapiens
atttaactggtgcactttgtaaa

SEQ ID NO: 775002 - DNA, 21 bp, Homo sapiens
atttaagaaaatacaataaac

SEQ ID NO: 775003 - DNA, 14 bp, Homo sapiens
atttaagacacatt

SEQ ID NO: 775004 - DNA, 19 bp, Homo sapiens
atttaagagatacttgatg

SEQ ID NO: 775005 - DNA, 11 bp, Homo sapiens
atttaagcatt

SEQ ID NO: 775006 - DNA, 20 bp, Homo sapiens
atttaagccttttgtgtaat

SEQ ID NO: 775007 - DNA, 18 bp, Homo sapiens
atttaagcttatgtcaga

SEQ ID NO: 775008 - DNA, 18 bp, Homo sapiens
atttaaggaatcaaatct

SEQ ID NO: 775009 - DNA, 19 bp, Homo sapiens
atttaaggaatcaaatctt

SEQ ID NO: 775010 - DNA, 19 bp, Homo sapiens
atttaaggagaaccatgct

SEQ ID NO: 775011 - DNA, 13 bp, Homo sapiens
atttaagggaaaa

SEQ ID NO: 775012 - DNA, 14 bp, Homo sapiens
atttaagggaaaaa

SEQ ID NO: 775013 - DNA, 18 bp, Homo sapiens
atttaagggaaaaatata

SEQ ID NO: 775014 - DNA, 16 bp, Homo sapiens
atttaagggaaagaaa

SEQ ID NO: 775015 - DNA, 23 bp, Homo sapiens
atttaagtatggaatattcattt

SEQ ID NO: 775016 - DNA, 14 bp, Homo sapiens
atttaagtgaagga

SEQ ID NO: 775017 - DNA, 18 bp, Homo sapiens
atttaagttatcaacttt

SEQ ID NO: 775018 - DNA, 16 bp, Homo sapiens
atttaataaaaaggaa

SEQ ID NO: 775019 - DNA, 17 bp, Homo sapiens
atttaataaaaaggaat

SEQ ID NO: 775020 - DNA, 14 bp, Homo sapiens
atttaataaagaaa

SEQ ID NO: 775021 - DNA, 15 bp, Homo sapiens
atttaataaagaaat

SEQ ID NO: 775022 - DNA, 16 bp, Homo sapiens
atttaataaagaaata

SEQ ID NO: 775023 - DNA, 23 bp, Homo sapiens
atttaataaagaaatatttacct

SEQ ID NO: 775024 - DNA, 14 bp, Homo sapiens
atttaataatatca

SEQ ID NO: 775025 - DNA, 20 bp, Homo sapiens
atttaatatctggcactgtt

SEQ ID NO: 775026 - DNA, 22 bp, Homo sapiens
atttaatatctggcactgttaa

SEQ ID NO: 775027 - DNA, 23 bp, Homo sapiens
atttaatatctggcactgttaat

SEQ ID NO: 775028 - DNA, 14 bp, Homo sapiens
atttaatatgcaaa

SEQ ID NO: 775029 - DNA, 14 bp, Homo sapiens
atttaatgaaagac

SEQ ID NO: 775030 - DNA, 15 bp, Homo sapiens
atttaatgaaagact

SEQ ID NO: 775031 - DNA, 13 bp, Homo sapiens
atttaatgcatta

SEQ ID NO: 775032 - DNA, 14 bp, Homo sapiens
atttaatgctgcct

SEQ ID NO: 775033 - DNA, 20 bp, Homo sapiens
atttaatggactgtgaattt

SEQ ID NO: 775034 - DNA, 14 bp, Homo sapiens
atttaatgtgagtt

SEQ ID NO: 775035 - DNA, 16 bp, Homo sapiens
atttaatgtgagtttg

SEQ ID NO: 775036 - DNA, 16 bp, Homo sapiens
atttaatgtttgattt

SEQ ID NO: 775037 - DNA, 20 bp, Homo sapiens
atttaatgttttaaatgtac

SEQ ID NO: 775038 - DNA, 15 bp, Homo sapiens
atttaattaaagcac

SEQ ID NO: 775039 - DNA, 17 bp, Homo sapiens
atttaattaaagcacac

SEQ ID NO: 775040 - DNA, 12 bp, Homo sapiens
atttaattgctt

SEQ ID NO: 775041 - DNA, 13 bp, Homo sapiens
atttaattgcttt

SEQ ID NO: 775042 - DNA, 18 bp, Homo sapiens
atttaatttgaaatatgg

SEQ ID NO: 775043 - DNA, 13 bp, Homo sapiens
atttaatttgtat

SEQ ID NO: 775044 - DNA, 20 bp, Homo sapiens
atttaattttgacactgaaa

SEQ ID NO: 775045 - DNA, 19 bp, Homo sapiens
atttacaaaaatataaaat

SEQ ID NO: 775046 - DNA, 14 bp, Homo sapiens
atttacaaaattta

SEQ ID NO: 775047 - DNA, 14 bp, Homo sapiens
atttacaaactgaa

SEQ ID NO: 775048 - DNA, 18 bp, Homo sapiens
atttacaaagtgtgtatt

SEQ ID NO: 775049 - DNA, 14 bp, Homo sapiens
atttacaagaagaa

SEQ ID NO: 775050 - DNA, 20 bp, Homo sapiens
atttacaagagctgttcatg

SEQ ID NO: 775051 - DNA, 17 bp, Homo sapiens
atttacaataaatattc

SEQ ID NO: 775052 - DNA, 18 bp, Homo sapiens
atttacaataaatattct

SEQ ID NO: 775053 - DNA, 19 bp, Homo sapiens
atttacaataaatattctg

SEQ ID NO: 775054 - DNA, 16 bp, Homo sapiens
atttacaatgtattaa

SEQ ID NO: 775055 - DNA, 12 bp, Homo sapiens
cctcctcctttt

SEQ ID NO: 775056 - DNA, 19 bp, Homo sapiens
cctcctcgctcctccttcc

SEQ ID NO: 775057 - DNA, 20 bp, Homo sapiens
cctcctcgctcctccttccc

SEQ ID NO: 775058 - DNA, 24 bp, Homo sapiens
cctcctcggaaccgctcacctaga

SEQ ID NO: 775059 - DNA, 19 bp, Homo sapiens
cctcctcggagagcagcag

SEQ ID NO: 775060 - DNA, 16 bp, Homo sapiens
cctcctctcccatccc

SEQ ID NO: 775061 - DNA, 22 bp, Homo sapiens
cctcctctgaggaagcagttgg

SEQ ID NO: 775062 - DNA, 21 bp, Homo sapiens
cctcctctgcactcccacctg

SEQ ID NO: 775063 - DNA, 21 bp, Homo sapiens
cctcctctgcctacagccagg

SEQ ID NO: 775064 - DNA, 22 bp, Homo sapiens
cctcctctggacggcaggctca

SEQ ID NO: 775065 - DNA, 16 bp, Homo sapiens
cctcctctgtccaggg

SEQ ID NO: 775066 - DNA, 18 bp, Homo sapiens
cctcctctgtccagggcc

SEQ ID NO: 775067 - DNA, 21 bp, Homo sapiens
cctcctcttcccttagcctct

SEQ ID NO: 775068 - DNA, 14 bp, Homo sapiens
cctcctcttctgac

SEQ ID NO: 775069 - DNA, 17 bp, Homo sapiens
cctcctcttctgacgtg

SEQ ID NO: 775070 - DNA, 18 bp, Homo sapiens
cctcctctttctctcccc

SEQ ID NO: 775071 - DNA, 21 bp, Homo sapiens
cctcctgaaacttacacacaa

SEQ ID NO: 775072 - DNA, 22 bp, Homo sapiens
cctcctgaagcctctgccctgc

SEQ ID NO: 775073 - DNA, 15 bp, Homo sapiens
cctcctgacctgtca

SEQ ID NO: 775074 - DNA, 12 bp, Homo sapiens
cctcctgagaaa

SEQ ID NO: 775075 - DNA, 14 bp, Homo sapiens
cctcctgagcctgt

SEQ ID NO: 775076 - DNA, 18 bp, Homo sapiens
cctcctgagcctgtgggt

SEQ ID NO: 775077 - DNA, 19 bp, Homo sapiens
cctcctgagtgccccactt

SEQ ID NO: 775078 - DNA, 14 bp, Homo sapiens
cctcctgcacacag

SEQ ID NO: 775079 - DNA, 16 bp, Homo sapiens
cctcctgcacacaggg

SEQ ID NO: 775080 - DNA, 21 bp, Homo sapiens
cctcctgcagacacctggact

SEQ ID NO: 775081 - DNA, 22 bp, Homo sapiens
cctcctgcagacacctggactg

SEQ ID NO: 775082 - DNA, 12 bp, Homo sapiens
cctcctgcccag

SEQ ID NO: 775083 - DNA, 16 bp, Homo sapiens
cctcctgcccagctcc

SEQ ID NO: 775084 - DNA, 19 bp, Homo sapiens
cctcctgcccagctcctca

SEQ ID NO: 775085 - DNA, 13 bp, Homo sapiens
cctcctgcccagg

SEQ ID NO: 775086 - DNA, 14 bp, Homo sapiens
cctcctgcccagga

SEQ ID NO: 775087 - DNA, 17 bp, Homo sapiens
cctcctgcccaggactg

SEQ ID NO: 775088 - DNA, 16 bp, Homo sapiens
cctcctgcccaggaga

SEQ ID NO: 775089 - DNA, 13 bp, Homo sapiens
cctcctgccccct

SEQ ID NO: 775090 - DNA, 17 bp, Homo sapiens
cctcctgccctgtccct

SEQ ID NO: 775091 - DNA, 20 bp, Homo sapiens
cctcctgccctgtccctgtc

SEQ ID NO: 775092 - DNA, 18 bp, Homo sapiens
cctcctgccgactcctgg

SEQ ID NO: 775093 - DNA, 19 bp, Homo sapiens
cctcctgccgactcctggg

SEQ ID NO: 775094 - DNA, 13 bp, Homo sapiens
cctcctgcctcag

SEQ ID NO: 775095 - DNA, 16 bp, Homo sapiens
cctcctgcctcagcct

SEQ ID NO: 775096 - DNA, 17 bp, Homo sapiens
cctcctgcctcagcctt

SEQ ID NO: 775097 - DNA, 14 bp, Homo sapiens
cctcctgcctgggg

SEQ ID NO: 775098 - DNA, 15 bp, Homo sapiens
cctcctgcggctcag

SEQ ID NO: 775099 - DNA, 12 bp, Homo sapiens
cctcctgctcct

SEQ ID NO: 775100 - DNA, 14 bp, Homo sapiens
cctcctgctcctca

SEQ ID NO: 775101 - DNA, 17 bp, Homo sapiens
cctcctgctcctcaccc

SEQ ID NO: 775102 - DNA, 11 bp, Homo sapiens
cctcctgctct

SEQ ID NO: 775103 - DNA, 12 bp, Homo sapiens
cctcctgctggg

SEQ ID NO: 775104 - DNA, 17 bp, Homo sapiens
cctcctggaaccttgct

SEQ ID NO: 775105 - DNA, 19 bp, Homo sapiens
cctcctggaaccttgctgt

SEQ ID NO: 775106 - DNA, 17 bp, Homo sapiens
cctcctggaagggacct

SEQ ID NO: 775107 - DNA, 12 bp, Homo sapiens
cctcctggacac

SEQ ID NO: 775108 - DNA, 23 bp, Homo sapiens
cctcctggagcagaaagtgcctt

SEQ ID NO: 775109 - DNA, 20 bp, Homo sapiens
cctcctggagcatcccaggc

SEQ ID NO: 775110 - DNA, 20 bp, Homo sapiens
cctcctggagctctgtgggt

SEQ ID NO: 775111 - DNA, 13 bp, Homo sapiens
cctcctggccaga

SEQ ID NO: 775112 - DNA, 14 bp, Homo sapiens
cctcctggccagac

SEQ ID NO: 775113 - DNA, 22 bp, Homo sapiens
cctcctggcccgccctcacctc

SEQ ID NO: 775114 - DNA, 16 bp, Homo sapiens
cctcctggccggggcc

SEQ ID NO: 775115 - DNA, 21 bp, Homo sapiens
cctcctggccggggcccctca

SEQ ID NO: 775116 - DNA, 12 bp, Homo sapiens
cctcctgggggc

SEQ ID NO: 775117 - DNA, 13 bp, Homo sapiens
cctcctgggggct

SEQ ID NO: 775118 - DNA, 19 bp, Homo sapiens
cctcctgggggctggctcc

SEQ ID NO: 775119 - DNA, 23 bp, Homo sapiens
cctcctgggggctggctcccagg

SEQ ID NO: 775120 - DNA, 17 bp, Homo sapiens
cctcctgggttcaagca

SEQ ID NO: 775121 - DNA, 13 bp, Homo sapiens
cctcctggtcctg

SEQ ID NO: 775122 - DNA, 15 bp, Homo sapiens
cctcctggtcctgga

SEQ ID NO: 775123 - DNA, 17 bp, Homo sapiens
atttgtaaatgatttta

SEQ ID NO: 775124 - DNA, 13 bp, Homo sapiens
atttgtaaatgct

SEQ ID NO: 775125 - DNA, 20 bp, Homo sapiens
atttgtaaatttagtgtttt

SEQ ID NO: 775126 - DNA, 21 bp, Homo sapiens
atttgtaacctcagctctggg

SEQ ID NO: 775127 - DNA, 14 bp, Homo sapiens
atttgtaataaagt

SEQ ID NO: 775128 - DNA, 22 bp, Homo sapiens
atttgtaatatggaaatctttt

SEQ ID NO: 775129 - DNA, 21 bp, Homo sapiens
atttgtacatagttatttatt

SEQ ID NO: 775130 - DNA, 16 bp, Homo sapiens
atttgtacatatgtaa

SEQ ID NO: 775131 - DNA, 21 bp, Homo sapiens
atttgtacctctaagtacata

SEQ ID NO: 775132 - DNA, 23 bp, Homo sapiens
atttgtactgaaaaatggtaatt

SEQ ID NO: 775133 - DNA, 22 bp, Homo sapiens
atttgtactgtttaatgttctg

SEQ ID NO: 775134 - DNA, 11 bp, Homo sapiens
atttgtacttc

SEQ ID NO: 775135 - DNA, 13 bp, Homo sapiens
atttgtacttctt

SEQ ID NO: 775136 - DNA, 19 bp, Homo sapiens
atttgtacttcttattgca

SEQ ID NO: 775137 - DNA, 14 bp, Homo sapiens
atttgtaggagaaa

SEQ ID NO: 775138 - DNA, 13 bp, Homo sapiens
atttgtagttgtt

SEQ ID NO: 775139 - DNA, 22 bp, Homo sapiens
atttgtataaattaaataaact

SEQ ID NO: 775140 - DNA, 21 bp, Homo sapiens
atttgtatagttgcttgcctg

SEQ ID NO: 775141 - DNA, 14 bp, Homo sapiens
atttgtatatcatg

SEQ ID NO: 775142 - DNA, 23 bp, Homo sapiens
atttgtatctctgaagcatgttt

SEQ ID NO: 775143 - DNA, 23 bp, Homo sapiens
atttgtatgaataatgaaaataa

SEQ ID NO: 775144 - DNA, 15 bp, Homo sapiens
atttgtatgatattt

SEQ ID NO: 775145 - DNA, 14 bp, Homo sapiens
atttgtatgctaaa

SEQ ID NO: 775146 - DNA, 18 bp, Homo sapiens
atttgtattaataaagca

SEQ ID NO: 775147 - DNA, 21 bp, Homo sapiens
atttgtatttctcttgtcctt

SEQ ID NO: 775148 - DNA, 17 bp, Homo sapiens
atttgtattttgtgtga

SEQ ID NO: 775149 - DNA, 14 bp, Homo sapiens
atttgtcaatgaca

SEQ ID NO: 775150 - DNA, 20 bp, Homo sapiens
atttgtcagtatttttgccg

SEQ ID NO: 775151 - DNA, 23 bp, Homo sapiens
atttgtcatcgttccccacccct

SEQ ID NO: 775152 - DNA, 21 bp, Homo sapiens
atttgtcatgacagtgcttgc

SEQ ID NO: 775153 - DNA, 19 bp, Homo sapiens
atttgtcatgctgggattt

SEQ ID NO: 775154 - DNA, 16 bp, Homo sapiens
atttgtccaattgagt

SEQ ID NO: 775155 - DNA, 17 bp, Homo sapiens
atttgtccattgtaaat

SEQ ID NO: 775156 - DNA, 22 bp, Homo sapiens
atttgtccattgtaaatctgaa

SEQ ID NO: 775157 - DNA, 15 bp, Homo sapiens
atttgtcccagcctg

SEQ ID NO: 775158 - DNA, 18 bp, Homo sapiens
atttgtccttttatttct

SEQ ID NO: 775159 - DNA, 16 bp, Homo sapiens
atttgtcttaaaaatt

SEQ ID NO: 775160 - DNA, 15 bp, Homo sapiens
atttgtctttcagga

SEQ ID NO: 775161 - DNA, 14 bp, Homo sapiens
atttgtctttttgt

SEQ ID NO: 775162 - DNA, 13 bp, Homo sapiens
atttgtgaagaat

SEQ ID NO: 775163 - DNA, 15 bp, Homo sapiens
atttgtgaatttgca

SEQ ID NO: 775164 - DNA, 17 bp, Homo sapiens
atttgtgacaaaaaatt

SEQ ID NO: 775165 - DNA, 15 bp, Homo sapiens
atttgtgactctttc

SEQ ID NO: 775166 - DNA, 15 bp, Homo sapiens
atttgtgatacaatg

SEQ ID NO: 775167 - DNA, 15 bp, Homo sapiens
atttgtgatagcact

SEQ ID NO: 775168 - DNA, 17 bp, Homo sapiens
atttgtgatagcacttt

SEQ ID NO: 775169 - DNA, 18 bp, Homo sapiens
atttgtgcattttattga

SEQ ID NO: 775170 - DNA, 21 bp, Homo sapiens
atttgtgctatagtatttgat

SEQ ID NO: 775171 - DNA, 19 bp, Homo sapiens
atttgtggttagaatcttg

SEQ ID NO: 775172 - DNA, 18 bp, Homo sapiens
atttgtgtaatatgaaat

SEQ ID NO: 775173 - DNA, 19 bp, Homo sapiens
atttgtgtattttcctgga

SEQ ID NO: 775174 - DNA, 14 bp, Homo sapiens
atttgtgtgtgtgc

SEQ ID NO: 775175 - DNA, 19 bp, Homo sapiens
atttgtgttgaaggaactt

SEQ ID NO: 775176 - DNA, 13 bp, Homo sapiens
atttgtgttttaa

SEQ ID NO: 775177 - DNA, 19 bp, Homo sapiens
atttgtgtttttctttttc

SEQ ID NO: 775178 - DNA, 14 bp, Homo sapiens
atttgttaaaatac

SEQ ID NO: 775179 - DNA, 19 bp, Homo sapiens
atttgttaatttagaaaac

SEQ ID NO: 775180 - DNA, 23 bp, Homo sapiens
atttgttaatttagaaaacttta

SEQ ID NO: 775181 - DNA, 22 bp, Homo sapiens
atttgttactcatcgggcccag

SEQ ID NO: 775182 - DNA, 16 bp, Homo sapiens
atttgttattttgcaa

SEQ ID NO: 775183 - DNA, 12 bp, Homo sapiens
atttgttcaagt

SEQ ID NO: 775184 - DNA, 18 bp, Homo sapiens
atttgttcactgaaggtg

SEQ ID NO: 775185 - DNA, 13 bp, Homo sapiens
atttgttcctgga

SEQ ID NO: 775186 - DNA, 20 bp, Homo sapiens
atttgttcctggagttttga

SEQ ID NO: 775187 - DNA, 23 bp, Homo sapiens
atttgttcctggagttttgattt

SEQ ID NO: 775188 - DNA, 13 bp, Homo sapiens
atttgttcttgta

SEQ ID NO: 775189 - DNA, 14 bp, Homo sapiens
atttgttgaaatta

SEQ ID NO: 775190 - DNA, 16 bp, Homo sapiens
atttgttgaaattatg

SEQ ID NO: 775191 - DNA, 20 bp, Homo sapiens
atttgttgacagcaaaatgt

SEQ ID NO: 775192 - DNA, 22 bp, Homo sapiens
atttgttgagagtgtgaccaaa

SEQ ID NO: 775193 - DNA, 11 bp, Homo sapiens
atttgttgcat

SEQ ID NO: 775194 - DNA, 13 bp, Homo sapiens
atttgttggaatg

SEQ ID NO: 775195 - DNA, 14 bp, Homo sapiens
atttgtttaaaatt

SEQ ID NO: 775196 - DNA, 16 bp, Homo sapiens
atttgtttaaaattct

SEQ ID NO: 775197 - DNA, 14 bp, Homo sapiens
atttgtttaaacaa

SEQ ID NO: 775198 - DNA, 18 bp, Homo sapiens
atttgtttaaacaatctt

SEQ ID NO: 775199 - DNA, 22 bp, Homo sapiens
atttgtttaaagaataaagtcc

SEQ ID NO: 775200 - DNA, 16 bp, Homo sapiens
atttgtttacatgcag

SEQ ID NO: 775201 - DNA, 20 bp, Homo sapiens
atttgtttatggtaaaaaat

SEQ ID NO: 775202 - DNA, 13 bp, Homo sapiens
atttgtttatgta

SEQ ID NO: 775203 - DNA, 17 bp, Homo sapiens
atttgtttatgtaattt

SEQ ID NO: 775204 - DNA, 13 bp, Homo sapiens
atttgtttctact

SEQ ID NO: 775205 - DNA, 13 bp, Homo sapiens
atttgtttgaact

SEQ ID NO: 775206 - DNA, 14 bp, Homo sapiens
atttgtttgaactg

SEQ ID NO: 775207 - DNA, 12 bp, Homo sapiens
atttgtttgtat

SEQ ID NO: 775208 - DNA, 23 bp, Homo sapiens
atttgtttgttttcttgtctgtg

SEQ ID NO: 775209 - DNA, 17 bp, Homo sapiens
cctgactctctgtgacc

SEQ ID NO: 775210 - DNA, 18 bp, Homo sapiens
cctgactgtcagggaggg

SEQ ID NO: 775211 - DNA, 19 bp, Homo sapiens
cctgactgttgccccccag

SEQ ID NO: 775212 - DNA, 23 bp, Homo sapiens
cctgacttctggagatggatcct

SEQ ID NO: 775213 - DNA, 13 bp, Homo sapiens
cctgacttgagcc

SEQ ID NO: 775214 - DNA, 20 bp, Homo sapiens
cctgacttgagccactcctt

SEQ ID NO: 775215 - DNA, 15 bp, Homo sapiens
cctgacttggctggg

SEQ ID NO: 775216 - DNA, 18 bp, Homo sapiens
cctgacttggctggggag

SEQ ID NO: 775217 - DNA, 13 bp, Homo sapiens
cctgacttttctg

SEQ ID NO: 775218 - DNA, 17 bp, Homo sapiens
cctgagaaagcccacct

SEQ ID NO: 775219 - DNA, 20 bp, Homo sapiens
cctgagaaagcccacctggg

SEQ ID NO: 775220 - DNA, 22 bp, Homo sapiens
cctgagaaagcccacctgggct

SEQ ID NO: 775221 - DNA, 20 bp, Homo sapiens
cctgagaagaagtggctgcc

SEQ ID NO: 775222 - DNA, 16 bp, Homo sapiens
cctgagaagctgctcc

SEQ ID NO: 775223 - DNA, 19 bp, Homo sapiens
cctgagaagctgctccagg

SEQ ID NO: 775224 - DNA, 12 bp, Homo sapiens
cctgagaatgag

SEQ ID NO: 775225 - DNA, 15 bp, Homo sapiens
cctgagacagcacca

SEQ ID NO: 775226 - DNA, 18 bp, Homo sapiens
cctgagacagcaccactg

SEQ ID NO: 775227 - DNA, 20 bp, Homo sapiens
cctgagacagcaccactgct

SEQ ID NO: 775228 - DNA, 16 bp, Homo sapiens
cctgagaccaccccca

SEQ ID NO: 775229 - DNA, 15 bp, Homo sapiens
cctgagaccctggga

SEQ ID NO: 775230 - DNA, 17 bp, Homo sapiens
cctgagaggcaggcata

SEQ ID NO: 775231 - DNA, 20 bp, Homo sapiens
cctgagaggggaagcggccc

SEQ ID NO: 775232 - DNA, 15 bp, Homo sapiens
cctgagagtcagctc

SEQ ID NO: 775233 - DNA, 17 bp, Homo sapiens
cctgagagtttcctcag

SEQ ID NO: 775234 - DNA, 15 bp, Homo sapiens
cctgagatcccctga

SEQ ID NO: 775235 - DNA, 17 bp, Homo sapiens
cctgagatgcaggtgat

SEQ ID NO: 775236 - DNA, 20 bp, Homo sapiens
cctgagatgcaggtgatgcc

SEQ ID NO: 775237 - DNA, 23 bp, Homo sapiens
cctgagcaacagagtgagaccct

SEQ ID NO: 775238 - DNA, 23 bp, Homo sapiens
cctgagcaactcttgattatcca

SEQ ID NO: 775239 - DNA, 21 bp, Homo sapiens
cctgagcagaatactggtctc

SEQ ID NO: 775240 - DNA, 12 bp, Homo sapiens
cctgagcattca

SEQ ID NO: 775241 - DNA, 23 bp, Homo sapiens
cctgagcattcaggcagcactga

SEQ ID NO: 775242 - DNA, 16 bp, Homo sapiens
cctgagcccaggagct

SEQ ID NO: 775243 - DNA, 23 bp, Homo sapiens
cctgagccccagggtgcccagaa

SEQ ID NO: 775244 - DNA, 18 bp, Homo sapiens
cctgagcccccacccggg

SEQ ID NO: 775245 - DNA, 18 bp, Homo sapiens
cctgcatctgaccagcag

SEQ ID NO: 775246 - DNA, 18 bp, Homo sapiens
cctgcatgcaactaattc

SEQ ID NO: 775247 - DNA, 20 bp, Homo sapiens
cctgcatgctgcccagccac

SEQ ID NO: 775248 - DNA, 14 bp, Homo sapiens
cctgcatggagaag

SEQ ID NO: 775249 - DNA, 13 bp, Homo sapiens
cctgcatgttctg

SEQ ID NO: 775250 - DNA, 14 bp, Homo sapiens
cctgcattgtaaat

SEQ ID NO: 775251 - DNA, 16 bp, Homo sapiens
cctgcatttctgagtt

SEQ ID NO: 775252 - DNA, 18 bp, Homo sapiens
cctgcattttcctcttgt

SEQ ID NO: 775253 - DNA, 23 bp, Homo sapiens
cctgccaaagtgcctgggaagcc

SEQ ID NO: 775254 - DNA, 15 bp, Homo sapiens
cctgccaatgctcca

SEQ ID NO: 775255 - DNA, 23 bp, Homo sapiens
cctgccacaaaccaccaggactg

SEQ ID NO: 775256 - DNA, 17 bp, Homo sapiens
cctgccacagccagagg

SEQ ID NO: 775257 - DNA, 12 bp, Homo sapiens
cctgccaccagg

SEQ ID NO: 775258 - DNA, 14 bp, Homo sapiens
cctgccaccaggcc

SEQ ID NO: 775259 - DNA, 18 bp, Homo sapiens
cctgccaccaggccacct

SEQ ID NO: 775260 - DNA, 15 bp, Homo sapiens
cctgccaccagggag

SEQ ID NO: 775261 - DNA, 15 bp, Homo sapiens
cctgccaccgactgc

SEQ ID NO: 775262 - DNA, 18 bp, Homo sapiens
cctgccaccgactgccca

SEQ ID NO: 775263 - DNA, 19 bp, Homo sapiens
cctgccaccgactgcccag

SEQ ID NO: 775264 - DNA, 22 bp, Homo sapiens
cctgccaccggaggtcactcca

SEQ ID NO: 775265 - DNA, 17 bp, Homo sapiens
cctgccacgtcccgctg

SEQ ID NO: 775266 - DNA, 20 bp, Homo sapiens
cctgccacgtcccgctgcct

SEQ ID NO: 775267 - DNA, 14 bp, Homo sapiens
cctgccactcaccc

SEQ ID NO: 775268 - DNA, 16 bp, Homo sapiens
cctgccactcaccctt

SEQ ID NO: 775269 - DNA, 17 bp, Homo sapiens
cctgccactcacccttc

SEQ ID NO: 775270 - DNA, 18 bp, Homo sapiens
cctgccactcacccttcc

SEQ ID NO: 775271 - DNA, 16 bp, Homo sapiens
cctgccactctctggg

SEQ ID NO: 775272 - DNA, 14 bp, Homo sapiens
cctgccactgggct

SEQ ID NO: 775273 - DNA, 15 bp, Homo sapiens
cctgccactgggctc

SEQ ID NO: 775274 - DNA, 16 bp, Homo sapiens
cctgccactgggctct

SEQ ID NO: 775275 - DNA, 18 bp, Homo sapiens
cctgccactgggctctgg

SEQ ID NO: 775276 - DNA, 21 bp, Homo sapiens
cctgccactgggctctggacc

SEQ ID NO: 775277 - DNA, 14 bp, Homo sapiens
cctgccagcagggg

SEQ ID NO: 775278 - DNA, 15 bp, Homo sapiens
cctgccagcctggct

SEQ ID NO: 775279 - DNA, 13 bp, Homo sapiens
cctgccagctgcc

SEQ ID NO: 775280 - DNA, 12 bp, Homo sapiens
cctgccaggcac

SEQ ID NO: 775281 - DNA, 14 bp, Homo sapiens
cctgccaggcaggg

SEQ ID NO: 775282 - DNA, 19 bp, Homo sapiens
cctgccaggcaggggtggg

SEQ ID NO: 775283 - DNA, 22 bp, Homo sapiens
cctgccaggcaggggtgggggt

SEQ ID NO: 775284 - DNA, 12 bp, Homo sapiens
cctgccaggcat

SEQ ID NO: 775285 - DNA, 15 bp, Homo sapiens
cctgccaggcatggt

SEQ ID NO: 775286 - DNA, 13 bp, Homo sapiens
cctgccagggcag

SEQ ID NO: 775287 - DNA, 13 bp, Homo sapiens
cctgccagtccca

SEQ ID NO: 775288 - DNA, 19 bp, Homo sapiens
cctgccagtgccagggtgg

SEQ ID NO: 775289 - DNA, 20 bp, Homo sapiens
cctgccagtgccttacctcc

SEQ ID NO: 775290 - DNA, 21 bp, Homo sapiens
cctgccagtgccttacctcct

SEQ ID NO: 775291 - DNA, 17 bp, Homo sapiens
cctgccatcttcccagc

SEQ ID NO: 775292 - DNA, 19 bp, Homo sapiens
cctgccatcttctccccga

SEQ ID NO: 775293 - DNA, 19 bp, Homo sapiens
cctgccatgtacctcccct

SEQ ID NO: 775294 - DNA, 21 bp, Homo sapiens
cctgccatgtacctcccctgc

SEQ ID NO: 775295 - DNA, 23 bp, Homo sapiens
cctgccatgtacctcccctgcct

SEQ ID NO: 775296 - DNA, 23 bp, Homo sapiens
cctgccattggcctcttgtccct

SEQ ID NO: 775297 - DNA, 17 bp, Homo sapiens
cctgccatttgcaccct

SEQ ID NO: 775298 - DNA, 23 bp, Homo sapiens
cctgccatttgcaccctccgcct

SEQ ID NO: 775299 - DNA, 13 bp, Homo sapiens
cctgccatttttt

SEQ ID NO: 775300 - DNA, 14 bp, Homo sapiens
cctgccatttttta

SEQ ID NO: 775301 - DNA, 23 bp, Homo sapiens
cctgcccaaacccttaactgaca

SEQ ID NO: 775302 - DNA, 14 bp, Homo sapiens
cctgcccaaactcc

SEQ ID NO: 775303 - DNA, 17 bp, Homo sapiens
cctgcccaaactcccct

SEQ ID NO: 775304 - DNA, 19 bp, Homo sapiens
cctgcccaaactccccttc

SEQ ID NO: 775305 - DNA, 18 bp, Homo sapiens
cctgcccaagtgaccagg

SEQ ID NO: 775306 - DNA, 19 bp, Homo sapiens
cctgcccaagtgaccaggg

SEQ ID NO: 775307 - DNA, 20 bp, Homo sapiens
cctgcccaagtgaccaggga

SEQ ID NO: 775308 - DNA, 13 bp, Homo sapiens
cctgcccaatgct

SEQ ID NO: 775309 - DNA, 15 bp, Homo sapiens
cctgcccaccctacc

SEQ ID NO: 775310 - DNA, 20 bp, Homo sapiens
cctgcccaccctaccagctc

SEQ ID NO: 775311 - DNA, 22 bp, Homo sapiens
cctgcccaccctaccagctcct

SEQ ID NO: 775312 - DNA, 14 bp, Homo sapiens
cctgcccacctctc

SEQ ID NO: 775313 - DNA, 16 bp, Homo sapiens
cctgcccacctctccc

SEQ ID NO: 775314 - DNA, 23 bp, Homo sapiens
cctgcccacctctccctgcatcc

SEQ ID NO: 775315 - DNA, 17 bp, Homo sapiens
cctgcccacgggaggac

SEQ ID NO: 775316 - DNA, 19 bp, Homo sapiens
cctgcccacttagccgtcc

SEQ ID NO: 775317 - DNA, 13 bp, Homo sapiens
cctgcccagactg

SEQ ID NO: 775318 - DNA, 16 bp, Homo sapiens
cctgcccagcctgtgg

SEQ ID NO: 775319 - DNA, 16 bp, Homo sapiens
cctgcccaggactgca

SEQ ID NO: 775320 - DNA, 20 bp, Homo sapiens
cctgcccaggtggcctcctg

SEQ ID NO: 775321 - DNA, 20 bp, Homo sapiens
cctgccccaatccctttatt

SEQ ID NO: 775322 - DNA, 16 bp, Homo sapiens
cctgccccacacggac

SEQ ID NO: 775323 - DNA, 21 bp, Homo sapiens
cctgccccaccacgcatgctc

SEQ ID NO: 775324 - DNA, 16 bp, Homo sapiens
cctgccccaccccatc

SEQ ID NO: 775325 - DNA, 22 bp, Homo sapiens
cctgccccaccccatccagcca

SEQ ID NO: 775326 - DNA, 15 bp, Homo sapiens
cctgccccagcccct

SEQ ID NO: 775327 - DNA, 18 bp, Homo sapiens
cctgccccaggcctgaaa

SEQ ID NO: 775328 - DNA, 16 bp, Homo sapiens
cctgccccaggcctgg

SEQ ID NO: 775329 - DNA, 17 bp, Homo sapiens
cctgccccaggcctgga

SEQ ID NO: 775330 - DNA, 14 bp, Homo sapiens
cctgcccccaagtc

SEQ ID NO: 775331 - DNA, 13 bp, Homo sapiens
cctgcccccagcc

SEQ ID NO: 775332 - DNA, 14 bp, Homo sapiens
cctgcccccagccc

SEQ ID NO: 775333 - DNA, 17 bp, Homo sapiens
cctgcccccagccccgg

SEQ ID NO: 775334 - DNA, 20 bp, Homo sapiens
cctgcccccatctccccagg

SEQ ID NO: 775335 - DNA, 14 bp, Homo sapiens
cctgccccccagcc

SEQ ID NO: 775336 - DNA, 22 bp, Homo sapiens
cctgccccccagcctctggcat

SEQ ID NO: 775337 - DNA, 14 bp, Homo sapiens
cctgccccccagtc

SEQ ID NO: 775338 - DNA, 18 bp, Homo sapiens
cctgccccctgccagtga

SEQ ID NO: 775339 - DNA, 12 bp, Homo sapiens
cctgccccctgg

SEQ ID NO: 775340 - DNA, 18 bp, Homo sapiens
cctgccccctgggctggg

SEQ ID NO: 775341 - DNA, 22 bp, Homo sapiens
cctgccccctgggctggggcct

SEQ ID NO: 775342 - DNA, 17 bp, Homo sapiens
cctgcccccttctccca

SEQ ID NO: 775343 - DNA, 21 bp, Homo sapiens
cctgcccccttctcccacact

SEQ ID NO: 775344 - DNA, 22 bp, Homo sapiens
cctgcccccttctcccacactg

SEQ ID NO: 775345 - DNA, 22 bp, Homo sapiens
cctgccccgcccagctgcacct

SEQ ID NO: 775346 - DNA, 15 bp, Homo sapiens
acatttaaattccac

SEQ ID NO: 775347 - DNA, 17 bp, Homo sapiens
acatttaaattccacag

SEQ ID NO: 775348 - DNA, 15 bp, Homo sapiens
acatttaataaaact

SEQ ID NO: 775349 - DNA, 15 bp, Homo sapiens
acatttacaaactga

SEQ ID NO: 775350 - DNA, 16 bp, Homo sapiens
acatttacaataaata

SEQ ID NO: 775351 - DNA, 17 bp, Homo sapiens
acatttacaataaatat

SEQ ID NO: 775352 - DNA, 14 bp, Homo sapiens
acatttacaggagg

SEQ ID NO: 775353 - DNA, 15 bp, Homo sapiens
acatttacaggaggg

SEQ ID NO: 775354 - DNA, 15 bp, Homo sapiens
atttcaaatgcagaa

SEQ ID NO: 775355 - DNA, 12 bp, Homo sapiens
atttcaaatgta

SEQ ID NO: 775356 - DNA, 21 bp, Homo sapiens
atttcaacaagaatattgtat

SEQ ID NO: 775357 - DNA, 19 bp, Homo sapiens
atttcaacatgagtgtatt

SEQ ID NO: 775358 - DNA, 15 bp, Homo sapiens
atttcaagaccttct

SEQ ID NO: 775359 - DNA, 22 bp, Homo sapiens
atttcaagggttgcttctgagt

SEQ ID NO: 775360 - DNA, 22 bp, Homo sapiens
atttcaagttccaagttgctaa

SEQ ID NO: 775361 - DNA, 20 bp, Homo sapiens
atttcaatgtaattaaactg

SEQ ID NO: 775362 - DNA, 22 bp, Homo sapiens
atttcaatgtaattaaactgtt

SEQ ID NO: 775363 - DNA, 17 bp, Homo sapiens
atttcaatgtcagcctt

SEQ ID NO: 775364 - DNA, 15 bp, Homo sapiens
atttcaatgtgtata

SEQ ID NO: 775365 - DNA, 22 bp, Homo sapiens
atttcaatgtgtataaattgtc

SEQ ID NO: 775366 - DNA, 13 bp, Homo sapiens
atttcacaacaga

SEQ ID NO: 775367 - DNA, 15 bp, Homo sapiens
atttcacaacagatc

SEQ ID NO: 775368 - DNA, 19 bp, Homo sapiens
atttcacaacagcctgaca

SEQ ID NO: 775369 - DNA, 10 bp, Homo sapiens
atttcacaag

SEQ ID NO: 775370 - DNA, 17 bp, Homo sapiens
atttcacacagtgaaac

SEQ ID NO: 775371 - DNA, 22 bp, Homo sapiens
atttcacacagtgaaacgcaat

SEQ ID NO: 775372 - DNA, 22 bp, Homo sapiens
atttcacagtgcccaagagtgg

SEQ ID NO: 775373 - DNA, 22 bp, Homo sapiens
atttcacattaatatttgctga

SEQ ID NO: 775374 - DNA, 17 bp, Homo sapiens
atttcacattattctgg

SEQ ID NO: 775375 - DNA, 23 bp, Homo sapiens
atttcaccccatccctccttaag

SEQ ID NO: 775376 - DNA, 19 bp, Homo sapiens
atttcacctgtaaacctga

SEQ ID NO: 775377 - DNA, 23 bp, Homo sapiens
atttcacgcttttaattctcatt

SEQ ID NO: 775378 - DNA, 17 bp, Homo sapiens
atttcactaaatgtaaa

SEQ ID NO: 775379 - DNA, 17 bp, Homo sapiens
atttcactagagacaaa

SEQ ID NO: 775380 - DNA, 19 bp, Homo sapiens
atttcacttgatgatacaa

SEQ ID NO: 775381 - DNA, 19 bp, Homo sapiens
atttcactttagatgctga

SEQ ID NO: 775382 - DNA, 19 bp, Homo sapiens
atttcacttttgttctgct

SEQ ID NO: 775383 - DNA, 21 bp, Homo sapiens
atttcagaagttagtttgtat

SEQ ID NO: 775384 - DNA, 18 bp, Homo sapiens
atttcagacatatccaaa

SEQ ID NO: 775385 - DNA, 14 bp, Homo sapiens
atttcagatgtaat

SEQ ID NO: 775386 - DNA, 17 bp, Homo sapiens
atttcagatgtaatgtt

SEQ ID NO: 775387 - DNA, 18 bp, Homo sapiens
atttcagattcccagagc

SEQ ID NO: 775388 - DNA, 16 bp, Homo sapiens
atttcagcttgaacct

SEQ ID NO: 775389 - DNA, 18 bp, Homo sapiens
atttcaggaatttaaaat

SEQ ID NO: 775390 - DNA, 15 bp, Homo sapiens
atttcaggagggatt

SEQ ID NO: 775391 - DNA, 19 bp, Homo sapiens
atttcaggcagcaggggct

SEQ ID NO: 775392 - DNA, 16 bp, Homo sapiens
atttcaggcattttgt

SEQ ID NO: 775393 - DNA, 17 bp, Homo sapiens
atttcagggaaattaat

SEQ ID NO: 775394 - DNA, 19 bp, Homo sapiens
atttcagggacctcagggg

SEQ ID NO: 775395 - DNA, 22 bp, Homo sapiens
atttcagggacctcaggggcac

SEQ ID NO: 775396 - DNA, 21 bp, Homo sapiens
atttcaggttttgtaaagatg

SEQ ID NO: 775397 - DNA, 18 bp, Homo sapiens
atttcagtaagtctcata

SEQ ID NO: 775398 - DNA, 15 bp, Homo sapiens
atttcagtaatgtct

SEQ ID NO: 775399 - DNA, 16 bp, Homo sapiens
atttcagtaatgtctt

SEQ ID NO: 775400 - DNA, 17 bp, Homo sapiens
atttcagtatcatctcc

SEQ ID NO: 775401 - DNA, 13 bp, Homo sapiens
atttcagtatttt

SEQ ID NO: 775402 - DNA, 17 bp, Homo sapiens
atttcagtcaattctga

SEQ ID NO: 775403 - DNA, 18 bp, Homo sapiens
atttcagtcaattctgat

SEQ ID NO: 775404 - DNA, 20 bp, Homo sapiens
atttcagtcttggtggttct

SEQ ID NO: 775405 - DNA, 11 bp, Homo sapiens
atttcagtgac

SEQ ID NO: 775406 - DNA, 15 bp, Homo sapiens
atttcagtggcttcc

SEQ ID NO: 775407 - DNA, 14 bp, Homo sapiens
atttcagtttttca

SEQ ID NO: 775408 - DNA, 17 bp, Homo sapiens
atttcagtttttcattt

SEQ ID NO: 775409 - DNA, 20 bp, Homo sapiens
atttcataaggcctgccctc

SEQ ID NO: 775410 - DNA, 17 bp, Homo sapiens
atttcataattctgaaa

SEQ ID NO: 775411 - DNA, 21 bp, Homo sapiens
atttcatacctcagaatgtaa

SEQ ID NO: 775412 - DNA, 14 bp, Homo sapiens
atttcatagttcag

SEQ ID NO: 775413 - DNA, 16 bp, Homo sapiens
atttcatagttcagaa

SEQ ID NO: 775414 - DNA, 17 bp, Homo sapiens
atttcatagttcagaat

SEQ ID NO: 775415 - DNA, 14 bp, Homo sapiens
atttcatatactat

SEQ ID NO: 775416 - DNA, 16 bp, Homo sapiens
atttcatatactataa

SEQ ID NO: 775417 - DNA, 17 bp, Homo sapiens
atttcatatactataat

SEQ ID NO: 775418 - DNA, 19 bp, Homo sapiens
atttcatatactataattg

SEQ ID NO: 775419 - DNA, 18 bp, Homo sapiens
atttcatcattgtttctg

SEQ ID NO: 775420 - DNA, 23 bp, Homo sapiens
atttcatccagtttgttctccgg

SEQ ID NO: 775421 - DNA, 17 bp, Homo sapiens
atttcatccttgaatcc

SEQ ID NO: 775422 - DNA, 18 bp, Homo sapiens
atttcatctatttctgag

SEQ ID NO: 775423 - DNA, 22 bp, Homo sapiens
atttcatctcatttaagggaaa

SEQ ID NO: 775424 - DNA, 15 bp, Homo sapiens
atttcatctgggtgg

SEQ ID NO: 775425 - DNA, 17 bp, Homo sapiens
atttcatcttctggaat

SEQ ID NO: 775426 - DNA, 20 bp, Homo sapiens
atttcatcttctggaatatt

SEQ ID NO: 775427 - DNA, 19 bp, Homo sapiens
atttcatgaaaaagctgct

SEQ ID NO: 775428 - DNA, 20 bp, Homo sapiens
atttcatgtaaaacagaaaa

SEQ ID NO: 775429 - DNA, 17 bp, Homo sapiens
atttcattcaaatcagt

SEQ ID NO: 775430 - DNA, 13 bp, Homo sapiens
atttcattccatt

SEQ ID NO: 775431 - DNA, 16 bp, Homo sapiens
atttcattccattgcc

SEQ ID NO: 775432 - DNA, 17 bp, Homo sapiens
atttcattccattgcct

SEQ ID NO: 775433 - DNA, 17 bp, Homo sapiens
atttcattgcctgtgta

SEQ ID NO: 775434 - DNA, 20 bp, Homo sapiens
atttcattgtacaagtatta

SEQ ID NO: 775435 - DNA, 21 bp, Homo sapiens
atttcattgtatgatgtgttg

SEQ ID NO: 775436 - DNA, 17 bp, Homo sapiens
atttcatttgtaacttt

SEQ ID NO: 775437 - DNA, 18 bp, Homo sapiens
atttccaaaataatctat

SEQ ID NO: 775438 - DNA, 14 bp, Homo sapiens
atttccaaacatcc

SEQ ID NO: 775439 - DNA, 17 bp, Homo sapiens
atttccaaataaaatga

SEQ ID NO: 775440 - DNA, 18 bp, Homo sapiens
atttccaaataaaatgag

SEQ ID NO: 775441 - DNA, 17 bp, Homo sapiens
atttccaaattcacaag

SEQ ID NO: 775442 - DNA, 20 bp, Homo sapiens
atttccaacaccacagacac

SEQ ID NO: 775443 - DNA, 20 bp, Homo sapiens
atttccaactcgaatctgtg

SEQ ID NO: 775444 - DNA, 14 bp, Homo sapiens
atttccaatgtttc

SEQ ID NO: 775445 - DNA, 20 bp, Homo sapiens
atttccaccaggccgtgcct

SEQ ID NO: 775446 - DNA, 18 bp, Homo sapiens
atttccactattttcaaa

SEQ ID NO: 775447 - DNA, 18 bp, Homo sapiens
atttccactgaacaaaac

SEQ ID NO: 775448 - DNA, 22 bp, Homo sapiens
atttccacttgccctgttctct

SEQ ID NO: 775449 - DNA, 12 bp, Homo sapiens
atttccaggccc

SEQ ID NO: 775450 - DNA, 15 bp, Homo sapiens
atttccaggcccctg

SEQ ID NO: 775451 - DNA, 18 bp, Homo sapiens
atttccaggcccctgagg

SEQ ID NO: 775452 - DNA, 17 bp, Homo sapiens
atttccagtacctttgt

SEQ ID NO: 775453 - DNA, 14 bp, Homo sapiens
atttccagtttaag

SEQ ID NO: 775454 - DNA, 15 bp, Homo sapiens
atttccatatggatt

SEQ ID NO: 775455 - DNA, 17 bp, Homo sapiens
atttccattatttatat

SEQ ID NO: 775456 - DNA, 15 bp, Homo sapiens
atttccattccagaa

SEQ ID NO: 775457 - DNA, 18 bp, Homo sapiens
atttccatttacttaaga

SEQ ID NO: 775458 - DNA, 22 bp, Homo sapiens
atttccatttacttaagactta

SEQ ID NO: 775459 - DNA, 15 bp, Homo sapiens
atttccatttattgt

SEQ ID NO: 775460 - DNA, 15 bp, Homo sapiens
atttccatttctgat

SEQ ID NO: 775461 - DNA, 17 bp, Homo sapiens
atttcccaaagtcctct

SEQ ID NO: 775462 - DNA, 20 bp, Homo sapiens
atttcccaaagtcctctgct

SEQ ID NO: 775463 - DNA, 20 bp, Homo sapiens
atttcccagcacatgaaacc

SEQ ID NO: 775464 - DNA, 20 bp, Homo sapiens
atttccccaggggaaaatga

SEQ ID NO: 775465 - DNA, 17 bp, Homo sapiens
atttccccctcctcaga

SEQ ID NO: 775466 - DNA, 16 bp, Homo sapiens
atttcccctccttccc

SEQ ID NO: 775467 - DNA, 22 bp, Homo sapiens
atttcccctctgcacccagaac

SEQ ID NO: 775468 - DNA, 14 bp, Homo sapiens
atttccccttggac

SEQ ID NO: 775469 - DNA, 16 bp, Homo sapiens
atttcccggagccatc

SEQ ID NO: 775470 - DNA, 18 bp, Homo sapiens
atttccctgactcctcta

SEQ ID NO: 775471 - DNA, 11 bp, Homo sapiens
atttccctgca

SEQ ID NO: 775472 - DNA, 16 bp, Homo sapiens
atttccctgtgtggat

SEQ ID NO: 775473 - DNA, 17 bp, Homo sapiens
atttcccttcatttaaa

SEQ ID NO: 775474 - DNA, 21 bp, Homo sapiens
atttcccttcatttaaactaa

SEQ ID NO: 775475 - DNA, 23 bp, Homo sapiens
atttccgcacttcagaattccat

SEQ ID NO: 775476 - DNA, 14 bp, Homo sapiens
atttccgggtggaa

SEQ ID NO: 775477 - DNA, 15 bp, Homo sapiens
atttccgtccccccc

SEQ ID NO: 775478 - DNA, 19 bp, Homo sapiens
attggctatgatggtgaca

SEQ ID NO: 775479 - DNA, 17 bp, Homo sapiens
attggctatttaaaact

SEQ ID NO: 775480 - DNA, 11 bp, Homo sapiens
attggcttaaa

SEQ ID NO: 775481 - DNA, 17 bp, Homo sapiens
attggcttaaagtgaag

SEQ ID NO: 775482 - DNA, 20 bp, Homo sapiens
attgtctaaagttactactg

SEQ ID NO: 775483 - DNA, 18 bp, Homo sapiens
attgtctactcctagaag

SEQ ID NO: 775484 - DNA, 16 bp, Homo sapiens
attgtctcccttccag

SEQ ID NO: 775485 - DNA, 23 bp, Homo sapiens
attgtctcctatatatttctatt

SEQ ID NO: 775486 - DNA, 13 bp, Homo sapiens
attgtctgtaaat

SEQ ID NO: 775487 - DNA, 22 bp, Homo sapiens
attgtcttgttatgtacaaact

SEQ ID NO: 775488 - DNA, 20 bp, Homo sapiens
attgtctttactaaacagat

SEQ ID NO: 775489 - DNA, 12 bp, Homo sapiens
attgtctttgct

SEQ ID NO: 775490 - DNA, 14 bp, Homo sapiens
attgtctttgctgt

SEQ ID NO: 775491 - DNA, 19 bp, Homo sapiens
attgtctttgctgtactct

SEQ ID NO: 775492 - DNA, 14 bp, Homo sapiens
attgtgaagtacat

SEQ ID NO: 775493 - DNA, 15 bp, Homo sapiens
attgtgaagtacata

SEQ ID NO: 775494 - DNA, 23 bp, Homo sapiens
attgtgacaatagggctaaatgt

SEQ ID NO: 775495 - DNA, 16 bp, Homo sapiens
attgtgacttcactgt

SEQ ID NO: 775496 - DNA, 17 bp, Homo sapiens
attgtgacttcactgta

SEQ ID NO: 775497 - DNA, 20 bp, Homo sapiens
attgtgacttcactgtatat

SEQ ID NO: 775498 - DNA, 23 bp, Homo sapiens
attgtgacttcactgtatataaa

SEQ ID NO: 775499 - DNA, 19 bp, Homo sapiens
attgtgagctctggttatt

SEQ ID NO: 775500 - DNA, 20 bp, Homo sapiens
attgtgagctctggttattt

SEQ ID NO: 775501 - DNA, 20 bp, Homo sapiens
attgtgattacgtgtatgtt

SEQ ID NO: 775502 - DNA, 23 bp, Homo sapiens
attgtgattacgtgtatgtttct

SEQ ID NO: 775503 - DNA, 16 bp, Homo sapiens
attgtgattagacaga

SEQ ID NO: 775504 - DNA, 15 bp, Homo sapiens
attgtgattggcctg

SEQ ID NO: 775505 - DNA, 16 bp, Homo sapiens
attgtgattggcctgt

SEQ ID NO: 775506 - DNA, 20 bp, Homo sapiens
attgtgcagtactttgtgca

SEQ ID NO: 775507 - DNA, 13 bp, Homo sapiens
attgtgccaagcc

SEQ ID NO: 775508 - DNA, 14 bp, Homo sapiens
attgtgccaagcct

SEQ ID NO: 775509 - DNA, 16 bp, Homo sapiens
attgtgccaatatgta

SEQ ID NO: 775510 - DNA, 21 bp, Homo sapiens
attgtgccatgtcaaacaaat

SEQ ID NO: 775511 - DNA, 21 bp, Homo sapiens
attgtgctgggtcccagcctg

SEQ ID NO: 775512 - DNA, 19 bp, Homo sapiens
attgtgcttactcaagtgt

SEQ ID NO: 775513 - DNA, 24 bp, Homo sapiens
attgtgcttcacagtagagccagc

SEQ ID NO: 775514 - DNA, 15 bp, Homo sapiens
attgtggaatgttgg

SEQ ID NO: 775515 - DNA, 16 bp, Homo sapiens
attgtggatgtgttca

SEQ ID NO: 775516 - DNA, 18 bp, Homo sapiens
attgtggattataaaaaa

SEQ ID NO: 775517 - DNA, 23 bp, Homo sapiens
attgtggattataaaaaatgtaa

SEQ ID NO: 775518 - DNA, 17 bp, Homo sapiens
attgtggctatcctgat

SEQ ID NO: 775519 - DNA, 19 bp, Homo sapiens
attgtggtacaatctcaaa

SEQ ID NO: 775520 - DNA, 18 bp, Homo sapiens
attgtgtaaaaaatggaa

SEQ ID NO: 775521 - DNA, 21 bp, Homo sapiens
attgtgtaaacaaatcctgtt

SEQ ID NO: 775522 - DNA, 23 bp, Homo sapiens
attgtgtaacaattttaatgcta

SEQ ID NO: 775523 - DNA, 15 bp, Homo sapiens
attgtgtagcctttt

SEQ ID NO: 775524 - DNA, 19 bp, Homo sapiens
attgtgtattatgttgttc

SEQ ID NO: 775525 - DNA, 15 bp, Homo sapiens
attgtgtattgatgc

SEQ ID NO: 775526 - DNA, 11 bp, Homo sapiens
attgtgtattt

SEQ ID NO: 775527 - DNA, 18 bp, Homo sapiens
attgtgtcagaaacatga

SEQ ID NO: 775528 - DNA, 22 bp, Homo sapiens
attgtgtcagaaacatgaaatg

SEQ ID NO: 775529 - DNA, 12 bp, Homo sapiens
attgtgtgaatt

SEQ ID NO: 775530 - DNA, 14 bp, Homo sapiens
attgtgtgatccag

SEQ ID NO: 775531 - DNA, 18 bp, Homo sapiens
attgtgtgttatttaaat

SEQ ID NO: 775532 - DNA, 21 bp, Homo sapiens
attgtgttgtcttcagcagtc

SEQ ID NO: 775533 - DNA, 17 bp, Homo sapiens
attgttaactcttgtct

SEQ ID NO: 775534 - DNA, 23 bp, Homo sapiens
attgttaagtctaaatatttcct

SEQ ID NO: 775535 - DNA, 19 bp, Homo sapiens
attgttaatatcttcacat

SEQ ID NO: 775536 - DNA, 20 bp, Homo sapiens
attgttagaaaatgacttat

SEQ ID NO: 775537 - DNA, 16 bp, Homo sapiens
attgttataaaataac

SEQ ID NO: 775538 - DNA, 17 bp, Homo sapiens
attgttataaataaaat

SEQ ID NO: 775539 - DNA, 20 bp, Homo sapiens
attgttataaataaaattgt

SEQ ID NO: 775540 - DNA, 18 bp, Homo sapiens
attgttcattttgagctg

SEQ ID NO: 775541 - DNA, 12 bp, Homo sapiens
attgttccaaga

SEQ ID NO: 775542 - DNA, 18 bp, Homo sapiens
attgttccaagacattgt

SEQ ID NO: 775543 - DNA, 22 bp, Homo sapiens
attgttccaagacattgtcaat

SEQ ID NO: 775544 - DNA, 22 bp, Homo sapiens
attgttcccgatggtctctctc

SEQ ID NO: 775545 - DNA, 12 bp, Homo sapiens
attgttctagta

SEQ ID NO: 775546 - DNA, 18 bp, Homo sapiens
attgttctagtactgtat

SEQ ID NO: 775547 - DNA, 17 bp, Homo sapiens
attgttctcttaaatat

SEQ ID NO: 775548 - DNA, 13 bp, Homo sapiens
attgttctgaaca

SEQ ID NO: 775549 - DNA, 19 bp, Homo sapiens
attgttgaaaaagtttgtt

SEQ ID NO: 775550 - DNA, 20 bp, Homo sapiens
attgttgacaactgtgactg

SEQ ID NO: 775551 - DNA, 18 bp, Homo sapiens
attgttgacagttctgaa

SEQ ID NO: 775552 - DNA, 21 bp, Homo sapiens
attgttgacagttctgaagaa

SEQ ID NO: 775553 - DNA, 21 bp, Homo sapiens
attgttgaggtggtctgaatg

SEQ ID NO: 775554 - DNA, 22 bp, Homo sapiens
attgttgaggtggtctgaatgt

SEQ ID NO: 775555 - DNA, 20 bp, Homo sapiens
attgttggtaattattttgg

SEQ ID NO: 775556 - DNA, 13 bp, Homo sapiens
attgttgtccttt

SEQ ID NO: 775557 - DNA, 22 bp, Homo sapiens
attgttgtgggctttctccggg

SEQ ID NO: 775558 - DNA, 14 bp, Homo sapiens
attgttgttctgtt

SEQ ID NO: 775559 - DNA, 18 bp, Homo sapiens
attgttgttctgttaact

SEQ ID NO: 775560 - DNA, 21 bp, Homo sapiens
attgttgttctgttaactgaa

SEQ ID NO: 775561 - DNA, 22 bp, Homo sapiens
attgttgtttgccatactttgt

SEQ ID NO: 775562 - DNA, 14 bp, Homo sapiens
attgtttaaaaacc

SEQ ID NO: 775563 - DNA, 14 bp, Homo sapiens
attgtttaaagatg

SEQ ID NO: 775564 - DNA, 16 bp, Homo sapiens
attgtttataatggca

SEQ ID NO: 775565 - DNA, 21 bp, Homo sapiens
attgtttatacacaactttgc

SEQ ID NO: 775566 - DNA, 22 bp, Homo sapiens
attgtttatacacaactttgca

SEQ ID NO: 775567 - DNA, 22 bp, Homo sapiens
attgtttatgtgttatgaacat

SEQ ID NO: 775568 - DNA, 22 bp, Homo sapiens
attgtttcattgcgaatctttt

SEQ ID NO: 775569 - DNA, 16 bp, Homo sapiens
attgtttccaacttgt

SEQ ID NO: 775570 - DNA, 22 bp, Homo sapiens
attgtttccaacttgtctggga

SEQ ID NO: 775571 - DNA, 18 bp, Homo sapiens
attgtttcttgacaagct

SEQ ID NO: 775572 - DNA, 17 bp, Homo sapiens
attgtttgaaacaaaga

SEQ ID NO: 775573 - DNA, 19 bp, Homo sapiens
attgtttgaaacaaagaag

SEQ ID NO: 775574 - DNA, 14 bp, Homo sapiens
attgtttgcttatt

SEQ ID NO: 775575 - DNA, 16 bp, Homo sapiens
attgtttgcttattgt

SEQ ID NO: 775576 - DNA, 18 bp, Homo sapiens
attgtttgcttattgttc

SEQ ID NO: 775577 - DNA, 19 bp, Homo sapiens
attgtttgcttattgttcc

SEQ ID NO: 775578 - DNA, 22 bp, Homo sapiens
attgtttgtacagtaatatgtt

SEQ ID NO: 775579 - DNA, 13 bp, Homo sapiens
attgttttacaat

SEQ ID NO: 775580 - DNA, 17 bp, Homo sapiens
attgttttacaatagtt

SEQ ID NO: 775581 - DNA, 10 bp, Homo sapiens
attgttttca

SEQ ID NO: 775582 - DNA, 15 bp, Homo sapiens
attgttttcacttgt

SEQ ID NO: 775583 - DNA, 17 bp, Homo sapiens
attgttttcagtgtaca

SEQ ID NO: 775584 - DNA, 19 bp, Homo sapiens
attgttttcagtgtacatg

SEQ ID NO: 775585 - DNA, 16 bp, Homo sapiens
atttatttaataacaa

SEQ ID NO: 775586 - DNA, 20 bp, Homo sapiens
atttatttaataacaattgt

SEQ ID NO: 775587 - DNA, 15 bp, Homo sapiens
atttatttaatgtta

SEQ ID NO: 775588 - DNA, 16 bp, Homo sapiens
atttatttacaaatgt

SEQ ID NO: 775589 - DNA, 13 bp, Homo sapiens
atttatttatatt

SEQ ID NO: 775590 - DNA, 13 bp, Homo sapiens
atttatttatgaa

SEQ ID NO: 775591 - DNA, 19 bp, Homo sapiens
atttatttatgaaaaaata

SEQ ID NO: 775592 - DNA, 17 bp, Homo sapiens
atttatttattaagatg

SEQ ID NO: 775593 - DNA, 14 bp, Homo sapiens
atttatttcaaaaa

SEQ ID NO: 775594 - DNA, 18 bp, Homo sapiens
atttatttccaatgtttc

SEQ ID NO: 775595 - DNA, 21 bp, Homo sapiens
atttatttccactaaaaatat

SEQ ID NO: 775596 - DNA, 14 bp, Homo sapiens
atttatttccagag

SEQ ID NO: 775597 - DNA, 14 bp, Homo sapiens
atttatttctctgg

SEQ ID NO: 775598 - DNA, 13 bp, Homo sapiens
atttatttcttaa

SEQ ID NO: 775599 - DNA, 20 bp, Homo sapiens
atttatttgtcgtgttggaa

SEQ ID NO: 775600 - DNA, 14 bp, Homo sapiens
atttattttataac

SEQ ID NO: 775601 - DNA, 20 bp, Homo sapiens
atttattttataagaaaaac

SEQ ID NO: 775602 - DNA, 12 bp, Homo sapiens
atttattttatt

SEQ ID NO: 775603 - DNA, 15 bp, Homo sapiens
atttattttcctaaa

SEQ ID NO: 775604 - DNA, 17 bp, Homo sapiens
atttattttcctaaaga

SEQ ID NO: 775605 - DNA, 21 bp, Homo sapiens
atttattttgctccctctgtt

SEQ ID NO: 775606 - DNA, 14 bp, Homo sapiens
atttatttttacaa

SEQ ID NO: 775607 - DNA, 22 bp, Homo sapiens
atttatttttcagttccaagaa

SEQ ID NO: 775608 - DNA, 23 bp, Homo sapiens
atttatttttcagttccaagaaa

SEQ ID NO: 775609 - DNA, 14 bp, Homo sapiens
atttattttttaca

SEQ ID NO: 775610 - DNA, 18 bp, Homo sapiens
atttattttttacattat

SEQ ID NO: 775611 - DNA, 19 bp, Homo sapiens
atttattttttacattatt

SEQ ID NO: 775612 - DNA, 22 bp, Homo sapiens
atttattttttcttttctttac

SEQ ID NO: 775613 - DNA, 18 bp, Homo sapiens
atttattttttttaaaga

SEQ ID NO: 775614 - DNA, 23 bp, Homo sapiens
atttcaaaaaaaaaaaaaaagac

SEQ ID NO: 775615 - DNA, 15 bp, Homo sapiens
atttcaaaaatataa

SEQ ID NO: 775616 - DNA, 17 bp, Homo sapiens
atttcaaaaatataact

SEQ ID NO: 775617 - DNA, 20 bp, Homo sapiens
atttcaaacattttgtatca

SEQ ID NO: 775618 - DNA, 21 bp, Homo sapiens
atttcaaaccattgctcttag

SEQ ID NO: 775619 - DNA, 15 bp, Homo sapiens
atttcaaagccctgc

SEQ ID NO: 775620 - DNA, 18 bp, Homo sapiens
atttgcaataacagctgc

SEQ ID NO: 775621 - DNA, 18 bp, Homo sapiens
atttgcactaatgtgtta

SEQ ID NO: 775622 - DNA, 11 bp, Homo sapiens
atttgcactga

SEQ ID NO: 775623 - DNA, 13 bp, Homo sapiens
atttgcagtatga

SEQ ID NO: 775624 - DNA, 9 bp, Homo sapiens
atttgcata

SEQ ID NO: 775625 - DNA, 19 bp, Homo sapiens
atttgcatattctattgta

SEQ ID NO: 775626 - DNA, 22 bp, Homo sapiens
atttgcatattctattgtatta

SEQ ID NO: 775627 - DNA, 22 bp, Homo sapiens
atttgcatatttttctaaagaa

SEQ ID NO: 775628 - DNA, 14 bp, Homo sapiens
atttgcatgttatg

SEQ ID NO: 775629 - DNA, 15 bp, Homo sapiens
atttgcattatgtat

SEQ ID NO: 775630 - DNA, 16 bp, Homo sapiens
atttgcattatgtatt

SEQ ID NO: 775631 - DNA, 19 bp, Homo sapiens
atttgcattatgtatttat

SEQ ID NO: 775632 - DNA, 22 bp, Homo sapiens
atttgcattgaacacaaactgt

SEQ ID NO: 775633 - DNA, 13 bp, Homo sapiens
atttgcattgtgt

SEQ ID NO: 775634 - DNA, 22 bp, Homo sapiens
atttgcatttgtttatgtaatt

SEQ ID NO: 775635 - DNA, 11 bp, Homo sapiens
atttgccagca

SEQ ID NO: 775636 - DNA, 17 bp, Homo sapiens
atttgccatgacatttc

SEQ ID NO: 775637 - DNA, 18 bp, Homo sapiens
atttgcctaattcctggc

SEQ ID NO: 775638 - DNA, 22 bp, Homo sapiens
atttgcctgtaacaagccagat

SEQ ID NO: 775639 - DNA, 16 bp, Homo sapiens
atttgccttcagtctt

SEQ ID NO: 775640 - DNA, 19 bp, Homo sapiens
atttgccttgcagaactgc

SEQ ID NO: 775641 - DNA, 21 bp, Homo sapiens
atttgccttgcagaactgcca

SEQ ID NO: 775642 - DNA, 22 bp, Homo sapiens
atttgccttgcagaactgccat

SEQ ID NO: 775643 - DNA, 15 bp, Homo sapiens
atttgccttgctgga

SEQ ID NO: 775644 - DNA, 14 bp, Homo sapiens
atttgctaattttt

SEQ ID NO: 775645 - DNA, 11 bp, Homo sapiens
atttgctcttt

SEQ ID NO: 775646 - DNA, 21 bp, Homo sapiens
atttgctgacaaccattaaag

SEQ ID NO: 775647 - DNA, 19 bp, Homo sapiens
atttgctgcaaagagaaac

SEQ ID NO: 775648 - DNA, 14 bp, Homo sapiens
atttgctgccaaat

SEQ ID NO: 775649 - DNA, 22 bp, Homo sapiens
atttgctgtgtaagctcacatc

SEQ ID NO: 775650 - DNA, 16 bp, Homo sapiens
atttgcttatttttat

SEQ ID NO: 775651 - DNA, 23 bp, Homo sapiens
atttgcttgcaatctaatctgaa

SEQ ID NO: 775652 - DNA, 22 bp, Homo sapiens
atttggaaccaaagtctaaact

SEQ ID NO: 775653 - DNA, 16 bp, Homo sapiens
atttggaaccttgttt

SEQ ID NO: 775654 - DNA, 12 bp, Homo sapiens
atttggaaggca

SEQ ID NO: 775655 - DNA, 14 bp, Homo sapiens
atttggaatatttg

SEQ ID NO: 775656 - DNA, 15 bp, Homo sapiens
atttggactgtctat

SEQ ID NO: 775657 - DNA, 11 bp, Homo sapiens
atttggagact

SEQ ID NO: 775658 - DNA, 23 bp, Homo sapiens
atttggaggctggagtaatcaga

SEQ ID NO: 775659 - DNA, 19 bp, Homo sapiens
atttggagggaagctcttg

SEQ ID NO: 775660 - DNA, 23 bp, Homo sapiens
atttggagtaaatatatatgtca

SEQ ID NO: 775661 - DNA, 21 bp, Homo sapiens
atttggagtgttccccttcca

SEQ ID NO: 775662 - DNA, 20 bp, Homo sapiens
atttggatttaaaagcctgc

SEQ ID NO: 775663 - DNA, 18 bp, Homo sapiens
atttggcaaaacaaaatg

SEQ ID NO: 775664 - DNA, 19 bp, Homo sapiens
atttggcaatgccatcatc

SEQ ID NO: 775665 - DNA, 18 bp, Homo sapiens
atttggccccaggggacg

SEQ ID NO: 775666 - DNA, 16 bp, Homo sapiens
atttggcctgcactaa

SEQ ID NO: 775667 - DNA, 19 bp, Homo sapiens
atttggcctgcactaattt

SEQ ID NO: 775668 - DNA, 18 bp, Homo sapiens
atttggctcacttgcctt

SEQ ID NO: 775669 - DNA, 13 bp, Homo sapiens
atttggcttgctg

SEQ ID NO: 775670 - DNA, 23 bp, Homo sapiens
atttgggaaggtttgtgttttct

SEQ ID NO: 775671 - DNA, 19 bp, Homo sapiens
atttgggagacatgtgaca

SEQ ID NO: 775672 - DNA, 17 bp, Homo sapiens
atttgggaggaggaaaa

SEQ ID NO: 775673 - DNA, 21 bp, Homo sapiens
atttgggagggaaaagggaag

SEQ ID NO: 775674 - DNA, 16 bp, Homo sapiens
atttgggatggagaag

SEQ ID NO: 775675 - DNA, 13 bp, Homo sapiens
atttgggctcagg

SEQ ID NO: 775676 - DNA, 17 bp, Homo sapiens
atttgggctcagggttg

SEQ ID NO: 775677 - DNA, 21 bp, Homo sapiens
atttggggcttgcatgccaaa

SEQ ID NO: 775678 - DNA, 21 bp, Homo sapiens
atttgggggctcggggaggca

SEQ ID NO: 775679 - DNA, 22 bp, Homo sapiens
atttgggtacatggcccgcagt

SEQ ID NO: 775680 - DNA, 23 bp, Homo sapiens
atttggtacttttgagtgtgtgt

SEQ ID NO: 775681 - DNA, 17 bp, Homo sapiens
atttggtataattatgg

SEQ ID NO: 775682 - DNA, 19 bp, Homo sapiens
atttggtccaaaaaaagga

SEQ ID NO: 775683 - DNA, 21 bp, Homo sapiens
atttggtccaaaaaaaggaaa

SEQ ID NO: 775684 - DNA, 18 bp, Homo sapiens
atttggtggtttcagaaa

SEQ ID NO: 775685 - DNA, 16 bp, Homo sapiens
atttggtgttcctgga

SEQ ID NO: 775686 - DNA, 18 bp, Homo sapiens
atttggtgttcctggaag

SEQ ID NO: 775687 - DNA, 14 bp, Homo sapiens
atttggttaaatca

SEQ ID NO: 775688 - DNA, 14 bp, Homo sapiens
atttggttgcactt

SEQ ID NO: 775689 - DNA, 18 bp, Homo sapiens
atttggttgcactttaga

SEQ ID NO: 775690 - DNA, 18 bp, Homo sapiens
atttggtttagaacataa

SEQ ID NO: 775691 - DNA, 13 bp, Homo sapiens
atttgtaaaaatg

SEQ ID NO: 775692 - DNA, 14 bp, Homo sapiens
atttgtaaaaatga

SEQ ID NO: 775693 - DNA, 16 bp, Homo sapiens
atttgtaaaaatgagt

SEQ ID NO: 775694 - DNA, 21 bp, Homo sapiens
atttgtaaaaatgagtcattt

SEQ ID NO: 775695 - DNA, 23 bp, Homo sapiens
atttgtaaaaatgagtcatttgt

SEQ ID NO: 775696 - DNA, 14 bp, Homo sapiens
atttgtaaaccatt

SEQ ID NO: 775697 - DNA, 15 bp, Homo sapiens
atttgtaaacttctg

SEQ ID NO: 775698 - DNA, 21 bp, Homo sapiens
atttgtaaacttctgaagact

SEQ ID NO: 775699 - DNA, 12 bp, Homo sapiens
atttgtaaatct

SEQ ID NO: 775700 - DNA, 16 bp, Homo sapiens
atttgtaaatgatttt

SEQ ID NO: 775701 - DNA, 16 bp, Homo sapiens
atttgtaaatttagtg

SEQ ID NO: 775702 - DNA, 17 bp, Homo sapiens
atttgtaaatttagtgt

SEQ ID NO: 775703 - DNA, 20 bp, Homo sapiens
atttgtaacattgtaaagta

SEQ ID NO: 775704 - DNA, 23 bp, Homo sapiens
atttgtaacattgtaaagtatgt

SEQ ID NO: 775705 - DNA, 16 bp, Homo sapiens
atttgtaacctcagct

SEQ ID NO: 775706 - DNA, 19 bp, Homo sapiens
atttgtaacctcagctctg

SEQ ID NO: 775707 - DNA, 20 bp, Homo sapiens
atttgtaacctcagctctgg

SEQ ID NO: 775708 - DNA, 19 bp, Homo sapiens
atttgtaagcaacttgctt

SEQ ID NO: 775709 - DNA, 21 bp, Homo sapiens
atttgtaagcaacttgcttct

SEQ ID NO: 775710 - DNA, 17 bp, Homo sapiens
atttgtaatagatgttt

SEQ ID NO: 775711 - DNA, 15 bp, Homo sapiens
atttgtaatatggaa

SEQ ID NO: 775712 - DNA, 15 bp, Homo sapiens
atttgtaattgctta

SEQ ID NO: 775713 - DNA, 13 bp, Homo sapiens
atttgtacaattt

SEQ ID NO: 775714 - DNA, 16 bp, Homo sapiens
atttgtacaattttaa

SEQ ID NO: 775715 - DNA, 21 bp, Homo sapiens
atttgtacatatgtaaaataa

SEQ ID NO: 775716 - DNA, 20 bp, Homo sapiens
atttgtaccattccttcaaa

SEQ ID NO: 775717 - DNA, 22 bp, Homo sapiens
atttgtaccattccttcaaata

SEQ ID NO: 775718 - DNA, 20 bp, Homo sapiens
atttgtactattagcaagaa

SEQ ID NO: 775719 - DNA, 23 bp, Homo sapiens
atttgtactattagcaagaatca

SEQ ID NO: 775720 - DNA, 21 bp, Homo sapiens
atttgtactgtttaatgttct

SEQ ID NO: 775721 - DNA, 16 bp, Homo sapiens
atttgtacttcttatt

SEQ ID NO: 775722 - DNA, 15 bp, Homo sapiens
atttgtagacttaag

SEQ ID NO: 775723 - DNA, 18 bp, Homo sapiens
atttgtagcataactgta

SEQ ID NO: 775724 - DNA, 19 bp, Homo sapiens
atttgtagcataactgtag

SEQ ID NO: 775725 - DNA, 22 bp, Homo sapiens
atttgtagcataactgtagctc

SEQ ID NO: 775726 - DNA, 23 bp, Homo sapiens
atttgtataaattaaataaactg

SEQ ID NO: 775727 - DNA, 18 bp, Homo sapiens
atttgtatagttgcttgc

SEQ ID NO: 775728 - DNA, 12 bp, Homo sapiens
atttgtatatat

SEQ ID NO: 775729 - DNA, 14 bp, Homo sapiens
atttgtatatattt

SEQ ID NO: 775730 - DNA, 17 bp, Homo sapiens
atttgtatattaaaata

SEQ ID NO: 775731 - DNA, 14 bp, Homo sapiens
atttgtatgatatt

SEQ ID NO: 775732 - DNA, 14 bp, Homo sapiens
atttgtattaataa

SEQ ID NO: 775733 - DNA, 15 bp, Homo sapiens
atttgtattaataaa

SEQ ID NO: 775734 - DNA, 20 bp, Homo sapiens
atttgtatttctcttgtcct

SEQ ID NO: 775735 - DNA, 23 bp, Homo sapiens
atttgtattttgtgtgaccaact

SEQ ID NO: 775736 - DNA, 17 bp, Homo sapiens
atttgtcaatgacagtt

SEQ ID NO: 775737 - DNA, 17 bp, Homo sapiens
atttgtcagtttggttg

SEQ ID NO: 775738 - DNA, 21 bp, Homo sapiens
atttgtcatcgttccccaccc

SEQ ID NO: 775739 - DNA, 13 bp, Homo sapiens
atttgtcatgaca

SEQ ID NO: 775740 - DNA, 15 bp, Homo sapiens
atttgtcatgacagt

SEQ ID NO: 775741 - DNA, 12 bp, Homo sapiens
atttgtcccaga

SEQ ID NO: 775742 - DNA, 19 bp, Homo sapiens
atttgtcccagcctggggc

SEQ ID NO: 775743 - DNA, 20 bp, Homo sapiens
atttgtcctctttacatgaa

SEQ ID NO: 775744 - DNA, 13 bp, Homo sapiens
attttacagagcg

SEQ ID NO: 775745 - DNA, 23 bp, Homo sapiens
attttacagctcattaaactttt

SEQ ID NO: 775746 - DNA, 17 bp, Homo sapiens
attttacagtaataata

SEQ ID NO: 775747 - DNA, 12 bp, Homo sapiens
attttacattaa

SEQ ID NO: 775748 - DNA, 15 bp, Homo sapiens
attttacattaaatt

SEQ ID NO: 775749 - DNA, 12 bp, Homo sapiens
attttaccaaag

SEQ ID NO: 775750 - DNA, 22 bp, Homo sapiens
attttaccaaagcatcaataca

SEQ ID NO: 775751 - DNA, 20 bp, Homo sapiens
attttaccaagagtaacttt

SEQ ID NO: 775752 - DNA, 15 bp, Homo sapiens
attttacctcttatt

SEQ ID NO: 775753 - DNA, 22 bp, Homo sapiens
attttactccataaacagactg

SEQ ID NO: 775754 - DNA, 16 bp, Homo sapiens
attttacttttataat

SEQ ID NO: 775755 - DNA, 16 bp, Homo sapiens
attttactttttcctg

SEQ ID NO: 775756 - DNA, 16 bp, Homo sapiens
attttagacttacctt

SEQ ID NO: 775757 - DNA, 20 bp, Homo sapiens
attttagatgttattatgct

SEQ ID NO: 775758 - DNA, 20 bp, Homo sapiens
attttagcagttctgcaaat

SEQ ID NO: 775759 - DNA, 15 bp, Homo sapiens
attttagctgcagaa

SEQ ID NO: 775760 - DNA, 18 bp, Homo sapiens
attttagcttcagttgtt

SEQ ID NO: 775761 - DNA, 14 bp, Homo sapiens
attttaggaaattt

SEQ ID NO: 775762 - DNA, 17 bp, Homo sapiens
attttaggaacttcaga

SEQ ID NO: 775763 - DNA, 20 bp, Homo sapiens
attttaggcactcttaaatg

SEQ ID NO: 775764 - DNA, 22 bp, Homo sapiens
attttagggtgggtaagaaagc

SEQ ID NO: 775765 - DNA, 21 bp, Homo sapiens
attttaggtgttgattttctg

SEQ ID NO: 775766 - DNA, 18 bp, Homo sapiens
attttagtcactaagact

SEQ ID NO: 775767 - DNA, 20 bp, Homo sapiens
attttagtcactaagacttt

SEQ ID NO: 775768 - DNA, 14 bp, Homo sapiens
attttagtgactgt

SEQ ID NO: 775769 - DNA, 22 bp, Homo sapiens
attttagttatagtgtttaact

SEQ ID NO: 775770 - DNA, 12 bp, Homo sapiens
attttataattt

SEQ ID NO: 775771 - DNA, 13 bp, Homo sapiens
attttatacaatt

SEQ ID NO: 775772 - DNA, 14 bp, Homo sapiens
attttatacaattt

SEQ ID NO: 775773 - DNA, 16 bp, Homo sapiens
attttatactgtacat

SEQ ID NO: 775774 - DNA, 17 bp, Homo sapiens
attttatactgtacatg

SEQ ID NO: 775775 - DNA, 17 bp, Homo sapiens
attttatataaaatcca

SEQ ID NO: 775776 - DNA, 16 bp, Homo sapiens
attttatataaagtat

SEQ ID NO: 775777 - DNA, 17 bp, Homo sapiens
attttatataataaagt

SEQ ID NO: 775778 - DNA, 21 bp, Homo sapiens
attttatatcatacagttttc

SEQ ID NO: 775779 - DNA, 19 bp, Homo sapiens
attttatatgagagaatca

SEQ ID NO: 775780 - DNA, 24 bp, Homo sapiens
attttgtattacatctaatgcttc

SEQ ID NO: 775781 - DNA, 16 bp, Homo sapiens
attttgtattttcaac

SEQ ID NO: 775782 - DNA, 19 bp, Homo sapiens
attttgtcacattatttat

SEQ ID NO: 775783 - DNA, 23 bp, Homo sapiens
attttgtcatataagattcatat

SEQ ID NO: 775784 - DNA, 21 bp, Homo sapiens
attttgtccaagttcacagta

SEQ ID NO: 775785 - DNA, 12 bp, Homo sapiens
attttgtctaaa

SEQ ID NO: 775786 - DNA, 15 bp, Homo sapiens
attttgtctcacttt

SEQ ID NO: 775787 - DNA, 19 bp, Homo sapiens
attttgtcttattcttaag

SEQ ID NO: 775788 - DNA, 12 bp, Homo sapiens
attttgtgcatt

SEQ ID NO: 775789 - DNA, 16 bp, Homo sapiens
attttgtgcattcttt

SEQ ID NO: 775790 - DNA, 20 bp, Homo sapiens
attttgtgctcatttaagtt

SEQ ID NO: 775791 - DNA, 18 bp, Homo sapiens
attttgtgtaagaaatac

SEQ ID NO: 775792 - DNA, 18 bp, Homo sapiens
attttgtgtgaccaactg

SEQ ID NO: 775793 - DNA, 23 bp, Homo sapiens
attttgtgtgaccaactgtgttg

SEQ ID NO: 775794 - DNA, 15 bp, Homo sapiens
attttgttaaagctg

SEQ ID NO: 775795 - DNA, 16 bp, Homo sapiens
attttgttatagaata

SEQ ID NO: 775796 - DNA, 12 bp, Homo sapiens
attttgttctga

SEQ ID NO: 775797 - DNA, 13 bp, Homo sapiens
attttgttgcctt

SEQ ID NO: 775798 - DNA, 11 bp, Homo sapiens
attttgtttac

SEQ ID NO: 775799 - DNA, 14 bp, Homo sapiens
attttgtttctgta

SEQ ID NO: 775800 - DNA, 21 bp, Homo sapiens
attttgttttaatctactttt

SEQ ID NO: 775801 - DNA, 17 bp, Homo sapiens
attttgttttgctctga

SEQ ID NO: 775802 - DNA, 22 bp, Homo sapiens
attttgtttttgtcttaaaaag

SEQ ID NO: 775803 - DNA, 20 bp, Homo sapiens
atttttaaaaaagtgatctt

SEQ ID NO: 775804 - DNA, 15 bp, Homo sapiens
atttttaaaaaatat

SEQ ID NO: 775805 - DNA, 16 bp, Homo sapiens
atttttaaaacccatt

SEQ ID NO: 775806 - DNA, 17 bp, Homo sapiens
atttttaaaacccattt

SEQ ID NO: 775807 - DNA, 14 bp, Homo sapiens
atttttaaaagttg

SEQ ID NO: 775808 - DNA, 18 bp, Homo sapiens
atttttaaacttgaaata

SEQ ID NO: 775809 - DNA, 15 bp, Homo sapiens
atttttaaagataga

SEQ ID NO: 775810 - DNA, 22 bp, Homo sapiens
atttttaaaggttggaatcttt

SEQ ID NO: 775811 - DNA, 15 bp, Homo sapiens
atttttaaataattt

SEQ ID NO: 775812 - DNA, 13 bp, Homo sapiens
atttttaaatgtg

SEQ ID NO: 775813 - DNA, 14 bp, Homo sapiens
atttttaaattata

SEQ ID NO: 775814 - DNA, 20 bp, Homo sapiens
atttttaacttttggaatca

SEQ ID NO: 775815 - DNA, 17 bp, Homo sapiens
atttttaagaacttcat

SEQ ID NO: 775816 - DNA, 12 bp, Homo sapiens
atttttaagctg

SEQ ID NO: 775817 - DNA, 13 bp, Homo sapiens
atttttaagtgct

SEQ ID NO: 775818 - DNA, 13 bp, Homo sapiens
atttttaatgtat

SEQ ID NO: 775819 - DNA, 14 bp, Homo sapiens
atttttaatgtatc

SEQ ID NO: 775820 - DNA, 13 bp, Homo sapiens
atttttaatgttt

SEQ ID NO: 775821 - DNA, 15 bp, Homo sapiens
atttttaattttatg

SEQ ID NO: 775822 - DNA, 18 bp, Homo sapiens
atttttacaaaactgcca

SEQ ID NO: 775823 - DNA, 19 bp, Homo sapiens
atttttacaagaagtttat

SEQ ID NO: 775824 - DNA, 19 bp, Homo sapiens
atttttaccgtttcttccc

SEQ ID NO: 775825 - DNA, 12 bp, Homo sapiens
atttttacctaa

SEQ ID NO: 775826 - DNA, 15 bp, Homo sapiens
atttttacctaaaga

SEQ ID NO: 775827 - DNA, 16 bp, Homo sapiens
atttttacctaaagac

SEQ ID NO: 775828 - DNA, 20 bp, Homo sapiens
atttttacctttttccttcc

SEQ ID NO: 775829 - DNA, 20 bp, Homo sapiens
atttttactattgaactgta

SEQ ID NO: 775830 - DNA, 16 bp, Homo sapiens
atttttagaataagaa

SEQ ID NO: 775831 - DNA, 23 bp, Homo sapiens
atttttagaataagaatttgcat

SEQ ID NO: 775832 - DNA, 21 bp, Homo sapiens
atttttagattggttctgttt

SEQ ID NO: 775833 - DNA, 22 bp, Homo sapiens
atttttagattggttctgtttt

SEQ ID NO: 775834 - DNA, 20 bp, Homo sapiens
atttttagccataattttgc

SEQ ID NO: 775835 - DNA, 22 bp, Homo sapiens
atttttagccataattttgcat

SEQ ID NO: 775836 - DNA, 21 bp, Homo sapiens
atttttagtagagatggggtt

SEQ ID NO: 775837 - DNA, 17 bp, Homo sapiens
atttttatacggaaaaa

SEQ ID NO: 775838 - DNA, 23 bp, Homo sapiens
atttttatacggaaaaaattgta

SEQ ID NO: 775839 - DNA, 15 bp, Homo sapiens
atttttatactcaga

SEQ ID NO: 775840 - DNA, 14 bp, Homo sapiens
atttttatacttta

SEQ ID NO: 775841 - DNA, 21 bp, Homo sapiens
atttttatagcaacaacaatt

SEQ ID NO: 775842 - DNA, 14 bp, Homo sapiens
atttttatcatgaa

SEQ ID NO: 775843 - DNA, 15 bp, Homo sapiens
atttttatgtgcagc

SEQ ID NO: 775844 - DNA, 15 bp, Homo sapiens
atttttattaaatgt

SEQ ID NO: 775845 - DNA, 16 bp, Homo sapiens
atttttattacttttt

SEQ ID NO: 775846 - DNA, 18 bp, Homo sapiens
atttttatttctttttaa

SEQ ID NO: 775847 - DNA, 16 bp, Homo sapiens
atttttatttttctaa

SEQ ID NO: 775848 - DNA, 18 bp, Homo sapiens
atttttatttttgctgag

SEQ ID NO: 775849 - DNA, 14 bp, Homo sapiens
atttttcaaagcaa

SEQ ID NO: 775850 - DNA, 12 bp, Homo sapiens
atttttcaaata

SEQ ID NO: 775851 - DNA, 19 bp, Homo sapiens
atttttcaaatcattcctt

SEQ ID NO: 775852 - DNA, 16 bp, Homo sapiens
atttttcaataaagca

SEQ ID NO: 775853 - DNA, 21 bp, Homo sapiens
atttttcaataaagcatttat

SEQ ID NO: 775854 - DNA, 22 bp, Homo sapiens
atttttcaatatattgaacttt

SEQ ID NO: 775855 - DNA, 12 bp, Homo sapiens
atttttcaatca

SEQ ID NO: 775856 - DNA, 14 bp, Homo sapiens
atttttcagatgct

SEQ ID NO: 775857 - DNA, 22 bp, Homo sapiens
atttttcagttccaagaaagat

SEQ ID NO: 775858 - DNA, 16 bp, Homo sapiens
atttttcatacttttc

SEQ ID NO: 775859 - DNA, 17 bp, Homo sapiens
atttttcatacttttct

SEQ ID NO: 775860 - DNA, 13 bp, Homo sapiens
atttttcatattg

SEQ ID NO: 775861 - DNA, 18 bp, Homo sapiens
atttttcatattgtgcca

SEQ ID NO: 775862 - DNA, 15 bp, Homo sapiens
atttttccatgtgtg

SEQ ID NO: 775863 - DNA, 14 bp, Homo sapiens
atttttccatttat

SEQ ID NO: 775864 - DNA, 10 bp, Homo sapiens
atttttccta

SEQ ID NO: 775865 - DNA, 16 bp, Homo sapiens
atttttcctgcatgtt

SEQ ID NO: 775866 - DNA, 12 bp, Homo sapiens
atttttccttta

SEQ ID NO: 775867 - DNA, 12 bp, Homo sapiens
atttttcctttc

SEQ ID NO: 775868 - DNA, 15 bp, Homo sapiens
atttttctaaagaaa

SEQ ID NO: 775869 - DNA, 18 bp, Homo sapiens
atttttctataaatcagt

SEQ ID NO: 775870 - DNA, 13 bp, Homo sapiens
atttttctcttca

SEQ ID NO: 775871 - DNA, 14 bp, Homo sapiens
atttttctcttgta

SEQ ID NO: 775872 - DNA, 18 bp, Homo sapiens
atttttctcttgtaccat

SEQ ID NO: 775873 - DNA, 15 bp, Homo sapiens
atttttctctttctc

SEQ ID NO: 775874 - DNA, 16 bp, Homo sapiens
atttttctgactttta

SEQ ID NO: 775875 - DNA, 22 bp, Homo sapiens
atttttctgacttttacagatt

SEQ ID NO: 775876 - DNA, 13 bp, Homo sapiens
atttttctgtact

SEQ ID NO: 775877 - DNA, 19 bp, Homo sapiens
atttttcttgttgcatctt

SEQ ID NO: 775878 - DNA, 14 bp, Homo sapiens
atttttctttacaa

SEQ ID NO: 775879 - DNA, 22 bp, Homo sapiens
atttttcttttattcttctttc

SEQ ID NO: 775880 - DNA, 14 bp, Homo sapiens
atttttctttttaa

SEQ ID NO: 775881 - DNA, 10 bp, Homo sapiens
atttttgaaa

SEQ ID NO: 775882 - DNA, 17 bp, Homo sapiens
atttttgaaaaatattg

SEQ ID NO: 775883 - DNA, 22 bp, Homo sapiens
atttttgaaaaatattgctaaa

SEQ ID NO: 775884 - DNA, 13 bp, Homo sapiens
atttttgaagact

SEQ ID NO: 775885 - DNA, 18 bp, Homo sapiens
atttttgacatggaaatg

SEQ ID NO: 775886 - DNA, 18 bp, Homo sapiens
atttttgaggaagttttg

SEQ ID NO: 775887 - DNA, 17 bp, Homo sapiens
atttttgataccttcaa

SEQ ID NO: 775888 - DNA, 17 bp, Homo sapiens
atttttgggtttggcca

SEQ ID NO: 775889 - DNA, 19 bp, Homo sapiens
atttttgggtttggccagg

SEQ ID NO: 775890 - DNA, 22 bp, Homo sapiens
atttttgggtttggccagggag

SEQ ID NO: 775891 - DNA, 23 bp, Homo sapiens
atttttgggtttggccagggagg

SEQ ID NO: 775892 - DNA, 17 bp, Homo sapiens
atttttggtatttatgt

SEQ ID NO: 775893 - DNA, 19 bp, Homo sapiens
atttttggttgtcaatatt

SEQ ID NO: 775894 - DNA, 12 bp, Homo sapiens
atttttgtaatt

SEQ ID NO: 775895 - DNA, 14 bp, Homo sapiens
atttttgtacttga

SEQ ID NO: 775896 - DNA, 15 bp, Homo sapiens
atttttgtacttgat

SEQ ID NO: 775897 - DNA, 12 bp, Homo sapiens
atttttgtataa

SEQ ID NO: 775898 - DNA, 13 bp, Homo sapiens
atttttgtataaa

SEQ ID NO: 775899 - DNA, 17 bp, Homo sapiens
atttttgtataaaaagg

SEQ ID NO: 775900 - DNA, 18 bp, Homo sapiens
atttttgtataaaaagga

SEQ ID NO: 775901 - DNA, 19 bp, Homo sapiens
atttttgtataaaatccat

SEQ ID NO: 775902 - DNA, 16 bp, Homo sapiens
atttttgtctgcagct

SEQ ID NO: 775903 - DNA, 20 bp, Homo sapiens
atttttgtgaaatgaaaaca

SEQ ID NO: 775904 - DNA, 18 bp, Homo sapiens
atttttgtgccattatat

SEQ ID NO: 775905 - DNA, 24 bp, Homo sapiens
atttttgtgccattatatttgcat

SEQ ID NO: 775906 - DNA, 22 bp, Homo sapiens
atttttgtgtttgaaagtgaaa

SEQ ID NO: 775907 - DNA, 14 bp, Homo sapiens
atttttgtttggac

SEQ ID NO: 775908 - DNA, 19 bp, Homo sapiens
atttttgtttggactgttt

SEQ ID NO: 775909 - DNA, 15 bp, Homo sapiens
atttttgttttcccc

SEQ ID NO: 775910 - DNA, 22 bp, Homo sapiens
atttttgtttttgagtactgta

SEQ ID NO: 775911 - DNA, 17 bp, Homo sapiens
atttttgtttttgtaat

SEQ ID NO: 775912 - DNA, 17 bp, Homo sapiens
attttttaaaaaagctt

SEQ ID NO: 775913 - DNA, 18 bp, Homo sapiens
attttttaaaaaagctta

SEQ ID NO: 775914 - DNA, 20 bp, Homo sapiens
attttttaaaaaagcttaaa

SEQ ID NO: 775915 - DNA, 22 bp, Homo sapiens
attttttaaaacaagccaagaa

SEQ ID NO: 775916 - DNA, 16 bp, Homo sapiens
attttttaaaacacta

SEQ ID NO: 775917 - DNA, 18 bp, Homo sapiens
attttttaaaacactaaa

SEQ ID NO: 775918 - DNA, 20 bp, Homo sapiens
attttttaaaagcatggcta

SEQ ID NO: 775919 - DNA, 18 bp, Homo sapiens
attttttaaacgaagaga

SEQ ID NO: 775920 - DNA, 14 bp, Homo sapiens
attttttaaatgca

SEQ ID NO: 775921 - DNA, 17 bp, Homo sapiens
attttttaaatgtaaaa

SEQ ID NO: 775922 - DNA, 23 bp, Homo sapiens
attttttaacctcctaagtatca

SEQ ID NO: 775923 - DNA, 16 bp, Homo sapiens
attttttaaggaaaca

SEQ ID NO: 775924 - DNA, 19 bp, Homo sapiens
attttttaagtatttatat

SEQ ID NO: 775925 - DNA, 20 bp, Homo sapiens
attttttaatgtattccctt

SEQ ID NO: 775926 - DNA, 21 bp, Homo sapiens
attttttaatttgatgaaagc

SEQ ID NO: 775927 - DNA, 22 bp, Homo sapiens
attttttaatttgatgaaagct

SEQ ID NO: 775928 - DNA, 19 bp, Homo sapiens
attttttacattttacaca

SEQ ID NO: 775929 - DNA, 16 bp, Homo sapiens
attttttatcatgcat

SEQ ID NO: 775930 - DNA, 16 bp, Homo sapiens
attttttatgtacaac

SEQ ID NO: 775931 - DNA, 20 bp, Homo sapiens
attttttcagacttgtcaag

SEQ ID NO: 775932 - DNA, 13 bp, Homo sapiens
attttttcccaaa

SEQ ID NO: 775933 - DNA, 14 bp, Homo sapiens
attttttccctcct

SEQ ID NO: 775934 - DNA, 20 bp, Homo sapiens
attttttccctcctgacaaa

SEQ ID NO: 775935 - DNA, 12 bp, Homo sapiens
attttttcctta

SEQ ID NO: 775936 - DNA, 15 bp, Homo sapiens
attttttctatgaac

SEQ ID NO: 775937 - DNA, 14 bp, Homo sapiens
attttttcttttgt

SEQ ID NO: 775938 - DNA, 16 bp, Homo sapiens
attttttgaaaagcag

SEQ ID NO: 775939 - DNA, 13 bp, Homo sapiens
attttttgaaagt

SEQ ID NO: 775940 - DNA, 14 bp, Homo sapiens
attttttgaaagtt

SEQ ID NO: 775941 - DNA, 22 bp, Homo sapiens
attttttgaaatgggcatttat

SEQ ID NO: 775942 - DNA, 16 bp, Homo sapiens
attttttgaaggtttc

SEQ ID NO: 775943 - DNA, 23 bp, Homo sapiens
attttttgactttttttgtatgt

SEQ ID NO: 775944 - DNA, 22 bp, Homo sapiens
attttttgctataatcattagt

SEQ ID NO: 775945 - DNA, 13 bp, Homo sapiens
attttttgggcca

SEQ ID NO: 775946 - DNA, 23 bp, Homo sapiens
attttttgtaatgtgtgaaaaag

SEQ ID NO: 775947 - DNA, 14 bp, Homo sapiens
attttttgtataat

SEQ ID NO: 775948 - DNA, 12 bp, Homo sapiens
attttttgttga

SEQ ID NO: 775949 - DNA, 14 bp, Homo sapiens
atttttttaaacaa

SEQ ID NO: 775950 - DNA, 17 bp, Homo sapiens
atttttttaaagtagtt

SEQ ID NO: 775951 - DNA, 20 bp, Homo sapiens
atttttttaaagtagttcct

SEQ ID NO: 775952 - DNA, 18 bp, Homo sapiens
atttttttaaatcaagga

SEQ ID NO: 775953 - DNA, 16 bp, Homo sapiens
atttttttaaccaaag

SEQ ID NO: 775954 - DNA, 21 bp, Homo sapiens
atttttttaaccaaaggtgaa

SEQ ID NO: 775955 - DNA, 16 bp, Homo sapiens
atttttttaactgaaa

SEQ ID NO: 775956 - DNA, 21 bp, Homo sapiens
atttttttaactgaaaatgta

SEQ ID NO: 775957 - DNA, 15 bp, Homo sapiens
atttttttaacttta

SEQ ID NO: 775958 - DNA, 18 bp, Homo sapiens
atttttttaagaaaaaag

SEQ ID NO: 775959 - DNA, 12 bp, Homo sapiens
atttttttaagc

SEQ ID NO: 775960 - DNA, 21 bp, Homo sapiens
atttttttcactggagttaca

SEQ ID NO: 775961 - DNA, 13 bp, Homo sapiens
atttttttctacc

SEQ ID NO: 775962 - DNA, 15 bp, Homo sapiens
atttttttctaccta

SEQ ID NO: 775963 - DNA, 20 bp, Homo sapiens
atttttttctaccttgaggt

SEQ ID NO: 775964 - DNA, 16 bp, Homo sapiens
atttttttctctctgg

SEQ ID NO: 775965 - DNA, 20 bp, Homo sapiens
atttttttgcaagtgaaggt

SEQ ID NO: 775966 - DNA, 15 bp, Homo sapiens
atttttttgtaataa

SEQ ID NO: 775967 - DNA, 16 bp, Homo sapiens
attttttttaaagaaa

SEQ ID NO: 775968 - DNA, 15 bp, Homo sapiens
attttttttaatgta

SEQ ID NO: 775969 - DNA, 17 bp, Homo sapiens
attttttttatatttat

SEQ ID NO: 775970 - DNA, 15 bp, Homo sapiens
attttttttggcctg

SEQ ID NO: 775971 - DNA, 15 bp, Homo sapiens
attttttttgtttca

SEQ ID NO: 775972 - DNA, 24 bp, Homo sapiens
attttttttgttttttgtaactac

SEQ ID NO: 775973 - DNA, 20 bp, Homo sapiens
atttttttttattttgcttt

SEQ ID NO: 775974 - DNA, 19 bp, Homo sapiens
atttttttttcatacactt

SEQ ID NO: 775975 - DNA, 20 bp, Homo sapiens
atttttttttcatacactta

SEQ ID NO: 775976 - DNA, 17 bp, Homo sapiens
atttttttttcctagcc

SEQ ID NO: 775977 - DNA, 16 bp, Homo sapiens
attttttttttaagtg

SEQ ID NO: 775978 - DNA, 17 bp, Homo sapiens
attttttttttcctctt

SEQ ID NO: 775979 - DNA, 19 bp, Homo sapiens
atttttttttttttttcct

SEQ ID NO: 775980 - DNA, 20 bp, Homo sapiens
caaaaaaaaaaaaaaagact

SEQ ID NO: 775981 - DNA, 21 bp, Homo sapiens
caaaaaaaaaaaaaaagactg

SEQ ID NO: 775982 - DNA, 23 bp, Homo sapiens
caaaaaaaaaaaaaaagactgtc

SEQ ID NO: 775983 - DNA, 17 bp, Homo sapiens
caaaaaaaaaaaaaatc

SEQ ID NO: 775984 - DNA, 17 bp, Homo sapiens
caaaaaaaaaaaaggaa

SEQ ID NO: 775985 - DNA, 15 bp, Homo sapiens
caaaaaaaaaaccct

SEQ ID NO: 775986 - DNA, 17 bp, Homo sapiens
caaaaaaaaaatagaga

SEQ ID NO: 775987 - DNA, 14 bp, Homo sapiens
caaaaaaaaaatga

SEQ ID NO: 775988 - DNA, 17 bp, Homo sapiens
caaaaaaaaagttttat

SEQ ID NO: 775989 - DNA, 19 bp, Homo sapiens
caaaaaaaaagttttattt

SEQ ID NO: 775990 - DNA, 20 bp, Homo sapiens
caaaaaaaaagttttatttt

SEQ ID NO: 775991 - DNA, 22 bp, Homo sapiens
caaaaaaaaagttttatttttc

SEQ ID NO: 775992 - DNA, 14 bp, Homo sapiens
caaaaaaaaataca

SEQ ID NO: 775993 - DNA, 23 bp, Homo sapiens
caaaaaaaaatttttttttctct

SEQ ID NO: 775994 - DNA, 18 bp, Homo sapiens
caaaaaaaattagccggg

SEQ ID NO: 775995 - DNA, 16 bp, Homo sapiens
caaaaaaacactagtt

SEQ ID NO: 775996 - DNA, 19 bp, Homo sapiens
caaaaaaagcctccaaggg

SEQ ID NO: 775997 - DNA, 13 bp, Homo sapiens
caaaaaaaggaaa

SEQ ID NO: 775998 - DNA, 15 bp, Homo sapiens
caaaagagccctggc

SEQ ID NO: 775999 - DNA, 17 bp, Homo sapiens
caaaagagccctggctc

SEQ ID NO: 776000 - DNA, 19 bp, Homo sapiens
caaaagatacccaaatttt

SEQ ID NO: 776001 - DNA, 16 bp, Homo sapiens
caaaagatgcttctca

SEQ ID NO: 776002 - DNA, 21 bp, Homo sapiens
caaaagatgtatccttccaat

SEQ ID NO: 776003 - DNA, 15 bp, Homo sapiens
caaaagcaaatgaga

SEQ ID NO: 776004 - DNA, 16 bp, Homo sapiens
caaaagcacatgtatt

SEQ ID NO: 776005 - DNA, 18 bp, Homo sapiens
caaaagcagcacaaggaa

SEQ ID NO: 776006 - DNA, 19 bp, Homo sapiens
caaaagcagcacaaggaat

SEQ ID NO: 776007 - DNA, 20 bp, Homo sapiens
caaaagcagccctctgcctc

SEQ ID NO: 776008 - DNA, 17 bp, Homo sapiens
caaaagcagctaaatgt

SEQ ID NO: 776009 - DNA, 13 bp, Homo sapiens
caaaagcatgtga

SEQ ID NO: 776010 - DNA, 12 bp, Homo sapiens
caaaagccacat

SEQ ID NO: 776011 - DNA, 18 bp, Homo sapiens
caaaagccataacttgaa

SEQ ID NO: 776012 - DNA, 12 bp, Homo sapiens
caaaagccatgt

SEQ ID NO: 776013 - DNA, 19 bp, Homo sapiens
caaaagcctcagaaaggga

SEQ ID NO: 776014 - DNA, 14 bp, Homo sapiens
caaaagcctgggtg

SEQ ID NO: 776015 - DNA, 15 bp, Homo sapiens
caaaagcgccctcac

SEQ ID NO: 776016 - DNA, 23 bp, Homo sapiens
caaaagcgtgagcttaaaataca

SEQ ID NO: 776017 - DNA, 21 bp, Homo sapiens
caaaagctatttaaagcatct

SEQ ID NO: 776018 - DNA, 14 bp, Homo sapiens
caaaagctgctcag

SEQ ID NO: 776019 - DNA, 18 bp, Homo sapiens
caaaagctgggaaccagc

SEQ ID NO: 776020 - DNA, 15 bp, Homo sapiens
caaaagctgggcagg

SEQ ID NO: 776021 - DNA, 13 bp, Homo sapiens
caaaaggaagtct

SEQ ID NO: 776022 - DNA, 16 bp, Homo sapiens
caaaaggcctcttgta

SEQ ID NO: 776023 - DNA, 19 bp, Homo sapiens
caaaagggccaaagaacca

SEQ ID NO: 776024 - DNA, 19 bp, Homo sapiens
caaaagggtgtatagtgtt

SEQ ID NO: 776025 - DNA, 20 bp, Homo sapiens
caaaaggttaataaagtaat

SEQ ID NO: 776026 - DNA, 20 bp, Homo sapiens
caaaaggttcactaaagcag

SEQ ID NO: 776027 - DNA, 19 bp, Homo sapiens
caaaagtaaatgggagggc

SEQ ID NO: 776028 - DNA, 22 bp, Homo sapiens
caaaagtcagcgtgacaatata

SEQ ID NO: 776029 - DNA, 16 bp, Homo sapiens
caaaagtgaaccatct

SEQ ID NO: 776030 - DNA, 22 bp, Homo sapiens
caaaagtgaaccatctcagacc

SEQ ID NO: 776031 - DNA, 20 bp, Homo sapiens
caaaagtggggctaaatgaa

SEQ ID NO: 776032 - DNA, 16 bp, Homo sapiens
caaaagttacatgttt

SEQ ID NO: 776033 - DNA, 21 bp, Homo sapiens
caaaagttccctgaaacacga

SEQ ID NO: 776034 - DNA, 17 bp, Homo sapiens
caaaagttcgaaagaaa

SEQ ID NO: 776035 - DNA, 15 bp, Homo sapiens
caaaagttctgactt

SEQ ID NO: 776036 - DNA, 18 bp, Homo sapiens
caaaagttctgacttgac

SEQ ID NO: 776037 - DNA, 13 bp, Homo sapiens
caaaataaaacat

SEQ ID NO: 776038 - DNA, 12 bp, Homo sapiens
caaaataaaact

SEQ ID NO: 776039 - DNA, 20 bp, Homo sapiens
caaaataaagcaatgtgttt

SEQ ID NO: 776040 - DNA, 14 bp, Homo sapiens
caaaataagaaaag

SEQ ID NO: 776041 - DNA, 15 bp, Homo sapiens
caaaataagaaaaga

SEQ ID NO: 776042 - DNA, 22 bp, Homo sapiens
caaaataaggaagagggctgag

SEQ ID NO: 776043 - DNA, 13 bp, Homo sapiens
caaaataagtttt

SEQ ID NO: 776044 - DNA, 20 bp, Homo sapiens
caaaataagtttttctttaa

SEQ ID NO: 776045 - DNA, 17 bp, Homo sapiens
caaaataataaaaatca

SEQ ID NO: 776046 - DNA, 20 bp, Homo sapiens
caaaataatctatattaaat

SEQ ID NO: 776047 - DNA, 14 bp, Homo sapiens
caaaataattctaa

SEQ ID NO: 776048 - DNA, 13 bp, Homo sapiens
caaaatacatgaa

SEQ ID NO: 776049 - DNA, 15 bp, Homo sapiens
caaaatacatttgta

SEQ ID NO: 776050 - DNA, 16 bp, Homo sapiens
caaaataccaaatgcc

SEQ ID NO: 776051 - DNA, 20 bp, Homo sapiens
caaaataccaaatgcctgtt

SEQ ID NO: 776052 - DNA, 13 bp, Homo sapiens
caaaatagaaagt

SEQ ID NO: 776053 - DNA, 13 bp, Homo sapiens
caaaatagaagct

SEQ ID NO: 776054 - DNA, 20 bp, Homo sapiens
caaaatagcttattatagaa

SEQ ID NO: 776055 - DNA, 15 bp, Homo sapiens
caaaatatgcccctt

SEQ ID NO: 776056 - DNA, 18 bp, Homo sapiens
caaaatattgagcagaat

SEQ ID NO: 776057 - DNA, 20 bp, Homo sapiens
caaaatatttaagtgaagga

SEQ ID NO: 776058 - DNA, 23 bp, Homo sapiens
caaaatatttaagtgaaggagaa

SEQ ID NO: 776059 - DNA, 17 bp, Homo sapiens
caaaatatttgtacata

SEQ ID NO: 776060 - DNA, 12 bp, Homo sapiens
caaaatattttc

SEQ ID NO: 776061 - DNA, 15 bp, Homo sapiens
caaaatattttttgc

SEQ ID NO: 776062 - DNA, 18 bp, Homo sapiens
caaaatcagtttttcata

SEQ ID NO: 776063 - DNA, 22 bp, Homo sapiens
caaaatcattttatatgtcaaa

SEQ ID NO: 776064 - DNA, 23 bp, Homo sapiens
caaaatcattttatatgtcaaag

SEQ ID NO: 776065 - DNA, 14 bp, Homo sapiens
caaaatccaaaact

SEQ ID NO: 776066 - DNA, 21 bp, Homo sapiens
caaaatccatgtgaccattct

SEQ ID NO: 776067 - DNA, 13 bp, Homo sapiens
caaaatcccctca

SEQ ID NO: 776068 - DNA, 15 bp, Homo sapiens
caaaatcccctcagc

SEQ ID NO: 776069 - DNA, 17 bp, Homo sapiens
caaaatcctcaggaaat

SEQ ID NO: 776070 - DNA, 15 bp, Homo sapiens
caaaatcctggaaga

SEQ ID NO: 776071 - DNA, 21 bp, Homo sapiens
caaaatcctggaagattttgg

SEQ ID NO: 776072 - DNA, 21 bp, Homo sapiens
caaaatcgatgcagtgcttcc

SEQ ID NO: 776073 - DNA, 20 bp, Homo sapiens
caaaatctaaaacaaaatct

SEQ ID NO: 776074 - DNA, 14 bp, Homo sapiens
caaaatctgaactc

SEQ ID NO: 776075 - DNA, 16 bp, Homo sapiens
caaaatctgattagaa

SEQ ID NO: 776076 - DNA, 16 bp, Homo sapiens
caaaatctgttctaac

SEQ ID NO: 776077 - DNA, 17 bp, Homo sapiens
caaaatctgttctaaca

SEQ ID NO: 776078 - DNA, 22 bp, Homo sapiens
caaaatcttgatcagttaagaa

SEQ ID NO: 776079 - DNA, 12 bp, Homo sapiens
caaaatgacttt

SEQ ID NO: 776080 - DNA, 16 bp, Homo sapiens
caaaatgactttgaac

SEQ ID NO: 776081 - DNA, 17 bp, Homo sapiens
caaaatgagtcaggcaa

SEQ ID NO: 776082 - DNA, 22 bp, Homo sapiens
caaaatgagtcaggcaattgat

SEQ ID NO: 776083 - DNA, 19 bp, Homo sapiens
caaaatgagttgtgatgaa

SEQ ID NO: 776084 - DNA, 12 bp, Homo sapiens
caaaatgccaag

SEQ ID NO: 776085 - DNA, 18 bp, Homo sapiens
caaaatgctctagtgcct

SEQ ID NO: 776086 - DNA, 15 bp, Homo sapiens
caaaatggaagcaaa

SEQ ID NO: 776087 - DNA, 16 bp, Homo sapiens
caaaatggatacataa

SEQ ID NO: 776088 - DNA, 19 bp, Homo sapiens
caaaatggatacataaaga

SEQ ID NO: 776089 - DNA, 18 bp, Homo sapiens
caaaatggggcagaagag

SEQ ID NO: 776090 - DNA, 20 bp, Homo sapiens
caaaatggtcagtattatct

SEQ ID NO: 776091 - DNA, 15 bp, Homo sapiens
caaaatggtttttgt

SEQ ID NO: 776092 - DNA, 16 bp, Homo sapiens
caaaatgtatgtctgg

SEQ ID NO: 776093 - DNA, 13 bp, Homo sapiens
caaaatgtctgta

SEQ ID NO: 776094 - DNA, 16 bp, Homo sapiens
caaaatgtgtatttct

SEQ ID NO: 776095 - DNA, 16 bp, Homo sapiens
caaaatgttctattta

SEQ ID NO: 776096 - DNA, 17 bp, Homo sapiens
caaaatgttctatttaa

SEQ ID NO: 776097 - DNA, 18 bp, Homo sapiens
caaaatgttctatttaac

SEQ ID NO: 776098 - DNA, 11 bp, Homo sapiens
caaactcctga

SEQ ID NO: 776099 - DNA, 16 bp, Homo sapiens
caaactcctgacctca

SEQ ID NO: 776100 - DNA, 12 bp, Homo sapiens
caaactcttcag

SEQ ID NO: 776101 - DNA, 13 bp, Homo sapiens
caaactcttcagt

SEQ ID NO: 776102 - DNA, 23 bp, Homo sapiens
caaactgaagcagcctctcccca

SEQ ID NO: 776103 - DNA, 22 bp, Homo sapiens
caaactgaggaatttcacctgt

SEQ ID NO: 776104 - DNA, 23 bp, Homo sapiens
caaactgagtaaattggaaacat

SEQ ID NO: 776105 - DNA, 14 bp, Homo sapiens
caaactgatgctga

SEQ ID NO: 776106 - DNA, 17 bp, Homo sapiens
caaactgatgctgagga

SEQ ID NO: 776107 - DNA, 21 bp, Homo sapiens
caaactgcacacacagctcct

SEQ ID NO: 776108 - DNA, 14 bp, Homo sapiens
caaactgcagctgt

SEQ ID NO: 776109 - DNA, 17 bp, Homo sapiens
caaactgcagctgtgag

SEQ ID NO: 776110 - DNA, 16 bp, Homo sapiens
caaactgctgcatact

SEQ ID NO: 776111 - DNA, 14 bp, Homo sapiens
caaactgctttatt

SEQ ID NO: 776112 - DNA, 18 bp, Homo sapiens
caaactgctttattttcc

SEQ ID NO: 776113 - DNA, 12 bp, Homo sapiens
caaactgtaaat

SEQ ID NO: 776114 - DNA, 14 bp, Homo sapiens
caaacttactattt

SEQ ID NO: 776115 - DNA, 15 bp, Homo sapiens
caaacttactatttt

SEQ ID NO: 776116 - DNA, 18 bp, Homo sapiens
caaacttggatacttgga

SEQ ID NO: 776117 - DNA, 18 bp, Homo sapiens
caaacttgtggcctcaag

SEQ ID NO: 776118 - DNA, 14 bp, Homo sapiens
caaacttgttcatt

SEQ ID NO: 776119 - DNA, 16 bp, Homo sapiens
caaacttgttcattta

SEQ ID NO: 776120 - DNA, 17 bp, Homo sapiens
caaacttgttcatttag

SEQ ID NO: 776121 - DNA, 15 bp, Homo sapiens
caaactttaaaatgc

SEQ ID NO: 776122 - DNA, 16 bp, Homo sapiens
caaactttaaaatgcg

SEQ ID NO: 776123 - DNA, 17 bp, Homo sapiens
caaactttaaaatgcga

SEQ ID NO: 776124 - DNA, 20 bp, Homo sapiens
caaactttgcatctcagtat

SEQ ID NO: 776125 - DNA, 14 bp, Homo sapiens
caaacttttctttc

SEQ ID NO: 776126 - DNA, 12 bp, Homo sapiens
caaactttttcc

SEQ ID NO: 776127 - DNA, 22 bp, Homo sapiens
caaactttttccagcaaaatgg

SEQ ID NO: 776128 - DNA, 11 bp, Homo sapiens
caaagaaaaaa

SEQ ID NO: 776129 - DNA, 20 bp, Homo sapiens
caaagaaaaaaaatcttata

SEQ ID NO: 776130 - DNA, 22 bp, Homo sapiens
caaagaaaaaaaatcttataaa

SEQ ID NO: 776131 - DNA, 17 bp, Homo sapiens
caaagaaaattcctata

SEQ ID NO: 776132 - DNA, 20 bp, Homo sapiens
caaagaaacaagctgtgcag

SEQ ID NO: 776133 - DNA, 13 bp, Homo sapiens
caaagaaacccaa

SEQ ID NO: 776134 - DNA, 16 bp, Homo sapiens
caaagaaagtgtattg

SEQ ID NO: 776135 - DNA, 15 bp, Homo sapiens
caaagaaatgggcct

SEQ ID NO: 776136 - DNA, 17 bp, Homo sapiens
caaagaaatgggcctgc

SEQ ID NO: 776137 - DNA, 18 bp, Homo sapiens
caaagaaatgggcctgcc

SEQ ID NO: 776138 - DNA, 23 bp, Homo sapiens
caaagaaattcagaacagcctgc

SEQ ID NO: 776139 - DNA, 17 bp, Homo sapiens
caaagaaccaaagaaga

SEQ ID NO: 776140 - DNA, 19 bp, Homo sapiens
caaagaacttgatttgcat

SEQ ID NO: 776141 - DNA, 14 bp, Homo sapiens
caaagaagacaaca

SEQ ID NO: 776142 - DNA, 14 bp, Homo sapiens
caaagaagcttcat

SEQ ID NO: 776143 - DNA, 21 bp, Homo sapiens
caaagaagcttccacaaaatt

SEQ ID NO: 776144 - DNA, 14 bp, Homo sapiens
caaagaaggagctg

SEQ ID NO: 776145 - DNA, 14 bp, Homo sapiens
caaagaaggtgctg

SEQ ID NO: 776146 - DNA, 14 bp, Homo sapiens
caaagaattacagt

SEQ ID NO: 776147 - DNA, 22 bp, Homo sapiens
caaagaattcctgaagccagat

SEQ ID NO: 776148 - DNA, 11 bp, Homo sapiens
caaagacaaaa

SEQ ID NO: 776149 - DNA, 12 bp, Homo sapiens
caaagacaaaag

SEQ ID NO: 776150 - DNA, 14 bp, Homo sapiens
caaagacaaaagaa

SEQ ID NO: 776151 - DNA, 15 bp, Homo sapiens
caaagacaaaagaaa

SEQ ID NO: 776152 - DNA, 16 bp, Homo sapiens
caaagacaaaagaaac

SEQ ID NO: 776153 - DNA, 18 bp, Homo sapiens
caaagacaaaagaaactt

SEQ ID NO: 776154 - DNA, 21 bp, Homo sapiens
caaagacaaattctgtttctt

SEQ ID NO: 776155 - DNA, 12 bp, Homo sapiens
caaagacaggca

SEQ ID NO: 776156 - DNA, 13 bp, Homo sapiens
caaagacaggcaa

SEQ ID NO: 776157 - DNA, 14 bp, Homo sapiens
caaagacaggcaaa

SEQ ID NO: 776158 - DNA, 13 bp, Homo sapiens
caaagacatcagt

SEQ ID NO: 776159 - DNA, 19 bp, Homo sapiens
caaagacccgggagctggc

SEQ ID NO: 776160 - DNA, 20 bp, Homo sapiens
caaagactatttcaaaatgt

SEQ ID NO: 776161 - DNA, 17 bp, Homo sapiens
caaagactcctctgggc

SEQ ID NO: 776162 - DNA, 20 bp, Homo sapiens
caaagactcctctgggcctg

SEQ ID NO: 776163 - DNA, 16 bp, Homo sapiens
caaagactccttgtgg

SEQ ID NO: 776164 - DNA, 14 bp, Homo sapiens
caaagactctgagc

SEQ ID NO: 776165 - DNA, 16 bp, Homo sapiens
caaagactctgagcca

SEQ ID NO: 776166 - DNA, 19 bp, Homo sapiens
caaagactctgagccaagg

SEQ ID NO: 776167 - DNA, 16 bp, Homo sapiens
caaagactgtactggc

SEQ ID NO: 776168 - DNA, 22 bp, Homo sapiens
caaagactgtgaacagcttgct

SEQ ID NO: 776169 - DNA, 16 bp, Homo sapiens
caaagacttagtatat

SEQ ID NO: 776170 - DNA, 16 bp, Homo sapiens
caaagagaaaaagaaa

SEQ ID NO: 776171 - DNA, 21 bp, Homo sapiens
caaagagaaaaagaaatgcaa

SEQ ID NO: 776172 - DNA, 14 bp, Homo sapiens
caaagagaaaacat

SEQ ID NO: 776173 - DNA, 20 bp, Homo sapiens
caaagagaaaccgcttttgg

SEQ ID NO: 776174 - DNA, 20 bp, Homo sapiens
caaagagaaatcacaggggc

SEQ ID NO: 776175 - DNA, 21 bp, Homo sapiens
caaagagaaatcacaggggcg

SEQ ID NO: 776176 - DNA, 23 bp, Homo sapiens
caaagagaagatgcctgttaatt

SEQ ID NO: 776177 - DNA, 16 bp, Homo sapiens
caaagagactggagca

SEQ ID NO: 776178 - DNA, 14 bp, Homo sapiens
caaagagattcgaa

SEQ ID NO: 776179 - DNA, 23 bp, Homo sapiens
caaagagccttcagaatgctcct

SEQ ID NO: 776180 - DNA, 15 bp, Homo sapiens
caaagagggatgttt

SEQ ID NO: 776181 - DNA, 20 bp, Homo sapiens
caaagagggggctctgccca

SEQ ID NO: 776182 - DNA, 16 bp, Homo sapiens
caaagaggtgaacatt

SEQ ID NO: 776183 - DNA, 20 bp, Homo sapiens
caaagaggttggagcaacaa

SEQ ID NO: 776184 - DNA, 20 bp, Homo sapiens
caaagagtgggctgcatctg

SEQ ID NO: 776185 - DNA, 22 bp, Homo sapiens
caaagagtgggctgcatctggg

SEQ ID NO: 776186 - DNA, 21 bp, Homo sapiens
caaagagttcaagaaataagt

SEQ ID NO: 776187 - DNA, 14 bp, Homo sapiens
caaagatattttgc

SEQ ID NO: 776188 - DNA, 20 bp, Homo sapiens
caaagatattttgctttgtg

SEQ ID NO: 776189 - DNA, 14 bp, Homo sapiens
caaagatcaaaata

SEQ ID NO: 776190 - DNA, 22 bp, Homo sapiens
caaagatctgaattaaataaat

SEQ ID NO: 776191 - DNA, 12 bp, Homo sapiens
caaagatgaaaa

SEQ ID NO: 776192 - DNA, 23 bp, Homo sapiens
caaagatgcatttttataaattt

SEQ ID NO: 776193 - DNA, 20 bp, Homo sapiens
caaagatgcgtttgcctcct

SEQ ID NO: 776194 - DNA, 16 bp, Homo sapiens
caaagatgtttgtcag

SEQ ID NO: 776195 - DNA, 15 bp, Homo sapiens
caaagattaaatgtg

SEQ ID NO: 776196 - DNA, 21 bp, Homo sapiens
caaagattaaatgtgtcattg

SEQ ID NO: 776197 - DNA, 16 bp, Homo sapiens
caaagattctttatat

SEQ ID NO: 776198 - DNA, 19 bp, Homo sapiens
caaagatttcagtagaatt

SEQ ID NO: 776199 - DNA, 15 bp, Homo sapiens
caaagcaaaaccaga

SEQ ID NO: 776200 - DNA, 15 bp, Homo sapiens
caaagcaaaggcagt

SEQ ID NO: 776201 - DNA, 20 bp, Homo sapiens
caaagcaaataaatgccttc

SEQ ID NO: 776202 - DNA, 22 bp, Homo sapiens
caaagcaagcattcagaagaaa

SEQ ID NO: 776203 - DNA, 23 bp, Homo sapiens
caaagcaagcattcagaagaaaa

SEQ ID NO: 776204 - DNA, 11 bp, Homo sapiens
caaagcacatg

SEQ ID NO: 776205 - DNA, 18 bp, Homo sapiens
caaagcaccaaaataaga

SEQ ID NO: 776206 - DNA, 21 bp, Homo sapiens
caaagcaccagcttctccagg

SEQ ID NO: 776207 - DNA, 21 bp, Homo sapiens
caaagcacccatttcaatgtg

SEQ ID NO: 776208 - DNA, 21 bp, Homo sapiens
caaagcacttgcttacatcct

SEQ ID NO: 776209 - DNA, 21 bp, Homo sapiens
caaagcacttggactcttgct

SEQ ID NO: 776210 - DNA, 18 bp, Homo sapiens
caaagcagaagtctggct

SEQ ID NO: 776211 - DNA, 19 bp, Homo sapiens
caaagcagacagctccacc

SEQ ID NO: 776212 - DNA, 14 bp, Homo sapiens
caaagcagcagcca

SEQ ID NO: 776213 - DNA, 12 bp, Homo sapiens
caaagcagccac

SEQ ID NO: 776214 - DNA, 10 bp, Homo sapiens
caaagcagga

SEQ ID NO: 776215 - DNA, 16 bp, Homo sapiens
caaagcaggagtggaa

SEQ ID NO: 776216 - DNA, 17 bp, Homo sapiens
caaagcagtatataata

SEQ ID NO: 776217 - DNA, 21 bp, Homo sapiens
caaagcagtatataataactt

SEQ ID NO: 776218 - DNA, 16 bp, Homo sapiens
caaagcatgaaatgga

SEQ ID NO: 776219 - DNA, 16 bp, Homo sapiens
caaagccaaacaaaac

SEQ ID NO: 776220 - DNA, 22 bp, Homo sapiens
caaagccaaactctgccagcca

SEQ ID NO: 776221 - DNA, 22 bp, Homo sapiens
caaagccaacagtcaaaacaga

SEQ ID NO: 776222 - DNA, 11 bp, Homo sapiens
caaagccagaa

SEQ ID NO: 776223 - DNA, 14 bp, Homo sapiens
caaagccagacagc

SEQ ID NO: 776224 - DNA, 15 bp, Homo sapiens
caaagccagggtctc

SEQ ID NO: 776225 - DNA, 18 bp, Homo sapiens
caaagccattcttttaaa

SEQ ID NO: 776226 - DNA, 11 bp, Homo sapiens
caaagccctgc

SEQ ID NO: 776227 - DNA, 13 bp, Homo sapiens
caaagccctgcct

SEQ ID NO: 776228 - DNA, 16 bp, Homo sapiens
caaagccctgcctctg

SEQ ID NO: 776229 - DNA, 18 bp, Homo sapiens
caaagccctgcctctgtg

SEQ ID NO: 776230 - DNA, 15 bp, Homo sapiens
caaagccctggtaaa

SEQ ID NO: 776231 - DNA, 13 bp, Homo sapiens
caaagcctcttca

SEQ ID NO: 776232 - DNA, 18 bp, Homo sapiens
caaagcctcttcaaaaag

SEQ ID NO: 776233 - DNA, 17 bp, Homo sapiens
caaagcgacagattcat

SEQ ID NO: 776234 - DNA, 13 bp, Homo sapiens
caaagcgggggga

SEQ ID NO: 776235 - DNA, 15 bp, Homo sapiens
caaagctacaggact

SEQ ID NO: 776236 - DNA, 21 bp, Homo sapiens
caaagctagggtggcccttgc

SEQ ID NO: 776237 - DNA, 20 bp, Homo sapiens
caaagctcaaataaaaataa

SEQ ID NO: 776238 - DNA, 11 bp, Homo sapiens
caaagctcata

SEQ ID NO: 776239 - DNA, 14 bp, Homo sapiens
caaagctgcccact

SEQ ID NO: 776240 - DNA, 15 bp, Homo sapiens
caaagctgcccactg

SEQ ID NO: 776241 - DNA, 11 bp, Homo sapiens
caaagctggag

SEQ ID NO: 776242 - DNA, 18 bp, Homo sapiens
caaagctgttaaactgtt

SEQ ID NO: 776243 - DNA, 22 bp, Homo sapiens
caaagctgttaaactgttagca

SEQ ID NO: 776244 - DNA, 21 bp, Homo sapiens
caaagcttctatcccaggagg

SEQ ID NO: 776245 - DNA, 14 bp, Homo sapiens
caaagcttgaagat

SEQ ID NO: 776246 - DNA, 16 bp, Homo sapiens
caaagcttgttaagat

SEQ ID NO: 776247 - DNA, 16 bp, Homo sapiens
caaagctttactactg

SEQ ID NO: 776248 - DNA, 23 bp, Homo sapiens
caaaggaacttttaaaagattat

SEQ ID NO: 776249 - DNA, 20 bp, Homo sapiens
caaaggaaggggttttccca

SEQ ID NO: 776250 - DNA, 20 bp, Homo sapiens
caaaggaataacctttctgg

SEQ ID NO: 776251 - DNA, 14 bp, Homo sapiens
caaaggagaaaaaa

SEQ ID NO: 776252 - DNA, 18 bp, Homo sapiens
caaaggagaaaaaaaacc

SEQ ID NO: 776253 - DNA, 19 bp, Homo sapiens
caaaggagaaaaaaaacct

SEQ ID NO: 776254 - DNA, 14 bp, Homo sapiens
caaaaaaaggaaaa

SEQ ID NO: 776255 - DNA, 16 bp, Homo sapiens
caaaaaaaggaaaaat

SEQ ID NO: 776256 - DNA, 17 bp, Homo sapiens
caaaaaaaggaaaaata

SEQ ID NO: 776257 - DNA, 20 bp, Homo sapiens
caaaaaaaggaaaaataatc

SEQ ID NO: 776258 - DNA, 16 bp, Homo sapiens
caaaaaaatctgcaga

SEQ ID NO: 776259 - DNA, 21 bp, Homo sapiens
caaaaaaatctgcagaaggaa

SEQ ID NO: 776260 - DNA, 21 bp, Homo sapiens
caaaaaaattaaaatggatgc

SEQ ID NO: 776261 - DNA, 11 bp, Homo sapiens
caaaaaacaga

SEQ ID NO: 776262 - DNA, 11 bp, Homo sapiens
caaaaaaccca

SEQ ID NO: 776263 - DNA, 11 bp, Homo sapiens
caaaaaactac

SEQ ID NO: 776264 - DNA, 15 bp, Homo sapiens
caaaaaactacttct

SEQ ID NO: 776265 - DNA, 14 bp, Homo sapiens
caaaaaagaaaacc

SEQ ID NO: 776266 - DNA, 21 bp, Homo sapiens
caaaaaagacttgagacaatg

SEQ ID NO: 776267 - DNA, 20 bp, Homo sapiens
caaaaaagcaaacacaagaa

SEQ ID NO: 776268 - DNA, 19 bp, Homo sapiens
caaaaaaggaaaagttaaa

SEQ ID NO: 776269 - DNA, 16 bp, Homo sapiens
caaaaaagtcaacaaa

SEQ ID NO: 776270 - DNA, 17 bp, Homo sapiens
caaaaaagtccaatttt

SEQ ID NO: 776271 - DNA, 18 bp, Homo sapiens
caaaaaagtccaatttta

SEQ ID NO: 776272 - DNA, 15 bp, Homo sapiens
caaaaaatgttttaa

SEQ ID NO: 776273 - DNA, 14 bp, Homo sapiens
caaaaaattaaaac

SEQ ID NO: 776274 - DNA, 15 bp, Homo sapiens
caaaaaattaaagca

SEQ ID NO: 776275 - DNA, 16 bp, Homo sapiens
caaaaaattagccggg

SEQ ID NO: 776276 - DNA, 14 bp, Homo sapiens
caaaaacaaaaaaa

SEQ ID NO: 776277 - DNA, 14 bp, Homo sapiens
caaaaacaaaaaga

SEQ ID NO: 776278 - DNA, 15 bp, Homo sapiens
caaaaacaaagctga

SEQ ID NO: 776279 - DNA, 16 bp, Homo sapiens
caaaaacaaagctgat

SEQ ID NO: 776280 - DNA, 16 bp, Homo sapiens
caaaaacaagactgcc

SEQ ID NO: 776281 - DNA, 20 bp, Homo sapiens
caaaaacaagactgcctccc

SEQ ID NO: 776282 - DNA, 21 bp, Homo sapiens
caaaaacagcagtttgtgata

SEQ ID NO: 776283 - DNA, 14 bp, Homo sapiens
caaaaacagcctca

SEQ ID NO: 776284 - DNA, 22 bp, Homo sapiens
caaaaacaggtatatactttga

SEQ ID NO: 776285 - DNA, 17 bp, Homo sapiens
caaaaacaggtttttga

SEQ ID NO: 776286 - DNA, 21 bp, Homo sapiens
caaaaacaggtttttgatttt

SEQ ID NO: 776287 - DNA, 15 bp, Homo sapiens
caaaaacatgtatgt

SEQ ID NO: 776288 - DNA, 16 bp, Homo sapiens
caaaaactacacatat

SEQ ID NO: 776289 - DNA, 14 bp, Homo sapiens
caaaaactatttgg

SEQ ID NO: 776290 - DNA, 16 bp, Homo sapiens
caaaaactgtactgtg

SEQ ID NO: 776291 - DNA, 16 bp, Homo sapiens
caaaaactgtgggaag

SEQ ID NO: 776292 - DNA, 17 bp, Homo sapiens
caaaaacttcctttaca

SEQ ID NO: 776293 - DNA, 19 bp, Homo sapiens
caaaaacttcctttacaga

SEQ ID NO: 776294 - DNA, 23 bp, Homo sapiens
caaaaactttggagtcccctcac

SEQ ID NO: 776295 - DNA, 16 bp, Homo sapiens
caaaaagaaaaaaaga

SEQ ID NO: 776296 - DNA, 18 bp, Homo sapiens
caaaaagaaaaaaagaaa

SEQ ID NO: 776297 - DNA, 20 bp, Homo sapiens
caaaaagaaaagaaaatttt

SEQ ID NO: 776298 - DNA, 15 bp, Homo sapiens
caaaaagaaatgtca

SEQ ID NO: 776299 - DNA, 21 bp, Homo sapiens
caaaaagaacaaaaaaatctg

SEQ ID NO: 776300 - DNA, 19 bp, Homo sapiens
caaaaagctaacatcttta

SEQ ID NO: 776301 - DNA, 16 bp, Homo sapiens
caaaaagctctgaaaa

SEQ ID NO: 776302 - DNA, 22 bp, Homo sapiens
caaaaagctcttacactacatt

SEQ ID NO: 776303 - DNA, 13 bp, Homo sapiens
caaaaagcttccc

SEQ ID NO: 776304 - DNA, 18 bp, Homo sapiens
caaaaaggaccaactggc

SEQ ID NO: 776305 - DNA, 17 bp, Homo sapiens
caaaaaggatacataat

SEQ ID NO: 776306 - DNA, 19 bp, Homo sapiens
caaaaaggcaaatattgaa

SEQ ID NO: 776307 - DNA, 20 bp, Homo sapiens
caaaaagggaaactattgtc

SEQ ID NO: 776308 - DNA, 22 bp, Homo sapiens
caaaaagggcttgaggtgaatt

SEQ ID NO: 776309 - DNA, 22 bp, Homo sapiens
caaaaagtaaaaattaaaaaat

SEQ ID NO: 776310 - DNA, 11 bp, Homo sapiens
caaaaagtgtt

SEQ ID NO: 776311 - DNA, 16 bp, Homo sapiens
caaaaagttgagtttc

SEQ ID NO: 776312 - DNA, 23 bp, Homo sapiens
caaaaataacactgttggcactt

SEQ ID NO: 776313 - DNA, 12 bp, Homo sapiens
caaaaatataaa

SEQ ID NO: 776314 - DNA, 14 bp, Homo sapiens
caaaaatatttata

SEQ ID NO: 776315 - DNA, 18 bp, Homo sapiens
caaaaatcaaagaacaga

SEQ ID NO: 776316 - DNA, 20 bp, Homo sapiens
caaaaatctcccagtgacaa

SEQ ID NO: 776317 - DNA, 21 bp, Homo sapiens
caaaaatgacaacagaaaaac

SEQ ID NO: 776318 - DNA, 11 bp, Homo sapiens
caaaaatggtg

SEQ ID NO: 776319 - DNA, 17 bp, Homo sapiens
caaaaattagccgggcg

SEQ ID NO: 776320 - DNA, 11 bp, Homo sapiens
caaaaattagg

SEQ ID NO: 776321 - DNA, 18 bp, Homo sapiens
caaaaattaggtattttg

SEQ ID NO: 776322 - DNA, 11 bp, Homo sapiens
caaaaattgcc

SEQ ID NO: 776323 - DNA, 14 bp, Homo sapiens
caaaaattgccaag

SEQ ID NO: 776324 - DNA, 21 bp, Homo sapiens
caaaaatttctgtaaaacagg

SEQ ID NO: 776325 - DNA, 16 bp, Homo sapiens
caaaacaaaaagatgt

SEQ ID NO: 776326 - DNA, 18 bp, Homo sapiens
caaaacaaaaagatgtct

SEQ ID NO: 776327 - DNA, 16 bp, Homo sapiens
caaaacaaacaaacac

SEQ ID NO: 776328 - DNA, 15 bp, Homo sapiens
caaaacaaaggccta

SEQ ID NO: 776329 - DNA, 22 bp, Homo sapiens
caaaacaaaggcctaattctat

SEQ ID NO: 776330 - DNA, 14 bp, Homo sapiens
caaaacaacaaaaa

SEQ ID NO: 776331 - DNA, 18 bp, Homo sapiens
caaaacaacaaaaaccaa

SEQ ID NO: 776332 - DNA, 20 bp, Homo sapiens
caaaacaacaaaaaccaaaa

SEQ ID NO: 776333 - DNA, 15 bp, Homo sapiens
caaaacaagccaaag

SEQ ID NO: 776334 - DNA, 12 bp, Homo sapiens
caaaacactgtg

SEQ ID NO: 776335 - DNA, 19 bp, Homo sapiens
caaaacacttccagtctgg

SEQ ID NO: 776336 - DNA, 13 bp, Homo sapiens
caaaacagattgt

SEQ ID NO: 776337 - DNA, 18 bp, Homo sapiens
caaaacagattgtttgca

SEQ ID NO: 776338 - DNA, 18 bp, Homo sapiens
caaaacatattcaaagca

SEQ ID NO: 776339 - DNA, 21 bp, Homo sapiens
caaaacatccacttaagttct

SEQ ID NO: 776340 - DNA, 21 bp, Homo sapiens
caaaaccaagattttgaagga

SEQ ID NO: 776341 - DNA, 17 bp, Homo sapiens
caaaaccaatgctgatg

SEQ ID NO: 776342 - DNA, 20 bp, Homo sapiens
caaaaccatccatccctaga

SEQ ID NO: 776343 - DNA, 13 bp, Homo sapiens
caaaacccacctt

SEQ ID NO: 776344 - DNA, 13 bp, Homo sapiens
caaaacccagacc

SEQ ID NO: 776345 - DNA, 14 bp, Homo sapiens
caaaacccatgtgg

SEQ ID NO: 776346 - DNA, 17 bp, Homo sapiens
caaaaccctcagcactg

SEQ ID NO: 776347 - DNA, 19 bp, Homo sapiens
caaaacctcaaaccagtca

SEQ ID NO: 776348 - DNA, 16 bp, Homo sapiens
caaaacctgtattact

SEQ ID NO: 776349 - DNA, 23 bp, Homo sapiens
caaaacctgtattactgaataat

SEQ ID NO: 776350 - DNA, 19 bp, Homo sapiens
caaaacctgtgccaggctg

SEQ ID NO: 776351 - DNA, 21 bp, Homo sapiens
caaaaccttttactggttgca

SEQ ID NO: 776352 - DNA, 23 bp, Homo sapiens
caaaacgcatggagtgtgtattg

SEQ ID NO: 776353 - DNA, 13 bp, Homo sapiens
caaaacggggcag

SEQ ID NO: 776354 - DNA, 17 bp, Homo sapiens
caaaacgggtcagtatt

SEQ ID NO: 776355 - DNA, 20 bp, Homo sapiens
caaaacgggttactaagatg

SEQ ID NO: 776356 - DNA, 19 bp, Homo sapiens
caaaactactgacagggag

SEQ ID NO: 776357 - DNA, 22 bp, Homo sapiens
caaaactatcctgattccaaat

SEQ ID NO: 776358 - DNA, 16 bp, Homo sapiens
caaaactcacagagct

SEQ ID NO: 776359 - DNA, 21 bp, Homo sapiens
caaaactcatttcctatgtaa

SEQ ID NO: 776360 - DNA, 15 bp, Homo sapiens
caaatgaatcattgt

SEQ ID NO: 776361 - DNA, 16 bp, Homo sapiens
caaatgaatcattgtt

SEQ ID NO: 776362 - DNA, 22 bp, Homo sapiens
caaatgaatgttgtctgtttgt

SEQ ID NO: 776363 - DNA, 18 bp, Homo sapiens
caaatgacagattctgac

SEQ ID NO: 776364 - DNA, 20 bp, Homo sapiens
caaatgaccgcacgttctct

SEQ ID NO: 776365 - DNA, 13 bp, Homo sapiens
caaatgagccatg

SEQ ID NO: 776366 - DNA, 15 bp, Homo sapiens
caaatgaggaaacca

SEQ ID NO: 776367 - DNA, 15 bp, Homo sapiens
caaatgagggagggg

SEQ ID NO: 776368 - DNA, 14 bp, Homo sapiens
caaatgagtaacat

SEQ ID NO: 776369 - DNA, 19 bp, Homo sapiens
caaatgagtaacatttgct

SEQ ID NO: 776370 - DNA, 9 bp, Homo sapiens
caaatgatg

SEQ ID NO: 776371 - DNA, 16 bp, Homo sapiens
caaatgcaaaattagt

SEQ ID NO: 776372 - DNA, 16 bp, Homo sapiens
caaatgcacaagctca

SEQ ID NO: 776373 - DNA, 18 bp, Homo sapiens
caaatgcacaagctcaga

SEQ ID NO: 776374 - DNA, 11 bp, Homo sapiens
caaatgcagaa

SEQ ID NO: 776375 - DNA, 22 bp, Homo sapiens
caaatgcagaaccacaaacaat

SEQ ID NO: 776376 - DNA, 16 bp, Homo sapiens
caaatgcagaatactt

SEQ ID NO: 776377 - DNA, 20 bp, Homo sapiens
caaatgcagggaggggaggc

SEQ ID NO: 776378 - DNA, 22 bp, Homo sapiens
caaatgcagggaggggaggcag

SEQ ID NO: 776379 - DNA, 17 bp, Homo sapiens
caaatgcgcgtgtgcac

SEQ ID NO: 776380 - DNA, 17 bp, Homo sapiens
caaatggagaagctgca

SEQ ID NO: 776381 - DNA, 16 bp, Homo sapiens
caaatggccattttaa

SEQ ID NO: 776382 - DNA, 20 bp, Homo sapiens
caaatggccattttaaaatg

SEQ ID NO: 776383 - DNA, 19 bp, Homo sapiens
caaatggcgtctggaagtc

SEQ ID NO: 776384 - DNA, 12 bp, Homo sapiens
caaatggctgct

SEQ ID NO: 776385 - DNA, 16 bp, Homo sapiens
caaatgggaaaaaaac

SEQ ID NO: 776386 - DNA, 23 bp, Homo sapiens
caaatgggaaaaaaacaaacaaa

SEQ ID NO: 776387 - DNA, 23 bp, Homo sapiens
caaatgggagactctttgaaatg

SEQ ID NO: 776388 - DNA, 21 bp, Homo sapiens
caaatgggcgcccccccctcc

SEQ ID NO: 776389 - DNA, 15 bp, Homo sapiens
caaatggtaggcatt

SEQ ID NO: 776390 - DNA, 20 bp, Homo sapiens
caaatggtaggcatttccta

SEQ ID NO: 776391 - DNA, 14 bp, Homo sapiens
caaatggtgtcatg

SEQ ID NO: 776392 - DNA, 18 bp, Homo sapiens
caaatggtgtcatggctg

SEQ ID NO: 776393 - DNA, 16 bp, Homo sapiens
caaatgtaaaattatg

SEQ ID NO: 776394 - DNA, 21 bp, Homo sapiens
caaatgtatagaataaacctt

SEQ ID NO: 776395 - DNA, 17 bp, Homo sapiens
caaatgtattgattaca

SEQ ID NO: 776396 - DNA, 18 bp, Homo sapiens
caaatgtcattgtctact

SEQ ID NO: 776397 - DNA, 17 bp, Homo sapiens
caaatgtcggggttggg

SEQ ID NO: 776398 - DNA, 24 bp, Homo sapiens
caaatgtcttttagaagatagatg

SEQ ID NO: 776399 - DNA, 20 bp, Homo sapiens
caaatgtgatcaactgttca

SEQ ID NO: 776400 - DNA, 22 bp, Homo sapiens
caaatgtgtacgtgcatgctgt

SEQ ID NO: 776401 - DNA, 20 bp, Homo sapiens
caaatgtgtatcggatgctt

SEQ ID NO: 776402 - DNA, 12 bp, Homo sapiens
caaatgtgtttt

SEQ ID NO: 776403 - DNA, 20 bp, Homo sapiens
caaatgtgtttttctatata

SEQ ID NO: 776404 - DNA, 14 bp, Homo sapiens
caaatgttacagtt

SEQ ID NO: 776405 - DNA, 13 bp, Homo sapiens
caaatgttatgca

SEQ ID NO: 776406 - DNA, 21 bp, Homo sapiens
caaatgttatgcataaagtca

SEQ ID NO: 776407 - DNA, 17 bp, Homo sapiens
caaatgttgtcctgtta

SEQ ID NO: 776408 - DNA, 14 bp, Homo sapiens
caaatgtttataaa

SEQ ID NO: 776409 - DNA, 18 bp, Homo sapiens
caaatgtttataactcta

SEQ ID NO: 776410 - DNA, 21 bp, Homo sapiens
caaatgtttataactctaggg

SEQ ID NO: 776411 - DNA, 18 bp, Homo sapiens
caaatgtttatttaaaag

SEQ ID NO: 776412 - DNA, 14 bp, Homo sapiens
caaatgtttcctta

SEQ ID NO: 776413 - DNA, 14 bp, Homo sapiens
caaatgtttctgca

SEQ ID NO: 776414 - DNA, 17 bp, Homo sapiens
caaatgttttaaagttt

SEQ ID NO: 776415 - DNA, 21 bp, Homo sapiens
caaattaaaaaaaaattgtat

SEQ ID NO: 776416 - DNA, 12 bp, Homo sapiens
caaattaactgt

SEQ ID NO: 776417 - DNA, 22 bp, Homo sapiens
caaattaagggttaagaaaaga

SEQ ID NO: 776418 - DNA, 19 bp, Homo sapiens
caaattactctttctccat

SEQ ID NO: 776419 - DNA, 20 bp, Homo sapiens
caagagcagagtctgggcct

SEQ ID NO: 776420 - DNA, 14 bp, Homo sapiens
caagagcagatact

SEQ ID NO: 776421 - DNA, 21 bp, Homo sapiens
caagagcagcctgtggcatct

SEQ ID NO: 776422 - DNA, 17 bp, Homo sapiens
caagagccctgtggccg

SEQ ID NO: 776423 - DNA, 14 bp, Homo sapiens
caagagcctgatct

SEQ ID NO: 776424 - DNA, 20 bp, Homo sapiens
caagagcctgatctcttcct

SEQ ID NO: 776425 - DNA, 14 bp, Homo sapiens
caagagcttttaca

SEQ ID NO: 776426 - DNA, 19 bp, Homo sapiens
caagaggaaaggcgccccc

SEQ ID NO: 776427 - DNA, 15 bp, Homo sapiens
caagaggaagagaga

SEQ ID NO: 776428 - DNA, 20 bp, Homo sapiens
caagaggcaagctgaaattt

SEQ ID NO: 776429 - DNA, 22 bp, Homo sapiens
caagaggccacttagggaaaga

SEQ ID NO: 776430 - DNA, 17 bp, Homo sapiens
caagaggcgtgtgcagg

SEQ ID NO: 776431 - DNA, 21 bp, Homo sapiens
caagaggcgtgtgcaggccga

SEQ ID NO: 776432 - DNA, 11 bp, Homo sapiens
caagaggctgg

SEQ ID NO: 776433 - DNA, 13 bp, Homo sapiens
caagaggctggtt

SEQ ID NO: 776434 - DNA, 15 bp, Homo sapiens
caagagggaacaaaa

SEQ ID NO: 776435 - DNA, 20 bp, Homo sapiens
caagagggaacaaaactgtt

SEQ ID NO: 776436 - DNA, 17 bp, Homo sapiens
caagagggacgcctggg

SEQ ID NO: 776437 - DNA, 13 bp, Homo sapiens
caagagggagggg

SEQ ID NO: 776438 - DNA, 18 bp, Homo sapiens
caagagggaggggacaga

SEQ ID NO: 776439 - DNA, 21 bp, Homo sapiens
caagagggaggggacagaggc

SEQ ID NO: 776440 - DNA, 13 bp, Homo sapiens
caagaggggaaaa

SEQ ID NO: 776441 - DNA, 18 bp, Homo sapiens
caagaggggcgggctcag

SEQ ID NO: 776442 - DNA, 21 bp, Homo sapiens
caagaggggcgggctcagagc

SEQ ID NO: 776443 - DNA, 22 bp, Homo sapiens
caagaggggcgggctcagagct

SEQ ID NO: 776444 - DNA, 16 bp, Homo sapiens
caagagggggacctgc

SEQ ID NO: 776445 - DNA, 14 bp, Homo sapiens
caagagggtctctt

SEQ ID NO: 776446 - DNA, 21 bp, Homo sapiens
caagagggtgacagcttcctt

SEQ ID NO: 776447 - DNA, 14 bp, Homo sapiens
caagagggtggatc

SEQ ID NO: 776448 - DNA, 12 bp, Homo sapiens
caagaggtctga

SEQ ID NO: 776449 - DNA, 16 bp, Homo sapiens
caagagtaactttact

SEQ ID NO: 776450 - DNA, 19 bp, Homo sapiens
caagagtagttatataatt

SEQ ID NO: 776451 - DNA, 14 bp, Homo sapiens
caagagtccctttg

SEQ ID NO: 776452 - DNA, 22 bp, Homo sapiens
caagagtgagatgtagaaagtt

SEQ ID NO: 776453 - DNA, 23 bp, Homo sapiens
caagagtgatatactccaggact

SEQ ID NO: 776454 - DNA, 18 bp, Homo sapiens
caagagtgattgcagctt

SEQ ID NO: 776455 - DNA, 18 bp, Homo sapiens
caagataggaccttgggc

SEQ ID NO: 776456 - DNA, 15 bp, Homo sapiens
caagatatggacaca

SEQ ID NO: 776457 - DNA, 15 bp, Homo sapiens
caagatattgtacat

SEQ ID NO: 776458 - DNA, 17 bp, Homo sapiens
caagatcaacattccag

SEQ ID NO: 776459 - DNA, 19 bp, Homo sapiens
caagatcctgtctttaagg

SEQ ID NO: 776460 - DNA, 22 bp, Homo sapiens
caagatcctgtctttaaggaaa

SEQ ID NO: 776461 - DNA, 14 bp, Homo sapiens
caagatctttcagg

SEQ ID NO: 776462 - DNA, 15 bp, Homo sapiens
caagatctttcagga

SEQ ID NO: 776463 - DNA, 16 bp, Homo sapiens
caagatgactggggtg

SEQ ID NO: 776464 - DNA, 21 bp, Homo sapiens
caagatgagattggcatggct

SEQ ID NO: 776465 - DNA, 19 bp, Homo sapiens
caagatgagctgcagcccc

SEQ ID NO: 776466 - DNA, 15 bp, Homo sapiens
caagatgagctgtgc

SEQ ID NO: 776467 - DNA, 13 bp, Homo sapiens
caagatgcttggt

SEQ ID NO: 776468 - DNA, 22 bp, Homo sapiens
caagatggaagtcacctttctg

SEQ ID NO: 776469 - DNA, 17 bp, Homo sapiens
caagatggacttacctg

SEQ ID NO: 776470 - DNA, 18 bp, Homo sapiens
caagatgggcatcttttg

SEQ ID NO: 776471 - DNA, 21 bp, Homo sapiens
caagatgggcatcttttgtat

SEQ ID NO: 776472 - DNA, 18 bp, Homo sapiens
caagatgggggcagggct

SEQ ID NO: 776473 - DNA, 20 bp, Homo sapiens
caagatggtccatttgttcc

SEQ ID NO: 776474 - DNA, 21 bp, Homo sapiens
caagatggtgttatcttttga

SEQ ID NO: 776475 - DNA, 19 bp, Homo sapiens
caagatgtgaattattgac

SEQ ID NO: 776476 - DNA, 21 bp, Homo sapiens
caagatgtttcttatattatt

SEQ ID NO: 776477 - DNA, 12 bp, Homo sapiens
caagattagaag

SEQ ID NO: 776478 - DNA, 15 bp, Homo sapiens
caagattcccagaga

SEQ ID NO: 776479 - DNA, 16 bp, Homo sapiens
caagattcccagagac

SEQ ID NO: 776480 - DNA, 23 bp, Homo sapiens
caagattcccagagacaggaaaa

SEQ ID NO: 776481 - DNA, 16 bp, Homo sapiens
caagattgagctctct

SEQ ID NO: 776482 - DNA, 19 bp, Homo sapiens
caagattgagctctctgcc

SEQ ID NO: 776483 - DNA, 23 bp, Homo sapiens
caagattgagctctctgcccttg

SEQ ID NO: 776484 - DNA, 21 bp, Homo sapiens
caagattgcttaaaatagcaa

SEQ ID NO: 776485 - DNA, 14 bp, Homo sapiens
caagattggaaaga

SEQ ID NO: 776486 - DNA, 17 bp, Homo sapiens
caagattggaaagacag

SEQ ID NO: 776487 - DNA, 18 bp, Homo sapiens
caagattggaaagacagg

SEQ ID NO: 776488 - DNA, 16 bp, Homo sapiens
caagatttagaaaaaa

SEQ ID NO: 776489 - DNA, 21 bp, Homo sapiens
caagatttccacaattcttct

SEQ ID NO: 776490 - DNA, 18 bp, Homo sapiens
caagattttaaagacatg

SEQ ID NO: 776491 - DNA, 20 bp, Homo sapiens
caagattttagggcttttat

SEQ ID NO: 776492 - DNA, 18 bp, Homo sapiens
caagattttcctcttgtg

SEQ ID NO: 776493 - DNA, 19 bp, Homo sapiens
caagattttcctcttgtga

SEQ ID NO: 776494 - DNA, 16 bp, Homo sapiens
caagattttttaattg

SEQ ID NO: 776495 - DNA, 18 bp, Homo sapiens
caagattttttaattgtt

SEQ ID NO: 776496 - DNA, 11 bp, Homo sapiens
caagcaaacat

SEQ ID NO: 776497 - DNA, 19 bp, Homo sapiens
caagcaaaccaatggtgat

SEQ ID NO: 776498 - DNA, 15 bp, Homo sapiens
caagcaacatttgta

SEQ ID NO: 776499 - DNA, 19 bp, Homo sapiens
caagcaatccacctgcctt

SEQ ID NO: 776500 - DNA, 15 bp, Homo sapiens
caagcaatcctccta

SEQ ID NO: 776501 - DNA, 18 bp, Homo sapiens
caagcaatcctcctgcct

SEQ ID NO: 776502 - DNA, 21 bp, Homo sapiens
caagcaatcctcctgcctcag

SEQ ID NO: 776503 - DNA, 22 bp, Homo sapiens
caagcaatccttctgccttggc

SEQ ID NO: 776504 - DNA, 13 bp, Homo sapiens
caagcacactgta

SEQ ID NO: 776505 - DNA, 15 bp, Homo sapiens
caagcacagagcctg

SEQ ID NO: 776506 - DNA, 20 bp, Homo sapiens
caagcacatctgcattttca

SEQ ID NO: 776507 - DNA, 15 bp, Homo sapiens
caagcaccaggaagt

SEQ ID NO: 776508 - DNA, 18 bp, Homo sapiens
caagcacctagcctcgct

SEQ ID NO: 776509 - DNA, 19 bp, Homo sapiens
caagcacctccaaccaaat

SEQ ID NO: 776510 - DNA, 18 bp, Homo sapiens
caagcactattttatatt

SEQ ID NO: 776511 - DNA, 21 bp, Homo sapiens
caagcactcgagaccatcctg

SEQ ID NO: 776512 - DNA, 18 bp, Homo sapiens
caagcactgctaggcgag

SEQ ID NO: 776513 - DNA, 23 bp, Homo sapiens
caagcactgctaggcgagtgcca

SEQ ID NO: 776514 - DNA, 21 bp, Homo sapiens
caagcactttaatggcctgga

SEQ ID NO: 776515 - DNA, 19 bp, Homo sapiens
caagcagactccagcccct

SEQ ID NO: 776516 - DNA, 18 bp, Homo sapiens
caagcagatctcatctca

SEQ ID NO: 776517 - DNA, 12 bp, Homo sapiens
caagcagccagc

SEQ ID NO: 776518 - DNA, 13 bp, Homo sapiens
caagcagccagcc

SEQ ID NO: 776519 - DNA, 14 bp, Homo sapiens
caagcagccagcca

SEQ ID NO: 776520 - DNA, 15 bp, Homo sapiens
caagcagccagccag

SEQ ID NO: 776521 - DNA, 16 bp, Homo sapiens
caagcagccgcagcgc

SEQ ID NO: 776522 - DNA, 15 bp, Homo sapiens
caagcagctggtcag

SEQ ID NO: 776523 - DNA, 22 bp, Homo sapiens
caagcagctttttattccctgc

SEQ ID NO: 776524 - DNA, 23 bp, Homo sapiens
caagcaggaaatgaaaatgtctt

SEQ ID NO: 776525 - DNA, 16 bp, Homo sapiens
caagcaggaattatgt

SEQ ID NO: 776526 - DNA, 17 bp, Homo sapiens
caagcaggaattatgtc

SEQ ID NO: 776527 - DNA, 17 bp, Homo sapiens
caagcagggaaagctcc

SEQ ID NO: 776528 - DNA, 21 bp, Homo sapiens
caagcagggaaagctccacgg

SEQ ID NO: 776529 - DNA, 18 bp, Homo sapiens
caagcagtcgtgcctgtg

SEQ ID NO: 776530 - DNA, 21 bp, Homo sapiens
caagcagtcgtgcctgtgtcc

SEQ ID NO: 776531 - DNA, 18 bp, Homo sapiens
caagcagtctaccctgtc

SEQ ID NO: 776532 - DNA, 19 bp, Homo sapiens
caagcagtctaccctgtcc

SEQ ID NO: 776533 - DNA, 21 bp, Homo sapiens
caagcagtctaccctgtcctt

SEQ ID NO: 776534 - DNA, 22 bp, Homo sapiens
caagcagtctaccctgtccttt

SEQ ID NO: 776535 - DNA, 23 bp, Homo sapiens
caagcagtggatacgtgtcaatg

SEQ ID NO: 776536 - DNA, 22 bp, Homo sapiens
caagcagtgtctgtcagctgtg

SEQ ID NO: 776537 - DNA, 15 bp, Homo sapiens
caagcatcaggggga

SEQ ID NO: 776538 - DNA, 22 bp, Homo sapiens
caagcattcagaagaaaaagaa

SEQ ID NO: 776539 - DNA, 13 bp, Homo sapiens
caagcatttcaaa

SEQ ID NO: 776540 - DNA, 20 bp, Homo sapiens
caacctctacctcctgggtt

SEQ ID NO: 776541 - DNA, 13 bp, Homo sapiens
caacctctcactc

SEQ ID NO: 776542 - DNA, 14 bp, Homo sapiens
caacctctcactcc

SEQ ID NO: 776543 - DNA, 21 bp, Homo sapiens
caacctctctgatcttgtgct

SEQ ID NO: 776544 - DNA, 14 bp, Homo sapiens
caacctctgcctcc

SEQ ID NO: 776545 - DNA, 14 bp, Homo sapiens
caacctctgtatta

SEQ ID NO: 776546 - DNA, 16 bp, Homo sapiens
caacctcttctggctc

SEQ ID NO: 776547 - DNA, 23 bp, Homo sapiens
caacctctttttcctcctggaca

SEQ ID NO: 776548 - DNA, 14 bp, Homo sapiens
caacctgaatcttt

SEQ ID NO: 776549 - DNA, 15 bp, Homo sapiens
caacctgaccaacat

SEQ ID NO: 776550 - DNA, 23 bp, Homo sapiens
caacctgaccaacatggagaaac

SEQ ID NO: 776551 - DNA, 15 bp, Homo sapiens
caacctgatacattt

SEQ ID NO: 776552 - DNA, 19 bp, Homo sapiens
caacctgatgccccttccc

SEQ ID NO: 776553 - DNA, 23 bp, Homo sapiens
caacctgatgccccttccccaag

SEQ ID NO: 776554 - DNA, 16 bp, Homo sapiens
caacctgcctgtgcat

SEQ ID NO: 776555 - DNA, 16 bp, Homo sapiens
caacctgctctgtccc

SEQ ID NO: 776556 - DNA, 19 bp, Homo sapiens
caacctgctctgtccccaa

SEQ ID NO: 776557 - DNA, 16 bp, Homo sapiens
caacctggtcacagga

SEQ ID NO: 776558 - DNA, 15 bp, Homo sapiens
caacctggtggcacc

SEQ ID NO: 776559 - DNA, 18 bp, Homo sapiens
caacctggtggcaccaga

SEQ ID NO: 776560 - DNA, 14 bp, Homo sapiens
caaccttcacctcc

SEQ ID NO: 776561 - DNA, 16 bp, Homo sapiens
caaccttctgtggctc

SEQ ID NO: 776562 - DNA, 17 bp, Homo sapiens
caaccttctgtggctca

SEQ ID NO: 776563 - DNA, 19 bp, Homo sapiens
caaccttctgtggctcaca

SEQ ID NO: 776564 - DNA, 19 bp, Homo sapiens
caacctttccctcaccccc

SEQ ID NO: 776565 - DNA, 18 bp, Homo sapiens
caacctttgtgtggctcc

SEQ ID NO: 776566 - DNA, 14 bp, Homo sapiens
caacgagcctcctc

SEQ ID NO: 776567 - DNA, 16 bp, Homo sapiens
caacgagcctcctcag

SEQ ID NO: 776568 - DNA, 20 bp, Homo sapiens
caacgattgtatttgtgact

SEQ ID NO: 776569 - DNA, 12 bp, Homo sapiens
caacgcagccct

SEQ ID NO: 776570 - DNA, 22 bp, Homo sapiens
caacgcccctccaaacctccag

SEQ ID NO: 776571 - DNA, 14 bp, Homo sapiens
caacgcccctgtgg

SEQ ID NO: 776572 - DNA, 15 bp, Homo sapiens
caacgcccctgtggc

SEQ ID NO: 776573 - DNA, 16 bp, Homo sapiens
caacgcccctgtggcc

SEQ ID NO: 776574 - DNA, 12 bp, Homo sapiens
caacgcctcctg

SEQ ID NO: 776575 - DNA, 23 bp, Homo sapiens
caacgcttgtagaactcactctg

SEQ ID NO: 776576 - DNA, 14 bp, Homo sapiens
caacggcaagacag

SEQ ID NO: 776577 - DNA, 21 bp, Homo sapiens
caacgggattgaagggtcctg

SEQ ID NO: 776578 - DNA, 14 bp, Homo sapiens
caacggggtgggga

SEQ ID NO: 776579 - DNA, 16 bp, Homo sapiens
caacggggtggggagg

SEQ ID NO: 776580 - DNA, 18 bp, Homo sapiens
caacggggtggggagggt

SEQ ID NO: 776581 - DNA, 19 bp, Homo sapiens
caacggggtggggagggtg

SEQ ID NO: 776582 - DNA, 14 bp, Homo sapiens
caacgtagcctggg

SEQ ID NO: 776583 - DNA, 13 bp, Homo sapiens
caacgtcccctcc

SEQ ID NO: 776584 - DNA, 18 bp, Homo sapiens
caacgttactcagggctc

SEQ ID NO: 776585 - DNA, 15 bp, Homo sapiens
caactaaaattagga

SEQ ID NO: 776586 - DNA, 23 bp, Homo sapiens
caaccagaaacacccctctgtct

SEQ ID NO: 776587 - DNA, 14 bp, Homo sapiens
caaccagaaaggga

SEQ ID NO: 776588 - DNA, 16 bp, Homo sapiens
caaccagaattgtcct

SEQ ID NO: 776589 - DNA, 22 bp, Homo sapiens
caaccagctaagaaaagatttt

SEQ ID NO: 776590 - DNA, 18 bp, Homo sapiens
caaccaggacccagggtc

SEQ ID NO: 776591 - DNA, 22 bp, Homo sapiens
caaccaggagctgatggcagct

SEQ ID NO: 776592 - DNA, 14 bp, Homo sapiens
caaccataaaagaa

SEQ ID NO: 776593 - DNA, 22 bp, Homo sapiens
caaccattccagactgcttcca

SEQ ID NO: 776594 - DNA, 16 bp, Homo sapiens
caaccattgtattttg

SEQ ID NO: 776595 - DNA, 20 bp, Homo sapiens
caaccattttttgttctgtg

SEQ ID NO: 776596 - DNA, 16 bp, Homo sapiens
caacccaagctctggg

SEQ ID NO: 776597 - DNA, 17 bp, Homo sapiens
caacccaataaaactga

SEQ ID NO: 776598 - DNA, 21 bp, Homo sapiens
caacccaatccctctccactc

SEQ ID NO: 776599 - DNA, 12 bp, Homo sapiens
caacccaggaat

SEQ ID NO: 776600 - DNA, 22 bp, Homo sapiens
caacccattgttgtcaaggaag

SEQ ID NO: 776601 - DNA, 16 bp, Homo sapiens
caaccccacccagctc

SEQ ID NO: 776602 - DNA, 12 bp, Homo sapiens
caaccccagcct

SEQ ID NO: 776603 - DNA, 15 bp, Homo sapiens
caaccccagcctcct

SEQ ID NO: 776604 - DNA, 13 bp, Homo sapiens
caaccccaggctg

SEQ ID NO: 776605 - DNA, 19 bp, Homo sapiens
caaccccagttctgctcct

SEQ ID NO: 776606 - DNA, 17 bp, Homo sapiens
caacccccaccccacac

SEQ ID NO: 776607 - DNA, 23 bp, Homo sapiens
caacccccaccccacacttgttc

SEQ ID NO: 776608 - DNA, 15 bp, Homo sapiens
caacccccagaggtg

SEQ ID NO: 776609 - DNA, 17 bp, Homo sapiens
caaccccccacctgcca

SEQ ID NO: 776610 - DNA, 18 bp, Homo sapiens
caacccccctcccagaca

SEQ ID NO: 776611 - DNA, 13 bp, Homo sapiens
caacccccctcct

SEQ ID NO: 776612 - DNA, 14 bp, Homo sapiens
caacccccctcctg

SEQ ID NO: 776613 - DNA, 19 bp, Homo sapiens
caacccccctcctgctcct

SEQ ID NO: 776614 - DNA, 23 bp, Homo sapiens
caacccccgccacctcagggcac

SEQ ID NO: 776615 - DNA, 13 bp, Homo sapiens
caaccccctcgga

SEQ ID NO: 776616 - DNA, 16 bp, Homo sapiens
caaccccgcggcccag

SEQ ID NO: 776617 - DNA, 12 bp, Homo sapiens
caacccctgtac

SEQ ID NO: 776618 - DNA, 16 bp, Homo sapiens
caaccctatctcctga

SEQ ID NO: 776619 - DNA, 13 bp, Homo sapiens
caaccctcagagc

SEQ ID NO: 776620 - DNA, 18 bp, Homo sapiens
caaccctcagagccaccc

SEQ ID NO: 776621 - DNA, 21 bp, Homo sapiens
caaccctcagagccaccccta

SEQ ID NO: 776622 - DNA, 20 bp, Homo sapiens
caaccctccctcagcccctc

SEQ ID NO: 776623 - DNA, 15 bp, Homo sapiens
caaccctcctatcac

SEQ ID NO: 776624 - DNA, 15 bp, Homo sapiens
caaccctctcctgtc

SEQ ID NO: 776625 - DNA, 13 bp, Homo sapiens
caaccctgcccct

SEQ ID NO: 776626 - DNA, 16 bp, Homo sapiens
caaccctgcccctgcc

SEQ ID NO: 776627 - DNA, 19 bp, Homo sapiens
caaccctgcctgccgctgc

SEQ ID NO: 776628 - DNA, 23 bp, Homo sapiens
caaccctgcctgccgctgcacct

SEQ ID NO: 776629 - DNA, 17 bp, Homo sapiens
caaccctgggctgggga

SEQ ID NO: 776630 - DNA, 22 bp, Homo sapiens
caacccttaccccttagcctcc

SEQ ID NO: 776631 - DNA, 11 bp, Homo sapiens
caacccttccc

SEQ ID NO: 776632 - DNA, 12 bp, Homo sapiens
caacccttcccc

SEQ ID NO: 776633 - DNA, 21 bp, Homo sapiens
caacccttctcctcttgtaaa

SEQ ID NO: 776634 - DNA, 23 bp, Homo sapiens
caacccttctcctcttgtaaata

SEQ ID NO: 776635 - DNA, 14 bp, Homo sapiens
caaccgatgctcca

SEQ ID NO: 776636 - DNA, 22 bp, Homo sapiens
caaccggtcccttccatgccct

SEQ ID NO: 776637 - DNA, 20 bp, Homo sapiens
caaccgtcctgctgtccctg

SEQ ID NO: 776638 - DNA, 15 bp, Homo sapiens
caacctaaaactctt

SEQ ID NO: 776639 - DNA, 18 bp, Homo sapiens
caacctaacccctttcct

SEQ ID NO: 776640 - DNA, 18 bp, Homo sapiens
caacctaccaccccttcc

SEQ ID NO: 776641 - DNA, 12 bp, Homo sapiens
caacctagaatg

SEQ ID NO: 776642 - DNA, 13 bp, Homo sapiens
caacctagaatgt

SEQ ID NO: 776643 - DNA, 14 bp, Homo sapiens
caacctagaatgtc

SEQ ID NO: 776644 - DNA, 19 bp, Homo sapiens
caacctagaatgtcagatt

SEQ ID NO: 776645 - DNA, 19 bp, Homo sapiens
caacctagccaacatggtg

SEQ ID NO: 776646 - DNA, 14 bp, Homo sapiens
caacctcaatgccc

SEQ ID NO: 776647 - DNA, 17 bp, Homo sapiens
caacctcaatgccctgc

SEQ ID NO: 776648 - DNA, 18 bp, Homo sapiens
caacctcaatgccctgcc

SEQ ID NO: 776649 - DNA, 20 bp, Homo sapiens
caacctcaatgccctgccat

SEQ ID NO: 776650 - DNA, 15 bp, Homo sapiens
caacctcaccaaact

SEQ ID NO: 776651 - DNA, 17 bp, Homo sapiens
caacctcaccttcctgt

SEQ ID NO: 776652 - DNA, 14 bp, Homo sapiens
caacctcactgccc

SEQ ID NO: 776653 - DNA, 15 bp, Homo sapiens
caacctcactgccct

SEQ ID NO: 776654 - DNA, 17 bp, Homo sapiens
caacctcagggctccca

SEQ ID NO: 776655 - DNA, 18 bp, Homo sapiens
caacctcagtaatttaga

SEQ ID NO: 776656 - DNA, 20 bp, Homo sapiens
caacctccagtgtcagggtc

SEQ ID NO: 776657 - DNA, 19 bp, Homo sapiens
caacctccgcctcccgggt

SEQ ID NO: 776658 - DNA, 20 bp, Homo sapiens
caacctccgccttccgggtt

SEQ ID NO: 776659 - DNA, 21 bp, Homo sapiens
caagcttttgcttgatccaga

SEQ ID NO: 776660 - DNA, 14 bp, Homo sapiens
caaggaaaattgaa

SEQ ID NO: 776661 - DNA, 15 bp, Homo sapiens
caaggaaatgtcctg

SEQ ID NO: 776662 - DNA, 16 bp, Homo sapiens
caaggaaatgtcctgc

SEQ ID NO: 776663 - DNA, 17 bp, Homo sapiens
caaggaaatgtcctgca

SEQ ID NO: 776664 - DNA, 19 bp, Homo sapiens
caaggaaatgtcctgcatg

SEQ ID NO: 776665 - DNA, 21 bp, Homo sapiens
caaggaaatgtcctgcatggg

SEQ ID NO: 776666 - DNA, 21 bp, Homo sapiens
caaggaactttccccagatca

SEQ ID NO: 776667 - DNA, 14 bp, Homo sapiens
caaggaagaaaacg

SEQ ID NO: 776668 - DNA, 19 bp, Homo sapiens
caaggaagaagaaatcttt

SEQ ID NO: 776669 - DNA, 17 bp, Homo sapiens
caaggaaggaaagaaag

SEQ ID NO: 776670 - DNA, 12 bp, Homo sapiens
caaggaaggagc

SEQ ID NO: 776671 - DNA, 17 bp, Homo sapiens
caaggaagggacaagac

SEQ ID NO: 776672 - DNA, 18 bp, Homo sapiens
caaggaagggatgtattt

SEQ ID NO: 776673 - DNA, 14 bp, Homo sapiens
caaggaataaatga

SEQ ID NO: 776674 - DNA, 16 bp, Homo sapiens
caaggaataaatgaga

SEQ ID NO: 776675 - DNA, 17 bp, Homo sapiens
caaggaatgcctgtgcc

SEQ ID NO: 776676 - DNA, 14 bp, Homo sapiens
caaggaatgtgtcc

SEQ ID NO: 776677 - DNA, 12 bp, Homo sapiens
caaggaatttct

SEQ ID NO: 776678 - DNA, 21 bp, Homo sapiens
caaggaatttcttaacttctt

SEQ ID NO: 776679 - DNA, 18 bp, Homo sapiens
caaggacaggagcctggt

SEQ ID NO: 776680 - DNA, 15 bp, Homo sapiens
caaggacagggctga

SEQ ID NO: 776681 - DNA, 23 bp, Homo sapiens
caaggacattgtatgcagggagc

SEQ ID NO: 776682 - DNA, 16 bp, Homo sapiens
caatagaaagaaacta

SEQ ID NO: 776683 - DNA, 13 bp, Homo sapiens
caatagaatttat

SEQ ID NO: 776684 - DNA, 12 bp, Homo sapiens
caatagagactg

SEQ ID NO: 776685 - DNA, 14 bp, Homo sapiens
caatagagactgta

SEQ ID NO: 776686 - DNA, 15 bp, Homo sapiens
caatagataaggttt

SEQ ID NO: 776687 - DNA, 19 bp, Homo sapiens
caatagatatttacctttt

SEQ ID NO: 776688 - DNA, 15 bp, Homo sapiens
caatagatctccagc

SEQ ID NO: 776689 - DNA, 19 bp, Homo sapiens
caatagattgctcaaatca

SEQ ID NO: 776690 - DNA, 23 bp, Homo sapiens
caatagatttaggagcagaaatg

SEQ ID NO: 776691 - DNA, 14 bp, Homo sapiens
caatagcaccccta

SEQ ID NO: 776692 - DNA, 18 bp, Homo sapiens
caatagcgtgtgtagata

SEQ ID NO: 776693 - DNA, 21 bp, Homo sapiens
caatagctttaccctcaggca

SEQ ID NO: 776694 - DNA, 13 bp, Homo sapiens
caataggaaagca

SEQ ID NO: 776695 - DNA, 16 bp, Homo sapiens
caatagggctaaatgt

SEQ ID NO: 776696 - DNA, 21 bp, Homo sapiens
caatagggtagaatgattaat

SEQ ID NO: 776697 - DNA, 18 bp, Homo sapiens
caatagtatagaagtctg

SEQ ID NO: 776698 - DNA, 14 bp, Homo sapiens
caatagtgtcatcc

SEQ ID NO: 776699 - DNA, 15 bp, Homo sapiens
caatagtgtgttctg

SEQ ID NO: 776700 - DNA, 16 bp, Homo sapiens
caatagtgtgttctga

SEQ ID NO: 776701 - DNA, 17 bp, Homo sapiens
caatagtgtgttctgat

SEQ ID NO: 776702 - DNA, 22 bp, Homo sapiens
caatataaaactgtacttcact

SEQ ID NO: 776703 - DNA, 22 bp, Homo sapiens
caatataaaaggcaaatgtgta

SEQ ID NO: 776704 - DNA, 13 bp, Homo sapiens
caatataagaagc

SEQ ID NO: 776705 - DNA, 15 bp, Homo sapiens
caatataatgttttt

SEQ ID NO: 776706 - DNA, 21 bp, Homo sapiens
caatataatgtttttaatatt

SEQ ID NO: 776707 - DNA, 23 bp, Homo sapiens
caatatacaactgtaaagcaaat

SEQ ID NO: 776708 - DNA, 17 bp, Homo sapiens
caatatacgaaaagcca

SEQ ID NO: 776709 - DNA, 18 bp, Homo sapiens
caatatattaccagcaag

SEQ ID NO: 776710 - DNA, 14 bp, Homo sapiens
caatatattgaact

SEQ ID NO: 776711 - DNA, 20 bp, Homo sapiens
caatatattgaacttttgta

SEQ ID NO: 776712 - DNA, 15 bp, Homo sapiens
caatatcactcttga

SEQ ID NO: 776713 - DNA, 13 bp, Homo sapiens
caatatcagtgct

SEQ ID NO: 776714 - DNA, 14 bp, Homo sapiens
caatatcccaacat

SEQ ID NO: 776715 - DNA, 18 bp, Homo sapiens
caatatccctcttgtaag

SEQ ID NO: 776716 - DNA, 15 bp, Homo sapiens
caatatctaatatat

SEQ ID NO: 776717 - DNA, 17 bp, Homo sapiens
caatatctaatatatat

SEQ ID NO: 776718 - DNA, 14 bp, Homo sapiens
caatatctgcagcg

SEQ ID NO: 776719 - DNA, 16 bp, Homo sapiens
caatatgaatctataa

SEQ ID NO: 776720 - DNA, 14 bp, Homo sapiens
caatatgcaagcag

SEQ ID NO: 776721 - DNA, 15 bp, Homo sapiens
caatatgcaagcagc

SEQ ID NO: 776722 - DNA, 18 bp, Homo sapiens
caatatgcaagcagcttt

SEQ ID NO: 776723 - DNA, 19 bp, Homo sapiens
caatatgcaagcagctttt

SEQ ID NO: 776724 - DNA, 15 bp, Homo sapiens
caatatgtaaatagt

SEQ ID NO: 776725 - DNA, 14 bp, Homo sapiens
caatatgtatgctt

SEQ ID NO: 776726 - DNA, 15 bp, Homo sapiens
caatatgtatgcttt

SEQ ID NO: 776727 - DNA, 14 bp, Homo sapiens
caatatgtattgta

SEQ ID NO: 776728 - DNA, 16 bp, Homo sapiens
caatatgtattgtaaa

SEQ ID NO: 776729 - DNA, 22 bp, Homo sapiens
caatatgtattgtaaacatgtg

SEQ ID NO: 776730 - DNA, 23 bp, Homo sapiens
caatatgtattgtaaacatgtgt

SEQ ID NO: 776731 - DNA, 20 bp, Homo sapiens
caatatgtgagtgccttttg

SEQ ID NO: 776732 - DNA, 23 bp, Homo sapiens
caatattaaatacagacactaag

SEQ ID NO: 776733 - DNA, 22 bp, Homo sapiens
caatattaacacgctgcctggt

SEQ ID NO: 776734 - DNA, 24 bp, Homo sapiens
caatattaacctaatcaccatgta

SEQ ID NO: 776735 - DNA, 14 bp, Homo sapiens
caatattataattt

SEQ ID NO: 776736 - DNA, 19 bp, Homo sapiens
caatattatactaagaaaa

SEQ ID NO: 776737 - DNA, 21 bp, Homo sapiens
caatattatactaagaaaaga

SEQ ID NO: 776738 - DNA, 23 bp, Homo sapiens
caatattatactaagaaaagata

SEQ ID NO: 776739 - DNA, 18 bp, Homo sapiens
caatattgaatttttcct

SEQ ID NO: 776740 - DNA, 16 bp, Homo sapiens
caatattgacatttgt

SEQ ID NO: 776741 - DNA, 23 bp, Homo sapiens
caatattgtaatcctagcacttt

SEQ ID NO: 776742 - DNA, 16 bp, Homo sapiens
caatattgtacagttt

SEQ ID NO: 776743 - DNA, 18 bp, Homo sapiens
caatattgtacagttttt

SEQ ID NO: 776744 - DNA, 12 bp, Homo sapiens
caatattgtata

SEQ ID NO: 776745 - DNA, 14 bp, Homo sapiens
caatattgtatatt

SEQ ID NO: 776746 - DNA, 13 bp, Homo sapiens
caatatttaaaca

SEQ ID NO: 776747 - DNA, 16 bp, Homo sapiens
caatatttactcatca

SEQ ID NO: 776748 - DNA, 12 bp, Homo sapiens
caatatttatta

SEQ ID NO: 776749 - DNA, 17 bp, Homo sapiens
caatatttatttccaga

SEQ ID NO: 776750 - DNA, 14 bp, Homo sapiens
caatatttcttttg

SEQ ID NO: 776751 - DNA, 15 bp, Homo sapiens
caatatttgaatttt

SEQ ID NO: 776752 - DNA, 21 bp, Homo sapiens
caatattttatggttatgttt

SEQ ID NO: 776753 - DNA, 22 bp, Homo sapiens
caatattttatggttatgtttt

SEQ ID NO: 776754 - DNA, 17 bp, Homo sapiens
caatattttcttttccc

SEQ ID NO: 776755 - DNA, 15 bp, Homo sapiens
caatattttgccttt

SEQ ID NO: 776756 - DNA, 14 bp, Homo sapiens
caatatttttagat

SEQ ID NO: 776757 - DNA, 20 bp, Homo sapiens
caatatttttatatcatgca

SEQ ID NO: 776758 - DNA, 15 bp, Homo sapiens
caatcaaagaattac

SEQ ID NO: 776759 - DNA, 16 bp, Homo sapiens
caatcaaagaattaca

SEQ ID NO: 776760 - DNA, 14 bp, Homo sapiens
caatcaaatctgct

SEQ ID NO: 776761 - DNA, 15 bp, Homo sapiens
caatcaactctaata

SEQ ID NO: 776762 - DNA, 16 bp, Homo sapiens
caatcaactttactgt

SEQ ID NO: 776763 - DNA, 11 bp, Homo sapiens
caatcaagttt

SEQ ID NO: 776764 - DNA, 18 bp, Homo sapiens
caatcaatggtgcaaaaa

SEQ ID NO: 776765 - DNA, 19 bp, Homo sapiens
caatcaatggtgcaaaaaa

SEQ ID NO: 776766 - DNA, 23 bp, Homo sapiens
caatcacgagatcttccttccgc

SEQ ID NO: 776767 - DNA, 15 bp, Homo sapiens
caatcactaaacttt

SEQ ID NO: 776768 - DNA, 17 bp, Homo sapiens
caatcactaaactttat

SEQ ID NO: 776769 - DNA, 19 bp, Homo sapiens
caatcactaaactttattt

SEQ ID NO: 776770 - DNA, 20 bp, Homo sapiens
caatcactaaactttatttg

SEQ ID NO: 776771 - DNA, 15 bp, Homo sapiens
caatcactattctta

SEQ ID NO: 776772 - DNA, 18 bp, Homo sapiens
caatcactattcttaagc

SEQ ID NO: 776773 - DNA, 13 bp, Homo sapiens
caatcagagagcc

SEQ ID NO: 776774 - DNA, 23 bp, Homo sapiens
caatcagcctttaggtctttagt

SEQ ID NO: 776775 - DNA, 20 bp, Homo sapiens
caatcagcttttgttctaga

SEQ ID NO: 776776 - DNA, 22 bp, Homo sapiens
caatcagttgactttaagtgaa

SEQ ID NO: 776777 - DNA, 19 bp, Homo sapiens
caatcatgaacagctctga

SEQ ID NO: 776778 - DNA, 13 bp, Homo sapiens
caatcatgtcagt

SEQ ID NO: 776779 - DNA, 17 bp, Homo sapiens
caatcattgaagtatat

SEQ ID NO: 776780 - DNA, 15 bp, Homo sapiens
caatcattgctgaaa

SEQ ID NO: 776781 - DNA, 18 bp, Homo sapiens
caatcattgctgaaaatg

SEQ ID NO: 776782 - DNA, 21 bp, Homo sapiens
caatcattgctgaaaatggta

SEQ ID NO: 776783 - DNA, 17 bp, Homo sapiens
caatccataactttagt

SEQ ID NO: 776784 - DNA, 15 bp, Homo sapiens
caatccatgcttcac

SEQ ID NO: 776785 - DNA, 16 bp, Homo sapiens
caatccatgcttcact

SEQ ID NO: 776786 - DNA, 21 bp, Homo sapiens
caatccatgttagtttttact

SEQ ID NO: 776787 - DNA, 23 bp, Homo sapiens
caatccatgttagtttttacttt

SEQ ID NO: 776788 - DNA, 15 bp, Homo sapiens
caatcccaattctgt

SEQ ID NO: 776789 - DNA, 17 bp, Homo sapiens
caatcccaattctgtcc

SEQ ID NO: 776790 - DNA, 12 bp, Homo sapiens
caatccccagcc

SEQ ID NO: 776791 - DNA, 13 bp, Homo sapiens
caatccccagcct

SEQ ID NO: 776792 - DNA, 21 bp, Homo sapiens
caatcccctcattcaggaaaa

SEQ ID NO: 776793 - DNA, 16 bp, Homo sapiens
caatcccctccttggg

SEQ ID NO: 776794 - DNA, 20 bp, Homo sapiens
caatcccctccttgggcact

SEQ ID NO: 776795 - DNA, 14 bp, Homo sapiens
caatccctgccact

SEQ ID NO: 776796 - DNA, 15 bp, Homo sapiens
caatccctgccactg

SEQ ID NO: 776797 - DNA, 20 bp, Homo sapiens
caatccctgccactgggctc

SEQ ID NO: 776798 - DNA, 21 bp, Homo sapiens
caatccctgccactgggctct

SEQ ID NO: 776799 - DNA, 20 bp, Homo sapiens
caatcctatgtttttgttca

SEQ ID NO: 776800 - DNA, 15 bp, Homo sapiens
caatcctattactct

SEQ ID NO: 776801 - DNA, 23 bp, Homo sapiens
caatcctcaaatcagtcttcctt

SEQ ID NO: 776802 - DNA, 18 bp, Homo sapiens
caatcctcactgggtggg

SEQ ID NO: 776803 - DNA, 15 bp, Homo sapiens
caatcctcctgcctc

SEQ ID NO: 776804 - DNA, 11 bp, Homo sapiens
caatcctggac

SEQ ID NO: 776805 - DNA, 15 bp, Homo sapiens
caatcctgtttataa

SEQ ID NO: 776806 - DNA, 22 bp, Homo sapiens
caatcctgtttataatctgaag

SEQ ID NO: 776807 - DNA, 20 bp, Homo sapiens
caagtttaaaagccatgtat

SEQ ID NO: 776808 - DNA, 16 bp, Homo sapiens
caagtttacacttcat

SEQ ID NO: 776809 - DNA, 19 bp, Homo sapiens
caagtttacacttcatata

SEQ ID NO: 776810 - DNA, 16 bp, Homo sapiens
caagtttatttctctc

SEQ ID NO: 776811 - DNA, 17 bp, Homo sapiens
caagtttatttctctct

SEQ ID NO: 776812 - DNA, 15 bp, Homo sapiens
caagtttcagacagg

SEQ ID NO: 776813 - DNA, 12 bp, Homo sapiens
caagtttgaatt

SEQ ID NO: 776814 - DNA, 18 bp, Homo sapiens
caagtttgctaaaagaag

SEQ ID NO: 776815 - DNA, 13 bp, Homo sapiens
caagttttaaagt

SEQ ID NO: 776816 - DNA, 15 bp, Homo sapiens
caagttttaaagttc

SEQ ID NO: 776817 - DNA, 13 bp, Homo sapiens
caagttttgtata

SEQ ID NO: 776818 - DNA, 13 bp, Homo sapiens
caataaaaaaaag

SEQ ID NO: 776819 - DNA, 20 bp, Homo sapiens
caataaaaaaaagaaatgaa

SEQ ID NO: 776820 - DNA, 20 bp, Homo sapiens
caataaaaacattgcctttg

SEQ ID NO: 776821 - DNA, 22 bp, Homo sapiens
caataaaaacattttgaagtgt

SEQ ID NO: 776822 - DNA, 13 bp, Homo sapiens
caataaaaagaaa

SEQ ID NO: 776823 - DNA, 13 bp, Homo sapiens
caataaaaagttc

SEQ ID NO: 776824 - DNA, 15 bp, Homo sapiens
caataaaaagttcag

SEQ ID NO: 776825 - DNA, 17 bp, Homo sapiens
caataaaaatgtttaac

SEQ ID NO: 776826 - DNA, 20 bp, Homo sapiens
caataaaaatgtttaacggt

SEQ ID NO: 776827 - DNA, 14 bp, Homo sapiens
caataaaacattaa

SEQ ID NO: 776828 - DNA, 17 bp, Homo sapiens
caataaaagagctgtct

SEQ ID NO: 776829 - DNA, 18 bp, Homo sapiens
caataaaagagctgtctg

SEQ ID NO: 776830 - DNA, 18 bp, Homo sapiens
caataaaagagctttatc

SEQ ID NO: 776831 - DNA, 19 bp, Homo sapiens
caataaaagtgactctcag

SEQ ID NO: 776832 - DNA, 15 bp, Homo sapiens
caataaaatgtgatt

SEQ ID NO: 776833 - DNA, 16 bp, Homo sapiens
caataaaatgtgattt

SEQ ID NO: 776834 - DNA, 20 bp, Homo sapiens
caataaaatgtgatttttct

SEQ ID NO: 776835 - DNA, 17 bp, Homo sapiens
caataaaatttctaaga

SEQ ID NO: 776836 - DNA, 16 bp, Homo sapiens
caataaacaacagctg

SEQ ID NO: 776837 - DNA, 14 bp, Homo sapiens
caataaacagctcc

SEQ ID NO: 776838 - DNA, 21 bp, Homo sapiens
caataaaccaaacccagccac

SEQ ID NO: 776839 - DNA, 22 bp, Homo sapiens
caataaaccaaacccagccact

SEQ ID NO: 776840 - DNA, 11 bp, Homo sapiens
caataaactat

SEQ ID NO: 776841 - DNA, 14 bp, Homo sapiens
caataaacttagag

SEQ ID NO: 776842 - DNA, 20 bp, Homo sapiens
caataaacttagaggaaaat

SEQ ID NO: 776843 - DNA, 22 bp, Homo sapiens
caataaacttagaggaaaatga

SEQ ID NO: 776844 - DNA, 12 bp, Homo sapiens
caataaagaaaa

SEQ ID NO: 776845 - DNA, 19 bp, Homo sapiens
caataaagaaaacttccat

SEQ ID NO: 776846 - DNA, 11 bp, Homo sapiens
caataaagaat

SEQ ID NO: 776847 - DNA, 22 bp, Homo sapiens
caataaagagttagaatgaaaa

SEQ ID NO: 776848 - DNA, 14 bp, Homo sapiens
caataaagattttt

SEQ ID NO: 776849 - DNA, 13 bp, Homo sapiens
caataaagcaatg

SEQ ID NO: 776850 - DNA, 16 bp, Homo sapiens
caataaagcactgagc

SEQ ID NO: 776851 - DNA, 11 bp, Homo sapiens
caataaagcag

SEQ ID NO: 776852 - DNA, 13 bp, Homo sapiens
caataaagcagag

SEQ ID NO: 776853 - DNA, 14 bp, Homo sapiens
caataaagcagagc

SEQ ID NO: 776854 - DNA, 15 bp, Homo sapiens
caataaagcagagcc

SEQ ID NO: 776855 - DNA, 22 bp, Homo sapiens
caataaagcagttaatttatat

SEQ ID NO: 776856 - DNA, 14 bp, Homo sapiens
caataaagcattta

SEQ ID NO: 776857 - DNA, 11 bp, Homo sapiens
caataaaggca

SEQ ID NO: 776858 - DNA, 14 bp, Homo sapiens
caataaaggcagct

SEQ ID NO: 776859 - DNA, 20 bp, Homo sapiens
caataaaggcagctgcctct

SEQ ID NO: 776860 - DNA, 19 bp, Homo sapiens
caataaagggagaatggtg

SEQ ID NO: 776861 - DNA, 20 bp, Homo sapiens
caataaagtataatgtttat

SEQ ID NO: 776862 - DNA, 22 bp, Homo sapiens
caataaagtgccttctgggctt

SEQ ID NO: 776863 - DNA, 17 bp, Homo sapiens
caataaagttattcaga

SEQ ID NO: 776864 - DNA, 18 bp, Homo sapiens
caataaagtttgtacact

SEQ ID NO: 776865 - DNA, 17 bp, Homo sapiens
caataaatagacacgca

SEQ ID NO: 776866 - DNA, 13 bp, Homo sapiens
caataaatgacac

SEQ ID NO: 776867 - DNA, 17 bp, Homo sapiens
caataaatggccagtgc

SEQ ID NO: 776868 - DNA, 18 bp, Homo sapiens
caataaatgtattcaaat

SEQ ID NO: 776869 - DNA, 12 bp, Homo sapiens
caataaatgtca

SEQ ID NO: 776870 - DNA, 17 bp, Homo sapiens
caataaatgtgcttatg

SEQ ID NO: 776871 - DNA, 16 bp, Homo sapiens
caataaatgtttgtta

SEQ ID NO: 776872 - DNA, 20 bp, Homo sapiens
caataaattgctaatgttgc

SEQ ID NO: 776873 - DNA, 17 bp, Homo sapiens
caataaatttatatact

SEQ ID NO: 776874 - DNA, 18 bp, Homo sapiens
caataacaaaacgaaact

SEQ ID NO: 776875 - DNA, 15 bp, Homo sapiens
caataacactatatt

SEQ ID NO: 776876 - DNA, 16 bp, Homo sapiens
caataacactatattt

SEQ ID NO: 776877 - DNA, 17 bp, Homo sapiens
caataacactatattta

SEQ ID NO: 776878 - DNA, 20 bp, Homo sapiens
caataacactatatttattt

SEQ ID NO: 776879 - DNA, 21 bp, Homo sapiens
caataacagatggtgctgcta

SEQ ID NO: 776880 - DNA, 12 bp, Homo sapiens
caataacagctg

SEQ ID NO: 776881 - DNA, 15 bp, Homo sapiens
caataacagctgcaa

SEQ ID NO: 776882 - DNA, 13 bp, Homo sapiens
caataacccagtt

SEQ ID NO: 776883 - DNA, 18 bp, Homo sapiens
caataacccagttacttt

SEQ ID NO: 776884 - DNA, 23 bp, Homo sapiens
caataacgtttaagccaaaacaa

SEQ ID NO: 776885 - DNA, 14 bp, Homo sapiens
caataactactgtg

SEQ ID NO: 776886 - DNA, 17 bp, Homo sapiens
caataactactgtgttc

SEQ ID NO: 776887 - DNA, 18 bp, Homo sapiens
caataactactgtgttcc

SEQ ID NO: 776888 - DNA, 19 bp, Homo sapiens
caataactactgtgttcct

SEQ ID NO: 776889 - DNA, 21 bp, Homo sapiens
caataactactgtgttcctgg

SEQ ID NO: 776890 - DNA, 21 bp, Homo sapiens
caataactagtaataccaaag

SEQ ID NO: 776891 - DNA, 17 bp, Homo sapiens
caataactccaagcaga

SEQ ID NO: 776892 - DNA, 18 bp, Homo sapiens
caataactccaagcagac

SEQ ID NO: 776893 - DNA, 20 bp, Homo sapiens
caataactccaagcagactc

SEQ ID NO: 776894 - DNA, 12 bp, Homo sapiens
caataactctgg

SEQ ID NO: 776895 - DNA, 14 bp, Homo sapiens
caataactctggga

SEQ ID NO: 776896 - DNA, 22 bp, Homo sapiens
caataacttctatattttaata

SEQ ID NO: 776897 - DNA, 23 bp, Homo sapiens
caataacttctatattttaatag

SEQ ID NO: 776898 - DNA, 15 bp, Homo sapiens
caataacttctatgt

SEQ ID NO: 776899 - DNA, 18 bp, Homo sapiens
caataacttctatgttgg

SEQ ID NO: 776900 - DNA, 13 bp, Homo sapiens
caataacttttat

SEQ ID NO: 776901 - DNA, 14 bp, Homo sapiens
caataacttttcac

SEQ ID NO: 776902 - DNA, 18 bp, Homo sapiens
caataagaaatgaacaaa

SEQ ID NO: 776903 - DNA, 12 bp, Homo sapiens
caataagcaaaa

SEQ ID NO: 776904 - DNA, 18 bp, Homo sapiens
caataagctggactagtg

SEQ ID NO: 776905 - DNA, 11 bp, Homo sapiens
caataataaaa

SEQ ID NO: 776906 - DNA, 21 bp, Homo sapiens
caataataagtgatgtgctga

SEQ ID NO: 776907 - DNA, 15 bp, Homo sapiens
caataataataaatt

SEQ ID NO: 776908 - DNA, 16 bp, Homo sapiens
caataataataaatta

SEQ ID NO: 776909 - DNA, 13 bp, Homo sapiens
caataatatattt

SEQ ID NO: 776910 - DNA, 12 bp, Homo sapiens
caataatcagaa

SEQ ID NO: 776911 - DNA, 14 bp, Homo sapiens
caataatccacccc

SEQ ID NO: 776912 - DNA, 18 bp, Homo sapiens
caataatggtcccatcca

SEQ ID NO: 776913 - DNA, 22 bp, Homo sapiens
caataatgtgcaaattttgcat

SEQ ID NO: 776914 - DNA, 15 bp, Homo sapiens
caataattgtttcca

SEQ ID NO: 776915 - DNA, 22 bp, Homo sapiens
caataatttgtacaatggttta

SEQ ID NO: 776916 - DNA, 20 bp, Homo sapiens
caatacaactttaccataaa

SEQ ID NO: 776917 - DNA, 16 bp, Homo sapiens
caatacaatgtacaat

SEQ ID NO: 776918 - DNA, 17 bp, Homo sapiens
caatacaatgtacaatt

SEQ ID NO: 776919 - DNA, 19 bp, Homo sapiens
caatacactagttgtttct

SEQ ID NO: 776920 - DNA, 23 bp, Homo sapiens
caatacagaattgactgcagttg

SEQ ID NO: 776921 - DNA, 15 bp, Homo sapiens
caatgtctgttgaac

SEQ ID NO: 776922 - DNA, 11 bp, Homo sapiens
caatgtcttga

SEQ ID NO: 776923 - DNA, 23 bp, Homo sapiens
caatgtcttgatgcatgcactgt

SEQ ID NO: 776924 - DNA, 20 bp, Homo sapiens
caatgtgaaacacatgccag

SEQ ID NO: 776925 - DNA, 21 bp, Homo sapiens
caatgtgaactttattaaata

SEQ ID NO: 776926 - DNA, 14 bp, Homo sapiens
caatgtgaatcaga

SEQ ID NO: 776927 - DNA, 18 bp, Homo sapiens
caatgtgaatcagaccct

SEQ ID NO: 776928 - DNA, 19 bp, Homo sapiens
caatgtgaatcagacccta

SEQ ID NO: 776929 - DNA, 16 bp, Homo sapiens
caatgtgattcttcta

SEQ ID NO: 776930 - DNA, 12 bp, Homo sapiens
caatgtgcagtg

SEQ ID NO: 776931 - DNA, 16 bp, Homo sapiens
caatgtgccttgattg

SEQ ID NO: 776932 - DNA, 19 bp, Homo sapiens
caatgtggacgtgcactga

SEQ ID NO: 776933 - DNA, 17 bp, Homo sapiens
caatgtggagcagcagc

SEQ ID NO: 776934 - DNA, 21 bp, Homo sapiens
caatgtggcctaaaaatgcaa

SEQ ID NO: 776935 - DNA, 21 bp, Homo sapiens
caatgtggttggtcaaatcaa

SEQ ID NO: 776936 - DNA, 15 bp, Homo sapiens
caatgtgtctttcta

SEQ ID NO: 776937 - DNA, 13 bp, Homo sapiens
caatgttatcaac

SEQ ID NO: 776938 - DNA, 15 bp, Homo sapiens
caatgttcatcccat

SEQ ID NO: 776939 - DNA, 14 bp, Homo sapiens
caatgttcattgta

SEQ ID NO: 776940 - DNA, 15 bp, Homo sapiens
caatgttcattgtaa

SEQ ID NO: 776941 - DNA, 14 bp, Homo sapiens
caatgttgagaagt

SEQ ID NO: 776942 - DNA, 23 bp, Homo sapiens
caatgttgagaagttcccattat

SEQ ID NO: 776943 - DNA, 22 bp, Homo sapiens
caatgttgtatttgttatttat

SEQ ID NO: 776944 - DNA, 16 bp, Homo sapiens
caatgttgtccaacaa

SEQ ID NO: 776945 - DNA, 19 bp, Homo sapiens
caatgttgtccaacaataa

SEQ ID NO: 776946 - DNA, 23 bp, Homo sapiens
caatgtttatgcaaggaaggaaa

SEQ ID NO: 776947 - DNA, 19 bp, Homo sapiens
caatgtttcttcatttctc

SEQ ID NO: 776948 - DNA, 23 bp, Homo sapiens
caatgtttgatgtccccaaagta

SEQ ID NO: 776949 - DNA, 13 bp, Homo sapiens
caattaaaaataa

SEQ ID NO: 776950 - DNA, 17 bp, Homo sapiens
caattaaaggtcctgcc

SEQ ID NO: 776951 - DNA, 15 bp, Homo sapiens
caattaatagtttgt

SEQ ID NO: 776952 - DNA, 19 bp, Homo sapiens
caattaatagtttgtctat

SEQ ID NO: 776953 - DNA, 11 bp, Homo sapiens
caattaatgct

SEQ ID NO: 776954 - DNA, 21 bp, Homo sapiens
caattaattgtccctgtttca

SEQ ID NO: 776955 - DNA, 15 bp, Homo sapiens
caattacagcaaaaa

SEQ ID NO: 776956 - DNA, 18 bp, Homo sapiens
caattacagggtgactca

SEQ ID NO: 776957 - DNA, 21 bp, Homo sapiens
caattacttattttaggaaat

SEQ ID NO: 776958 - DNA, 21 bp, Homo sapiens
caattagcaattgactgtcac

SEQ ID NO: 776959 - DNA, 12 bp, Homo sapiens
caattagcagaa

SEQ ID NO: 776960 - DNA, 15 bp, Homo sapiens
caattaggaagtgta

SEQ ID NO: 776961 - DNA, 17 bp, Homo sapiens
caattaggtttttcctt

SEQ ID NO: 776962 - DNA, 19 bp, Homo sapiens
caattagtggtcataaaat

SEQ ID NO: 776963 - DNA, 21 bp, Homo sapiens
caattagtggtcataaaatag

SEQ ID NO: 776964 - DNA, 17 bp, Homo sapiens
caattatatctattatg

SEQ ID NO: 776965 - DNA, 19 bp, Homo sapiens
caattatatctattatgta

SEQ ID NO: 776966 - DNA, 21 bp, Homo sapiens
caattatatctattatgtata

SEQ ID NO: 776967 - DNA, 14 bp, Homo sapiens
caattatgaaaata

SEQ ID NO: 776968 - DNA, 17 bp, Homo sapiens
caattattgttacacat

SEQ ID NO: 776969 - DNA, 17 bp, Homo sapiens
caattatttaaagaaag

SEQ ID NO: 776970 - DNA, 20 bp, Homo sapiens
caattatttaaagaaagtga

SEQ ID NO: 776971 - DNA, 13 bp, Homo sapiens
caattcaaagctg

SEQ ID NO: 776972 - DNA, 15 bp, Homo sapiens
caattcaacaatgtg

SEQ ID NO: 776973 - DNA, 17 bp, Homo sapiens
caattcaagctgagaaa

SEQ ID NO: 776974 - DNA, 21 bp, Homo sapiens
caattcagtggtcttattttt

SEQ ID NO: 776975 - DNA, 23 bp, Homo sapiens
caattcatgtaacagttgtgtca

SEQ ID NO: 776976 - DNA, 15 bp, Homo sapiens
caattccaagaaaat

SEQ ID NO: 776977 - DNA, 15 bp, Homo sapiens
caattccctgctgtc

SEQ ID NO: 776978 - DNA, 20 bp, Homo sapiens
caattcccttctttttcatc

SEQ ID NO: 776979 - DNA, 21 bp, Homo sapiens
caattcccttctttttcatcc

SEQ ID NO: 776980 - DNA, 22 bp, Homo sapiens
caattcctagataaaaagatgg

SEQ ID NO: 776981 - DNA, 13 bp, Homo sapiens
caattcctctggg

SEQ ID NO: 776982 - DNA, 15 bp, Homo sapiens
caattcctctgggaa

SEQ ID NO: 776983 - DNA, 14 bp, Homo sapiens
caattcctggccct

SEQ ID NO: 776984 - DNA, 16 bp, Homo sapiens
caattcctggccctgt

SEQ ID NO: 776985 - DNA, 12 bp, Homo sapiens
caattcctgggc

SEQ ID NO: 776986 - DNA, 16 bp, Homo sapiens
caattcctgggcccca

SEQ ID NO: 776987 - DNA, 16 bp, Homo sapiens
caattcggggcctgct

SEQ ID NO: 776988 - DNA, 17 bp, Homo sapiens
caattcggggcctgctg

SEQ ID NO: 776989 - DNA, 19 bp, Homo sapiens
caattcggggcctgctgga

SEQ ID NO: 776990 - DNA, 20 bp, Homo sapiens
caattctaaatccgacttga

SEQ ID NO: 776991 - DNA, 23 bp, Homo sapiens
caattctatcttttgtttccttt

SEQ ID NO: 776992 - DNA, 21 bp, Homo sapiens
caattctcctgcctcagcctc

SEQ ID NO: 776993 - DNA, 13 bp, Homo sapiens
caattctgactgt

SEQ ID NO: 776994 - DNA, 14 bp, Homo sapiens
caattctgactgtc

SEQ ID NO: 776995 - DNA, 20 bp, Homo sapiens
caattctgatgttactgaga

SEQ ID NO: 776996 - DNA, 21 bp, Homo sapiens
caattctgatgttactgagat

SEQ ID NO: 776997 - DNA, 23 bp, Homo sapiens
caattctgcctgcctcctccctc

SEQ ID NO: 776998 - DNA, 13 bp, Homo sapiens
caattctgtccct

SEQ ID NO: 776999 - DNA, 17 bp, Homo sapiens
caattctgtccctgtcc

SEQ ID NO: 777000 - DNA, 18 bp, Homo sapiens
caattctgtccctgtccc

SEQ ID NO: 777001 - DNA, 14 bp, Homo sapiens
caattctgttttta

SEQ ID NO: 777002 - DNA, 23 bp, Homo sapiens
caattctgtttttaatgctattt

SEQ ID NO: 777003 - DNA, 15 bp, Homo sapiens
caattgaagtaaact

SEQ ID NO: 777004 - DNA, 17 bp, Homo sapiens
caattgaagtaaacttt

SEQ ID NO: 777005 - DNA, 14 bp, Homo sapiens
caattgacaaatga

SEQ ID NO: 777006 - DNA, 16 bp, Homo sapiens
caattgacaaatgatg

SEQ ID NO: 777007 - DNA, 22 bp, Homo sapiens
caattgacataggcaataataa

SEQ ID NO: 777008 - DNA, 14 bp, Homo sapiens
caattgactctcac

SEQ ID NO: 777009 - DNA, 19 bp, Homo sapiens
caattgactgtcactgttc

SEQ ID NO: 777010 - DNA, 12 bp, Homo sapiens
caattgatgttt

SEQ ID NO: 777011 - DNA, 13 bp, Homo sapiens
caattgatgtttt

SEQ ID NO: 777012 - DNA, 21 bp, Homo sapiens
caattgatgttttacgtgcaa

SEQ ID NO: 777013 - DNA, 15 bp, Homo sapiens
caattgcactgctgt

SEQ ID NO: 777014 - DNA, 21 bp, Homo sapiens
caattgcagcagacccagcag

SEQ ID NO: 777015 - DNA, 19 bp, Homo sapiens
cacaactgctgtggccccc

SEQ ID NO: 777016 - DNA, 18 bp, Homo sapiens
cacaactttgcaaattat

SEQ ID NO: 777017 - DNA, 22 bp, Homo sapiens
cacaagaaatcaaaatccaaaa

SEQ ID NO: 777018 - DNA, 14 bp, Homo sapiens
cacaagaaatttga

SEQ ID NO: 777019 - DNA, 14 bp, Homo sapiens
cacaagaatggatc

SEQ ID NO: 777020 - DNA, 15 bp, Homo sapiens
cacaagagacttaaa

SEQ ID NO: 777021 - DNA, 14 bp, Homo sapiens
cacaagattcccag

SEQ ID NO: 777022 - DNA, 16 bp, Homo sapiens
cacaagattcccagag

SEQ ID NO: 777023 - DNA, 22 bp, Homo sapiens
cacaagattcccagagacagga

SEQ ID NO: 777024 - DNA, 21 bp, Homo sapiens
cacaagcactttaatggcctg

SEQ ID NO: 777025 - DNA, 21 bp, Homo sapiens
cacaagccacaagtcttccag

SEQ ID NO: 777026 - DNA, 12 bp, Homo sapiens
cacaagcctcct

SEQ ID NO: 777027 - DNA, 17 bp, Homo sapiens
cacaagctgcaccctca

SEQ ID NO: 777028 - DNA, 19 bp, Homo sapiens
cacaagctgcactgtgaac

SEQ ID NO: 777029 - DNA, 15 bp, Homo sapiens
cacaagctggaagca

SEQ ID NO: 777030 - DNA, 20 bp, Homo sapiens
cacaaggaaaatagtttagg

SEQ ID NO: 777031 - DNA, 16 bp, Homo sapiens
cacaaggaaccctcag

SEQ ID NO: 777032 - DNA, 23 bp, Homo sapiens
cacaaggaatttccctgtgtgga

SEQ ID NO: 777033 - DNA, 20 bp, Homo sapiens
cacaaggagtgcccgccttg

SEQ ID NO: 777034 - DNA, 22 bp, Homo sapiens
cacaaggataatagagtagcct

SEQ ID NO: 777035 - DNA, 15 bp, Homo sapiens
cacaaggcacggcca

SEQ ID NO: 777036 - DNA, 19 bp, Homo sapiens
cacaaggctgaccaagaga

SEQ ID NO: 777037 - DNA, 20 bp, Homo sapiens
cacaaggctggccagcaagg

SEQ ID NO: 777038 - DNA, 16 bp, Homo sapiens
cacaagggcacattgc

SEQ ID NO: 777039 - DNA, 23 bp, Homo sapiens
cacaaggtccactccctgctcca

SEQ ID NO: 777040 - DNA, 19 bp, Homo sapiens
cacaagtctcctagacact

SEQ ID NO: 777041 - DNA, 14 bp, Homo sapiens
cacaagtcttccag

SEQ ID NO: 777042 - DNA, 15 bp, Homo sapiens
cacaagtgaatcttt

SEQ ID NO: 777043 - DNA, 18 bp, Homo sapiens
cacaagtgaatctttctc

SEQ ID NO: 777044 - DNA, 22 bp, Homo sapiens
cacaagtgaatctttctcctgg

SEQ ID NO: 777045 - DNA, 23 bp, Homo sapiens
cacaagtgaatctttctcctggt

SEQ ID NO: 777046 - DNA, 22 bp, Homo sapiens
cacaagtgccactgcccgagct

SEQ ID NO: 777047 - DNA, 19 bp, Homo sapiens
cacaagtgccgcaaattgt

SEQ ID NO: 777048 - DNA, 16 bp, Homo sapiens
caatcggactgccaaa

SEQ ID NO: 777049 - DNA, 16 bp, Homo sapiens
caatcgggtccagaga

SEQ ID NO: 777050 - DNA, 23 bp, Homo sapiens
caatcggtgtgtagtgatgtttc

SEQ ID NO: 777051 - DNA, 15 bp, Homo sapiens
caatctactggaaat

SEQ ID NO: 777052 - DNA, 14 bp, Homo sapiens
caatctccagggct

SEQ ID NO: 777053 - DNA, 18 bp, Homo sapiens
caatctctggaaaaataa

SEQ ID NO: 777054 - DNA, 15 bp, Homo sapiens
caatctctgttctgc

SEQ ID NO: 777055 - DNA, 11 bp, Homo sapiens
caatctgccct

SEQ ID NO: 777056 - DNA, 15 bp, Homo sapiens
caatctgggactttc

SEQ ID NO: 777057 - DNA, 15 bp, Homo sapiens
caatctgtaaactgt

SEQ ID NO: 777058 - DNA, 16 bp, Homo sapiens
caatctgtaaactgtg

SEQ ID NO: 777059 - DNA, 16 bp, Homo sapiens
caatctgtatctttga

SEQ ID NO: 777060 - DNA, 20 bp, Homo sapiens
caatctgttttggctttatg

SEQ ID NO: 777061 - DNA, 17 bp, Homo sapiens
caatcttaccagatgct

SEQ ID NO: 777062 - DNA, 15 bp, Homo sapiens
caatcttgttactgc

SEQ ID NO: 777063 - DNA, 23 bp, Homo sapiens
caatcttgttactgctgattctt

SEQ ID NO: 777064 - DNA, 22 bp, Homo sapiens
caatctttcatgtcttgtcata

SEQ ID NO: 777065 - DNA, 14 bp, Homo sapiens
caatctttctatat

SEQ ID NO: 777066 - DNA, 21 bp, Homo sapiens
caatctttctatataaaatgt

SEQ ID NO: 777067 - DNA, 19 bp, Homo sapiens
caatctttgcctttatctc

SEQ ID NO: 777068 - DNA, 15 bp, Homo sapiens
caatgaaaaaatgta

SEQ ID NO: 777069 - DNA, 17 bp, Homo sapiens
caatgaaaaatgtaatt

SEQ ID NO: 777070 - DNA, 16 bp, Homo sapiens
caatgaaaactctttg

SEQ ID NO: 777071 - DNA, 19 bp, Homo sapiens
caatgaaaactctttgctg

SEQ ID NO: 777072 - DNA, 19 bp, Homo sapiens
caatgaaaaggtgattgtc

SEQ ID NO: 777073 - DNA, 22 bp, Homo sapiens
caatgaaatacacaagtaaaca

SEQ ID NO: 777074 - DNA, 17 bp, Homo sapiens
caatgaaatactccagc

SEQ ID NO: 777075 - DNA, 18 bp, Homo sapiens
caatgaaatactccagca

SEQ ID NO: 777076 - DNA, 23 bp, Homo sapiens
caatgaaatgaattaaagtggac

SEQ ID NO: 777077 - DNA, 18 bp, Homo sapiens
caatgaacacttataagt

SEQ ID NO: 777078 - DNA, 13 bp, Homo sapiens
caatgaaccccca

SEQ ID NO: 777079 - DNA, 20 bp, Homo sapiens
caatgaacccccatgatgta

SEQ ID NO: 777080 - DNA, 18 bp, Homo sapiens
caatgaactgcttttcct

SEQ ID NO: 777081 - DNA, 16 bp, Homo sapiens
caatgaagaagtttct

SEQ ID NO: 777082 - DNA, 18 bp, Homo sapiens
caatgaatatactcatta

SEQ ID NO: 777083 - DNA, 15 bp, Homo sapiens
caatgaattaattca

SEQ ID NO: 777084 - DNA, 13 bp, Homo sapiens
caatgaattatta

SEQ ID NO: 777085 - DNA, 15 bp, Homo sapiens
caatgacagggatgc

SEQ ID NO: 777086 - DNA, 20 bp, Homo sapiens
caatgacagggatgccaaca

SEQ ID NO: 777087 - DNA, 22 bp, Homo sapiens
caatgacatccagaaagctgag

SEQ ID NO: 777088 - DNA, 16 bp, Homo sapiens
caatgacatctcaggg

SEQ ID NO: 777089 - DNA, 19 bp, Homo sapiens
caatgaccattcaattagt

SEQ ID NO: 777090 - DNA, 13 bp, Homo sapiens
caatgacttctaa

SEQ ID NO: 777091 - DNA, 19 bp, Homo sapiens
caatgagagcataatttaa

SEQ ID NO: 777092 - DNA, 14 bp, Homo sapiens
caatgagatgcatg

SEQ ID NO: 777093 - DNA, 18 bp, Homo sapiens
caatgatagtaagaaaag

SEQ ID NO: 777094 - DNA, 13 bp, Homo sapiens
caatgatggtcac

SEQ ID NO: 777095 - DNA, 14 bp, Homo sapiens
caatgatggtcacc

SEQ ID NO: 777096 - DNA, 13 bp, Homo sapiens
caatgatgtgacc

SEQ ID NO: 777097 - DNA, 23 bp, Homo sapiens
caatgcaagagtgattgcagctt

SEQ ID NO: 777098 - DNA, 13 bp, Homo sapiens
caatgcagtcagt

SEQ ID NO: 777099 - DNA, 17 bp, Homo sapiens
caatgcatacaataaaa

SEQ ID NO: 777100 - DNA, 18 bp, Homo sapiens
caatgcatacaataaaag

SEQ ID NO: 777101 - DNA, 20 bp, Homo sapiens
caatgcatacaataaaagag

SEQ ID NO: 777102 - DNA, 20 bp, Homo sapiens
caatgcatgcagccactgtg

SEQ ID NO: 777103 - DNA, 20 bp, Homo sapiens
caatgcattgtcttgtggag

SEQ ID NO: 777104 - DNA, 22 bp, Homo sapiens
caatgccaaaaaaagacagggc

SEQ ID NO: 777105 - DNA, 13 bp, Homo sapiens
caatgccatcagc

SEQ ID NO: 777106 - DNA, 16 bp, Homo sapiens
caatgccatcagcccc

SEQ ID NO: 777107 - DNA, 14 bp, Homo sapiens
caatgccatcatct

SEQ ID NO: 777108 - DNA, 13 bp, Homo sapiens
caatgccctgcca

SEQ ID NO: 777109 - DNA, 23 bp, Homo sapiens
caatgcctattgtaatatagaaa

SEQ ID NO: 777110 - DNA, 14 bp, Homo sapiens
caatgcctttttag

SEQ ID NO: 777111 - DNA, 17 bp, Homo sapiens
caatgcctttttagatg

SEQ ID NO: 777112 - DNA, 20 bp, Homo sapiens
caatgctcttttcacagcta

SEQ ID NO: 777113 - DNA, 13 bp, Homo sapiens
caatgcttgtaga

SEQ ID NO: 777114 - DNA, 20 bp, Homo sapiens
caatgcttgtagaagtagga

SEQ ID NO: 777115 - DNA, 23 bp, Homo sapiens
caatgctttgggaggccaaggca

SEQ ID NO: 777116 - DNA, 18 bp, Homo sapiens
caatgcttttaatgaatt

SEQ ID NO: 777117 - DNA, 21 bp, Homo sapiens
caatgcttttatatggcccag

SEQ ID NO: 777118 - DNA, 22 bp, Homo sapiens
caatggaaaacctgggggatgg

SEQ ID NO: 777119 - DNA, 23 bp, Homo sapiens
caatggaaaacctgggggatggt

SEQ ID NO: 777120 - DNA, 17 bp, Homo sapiens
caatggaaacctcacgc

SEQ ID NO: 777121 - DNA, 17 bp, Homo sapiens
caatggaagaaatggct

SEQ ID NO: 777122 - DNA, 13 bp, Homo sapiens
caatggaataaat

SEQ ID NO: 777123 - DNA, 19 bp, Homo sapiens
caatggacaagcagtggat

SEQ ID NO: 777124 - DNA, 17 bp, Homo sapiens
caatggatttgatgctg

SEQ ID NO: 777125 - DNA, 19 bp, Homo sapiens
caatggatttgatgctgtt

SEQ ID NO: 777126 - DNA, 14 bp, Homo sapiens
caatggcacctctg

SEQ ID NO: 777127 - DNA, 19 bp, Homo sapiens
caatggcacctctgccctt

SEQ ID NO: 777128 - DNA, 22 bp, Homo sapiens
caatggcacctctgcccttccc

SEQ ID NO: 777129 - DNA, 20 bp, Homo sapiens
caatggcagcattcccacca

SEQ ID NO: 777130 - DNA, 23 bp, Homo sapiens
caatggcagctagactggagtga

SEQ ID NO: 777131 - DNA, 12 bp, Homo sapiens
caatggccagag

SEQ ID NO: 777132 - DNA, 14 bp, Homo sapiens
caatggccagagcc

SEQ ID NO: 777133 - DNA, 15 bp, Homo sapiens
caatggccagagcct

SEQ ID NO: 777134 - DNA, 16 bp, Homo sapiens
caatggccagagcctc

SEQ ID NO: 777135 - DNA, 21 bp, Homo sapiens
caatggcctaaaactggcctg

SEQ ID NO: 777136 - DNA, 11 bp, Homo sapiens
caatggccttt

SEQ ID NO: 777137 - DNA, 23 bp, Homo sapiens
caatggccttttgctacgtgcct

SEQ ID NO: 777138 - DNA, 17 bp, Homo sapiens
caatggctaattcccag

SEQ ID NO: 777139 - DNA, 17 bp, Homo sapiens
caatggctattaacaat

SEQ ID NO: 777140 - DNA, 21 bp, Homo sapiens
caatggctgagcctcgtgtcc

SEQ ID NO: 777141 - DNA, 20 bp, Homo sapiens
caatgggaagactcaggagt

SEQ ID NO: 777142 - DNA, 21 bp, Homo sapiens
caatgggaagactcaggagtc

SEQ ID NO: 777143 - DNA, 21 bp, Homo sapiens
caatgggagctgaggccacac

SEQ ID NO: 777144 - DNA, 23 bp, Homo sapiens
caatgggagctgaggccacactc

SEQ ID NO: 777145 - DNA, 19 bp, Homo sapiens
caatgggcactgggatgag

SEQ ID NO: 777146 - DNA, 16 bp, Homo sapiens
caatggggtgggccca

SEQ ID NO: 777147 - DNA, 16 bp, Homo sapiens
cacaagttatttaaat

SEQ ID NO: 777148 - DNA, 13 bp, Homo sapiens
cacaataaaaaat

SEQ ID NO: 777149 - DNA, 18 bp, Homo sapiens
cacaataaaaatgtttaa

SEQ ID NO: 777150 - DNA, 13 bp, Homo sapiens
cacaataaatggc

SEQ ID NO: 777151 - DNA, 22 bp, Homo sapiens
cacaataaatggccagtgctgc

SEQ ID NO: 777152 - DNA, 20 bp, Homo sapiens
cacaataaatgtattcaaat

SEQ ID NO: 777153 - DNA, 19 bp, Homo sapiens
cacaataacactaaaattt

SEQ ID NO: 777154 - DNA, 22 bp, Homo sapiens
cacaataactagtaataccaaa

SEQ ID NO: 777155 - DNA, 13 bp, Homo sapiens
cacaataagcaaa

SEQ ID NO: 777156 - DNA, 19 bp, Homo sapiens
cacaatatacgaaaagcca

SEQ ID NO: 777157 - DNA, 15 bp, Homo sapiens
cacaatcagtttatc

SEQ ID NO: 777158 - DNA, 20 bp, Homo sapiens
cacaatcctaacacattatc

SEQ ID NO: 777159 - DNA, 18 bp, Homo sapiens
cacaatctgggactttca

SEQ ID NO: 777160 - DNA, 19 bp, Homo sapiens
cacaatggaaaacctgggg

SEQ ID NO: 777161 - DNA, 21 bp, Homo sapiens
cacaatggaaaacctggggga

SEQ ID NO: 777162 - DNA, 14 bp, Homo sapiens
cacaatggcacctc

SEQ ID NO: 777163 - DNA, 24 bp, Homo sapiens
cacaatgtggacgtgcactgacag

SEQ ID NO: 777164 - DNA, 17 bp, Homo sapiens
cacaattagatttctca

SEQ ID NO: 777165 - DNA, 17 bp, Homo sapiens
cacaattcattcaccag

SEQ ID NO: 777166 - DNA, 18 bp, Homo sapiens
cacaattctgtccctgtc

SEQ ID NO: 777167 - DNA, 20 bp, Homo sapiens
cacaattctgtccctgtccc

SEQ ID NO: 777168 - DNA, 12 bp, Homo sapiens
cacaatttaaaa

SEQ ID NO: 777169 - DNA, 15 bp, Homo sapiens
cacaatttaaaatat

SEQ ID NO: 777170 - DNA, 13 bp, Homo sapiens
cacaatttgcact

SEQ ID NO: 777171 - DNA, 20 bp, Homo sapiens
cacacaaaaaggagcgggca

SEQ ID NO: 777172 - DNA, 19 bp, Homo sapiens
cacacaaacctactgccca

SEQ ID NO: 777173 - DNA, 21 bp, Homo sapiens
cacacaaacctactgcccaca

SEQ ID NO: 777174 - DNA, 18 bp, Homo sapiens
cacacaaaggtataattt

SEQ ID NO: 777175 - DNA, 14 bp, Homo sapiens
cacacacaaaccat

SEQ ID NO: 777176 - DNA, 22 bp, Homo sapiens
cacacacaaacctactgcccac

SEQ ID NO: 777177 - DNA, 9 bp, Homo sapiens
cacacacac

SEQ ID NO: 777178 - DNA, 12 bp, Homo sapiens
cacacacacaca

SEQ ID NO: 777179 - DNA, 13 bp, Homo sapiens
cacacacacacac

SEQ ID NO: 777180 - DNA, 15 bp, Homo sapiens
cacacacacacacaa

SEQ ID NO: 777181 - DNA, 16 bp, Homo sapiens
cacacacacacacaca

SEQ ID NO: 777182 - DNA, 14 bp, Homo sapiens
cacacacacacacg

SEQ ID NO: 777183 - DNA, 15 bp, Homo sapiens
cacacacacacacga

SEQ ID NO: 777184 - DNA, 14 bp, Homo sapiens
cacacacacacagg

SEQ ID NO: 777185 - DNA, 13 bp, Homo sapiens
cacacacacatac

SEQ ID NO: 777186 - DNA, 14 bp, Homo sapiens
cacacacacatgct

SEQ ID NO: 777187 - DNA, 13 bp, Homo sapiens
cacacacacccac

SEQ ID NO: 777188 - DNA, 11 bp, Homo sapiens
cacacacacga

SEQ ID NO: 777189 - DNA, 15 bp, Homo sapiens
cacacacacgatgca

SEQ ID NO: 777190 - DNA, 14 bp, Homo sapiens
cacacacacgcacg

SEQ ID NO: 777191 - DNA, 13 bp, Homo sapiens
cacacacagcccc

SEQ ID NO: 777192 - DNA, 14 bp, Homo sapiens
cacacacagctcct

SEQ ID NO: 777193 - DNA, 12 bp, Homo sapiens
cacacacaggcc

SEQ ID NO: 777194 - DNA, 14 bp, Homo sapiens
cacacacaggcctt

SEQ ID NO: 777195 - DNA, 18 bp, Homo sapiens
cacacaccctgaggtcag

SEQ ID NO: 777196 - DNA, 21 bp, Homo sapiens
cacacacgatgcatttaataa

SEQ ID NO: 777197 - DNA, 17 bp, Homo sapiens
cacacacgcacgcacac

SEQ ID NO: 777198 - DNA, 21 bp, Homo sapiens
cacacactcaccagtggcctt

SEQ ID NO: 777199 - DNA, 20 bp, Homo sapiens
cacacactcgcccgcccact

SEQ ID NO: 777200 - DNA, 21 bp, Homo sapiens
cacacactcgcccgcccactg

SEQ ID NO: 777201 - DNA, 16 bp, Homo sapiens
cacacactgcacatct

SEQ ID NO: 777202 - DNA, 19 bp, Homo sapiens
cacacactgtctggggccc

SEQ ID NO: 777203 - DNA, 11 bp, Homo sapiens
cacacactgtg

SEQ ID NO: 777204 - DNA, 15 bp, Homo sapiens
cacacagaaactctt

SEQ ID NO: 777205 - DNA, 16 bp, Homo sapiens
cacacagacggcctag

SEQ ID NO: 777206 - DNA, 21 bp, Homo sapiens
cacacagagatttgagaacca

SEQ ID NO: 777207 - DNA, 20 bp, Homo sapiens
cacacagagtggtctttctg

SEQ ID NO: 777208 - DNA, 20 bp, Homo sapiens
cacacagatttgagctcagc

SEQ ID NO: 777209 - DNA, 13 bp, Homo sapiens
cacacagcagccc

SEQ ID NO: 777210 - DNA, 21 bp, Homo sapiens
cacacagcagccccccagcac

SEQ ID NO: 777211 - DNA, 18 bp, Homo sapiens
cacacagcctctaagcgt

SEQ ID NO: 777212 - DNA, 12 bp, Homo sapiens
cacacagctgcc

SEQ ID NO: 777213 - DNA, 14 bp, Homo sapiens
cacacagctgggca

SEQ ID NO: 777214 - DNA, 18 bp, Homo sapiens
cacacaggacccccttcc

SEQ ID NO: 777215 - DNA, 12 bp, Homo sapiens
cacacaggcctt

SEQ ID NO: 777216 - DNA, 16 bp, Homo sapiens
cacacaggccttctgt

SEQ ID NO: 777217 - DNA, 17 bp, Homo sapiens
cacacaggccttctgtg

SEQ ID NO: 777218 - DNA, 18 bp, Homo sapiens
cacacaggccttctgtgg

SEQ ID NO: 777219 - DNA, 20 bp, Homo sapiens
cacacaggccttctgtgggg

SEQ ID NO: 777220 - DNA, 22 bp, Homo sapiens
cacacagggcccggccacaccc

SEQ ID NO: 777221 - DNA, 14 bp, Homo sapiens
atggaaagttgtat

SEQ ID NO: 777222 - DNA, 18 bp, Homo sapiens
atggaaatgtgagaaatg

SEQ ID NO: 777223 - DNA, 18 bp, Homo sapiens
atggaaattctgctcaga

SEQ ID NO: 777224 - DNA, 15 bp, Homo sapiens
atggaacatgcccac

SEQ ID NO: 777225 - DNA, 21 bp, Homo sapiens
atggaaccttccctccaaatt

SEQ ID NO: 777226 - DNA, 14 bp, Homo sapiens
atggaactgacccc

SEQ ID NO: 777227 - DNA, 14 bp, Homo sapiens
atggaacttagcca

SEQ ID NO: 777228 - DNA, 18 bp, Homo sapiens
atggaacttctaatatat

SEQ ID NO: 777229 - DNA, 14 bp, Homo sapiens
atggaagaaagtaa

SEQ ID NO: 777230 - DNA, 15 bp, Homo sapiens
atggaagagagaaag

SEQ ID NO: 777231 - DNA, 19 bp, Homo sapiens
atggaagatggtccgtgcc

SEQ ID NO: 777232 - DNA, 22 bp, Homo sapiens
atggaagatggtccgtgcccag

SEQ ID NO: 777233 - DNA, 13 bp, Homo sapiens
atggaagcaaaga

SEQ ID NO: 777234 - DNA, 15 bp, Homo sapiens
atggaagcaaagaca

SEQ ID NO: 777235 - DNA, 16 bp, Homo sapiens
atggaagcaaagacaa

SEQ ID NO: 777236 - DNA, 21 bp, Homo sapiens
atggaagcccacttctcagat

SEQ ID NO: 777237 - DNA, 20 bp, Homo sapiens
atggaagcctgaactgaggc

SEQ ID NO: 777238 - DNA, 16 bp, Homo sapiens
atggaagggtttgtgg

SEQ ID NO: 777239 - DNA, 23 bp, Homo sapiens
atggaaggtgccagaaggaaggt

SEQ ID NO: 777240 - DNA, 17 bp, Homo sapiens
atggaagtaaagcctca

SEQ ID NO: 777241 - DNA, 22 bp, Homo sapiens
atggaagtcacctttctgggct

SEQ ID NO: 777242 - DNA, 17 bp, Homo sapiens
atggaagtggcagtgaa

SEQ ID NO: 777243 - DNA, 13 bp, Homo sapiens
atggaataaaagg

SEQ ID NO: 777244 - DNA, 20 bp, Homo sapiens
atggaataaattatggcatt

SEQ ID NO: 777245 - DNA, 15 bp, Homo sapiens
atggaatacagtgtt

SEQ ID NO: 777246 - DNA, 14 bp, Homo sapiens
atggaatatatcag

SEQ ID NO: 777247 - DNA, 21 bp, Homo sapiens
atggaatatttataggccagg

SEQ ID NO: 777248 - DNA, 18 bp, Homo sapiens
atggaatcgatttcctcc

SEQ ID NO: 777249 - DNA, 15 bp, Homo sapiens
atggaatggaaaagc

SEQ ID NO: 777250 - DNA, 16 bp, Homo sapiens
atggaatgtgccacct

SEQ ID NO: 777251 - DNA, 18 bp, Homo sapiens
atggaatgtgccacctgt

SEQ ID NO: 777252 - DNA, 14 bp, Homo sapiens
atggaatgtgcccc

SEQ ID NO: 777253 - DNA, 23 bp, Homo sapiens
atggaattaaccatttaataaag

SEQ ID NO: 777254 - DNA, 21 bp, Homo sapiens
atggaattcgtgttatgaatc

SEQ ID NO: 777255 - DNA, 18 bp, Homo sapiens
atggaattcttcctcctc

SEQ ID NO: 777256 - DNA, 20 bp, Homo sapiens
atggaattcttcctcctctg

SEQ ID NO: 777257 - DNA, 19 bp, Homo sapiens
atggaattgatttgcattg

SEQ ID NO: 777258 - DNA, 22 bp, Homo sapiens
atggaattgcttctgtgtagtc

SEQ ID NO: 777259 - DNA, 15 bp, Homo sapiens
atggacaacttattt

SEQ ID NO: 777260 - DNA, 21 bp, Homo sapiens
atggacaacttatttaaaaat

SEQ ID NO: 777261 - DNA, 22 bp, Homo sapiens
atggacaagcagtgtctgtcag

SEQ ID NO: 777262 - DNA, 22 bp, Homo sapiens
atggacaatataaactgaaaaa

SEQ ID NO: 777263 - DNA, 15 bp, Homo sapiens
atggacacaaatttt

SEQ ID NO: 777264 - DNA, 16 bp, Homo sapiens
atggacacaaattttc

SEQ ID NO: 777265 - DNA, 22 bp, Homo sapiens
atggacaccccttatccaggac

SEQ ID NO: 777266 - DNA, 15 bp, Homo sapiens
atggacacgagccac

SEQ ID NO: 777267 - DNA, 16 bp, Homo sapiens
atggacacgagccaca

SEQ ID NO: 777268 - DNA, 23 bp, Homo sapiens
atggacacgagccacaagctgca

SEQ ID NO: 777269 - DNA, 17 bp, Homo sapiens
atggacactccagtgcc

SEQ ID NO: 777270 - DNA, 11 bp, Homo sapiens
atggacagaca

SEQ ID NO: 777271 - DNA, 12 bp, Homo sapiens
atggacagacac

SEQ ID NO: 777272 - DNA, 16 bp, Homo sapiens
atggacagacacctcc

SEQ ID NO: 777273 - DNA, 17 bp, Homo sapiens
atggacagacacctccc

SEQ ID NO: 777274 - DNA, 18 bp, Homo sapiens
atggacagacacctcccc

SEQ ID NO: 777275 - DNA, 19 bp, Homo sapiens
atggacaggctggctccag

SEQ ID NO: 777276 - DNA, 13 bp, Homo sapiens
atggacagggcca

SEQ ID NO: 777277 - DNA, 15 bp, Homo sapiens
atggacagggccagg

SEQ ID NO: 777278 - DNA, 18 bp, Homo sapiens
atggacagggccagggtt

SEQ ID NO: 777279 - DNA, 13 bp, Homo sapiens
atggacatcctgt

SEQ ID NO: 777280 - DNA, 22 bp, Homo sapiens
atggacattttcttttattatc

SEQ ID NO: 777281 - DNA, 21 bp, Homo sapiens
atggaccaaatgtgccatact

SEQ ID NO: 777282 - DNA, 20 bp, Homo sapiens
atggaccaacctgctctgtc

SEQ ID NO: 777283 - DNA, 22 bp, Homo sapiens
atggaccaacctgctctgtccc

SEQ ID NO: 777284 - DNA, 14 bp, Homo sapiens
atggaccagcatct

SEQ ID NO: 777285 - DNA, 21 bp, Homo sapiens
atggacccaatatttaccaga

SEQ ID NO: 777286 - DNA, 14 bp, Homo sapiens
atggacccctccct

SEQ ID NO: 777287 - DNA, 15 bp, Homo sapiens
atggacccctccctt

SEQ ID NO: 777288 - DNA, 20 bp, Homo sapiens
atggaccgggtgggcctggc

SEQ ID NO: 777289 - DNA, 20 bp, Homo sapiens
atggccaccccgtgccaccc

SEQ ID NO: 777290 - DNA, 19 bp, Homo sapiens
atggccagagcctctggcc

SEQ ID NO: 777291 - DNA, 12 bp, Homo sapiens
atggccagagga

SEQ ID NO: 777292 - DNA, 13 bp, Homo sapiens
atggccagcccct

SEQ ID NO: 777293 - DNA, 22 bp, Homo sapiens
atggccagcccctggggcccag

SEQ ID NO: 777294 - DNA, 22 bp, Homo sapiens
atggccaggtggccactccaga

SEQ ID NO: 777295 - DNA, 14 bp, Homo sapiens
atggccagtgctgc

SEQ ID NO: 777296 - DNA, 15 bp, Homo sapiens
atggccagtgctgct

SEQ ID NO: 777297 - DNA, 16 bp, Homo sapiens
atggccagtgctgctt

SEQ ID NO: 777298 - DNA, 17 bp, Homo sapiens
atggccagtgctgcttc

SEQ ID NO: 777299 - DNA, 15 bp, Homo sapiens
atggccatagaggcc

SEQ ID NO: 777300 - DNA, 14 bp, Homo sapiens
atggccatgcccta

SEQ ID NO: 777301 - DNA, 22 bp, Homo sapiens
atggccatggagtgtacaagta

SEQ ID NO: 777302 - DNA, 19 bp, Homo sapiens
atggcccaaaatgaccaac

SEQ ID NO: 777303 - DNA, 16 bp, Homo sapiens
atggcccaagggatgg

SEQ ID NO: 777304 - DNA, 18 bp, Homo sapiens
atggcccaagggatggca

SEQ ID NO: 777305 - DNA, 15 bp, Homo sapiens
atggcccaggcagcc

SEQ ID NO: 777306 - DNA, 14 bp, Homo sapiens
atggcccagtgtca

SEQ ID NO: 777307 - DNA, 14 bp, Homo sapiens
atggccccaacaag

SEQ ID NO: 777308 - DNA, 19 bp, Homo sapiens
atggccccaacaagcaccc

SEQ ID NO: 777309 - DNA, 14 bp, Homo sapiens
atggcccccaataa

SEQ ID NO: 777310 - DNA, 19 bp, Homo sapiens
atggcccccaataaaggca

SEQ ID NO: 777311 - DNA, 13 bp, Homo sapiens
atggccccccact

SEQ ID NO: 777312 - DNA, 22 bp, Homo sapiens
atggcccctccttgcaaccagg

SEQ ID NO: 777313 - DNA, 17 bp, Homo sapiens
atggcccgacatttctt

SEQ ID NO: 777314 - DNA, 11 bp, Homo sapiens
atggccctggg

SEQ ID NO: 777315 - DNA, 14 bp, Homo sapiens
atggccctgtccca

SEQ ID NO: 777316 - DNA, 15 bp, Homo sapiens
atggccctgtcccag

SEQ ID NO: 777317 - DNA, 21 bp, Homo sapiens
atggtactgactttgcttgct

SEQ ID NO: 777318 - DNA, 18 bp, Homo sapiens
atggtagaaaaatttcac

SEQ ID NO: 777319 - DNA, 13 bp, Homo sapiens
atggtagcatttt

SEQ ID NO: 777320 - DNA, 18 bp, Homo sapiens
atggtagcattttaaaca

SEQ ID NO: 777321 - DNA, 19 bp, Homo sapiens
atggtagccagatgataaa

SEQ ID NO: 777322 - DNA, 16 bp, Homo sapiens
atggtaggggagggca

SEQ ID NO: 777323 - DNA, 17 bp, Homo sapiens
atggtagttttttcatc

SEQ ID NO: 777324 - DNA, 21 bp, Homo sapiens
atggtatcatattaacatatt

SEQ ID NO: 777325 - DNA, 18 bp, Homo sapiens
atggtatgatcaataaag

SEQ ID NO: 777326 - DNA, 22 bp, Homo sapiens
atggtatgctggccagcaccct

SEQ ID NO: 777327 - DNA, 21 bp, Homo sapiens
atggtattaatcttgtgtagt

SEQ ID NO: 777328 - DNA, 14 bp, Homo sapiens
atggtattacaaaa

SEQ ID NO: 777329 - DNA, 16 bp, Homo sapiens
atggtcacacactgat

SEQ ID NO: 777330 - DNA, 18 bp, Homo sapiens
atggtcacacactgatgc

SEQ ID NO: 777331 - DNA, 19 bp, Homo sapiens
atggtcacacactgatgct

SEQ ID NO: 777332 - DNA, 20 bp, Homo sapiens
atggtcacacactgatgctt

SEQ ID NO: 777333 - DNA, 20 bp, Homo sapiens
atggtcacgtttggtgcttc

SEQ ID NO: 777334 - DNA, 18 bp, Homo sapiens
atggtcagccctagggtg

SEQ ID NO: 777335 - DNA, 13 bp, Homo sapiens
atggtcagctccc

SEQ ID NO: 777336 - DNA, 22 bp, Homo sapiens
atggtcatcttggagggaccaa

SEQ ID NO: 777337 - DNA, 20 bp, Homo sapiens
atggtccaattagtttcctt

SEQ ID NO: 777338 - DNA, 20 bp, Homo sapiens
atggtccagaaactcctgtt

SEQ ID NO: 777339 - DNA, 17 bp, Homo sapiens
atggtccaggatctcca

SEQ ID NO: 777340 - DNA, 20 bp, Homo sapiens
atggtcccaggaagcaggga

SEQ ID NO: 777341 - DNA, 18 bp, Homo sapiens
atggtcccatccaggcag

SEQ ID NO: 777342 - DNA, 14 bp, Homo sapiens
atggtcctggggct

SEQ ID NO: 777343 - DNA, 15 bp, Homo sapiens
atggtcggaaaacat

SEQ ID NO: 777344 - DNA, 22 bp, Homo sapiens
atggtcggatctcacaggctga

SEQ ID NO: 777345 - DNA, 16 bp, Homo sapiens
atggtctctctccctc

SEQ ID NO: 777346 - DNA, 16 bp, Homo sapiens
atggtcttacattgga

SEQ ID NO: 777347 - DNA, 16 bp, Homo sapiens
atggtcttgagccagt

SEQ ID NO: 777348 - DNA, 17 bp, Homo sapiens
atggtgaaaatgtactg

SEQ ID NO: 777349 - DNA, 20 bp, Homo sapiens
atggtgaaaccccgtctcta

SEQ ID NO: 777350 - DNA, 17 bp, Homo sapiens
atggtgaaatttattag

SEQ ID NO: 777351 - DNA, 18 bp, Homo sapiens
atggtgaagacagaaacc

SEQ ID NO: 777352 - DNA, 14 bp, Homo sapiens
atggtgaagtaaca

SEQ ID NO: 777353 - DNA, 14 bp, Homo sapiens
atggtgagctggga

SEQ ID NO: 777354 - DNA, 16 bp, Homo sapiens
atggtgagctgggaag

SEQ ID NO: 777355 - DNA, 17 bp, Homo sapiens
atggtgaggctgtcagt

SEQ ID NO: 777356 - DNA, 16 bp, Homo sapiens
atggtgatcctctatt

SEQ ID NO: 777357 - DNA, 19 bp, Homo sapiens
atggtgatcctctattttg

SEQ ID NO: 777358 - DNA, 21 bp, Homo sapiens
atggtgatcctctattttgtg

SEQ ID NO: 777359 - DNA, 15 bp, Homo sapiens
atggtgcattgtata

SEQ ID NO: 777360 - DNA, 15 bp, Homo sapiens
atggtgcctgagagg

SEQ ID NO: 777361 - DNA, 16 bp, Homo sapiens
atggtgcctgagaggc

SEQ ID NO: 777362 - DNA, 13 bp, Homo sapiens
atggtgcttcctt

SEQ ID NO: 777363 - DNA, 23 bp, Homo sapiens
atggtggaagggggtgtgcgtgc

SEQ ID NO: 777364 - DNA, 17 bp, Homo sapiens
atggtggactaagcaat

SEQ ID NO: 777365 - DNA, 19 bp, Homo sapiens
atggtggagggcacttcag

SEQ ID NO: 777366 - DNA, 13 bp, Homo sapiens
atggtggagggcc

SEQ ID NO: 777367 - DNA, 17 bp, Homo sapiens
atggtggcacaggcact

SEQ ID NO: 777368 - DNA, 14 bp, Homo sapiens
atgtaatataaatt

SEQ ID NO: 777369 - DNA, 15 bp, Homo sapiens
atgtaatatattgta

SEQ ID NO: 777370 - DNA, 16 bp, Homo sapiens
atgtaatatattgtac

SEQ ID NO: 777371 - DNA, 19 bp, Homo sapiens
atgtaatctctctgcagct

SEQ ID NO: 777372 - DNA, 16 bp, Homo sapiens
atgtaatggcagttat

SEQ ID NO: 777373 - DNA, 18 bp, Homo sapiens
atgtaatggcagttatat

SEQ ID NO: 777374 - DNA, 23 bp, Homo sapiens
atgtaatgtgtggtggcctcagc

SEQ ID NO: 777375 - DNA, 15 bp, Homo sapiens
atgtaattaagtact

SEQ ID NO: 777376 - DNA, 17 bp, Homo sapiens
atgtaattaagtactat

SEQ ID NO: 777377 - DNA, 15 bp, Homo sapiens
atgtaattcaggact

SEQ ID NO: 777378 - DNA, 19 bp, Homo sapiens
atgtaattgtaattttgaa

SEQ ID NO: 777379 - DNA, 14 bp, Homo sapiens
atgtaatttatgca

SEQ ID NO: 777380 - DNA, 16 bp, Homo sapiens
atgtaatttcaaaata

SEQ ID NO: 777381 - DNA, 13 bp, Homo sapiens
atgtaatttgcat

SEQ ID NO: 777382 - DNA, 20 bp, Homo sapiens
atgtaattttattttaaaat

SEQ ID NO: 777383 - DNA, 23 bp, Homo sapiens
atgtaattttattttaaaatttc

SEQ ID NO: 777384 - DNA, 12 bp, Homo sapiens
atgtaattttgt

SEQ ID NO: 777385 - DNA, 17 bp, Homo sapiens
atgtaattttgtgtaag

SEQ ID NO: 777386 - DNA, 18 bp, Homo sapiens
atgtcctccagaagcctc

SEQ ID NO: 777387 - DNA, 20 bp, Homo sapiens
atgtgaggaactcacatact

SEQ ID NO: 777388 - DNA, 14 bp, Homo sapiens
atgttgtcaaggat

SEQ ID NO: 777389 - DNA, 17 bp, Homo sapiens
atgttgtcataacattt

SEQ ID NO: 777390 - DNA, 12 bp, Homo sapiens
atgttgttattt

SEQ ID NO: 777391 - DNA, 20 bp, Homo sapiens
atgttgttcattattggagg

SEQ ID NO: 777392 - DNA, 14 bp, Homo sapiens
atgttgttgaaagg

SEQ ID NO: 777393 - DNA, 16 bp, Homo sapiens
atgttgttgtgtgtat

SEQ ID NO: 777394 - DNA, 22 bp, Homo sapiens
atgttgttgtgtgtatatgtat

SEQ ID NO: 777395 - DNA, 18 bp, Homo sapiens
atgttgtttataataaaa

SEQ ID NO: 777396 - DNA, 22 bp, Homo sapiens
atgttgtttataataaaaatat

SEQ ID NO: 777397 - DNA, 17 bp, Homo sapiens
atgttgttttttcatag

SEQ ID NO: 777398 - DNA, 19 bp, Homo sapiens
atgtttaaaataaaatgaa

SEQ ID NO: 777399 - DNA, 15 bp, Homo sapiens
atgtttaaatagcct

SEQ ID NO: 777400 - DNA, 17 bp, Homo sapiens
atgtttaaatataaatg

SEQ ID NO: 777401 - DNA, 14 bp, Homo sapiens
atgtttaaatcatg

SEQ ID NO: 777402 - DNA, 15 bp, Homo sapiens
atgtttaaatcatgt

SEQ ID NO: 777403 - DNA, 14 bp, Homo sapiens
atgtttaaattgta

SEQ ID NO: 777404 - DNA, 15 bp, Homo sapiens
atgtttaaattgtaa

SEQ ID NO: 777405 - DNA, 17 bp, Homo sapiens
atgtttaaattgtaaat

SEQ ID NO: 777406 - DNA, 16 bp, Homo sapiens
atgtttaacaaatcta

SEQ ID NO: 777407 - DNA, 22 bp, Homo sapiens
atgtttaacaaatctaatctct

SEQ ID NO: 777408 - DNA, 20 bp, Homo sapiens
atgtttaagtattaacttac

SEQ ID NO: 777409 - DNA, 17 bp, Homo sapiens
atgtttaatctgttatg

SEQ ID NO: 777410 - DNA, 18 bp, Homo sapiens
atgtttaccgtgtgttat

SEQ ID NO: 777411 - DNA, 20 bp, Homo sapiens
atgtttagttttacatttta

SEQ ID NO: 777412 - DNA, 20 bp, Homo sapiens
atgtttataaatcttatgct

SEQ ID NO: 777413 - DNA, 17 bp, Homo sapiens
atgtttataactctagg

SEQ ID NO: 777414 - DNA, 13 bp, Homo sapiens
atgtttatactgt

SEQ ID NO: 777415 - DNA, 23 bp, Homo sapiens
atgtttatactgtatttctaaga

SEQ ID NO: 777416 - DNA, 14 bp, Homo sapiens
atgtttatgagcca

SEQ ID NO: 777417 - DNA, 15 bp, Homo sapiens
atgtttatgagccag

SEQ ID NO: 777418 - DNA, 20 bp, Homo sapiens
atgtttatgcaaggaaggaa

SEQ ID NO: 777419 - DNA, 21 bp, Homo sapiens
atgtttattggtatattttct

SEQ ID NO: 777420 - DNA, 22 bp, Homo sapiens
cacacctctgtccctcaaaatt

SEQ ID NO: 777421 - DNA, 16 bp, Homo sapiens
cacacctgaacttgcc

SEQ ID NO: 777422 - DNA, 20 bp, Homo sapiens
cacacctgagcgctgtggac

SEQ ID NO: 777423 - DNA, 21 bp, Homo sapiens
cacacctggctaattttttgt

SEQ ID NO: 777424 - DNA, 15 bp, Homo sapiens
cacaccttccccggg

SEQ ID NO: 777425 - DNA, 11 bp, Homo sapiens
cacacgatgca

SEQ ID NO: 777426 - DNA, 20 bp, Homo sapiens
cacacgatgcatttaataaa

SEQ ID NO: 777427 - DNA, 14 bp, Homo sapiens
cacacgcacacaca

SEQ ID NO: 777428 - DNA, 16 bp, Homo sapiens
cacacgcacacacaca

SEQ ID NO: 777429 - DNA, 14 bp, Homo sapiens
cacacgcacgcaca

SEQ ID NO: 777430 - DNA, 14 bp, Homo sapiens
cacacgcaggaact

SEQ ID NO: 777431 - DNA, 20 bp, Homo sapiens
cacacgcaggaactcccagc

SEQ ID NO: 777432 - DNA, 19 bp, Homo sapiens
cacacgcaggcggccaggg

SEQ ID NO: 777433 - DNA, 13 bp, Homo sapiens
cacacgcatgggc

SEQ ID NO: 777434 - DNA, 15 bp, Homo sapiens
cacacgccagctcct

SEQ ID NO: 777435 - DNA, 16 bp, Homo sapiens
cacacgccagctcctc

SEQ ID NO: 777436 - DNA, 20 bp, Homo sapiens
cacacgccagctcctctctg

SEQ ID NO: 777437 - DNA, 19 bp, Homo sapiens
cacacggactcccgggcca

SEQ ID NO: 777438 - DNA, 20 bp, Homo sapiens
cacacggaggcatctgcacc

SEQ ID NO: 777439 - DNA, 13 bp, Homo sapiens
cacacggcagccc

SEQ ID NO: 777440 - DNA, 14 bp, Homo sapiens
cacacggcagcccc

SEQ ID NO: 777441 - DNA, 20 bp, Homo sapiens
cacacggctggtcactctgc

SEQ ID NO: 777442 - DNA, 21 bp, Homo sapiens
cacacgggcgagctttctctc

SEQ ID NO: 777443 - DNA, 16 bp, Homo sapiens
cacacgttgacgggcc

SEQ ID NO: 777444 - DNA, 18 bp, Homo sapiens
cacactacacagcacacc

SEQ ID NO: 777445 - DNA, 21 bp, Homo sapiens
cacactaccgaatgtgtcttt

SEQ ID NO: 777446 - DNA, 19 bp, Homo sapiens
cacactagcctctccagga

SEQ ID NO: 777447 - DNA, 20 bp, Homo sapiens
cacactattaccatgagaag

SEQ ID NO: 777448 - DNA, 16 bp, Homo sapiens
cacactcaccagtggc

SEQ ID NO: 777449 - DNA, 14 bp, Homo sapiens
cacactcatcccct

SEQ ID NO: 777450 - DNA, 19 bp, Homo sapiens
cacactcatgcacacagat

SEQ ID NO: 777451 - DNA, 15 bp, Homo sapiens
cacactccactctga

SEQ ID NO: 777452 - DNA, 16 bp, Homo sapiens
cacactccactctgat

SEQ ID NO: 777453 - DNA, 21 bp, Homo sapiens
cacactcccaaggttggagcc

SEQ ID NO: 777454 - DNA, 16 bp, Homo sapiens
cacactctaaaccccg

SEQ ID NO: 777455 - DNA, 21 bp, Homo sapiens
cacactctcatgtccccttcc

SEQ ID NO: 777456 - DNA, 23 bp, Homo sapiens
cacactctcctgggccccaagga

SEQ ID NO: 777457 - DNA, 15 bp, Homo sapiens
cacactctctgcagc

SEQ ID NO: 777458 - DNA, 22 bp, Homo sapiens
cacactgaatcagctgctgact

SEQ ID NO: 777459 - DNA, 14 bp, Homo sapiens
cacactgagttcta

SEQ ID NO: 777460 - DNA, 14 bp, Homo sapiens
cacactgatgctta

SEQ ID NO: 777461 - DNA, 19 bp, Homo sapiens
cacactgatgggctggggc

SEQ ID NO: 777462 - DNA, 23 bp, Homo sapiens
cacactgatgggctggggcaggg

SEQ ID NO: 777463 - DNA, 20 bp, Homo sapiens
cacactgcaagagccttggt

SEQ ID NO: 777464 - DNA, 17 bp, Homo sapiens
cacactgccagaagaga

SEQ ID NO: 777465 - DNA, 20 bp, Homo sapiens
cacactgctgtcctctcccc

SEQ ID NO: 777466 - DNA, 12 bp, Homo sapiens
cacactggaccc

SEQ ID NO: 777467 - DNA, 18 bp, Homo sapiens
cacactggaccccactgg

SEQ ID NO: 777468 - DNA, 20 bp, Homo sapiens
cacactggactccggccctc

SEQ ID NO: 777469 - DNA, 15 bp, Homo sapiens
cacactgggcctgga

SEQ ID NO: 777470 - DNA, 23 bp, Homo sapiens
cacactgggcctggagccctggg

SEQ ID NO: 777471 - DNA, 19 bp, Homo sapiens
cacactggtacttagagtt

SEQ ID NO: 777472 - DNA, 20 bp, Homo sapiens
cacactggttctcaatgaaa

SEQ ID NO: 777473 - DNA, 18 bp, Homo sapiens
cacactgtcatgcttcat

SEQ ID NO: 777474 - DNA, 15 bp, Homo sapiens
cacactgtctggggc

SEQ ID NO: 777475 - DNA, 19 bp, Homo sapiens
cacactgtctggggcccca

SEQ ID NO: 777476 - DNA, 16 bp, Homo sapiens
cacactgtgccccaca

SEQ ID NO: 777477 - DNA, 20 bp, Homo sapiens
cacactgttacacgtgcctg

SEQ ID NO: 777478 - DNA, 23 bp, Homo sapiens
cacactgttacacgtgcctgtag

SEQ ID NO: 777479 - DNA, 19 bp, Homo sapiens
cacacttagccattgaaat

SEQ ID NO: 777480 - DNA, 14 bp, Homo sapiens
cacacttcaggctc

SEQ ID NO: 777481 - DNA, 18 bp, Homo sapiens
cacacttcaggctcttct

SEQ ID NO: 777482 - DNA, 23 bp, Homo sapiens
cacgattttctccagctcagaac

SEQ ID NO: 777483 - DNA, 18 bp, Homo sapiens
cacgcaagggcatcaggc

SEQ ID NO: 777484 - DNA, 20 bp, Homo sapiens
cacgcaagggcatcaggcac

SEQ ID NO: 777485 - DNA, 11 bp, Homo sapiens
cacgcaagtgc

SEQ ID NO: 777486 - DNA, 13 bp, Homo sapiens
cacgcaagtgcca

SEQ ID NO: 777487 - DNA, 13 bp, Homo sapiens
cacgcacacacac

SEQ ID NO: 777488 - DNA, 15 bp, Homo sapiens
cacgcacacacacac

SEQ ID NO: 777489 - DNA, 15 bp, Homo sapiens
cacgcacacacacat

SEQ ID NO: 777490 - DNA, 12 bp, Homo sapiens
cacgcacctgta

SEQ ID NO: 777491 - DNA, 13 bp, Homo sapiens
cacgcacctgtag

SEQ ID NO: 777492 - DNA, 17 bp, Homo sapiens
cacgcacgcacacacac

SEQ ID NO: 777493 - DNA, 13 bp, Homo sapiens
cacgcagacctgc

SEQ ID NO: 777494 - DNA, 21 bp, Homo sapiens
cacgcagacctgcagcgggca

SEQ ID NO: 777495 - DNA, 19 bp, Homo sapiens
cacgcaggaactcccagca

SEQ ID NO: 777496 - DNA, 13 bp, Homo sapiens
cacgcaggaccag

SEQ ID NO: 777497 - DNA, 15 bp, Homo sapiens
cacgcaggcggccag

SEQ ID NO: 777498 - DNA, 16 bp, Homo sapiens
cacgcaggcggggcag

SEQ ID NO: 777499 - DNA, 20 bp, Homo sapiens
cacgcaggggctctgagccc

SEQ ID NO: 777500 - DNA, 15 bp, Homo sapiens
cacgcatacacacat

SEQ ID NO: 777501 - DNA, 20 bp, Homo sapiens
cacgcatgggcattgcagcc

SEQ ID NO: 777502 - DNA, 11 bp, Homo sapiens
cacgccacccc

SEQ ID NO: 777503 - DNA, 13 bp, Homo sapiens
cacgccactgcct

SEQ ID NO: 777504 - DNA, 22 bp, Homo sapiens
cacgccagctcctctctgaagc

SEQ ID NO: 777505 - DNA, 15 bp, Homo sapiens
cacgcccacccccag

SEQ ID NO: 777506 - DNA, 14 bp, Homo sapiens
cacgcccatgtgtg

SEQ ID NO: 777507 - DNA, 16 bp, Homo sapiens
cacgccccgctgtgtc

SEQ ID NO: 777508 - DNA, 21 bp, Homo sapiens
cacgcccggggtggccacagc

SEQ ID NO: 777509 - DNA, 19 bp, Homo sapiens
cacgcccgtcctgcctgtg

SEQ ID NO: 777510 - DNA, 21 bp, Homo sapiens
cacgcccgtcctgcctgtggc

SEQ ID NO: 777511 - DNA, 17 bp, Homo sapiens
cacgccctactccactg

SEQ ID NO: 777512 - DNA, 19 bp, Homo sapiens
cacgccctactccactgcc

SEQ ID NO: 777513 - DNA, 22 bp, Homo sapiens
cacgccggcctctgctgccccc

SEQ ID NO: 777514 - DNA, 17 bp, Homo sapiens
cacgccgtctgtcctca

SEQ ID NO: 777515 - DNA, 19 bp, Homo sapiens
cacgcctatgatcccagca

SEQ ID NO: 777516 - DNA, 22 bp, Homo sapiens
cacgcctatgatcccagcactt

SEQ ID NO: 777517 - DNA, 22 bp, Homo sapiens
cacgcctatgccctgcccttcc

SEQ ID NO: 777518 - DNA, 22 bp, Homo sapiens
cacgcctcccactggggtccag

SEQ ID NO: 777519 - DNA, 14 bp, Homo sapiens
cacgcctcctggcc

SEQ ID NO: 777520 - DNA, 16 bp, Homo sapiens
cacgcctcctggccag

SEQ ID NO: 777521 - DNA, 18 bp, Homo sapiens
cacgcctcctggccagac

SEQ ID NO: 777522 - DNA, 12 bp, Homo sapiens
cacgcctgagcg

SEQ ID NO: 777523 - DNA, 20 bp, Homo sapiens
cacgcctgtaatcccagcac

SEQ ID NO: 777524 - DNA, 20 bp, Homo sapiens
cacgcctgtaatcctagcac

SEQ ID NO: 777525 - DNA, 22 bp, Homo sapiens
cacgcgcgagtgtgctgtatgg

SEQ ID NO: 777526 - DNA, 16 bp, Homo sapiens
cacgcgctctccacca

SEQ ID NO: 777527 - DNA, 18 bp, Homo sapiens
cacgcgctctccaccacc

SEQ ID NO: 777528 - DNA, 20 bp, Homo sapiens
cacgcggccttgtctgggtg

SEQ ID NO: 777529 - DNA, 21 bp, Homo sapiens
cacgcgtatgttcgttgcagc

SEQ ID NO: 777530 - DNA, 13 bp, Homo sapiens
cacgctcagtgcc

SEQ ID NO: 777531 - DNA, 17 bp, Homo sapiens
cacgctcccccgcagtc

SEQ ID NO: 777532 - DNA, 14 bp, Homo sapiens
cacgctccctgact

SEQ ID NO: 777533 - DNA, 20 bp, Homo sapiens
cacgctccctgacttctccc

SEQ ID NO: 777534 - DNA, 23 bp, Homo sapiens
cacgctccctgacttctcccccg

SEQ ID NO: 777535 - DNA, 14 bp, Homo sapiens
cacgctcgctgcca

SEQ ID NO: 777536 - DNA, 23 bp, Homo sapiens
cacgctcttgaggaagcccaggc

SEQ ID NO: 777537 - DNA, 15 bp, Homo sapiens
cacgctgcctgccaa

SEQ ID NO: 777538 - DNA, 12 bp, Homo sapiens
cacgctgcctgg

SEQ ID NO: 777539 - DNA, 16 bp, Homo sapiens
cacgctgcctggtctg

SEQ ID NO: 777540 - DNA, 14 bp, Homo sapiens
cacgctgtcctctc

SEQ ID NO: 777541 - DNA, 22 bp, Homo sapiens
cacgctgtcctctcgagcccag

SEQ ID NO: 777542 - DNA, 20 bp, Homo sapiens
cacgctgtctccagaccccc

SEQ ID NO: 777543 - DNA, 22 bp, Homo sapiens
cacgcttcaaggatatactgca

SEQ ID NO: 777544 - DNA, 14 bp, Homo sapiens
cacgcttctccgga

SEQ ID NO: 777545 - DNA, 19 bp, Homo sapiens
cacgcttgcgtatgtctgt

SEQ ID NO: 777546 - DNA, 14 bp, Homo sapiens
cacgctttcctgaa

SEQ ID NO: 777547 - DNA, 18 bp, Homo sapiens
cacgctttgatgagcatt

SEQ ID NO: 777548 - DNA, 13 bp, Homo sapiens
cacggaaacagaa

SEQ ID NO: 777549 - DNA, 15 bp, Homo sapiens
cacggaaacagaact

SEQ ID NO: 777550 - DNA, 24 bp, Homo sapiens
cacggaaacatacagaggatgcct

SEQ ID NO: 777551 - DNA, 22 bp, Homo sapiens
cacggaagagccttgcggaagg

SEQ ID NO: 777552 - DNA, 15 bp, Homo sapiens
cacggaagttttcaa

SEQ ID NO: 777553 - DNA, 18 bp, Homo sapiens
cacggacgtttccatcag

SEQ ID NO: 777554 - DNA, 23 bp, Homo sapiens
cacggactctcccaggcctgcct

SEQ ID NO: 777555 - DNA, 18 bp, Homo sapiens
cacggactgaggtgcctg

SEQ ID NO: 777556 - DNA, 20 bp, Homo sapiens
cacggactgaggtgcctgct

SEQ ID NO: 777557 - DNA, 22 bp, Homo sapiens
cacggagagaaggcccatacct

SEQ ID NO: 777558 - DNA, 16 bp, Homo sapiens
cacggagaggccactg

SEQ ID NO: 777559 - DNA, 20 bp, Homo sapiens
cacggagcagttcagagtgg

SEQ ID NO: 777560 - DNA, 15 bp, Homo sapiens
cacggagccactcct

SEQ ID NO: 777561 - DNA, 16 bp, Homo sapiens
cacggagccactcctc

SEQ ID NO: 777562 - DNA, 17 bp, Homo sapiens
cacggagccactcctct

SEQ ID NO: 777563 - DNA, 23 bp, Homo sapiens
cacggatccatgtagcaggactg

SEQ ID NO: 777564 - DNA, 17 bp, Homo sapiens
cacggatggtgcatggg

SEQ ID NO: 777565 - DNA, 17 bp, Homo sapiens
cacggcagcccccccct

SEQ ID NO: 777566 - DNA, 22 bp, Homo sapiens
cacggcagcccccccctcaagg

SEQ ID NO: 777567 - DNA, 23 bp, Homo sapiens
cacggcagcccccccctcaaggg

SEQ ID NO: 777568 - DNA, 23 bp, Homo sapiens
cacggcatcgcatccgtcctggg

SEQ ID NO: 777569 - DNA, 11 bp, Homo sapiens
cacggccaccc

SEQ ID NO: 777570 - DNA, 13 bp, Homo sapiens
cactacattctgt

SEQ ID NO: 777571 - DNA, 16 bp, Homo sapiens
cactacattctgttaa

SEQ ID NO: 777572 - DNA, 21 bp, Homo sapiens
cactaccaaacactcagtcca

SEQ ID NO: 777573 - DNA, 14 bp, Homo sapiens
cactaccagccagc

SEQ ID NO: 777574 - DNA, 20 bp, Homo sapiens
cactaccgaatgtgtcttta

SEQ ID NO: 777575 - DNA, 23 bp, Homo sapiens
cactaccgaatgtgtctttagat

SEQ ID NO: 777576 - DNA, 22 bp, Homo sapiens
cactacgcatgactaatttttt

SEQ ID NO: 777577 - DNA, 13 bp, Homo sapiens
cactactctgtgc

SEQ ID NO: 777578 - DNA, 14 bp, Homo sapiens
cactactctgtgcc

SEQ ID NO: 777579 - DNA, 13 bp, Homo sapiens
cactactgacatg

SEQ ID NO: 777580 - DNA, 17 bp, Homo sapiens
cactactgctaaatcct

SEQ ID NO: 777581 - DNA, 12 bp, Homo sapiens
cactactgggtg

SEQ ID NO: 777582 - DNA, 15 bp, Homo sapiens
cactactgggtgtca

SEQ ID NO: 777583 - DNA, 13 bp, Homo sapiens
cactagaagaaaa

SEQ ID NO: 777584 - DNA, 18 bp, Homo sapiens
cactagaagaaaagccca

SEQ ID NO: 777585 - DNA, 23 bp, Homo sapiens
cactagagctgagagtctgaaag

SEQ ID NO: 777586 - DNA, 22 bp, Homo sapiens
cactagagggcccatcaggcag

SEQ ID NO: 777587 - DNA, 16 bp, Homo sapiens
cactagccagacactc

SEQ ID NO: 777588 - DNA, 20 bp, Homo sapiens
cactagccagacactctgct

SEQ ID NO: 777589 - DNA, 16 bp, Homo sapiens
cactagcccaatgaaa

SEQ ID NO: 777590 - DNA, 14 bp, Homo sapiens
cactagcctctcca

SEQ ID NO: 777591 - DNA, 21 bp, Homo sapiens
cactagcctctccaggaatgc

SEQ ID NO: 777592 - DNA, 13 bp, Homo sapiens
cactagcttactg

SEQ ID NO: 777593 - DNA, 11 bp, Homo sapiens
cactaggaatt

SEQ ID NO: 777594 - DNA, 13 bp, Homo sapiens
cactaggaattct

SEQ ID NO: 777595 - DNA, 18 bp, Homo sapiens
cactaggactctgaggct

SEQ ID NO: 777596 - DNA, 13 bp, Homo sapiens
cactaggcaggta

SEQ ID NO: 777597 - DNA, 17 bp, Homo sapiens
cactaggcccccacttg

SEQ ID NO: 777598 - DNA, 21 bp, Homo sapiens
cactaggcccccacttgcctc

SEQ ID NO: 777599 - DNA, 23 bp, Homo sapiens
cactaggcccccacttgcctctt

SEQ ID NO: 777600 - DNA, 20 bp, Homo sapiens
cactaggggatataggagag

SEQ ID NO: 777601 - DNA, 14 bp, Homo sapiens
cactaggtaactta

SEQ ID NO: 777602 - DNA, 12 bp, Homo sapiens
cactataaatgg

SEQ ID NO: 777603 - DNA, 19 bp, Homo sapiens
cactataaatggtgttttt

SEQ ID NO: 777604 - DNA, 18 bp, Homo sapiens
cactataatgtaagctct

SEQ ID NO: 777605 - DNA, 14 bp, Homo sapiens
cactatacagattc

SEQ ID NO: 777606 - DNA, 23 bp, Homo sapiens
cactatactctaaaatggacatt

SEQ ID NO: 777607 - DNA, 13 bp, Homo sapiens
cactatataaata

SEQ ID NO: 777608 - DNA, 15 bp, Homo sapiens
cactatataaataag

SEQ ID NO: 777609 - DNA, 17 bp, Homo sapiens
cactatatcttcccatt

SEQ ID NO: 777610 - DNA, 19 bp, Homo sapiens
cactatcccaatcaaagaa

SEQ ID NO: 777611 - DNA, 12 bp, Homo sapiens
cactatgcattt

SEQ ID NO: 777612 - DNA, 15 bp, Homo sapiens
cactatgctttcctt

SEQ ID NO: 777613 - DNA, 13 bp, Homo sapiens
cactattgaaaaa

SEQ ID NO: 777614 - DNA, 15 bp, Homo sapiens
cactattgtaatcat

SEQ ID NO: 777615 - DNA, 22 bp, Homo sapiens
cactatttatttacaaatgttt

SEQ ID NO: 777616 - DNA, 20 bp, Homo sapiens
cactattttcactagggctg

SEQ ID NO: 777617 - DNA, 16 bp, Homo sapiens
cactcaaattaatctt

SEQ ID NO: 777618 - DNA, 18 bp, Homo sapiens
cactcaaccataacactt

SEQ ID NO: 777619 - DNA, 18 bp, Homo sapiens
cactcaactctgagccca

SEQ ID NO: 777620 - DNA, 20 bp, Homo sapiens
cactcaactctgagcccata

SEQ ID NO: 777621 - DNA, 19 bp, Homo sapiens
cactcaagccagtgttgct

SEQ ID NO: 777622 - DNA, 18 bp, Homo sapiens
cactcaaggacaggagcc

SEQ ID NO: 777623 - DNA, 13 bp, Homo sapiens
cactcaataaatt

SEQ ID NO: 777624 - DNA, 20 bp, Homo sapiens
cactcacaatttaaaatatt

SEQ ID NO: 777625 - DNA, 12 bp, Homo sapiens
cactcacacagg

SEQ ID NO: 777626 - DNA, 21 bp, Homo sapiens
cactcacacaggacccccttc

SEQ ID NO: 777627 - DNA, 19 bp, Homo sapiens
cactcacagacctggagcc

SEQ ID NO: 777628 - DNA, 23 bp, Homo sapiens
cactcacagacctggagcccctg

SEQ ID NO: 777629 - DNA, 19 bp, Homo sapiens
cactcaccacaagctgagc

SEQ ID NO: 777630 - DNA, 12 bp, Homo sapiens
cactcaccagcc

SEQ ID NO: 777631 - DNA, 18 bp, Homo sapiens
cactcaccagccctagct

SEQ ID NO: 777632 - DNA, 12 bp, Homo sapiens
cactcaccaggg

SEQ ID NO: 777633 - DNA, 16 bp, Homo sapiens
cactcaccagtggcct

SEQ ID NO: 777634 - DNA, 21 bp, Homo sapiens
cactcaccagtgtcccctcca

SEQ ID NO: 777635 - DNA, 21 bp, Homo sapiens
cactcacccatgtgccaaggt

SEQ ID NO: 777636 - DNA, 22 bp, Homo sapiens
cactcacccatgtgccaaggtg

SEQ ID NO: 777637 - DNA, 16 bp, Homo sapiens
cactcaccccagcctc

SEQ ID NO: 777638 - DNA, 21 bp, Homo sapiens
cactcaccccctttgctgtga

SEQ ID NO: 777639 - DNA, 20 bp, Homo sapiens
cactcacccttcctggccca

SEQ ID NO: 777640 - DNA, 17 bp, Homo sapiens
cactcactaggccccca

SEQ ID NO: 777641 - DNA, 15 bp, Homo sapiens
cactcactcactcat

SEQ ID NO: 777642 - DNA, 17 bp, Homo sapiens
cactcactcactccaag

SEQ ID NO: 777643 - DNA, 18 bp, Homo sapiens
cactcactcactccaaga

SEQ ID NO: 777644 - DNA, 17 bp, Homo sapiens
cactcactcactcccca

SEQ ID NO: 777645 - DNA, 23 bp, Homo sapiens
cactcactccaagaccaccaggg

SEQ ID NO: 777646 - DNA, 14 bp, Homo sapiens
cactcactccagcc

SEQ ID NO: 777647 - DNA, 15 bp, Homo sapiens
cactcactccagccc

SEQ ID NO: 777648 - DNA, 12 bp, Homo sapiens
cactcagacctg

SEQ ID NO: 777649 - DNA, 17 bp, Homo sapiens
cactcagaggcccccag

SEQ ID NO: 777650 - DNA, 22 bp, Homo sapiens
cactcagcacaaggccatctgg

SEQ ID NO: 777651 - DNA, 22 bp, Homo sapiens
cactcagccatttccccctcct

SEQ ID NO: 777652 - DNA, 18 bp, Homo sapiens
cactcagcccctacccct

SEQ ID NO: 777653 - DNA, 21 bp, Homo sapiens
cactcagcccctacccctgcc

SEQ ID NO: 777654 - DNA, 22 bp, Homo sapiens
cactcagcccctacccctgccc

SEQ ID NO: 777655 - DNA, 18 bp, Homo sapiens
cactcagcccctaggagt

SEQ ID NO: 777656 - DNA, 22 bp, Homo sapiens
cactcagcccctaggagtatat

SEQ ID NO: 777657 - DNA, 13 bp, Homo sapiens
cactcagcctcat

SEQ ID NO: 777658 - DNA, 20 bp, Homo sapiens
cactcagctgtcctgcagca

SEQ ID NO: 777659 - DNA, 20 bp, Homo sapiens
cactcaggaggctgaggcag

SEQ ID NO: 777660 - DNA, 15 bp, Homo sapiens
cactcaggattggga

SEQ ID NO: 777661 - DNA, 19 bp, Homo sapiens
cactcaggccaacaagcca

SEQ ID NO: 777662 - DNA, 13 bp, Homo sapiens
cactcagggcagc

SEQ ID NO: 777663 - DNA, 14 bp, Homo sapiens
cactcagggcagct

SEQ ID NO: 777664 - DNA, 17 bp, Homo sapiens
cactcagggcagctgcc

SEQ ID NO: 777665 - DNA, 22 bp, Homo sapiens
cactcagggcagctgcctggcc

SEQ ID NO: 777666 - DNA, 18 bp, Homo sapiens
cactcaggggaccccact

SEQ ID NO: 777667 - DNA, 18 bp, Homo sapiens
cactcagtctctcttctc

SEQ ID NO: 777668 - DNA, 20 bp, Homo sapiens
cactcagtgagcctcctgtg

SEQ ID NO: 777669 - DNA, 21 bp, Homo sapiens
cactcagtgagcctcctgtgc

SEQ ID NO: 777670 - DNA, 22 bp, Homo sapiens
cactcagtgagcctcctgtgcc

SEQ ID NO: 777671 - DNA, 23 bp, Homo sapiens
cactcagtgagcctcctgtgcct

SEQ ID NO: 777672 - DNA, 19 bp, Homo sapiens
cactcagtgcagcaatata

SEQ ID NO: 777673 - DNA, 19 bp, Homo sapiens
cactcagtgcctccacatg

SEQ ID NO: 777674 - DNA, 15 bp, Homo sapiens
cactcatagggtgct

SEQ ID NO: 777675 - DNA, 20 bp, Homo sapiens
cactcatcaatggggccagt

SEQ ID NO: 777676 - DNA, 24 bp, Homo sapiens
cactcatctactgaatgacctctc

SEQ ID NO: 777677 - DNA, 14 bp, Homo sapiens
cactcatttcatct

SEQ ID NO: 777678 - DNA, 17 bp, Homo sapiens
cactcatttcatctcat

SEQ ID NO: 777679 - DNA, 14 bp, Homo sapiens
cactccaagaccac

SEQ ID NO: 777680 - DNA, 17 bp, Homo sapiens
cactccaagccccctgg

SEQ ID NO: 777681 - DNA, 13 bp, Homo sapiens
cactccacagtgt

SEQ ID NO: 777682 - DNA, 19 bp, Homo sapiens
cactccacagtgtttatat

SEQ ID NO: 777683 - DNA, 13 bp, Homo sapiens
cactccaccatcc

SEQ ID NO: 777684 - DNA, 21 bp, Homo sapiens
cactccaccctccaccttcca

SEQ ID NO: 777685 - DNA, 15 bp, Homo sapiens
cactccaccctgtta

SEQ ID NO: 777686 - DNA, 16 bp, Homo sapiens
cactccaccctgttag

SEQ ID NO: 777687 - DNA, 12 bp, Homo sapiens
cactccagagaa

SEQ ID NO: 777688 - DNA, 14 bp, Homo sapiens
cactccctgagctt

SEQ ID NO: 777689 - DNA, 16 bp, Homo sapiens
cactccctgctccacg

SEQ ID NO: 777690 - DNA, 20 bp, Homo sapiens
cactccctgctccacgaagc

SEQ ID NO: 777691 - DNA, 15 bp, Homo sapiens
cactccctggccttg

SEQ ID NO: 777692 - DNA, 16 bp, Homo sapiens
cactccctggccttgc

SEQ ID NO: 777693 - DNA, 18 bp, Homo sapiens
cactcccttgctggcccc

SEQ ID NO: 777694 - DNA, 13 bp, Homo sapiens
cactcccttgggc

SEQ ID NO: 777695 - DNA, 19 bp, Homo sapiens
cactccgagaggtgggcca

SEQ ID NO: 777696 - DNA, 20 bp, Homo sapiens
cactccgcgccgatgccacc

SEQ ID NO: 777697 - DNA, 22 bp, Homo sapiens
cactccgcgccgatgccaccgg

SEQ ID NO: 777698 - DNA, 20 bp, Homo sapiens
cactccggcctgatgacaga

SEQ ID NO: 777699 - DNA, 19 bp, Homo sapiens
cactccggtgtgcctgcag

SEQ ID NO: 777700 - DNA, 21 bp, Homo sapiens
cactccggtgtgcctgcagcc

SEQ ID NO: 777701 - DNA, 22 bp, Homo sapiens
cactccggtgtgcctgcagccc

SEQ ID NO: 777702 - DNA, 13 bp, Homo sapiens
cactcctacctgg

SEQ ID NO: 777703 - DNA, 16 bp, Homo sapiens
cactcctaggagagcc

SEQ ID NO: 777704 - DNA, 15 bp, Homo sapiens
cactcctcaagactt

SEQ ID NO: 777705 - DNA, 16 bp, Homo sapiens
cactcctcaagacttt

SEQ ID NO: 777706 - DNA, 12 bp, Homo sapiens
cactcctcacac

SEQ ID NO: 777707 - DNA, 14 bp, Homo sapiens
cactcctccctccg

SEQ ID NO: 777708 - DNA, 19 bp, Homo sapiens
cactcctcctcactaaaaa

SEQ ID NO: 777709 - DNA, 20 bp, Homo sapiens
cactcctctactcttacaga

SEQ ID NO: 777710 - DNA, 15 bp, Homo sapiens
cactcctctcccttg

SEQ ID NO: 777711 - DNA, 12 bp, Homo sapiens
cactcctctgac

SEQ ID NO: 777712 - DNA, 13 bp, Homo sapiens
cactcctctgact

SEQ ID NO: 777713 - DNA, 13 bp, Homo sapiens
cactcctctgctg

SEQ ID NO: 777714 - DNA, 18 bp, Homo sapiens
cactcctctgctgacctg

SEQ ID NO: 777715 - DNA, 21 bp, Homo sapiens
cactcctctgctgacctgctg

SEQ ID NO: 777716 - DNA, 21 bp, Homo sapiens
cactcctgacccctctcctca

SEQ ID NO: 777717 - DNA, 22 bp, Homo sapiens
cactcctgacccctctcctcaa

SEQ ID NO: 777718 - DNA, 20 bp, Homo sapiens
cactcctgcttctctcagcc

SEQ ID NO: 777719 - DNA, 12 bp, Homo sapiens
cactcctggggc

SEQ ID NO: 777720 - DNA, 19 bp, Homo sapiens
cactcctggggcctcttgg

SEQ ID NO: 777721 - DNA, 18 bp, Homo sapiens
cactcctgtcccgccttc

SEQ ID NO: 777722 - DNA, 12 bp, Homo sapiens
cactccttcctt

SEQ ID NO: 777723 - DNA, 17 bp, Homo sapiens
cactccttccttcagga

SEQ ID NO: 777724 - DNA, 15 bp, Homo sapiens
cactccttttaaaga

SEQ ID NO: 777725 - DNA, 16 bp, Homo sapiens
cactcgagaccatcct

SEQ ID NO: 777726 - DNA, 22 bp, Homo sapiens
cactcgagaccatcctggcccc

SEQ ID NO: 777727 - DNA, 12 bp, Homo sapiens
cactcgcaggac

SEQ ID NO: 777728 - DNA, 21 bp, Homo sapiens
cactcgccatttcctcacgtg

SEQ ID NO: 777729 - DNA, 24 bp, Homo sapiens
cactcgccatttcctcacgtgcag

SEQ ID NO: 777730 - DNA, 23 bp, Homo sapiens
cactcgcccgcccactgtcctgg

SEQ ID NO: 777731 - DNA, 14 bp, Homo sapiens
cactcgcgtgttcc

SEQ ID NO: 777732 - DNA, 17 bp, Homo sapiens
cactcggagggtgccct

SEQ ID NO: 777733 - DNA, 12 bp, Homo sapiens
cactcggtccca

SEQ ID NO: 777734 - DNA, 20 bp, Homo sapiens
cactcgtgtgcaacagacaa

SEQ ID NO: 777735 - DNA, 18 bp, Homo sapiens
cactctaagtcatgtatg

SEQ ID NO: 777736 - DNA, 16 bp, Homo sapiens
cactctaattagagaa

SEQ ID NO: 777737 - DNA, 15 bp, Homo sapiens
cactctaccctccca

SEQ ID NO: 777738 - DNA, 18 bp, Homo sapiens
cactctaccctcccaccc

SEQ ID NO: 777739 - DNA, 19 bp, Homo sapiens
cactctaggggtcaggctc

SEQ ID NO: 777740 - DNA, 22 bp, Homo sapiens
cactctagtgacttcctggtga

SEQ ID NO: 777741 - DNA, 23 bp, Homo sapiens
cactctagtgacttcctggtgag

SEQ ID NO: 777742 - DNA, 13 bp, Homo sapiens
cactctagttcta

SEQ ID NO: 777743 - DNA, 14 bp, Homo sapiens
cactctcaccccaa

SEQ ID NO: 777744 - DNA, 14 bp, Homo sapiens
cactctcatgtccc

SEQ ID NO: 777745 - DNA, 19 bp, Homo sapiens
cactctcatgtccccttcc

SEQ ID NO: 777746 - DNA, 12 bp, Homo sapiens
cactctcccctc

SEQ ID NO: 777747 - DNA, 18 bp, Homo sapiens
cactctcccctccctctt

SEQ ID NO: 777748 - DNA, 22 bp, Homo sapiens
cactctcccctccctcttcctt

SEQ ID NO: 777749 - DNA, 21 bp, Homo sapiens
cactctcctgggccccaagga

SEQ ID NO: 777750 - DNA, 22 bp, Homo sapiens
cactctctattgtcatggggat

SEQ ID NO: 777751 - DNA, 19 bp, Homo sapiens
cactctctcacccaccagc

SEQ ID NO: 777752 - DNA, 22 bp, Homo sapiens
cactctctcacccaccagctcc

SEQ ID NO: 777753 - DNA, 11 bp, Homo sapiens
cactctctgca

SEQ ID NO: 777754 - DNA, 12 bp, Homo sapiens
cactctctgcag

SEQ ID NO: 777755 - DNA, 16 bp, Homo sapiens
cactctctgcagccca

SEQ ID NO: 777756 - DNA, 14 bp, Homo sapiens
cactctctgcagtc

SEQ ID NO: 777757 - DNA, 14 bp, Homo sapiens
cactctctgcccct

SEQ ID NO: 777758 - DNA, 23 bp, Homo sapiens
cactctctgcccctaaagatggg

SEQ ID NO: 777759 - DNA, 15 bp, Homo sapiens
cactctctgggactc

SEQ ID NO: 777760 - DNA, 23 bp, Homo sapiens
cactctgagtcacaggtgtggga

SEQ ID NO: 777761 - DNA, 16 bp, Homo sapiens
cactctgattcacctc

SEQ ID NO: 777762 - DNA, 13 bp, Homo sapiens
cactctgccccca

SEQ ID NO: 777763 - DNA, 13 bp, Homo sapiens
cactctgccctct

SEQ ID NO: 777764 - DNA, 14 bp, Homo sapiens
cactctgccctctg

SEQ ID NO: 777765 - DNA, 22 bp, Homo sapiens
cactctgccctctgctgctgcc

SEQ ID NO: 777766 - DNA, 12 bp, Homo sapiens
cactctgcctgc

SEQ ID NO: 777767 - DNA, 14 bp, Homo sapiens
cactctgcctgcct

SEQ ID NO: 777768 - DNA, 21 bp, Homo sapiens
cactctgctctgcccttgttc

SEQ ID NO: 777769 - DNA, 12 bp, Homo sapiens
cactctgctgct

SEQ ID NO: 777770 - DNA, 14 bp, Homo sapiens
cactctgctgctta

SEQ ID NO: 777771 - DNA, 13 bp, Homo sapiens
cactctgcttctc

SEQ ID NO: 777772 - DNA, 14 bp, Homo sapiens
cactctgcttctct

SEQ ID NO: 777773 - DNA, 16 bp, Homo sapiens
cactctgcttctctga

SEQ ID NO: 777774 - DNA, 19 bp, Homo sapiens
cactctggattcagccttc

SEQ ID NO: 777775 - DNA, 12 bp, Homo sapiens
cactctggcctc

SEQ ID NO: 777776 - DNA, 20 bp, Homo sapiens
cactctggcggtggccacag

SEQ ID NO: 777777 - DNA, 12 bp, Homo sapiens
cactctggtggc

SEQ ID NO: 777778 - DNA, 20 bp, Homo sapiens
cactctgtaatagttcagta

SEQ ID NO: 777779 - DNA, 23 bp, Homo sapiens
cactctgtaattgaatattattc

SEQ ID NO: 777780 - DNA, 16 bp, Homo sapiens
cactgctgttcctgct

SEQ ID NO: 777781 - DNA, 21 bp, Homo sapiens
cactgctgttcctgctccatg

SEQ ID NO: 777782 - DNA, 17 bp, Homo sapiens
cactgcttctcttttga

SEQ ID NO: 777783 - DNA, 17 bp, Homo sapiens
cactgcttgaactaggc

SEQ ID NO: 777784 - DNA, 13 bp, Homo sapiens
cactgcttgagga

SEQ ID NO: 777785 - DNA, 20 bp, Homo sapiens
cactgcttgaggaaaacaag

SEQ ID NO: 777786 - DNA, 21 bp, Homo sapiens
cactgcttttccctttgtgag

SEQ ID NO: 777787 - DNA, 22 bp, Homo sapiens
cactggaaaggggagagcctgc

SEQ ID NO: 777788 - DNA, 14 bp, Homo sapiens
cactggaacattcc

SEQ ID NO: 777789 - DNA, 22 bp, Homo sapiens
cactggaatataaaacagtcat

SEQ ID NO: 777790 - DNA, 13 bp, Homo sapiens
cactggaatgaag

SEQ ID NO: 777791 - DNA, 19 bp, Homo sapiens
cactggaatgaagaccatg

SEQ ID NO: 777792 - DNA, 14 bp, Homo sapiens
cactggacaacact

SEQ ID NO: 777793 - DNA, 20 bp, Homo sapiens
cactggacatggcccattgg

SEQ ID NO: 777794 - DNA, 21 bp, Homo sapiens
cactggacatggcccattgga

SEQ ID NO: 777795 - DNA, 23 bp, Homo sapiens
cactggactgcatggggaggcag

SEQ ID NO: 777796 - DNA, 17 bp, Homo sapiens
cactggagcaccaggca

SEQ ID NO: 777797 - DNA, 16 bp, Homo sapiens
cactggagccacaggc

SEQ ID NO: 777798 - DNA, 11 bp, Homo sapiens
cactggagccc

SEQ ID NO: 777799 - DNA, 14 bp, Homo sapiens
cactggagcccagg

SEQ ID NO: 777800 - DNA, 16 bp, Homo sapiens
cactggaggagagaag

SEQ ID NO: 777801 - DNA, 16 bp, Homo sapiens
cactggaggagcagct

SEQ ID NO: 777802 - DNA, 16 bp, Homo sapiens
cactggagtgcaggga

SEQ ID NO: 777803 - DNA, 17 bp, Homo sapiens
cactggagtgcagggag

SEQ ID NO: 777804 - DNA, 18 bp, Homo sapiens
cactggagtgcagggagg

SEQ ID NO: 777805 - DNA, 23 bp, Homo sapiens
cactggagtgcagggaggagagg

SEQ ID NO: 777806 - DNA, 16 bp, Homo sapiens
cactggcaatgaaaaa

SEQ ID NO: 777807 - DNA, 14 bp, Homo sapiens
cactggcagagcac

SEQ ID NO: 777808 - DNA, 17 bp, Homo sapiens
cactggcagagcacagc

SEQ ID NO: 777809 - DNA, 19 bp, Homo sapiens
cactggcagagcacagccc

SEQ ID NO: 777810 - DNA, 20 bp, Homo sapiens
cactggcagagcacagccca

SEQ ID NO: 777811 - DNA, 22 bp, Homo sapiens
cactggcagagcacagcccacg

SEQ ID NO: 777812 - DNA, 17 bp, Homo sapiens
cactggcatcgcagctt

SEQ ID NO: 777813 - DNA, 20 bp, Homo sapiens
cactggcatcgcagcttcct

SEQ ID NO: 777814 - DNA, 12 bp, Homo sapiens
cactggccacca

SEQ ID NO: 777815 - DNA, 16 bp, Homo sapiens
cactggccaccaggct

SEQ ID NO: 777816 - DNA, 19 bp, Homo sapiens
cactggccaccaggctggc

SEQ ID NO: 777817 - DNA, 13 bp, Homo sapiens
cactggccagaga

SEQ ID NO: 777818 - DNA, 15 bp, Homo sapiens
cactggccagagagg

SEQ ID NO: 777819 - DNA, 17 bp, Homo sapiens
cactggccagagagggc

SEQ ID NO: 777820 - DNA, 20 bp, Homo sapiens
cactggccagagagggccca

SEQ ID NO: 777821 - DNA, 21 bp, Homo sapiens
cactggccagagagggcccag

SEQ ID NO: 777822 - DNA, 17 bp, Homo sapiens
cactggccgctgagcgc

SEQ ID NO: 777823 - DNA, 16 bp, Homo sapiens
cactggctaaagataa

SEQ ID NO: 777824 - DNA, 18 bp, Homo sapiens
cactggctcatgcccctt

SEQ ID NO: 777825 - DNA, 12 bp, Homo sapiens
cactggctctcc

SEQ ID NO: 777826 - DNA, 16 bp, Homo sapiens
cactggctctccaagt

SEQ ID NO: 777827 - DNA, 18 bp, Homo sapiens
cactggctctccaagtgc

SEQ ID NO: 777828 - DNA, 19 bp, Homo sapiens
cactggctctccaagtgcc

SEQ ID NO: 777829 - DNA, 14 bp, Homo sapiens
cactggctctcctg

SEQ ID NO: 777830 - DNA, 15 bp, Homo sapiens
cactggctctcctgg

SEQ ID NO: 777831 - DNA, 21 bp, Homo sapiens
cactggctctcctggccctgg

SEQ ID NO: 777832 - DNA, 22 bp, Homo sapiens
cactggctgagaatctgggggt

SEQ ID NO: 777833 - DNA, 13 bp, Homo sapiens
cactggctgggag

SEQ ID NO: 777834 - DNA, 15 bp, Homo sapiens
cactggctggggcag

SEQ ID NO: 777835 - DNA, 16 bp, Homo sapiens
cactggctggggcaga

SEQ ID NO: 777836 - DNA, 23 bp, Homo sapiens
cactggctggggcagaggggcag

SEQ ID NO: 777837 - DNA, 18 bp, Homo sapiens
cactgggaaacagaggct

SEQ ID NO: 777838 - DNA, 15 bp, Homo sapiens
cactgggaagctgga

SEQ ID NO: 777839 - DNA, 16 bp, Homo sapiens
cactgggaagctggag

SEQ ID NO: 777840 - DNA, 10 bp, Homo sapiens
cactgggact

SEQ ID NO: 777841 - DNA, 15 bp, Homo sapiens
cactgggactcccag

SEQ ID NO: 777842 - DNA, 15 bp, Homo sapiens
cactgggcacctgcg

SEQ ID NO: 777843 - DNA, 21 bp, Homo sapiens
cactgggcacctgcgcacagg

SEQ ID NO: 777844 - DNA, 23 bp, Homo sapiens
cactgggcacctgcgcacaggtg

SEQ ID NO: 777845 - DNA, 16 bp, Homo sapiens
cactgggcagcaaggc

SEQ ID NO: 777846 - DNA, 17 bp, Homo sapiens
cactgggcagcaaggct

SEQ ID NO: 777847 - DNA, 12 bp, Homo sapiens
cactgggcaggt

SEQ ID NO: 777848 - DNA, 20 bp, Homo sapiens
cactgggcaggttcctgggg

SEQ ID NO: 777849 - DNA, 23 bp, Homo sapiens
cactgggcaggttcctggggccg

SEQ ID NO: 777850 - DNA, 19 bp, Homo sapiens
cactgggccagccctgcag

SEQ ID NO: 777851 - DNA, 20 bp, Homo sapiens
cactgggccagccctgcagc

SEQ ID NO: 777852 - DNA, 13 bp, Homo sapiens
cactgggcccctg

SEQ ID NO: 777853 - DNA, 16 bp, Homo sapiens
cactgggcccctgtcc

SEQ ID NO: 777854 - DNA, 15 bp, Homo sapiens
cactgggcctgctag

SEQ ID NO: 777855 - DNA, 22 bp, Homo sapiens
cactggggatggtggcacaggc

SEQ ID NO: 777856 - DNA, 18 bp, Homo sapiens
cactgggggaggagagga

SEQ ID NO: 777857 - DNA, 14 bp, Homo sapiens
cactgggggagggg

SEQ ID NO: 777858 - DNA, 18 bp, Homo sapiens
cactgggggaggggacat

SEQ ID NO: 777859 - DNA, 20 bp, Homo sapiens
cactgggtctcactcctgag

SEQ ID NO: 777860 - DNA, 19 bp, Homo sapiens
cactgggtgcgtctccagt

SEQ ID NO: 777861 - DNA, 23 bp, Homo sapiens
cactgggtggggtgaggaccact

SEQ ID NO: 777862 - DNA, 19 bp, Homo sapiens
cactgtgaaatttcatgat

SEQ ID NO: 777863 - DNA, 20 bp, Homo sapiens
cactgtgaacctgggcactc

SEQ ID NO: 777864 - DNA, 13 bp, Homo sapiens
cactgtgaagaga

SEQ ID NO: 777865 - DNA, 17 bp, Homo sapiens
cactgtgaatcctggca

SEQ ID NO: 777866 - DNA, 18 bp, Homo sapiens
cactgtgaatcctggcaa

SEQ ID NO: 777867 - DNA, 20 bp, Homo sapiens
cactgtgaatcctggcaaga

SEQ ID NO: 777868 - DNA, 15 bp, Homo sapiens
cactgtgacccccag

SEQ ID NO: 777869 - DNA, 19 bp, Homo sapiens
cactgtgacccccagctcc

SEQ ID NO: 777870 - DNA, 22 bp, Homo sapiens
cactgtgacccccagctccggc

SEQ ID NO: 777871 - DNA, 17 bp, Homo sapiens
cactgtgagagttgtct

SEQ ID NO: 777872 - DNA, 21 bp, Homo sapiens
cactgtgagagttgtctctgt

SEQ ID NO: 777873 - DNA, 17 bp, Homo sapiens
cactgtgaggggaaggc

SEQ ID NO: 777874 - DNA, 16 bp, Homo sapiens
cactgtgattttgccc

SEQ ID NO: 777875 - DNA, 21 bp, Homo sapiens
cactgtgattttgccctcctg

SEQ ID NO: 777876 - DNA, 20 bp, Homo sapiens
cactgtgcacatctgtgtct

SEQ ID NO: 777877 - DNA, 17 bp, Homo sapiens
cactgtgcccagcccgg

SEQ ID NO: 777878 - DNA, 19 bp, Homo sapiens
cactgtgccccgcgggctt

SEQ ID NO: 777879 - DNA, 16 bp, Homo sapiens
cactgtgccctggtgg

SEQ ID NO: 777880 - DNA, 17 bp, Homo sapiens
cactgtgccctggtgga

SEQ ID NO: 777881 - DNA, 13 bp, Homo sapiens
cactgtgcctcag

SEQ ID NO: 777882 - DNA, 21 bp, Homo sapiens
cactgtgcctttgcaaatcag

SEQ ID NO: 777883 - DNA, 17 bp, Homo sapiens
cactgtgccttttcccc

SEQ ID NO: 777884 - DNA, 19 bp, Homo sapiens
cactgtggaactaataaat

SEQ ID NO: 777885 - DNA, 23 bp, Homo sapiens
cactgtggacttggtcaccagct

SEQ ID NO: 777886 - DNA, 24 bp, Homo sapiens
cactgtggacttggtcaccagctc

SEQ ID NO: 777887 - DNA, 12 bp, Homo sapiens
cactgtggccac

SEQ ID NO: 777888 - DNA, 15 bp, Homo sapiens
cactgtggccacagc

SEQ ID NO: 777889 - DNA, 16 bp, Homo sapiens
cactgtggccacagcc

SEQ ID NO: 777890 - DNA, 17 bp, Homo sapiens
cactgtggccacagccc

SEQ ID NO: 777891 - DNA, 19 bp, Homo sapiens
cactgtggccacagccccc

SEQ ID NO: 777892 - DNA, 20 bp, Homo sapiens
cactgtggccacagccccct

SEQ ID NO: 777893 - DNA, 23 bp, Homo sapiens
cactgtggccagagctggaaggc

SEQ ID NO: 777894 - DNA, 17 bp, Homo sapiens
cactgtggccaggcctt

SEQ ID NO: 777895 - DNA, 14 bp, Homo sapiens
cactgtggccccaa

SEQ ID NO: 777896 - DNA, 17 bp, Homo sapiens
cactgtgggaaggccag

SEQ ID NO: 777897 - DNA, 20 bp, Homo sapiens
cactgtgggaaggccagctg

SEQ ID NO: 777898 - DNA, 16 bp, Homo sapiens
cactgtgggactcttc

SEQ ID NO: 777899 - DNA, 13 bp, Homo sapiens
cactgtggtggca

SEQ ID NO: 777900 - DNA, 14 bp, Homo sapiens
cactgtggtgtctg

SEQ ID NO: 777901 - DNA, 15 bp, Homo sapiens
cactgtggtttcaga

SEQ ID NO: 777902 - DNA, 16 bp, Homo sapiens
cactgtggtttcagat

SEQ ID NO: 777903 - DNA, 13 bp, Homo sapiens
cactgtgtctctg

SEQ ID NO: 777904 - DNA, 17 bp, Homo sapiens
cactgtgtctctgtttc

SEQ ID NO: 777905 - DNA, 18 bp, Homo sapiens
cactgtgtgaggctgtgt

SEQ ID NO: 777906 - DNA, 23 bp, Homo sapiens
cactgtgtgaggctgtgtctctg

SEQ ID NO: 777907 - DNA, 13 bp, Homo sapiens
cactgtgtgcctt

SEQ ID NO: 777908 - DNA, 17 bp, Homo sapiens
cactgtgtgttgacact

SEQ ID NO: 777909 - DNA, 13 bp, Homo sapiens
cactgtgtttagt

SEQ ID NO: 777910 - DNA, 18 bp, Homo sapiens
cactgttaatacacagta

SEQ ID NO: 777911 - DNA, 14 bp, Homo sapiens
cactgttccctctg

SEQ ID NO: 777912 - DNA, 14 bp, Homo sapiens
cactgttctgcaaa

SEQ ID NO: 777913 - DNA, 14 bp, Homo sapiens
cactgttgaaaatt

SEQ ID NO: 777914 - DNA, 13 bp, Homo sapiens
cactgttgaattt

SEQ ID NO: 777915 - DNA, 16 bp, Homo sapiens
cactgttgagccccag

SEQ ID NO: 777916 - DNA, 13 bp, Homo sapiens
cactgttgataaa

SEQ ID NO: 777917 - DNA, 14 bp, Homo sapiens
cactgttgataaaa

SEQ ID NO: 777918 - DNA, 17 bp, Homo sapiens
cactgttgataaaaact

SEQ ID NO: 777919 - DNA, 17 bp, Homo sapiens
cactgttgatgtatctg

SEQ ID NO: 777920 - DNA, 22 bp, Homo sapiens
cactgttgggtgggtgggccct

SEQ ID NO: 777921 - DNA, 17 bp, Homo sapiens
cactgtttacaagaaaa

SEQ ID NO: 777922 - DNA, 19 bp, Homo sapiens
cactgtttatacactgtgt

SEQ ID NO: 777923 - DNA, 19 bp, Homo sapiens
cactgtttcaaactttact

SEQ ID NO: 777924 - DNA, 18 bp, Homo sapiens
cactgtttctctgctgtt

SEQ ID NO: 777925 - DNA, 18 bp, Homo sapiens
cactgtttctcttgagct

SEQ ID NO: 777926 - DNA, 19 bp, Homo sapiens
cactgtttctcttgagctg

SEQ ID NO: 777927 - DNA, 15 bp, Homo sapiens
cactgtttttaatct

SEQ ID NO: 777928 - DNA, 14 bp, Homo sapiens
cacttaaaaaatgt

SEQ ID NO: 777929 - DNA, 17 bp, Homo sapiens
cacttaaagaagtattt

SEQ ID NO: 777930 - DNA, 23 bp, Homo sapiens
cacttaaccaagacaaaaagcca

SEQ ID NO: 777931 - DNA, 17 bp, Homo sapiens
cacttaagagaatattt

SEQ ID NO: 777932 - DNA, 12 bp, Homo sapiens
cacttaagcctg

SEQ ID NO: 777933 - DNA, 17 bp, Homo sapiens
cacttaaggcactctgt

SEQ ID NO: 777934 - DNA, 18 bp, Homo sapiens
cacttaagtcttccttaa

SEQ ID NO: 777935 - DNA, 18 bp, Homo sapiens
cacttaagtgcacttttt

SEQ ID NO: 777936 - DNA, 14 bp, Homo sapiens
cacttaagtgtctg

SEQ ID NO: 777937 - DNA, 20 bp, Homo sapiens
cacttaagttagttccactg

SEQ ID NO: 777938 - DNA, 22 bp, Homo sapiens
cacttaagttagttccactgag

SEQ ID NO: 777939 - DNA, 15 bp, Homo sapiens
cacttaatttgtaaa

SEQ ID NO: 777940 - DNA, 16 bp, Homo sapiens
cacttaatttgtaaac

SEQ ID NO: 777941 - DNA, 16 bp, Homo sapiens
cacttacactttatgc

SEQ ID NO: 777942 - DNA, 17 bp, Homo sapiens
cacttacagttaggatt

SEQ ID NO: 777943 - DNA, 20 bp, Homo sapiens
cacttacataaagctccctt

SEQ ID NO: 777944 - DNA, 15 bp, Homo sapiens
cacttaccgccctgc

SEQ ID NO: 777945 - DNA, 17 bp, Homo sapiens
cacttacgtaaaacatt

SEQ ID NO: 777946 - DNA, 17 bp, Homo sapiens
cacttagaaattgcatt

SEQ ID NO: 777947 - DNA, 19 bp, Homo sapiens
cacttagaaattgcatttc

SEQ ID NO: 777948 - DNA, 24 bp, Homo sapiens
cacttagaaattgcatttcctgac

SEQ ID NO: 777949 - DNA, 16 bp, Homo sapiens
cacttagaatagcatt

SEQ ID NO: 777950 - DNA, 22 bp, Homo sapiens
cacttagattaagattttactt

SEQ ID NO: 777951 - DNA, 15 bp, Homo sapiens
cacttagccgcaccc

SEQ ID NO: 777952 - DNA, 17 bp, Homo sapiens
cacttagccgcaccctg

SEQ ID NO: 777953 - DNA, 23 bp, Homo sapiens
cacttaggaacgtaatcgtgtcc

SEQ ID NO: 777954 - DNA, 16 bp, Homo sapiens
cacttagtatgcagtt

SEQ ID NO: 777955 - DNA, 22 bp, Homo sapiens
cacttagtattttaaaaaataa

SEQ ID NO: 777956 - DNA, 12 bp, Homo sapiens
cacttagtcctt

SEQ ID NO: 777957 - DNA, 14 bp, Homo sapiens
cacttatattttat

SEQ ID NO: 777958 - DNA, 16 bp, Homo sapiens
cacttatattttatga

SEQ ID NO: 777959 - DNA, 18 bp, Homo sapiens
cacttatattttatgaac

SEQ ID NO: 777960 - DNA, 20 bp, Homo sapiens
cacttatattttatgaacat

SEQ ID NO: 777961 - DNA, 15 bp, Homo sapiens
cacttatctgatact

SEQ ID NO: 777962 - DNA, 17 bp, Homo sapiens
cacttatgctgctgtga

SEQ ID NO: 777963 - DNA, 16 bp, Homo sapiens
cacttattattaataa

SEQ ID NO: 777964 - DNA, 15 bp, Homo sapiens
cacttattgaatata

SEQ ID NO: 777965 - DNA, 21 bp, Homo sapiens
cacttattggaactctgcttg

SEQ ID NO: 777966 - DNA, 15 bp, Homo sapiens
cacttattgtcccct

SEQ ID NO: 777967 - DNA, 14 bp, Homo sapiens
cacttatttatgaa

SEQ ID NO: 777968 - DNA, 23 bp, Homo sapiens
cacttatttatgaattgtctaaa

SEQ ID NO: 777969 - DNA, 22 bp, Homo sapiens
cacttatttattgttgcctttt

SEQ ID NO: 777970 - DNA, 17 bp, Homo sapiens
cacttcaaataattaaa

SEQ ID NO: 777971 - DNA, 14 bp, Homo sapiens
cacttcacagctgg

SEQ ID NO: 777972 - DNA, 13 bp, Homo sapiens
cacttcaccccca

SEQ ID NO: 777973 - DNA, 15 bp, Homo sapiens
cacttcacccccaac

SEQ ID NO: 777974 - DNA, 14 bp, Homo sapiens
cacttcaccctgga

SEQ ID NO: 777975 - DNA, 21 bp, Homo sapiens
cacttcactgcgaagaccctc

SEQ ID NO: 777976 - DNA, 12 bp, Homo sapiens
cacttcactgtg

SEQ ID NO: 777977 - DNA, 23 bp, Homo sapiens
cacttcagacacaggaaaaataa

SEQ ID NO: 777978 - DNA, 17 bp, Homo sapiens
cacttcagagagctggt

SEQ ID NO: 777979 - DNA, 12 bp, Homo sapiens
cacttcagatct

SEQ ID NO: 777980 - DNA, 16 bp, Homo sapiens
cacttcagatctgagg

SEQ ID NO: 777981 - DNA, 23 bp, Homo sapiens
cacttcaggctcttctcctttca

SEQ ID NO: 777982 - DNA, 12 bp, Homo sapiens
cacttcaggtcc

SEQ ID NO: 777983 - DNA, 14 bp, Homo sapiens
cacttcataatcca

SEQ ID NO: 777984 - DNA, 14 bp, Homo sapiens
cacttcattccagc

SEQ ID NO: 777985 - DNA, 16 bp, Homo sapiens
cacttcattccagcag

SEQ ID NO: 777986 - DNA, 14 bp, Homo sapiens
cacttccaggggaa

SEQ ID NO: 777987 - DNA, 13 bp, Homo sapiens
cacttccagggtt

SEQ ID NO: 777988 - DNA, 16 bp, Homo sapiens
cacttccagtctggag

SEQ ID NO: 777989 - DNA, 20 bp, Homo sapiens
cacttccagtgttggctgtg

SEQ ID NO: 777990 - DNA, 14 bp, Homo sapiens
cacttcccaccccc

SEQ ID NO: 777991 - DNA, 14 bp, Homo sapiens
cacttcccagtgga

SEQ ID NO: 777992 - DNA, 15 bp, Homo sapiens
cacttcccatctcca

SEQ ID NO: 777993 - DNA, 18 bp, Homo sapiens
cacttcccatctccaggg

SEQ ID NO: 777994 - DNA, 19 bp, Homo sapiens
cacttcccctccaagaccc

SEQ ID NO: 777995 - DNA, 13 bp, Homo sapiens
cacttccccttgt

SEQ ID NO: 777996 - DNA, 14 bp, Homo sapiens
cacttccccttgtc

SEQ ID NO: 777997 - DNA, 21 bp, Homo sapiens
cacttccccttgtctccctgg

SEQ ID NO: 777998 - DNA, 16 bp, Homo sapiens
cacttcccgtctcaga

SEQ ID NO: 777999 - DNA, 14 bp, Homo sapiens
cacttccctctgtt

SEQ ID NO: 778000 - DNA, 18 bp, Homo sapiens
cacttccctgcttaaatt

SEQ ID NO: 778001 - DNA, 13 bp, Homo sapiens
cacttccctggcg

SEQ ID NO: 778002 - DNA, 23 bp, Homo sapiens
cacttcctacaagagcagcctgt

SEQ ID NO: 778003 - DNA, 14 bp, Homo sapiens
cacttcctccacag

SEQ ID NO: 778004 - DNA, 13 bp, Homo sapiens
cacttcctcctac

SEQ ID NO: 778005 - DNA, 15 bp, Homo sapiens
cacttcctcctacct

SEQ ID NO: 778006 - DNA, 18 bp, Homo sapiens
cacttcctcctacctggg

SEQ ID NO: 778007 - DNA, 11 bp, Homo sapiens
cacttcctgcc

SEQ ID NO: 778008 - DNA, 13 bp, Homo sapiens
cacttcctgtcca

SEQ ID NO: 778009 - DNA, 14 bp, Homo sapiens
cacttcctgtcctt

SEQ ID NO: 778010 - DNA, 16 bp, Homo sapiens
cacttcctgtccttgt

SEQ ID NO: 778011 - DNA, 17 bp, Homo sapiens
cacttcctttcctactg

SEQ ID NO: 778012 - DNA, 23 bp, Homo sapiens
cacttcgcaccggagtgtctgga

SEQ ID NO: 778013 - DNA, 21 bp, Homo sapiens
cacttcgggaggtcgaggcag

SEQ ID NO: 778014 - DNA, 12 bp, Homo sapiens
cacttctattta

SEQ ID NO: 778015 - DNA, 17 bp, Homo sapiens
cacttctcatcatattg

SEQ ID NO: 778016 - DNA, 19 bp, Homo sapiens
cacttctcatcatattgta

SEQ ID NO: 778017 - DNA, 16 bp, Homo sapiens
cacttctccccagaaa

SEQ ID NO: 778018 - DNA, 17 bp, Homo sapiens
cacttctccccgcagcc

SEQ ID NO: 778019 - DNA, 19 bp, Homo sapiens
cacttctccccgcagcccg

SEQ ID NO: 778020 - DNA, 13 bp, Homo sapiens
cacttctctgctg

SEQ ID NO: 778021 - DNA, 15 bp, Homo sapiens
cacttctctgctgcc

SEQ ID NO: 778022 - DNA, 14 bp, Homo sapiens
cacttctctgggtc

SEQ ID NO: 778023 - DNA, 13 bp, Homo sapiens
cacttctgaccac

SEQ ID NO: 778024 - DNA, 14 bp, Homo sapiens
cacttctgccttga

SEQ ID NO: 778025 - DNA, 19 bp, Homo sapiens
cacttctgcgggctccctc

SEQ ID NO: 778026 - DNA, 22 bp, Homo sapiens
cacttctgcgggctccctcctc

SEQ ID NO: 778027 - DNA, 23 bp, Homo sapiens
cacttctgcgggctccctcctct

SEQ ID NO: 778028 - DNA, 12 bp, Homo sapiens
cacttctgcttt

SEQ ID NO: 778029 - DNA, 13 bp, Homo sapiens
cacttctggccac

SEQ ID NO: 778030 - DNA, 20 bp, Homo sapiens
cacttctggccacatcagcc

SEQ ID NO: 778031 - DNA, 18 bp, Homo sapiens
cacttctggcctccagcc

SEQ ID NO: 778032 - DNA, 20 bp, Homo sapiens
cacttctggcctccagcctt

SEQ ID NO: 778033 - DNA, 18 bp, Homo sapiens
cacttctggctcacagga

SEQ ID NO: 778034 - DNA, 11 bp, Homo sapiens
cacttctggga

SEQ ID NO: 778035 - DNA, 19 bp, Homo sapiens
cacttctggtcccctgtgg

SEQ ID NO: 778036 - DNA, 20 bp, Homo sapiens
cacttctgtgagacccccac

SEQ ID NO: 778037 - DNA, 15 bp, Homo sapiens
cacttctgtgggcat

SEQ ID NO: 778038 - DNA, 17 bp, Homo sapiens
cacttctgtgggcatgg

SEQ ID NO: 778039 - DNA, 18 bp, Homo sapiens
cacttctgtgggcatggc

SEQ ID NO: 778040 - DNA, 19 bp, Homo sapiens
cacttcttaaaggcctgga

SEQ ID NO: 778041 - DNA, 14 bp, Homo sapiens
cacttcttacccca

SEQ ID NO: 778042 - DNA, 12 bp, Homo sapiens
cacttcttcctt

SEQ ID NO: 778043 - DNA, 13 bp, Homo sapiens
cacttcttccttt

SEQ ID NO: 778044 - DNA, 15 bp, Homo sapiens
cacttcttcctttct

SEQ ID NO: 778045 - DNA, 16 bp, Homo sapiens
cacttcttcctttctc

SEQ ID NO: 778046 - DNA, 17 bp, Homo sapiens
cacttcttcctttctct

SEQ ID NO: 778047 - DNA, 17 bp, Homo sapiens
cacttcttgaaacagcc

SEQ ID NO: 778048 - DNA, 17 bp, Homo sapiens
cacttcttggttcctgg

SEQ ID NO: 778049 - DNA, 21 bp, Homo sapiens
cacttcttggttcctgggatg

SEQ ID NO: 778050 - DNA, 19 bp, Homo sapiens
cacttctttgcagagcctt

SEQ ID NO: 778051 - DNA, 13 bp, Homo sapiens
cacttgaatttat

SEQ ID NO: 778052 - DNA, 16 bp, Homo sapiens
cacttgaatttattga

SEQ ID NO: 778053 - DNA, 13 bp, Homo sapiens
cacttgagagaaa

SEQ ID NO: 778054 - DNA, 19 bp, Homo sapiens
cacttgatgacccccaacc

SEQ ID NO: 778055 - DNA, 18 bp, Homo sapiens
cacttgattcaggaggtc

SEQ ID NO: 778056 - DNA, 19 bp, Homo sapiens
cacttgattcatctctggt

SEQ ID NO: 778057 - DNA, 20 bp, Homo sapiens
cacttgattcatctctggtt

SEQ ID NO: 778058 - DNA, 22 bp, Homo sapiens
cacttgcagaggagcccagtgg

SEQ ID NO: 778059 - DNA, 20 bp, Homo sapiens
cacttgcaggggtccctgct

SEQ ID NO: 778060 - DNA, 21 bp, Homo sapiens
cacttgcaggggtccctgcta

SEQ ID NO: 778061 - DNA, 12 bp, Homo sapiens
cacttgcatttc

SEQ ID NO: 778062 - DNA, 16 bp, Homo sapiens
cacttgccaaaatcca

SEQ ID NO: 778063 - DNA, 20 bp, Homo sapiens
cacttgccattccaaaatat

SEQ ID NO: 778064 - DNA, 23 bp, Homo sapiens
cacttgccattgccaggagatgg

SEQ ID NO: 778065 - DNA, 22 bp, Homo sapiens
cacttgccctgttctcttcaca

SEQ ID NO: 778066 - DNA, 22 bp, Homo sapiens
cacttgccgcgtcgccctccca

SEQ ID NO: 778067 - DNA, 17 bp, Homo sapiens
cacttgcctcttccttg

SEQ ID NO: 778068 - DNA, 23 bp, Homo sapiens
cacttgcctggaataaaatataa

SEQ ID NO: 778069 - DNA, 12 bp, Homo sapiens
cacttgccttag

SEQ ID NO: 778070 - DNA, 15 bp, Homo sapiens
cacttgcgtcctgca

SEQ ID NO: 778071 - DNA, 14 bp, Homo sapiens
cacttgctggggct

SEQ ID NO: 778072 - DNA, 14 bp, Homo sapiens
cacttggcagcgcg

SEQ ID NO: 778073 - DNA, 21 bp, Homo sapiens
cacttggcatacaaaatattt

SEQ ID NO: 778074 - DNA, 19 bp, Homo sapiens
cacttgggagctgctgggc

SEQ ID NO: 778075 - DNA, 19 bp, Homo sapiens
cacttggttagacgccttc

SEQ ID NO: 778076 - DNA, 17 bp, Homo sapiens
cacttgtacaaaataaa

SEQ ID NO: 778077 - DNA, 13 bp, Homo sapiens
cacttgtatatac

SEQ ID NO: 778078 - DNA, 15 bp, Homo sapiens
cacttgtattgactt

SEQ ID NO: 778079 - DNA, 17 bp, Homo sapiens
cacttgtattgacttta

SEQ ID NO: 778080 - DNA, 14 bp, Homo sapiens
cacttgtcaaagaa

SEQ ID NO: 778081 - DNA, 15 bp, Homo sapiens
cacttgtccagctga

SEQ ID NO: 778082 - DNA, 19 bp, Homo sapiens
cacttgtcccactatctgg

SEQ ID NO: 778083 - DNA, 22 bp, Homo sapiens
cacttgtcccactatctgggtg

SEQ ID NO: 778084 - DNA, 14 bp, Homo sapiens
cacttgtcttgctc

SEQ ID NO: 778085 - DNA, 16 bp, Homo sapiens
cacttgtcttgctctt

SEQ ID NO: 778086 - DNA, 18 bp, Homo sapiens
cacttgtcttgctcttag

SEQ ID NO: 778087 - DNA, 17 bp, Homo sapiens
cacttgtgattatttat

SEQ ID NO: 778088 - DNA, 22 bp, Homo sapiens
cacttgtgcaccctctatccca

SEQ ID NO: 778089 - DNA, 16 bp, Homo sapiens
cacttgtgccagcccg

SEQ ID NO: 778090 - DNA, 17 bp, Homo sapiens
cacttgtgccagcccgg

SEQ ID NO: 778091 - DNA, 15 bp, Homo sapiens
cacttgtgctttgct

SEQ ID NO: 778092 - DNA, 21 bp, Homo sapiens
cacttgtgtgtgggctgtgag

SEQ ID NO: 778093 - DNA, 22 bp, Homo sapiens
cacttgtgtgtgggctgtgagt

SEQ ID NO: 778094 - DNA, 19 bp, Homo sapiens
cacttgttgattaatggaa

SEQ ID NO: 778095 - DNA, 23 bp, Homo sapiens
cactttaaagaggctgtgtggcc

SEQ ID NO: 778096 - DNA, 14 bp, Homo sapiens
cactttaagttttg

SEQ ID NO: 778097 - DNA, 20 bp, Homo sapiens
cactttaattaccaacctgt

SEQ ID NO: 778098 - DNA, 22 bp, Homo sapiens
cactttacccacctagaacact

SEQ ID NO: 778099 - DNA, 14 bp, Homo sapiens
cactttagacattt

SEQ ID NO: 778100 - DNA, 16 bp, Homo sapiens
cactttagacattttt

SEQ ID NO: 778101 - DNA, 15 bp, Homo sapiens
cactttagatgctga

SEQ ID NO: 778102 - DNA, 21 bp, Homo sapiens
cactttagatgctgatgattt

SEQ ID NO: 778103 - DNA, 23 bp, Homo sapiens
cactttagggctgtaaaatgcat

SEQ ID NO: 778104 - DNA, 22 bp, Homo sapiens
cactttataagtcattgtatgt

SEQ ID NO: 778105 - DNA, 21 bp, Homo sapiens
cactttatgccggatgtgctt

SEQ ID NO: 778106 - DNA, 22 bp, Homo sapiens
cactttatgccggatgtgcttt

SEQ ID NO: 778107 - DNA, 23 bp, Homo sapiens
cactttattgccttttaattttt

SEQ ID NO: 778108 - DNA, 12 bp, Homo sapiens
cactttcaaaac

SEQ ID NO: 778109 - DNA, 17 bp, Homo sapiens
cactttcacatagatgt

SEQ ID NO: 778110 - DNA, 22 bp, Homo sapiens
cactttccacttcttcctttct

SEQ ID NO: 778111 - DNA, 12 bp, Homo sapiens
cactttcctcag

SEQ ID NO: 778112 - DNA, 16 bp, Homo sapiens
cagaaattgtatattg

SEQ ID NO: 778113 - DNA, 19 bp, Homo sapiens
cagaaattgtatattgtaa

SEQ ID NO: 778114 - DNA, 22 bp, Homo sapiens
cagaaatttaattcatgtttct

SEQ ID NO: 778115 - DNA, 14 bp, Homo sapiens
cagaaatttttatt

SEQ ID NO: 778116 - DNA, 18 bp, Homo sapiens
cagaacaaatgtgttttt

SEQ ID NO: 778117 - DNA, 13 bp, Homo sapiens
cagaacacacaga

SEQ ID NO: 778118 - DNA, 18 bp, Homo sapiens
cagaacacctggccgggt

SEQ ID NO: 778119 - DNA, 21 bp, Homo sapiens
cagaacagagggccagagcta

SEQ ID NO: 778120 - DNA, 12 bp, Homo sapiens
cagaacagggtc

SEQ ID NO: 778121 - DNA, 14 bp, Homo sapiens
cagaacatacactg

SEQ ID NO: 778122 - DNA, 20 bp, Homo sapiens
cagaacatacactgtgaact

SEQ ID NO: 778123 - DNA, 15 bp, Homo sapiens
cagaacatcattaga

SEQ ID NO: 778124 - DNA, 16 bp, Homo sapiens
cagaacatcattagaa

SEQ ID NO: 778125 - DNA, 19 bp, Homo sapiens
cagaacatcgatatgtata

SEQ ID NO: 778126 - DNA, 12 bp, Homo sapiens
cagaacatgtta

SEQ ID NO: 778127 - DNA, 17 bp, Homo sapiens
cagaacatgttaagata

SEQ ID NO: 778128 - DNA, 19 bp, Homo sapiens
cagaacattgccttcctcg

SEQ ID NO: 778129 - DNA, 20 bp, Homo sapiens
cagaacattgccttcctcgt

SEQ ID NO: 778130 - DNA, 16 bp, Homo sapiens
cagaaccacaaacaat

SEQ ID NO: 778131 - DNA, 19 bp, Homo sapiens
cagaacccacagtgagagg

SEQ ID NO: 778132 - DNA, 13 bp, Homo sapiens
cagaacccagggc

SEQ ID NO: 778133 - DNA, 19 bp, Homo sapiens
cagacaagagctgctgtcc

SEQ ID NO: 778134 - DNA, 22 bp, Homo sapiens
cagacaagattttttaattgtt

SEQ ID NO: 778135 - DNA, 15 bp, Homo sapiens
cagacaaggttctgc

SEQ ID NO: 778136 - DNA, 20 bp, Homo sapiens
cagacaatagtatagaagtc

SEQ ID NO: 778137 - DNA, 16 bp, Homo sapiens
cagacacaatatgtat

SEQ ID NO: 778138 - DNA, 12 bp, Homo sapiens
cagacacacaca

SEQ ID NO: 778139 - DNA, 14 bp, Homo sapiens
cagacacacacaca

SEQ ID NO: 778140 - DNA, 17 bp, Homo sapiens
cagacacacacacgcac

SEQ ID NO: 778141 - DNA, 15 bp, Homo sapiens
cagacacagactggc

SEQ ID NO: 778142 - DNA, 14 bp, Homo sapiens
cagacacagctctt

SEQ ID NO: 778143 - DNA, 15 bp, Homo sapiens
cagacacagctcttc

SEQ ID NO: 778144 - DNA, 12 bp, Homo sapiens
cagacaccatgt

SEQ ID NO: 778145 - DNA, 17 bp, Homo sapiens
cagacaccatgtgcaat

SEQ ID NO: 778146 - DNA, 14 bp, Homo sapiens
cagacacctccccc

SEQ ID NO: 778147 - DNA, 20 bp, Homo sapiens
cagacacctccccctaccca

SEQ ID NO: 778148 - DNA, 21 bp, Homo sapiens
cagacacctccccctacccat

SEQ ID NO: 778149 - DNA, 17 bp, Homo sapiens
cagacacctggactgag

SEQ ID NO: 778150 - DNA, 22 bp, Homo sapiens
cagacacctgttcacagaaaaa

SEQ ID NO: 778151 - DNA, 18 bp, Homo sapiens
cagacaccttggacatcc

SEQ ID NO: 778152 - DNA, 11 bp, Homo sapiens
cagacactaag

SEQ ID NO: 778153 - DNA, 21 bp, Homo sapiens
cagacactaagttatagtata

SEQ ID NO: 778154 - DNA, 12 bp, Homo sapiens
cagacactctgc

SEQ ID NO: 778155 - DNA, 21 bp, Homo sapiens
cagacactgaccatccactct

SEQ ID NO: 778156 - DNA, 20 bp, Homo sapiens
cagacactgagcttctgaga

SEQ ID NO: 778157 - DNA, 15 bp, Homo sapiens
cagacactgttgcaa

SEQ ID NO: 778158 - DNA, 22 bp, Homo sapiens
cagacactgttgcaaaggtagg

SEQ ID NO: 778159 - DNA, 18 bp, Homo sapiens
cagacacttaactcaatt

SEQ ID NO: 778160 - DNA, 15 bp, Homo sapiens
cagacactttggaag

SEQ ID NO: 778161 - DNA, 21 bp, Homo sapiens
cagacagaaactggattaaaa

SEQ ID NO: 778162 - DNA, 14 bp, Homo sapiens
cagacagacacaca

SEQ ID NO: 778163 - DNA, 15 bp, Homo sapiens
cagacagacatacat

SEQ ID NO: 778164 - DNA, 19 bp, Homo sapiens
cagacagacatctctgcac

SEQ ID NO: 778165 - DNA, 21 bp, Homo sapiens
cagacagacctcaagggacag

SEQ ID NO: 778166 - DNA, 14 bp, Homo sapiens
cagacagagccagg

SEQ ID NO: 778167 - DNA, 15 bp, Homo sapiens
cagacagagccagga

SEQ ID NO: 778168 - DNA, 23 bp, Homo sapiens
cagacagagccaggagaagctca

SEQ ID NO: 778169 - DNA, 21 bp, Homo sapiens
cagacagatgttgggaggata

SEQ ID NO: 778170 - DNA, 13 bp, Homo sapiens
cagacagcaagga

SEQ ID NO: 778171 - DNA, 13 bp, Homo sapiens
cagacagcagctc

SEQ ID NO: 778172 - DNA, 16 bp, Homo sapiens
cagacagcagctcagg

SEQ ID NO: 778173 - DNA, 16 bp, Homo sapiens
cagacagcaggcagcg

SEQ ID NO: 778174 - DNA, 16 bp, Homo sapiens
cagacagccatgcgtg

SEQ ID NO: 778175 - DNA, 20 bp, Homo sapiens
cagacagccatgcgtggcca

SEQ ID NO: 778176 - DNA, 22 bp, Homo sapiens
cagacaggaatttagaaaaagt

SEQ ID NO: 778177 - DNA, 12 bp, Homo sapiens
cagacaggagga

SEQ ID NO: 778178 - DNA, 21 bp, Homo sapiens
cagacaggccatgtgagccac

SEQ ID NO: 778179 - DNA, 18 bp, Homo sapiens
cagacaggccctccctgt

SEQ ID NO: 778180 - DNA, 23 bp, Homo sapiens
cagacagggtgggcttcctgccc

SEQ ID NO: 778181 - DNA, 18 bp, Homo sapiens
cagacagtcgctcagtct

SEQ ID NO: 778182 - DNA, 20 bp, Homo sapiens
cagacagtctgttatgcact

SEQ ID NO: 778183 - DNA, 22 bp, Homo sapiens
cagacagtggatatgacccaca

SEQ ID NO: 778184 - DNA, 15 bp, Homo sapiens
cagacatacagctgc

SEQ ID NO: 778185 - DNA, 14 bp, Homo sapiens
cagacatacataga

SEQ ID NO: 778186 - DNA, 18 bp, Homo sapiens
cagacatatgggatattc

SEQ ID NO: 778187 - DNA, 13 bp, Homo sapiens
cagacatatttaa

SEQ ID NO: 778188 - DNA, 14 bp, Homo sapiens
cagacatatttaac

SEQ ID NO: 778189 - DNA, 15 bp, Homo sapiens
cagacatatttaact

SEQ ID NO: 778190 - DNA, 16 bp, Homo sapiens
cagacatctctggagc

SEQ ID NO: 778191 - DNA, 21 bp, Homo sapiens
cagacatctctggagccagag

SEQ ID NO: 778192 - DNA, 23 bp, Homo sapiens
cagacatctctggagccagagag

SEQ ID NO: 778193 - DNA, 14 bp, Homo sapiens
cagacatgccttgg

SEQ ID NO: 778194 - DNA, 19 bp, Homo sapiens
cagacatgccttggtgccg

SEQ ID NO: 778195 - DNA, 23 bp, Homo sapiens
cagacatgctctttttttaagtg

SEQ ID NO: 778196 - DNA, 12 bp, Homo sapiens
cagacatgtttt

SEQ ID NO: 778197 - DNA, 16 bp, Homo sapiens
cagacattaaataatc

SEQ ID NO: 778198 - DNA, 12 bp, Homo sapiens
cagaccaaccct

SEQ ID NO: 778199 - DNA, 21 bp, Homo sapiens
cagaccaacgttactcagggc

SEQ ID NO: 778200 - DNA, 20 bp, Homo sapiens
cagaccacatctttatctgt

SEQ ID NO: 778201 - DNA, 17 bp, Homo sapiens
cagaccaccagccgccc

SEQ ID NO: 778202 - DNA, 19 bp, Homo sapiens
cagaccaccccgcctgccc

SEQ ID NO: 778203 - DNA, 13 bp, Homo sapiens
cagaccacttgcc

SEQ ID NO: 778204 - DNA, 17 bp, Homo sapiens
cagaccacttgccacgc

SEQ ID NO: 778205 - DNA, 19 bp, Homo sapiens
cagaccacttgccacgctg

SEQ ID NO: 778206 - DNA, 22 bp, Homo sapiens
cagaccagagctgtctgaactc

SEQ ID NO: 778207 - DNA, 14 bp, Homo sapiens
cagaccatggacac

SEQ ID NO: 778208 - DNA, 18 bp, Homo sapiens
cagacccacctggagccc

SEQ ID NO: 778209 - DNA, 12 bp, Homo sapiens
cagacccagagc

SEQ ID NO: 778210 - DNA, 20 bp, Homo sapiens
cagacccagcccgcggcctg

SEQ ID NO: 778211 - DNA, 23 bp, Homo sapiens
cagacccagcccgcggcctggac

SEQ ID NO: 778212 - DNA, 13 bp, Homo sapiens
cagacccattcct

SEQ ID NO: 778213 - DNA, 13 bp, Homo sapiens
cagacccccaccc

SEQ ID NO: 778214 - DNA, 14 bp, Homo sapiens
cagacccccacccc

SEQ ID NO: 778215 - DNA, 17 bp, Homo sapiens
cagacccccaccccttc

SEQ ID NO: 778216 - DNA, 14 bp, Homo sapiens
cagacccccactct

SEQ ID NO: 778217 - DNA, 13 bp, Homo sapiens
cagacccccagca

SEQ ID NO: 778218 - DNA, 15 bp, Homo sapiens
cagaccccgcccctg

SEQ ID NO: 778219 - DNA, 15 bp, Homo sapiens
cagaccccgtggctc

SEQ ID NO: 778220 - DNA, 11 bp, Homo sapiens
cagacccctgc

SEQ ID NO: 778221 - DNA, 13 bp, Homo sapiens
cagacccctggct

SEQ ID NO: 778222 - DNA, 14 bp, Homo sapiens
cagacccctggctt

SEQ ID NO: 778223 - DNA, 15 bp, Homo sapiens
cagacccctggcttt

SEQ ID NO: 778224 - DNA, 23 bp, Homo sapiens
cagacccctggcttttcactgct

SEQ ID NO: 778225 - DNA, 16 bp, Homo sapiens
cagaccctaccccacc

SEQ ID NO: 778226 - DNA, 12 bp, Homo sapiens
cagaccctgcct

SEQ ID NO: 778227 - DNA, 13 bp, Homo sapiens
cagaccctgcctg

SEQ ID NO: 778228 - DNA, 15 bp, Homo sapiens
cagaccctgcctgag

SEQ ID NO: 778229 - DNA, 17 bp, Homo sapiens
cagaccctgcctgagcc

SEQ ID NO: 778230 - DNA, 11 bp, Homo sapiens
cagaccctgga

SEQ ID NO: 778231 - DNA, 18 bp, Homo sapiens
cagaccctggaggcccca

SEQ ID NO: 778232 - DNA, 21 bp, Homo sapiens
cagaccgaactgttgtataaa

SEQ ID NO: 778233 - DNA, 15 bp, Homo sapiens
cagaccgcagagagg

SEQ ID NO: 778234 - DNA, 15 bp, Homo sapiens
cagaccgggcccccc

SEQ ID NO: 778235 - DNA, 20 bp, Homo sapiens
cagaccggggttcaagccat

SEQ ID NO: 778236 - DNA, 22 bp, Homo sapiens
cagaccggggttcaagccatgg

SEQ ID NO: 778237 - DNA, 20 bp, Homo sapiens
cagacctagcaggctgttcc

SEQ ID NO: 778238 - DNA, 21 bp, Homo sapiens
cagacctagcaggctgttcca

SEQ ID NO: 778239 - DNA, 18 bp, Homo sapiens
cagacctcaagggacagg

SEQ ID NO: 778240 - DNA, 14 bp, Homo sapiens
cagacctcacacct

SEQ ID NO: 778241 - DNA, 14 bp, Homo sapiens
cagacctcactgtc

SEQ ID NO: 778242 - DNA, 16 bp, Homo sapiens
cagacctcatgcccag

SEQ ID NO: 778243 - DNA, 15 bp, Homo sapiens
cagacctctgcttgg

SEQ ID NO: 778244 - DNA, 12 bp, Homo sapiens
cagacctgacac

SEQ ID NO: 778245 - DNA, 20 bp, Homo sapiens
cagacctgcagtgaggggcc

SEQ ID NO: 778246 - DNA, 23 bp, Homo sapiens
cagacctgcagtgaggggccctc

SEQ ID NO: 778247 - DNA, 16 bp, Homo sapiens
cagacctgctctggac

SEQ ID NO: 778248 - DNA, 22 bp, Homo sapiens
cagacctgctctggacacttgc

SEQ ID NO: 778249 - DNA, 11 bp, Homo sapiens
cagacctggag

SEQ ID NO: 778250 - DNA, 14 bp, Homo sapiens
cagacctggagccc

SEQ ID NO: 778251 - DNA, 17 bp, Homo sapiens
cagacctggagcccctg

SEQ ID NO: 778252 - DNA, 20 bp, Homo sapiens
cagagcaagactctgtctca

SEQ ID NO: 778253 - DNA, 13 bp, Homo sapiens
cagagcaataaca

SEQ ID NO: 778254 - DNA, 15 bp, Homo sapiens
cagagcacacttatt

SEQ ID NO: 778255 - DNA, 20 bp, Homo sapiens
cagagcacacttatttatga

SEQ ID NO: 778256 - DNA, 15 bp, Homo sapiens
cagagcacagcccac

SEQ ID NO: 778257 - DNA, 14 bp, Homo sapiens
cagagcacaggagc

SEQ ID NO: 778258 - DNA, 21 bp, Homo sapiens
cagagcacccccaagcctggg

SEQ ID NO: 778259 - DNA, 20 bp, Homo sapiens
cagagcaccccctgctccac

SEQ ID NO: 778260 - DNA, 20 bp, Homo sapiens
cagagcacctttgcacagga

SEQ ID NO: 778261 - DNA, 23 bp, Homo sapiens
cagagcacctttgcacaggatgc

SEQ ID NO: 778262 - DNA, 15 bp, Homo sapiens
cagagcagagagcag

SEQ ID NO: 778263 - DNA, 14 bp, Homo sapiens
cagagcagcagcac

SEQ ID NO: 778264 - DNA, 16 bp, Homo sapiens
cagagcagcagcacct

SEQ ID NO: 778265 - DNA, 23 bp, Homo sapiens
cagagcagctaactccgagagca

SEQ ID NO: 778266 - DNA, 13 bp, Homo sapiens
cagagcagctagc

SEQ ID NO: 778267 - DNA, 23 bp, Homo sapiens
cagagcaggaaggacaggaagct

SEQ ID NO: 778268 - DNA, 16 bp, Homo sapiens
cagagcaggacctccc

SEQ ID NO: 778269 - DNA, 22 bp, Homo sapiens
cagagcaggacctcccttccga

SEQ ID NO: 778270 - DNA, 15 bp, Homo sapiens
cagagcaggaggccc

SEQ ID NO: 778271 - DNA, 13 bp, Homo sapiens
cagagcaggctca

SEQ ID NO: 778272 - DNA, 15 bp, Homo sapiens
cagagcaggggcagg

SEQ ID NO: 778273 - DNA, 13 bp, Homo sapiens
cagagcaggggcc

SEQ ID NO: 778274 - DNA, 19 bp, Homo sapiens
cagagcaggggctccagca

SEQ ID NO: 778275 - DNA, 18 bp, Homo sapiens
cagagcataaaacctaaa

SEQ ID NO: 778276 - DNA, 16 bp, Homo sapiens
cagagcatacaacaga

SEQ ID NO: 778277 - DNA, 19 bp, Homo sapiens
cagagcatacaacagaggg

SEQ ID NO: 778278 - DNA, 21 bp, Homo sapiens
cagagcattacgtgagccagg

SEQ ID NO: 778279 - DNA, 15 bp, Homo sapiens
cagagcatttaagag

SEQ ID NO: 778280 - DNA, 15 bp, Homo sapiens
cagagccaaggccac

SEQ ID NO: 778281 - DNA, 17 bp, Homo sapiens
cagagccagcctggctc

SEQ ID NO: 778282 - DNA, 18 bp, Homo sapiens
cagagccagcctggctct

SEQ ID NO: 778283 - DNA, 17 bp, Homo sapiens
cagagccagcctgggac

SEQ ID NO: 778284 - DNA, 18 bp, Homo sapiens
cagagccagcctgggact

SEQ ID NO: 778285 - DNA, 19 bp, Homo sapiens
cagagccagcctgggactc

SEQ ID NO: 778286 - DNA, 23 bp, Homo sapiens
cagagccagcctgggactcccag

SEQ ID NO: 778287 - DNA, 15 bp, Homo sapiens
cagagccaggaagat

SEQ ID NO: 778288 - DNA, 23 bp, Homo sapiens
cagagccaggaagatcccccaga

SEQ ID NO: 778289 - DNA, 16 bp, Homo sapiens
cagagccaggagaagc

SEQ ID NO: 778290 - DNA, 20 bp, Homo sapiens
cagagccaggagaagctcag

SEQ ID NO: 778291 - DNA, 11 bp, Homo sapiens
cagagccaggg

SEQ ID NO: 778292 - DNA, 15 bp, Homo sapiens
cagagccagggctgt

SEQ ID NO: 778293 - DNA, 18 bp, Homo sapiens
cagagccagggctgtcct

SEQ ID NO: 778294 - DNA, 11 bp, Homo sapiens
cagagccagtg

SEQ ID NO: 778295 - DNA, 14 bp, Homo sapiens
cagagccagtgaag

SEQ ID NO: 778296 - DNA, 11 bp, Homo sapiens
cagagccatgg

SEQ ID NO: 778297 - DNA, 21 bp, Homo sapiens
cagagccatgggcctgggcct

SEQ ID NO: 778298 - DNA, 23 bp, Homo sapiens
cagagccatgggcctgggcctgc

SEQ ID NO: 778299 - DNA, 14 bp, Homo sapiens
cagagcccaccagc

SEQ ID NO: 778300 - DNA, 19 bp, Homo sapiens
cagagcccaccagccagcc

SEQ ID NO: 778301 - DNA, 11 bp, Homo sapiens
cagagcccagc

SEQ ID NO: 778302 - DNA, 19 bp, Homo sapiens
cagagcccagctcttgctc

SEQ ID NO: 778303 - DNA, 16 bp, Homo sapiens
cagagccccaagcagg

SEQ ID NO: 778304 - DNA, 20 bp, Homo sapiens
cagagccccacacggaggca

SEQ ID NO: 778305 - DNA, 14 bp, Homo sapiens
cagagccccacgct

SEQ ID NO: 778306 - DNA, 14 bp, Homo sapiens
cagagccccactcc

SEQ ID NO: 778307 - DNA, 15 bp, Homo sapiens
cagagcccccagccc

SEQ ID NO: 778308 - DNA, 16 bp, Homo sapiens
cagagcccctacagca

SEQ ID NO: 778309 - DNA, 17 bp, Homo sapiens
cagagcccctcctccag

SEQ ID NO: 778310 - DNA, 18 bp, Homo sapiens
cagagcccctcctccagc

SEQ ID NO: 778311 - DNA, 14 bp, Homo sapiens
cagagccctctgag

SEQ ID NO: 778312 - DNA, 15 bp, Homo sapiens
cagagccctggacct

SEQ ID NO: 778313 - DNA, 17 bp, Homo sapiens
cagagccctggctgggt

SEQ ID NO: 778314 - DNA, 20 bp, Homo sapiens
cagagctgtgcctgctcagc

SEQ ID NO: 778315 - DNA, 17 bp, Homo sapiens
cagagcttattggccac

SEQ ID NO: 778316 - DNA, 23 bp, Homo sapiens
cagagcttccctgactcattctg

SEQ ID NO: 778317 - DNA, 15 bp, Homo sapiens
cagagcttgaagatt

SEQ ID NO: 778318 - DNA, 20 bp, Homo sapiens
cagagctttaaaagtatctt

SEQ ID NO: 778319 - DNA, 18 bp, Homo sapiens
cagagcttttgcatttcc

SEQ ID NO: 778320 - DNA, 20 bp, Homo sapiens
cagagcttttgcatttcctg

SEQ ID NO: 778321 - DNA, 18 bp, Homo sapiens
cagaggaaagggctggct

SEQ ID NO: 778322 - DNA, 19 bp, Homo sapiens
cagaggaactgtccagaga

SEQ ID NO: 778323 - DNA, 20 bp, Homo sapiens
cagaggaactgtccagagag

SEQ ID NO: 778324 - DNA, 20 bp, Homo sapiens
cagaggaaggggccagaggc

SEQ ID NO: 778325 - DNA, 22 bp, Homo sapiens
cagaggaatcctggcagcccag

SEQ ID NO: 778326 - DNA, 23 bp, Homo sapiens
cagaggaatcctggcagcccaga

SEQ ID NO: 778327 - DNA, 21 bp, Homo sapiens
cagaggaatgtagggcctgca

SEQ ID NO: 778328 - DNA, 17 bp, Homo sapiens
cagaggacacagagaag

SEQ ID NO: 778329 - DNA, 18 bp, Homo sapiens
cagaggaccacagtgggt

SEQ ID NO: 778330 - DNA, 19 bp, Homo sapiens
cagaggaccccagggtggt

SEQ ID NO: 778331 - DNA, 14 bp, Homo sapiens
cagaggacgcacgc

SEQ ID NO: 778332 - DNA, 19 bp, Homo sapiens
cagaggactcccaaccctg

SEQ ID NO: 778333 - DNA, 16 bp, Homo sapiens
cagaggactctgctta

SEQ ID NO: 778334 - DNA, 17 bp, Homo sapiens
cagaggactctgcttaa

SEQ ID NO: 778335 - DNA, 21 bp, Homo sapiens
cagaggactctgcttaaacaa

SEQ ID NO: 778336 - DNA, 16 bp, Homo sapiens
cagaggagagacggtg

SEQ ID NO: 778337 - DNA, 22 bp, Homo sapiens
cagaggagagtcccagagcagg

SEQ ID NO: 778338 - DNA, 23 bp, Homo sapiens
cagaggagagtcccagagcagga

SEQ ID NO: 778339 - DNA, 22 bp, Homo sapiens
cagaggagatgccacttctcac

SEQ ID NO: 778340 - DNA, 18 bp, Homo sapiens
cagaggagccaccagttc

SEQ ID NO: 778341 - DNA, 16 bp, Homo sapiens
cagaggagcgcaggca

SEQ ID NO: 778342 - DNA, 15 bp, Homo sapiens
cagaggagcttttct

SEQ ID NO: 778343 - DNA, 23 bp, Homo sapiens
cagaggagtgattgaaccagctc

SEQ ID NO: 778344 - DNA, 21 bp, Homo sapiens
cagaggatgccttttctgtga

SEQ ID NO: 778345 - DNA, 23 bp, Homo sapiens
cagaggatgccttttctgtgatt

SEQ ID NO: 778346 - DNA, 21 bp, Homo sapiens
cagaggattgctgccccatca

SEQ ID NO: 778347 - DNA, 21 bp, Homo sapiens
cagaggcagcccgcacacctg

SEQ ID NO: 778348 - DNA, 16 bp, Homo sapiens
cagaggcaggagtggc

SEQ ID NO: 778349 - DNA, 20 bp, Homo sapiens
cagaggccagaggcccccag

SEQ ID NO: 778350 - DNA, 13 bp, Homo sapiens
cagaggcccccag

SEQ ID NO: 778351 - DNA, 19 bp, Homo sapiens
cagaggcccccagcccagg

SEQ ID NO: 778352 - DNA, 24 bp, Homo sapiens
cagaggcccccagcccagggctcc

SEQ ID NO: 778353 - DNA, 17 bp, Homo sapiens
cagaggcccccagtggg

SEQ ID NO: 778354 - DNA, 18 bp, Homo sapiens
cagaggcccccagtgggg

SEQ ID NO: 778355 - DNA, 10 bp, Homo sapiens
cagaggccct

SEQ ID NO: 778356 - DNA, 13 bp, Homo sapiens
cagaggccctgcc

SEQ ID NO: 778357 - DNA, 18 bp, Homo sapiens
cagaggccggggtccagg

SEQ ID NO: 778358 - DNA, 22 bp, Homo sapiens
cagaggccggggtccaggcccg

SEQ ID NO: 778359 - DNA, 17 bp, Homo sapiens
cagaggcctgctgccag

SEQ ID NO: 778360 - DNA, 23 bp, Homo sapiens
cagaggcctgctgccagtgcagc

SEQ ID NO: 778361 - DNA, 16 bp, Homo sapiens
cagaggcctgggctgg

SEQ ID NO: 778362 - DNA, 12 bp, Homo sapiens
cagaggccttgt

SEQ ID NO: 778363 - DNA, 16 bp, Homo sapiens
cagaggctactcttga

SEQ ID NO: 778364 - DNA, 21 bp, Homo sapiens
cagaggctcagattgtaatat

SEQ ID NO: 778365 - DNA, 18 bp, Homo sapiens
cagaggctgagccctgta

SEQ ID NO: 778366 - DNA, 13 bp, Homo sapiens
cagaggctgaggt

SEQ ID NO: 778367 - DNA, 16 bp, Homo sapiens
cagaggctggaggcag

SEQ ID NO: 778368 - DNA, 17 bp, Homo sapiens
cagaggctggaggcagg

SEQ ID NO: 778369 - DNA, 21 bp, Homo sapiens
cagaggctggaggcagggcct

SEQ ID NO: 778370 - DNA, 20 bp, Homo sapiens
cagaggctggcaccatggtg

SEQ ID NO: 778371 - DNA, 15 bp, Homo sapiens
cagaggctggcactg

SEQ ID NO: 778372 - DNA, 12 bp, Homo sapiens
cagaggctgggt

SEQ ID NO: 778373 - DNA, 14 bp, Homo sapiens
cagaggctgtggct

SEQ ID NO: 778374 - DNA, 20 bp, Homo sapiens
cagaggcttcttcagatcag

SEQ ID NO: 778375 - DNA, 20 bp, Homo sapiens
cagagggaaactcagatgtc

SEQ ID NO: 778376 - DNA, 14 bp, Homo sapiens
cagagggaagccat

SEQ ID NO: 778377 - DNA, 18 bp, Homo sapiens
cagagggaagccatgtgg

SEQ ID NO: 778378 - DNA, 20 bp, Homo sapiens
cagagggaagccatgtgggg

SEQ ID NO: 778379 - DNA, 18 bp, Homo sapiens
cagagggaatgttccctg

SEQ ID NO: 778380 - DNA, 20 bp, Homo sapiens
cagagggaatgttccctgca

SEQ ID NO: 778381 - DNA, 22 bp, Homo sapiens
cagagggaccaaattgcttcta

SEQ ID NO: 778382 - DNA, 23 bp, Homo sapiens
cagagggaccaaattgcttctag

SEQ ID NO: 778383 - DNA, 18 bp, Homo sapiens
cagagggagacagggctg

SEQ ID NO: 778384 - DNA, 22 bp, Homo sapiens
cagagggagacggccctgctgg

SEQ ID NO: 778385 - DNA, 20 bp, Homo sapiens
cagagggagtttaatacagg

SEQ ID NO: 778386 - DNA, 14 bp, Homo sapiens
cagagggccagagc

SEQ ID NO: 778387 - DNA, 16 bp, Homo sapiens
cagagggccagagcta

SEQ ID NO: 778388 - DNA, 16 bp, Homo sapiens
cagagggccagcaggc

SEQ ID NO: 778389 - DNA, 18 bp, Homo sapiens
cagagggccagcaggctc

SEQ ID NO: 778390 - DNA, 13 bp, Homo sapiens
cagagggcccagg

SEQ ID NO: 778391 - DNA, 16 bp, Homo sapiens
cagagggcccaggcag

SEQ ID NO: 778392 - DNA, 14 bp, Homo sapiens
cagagggcgccacc

SEQ ID NO: 778393 - DNA, 15 bp, Homo sapiens
cagagggcgccacca

SEQ ID NO: 778394 - DNA, 13 bp, Homo sapiens
cagagggctaggg

SEQ ID NO: 778395 - DNA, 12 bp, Homo sapiens
cagagggctgga

SEQ ID NO: 778396 - DNA, 13 bp, Homo sapiens
cagagggctggag

SEQ ID NO: 778397 - DNA, 20 bp, Homo sapiens
cagagggctggaggcccagg

SEQ ID NO: 778398 - DNA, 14 bp, Homo sapiens
cagaggggactctg

SEQ ID NO: 778399 - DNA, 18 bp, Homo sapiens
cagaggggagcagcggct

SEQ ID NO: 778400 - DNA, 21 bp, Homo sapiens
cagaggggagcagcggctctg

SEQ ID NO: 778401 - DNA, 19 bp, Homo sapiens
cagaggggatggggataga

SEQ ID NO: 778402 - DNA, 14 bp, Homo sapiens
cagaggggcagccg

SEQ ID NO: 778403 - DNA, 23 bp, Homo sapiens
cagaggggcgttctcccaaagat

SEQ ID NO: 778404 - DNA, 17 bp, Homo sapiens
cagagggggactgctgc

SEQ ID NO: 778405 - DNA, 21 bp, Homo sapiens
cagagggggactgctgctgcc

SEQ ID NO: 778406 - DNA, 22 bp, Homo sapiens
cagagggggagtagccaagctg

SEQ ID NO: 778407 - DNA, 16 bp, Homo sapiens
cagagggttaggagtg

SEQ ID NO: 778408 - DNA, 17 bp, Homo sapiens
cagagggtttggaccac

SEQ ID NO: 778409 - DNA, 19 bp, Homo sapiens
cagagggtttgtgcccagt

SEQ ID NO: 778410 - DNA, 14 bp, Homo sapiens
cagaggtagcattg

SEQ ID NO: 778411 - DNA, 19 bp, Homo sapiens
cagaggtcagactaagaaa

SEQ ID NO: 778412 - DNA, 13 bp, Homo sapiens
cagaggtccagcc

SEQ ID NO: 778413 - DNA, 19 bp, Homo sapiens
cagaggtcttcagggctct

SEQ ID NO: 778414 - DNA, 19 bp, Homo sapiens
cagaggtgagaactcagaa

SEQ ID NO: 778415 - DNA, 23 bp, Homo sapiens
cagaggtgagaactcagaagaga

SEQ ID NO: 778416 - DNA, 19 bp, Homo sapiens
cagaggtgcaagacctagt

SEQ ID NO: 778417 - DNA, 21 bp, Homo sapiens
cagaggtgcttcaccctgagt

SEQ ID NO: 778418 - DNA, 16 bp, Homo sapiens
cagaggtggaggtggg

SEQ ID NO: 778419 - DNA, 13 bp, Homo sapiens
cagaggtggatgt

SEQ ID NO: 778420 - DNA, 18 bp, Homo sapiens
cagaggtggatgttatga

SEQ ID NO: 778421 - DNA, 11 bp, Homo sapiens
cagaggtggcc

SEQ ID NO: 778422 - DNA, 17 bp, Homo sapiens
cagaggtggccagagct

SEQ ID NO: 778423 - DNA, 21 bp, Homo sapiens
cagaggtggccagagctggga

SEQ ID NO: 778424 - DNA, 20 bp, Homo sapiens
cagaggtgggatcctccctc

SEQ ID NO: 778425 - DNA, 13 bp, Homo sapiens
cagaggtgggcag

SEQ ID NO: 778426 - DNA, 18 bp, Homo sapiens
cagaggttatctgcctgg

SEQ ID NO: 778427 - DNA, 17 bp, Homo sapiens
cagaggttgcagtgtgg

SEQ ID NO: 778428 - DNA, 24 bp, Homo sapiens
cagcttctctctccctgtcacaca

SEQ ID NO: 778429 - DNA, 16 bp, Homo sapiens
caggaacgctctcctc

SEQ ID NO: 778430 - DNA, 14 bp, Homo sapiens
caggaacggccctg

SEQ ID NO: 778431 - DNA, 21 bp, Homo sapiens
caggaacggccctgcaggagc

SEQ ID NO: 778432 - DNA, 19 bp, Homo sapiens
caggaacgttgccacacca

SEQ ID NO: 778433 - DNA, 15 bp, Homo sapiens
caggaactcccagca

SEQ ID NO: 778434 - DNA, 19 bp, Homo sapiens
caggaactgcctgggccat

SEQ ID NO: 778435 - DNA, 12 bp, Homo sapiens
caggaactgggc

SEQ ID NO: 778436 - DNA, 14 bp, Homo sapiens
caggaagaaatcac

SEQ ID NO: 778437 - DNA, 16 bp, Homo sapiens
caggaagaagagatgc

SEQ ID NO: 778438 - DNA, 13 bp, Homo sapiens
caggaagaggccc

SEQ ID NO: 778439 - DNA, 15 bp, Homo sapiens
caggaagaggcccac

SEQ ID NO: 778440 - DNA, 23 bp, Homo sapiens
caggaagcaaactaagcccccgc

SEQ ID NO: 778441 - DNA, 15 bp, Homo sapiens
caggaagcagggaga

SEQ ID NO: 778442 - DNA, 20 bp, Homo sapiens
caggaagcagggagagttgg

SEQ ID NO: 778443 - DNA, 22 bp, Homo sapiens
caggaagcattcagagagcagc

SEQ ID NO: 778444 - DNA, 15 bp, Homo sapiens
caggaagccagagcc

SEQ ID NO: 778445 - DNA, 16 bp, Homo sapiens
caggaagccagagccc

SEQ ID NO: 778446 - DNA, 17 bp, Homo sapiens
caggaagccagagcccc

SEQ ID NO: 778447 - DNA, 18 bp, Homo sapiens
caggaagccgtcctggcg

SEQ ID NO: 778448 - DNA, 21 bp, Homo sapiens
caggaagcctgcagtcctgga

SEQ ID NO: 778449 - DNA, 15 bp, Homo sapiens
caggaagctggcaga

SEQ ID NO: 778450 - DNA, 12 bp, Homo sapiens
caggaaggaaca

SEQ ID NO: 778451 - DNA, 20 bp, Homo sapiens
caggaaggacaggaagctgg

SEQ ID NO: 778452 - DNA, 18 bp, Homo sapiens
caggaaggagagcctgct

SEQ ID NO: 778453 - DNA, 23 bp, Homo sapiens
caggaaggaggagccgaccggga

SEQ ID NO: 778454 - DNA, 22 bp, Homo sapiens
caggaaggaggggagagacagg

SEQ ID NO: 778455 - DNA, 13 bp, Homo sapiens
caggaaggcagct

SEQ ID NO: 778456 - DNA, 19 bp, Homo sapiens
caggaaggcagctgctctt

SEQ ID NO: 778457 - DNA, 14 bp, Homo sapiens
caggaaggcaggag

SEQ ID NO: 778458 - DNA, 23 bp, Homo sapiens
caggaaggcccctctgtggagcg

SEQ ID NO: 778459 - DNA, 15 bp, Homo sapiens
caggaagggaagcgt

SEQ ID NO: 778460 - DNA, 21 bp, Homo sapiens
caggaagggggtccacccagc

SEQ ID NO: 778461 - DNA, 13 bp, Homo sapiens
caggaagggtggg

SEQ ID NO: 778462 - DNA, 18 bp, Homo sapiens
caggaagtaaaataaata

SEQ ID NO: 778463 - DNA, 19 bp, Homo sapiens
caggaagtacttccacctc

SEQ ID NO: 778464 - DNA, 14 bp, Homo sapiens
caggaagtgtttat

SEQ ID NO: 778465 - DNA, 12 bp, Homo sapiens
caggaataaggc

SEQ ID NO: 778466 - DNA, 22 bp, Homo sapiens
caggaatatgacacaaaggtgg

SEQ ID NO: 778467 - DNA, 12 bp, Homo sapiens
caggaatgaaaa

SEQ ID NO: 778468 - DNA, 13 bp, Homo sapiens
caggaatgaaaac

SEQ ID NO: 778469 - DNA, 15 bp, Homo sapiens
caggaatgagtcaat

SEQ ID NO: 778470 - DNA, 23 bp, Homo sapiens
caggaatgagtcaatcagccttt

SEQ ID NO: 778471 - DNA, 14 bp, Homo sapiens
caggaatgggggtc

SEQ ID NO: 778472 - DNA, 16 bp, Homo sapiens
caggaatgtgtggcct

SEQ ID NO: 778473 - DNA, 18 bp, Homo sapiens
caggaattctaaataaat

SEQ ID NO: 778474 - DNA, 21 bp, Homo sapiens
caggaattcttggagaaaatg

SEQ ID NO: 778475 - DNA, 15 bp, Homo sapiens
caggaattttatttt

SEQ ID NO: 778476 - DNA, 16 bp, Homo sapiens
caggacaaaggctgac

SEQ ID NO: 778477 - DNA, 16 bp, Homo sapiens
caggacaagcacgagg

SEQ ID NO: 778478 - DNA, 23 bp, Homo sapiens
caggacaaggccttgctcactca

SEQ ID NO: 778479 - DNA, 22 bp, Homo sapiens
caggacaatgaaatactccagc

SEQ ID NO: 778480 - DNA, 14 bp, Homo sapiens
caggacacatcaca

SEQ ID NO: 778481 - DNA, 20 bp, Homo sapiens
caggacacatcccggcctct

SEQ ID NO: 778482 - DNA, 21 bp, Homo sapiens
caggacacatcccggcctctt

SEQ ID NO: 778483 - DNA, 19 bp, Homo sapiens
caggagaagctcagctgca

SEQ ID NO: 778484 - DNA, 21 bp, Homo sapiens
caggagaaggccaattcctat

SEQ ID NO: 778485 - DNA, 22 bp, Homo sapiens
caggagaaggccaattcctata

SEQ ID NO: 778486 - DNA, 12 bp, Homo sapiens
caggagaagggg

SEQ ID NO: 778487 - DNA, 21 bp, Homo sapiens
caggagaagggggctctgccc

SEQ ID NO: 778488 - DNA, 16 bp, Homo sapiens
caggagaaggtcagcg

SEQ ID NO: 778489 - DNA, 12 bp, Homo sapiens
caggagacaaga

SEQ ID NO: 778490 - DNA, 22 bp, Homo sapiens
caggagacagaccacttgccac

SEQ ID NO: 778491 - DNA, 14 bp, Homo sapiens
caggagacaggaag

SEQ ID NO: 778492 - DNA, 12 bp, Homo sapiens
caggagacatcc

SEQ ID NO: 778493 - DNA, 11 bp, Homo sapiens
caggagagagc

SEQ ID NO: 778494 - DNA, 17 bp, Homo sapiens
caggagagcccccacca

SEQ ID NO: 778495 - DNA, 18 bp, Homo sapiens
caggagagcccccaccag

SEQ ID NO: 778496 - DNA, 23 bp, Homo sapiens
caggagagcccccaccagcagca

SEQ ID NO: 778497 - DNA, 15 bp, Homo sapiens
caggagagcctgggg

SEQ ID NO: 778498 - DNA, 16 bp, Homo sapiens
caggagagcctggggg

SEQ ID NO: 778499 - DNA, 14 bp, Homo sapiens
caggagaggcagca

SEQ ID NO: 778500 - DNA, 21 bp, Homo sapiens
caggagaggcagcatgcttgg

SEQ ID NO: 778501 - DNA, 12 bp, Homo sapiens
caggagagggaa

SEQ ID NO: 778502 - DNA, 17 bp, Homo sapiens
caggagaggggcagaac

SEQ ID NO: 778503 - DNA, 15 bp, Homo sapiens
caggagagtgtgcaa

SEQ ID NO: 778504 - DNA, 24 bp, Homo sapiens
caggagagtgtgcaactggccagc

SEQ ID NO: 778505 - DNA, 23 bp, Homo sapiens
caggagataattgtttcattcat

SEQ ID NO: 778506 - DNA, 9 bp, Homo sapiens
cagggaggc

SEQ ID NO: 778507 - DNA, 20 bp, Homo sapiens
cagggaggcaacactgctgt

SEQ ID NO: 778508 - DNA, 14 bp, Homo sapiens
cagggaggcagagc

SEQ ID NO: 778509 - DNA, 18 bp, Homo sapiens
cagggaggcagagcggga

SEQ ID NO: 778510 - DNA, 20 bp, Homo sapiens
cagggaggcagagcgggagg

SEQ ID NO: 778511 - DNA, 22 bp, Homo sapiens
cagggaggcagcgtgggctctg

SEQ ID NO: 778512 - DNA, 15 bp, Homo sapiens
cagggaggcgcaggg

SEQ ID NO: 778513 - DNA, 18 bp, Homo sapiens
cagggaggcgcagggaca

SEQ ID NO: 778514 - DNA, 16 bp, Homo sapiens
cagggagggccaggga

SEQ ID NO: 778515 - DNA, 20 bp, Homo sapiens
cagggagggccagggaggca

SEQ ID NO: 778516 - DNA, 20 bp, Homo sapiens
cagggagggcttggggctgc

SEQ ID NO: 778517 - DNA, 10 bp, Homo sapiens
cagggagggg

SEQ ID NO: 778518 - DNA, 19 bp, Homo sapiens
cagggaggggactatttat

SEQ ID NO: 778519 - DNA, 14 bp, Homo sapiens
cagggaggggaggc

SEQ ID NO: 778520 - DNA, 18 bp, Homo sapiens
cagggaggggaggcagat

SEQ ID NO: 778521 - DNA, 11 bp, Homo sapiens
cagggaggggc

SEQ ID NO: 778522 - DNA, 16 bp, Homo sapiens
cagggagggggacctg

SEQ ID NO: 778523 - DNA, 20 bp, Homo sapiens
cagggagggggacctgtccc

SEQ ID NO: 778524 - DNA, 21 bp, Homo sapiens
cagggagggggacctgtcccc

SEQ ID NO: 778525 - DNA, 22 bp, Homo sapiens
cagggagggttagcctgcaccg

SEQ ID NO: 778526 - DNA, 24 bp, Homo sapiens
cagggaggtgggggcctcctcagc

SEQ ID NO: 778527 - DNA, 13 bp, Homo sapiens
cagggagtccagg

SEQ ID NO: 778528 - DNA, 21 bp, Homo sapiens
cagggagtgagcagctactgt

SEQ ID NO: 778529 - DNA, 19 bp, Homo sapiens
cagggataaggcctgtggg

SEQ ID NO: 778530 - DNA, 16 bp, Homo sapiens
cagggatattgcctta

SEQ ID NO: 778531 - DNA, 22 bp, Homo sapiens
cagggatctgtttgaacactta

SEQ ID NO: 778532 - DNA, 17 bp, Homo sapiens
cagggatcttgcattcc

SEQ ID NO: 778533 - DNA, 20 bp, Homo sapiens
cagggatgattcaagccatt

SEQ ID NO: 778534 - DNA, 23 bp, Homo sapiens
cagggatgccaacaccttcttgg

SEQ ID NO: 778535 - DNA, 14 bp, Homo sapiens
cagggatgccctgg

SEQ ID NO: 778536 - DNA, 16 bp, Homo sapiens
cagggatgccctggag

SEQ ID NO: 778537 - DNA, 12 bp, Homo sapiens
cagggatgctgg

SEQ ID NO: 778538 - DNA, 18 bp, Homo sapiens
cagggatgctgggctggg

SEQ ID NO: 778539 - DNA, 21 bp, Homo sapiens
cagggatgctgggctgggccc

SEQ ID NO: 778540 - DNA, 22 bp, Homo sapiens
cagggatgctgggctgggccct

SEQ ID NO: 778541 - DNA, 18 bp, Homo sapiens
cagggattaacctctgca

SEQ ID NO: 778542 - DNA, 20 bp, Homo sapiens
cagggattaacctctgcact

SEQ ID NO: 778543 - DNA, 17 bp, Homo sapiens
cagggattccctgtccc

SEQ ID NO: 778544 - DNA, 18 bp, Homo sapiens
cagggattccctgtcccc

SEQ ID NO: 778545 - DNA, 23 bp, Homo sapiens
cagggattctgggcttggggtgt

SEQ ID NO: 778546 - DNA, 17 bp, Homo sapiens
cagggatttagcccatg

SEQ ID NO: 778547 - DNA, 23 bp, Homo sapiens
cagggcaacaagcccgttagccc

SEQ ID NO: 778548 - DNA, 20 bp, Homo sapiens
cagggcaagggttaaggcct

SEQ ID NO: 778549 - DNA, 23 bp, Homo sapiens
cagggcaagggttaaggcctgaa

SEQ ID NO: 778550 - DNA, 18 bp, Homo sapiens
cagggcaatgccatcagc

SEQ ID NO: 778551 - DNA, 24 bp, Homo sapiens
cagggcaatgccatcagcccctgg

SEQ ID NO: 778552 - DNA, 16 bp, Homo sapiens
cagggcacagatgacc

SEQ ID NO: 778553 - DNA, 19 bp, Homo sapiens
cagggcacagatgaccaaa

SEQ ID NO: 778554 - DNA, 19 bp, Homo sapiens
cagggcacgcaggaccagt

SEQ ID NO: 778555 - DNA, 13 bp, Homo sapiens
cagggcacgggga

SEQ ID NO: 778556 - DNA, 18 bp, Homo sapiens
cagggcagagcaggaagg

SEQ ID NO: 778557 - DNA, 16 bp, Homo sapiens
cagggcagaggaatgt

SEQ ID NO: 778558 - DNA, 19 bp, Homo sapiens
cagggcagaggaatgtagg

SEQ ID NO: 778559 - DNA, 16 bp, Homo sapiens
cagggcagcagtgggg

SEQ ID NO: 778560 - DNA, 19 bp, Homo sapiens
cagggcagcagtggggtga

SEQ ID NO: 778561 - DNA, 12 bp, Homo sapiens
cagggcagcctc

SEQ ID NO: 778562 - DNA, 17 bp, Homo sapiens
cagggcagcctggatcc

SEQ ID NO: 778563 - DNA, 15 bp, Homo sapiens
cagggcagcggctcc

SEQ ID NO: 778564 - DNA, 17 bp, Homo sapiens
cagggcagcggctccac

SEQ ID NO: 778565 - DNA, 15 bp, Homo sapiens
cagggcagctgcctg

SEQ ID NO: 778566 - DNA, 18 bp, Homo sapiens
cagggcagctgcctggcc

SEQ ID NO: 778567 - DNA, 20 bp, Homo sapiens
cagggcagctgcctggccat

SEQ ID NO: 778568 - DNA, 16 bp, Homo sapiens
cagggcaggccttgct

SEQ ID NO: 778569 - DNA, 22 bp, Homo sapiens
cagggcaggggatgcccagaag

SEQ ID NO: 778570 - DNA, 21 bp, Homo sapiens
cagggcagggtagtgcagggc

SEQ ID NO: 778571 - DNA, 13 bp, Homo sapiens
cagggcagggtct

SEQ ID NO: 778572 - DNA, 14 bp, Homo sapiens
cagggcagggtctg

SEQ ID NO: 778573 - DNA, 18 bp, Homo sapiens
cagggcagggtctgggct

SEQ ID NO: 778574 - DNA, 22 bp, Homo sapiens
cagggcagtccttactccccca

SEQ ID NO: 778575 - DNA, 15 bp, Homo sapiens
cagggcagtggccaa

SEQ ID NO: 778576 - DNA, 13 bp, Homo sapiens
cagggcatctcct

SEQ ID NO: 778577 - DNA, 15 bp, Homo sapiens
cagggcatcttgctg

SEQ ID NO: 778578 - DNA, 19 bp, Homo sapiens
cagggcatcttgctggcta

SEQ ID NO: 778579 - DNA, 16 bp, Homo sapiens
cagggcatgtgtatgt

SEQ ID NO: 778580 - DNA, 22 bp, Homo sapiens
cagggcatgtgtatgtgtctgc

SEQ ID NO: 778581 - DNA, 17 bp, Homo sapiens
cagggccaacttgaggg

SEQ ID NO: 778582 - DNA, 19 bp, Homo sapiens
cagggccaacttgagggcc

SEQ ID NO: 778583 - DNA, 18 bp, Homo sapiens
cagggccacctgcaggac

SEQ ID NO: 778584 - DNA, 20 bp, Homo sapiens
cagggccacctgcaggaccc

SEQ ID NO: 778585 - DNA, 20 bp, Homo sapiens
cagggccacgctccagctgc

SEQ ID NO: 778586 - DNA, 22 bp, Homo sapiens
cagggccacgctccagctgccc

SEQ ID NO: 778587 - DNA, 20 bp, Homo sapiens
cagggccagaaggagggcag

SEQ ID NO: 778588 - DNA, 15 bp, Homo sapiens
cagggccagactgga

SEQ ID NO: 778589 - DNA, 16 bp, Homo sapiens
cagggccagactggaa

SEQ ID NO: 778590 - DNA, 11 bp, Homo sapiens
cagggccaggg

SEQ ID NO: 778591 - DNA, 18 bp, Homo sapiens
cagggccagggcaatgcc

SEQ ID NO: 778592 - DNA, 19 bp, Homo sapiens
cagggccagggccctgcag

SEQ ID NO: 778593 - DNA, 19 bp, Homo sapiens
cagggccaggtgcagacct

SEQ ID NO: 778594 - DNA, 20 bp, Homo sapiens
cagggccaggtgcagacctt

SEQ ID NO: 778595 - DNA, 18 bp, Homo sapiens
cagggccagtggggcctg

SEQ ID NO: 778596 - DNA, 19 bp, Homo sapiens
cagggccagtggggcctgt

SEQ ID NO: 778597 - DNA, 15 bp, Homo sapiens
cagggccatgcagac

SEQ ID NO: 778598 - DNA, 22 bp, Homo sapiens
cagggccatgcagacctcatgc

SEQ ID NO: 778599 - DNA, 16 bp, Homo sapiens
cagggccatgcctgcc

SEQ ID NO: 778600 - DNA, 18 bp, Homo sapiens
cagggccatgctgaggcc

SEQ ID NO: 778601 - DNA, 22 bp, Homo sapiens
cagggccatgctgaggcctggg

SEQ ID NO: 778602 - DNA, 22 bp, Homo sapiens
cagggcccaccttggaccctgg

SEQ ID NO: 778603 - DNA, 23 bp, Homo sapiens
cagggcccaccttggaccctggt

SEQ ID NO: 778604 - DNA, 13 bp, Homo sapiens
cagggcccagagc

SEQ ID NO: 778605 - DNA, 19 bp, Homo sapiens
cagggcccagagcccttga

SEQ ID NO: 778606 - DNA, 11 bp, Homo sapiens
cagggcccagg

SEQ ID NO: 778607 - DNA, 16 bp, Homo sapiens
cagggcccaggccatg

SEQ ID NO: 778608 - DNA, 15 bp, Homo sapiens
cagggcccaggcctg

SEQ ID NO: 778609 - DNA, 15 bp, Homo sapiens
cagggccccagaagg

SEQ ID NO: 778610 - DNA, 22 bp, Homo sapiens
cagggccccagcactaaagcag

SEQ ID NO: 778611 - DNA, 15 bp, Homo sapiens
cagggcccccatctc

SEQ ID NO: 778612 - DNA, 18 bp, Homo sapiens
cagggcccctcaccctgc

SEQ ID NO: 778613 - DNA, 21 bp, Homo sapiens
cagggcccctcaccctgcctt

SEQ ID NO: 778614 - DNA, 22 bp, Homo sapiens
cagggcccctcaccctgcctta

SEQ ID NO: 778615 - DNA, 12 bp, Homo sapiens
cagtgcctgctg

SEQ ID NO: 778616 - DNA, 17 bp, Homo sapiens
cagtgccttacctcctg

SEQ ID NO: 778617 - DNA, 21 bp, Homo sapiens
cagtgccttacctcctgccca

SEQ ID NO: 778618 - DNA, 22 bp, Homo sapiens
cagtgccttacctcctgcccag

SEQ ID NO: 778619 - DNA, 16 bp, Homo sapiens
cagtgccttccataat

SEQ ID NO: 778620 - DNA, 23 bp, Homo sapiens
cagtgccttccataattatgaca

SEQ ID NO: 778621 - DNA, 13 bp, Homo sapiens
cagtgccttcctc

SEQ ID NO: 778622 - DNA, 11 bp, Homo sapiens
cagtgccttct

SEQ ID NO: 778623 - DNA, 21 bp, Homo sapiens
cagtgccttggggaatttcct

SEQ ID NO: 778624 - DNA, 22 bp, Homo sapiens
cagtgccttggggaatttcctc

SEQ ID NO: 778625 - DNA, 20 bp, Homo sapiens
cagtgcgctcgttccggtcc

SEQ ID NO: 778626 - DNA, 17 bp, Homo sapiens
cagtgcgtgatttctca

SEQ ID NO: 778627 - DNA, 14 bp, Homo sapiens
cagtgctagaaaat

SEQ ID NO: 778628 - DNA, 23 bp, Homo sapiens
cagtgctcatacgtatctgctca

SEQ ID NO: 778629 - DNA, 16 bp, Homo sapiens
cagtgctctcagctgg

SEQ ID NO: 778630 - DNA, 19 bp, Homo sapiens
cagtgctctcagctggcag

SEQ ID NO: 778631 - DNA, 15 bp, Homo sapiens
cagtgctctgcctca

SEQ ID NO: 778632 - DNA, 23 bp, Homo sapiens
cagtgctcttttctcctcactgt

SEQ ID NO: 778633 - DNA, 18 bp, Homo sapiens
cagtgctgccatgccact

SEQ ID NO: 778634 - DNA, 17 bp, Homo sapiens
cagtgctgccccttgca

SEQ ID NO: 778635 - DNA, 18 bp, Homo sapiens
cagtgctgccccttgcaa

SEQ ID NO: 778636 - DNA, 21 bp, Homo sapiens
cagtgctgccccttgcaagcc

SEQ ID NO: 778637 - DNA, 16 bp, Homo sapiens
cagtgctgccctgcga

SEQ ID NO: 778638 - DNA, 13 bp, Homo sapiens
cagtgctgcttct

SEQ ID NO: 778639 - DNA, 19 bp, Homo sapiens
cagtgctgcttctcttggg

SEQ ID NO: 778640 - DNA, 16 bp, Homo sapiens
cagtgctgcttcttgc

SEQ ID NO: 778641 - DNA, 18 bp, Homo sapiens
cagtgctgtggcctgggc

SEQ ID NO: 778642 - DNA, 16 bp, Homo sapiens
cagtgcttcagcctga

SEQ ID NO: 778643 - DNA, 17 bp, Homo sapiens
cagtgcttcagcctgag

SEQ ID NO: 778644 - DNA, 18 bp, Homo sapiens
cagtgcttcagcctgagg

SEQ ID NO: 778645 - DNA, 19 bp, Homo sapiens
cagtgcttcagcctgaggc

SEQ ID NO: 778646 - DNA, 20 bp, Homo sapiens
cagtgcttcagcctgaggct

SEQ ID NO: 778647 - DNA, 16 bp, Homo sapiens
cagtgcttgggctcca

SEQ ID NO: 778648 - DNA, 16 bp, Homo sapiens
cagtgctttaatggca

SEQ ID NO: 778649 - DNA, 19 bp, Homo sapiens
cagtgctttgcatgtatta

SEQ ID NO: 778650 - DNA, 20 bp, Homo sapiens
cagtgcttttaagtgaaaat

SEQ ID NO: 778651 - DNA, 19 bp, Homo sapiens
cagtgcttttcactacttt

SEQ ID NO: 778652 - DNA, 19 bp, Homo sapiens
cagtggaagttcttcaaga

SEQ ID NO: 778653 - DNA, 15 bp, Homo sapiens
cagtggaattgtaca

SEQ ID NO: 778654 - DNA, 17 bp, Homo sapiens
cagtggaccctgtggcc

SEQ ID NO: 778655 - DNA, 22 bp, Homo sapiens
cagtggaccctgtggccaggtg

SEQ ID NO: 778656 - DNA, 16 bp, Homo sapiens
cagtggacctagcctg

SEQ ID NO: 778657 - DNA, 18 bp, Homo sapiens
cagtggacctagcctgga

SEQ ID NO: 778658 - DNA, 19 bp, Homo sapiens
cagtggacctagcctggat

SEQ ID NO: 778659 - DNA, 20 bp, Homo sapiens
cagtggactcagaaagccaa

SEQ ID NO: 778660 - DNA, 17 bp, Homo sapiens
cagtggactctgaggac

SEQ ID NO: 778661 - DNA, 19 bp, Homo sapiens
cagtggactttccaccccc

SEQ ID NO: 778662 - DNA, 18 bp, Homo sapiens
cagtggagctggtctgcc

SEQ ID NO: 778663 - DNA, 15 bp, Homo sapiens
cagtggaggaagagg

SEQ ID NO: 778664 - DNA, 15 bp, Homo sapiens
cagtggaggtttgtc

SEQ ID NO: 778665 - DNA, 14 bp, Homo sapiens
cagtggatacgtgt

SEQ ID NO: 778666 - DNA, 16 bp, Homo sapiens
cagtggccaagcctgc

SEQ ID NO: 778667 - DNA, 20 bp, Homo sapiens
cagtggcccccgggcctgca

SEQ ID NO: 778668 - DNA, 18 bp, Homo sapiens
cagtggcctacaaatcag

SEQ ID NO: 778669 - DNA, 21 bp, Homo sapiens
cagtggcctcaaccctccctc

SEQ ID NO: 778670 - DNA, 14 bp, Homo sapiens
cagtggcctcttga

SEQ ID NO: 778671 - DNA, 15 bp, Homo sapiens
cagtggcctcttgag

SEQ ID NO: 778672 - DNA, 23 bp, Homo sapiens
cagtggcctcttgagttcctctg

SEQ ID NO: 778673 - DNA, 17 bp, Homo sapiens
cagtggccttccccagc

SEQ ID NO: 778674 - DNA, 19 bp, Homo sapiens
cagtggccttccccagcat

SEQ ID NO: 778675 - DNA, 16 bp, Homo sapiens
cagtggcctttcagtg

SEQ ID NO: 778676 - DNA, 20 bp, Homo sapiens
cagtggcctttttctgagat

SEQ ID NO: 778677 - DNA, 20 bp, Homo sapiens
cagtggcgcattctaggctc

SEQ ID NO: 778678 - DNA, 21 bp, Homo sapiens
cagtggcgggtgatggccagc

SEQ ID NO: 778679 - DNA, 19 bp, Homo sapiens
cagtggcgttgttgcatgt

SEQ ID NO: 778680 - DNA, 21 bp, Homo sapiens
cagtggctagtggggtgaaca

SEQ ID NO: 778681 - DNA, 13 bp, Homo sapiens
cagtggctcgctc

SEQ ID NO: 778682 - DNA, 19 bp, Homo sapiens
cagtggctctcagagcagc

SEQ ID NO: 778683 - DNA, 13 bp, Homo sapiens
cagtggctctcca

SEQ ID NO: 778684 - DNA, 20 bp, Homo sapiens
cagtggctgggtgggcccag

SEQ ID NO: 778685 - DNA, 20 bp, Homo sapiens
cagtggctggtccagggcta

SEQ ID NO: 778686 - DNA, 14 bp, Homo sapiens
cagtggctggtgcc

SEQ ID NO: 778687 - DNA, 19 bp, Homo sapiens
cagtggctggtgcccatga

SEQ ID NO: 778688 - DNA, 15 bp, Homo sapiens
cagtggcttcccagc

SEQ ID NO: 778689 - DNA, 18 bp, Homo sapiens
cagtggcttcccagctct

SEQ ID NO: 778690 - DNA, 14 bp, Homo sapiens
cagtggcttttcat

SEQ ID NO: 778691 - DNA, 20 bp, Homo sapiens
cagtggcttttgccccagaa

SEQ ID NO: 778692 - DNA, 19 bp, Homo sapiens
cagtgggaacgtgactgcc

SEQ ID NO: 778693 - DNA, 20 bp, Homo sapiens
cagtgggaacgtgactgccc

SEQ ID NO: 778694 - DNA, 11 bp, Homo sapiens
cagtgggacaa

SEQ ID NO: 778695 - DNA, 13 bp, Homo sapiens
cagtgggacagag

SEQ ID NO: 778696 - DNA, 13 bp, Homo sapiens
cagtgggagccct

SEQ ID NO: 778697 - DNA, 14 bp, Homo sapiens
cagtgggagccctg

SEQ ID NO: 778698 - DNA, 13 bp, Homo sapiens
cagtgggagctga

SEQ ID NO: 778699 - DNA, 11 bp, Homo sapiens
cagtgggaggg

SEQ ID NO: 778700 - DNA, 14 bp, Homo sapiens
cagtgggaggggca

SEQ ID NO: 778701 - DNA, 22 bp, Homo sapiens
cagtgggagggtaccagcagaa

SEQ ID NO: 778702 - DNA, 13 bp, Homo sapiens
cagtgggcagggg

SEQ ID NO: 778703 - DNA, 14 bp, Homo sapiens
cagtgggcaggtgg

SEQ ID NO: 778704 - DNA, 15 bp, Homo sapiens
cagtgggcaggtggc

SEQ ID NO: 778705 - DNA, 17 bp, Homo sapiens
cagtgggcaggtggccg

SEQ ID NO: 778706 - DNA, 18 bp, Homo sapiens
cagtgggcctgctgaggc

SEQ ID NO: 778707 - DNA, 13 bp, Homo sapiens
cagtgggctgcac

SEQ ID NO: 778708 - DNA, 11 bp, Homo sapiens
cagtgggctgt

SEQ ID NO: 778709 - DNA, 17 bp, Homo sapiens
cagtggggacagggagg

SEQ ID NO: 778710 - DNA, 13 bp, Homo sapiens
cagtggggcctgt

SEQ ID NO: 778711 - DNA, 22 bp, Homo sapiens
cagtggggtgaaattttcttaa

SEQ ID NO: 778712 - DNA, 22 bp, Homo sapiens
cagtgggtgatgcttttgctgc

SEQ ID NO: 778713 - DNA, 17 bp, Homo sapiens
cagtgggtggcacctcc

SEQ ID NO: 778714 - DNA, 20 bp, Homo sapiens
cagtgggtggcacctcctga

SEQ ID NO: 778715 - DNA, 15 bp, Homo sapiens
cagtggtaaaaaggc

SEQ ID NO: 778716 - DNA, 15 bp, Homo sapiens
cagtggtaagctctg

SEQ ID NO: 778717 - DNA, 20 bp, Homo sapiens
cagtggtaagctctggcttt

SEQ ID NO: 778718 - DNA, 16 bp, Homo sapiens
cagtggtagagaggtt

SEQ ID NO: 778719 - DNA, 17 bp, Homo sapiens
cagtggtagagaggttt

SEQ ID NO: 778720 - DNA, 18 bp, Homo sapiens
cagtggtcaaaccgcact

SEQ ID NO: 778721 - DNA, 11 bp, Homo sapiens
cagtggtctta

SEQ ID NO: 778722 - DNA, 23 bp, Homo sapiens
cagtggtgaagaaaactccttta

SEQ ID NO: 778723 - DNA, 16 bp, Homo sapiens
cagtggtgaccccctt

SEQ ID NO: 778724 - DNA, 22 bp, Homo sapiens
cagtggtgcaatcacagctcac

SEQ ID NO: 778725 - DNA, 20 bp, Homo sapiens
cagtggtggttttctgttct

SEQ ID NO: 778726 - DNA, 22 bp, Homo sapiens
cagtggtggttttctgttcttt

SEQ ID NO: 778727 - DNA, 15 bp, Homo sapiens
cagtggtgtgaaaca

SEQ ID NO: 778728 - DNA, 23 bp, Homo sapiens
cagtggtttctacttcccctggg

SEQ ID NO: 778729 - DNA, 18 bp, Homo sapiens
cagtggtttgagacactg

SEQ ID NO: 778730 - DNA, 21 bp, Homo sapiens
cagtggttttatactgaagga

SEQ ID NO: 778731 - DNA, 16 bp, Homo sapiens
cagtgtacacgtctgg

SEQ ID NO: 778732 - DNA, 17 bp, Homo sapiens
cagtgtacacgtctgga

SEQ ID NO: 778733 - DNA, 16 bp, Homo sapiens
cagtgtagattttata

SEQ ID NO: 778734 - DNA, 20 bp, Homo sapiens
cagtgtagcatcttcctctg

SEQ ID NO: 778735 - DNA, 15 bp, Homo sapiens
cagtgtatggggcag

SEQ ID NO: 778736 - DNA, 23 bp, Homo sapiens
cagtgtatggggcagcttccggc

SEQ ID NO: 778737 - DNA, 20 bp, Homo sapiens
cagtgtatttttgtaaaaaa

SEQ ID NO: 778738 - DNA, 13 bp, Homo sapiens
cagtgtcactggt

SEQ ID NO: 778739 - DNA, 21 bp, Homo sapiens
cagttagcagggatgttcctt

SEQ ID NO: 778740 - DNA, 19 bp, Homo sapiens
cagttagggttgagttact

SEQ ID NO: 778741 - DNA, 22 bp, Homo sapiens
cagttagggttttgcaataact

SEQ ID NO: 778742 - DNA, 19 bp, Homo sapiens
cagttagttgtgaaagaaa

SEQ ID NO: 778743 - DNA, 17 bp, Homo sapiens
cagttataaaattaaaa

SEQ ID NO: 778744 - DNA, 15 bp, Homo sapiens
cagttataagcgtat

SEQ ID NO: 778745 - DNA, 17 bp, Homo sapiens
cagttataagcgtattt

SEQ ID NO: 778746 - DNA, 21 bp, Homo sapiens
cagttataagtagcaggccaa

SEQ ID NO: 778747 - DNA, 19 bp, Homo sapiens
cagttatacagttataaaa

SEQ ID NO: 778748 - DNA, 14 bp, Homo sapiens
cagttatatgatat

SEQ ID NO: 778749 - DNA, 15 bp, Homo sapiens
cagttatatgatatt

SEQ ID NO: 778750 - DNA, 16 bp, Homo sapiens
cagttatattttgcag

SEQ ID NO: 778751 - DNA, 18 bp, Homo sapiens
cagttatattttgcagtt

SEQ ID NO: 778752 - DNA, 22 bp, Homo sapiens
cagttatctaagttaatttaaa

SEQ ID NO: 778753 - DNA, 18 bp, Homo sapiens
cagttatgtgaatgatct

SEQ ID NO: 778754 - DNA, 20 bp, Homo sapiens
cagttatgtgaatgatctct

SEQ ID NO: 778755 - DNA, 15 bp, Homo sapiens
cagttattacatgta

SEQ ID NO: 778756 - DNA, 10 bp, Homo sapiens
cagttatttt

SEQ ID NO: 778757 - DNA, 16 bp, Homo sapiens
cagttcaaagtgtata

SEQ ID NO: 778758 - DNA, 17 bp, Homo sapiens
cagttcaaatcctcacc

SEQ ID NO: 778759 - DNA, 21 bp, Homo sapiens
cagttcaacctggtggcacca

SEQ ID NO: 778760 - DNA, 22 bp, Homo sapiens
cagttcaacctggtggcaccag

SEQ ID NO: 778761 - DNA, 19 bp, Homo sapiens
cagttcaatctcccgctgc

SEQ ID NO: 778762 - DNA, 22 bp, Homo sapiens
cagttcacttctttgcagagcc

SEQ ID NO: 778763 - DNA, 16 bp, Homo sapiens
cagttcagcaccaccc

SEQ ID NO: 778764 - DNA, 23 bp, Homo sapiens
cagttcaggagtcccaaggaaag

SEQ ID NO: 778765 - DNA, 20 bp, Homo sapiens
cagttcagtctgtagggagt

SEQ ID NO: 778766 - DNA, 19 bp, Homo sapiens
cagttcatcgattttctat

SEQ ID NO: 778767 - DNA, 12 bp, Homo sapiens
cagttcatcttt

SEQ ID NO: 778768 - DNA, 22 bp, Homo sapiens
cagttcatgtatgttcagaaga

SEQ ID NO: 778769 - DNA, 17 bp, Homo sapiens
cagttcattagaaatat

SEQ ID NO: 778770 - DNA, 20 bp, Homo sapiens
cagttcattagaaatatttt

SEQ ID NO: 778771 - DNA, 18 bp, Homo sapiens
cagttcattattttgtgg

SEQ ID NO: 778772 - DNA, 18 bp, Homo sapiens
cagttcattgcactttga

SEQ ID NO: 778773 - DNA, 12 bp, Homo sapiens
cagttccaagaa

SEQ ID NO: 778774 - DNA, 16 bp, Homo sapiens
cagttccaagaaagat

SEQ ID NO: 778775 - DNA, 22 bp, Homo sapiens
cagttccatttatgctggttaa

SEQ ID NO: 778776 - DNA, 19 bp, Homo sapiens
cagttcccacattaaagaa

SEQ ID NO: 778777 - DNA, 12 bp, Homo sapiens
cagttcccagct

SEQ ID NO: 778778 - DNA, 18 bp, Homo sapiens
cagttcccagctcccccc

SEQ ID NO: 778779 - DNA, 21 bp, Homo sapiens
cagttcccatggtgtatgtgg

SEQ ID NO: 778780 - DNA, 22 bp, Homo sapiens
cagttcccatggtgtatgtggt

SEQ ID NO: 778781 - DNA, 15 bp, Homo sapiens
cagttcccccagtac

SEQ ID NO: 778782 - DNA, 19 bp, Homo sapiens
cagttccctcctgcccagg

SEQ ID NO: 778783 - DNA, 14 bp, Homo sapiens
catatatctacaca

SEQ ID NO: 778784 - DNA, 19 bp, Homo sapiens
catatatgctgtatttctt

SEQ ID NO: 778785 - DNA, 14 bp, Homo sapiens
catatattgaggtt

SEQ ID NO: 778786 - DNA, 16 bp, Homo sapiens
catatattttttaaaa

SEQ ID NO: 778787 - DNA, 21 bp, Homo sapiens
catatattttttaaaataagt

SEQ ID NO: 778788 - DNA, 13 bp, Homo sapiens
catatcagttgag

SEQ ID NO: 778789 - DNA, 19 bp, Homo sapiens
catatcatggtaatgacag

SEQ ID NO: 778790 - DNA, 19 bp, Homo sapiens
catatcattaaacaaataa

SEQ ID NO: 778791 - DNA, 14 bp, Homo sapiens
catatcatttctta

SEQ ID NO: 778792 - DNA, 16 bp, Homo sapiens
catatcatttgtgaag

SEQ ID NO: 778793 - DNA, 19 bp, Homo sapiens
catatcatttgtgaagaat

SEQ ID NO: 778794 - DNA, 17 bp, Homo sapiens
catatccaagtaccaat

SEQ ID NO: 778795 - DNA, 14 bp, Homo sapiens
catatccctgccca

SEQ ID NO: 778796 - DNA, 19 bp, Homo sapiens
catatccctgcccagcctg

SEQ ID NO: 778797 - DNA, 22 bp, Homo sapiens
catatccctgcccagcctgtgg

SEQ ID NO: 778798 - DNA, 15 bp, Homo sapiens
catatcctgagccat

SEQ ID NO: 778799 - DNA, 11 bp, Homo sapiens
catatcctgcc

SEQ ID NO: 778800 - DNA, 18 bp, Homo sapiens
catatcgctgacttcatg

SEQ ID NO: 778801 - DNA, 14 bp, Homo sapiens
catatctccttccc

SEQ ID NO: 778802 - DNA, 21 bp, Homo sapiens
catatctctgccgtctctcct

SEQ ID NO: 778803 - DNA, 20 bp, Homo sapiens
catatctcttatcttacgaa

SEQ ID NO: 778804 - DNA, 16 bp, Homo sapiens
catatctgcctcccct

SEQ ID NO: 778805 - DNA, 13 bp, Homo sapiens
catattgtaaaac

SEQ ID NO: 778806 - DNA, 17 bp, Homo sapiens
catattgtaaaacaggt

SEQ ID NO: 778807 - DNA, 19 bp, Homo sapiens
catattgtaaaacaggtag

SEQ ID NO: 778808 - DNA, 16 bp, Homo sapiens
catattgtatgtaagt

SEQ ID NO: 778809 - DNA, 18 bp, Homo sapiens
catattgtatgtaagtaa

SEQ ID NO: 778810 - DNA, 13 bp, Homo sapiens
catattgtgccaa

SEQ ID NO: 778811 - DNA, 23 bp, Homo sapiens
catattgtgcttcacagtagagc

SEQ ID NO: 778812 - DNA, 16 bp, Homo sapiens
catattgttgaaaggt

SEQ ID NO: 778813 - DNA, 15 bp, Homo sapiens
catattgtttgatct

SEQ ID NO: 778814 - DNA, 13 bp, Homo sapiens
catatttaatgtt

SEQ ID NO: 778815 - DNA, 22 bp, Homo sapiens
catatttaatgttttaaatgta

SEQ ID NO: 778816 - DNA, 20 bp, Homo sapiens
catatttacttcttatacat

SEQ ID NO: 778817 - DNA, 22 bp, Homo sapiens
catatttatagcaatccatgtt

SEQ ID NO: 778818 - DNA, 23 bp, Homo sapiens
catatttatattgtatattctgg

SEQ ID NO: 778819 - DNA, 13 bp, Homo sapiens
catatttatttca

SEQ ID NO: 778820 - DNA, 21 bp, Homo sapiens
catatttccccttggacactt

SEQ ID NO: 778821 - DNA, 11 bp, Homo sapiens
catatttctgt

SEQ ID NO: 778822 - DNA, 12 bp, Homo sapiens
catatttctgta

SEQ ID NO: 778823 - DNA, 18 bp, Homo sapiens
catatttgatttctaatt

SEQ ID NO: 778824 - DNA, 14 bp, Homo sapiens
catatttgtggaat

SEQ ID NO: 778825 - DNA, 16 bp, Homo sapiens
catatttgttacttta

SEQ ID NO: 778826 - DNA, 13 bp, Homo sapiens
catattttaaaat

SEQ ID NO: 778827 - DNA, 17 bp, Homo sapiens
catattttaaacagagg

SEQ ID NO: 778828 - DNA, 17 bp, Homo sapiens
catattttagctgcacg

SEQ ID NO: 778829 - DNA, 23 bp, Homo sapiens
catattttattactgtttattac

SEQ ID NO: 778830 - DNA, 18 bp, Homo sapiens
catattttcaccatttga

SEQ ID NO: 778831 - DNA, 19 bp, Homo sapiens
catattttccccctgtttt

SEQ ID NO: 778832 - DNA, 12 bp, Homo sapiens
catattttgctg

SEQ ID NO: 778833 - DNA, 13 bp, Homo sapiens
catattttgctgg

SEQ ID NO: 778834 - DNA, 16 bp, Homo sapiens
catatttttctaaaga

SEQ ID NO: 778835 - DNA, 19 bp, Homo sapiens
catcaaaatgagtcaggca

SEQ ID NO: 778836 - DNA, 15 bp, Homo sapiens
catcaaaatgctttt

SEQ ID NO: 778837 - DNA, 22 bp, Homo sapiens
catcaaagcagaagtctggctt

SEQ ID NO: 778838 - DNA, 21 bp, Homo sapiens
catcaaagctagaatgtgaat

SEQ ID NO: 778839 - DNA, 14 bp, Homo sapiens
catcaaagcttctt

SEQ ID NO: 778840 - DNA, 20 bp, Homo sapiens
catcaaagtggtaaatactg

SEQ ID NO: 778841 - DNA, 16 bp, Homo sapiens
catcaaataaatttct

SEQ ID NO: 778842 - DNA, 21 bp, Homo sapiens
catcaaataaatttctgggat

SEQ ID NO: 778843 - DNA, 15 bp, Homo sapiens
catcaacaaaaattg

SEQ ID NO: 778844 - DNA, 14 bp, Homo sapiens
catcaacatcttgg

SEQ ID NO: 778845 - DNA, 23 bp, Homo sapiens
catcaacatggcaattgcactca

SEQ ID NO: 778846 - DNA, 14 bp, Homo sapiens
catcaactgaatga

SEQ ID NO: 778847 - DNA, 15 bp, Homo sapiens
catcaacttaaaagt

SEQ ID NO: 778848 - DNA, 16 bp, Homo sapiens
catcaagaagggctgc

SEQ ID NO: 778849 - DNA, 21 bp, Homo sapiens
catcaagaagggctgcatgat

SEQ ID NO: 778850 - DNA, 19 bp, Homo sapiens
catcaagactatctacaaa

SEQ ID NO: 778851 - DNA, 20 bp, Homo sapiens
catcaagactatctacaaaa

SEQ ID NO: 778852 - DNA, 22 bp, Homo sapiens
catcaagactatctacaaaaat

SEQ ID NO: 778853 - DNA, 20 bp, Homo sapiens
catcaagcaggaattatgtc

SEQ ID NO: 778854 - DNA, 14 bp, Homo sapiens
catcaagtaataca

SEQ ID NO: 778855 - DNA, 13 bp, Homo sapiens
catcaagttctcc

SEQ ID NO: 778856 - DNA, 17 bp, Homo sapiens
catcaatacaaccagcc

SEQ ID NO: 778857 - DNA, 19 bp, Homo sapiens
catcaatatccctcttgta

SEQ ID NO: 778858 - DNA, 24 bp, Homo sapiens
catcaatatccctcttgtaagtca

SEQ ID NO: 778859 - DNA, 21 bp, Homo sapiens
catcaatcctggtaaccaaat

SEQ ID NO: 778860 - DNA, 14 bp, Homo sapiens
catcaatcttgtta

SEQ ID NO: 778861 - DNA, 14 bp, Homo sapiens
catcaatgttcatt

SEQ ID NO: 778862 - DNA, 16 bp, Homo sapiens
catcaattaacatcgt

SEQ ID NO: 778863 - DNA, 17 bp, Homo sapiens
catcaattaattgattc

SEQ ID NO: 778864 - DNA, 17 bp, Homo sapiens
catcacaagaacacaca

SEQ ID NO: 778865 - DNA, 17 bp, Homo sapiens
catcacacctgccctaa

SEQ ID NO: 778866 - DNA, 23 bp, Homo sapiens
catcacactcaaggacaggagcc

SEQ ID NO: 778867 - DNA, 14 bp, Homo sapiens
catcacactgggtg

SEQ ID NO: 778868 - DNA, 22 bp, Homo sapiens
catcacacttatattttatgaa

SEQ ID NO: 778869 - DNA, 23 bp, Homo sapiens
catcacatgagacaattttgctt

SEQ ID NO: 778870 - DNA, 19 bp, Homo sapiens
catcaccaccgcctctggc

SEQ ID NO: 778871 - DNA, 20 bp, Homo sapiens
catcaccaccgcctctggcc

SEQ ID NO: 778872 - DNA, 15 bp, Homo sapiens
catcaccaggtgcat

SEQ ID NO: 778873 - DNA, 15 bp, Homo sapiens
catccaaccccccac

SEQ ID NO: 778874 - DNA, 21 bp, Homo sapiens
catccaaccccccacctgcca

SEQ ID NO: 778875 - DNA, 14 bp, Homo sapiens
catccaaccttccc

SEQ ID NO: 778876 - DNA, 15 bp, Homo sapiens
catccaactccagca

SEQ ID NO: 778877 - DNA, 16 bp, Homo sapiens
catccaactccagcaa

SEQ ID NO: 778878 - DNA, 17 bp, Homo sapiens
catcccctttcctcccc

SEQ ID NO: 778879 - DNA, 17 bp, Homo sapiens
catcccgagcacctcca

SEQ ID NO: 778880 - DNA, 14 bp, Homo sapiens
catcccgcttagcc

SEQ ID NO: 778881 - DNA, 19 bp, Homo sapiens
catcccgcttagcctgcct

SEQ ID NO: 778882 - DNA, 16 bp, Homo sapiens
catcccggaggaaatc

SEQ ID NO: 778883 - DNA, 12 bp, Homo sapiens
catcccggcctc

SEQ ID NO: 778884 - DNA, 16 bp, Homo sapiens
catcccgtatcacagt

SEQ ID NO: 778885 - DNA, 19 bp, Homo sapiens
catcccgtatcacagtgtt

SEQ ID NO: 778886 - DNA, 20 bp, Homo sapiens
catcccgtatcacagtgttt

SEQ ID NO: 778887 - DNA, 14 bp, Homo sapiens
catcccgtgttctc

SEQ ID NO: 778888 - DNA, 15 bp, Homo sapiens
catccctaccactgt

SEQ ID NO: 778889 - DNA, 16 bp, Homo sapiens
catccctagaagagca

SEQ ID NO: 778890 - DNA, 22 bp, Homo sapiens
catccctagaagagcacagagc

SEQ ID NO: 778891 - DNA, 17 bp, Homo sapiens
catccctcccccagcag

SEQ ID NO: 778892 - DNA, 15 bp, Homo sapiens
catccctccttgcct

SEQ ID NO: 778893 - DNA, 13 bp, Homo sapiens
catccctgaagac

SEQ ID NO: 778894 - DNA, 20 bp, Homo sapiens
catccctgactggccaaacc

SEQ ID NO: 778895 - DNA, 21 bp, Homo sapiens
catccctgactggccaaaccc

SEQ ID NO: 778896 - DNA, 12 bp, Homo sapiens
catccctgctct

SEQ ID NO: 778897 - DNA, 14 bp, Homo sapiens
catccctgctctgg

SEQ ID NO: 778898 - DNA, 19 bp, Homo sapiens
catccctgcttgcccgctc

SEQ ID NO: 778899 - DNA, 15 bp, Homo sapiens
catgccaccctcaca

SEQ ID NO: 778900 - DNA, 17 bp, Homo sapiens
catgccactgccaggca

SEQ ID NO: 778901 - DNA, 20 bp, Homo sapiens
catgccactgccaggcacct

SEQ ID NO: 778902 - DNA, 21 bp, Homo sapiens
catgccactgccaggcacctg

SEQ ID NO: 778903 - DNA, 13 bp, Homo sapiens
catgccagctggc

SEQ ID NO: 778904 - DNA, 22 bp, Homo sapiens
catgccagctggcctttgtaag

SEQ ID NO: 778905 - DNA, 18 bp, Homo sapiens
catgccaggacccgccag

SEQ ID NO: 778906 - DNA, 20 bp, Homo sapiens
catgccaggacccgccagcc

SEQ ID NO: 778907 - DNA, 14 bp, Homo sapiens
catgccagtatttt

SEQ ID NO: 778908 - DNA, 23 bp, Homo sapiens
catgccagtttttaaaatgctgc

SEQ ID NO: 778909 - DNA, 16 bp, Homo sapiens
catgccatctgttttc

SEQ ID NO: 778910 - DNA, 11 bp, Homo sapiens
catgcccacaa

SEQ ID NO: 778911 - DNA, 16 bp, Homo sapiens
catgcccaccccctgc

SEQ ID NO: 778912 - DNA, 18 bp, Homo sapiens
catgcccaccccctgccc

SEQ ID NO: 778913 - DNA, 21 bp, Homo sapiens
catgcccacctgcccatcaca

SEQ ID NO: 778914 - DNA, 15 bp, Homo sapiens
catgcccagctctct

SEQ ID NO: 778915 - DNA, 15 bp, Homo sapiens
catgccccacccccc

SEQ ID NO: 778916 - DNA, 20 bp, Homo sapiens
catgccccagctctggatga

SEQ ID NO: 778917 - DNA, 22 bp, Homo sapiens
catgccccagtcggccccatct

SEQ ID NO: 778918 - DNA, 13 bp, Homo sapiens
catgcccccctca

SEQ ID NO: 778919 - DNA, 21 bp, Homo sapiens
catgccccctcccttcacagg

SEQ ID NO: 778920 - DNA, 14 bp, Homo sapiens
catgccccctgcag

SEQ ID NO: 778921 - DNA, 19 bp, Homo sapiens
catgcccccttcgctcctc

SEQ ID NO: 778922 - DNA, 14 bp, Homo sapiens
catgcccctccccc

SEQ ID NO: 778923 - DNA, 17 bp, Homo sapiens
catgcccctcccccagc

SEQ ID NO: 778924 - DNA, 13 bp, Homo sapiens
catgcccctgaac

SEQ ID NO: 778925 - DNA, 14 bp, Homo sapiens
catgcccctggctg

SEQ ID NO: 778926 - DNA, 15 bp, Homo sapiens
catgcccctggctgg

SEQ ID NO: 778927 - DNA, 15 bp, Homo sapiens
catgccccttggctg

SEQ ID NO: 778928 - DNA, 16 bp, Homo sapiens
catgccccttggctgg

SEQ ID NO: 778929 - DNA, 15 bp, Homo sapiens
catgccctcccagga

SEQ ID NO: 778930 - DNA, 11 bp, Homo sapiens
catgccctcct

SEQ ID NO: 778931 - DNA, 13 bp, Homo sapiens
catgccctcctct

SEQ ID NO: 778932 - DNA, 14 bp, Homo sapiens
catgccctcctgga

SEQ ID NO: 778933 - DNA, 15 bp, Homo sapiens
catgccctcctggac

SEQ ID NO: 778934 - DNA, 13 bp, Homo sapiens
catgccctgggat

SEQ ID NO: 778935 - DNA, 19 bp, Homo sapiens
catgccctgtgcaacctct

SEQ ID NO: 778936 - DNA, 20 bp, Homo sapiens
catgccgcggtaggtaaggg

SEQ ID NO: 778937 - DNA, 14 bp, Homo sapiens
catgcctcagccct

SEQ ID NO: 778938 - DNA, 13 bp, Homo sapiens
catgcctcatgcc

SEQ ID NO: 778939 - DNA, 22 bp, Homo sapiens
catgcctctggaggcctctggc

SEQ ID NO: 778940 - DNA, 12 bp, Homo sapiens
catgcctgccaa

SEQ ID NO: 778941 - DNA, 12 bp, Homo sapiens
catgcctgcgcc

SEQ ID NO: 778942 - DNA, 23 bp, Homo sapiens
catgcctgcgcctgctgcctgct

SEQ ID NO: 778943 - DNA, 24 bp, Homo sapiens
catgcctgcgcctgctgcctgctg

SEQ ID NO: 778944 - DNA, 16 bp, Homo sapiens
catgcctgtccagcct

SEQ ID NO: 778945 - DNA, 23 bp, Homo sapiens
catgcctgtccagcctgggcagc

SEQ ID NO: 778946 - DNA, 14 bp, Homo sapiens
catgcctgtctctg

SEQ ID NO: 778947 - DNA, 20 bp, Homo sapiens
catgccttaaacctacctcc

SEQ ID NO: 778948 - DNA, 15 bp, Homo sapiens
catgccttaaatttg

SEQ ID NO: 778949 - DNA, 15 bp, Homo sapiens
catgccttgataaat

SEQ ID NO: 778950 - DNA, 10 bp, Homo sapiens
catgccttgg

SEQ ID NO: 778951 - DNA, 14 bp, Homo sapiens
catgccttggtgcc

SEQ ID NO: 778952 - DNA, 15 bp, Homo sapiens
catgccttggtgccg

SEQ ID NO: 778953 - DNA, 21 bp, Homo sapiens
catgcgaggggccagcagagg

SEQ ID NO: 778954 - DNA, 12 bp, Homo sapiens
catgcgcacaga

SEQ ID NO: 778955 - DNA, 22 bp, Homo sapiens
catgcgcacagagggaagccat

SEQ ID NO: 778956 - DNA, 21 bp, Homo sapiens
catgcgccccctccgccctgc

SEQ ID NO: 778957 - DNA, 23 bp, Homo sapiens
catgcgccccctccgccctgcca

SEQ ID NO: 778958 - DNA, 14 bp, Homo sapiens
catgcgctcagggc

SEQ ID NO: 778959 - DNA, 15 bp, Homo sapiens
catgcgctcagggcc

SEQ ID NO: 778960 - DNA, 22 bp, Homo sapiens
catgcgctcagggccatgctga

SEQ ID NO: 778961 - DNA, 16 bp, Homo sapiens
catgcggctgcccacg

SEQ ID NO: 778962 - DNA, 14 bp, Homo sapiens
catgcggtagccag

SEQ ID NO: 778963 - DNA, 16 bp, Homo sapiens
catgcggtagccagca

SEQ ID NO: 778964 - DNA, 19 bp, Homo sapiens
catgcggtagccagcacac

SEQ ID NO: 778965 - DNA, 15 bp, Homo sapiens
catgcgtatatgtgc

SEQ ID NO: 778966 - DNA, 20 bp, Homo sapiens
catgcgtgccgcctgctcct

SEQ ID NO: 778967 - DNA, 22 bp, Homo sapiens
catgcgtgccgcctgctcctca

SEQ ID NO: 778968 - DNA, 14 bp, Homo sapiens
catgcgtgtgtcag

SEQ ID NO: 778969 - DNA, 17 bp, Homo sapiens
catgcgtgtgtcaggga

SEQ ID NO: 778970 - DNA, 17 bp, Homo sapiens
catgctaacaaagacaa

SEQ ID NO: 778971 - DNA, 16 bp, Homo sapiens
catgctaagagaagta

SEQ ID NO: 778972 - DNA, 13 bp, Homo sapiens
catgctacagtta

SEQ ID NO: 778973 - DNA, 14 bp, Homo sapiens
catgctaggatgcg

SEQ ID NO: 778974 - DNA, 17 bp, Homo sapiens
catgctatgagttttct

SEQ ID NO: 778975 - DNA, 22 bp, Homo sapiens
catgctatgttctgtcttccca

SEQ ID NO: 778976 - DNA, 13 bp, Homo sapiens
catgctcaacccc

SEQ ID NO: 778977 - DNA, 14 bp, Homo sapiens
catgctcaaccccc

SEQ ID NO: 778978 - DNA, 19 bp, Homo sapiens
catgctcaacccccctccc

SEQ ID NO: 778979 - DNA, 21 bp, Homo sapiens
catgctcaacccccctcccag

SEQ ID NO: 778980 - DNA, 22 bp, Homo sapiens
catgctcaacccccctcccaga

SEQ ID NO: 778981 - DNA, 13 bp, Homo sapiens
catgctcacctct

SEQ ID NO: 778982 - DNA, 15 bp, Homo sapiens
catgctcagtgcctt

SEQ ID NO: 778983 - DNA, 16 bp, Homo sapiens
catgctcatctgctgg

SEQ ID NO: 778984 - DNA, 17 bp, Homo sapiens
catgctcatctgctggt

SEQ ID NO: 778985 - DNA, 12 bp, Homo sapiens
catgctccaaat

SEQ ID NO: 778986 - DNA, 22 bp, Homo sapiens
catgctccagattagagcctgt

SEQ ID NO: 778987 - DNA, 17 bp, Homo sapiens
catgctcctggcccact

SEQ ID NO: 778988 - DNA, 13 bp, Homo sapiens
catgctccttaat

SEQ ID NO: 778989 - DNA, 14 bp, Homo sapiens
catgctctctgcag

SEQ ID NO: 778990 - DNA, 12 bp, Homo sapiens
catgctctgccc

SEQ ID NO: 778991 - DNA, 18 bp, Homo sapiens
catgctctgccccaagcc

SEQ ID NO: 778992 - DNA, 19 bp, Homo sapiens
catgctctggaagcctgga

SEQ ID NO: 778993 - DNA, 16 bp, Homo sapiens
catgctctttttttaa

SEQ ID NO: 778994 - DNA, 19 bp, Homo sapiens
catgctgaaggctgaaaga

SEQ ID NO: 778995 - DNA, 13 bp, Homo sapiens
catgctgaaggga

SEQ ID NO: 778996 - DNA, 19 bp, Homo sapiens
catgctgaagggaccttga

SEQ ID NO: 778997 - DNA, 13 bp, Homo sapiens
catgctgaatgcc

SEQ ID NO: 778998 - DNA, 18 bp, Homo sapiens
catgctgaatgccccctg

SEQ ID NO: 778999 - DNA, 21 bp, Homo sapiens
catgctgaatgccccctgctt

SEQ ID NO: 779000 - DNA, 19 bp, Homo sapiens
catgctgaggttttgaata

SEQ ID NO: 779001 - DNA, 18 bp, Homo sapiens
catgctgcccagccactc

SEQ ID NO: 779002 - DNA, 22 bp, Homo sapiens
catgctgcctggcacagaccag

SEQ ID NO: 779003 - DNA, 14 bp, Homo sapiens
catgctgccttctt

SEQ ID NO: 779004 - DNA, 22 bp, Homo sapiens
catgctgctctggtgcacgcct

SEQ ID NO: 779005 - DNA, 20 bp, Homo sapiens
catgctgctttttggcacag

SEQ ID NO: 779006 - DNA, 16 bp, Homo sapiens
catgctggagggaggc

SEQ ID NO: 779007 - DNA, 19 bp, Homo sapiens
catgctggatactggacac

SEQ ID NO: 779008 - DNA, 23 bp, Homo sapiens
catgctggcggcgcagagggaag

SEQ ID NO: 779009 - DNA, 13 bp, Homo sapiens
catgctgggattt

SEQ ID NO: 779010 - DNA, 21 bp, Homo sapiens
catgcttagcttatctttctt

SEQ ID NO: 779011 - DNA, 21 bp, Homo sapiens
catgcttagtcactgcctgca

SEQ ID NO: 779012 - DNA, 16 bp, Homo sapiens
catgcttcacaatgtt

SEQ ID NO: 779013 - DNA, 20 bp, Homo sapiens
catgcttcctttctctcctg

SEQ ID NO: 779014 - DNA, 22 bp, Homo sapiens
catgcttcctttctctcctggc

SEQ ID NO: 779015 - DNA, 18 bp, Homo sapiens
catgcttgacatacctac

SEQ ID NO: 779016 - DNA, 14 bp, Homo sapiens
catgcttgggctga

SEQ ID NO: 779017 - DNA, 15 bp, Homo sapiens
catgctttgctgcta

SEQ ID NO: 779018 - DNA, 19 bp, Homo sapiens
catgctttgctgctatgaa

SEQ ID NO: 779019 - DNA, 13 bp, Homo sapiens
catggaaaacaga

SEQ ID NO: 779020 - DNA, 16 bp, Homo sapiens
catggaaaacagagta

SEQ ID NO: 779021 - DNA, 18 bp, Homo sapiens
catggaaacctgaaaaaa

SEQ ID NO: 779022 - DNA, 16 bp, Homo sapiens
catggaaatagaatga

SEQ ID NO: 779023 - DNA, 15 bp, Homo sapiens
catggaaatttaaag

SEQ ID NO: 779024 - DNA, 21 bp, Homo sapiens
catggaaatttaaagcaggtt

SEQ ID NO: 779025 - DNA, 18 bp, Homo sapiens
catggaagcaataaagct

SEQ ID NO: 779026 - DNA, 18 bp, Homo sapiens
catggaaggggcttctgg

SEQ ID NO: 779027 - DNA, 16 bp, Homo sapiens
catggaaggtgccaga

SEQ ID NO: 779028 - DNA, 20 bp, Homo sapiens
catggaaggtgccagaagga

SEQ ID NO: 779029 - DNA, 21 bp, Homo sapiens
catggaaggtgccagaaggaa

SEQ ID NO: 779030 - DNA, 16 bp, Homo sapiens
catggaagttggggca

SEQ ID NO: 779031 - DNA, 16 bp, Homo sapiens
catggaataacatgta

SEQ ID NO: 779032 - DNA, 23 bp, Homo sapiens
catggaatatttataggccaggg

SEQ ID NO: 779033 - DNA, 17 bp, Homo sapiens
catggaatcgaagtgtt

SEQ ID NO: 779034 - DNA, 16 bp, Homo sapiens
catggaatcttgctgc

SEQ ID NO: 779035 - DNA, 22 bp, Homo sapiens
catggaatcttgctgcaggccc

SEQ ID NO: 779036 - DNA, 23 bp, Homo sapiens
catggaatggcaggtgtcatatg

SEQ ID NO: 779037 - DNA, 19 bp, Homo sapiens
catggaattcacaaagtaa

SEQ ID NO: 779038 - DNA, 17 bp, Homo sapiens
catggaattccctcctg

SEQ ID NO: 779039 - DNA, 22 bp, Homo sapiens
catggacaccccttatccagga

SEQ ID NO: 779040 - DNA, 19 bp, Homo sapiens
catggacactacacccagc

SEQ ID NO: 779041 - DNA, 21 bp, Homo sapiens
catggacactacacccagcaa

SEQ ID NO: 779042 - DNA, 19 bp, Homo sapiens
catggacactccagtgcca

SEQ ID NO: 779043 - DNA, 18 bp, Homo sapiens
catggacaggctggctcc

SEQ ID NO: 779044 - DNA, 12 bp, Homo sapiens
catggacagggc

SEQ ID NO: 779045 - DNA, 18 bp, Homo sapiens
catggacagggccagggt

SEQ ID NO: 779046 - DNA, 20 bp, Homo sapiens
catggacatttagaagaaag

SEQ ID NO: 779047 - DNA, 12 bp, Homo sapiens
catggaccagca

SEQ ID NO: 779048 - DNA, 16 bp, Homo sapiens
catggaccagcatctg

SEQ ID NO: 779049 - DNA, 22 bp, Homo sapiens
catggaccagcatctggtcttg

SEQ ID NO: 779050 - DNA, 12 bp, Homo sapiens
catggacccgga

SEQ ID NO: 779051 - DNA, 15 bp, Homo sapiens
catggacctaacatt

SEQ ID NO: 779052 - DNA, 15 bp, Homo sapiens
catggactgagctgg

SEQ ID NO: 779053 - DNA, 16 bp, Homo sapiens
catggacttgtatatt

SEQ ID NO: 779054 - DNA, 15 bp, Homo sapiens
catggagaaaccctg

SEQ ID NO: 779055 - DNA, 21 bp, Homo sapiens
catggagaagggttctgccct

SEQ ID NO: 779056 - DNA, 19 bp, Homo sapiens
catggagactcctgccctg

SEQ ID NO: 779057 - DNA, 16 bp, Homo sapiens
catggagatgtaaaat

SEQ ID NO: 779058 - DNA, 19 bp, Homo sapiens
catggagccccctctgccg

SEQ ID NO: 779059 - DNA, 22 bp, Homo sapiens
catggagcctggaactgcatca

SEQ ID NO: 779060 - DNA, 19 bp, Homo sapiens
catggaggaggagggaggc

SEQ ID NO: 779061 - DNA, 17 bp, Homo sapiens
catggaggccctcctgt

SEQ ID NO: 779062 - DNA, 18 bp, Homo sapiens
catggagtgtgtattgtt

SEQ ID NO: 779063 - DNA, 18 bp, Homo sapiens
catggatatagttttact

SEQ ID NO: 779064 - DNA, 22 bp, Homo sapiens
catggattaatagagttggagt

SEQ ID NO: 779065 - DNA, 18 bp, Homo sapiens
catggattttggcagggc

SEQ ID NO: 779066 - DNA, 19 bp, Homo sapiens
catggattttggcagggcg

SEQ ID NO: 779067 - DNA, 20 bp, Homo sapiens
catggcaaatcaggggccag

SEQ ID NO: 779068 - DNA, 23 bp, Homo sapiens
catggcaaatcaggggccagaga

SEQ ID NO: 779069 - DNA, 14 bp, Homo sapiens
catggcacaggccc

SEQ ID NO: 779070 - DNA, 14 bp, Homo sapiens
catggcaccagccc

SEQ ID NO: 779071 - DNA, 22 bp, Homo sapiens
catggcaccttcagactttgct

SEQ ID NO: 779072 - DNA, 23 bp, Homo sapiens
catggcaccttcagactttgctt

SEQ ID NO: 779073 - DNA, 13 bp, Homo sapiens
catggcagctggt

SEQ ID NO: 779074 - DNA, 14 bp, Homo sapiens
catggcagctgttt

SEQ ID NO: 779075 - DNA, 19 bp, Homo sapiens
catggcagctgtttctcat

SEQ ID NO: 779076 - DNA, 15 bp, Homo sapiens
catggcatccaagac

SEQ ID NO: 779077 - DNA, 17 bp, Homo sapiens
catggcatccctttttc

SEQ ID NO: 779078 - DNA, 18 bp, Homo sapiens
catggccaccttttcagc

SEQ ID NO: 779079 - DNA, 18 bp, Homo sapiens
catggccatagaggccca

SEQ ID NO: 779080 - DNA, 19 bp, Homo sapiens
catggccatagaggcccag

SEQ ID NO: 779081 - DNA, 14 bp, Homo sapiens
catggcccattgga

SEQ ID NO: 779082 - DNA, 22 bp, Homo sapiens
catggcccattggagcacctgg

SEQ ID NO: 779083 - DNA, 12 bp, Homo sapiens
catggcccccaa

SEQ ID NO: 779084 - DNA, 14 bp, Homo sapiens
catggcccccaata

SEQ ID NO: 779085 - DNA, 19 bp, Homo sapiens
catggcccccaataaaggc

SEQ ID NO: 779086 - DNA, 13 bp, Homo sapiens
catggcccctctg

SEQ ID NO: 779087 - DNA, 16 bp, Homo sapiens
catggcccctctgacc

SEQ ID NO: 779088 - DNA, 14 bp, Homo sapiens
catggccctggggt

SEQ ID NO: 779089 - DNA, 19 bp, Homo sapiens
catggccctgtcccaggcc

SEQ ID NO: 779090 - DNA, 20 bp, Homo sapiens
catggccgaagccccttgga

SEQ ID NO: 779091 - DNA, 15 bp, Homo sapiens
catggccgcttctag

SEQ ID NO: 779092 - DNA, 21 bp, Homo sapiens
catggcctattatattaaaat

SEQ ID NO: 779093 - DNA, 18 bp, Homo sapiens
catggccttgaaacagtt

SEQ ID NO: 779094 - DNA, 17 bp, Homo sapiens
catggcgccctgcctcc

SEQ ID NO: 779095 - DNA, 22 bp, Homo sapiens
catggcgtaatgggcctgccca

SEQ ID NO: 779096 - DNA, 23 bp, Homo sapiens
catggcgtaatgggcctgcccaa

SEQ ID NO: 779097 - DNA, 18 bp, Homo sapiens
catggctagcctttcttg

SEQ ID NO: 779098 - DNA, 14 bp, Homo sapiens
catggctattttat

SEQ ID NO: 779099 - DNA, 17 bp, Homo sapiens
catggctattttatatt

SEQ ID NO: 779100 - DNA, 20 bp, Homo sapiens
catggctcagagcttgaaga

SEQ ID NO: 779101 - DNA, 12 bp, Homo sapiens
catggctcaggc

SEQ ID NO: 779102 - DNA, 16 bp, Homo sapiens
catggctcaggcaagc

SEQ ID NO: 779103 - DNA, 18 bp, Homo sapiens
catggctcaggcaagccc

SEQ ID NO: 779104 - DNA, 17 bp, Homo sapiens
catggctccagaaatgt

SEQ ID NO: 779105 - DNA, 18 bp, Homo sapiens
catggctgaagttggcca

SEQ ID NO: 779106 - DNA, 23 bp, Homo sapiens
catggctgtggttcctaagcctg

SEQ ID NO: 779107 - DNA, 15 bp, Homo sapiens
catggcttaatgttt

SEQ ID NO: 779108 - DNA, 20 bp, Homo sapiens
catggcttaatgtttattcc

SEQ ID NO: 779109 - DNA, 15 bp, Homo sapiens
catggcttcctgaga

SEQ ID NO: 779110 - DNA, 18 bp, Homo sapiens
catggctttcatcctgtg

SEQ ID NO: 779111 - DNA, 20 bp, Homo sapiens
catgggaaaagaccagggct

SEQ ID NO: 779112 - DNA, 23 bp, Homo sapiens
catgggaaacgtatgtgtgcagg

SEQ ID NO: 779113 - DNA, 18 bp, Homo sapiens
catgggaaagccacctct

SEQ ID NO: 779114 - DNA, 14 bp, Homo sapiens
catgggaacctcat

SEQ ID NO: 779115 - DNA, 20 bp, Homo sapiens
catgggaacgcagcctccag

SEQ ID NO: 779116 - DNA, 16 bp, Homo sapiens
catgggaaggggagga

SEQ ID NO: 779117 - DNA, 19 bp, Homo sapiens
catgggaatgatagcccag

SEQ ID NO: 779118 - DNA, 17 bp, Homo sapiens
catgggacctcctccct

SEQ ID NO: 779119 - DNA, 19 bp, Homo sapiens
catgggacctcctccctca

SEQ ID NO: 779120 - DNA, 14 bp, Homo sapiens
catgggacctggcc

SEQ ID NO: 779121 - DNA, 13 bp, Homo sapiens
catgggagccggg

SEQ ID NO: 779122 - DNA, 22 bp, Homo sapiens
catgggagccgggtctgcctct

SEQ ID NO: 779123 - DNA, 15 bp, Homo sapiens
catgggagggatcag

SEQ ID NO: 779124 - DNA, 18 bp, Homo sapiens
catgggagggatcagccc

SEQ ID NO: 779125 - DNA, 19 bp, Homo sapiens
catgggaggtggggcctca

SEQ ID NO: 779126 - DNA, 17 bp, Homo sapiens
catgggatatgtggtgt

SEQ ID NO: 779127 - DNA, 20 bp, Homo sapiens
catgggatccaattttaata

SEQ ID NO: 779128 - DNA, 15 bp, Homo sapiens
catgggcacagtggt

SEQ ID NO: 779129 - DNA, 17 bp, Homo sapiens
catgggcagagcccaag

SEQ ID NO: 779130 - DNA, 21 bp, Homo sapiens
catgggcattgcagccttgcg

SEQ ID NO: 779131 - DNA, 13 bp, Homo sapiens
catgggccagagc

SEQ ID NO: 779132 - DNA, 16 bp, Homo sapiens
catgggccagagcctc

SEQ ID NO: 779133 - DNA, 17 bp, Homo sapiens
catgggcccgctgcctc

SEQ ID NO: 779134 - DNA, 16 bp, Homo sapiens
catgggcctctctggg

SEQ ID NO: 779135 - DNA, 14 bp, Homo sapiens
catgggcctgctgc

SEQ ID NO: 779136 - DNA, 23 bp, Homo sapiens
catgggcctggccacctctctcc

SEQ ID NO: 779137 - DNA, 16 bp, Homo sapiens
catgggcctgggcctg

SEQ ID NO: 779138 - DNA, 18 bp, Homo sapiens
catgggcctgggcctgct

SEQ ID NO: 779139 - DNA, 20 bp, Homo sapiens
catgggcctttaagaacctt

SEQ ID NO: 779140 - DNA, 22 bp, Homo sapiens
catgggcctttaagaaccttaa

SEQ ID NO: 779141 - DNA, 22 bp, Homo sapiens
catgggctagtgtgagtggcag

SEQ ID NO: 779142 - DNA, 12 bp, Homo sapiens
catgggcttgga

SEQ ID NO: 779143 - DNA, 13 bp, Homo sapiens
catgggcttggac

SEQ ID NO: 779144 - DNA, 14 bp, Homo sapiens
catggggaaggcag

SEQ ID NO: 779145 - DNA, 16 bp, Homo sapiens
catggggaaggcagag

SEQ ID NO: 779146 - DNA, 17 bp, Homo sapiens
catggggaggcagcaga

SEQ ID NO: 779147 - DNA, 18 bp, Homo sapiens
catggggaggcagcagag

SEQ ID NO: 779148 - DNA, 11 bp, Homo sapiens
catggggaggg

SEQ ID NO: 779149 - DNA, 21 bp, Homo sapiens
catggggatcaattttcatta

SEQ ID NO: 779150 - DNA, 16 bp, Homo sapiens
catggggatctggggg

SEQ ID NO: 779151 - DNA, 18 bp, Homo sapiens
catggggatctggggggt

SEQ ID NO: 779152 - DNA, 16 bp, Homo sapiens
catggggcaagccagg

SEQ ID NO: 779153 - DNA, 19 bp, Homo sapiens
catggggcaagccagggcc

SEQ ID NO: 779154 - DNA, 15 bp, Homo sapiens
catggggcagaggct

SEQ ID NO: 779155 - DNA, 18 bp, Homo sapiens
catggggcagaggcttcc

SEQ ID NO: 779156 - DNA, 16 bp, Homo sapiens
catgggggtgacccca

SEQ ID NO: 779157 - DNA, 18 bp, Homo sapiens
catgggggtgaccccacg

SEQ ID NO: 779158 - DNA, 23 bp, Homo sapiens
catggggtcagccccaagggctg

SEQ ID NO: 779159 - DNA, 21 bp, Homo sapiens
catggggtccatccccttccc

SEQ ID NO: 779160 - DNA, 17 bp, Homo sapiens
catggggtccttggagt

SEQ ID NO: 779161 - DNA, 21 bp, Homo sapiens
catggggtggggtagggctga

SEQ ID NO: 779162 - DNA, 21 bp, Homo sapiens
catggggttcgagactccatc

SEQ ID NO: 779163 - DNA, 14 bp, Homo sapiens
catgggtccagggc

SEQ ID NO: 779164 - DNA, 23 bp, Homo sapiens
catgggtccttgatgccagaggg

SEQ ID NO: 779165 - DNA, 14 bp, Homo sapiens
catgggtctggcct

SEQ ID NO: 779166 - DNA, 19 bp, Homo sapiens
catgggtgaagggagagcc

SEQ ID NO: 779167 - DNA, 23 bp, Homo sapiens
catgggtgaagggagagccagct

SEQ ID NO: 779168 - DNA, 15 bp, Homo sapiens
catggtactgtagca

SEQ ID NO: 779169 - DNA, 21 bp, Homo sapiens
catggtagactctttttgtaa

SEQ ID NO: 779170 - DNA, 15 bp, Homo sapiens
catggtattgggact

SEQ ID NO: 779171 - DNA, 16 bp, Homo sapiens
catggtcacacactga

SEQ ID NO: 779172 - DNA, 21 bp, Homo sapiens
catggtcacacactgatgctt

SEQ ID NO: 779173 - DNA, 15 bp, Homo sapiens
catggtcatggacag

SEQ ID NO: 779174 - DNA, 15 bp, Homo sapiens
catggtccctgcctt

SEQ ID NO: 779175 - DNA, 17 bp, Homo sapiens
catggtccctgccttag

SEQ ID NO: 779176 - DNA, 17 bp, Homo sapiens
catggtccggtgtcctt

SEQ ID NO: 779177 - DNA, 19 bp, Homo sapiens
catggtcctgtctgtcctt

SEQ ID NO: 779178 - DNA, 21 bp, Homo sapiens
catggtgaaaatgtactgaga

SEQ ID NO: 779179 - DNA, 13 bp, Homo sapiens
catggtgaaactc

SEQ ID NO: 779180 - DNA, 23 bp, Homo sapiens
catggtgaagtgcttggaacata

SEQ ID NO: 779181 - DNA, 23 bp, Homo sapiens
catggtgaccaccccctgttccc

SEQ ID NO: 779182 - DNA, 15 bp, Homo sapiens
catggtgagcctagc

SEQ ID NO: 779183 - DNA, 22 bp, Homo sapiens
catggtgcctgagaggcaggca

SEQ ID NO: 779184 - DNA, 17 bp, Homo sapiens
catggtgctaggaagag

SEQ ID NO: 779185 - DNA, 19 bp, Homo sapiens
catggtgcttgttaatgct

SEQ ID NO: 779186 - DNA, 16 bp, Homo sapiens
catggtggagggcact

SEQ ID NO: 779187 - DNA, 20 bp, Homo sapiens
catggtggcacacgcctgta

SEQ ID NO: 779188 - DNA, 19 bp, Homo sapiens
catggtggtgatgtccaaa

SEQ ID NO: 779189 - DNA, 19 bp, Homo sapiens
catggtggtgcgtgcctgt

SEQ ID NO: 779190 - DNA, 17 bp, Homo sapiens
catggtgtatgtggttt

SEQ ID NO: 779191 - DNA, 15 bp, Homo sapiens
catggtgtctcccaa

SEQ ID NO: 779192 - DNA, 19 bp, Homo sapiens
catggtgtctcccaacatg

SEQ ID NO: 779193 - DNA, 14 bp, Homo sapiens
catggtgtggccat

SEQ ID NO: 779194 - DNA, 15 bp, Homo sapiens
catggtgtggccatc

SEQ ID NO: 779195 - DNA, 17 bp, Homo sapiens
catggtgtgtggtgcta

SEQ ID NO: 779196 - DNA, 13 bp, Homo sapiens
catggtgttgcgt

SEQ ID NO: 779197 - DNA, 15 bp, Homo sapiens
catggtgtttatgca

SEQ ID NO: 779198 - DNA, 19 bp, Homo sapiens
catggttaaggtaaagtaa

SEQ ID NO: 779199 - DNA, 16 bp, Homo sapiens
catggttgagaaatga

SEQ ID NO: 779200 - DNA, 18 bp, Homo sapiens
catggttgggggaatgca

SEQ ID NO: 779201 - DNA, 14 bp, Homo sapiens
catggttgtttttt

SEQ ID NO: 779202 - DNA, 19 bp, Homo sapiens
catggtttaaaagaaaaaa

SEQ ID NO: 779203 - DNA, 20 bp, Homo sapiens
catggtttaaaagaaaaaat

SEQ ID NO: 779204 - DNA, 17 bp, Homo sapiens
catggtttccatttact

SEQ ID NO: 779205 - DNA, 17 bp, Homo sapiens
catggtttgcatttaaa

SEQ ID NO: 779206 - DNA, 19 bp, Homo sapiens
catggttttggctctccca

SEQ ID NO: 779207 - DNA, 23 bp, Homo sapiens
catggttttggctctcccacccc

SEQ ID NO: 779208 - DNA, 12 bp, Homo sapiens
catgtaaaatat

SEQ ID NO: 779209 - DNA, 13 bp, Homo sapiens
catgtaaaatatg

SEQ ID NO: 779210 - DNA, 21 bp, Homo sapiens
catgtaaactatttgtggcaa

SEQ ID NO: 779211 - DNA, 14 bp, Homo sapiens
catgtaaataaata

SEQ ID NO: 779212 - DNA, 17 bp, Homo sapiens
catgtaaattgactgta

SEQ ID NO: 779213 - DNA, 15 bp, Homo sapiens
catgtaacagttgtg

SEQ ID NO: 779214 - DNA, 16 bp, Homo sapiens
catgtaacattggtga

SEQ ID NO: 779215 - DNA, 17 bp, Homo sapiens
catgtaacattggtgaa

SEQ ID NO: 779216 - DNA, 18 bp, Homo sapiens
catgtaactatttcttca

SEQ ID NO: 779217 - DNA, 17 bp, Homo sapiens
catgtaagaaaatgtta

SEQ ID NO: 779218 - DNA, 18 bp, Homo sapiens
catgtaagaaaatgttac

SEQ ID NO: 779219 - DNA, 14 bp, Homo sapiens
catgtaagaagccc

SEQ ID NO: 779220 - DNA, 19 bp, Homo sapiens
catgtaaggttgtgcaggg

SEQ ID NO: 779221 - DNA, 16 bp, Homo sapiens
catgtaatccttttgt

SEQ ID NO: 779222 - DNA, 19 bp, Homo sapiens
catgtaatgttaatgttat

SEQ ID NO: 779223 - DNA, 23 bp, Homo sapiens
catgtaatgttaatgttatatca

SEQ ID NO: 779224 - DNA, 19 bp, Homo sapiens
catgtaattttattttaaa

SEQ ID NO: 779225 - DNA, 23 bp, Homo sapiens
catgtacaaaatcgattggcttt

SEQ ID NO: 779226 - DNA, 19 bp, Homo sapiens
catgtacataaactgtcac

SEQ ID NO: 779227 - DNA, 15 bp, Homo sapiens
catgtacatgaagaa

SEQ ID NO: 779228 - DNA, 20 bp, Homo sapiens
catgtacatgaagaagctaa

SEQ ID NO: 779229 - DNA, 16 bp, Homo sapiens
catgtacctcccctgc

SEQ ID NO: 779230 - DNA, 13 bp, Homo sapiens
catgtactccaga

SEQ ID NO: 779231 - DNA, 17 bp, Homo sapiens
catgtacttcctgtgta

SEQ ID NO: 779232 - DNA, 13 bp, Homo sapiens
catgtacttgttt

SEQ ID NO: 779233 - DNA, 23 bp, Homo sapiens
catgtactttggcatcttttgga

SEQ ID NO: 779234 - DNA, 20 bp, Homo sapiens
catgtagaaaatttgttatt

SEQ ID NO: 779235 - DNA, 19 bp, Homo sapiens
catgtagagaaaagcacac

SEQ ID NO: 779236 - DNA, 17 bp, Homo sapiens
catgtagccccctggcc

SEQ ID NO: 779237 - DNA, 22 bp, Homo sapiens
catgtagccccctggcctctgt

SEQ ID NO: 779238 - DNA, 15 bp, Homo sapiens
catgtagctgagttt

SEQ ID NO: 779239 - DNA, 16 bp, Homo sapiens
catgtaggtgagcctg

SEQ ID NO: 779240 - DNA, 20 bp, Homo sapiens
catgtaggtgagcctgggca

SEQ ID NO: 779241 - DNA, 17 bp, Homo sapiens
catgtagtaacactaat

SEQ ID NO: 779242 - DNA, 21 bp, Homo sapiens
catgtagtaacactaatatat

SEQ ID NO: 779243 - DNA, 23 bp, Homo sapiens
catgtagtaacactaatatattt

SEQ ID NO: 779244 - DNA, 15 bp, Homo sapiens
catgtataaccaagt

SEQ ID NO: 779245 - DNA, 19 bp, Homo sapiens
catgtatagttttccctat

SEQ ID NO: 779246 - DNA, 15 bp, Homo sapiens
catgtatcataatta

SEQ ID NO: 779247 - DNA, 18 bp, Homo sapiens
catgtatcataattacca

SEQ ID NO: 779248 - DNA, 14 bp, Homo sapiens
catgtatgaatgta

SEQ ID NO: 779249 - DNA, 13 bp, Homo sapiens
catgtatgcaagt

SEQ ID NO: 779250 - DNA, 14 bp, Homo sapiens
catgtatgcctgcc

SEQ ID NO: 779251 - DNA, 13 bp, Homo sapiens
catgtatgttatg

SEQ ID NO: 779252 - DNA, 22 bp, Homo sapiens
catgtatgttatgatattgttt

SEQ ID NO: 779253 - DNA, 23 bp, Homo sapiens
catgtatgttatgatattgttta

SEQ ID NO: 779254 - DNA, 20 bp, Homo sapiens
catgtattagctcactgaat

SEQ ID NO: 779255 - DNA, 17 bp, Homo sapiens
catgtattatcacatca

SEQ ID NO: 779256 - DNA, 16 bp, Homo sapiens
catgtattatgaaaaa

SEQ ID NO: 779257 - DNA, 19 bp, Homo sapiens
catgtattatgaaaaagat

SEQ ID NO: 779258 - DNA, 13 bp, Homo sapiens
catgttatgttta

SEQ ID NO: 779259 - DNA, 23 bp, Homo sapiens
catgttatttgtaatagatgttt

SEQ ID NO: 779260 - DNA, 22 bp, Homo sapiens
catgttcaaagccacattattt

SEQ ID NO: 779261 - DNA, 20 bp, Homo sapiens
catgttcaaattttatcatg

SEQ ID NO: 779262 - DNA, 20 bp, Homo sapiens
catgttcacaccgctgcact

SEQ ID NO: 779263 - DNA, 16 bp, Homo sapiens
catgttctcttcccag

SEQ ID NO: 779264 - DNA, 18 bp, Homo sapiens
catgttctcttcccaggc

SEQ ID NO: 779265 - DNA, 13 bp, Homo sapiens
catgttctgcccc

SEQ ID NO: 779266 - DNA, 17 bp, Homo sapiens
catgttctgcccccagc

SEQ ID NO: 779267 - DNA, 18 bp, Homo sapiens
catgttctgcccccagcc

SEQ ID NO: 779268 - DNA, 19 bp, Homo sapiens
catgttctgcccccagccc

SEQ ID NO: 779269 - DNA, 21 bp, Homo sapiens
catgttctgcccccagcccaa

SEQ ID NO: 779270 - DNA, 21 bp, Homo sapiens
catgttctgtgacatcctgct

SEQ ID NO: 779271 - DNA, 14 bp, Homo sapiens
catgttcttgtcat

SEQ ID NO: 779272 - DNA, 22 bp, Homo sapiens
catgttcttgtcataaaatgca

SEQ ID NO: 779273 - DNA, 15 bp, Homo sapiens
catgttgagccagtg

SEQ ID NO: 779274 - DNA, 20 bp, Homo sapiens
catgttgatcatgtactttt

SEQ ID NO: 779275 - DNA, 18 bp, Homo sapiens
catgttgctgaatttgta

SEQ ID NO: 779276 - DNA, 14 bp, Homo sapiens
catgttgctgagga

SEQ ID NO: 779277 - DNA, 15 bp, Homo sapiens
catgttggccaggct

SEQ ID NO: 779278 - DNA, 16 bp, Homo sapiens
catgttggccaggctg

SEQ ID NO: 779279 - DNA, 18 bp, Homo sapiens
catgttggccaggctggt

SEQ ID NO: 779280 - DNA, 15 bp, Homo sapiens
catgttgggaaactt

SEQ ID NO: 779281 - DNA, 20 bp, Homo sapiens
catgttgggaaacttggctc

SEQ ID NO: 779282 - DNA, 22 bp, Homo sapiens
catgttggtcaaaagctggatt

SEQ ID NO: 779283 - DNA, 20 bp, Homo sapiens
catgttggtcaggctggtct

SEQ ID NO: 779284 - DNA, 19 bp, Homo sapiens
catgttggtttattttcac

SEQ ID NO: 779285 - DNA, 15 bp, Homo sapiens
catgttgtaatgctg

SEQ ID NO: 779286 - DNA, 19 bp, Homo sapiens
catgttgtaatgctgcact

SEQ ID NO: 779287 - DNA, 20 bp, Homo sapiens
catgttgtaatgctgcactt

SEQ ID NO: 779288 - DNA, 22 bp, Homo sapiens
catgttgtcctttttatctgat

SEQ ID NO: 779289 - DNA, 15 bp, Homo sapiens
catgttgttttttca

SEQ ID NO: 779290 - DNA, 16 bp, Homo sapiens
catgttgttttttcat

SEQ ID NO: 779291 - DNA, 20 bp, Homo sapiens
catgtttaaatagcctaaat

SEQ ID NO: 779292 - DNA, 22 bp, Homo sapiens
catgtttaaatagcctaaatga

SEQ ID NO: 779293 - DNA, 19 bp, Homo sapiens
catgtttaaattgtaaatt

SEQ ID NO: 779294 - DNA, 23 bp, Homo sapiens
catgtttataaatcttatgctct

SEQ ID NO: 779295 - DNA, 15 bp, Homo sapiens
catgtttatgagaaa

SEQ ID NO: 779296 - DNA, 15 bp, Homo sapiens
catgtttatttttct

SEQ ID NO: 779297 - DNA, 18 bp, Homo sapiens
catgtttcactcctgctt

SEQ ID NO: 779298 - DNA, 21 bp, Homo sapiens
catgtttcactcctgcttctc

SEQ ID NO: 779299 - DNA, 17 bp, Homo sapiens
catgtttcatgttttgt

SEQ ID NO: 779300 - DNA, 14 bp, Homo sapiens
catgtttccagcag

SEQ ID NO: 779301 - DNA, 13 bp, Homo sapiens
catgtttcctcta

SEQ ID NO: 779302 - DNA, 16 bp, Homo sapiens
catgtttgagctcaga

SEQ ID NO: 779303 - DNA, 18 bp, Homo sapiens
catgtttgagctcagacc

SEQ ID NO: 779304 - DNA, 20 bp, Homo sapiens
catgtttgagctcagacccc

SEQ ID NO: 779305 - DNA, 14 bp, Homo sapiens
catgttttataatt

SEQ ID NO: 779306 - DNA, 15 bp, Homo sapiens
catgttttcaactgc

SEQ ID NO: 779307 - DNA, 15 bp, Homo sapiens
catgttttccattgt

SEQ ID NO: 779308 - DNA, 23 bp, Homo sapiens
catgttttgtgactatatagaga

SEQ ID NO: 779309 - DNA, 14 bp, Homo sapiens
catgtttttcccct

SEQ ID NO: 779310 - DNA, 21 bp, Homo sapiens
catgtttttctattaaaaata

SEQ ID NO: 779311 - DNA, 15 bp, Homo sapiens
catgtttttgccaaa

SEQ ID NO: 779312 - DNA, 17 bp, Homo sapiens
catgtttttgttttctt

SEQ ID NO: 779313 - DNA, 13 bp, Homo sapiens
catgttttttcat

SEQ ID NO: 779314 - DNA, 22 bp, Homo sapiens
cattaaaaaaaaaaaaaaaagt

SEQ ID NO: 779315 - DNA, 23 bp, Homo sapiens
cattaaaaaaatgtgcctagttt

SEQ ID NO: 779316 - DNA, 13 bp, Homo sapiens
cattaaaactcat

SEQ ID NO: 779317 - DNA, 12 bp, Homo sapiens
cattaaaagaaa

SEQ ID NO: 779318 - DNA, 16 bp, Homo sapiens
cattaaaataaaacaa

SEQ ID NO: 779319 - DNA, 18 bp, Homo sapiens
cattaaaataaaacaagc

SEQ ID NO: 779320 - DNA, 20 bp, Homo sapiens
cattaaaataaaacaagcct

SEQ ID NO: 779321 - DNA, 22 bp, Homo sapiens
cattaaaataaaacaagcctta

SEQ ID NO: 779322 - DNA, 15 bp, Homo sapiens
cattaaaatatatgt

SEQ ID NO: 779323 - DNA, 16 bp, Homo sapiens
cattaaacaaataaaa

SEQ ID NO: 779324 - DNA, 17 bp, Homo sapiens
cattaaacactgtaatc

SEQ ID NO: 779325 - DNA, 19 bp, Homo sapiens
cattaaacttttttaacca

SEQ ID NO: 779326 - DNA, 15 bp, Homo sapiens
cattaaagaagacct

SEQ ID NO: 779327 - DNA, 13 bp, Homo sapiens
cattaaagtcaga

SEQ ID NO: 779328 - DNA, 15 bp, Homo sapiens
cattaaagtcagaag

SEQ ID NO: 779329 - DNA, 17 bp, Homo sapiens
cattaaagtcagaagtt

SEQ ID NO: 779330 - DNA, 17 bp, Homo sapiens
cattaaagtctgaatca

SEQ ID NO: 779331 - DNA, 14 bp, Homo sapiens
cattaaattcacaa

SEQ ID NO: 779332 - DNA, 17 bp, Homo sapiens
cattaaattcacaaact

SEQ ID NO: 779333 - DNA, 21 bp, Homo sapiens
cattaaattcacaaactttta

SEQ ID NO: 779334 - DNA, 15 bp, Homo sapiens
cattaacaaataaaa

SEQ ID NO: 779335 - DNA, 21 bp, Homo sapiens
cattaacagttttccatgaaa

SEQ ID NO: 779336 - DNA, 22 bp, Homo sapiens
cattaacagttttccatgaaaa

SEQ ID NO: 779337 - DNA, 15 bp, Homo sapiens
cattaacggtgctaa

SEQ ID NO: 779338 - DNA, 18 bp, Homo sapiens
cattaactaaatgctcat

SEQ ID NO: 779339 - DNA, 18 bp, Homo sapiens
cattaactaatctattgg

SEQ ID NO: 779340 - DNA, 17 bp, Homo sapiens
cattaactccctccacc

SEQ ID NO: 779341 - DNA, 21 bp, Homo sapiens
cattaactccctccaccagcc

SEQ ID NO: 779342 - DNA, 22 bp, Homo sapiens
cattaactccctccaccagcct

SEQ ID NO: 779343 - DNA, 17 bp, Homo sapiens
cattaagaaaatcatat

SEQ ID NO: 779344 - DNA, 20 bp, Homo sapiens
cattaagcacacacatctgg

SEQ ID NO: 779345 - DNA, 13 bp, Homo sapiens
cattaaggtattt

SEQ ID NO: 779346 - DNA, 20 bp, Homo sapiens
cattaaggtatttcgaaact

SEQ ID NO: 779347 - DNA, 13 bp, Homo sapiens
cattaataaaaat

SEQ ID NO: 779348 - DNA, 20 bp, Homo sapiens
cattaatagcagcctttctc

SEQ ID NO: 779349 - DNA, 17 bp, Homo sapiens
cattaatcatttcccca

SEQ ID NO: 779350 - DNA, 21 bp, Homo sapiens
cattaatccacatgtttcaga

SEQ ID NO: 779351 - DNA, 20 bp, Homo sapiens
cattaatgcccagccagcca

SEQ ID NO: 779352 - DNA, 22 bp, Homo sapiens
cattaatgcccagccagccacc

SEQ ID NO: 779353 - DNA, 24 bp, Homo sapiens
cattaatgcccagccagccacccc

SEQ ID NO: 779354 - DNA, 21 bp, Homo sapiens
cattaatgcctgctttttgga

SEQ ID NO: 779355 - DNA, 22 bp, Homo sapiens
cattaatgcctgctttttggaa

SEQ ID NO: 779356 - DNA, 12 bp, Homo sapiens
cattaattacat

SEQ ID NO: 779357 - DNA, 22 bp, Homo sapiens
cattaattagttccagtttctc

SEQ ID NO: 779358 - DNA, 15 bp, Homo sapiens
cattaattattaata

SEQ ID NO: 779359 - DNA, 12 bp, Homo sapiens
cattaatttaaa

SEQ ID NO: 779360 - DNA, 14 bp, Homo sapiens
cattaatttaaatg

SEQ ID NO: 779361 - DNA, 18 bp, Homo sapiens
cattaattttgtgcattc

SEQ ID NO: 779362 - DNA, 22 bp, Homo sapiens
cattacaactgaccaagtttct

SEQ ID NO: 779363 - DNA, 14 bp, Homo sapiens
cattacagcttaat

SEQ ID NO: 779364 - DNA, 15 bp, Homo sapiens
cattacagttcataa

SEQ ID NO: 779365 - DNA, 12 bp, Homo sapiens
cattacagttct

SEQ ID NO: 779366 - DNA, 17 bp, Homo sapiens
cattacagttctttcct

SEQ ID NO: 779367 - DNA, 14 bp, Homo sapiens
cattacatggctgt

SEQ ID NO: 779368 - DNA, 15 bp, Homo sapiens
cattacatgtttaaa

SEQ ID NO: 779369 - DNA, 15 bp, Homo sapiens
cattacattattaaa

SEQ ID NO: 779370 - DNA, 14 bp, Homo sapiens
cattacatttctga

SEQ ID NO: 779371 - DNA, 15 bp, Homo sapiens
cattacatttctgaa

SEQ ID NO: 779372 - DNA, 17 bp, Homo sapiens
cattacatttctgaatt

SEQ ID NO: 779373 - DNA, 18 bp, Homo sapiens
cattacatttctgaattg

SEQ ID NO: 779374 - DNA, 11 bp, Homo sapiens
cattaccaaaa

SEQ ID NO: 779375 - DNA, 23 bp, Homo sapiens
cattaccaaaataataaaaatca

SEQ ID NO: 779376 - DNA, 15 bp, Homo sapiens
cattaccatgtaatg

SEQ ID NO: 779377 - DNA, 19 bp, Homo sapiens
cattacccacgtgacacca

SEQ ID NO: 779378 - DNA, 14 bp, Homo sapiens
cattaccccatacc

SEQ ID NO: 779379 - DNA, 16 bp, Homo sapiens
cattacccttccctgc

SEQ ID NO: 779380 - DNA, 17 bp, Homo sapiens
cattaccgcgttgtaaa

SEQ ID NO: 779381 - DNA, 18 bp, Homo sapiens
cattaccgcgttgtaaaa

SEQ ID NO: 779382 - DNA, 14 bp, Homo sapiens
cattacctgtttat

SEQ ID NO: 779383 - DNA, 16 bp, Homo sapiens
cattacgtgagccagg

SEQ ID NO: 779384 - DNA, 14 bp, Homo sapiens
cattacgtgcattt

SEQ ID NO: 779385 - DNA, 17 bp, Homo sapiens
cattacgtgcatttaaa

SEQ ID NO: 779386 - DNA, 18 bp, Homo sapiens
cattacgtgcatttaaac

SEQ ID NO: 779387 - DNA, 21 bp, Homo sapiens
cattacgtgcatttaaactct

SEQ ID NO: 779388 - DNA, 22 bp, Homo sapiens
cattacgtgcatttaaactctg

SEQ ID NO: 779389 - DNA, 17 bp, Homo sapiens
cattactactgtacacg

SEQ ID NO: 779390 - DNA, 15 bp, Homo sapiens
cattactctttttca

SEQ ID NO: 779391 - DNA, 23 bp, Homo sapiens
cattactgtacagggttatctgc

SEQ ID NO: 779392 - DNA, 13 bp, Homo sapiens
cattactgtcccc

SEQ ID NO: 779393 - DNA, 15 bp, Homo sapiens
cattacttgctttca

SEQ ID NO: 779394 - DNA, 19 bp, Homo sapiens
cattacttgggaaattttt

SEQ ID NO: 779395 - DNA, 17 bp, Homo sapiens
cattagaaatagacagt

SEQ ID NO: 779396 - DNA, 15 bp, Homo sapiens
cattagaaatatttt

SEQ ID NO: 779397 - DNA, 12 bp, Homo sapiens
cattagaatgtg

SEQ ID NO: 779398 - DNA, 16 bp, Homo sapiens
cattagagcacagctt

SEQ ID NO: 779399 - DNA, 21 bp, Homo sapiens
cattagagcacagcttcttct

SEQ ID NO: 779400 - DNA, 22 bp, Homo sapiens
cattagagcttaaattgtcaga

SEQ ID NO: 779401 - DNA, 17 bp, Homo sapiens
cattagagtcaactaca

SEQ ID NO: 779402 - DNA, 22 bp, Homo sapiens
cattagatattaggggggaaag

SEQ ID NO: 779403 - DNA, 15 bp, Homo sapiens
cattagatgtcatga

SEQ ID NO: 779404 - DNA, 19 bp, Homo sapiens
cattagattttattttact

SEQ ID NO: 779405 - DNA, 21 bp, Homo sapiens
cattagattttattttactat

SEQ ID NO: 779406 - DNA, 14 bp, Homo sapiens
cattagcagttgct

SEQ ID NO: 779407 - DNA, 14 bp, Homo sapiens
cattagccaaggat

SEQ ID NO: 779408 - DNA, 19 bp, Homo sapiens
cattagccagatttgtctt

SEQ ID NO: 779409 - DNA, 20 bp, Homo sapiens
cattaggccagcaacgcttg

SEQ ID NO: 779410 - DNA, 20 bp, Homo sapiens
cattaggggaaccattgttg

SEQ ID NO: 779411 - DNA, 21 bp, Homo sapiens
cattagtcatgtttatctgct

SEQ ID NO: 779412 - DNA, 22 bp, Homo sapiens
cattagtctcagtgaagactat

SEQ ID NO: 779413 - DNA, 22 bp, Homo sapiens
cattagtgtccccccttgaagc

SEQ ID NO: 779414 - DNA, 22 bp, Homo sapiens
cattataaaccttcagaagcta

SEQ ID NO: 779415 - DNA, 13 bp, Homo sapiens
cattataaacgtg

SEQ ID NO: 779416 - DNA, 20 bp, Homo sapiens
cattataactgaaggagaag

SEQ ID NO: 779417 - DNA, 21 bp, Homo sapiens
cattataatttgggtgactag

SEQ ID NO: 779418 - DNA, 16 bp, Homo sapiens
cattatatttgcatta

SEQ ID NO: 779419 - DNA, 13 bp, Homo sapiens
cattatattttga

SEQ ID NO: 779420 - DNA, 20 bp, Homo sapiens
cattatattttgaaagaagc

SEQ ID NO: 779421 - DNA, 13 bp, Homo sapiens
cattatcacatga

SEQ ID NO: 779422 - DNA, 14 bp, Homo sapiens
cattatcctttatt

SEQ ID NO: 779423 - DNA, 21 bp, Homo sapiens
cattatcgagcagcattttat

SEQ ID NO: 779424 - DNA, 20 bp, Homo sapiens
cattatcgccttttgacagc

SEQ ID NO: 779425 - DNA, 18 bp, Homo sapiens
cattatctagatactgta

SEQ ID NO: 779426 - DNA, 19 bp, Homo sapiens
cattatctcacttagtcct

SEQ ID NO: 779427 - DNA, 16 bp, Homo sapiens
cattatgagaggcaat

SEQ ID NO: 779428 - DNA, 22 bp, Homo sapiens
cattatgagaggcaatgattgt

SEQ ID NO: 779429 - DNA, 14 bp, Homo sapiens
cattatgatttcat

SEQ ID NO: 779430 - DNA, 15 bp, Homo sapiens
cattatgatttcatt

SEQ ID NO: 779431 - DNA, 21 bp, Homo sapiens
cattatgcacttttagaaatg

SEQ ID NO: 779432 - DNA, 20 bp, Homo sapiens
cattatgtccactgtgtata

SEQ ID NO: 779433 - DNA, 21 bp, Homo sapiens
cattatgtccactgtgtatag

SEQ ID NO: 779434 - DNA, 13 bp, Homo sapiens
cattattaaattg

SEQ ID NO: 779435 - DNA, 20 bp, Homo sapiens
cattattaggtcttaaagta

SEQ ID NO: 779436 - DNA, 22 bp, Homo sapiens
cattattatataaatcatgatg

SEQ ID NO: 779437 - DNA, 17 bp, Homo sapiens
cattattatttctgttc

SEQ ID NO: 779438 - DNA, 21 bp, Homo sapiens
cattattcctcagattgctga

SEQ ID NO: 779439 - DNA, 24 bp, Homo sapiens
cattattctctgctatatataaaa

SEQ ID NO: 779440 - DNA, 13 bp, Homo sapiens
cattattgagttc

SEQ ID NO: 779441 - DNA, 12 bp, Homo sapiens
cattattggaat

SEQ ID NO: 779442 - DNA, 20 bp, Homo sapiens
cattattggaattaacctgg

SEQ ID NO: 779443 - DNA, 23 bp, Homo sapiens
cattattggaattaacctggtgc

SEQ ID NO: 779444 - DNA, 17 bp, Homo sapiens
cattatttaatgtttga

SEQ ID NO: 779445 - DNA, 21 bp, Homo sapiens
cattatttaatgtttgattta

SEQ ID NO: 779446 - DNA, 18 bp, Homo sapiens
cattatttaatttgtatg

SEQ ID NO: 779447 - DNA, 23 bp, Homo sapiens
cattatttaatttgtatgctaaa

SEQ ID NO: 779448 - DNA, 22 bp, Homo sapiens
cattatttagcaccgtttgtga

SEQ ID NO: 779449 - DNA, 14 bp, Homo sapiens
cattatttatatgg

SEQ ID NO: 779450 - DNA, 23 bp, Homo sapiens
cattatttatatggggaatatat

SEQ ID NO: 779451 - DNA, 17 bp, Homo sapiens
cattatttattaaaaat

SEQ ID NO: 779452 - DNA, 15 bp, Homo sapiens
cattatttattgtta

SEQ ID NO: 779453 - DNA, 16 bp, Homo sapiens
cattatttattgttaa

SEQ ID NO: 779454 - DNA, 13 bp, Homo sapiens
cattatttctagt

SEQ ID NO: 779455 - DNA, 20 bp, Homo sapiens
cattatttctagtccaaaat

SEQ ID NO: 779456 - DNA, 12 bp, Homo sapiens
cattatttgtca

SEQ ID NO: 779457 - DNA, 13 bp, Homo sapiens
cattatttgtcaa

SEQ ID NO: 779458 - DNA, 14 bp, Homo sapiens
cattatttgtcaaa

SEQ ID NO: 779459 - DNA, 17 bp, Homo sapiens
cattattttctgtcaga

SEQ ID NO: 779460 - DNA, 14 bp, Homo sapiens
cattattttgtggt

SEQ ID NO: 779461 - DNA, 22 bp, Homo sapiens
cattatttttccactttgttct

SEQ ID NO: 779462 - DNA, 20 bp, Homo sapiens
cattatttttgttagcaaag

SEQ ID NO: 779463 - DNA, 21 bp, Homo sapiens
cattatttttgttagcaaaga

SEQ ID NO: 779464 - DNA, 19 bp, Homo sapiens
cattattttttatttctga

SEQ ID NO: 779465 - DNA, 21 bp, Homo sapiens
cattcaaaacgtgatgttttg

SEQ ID NO: 779466 - DNA, 16 bp, Homo sapiens
cattcaaaagttgaaa

SEQ ID NO: 779467 - DNA, 18 bp, Homo sapiens
cattcaaaagttgaaatt

SEQ ID NO: 779468 - DNA, 16 bp, Homo sapiens
cattcaaatcagtgat

SEQ ID NO: 779469 - DNA, 22 bp, Homo sapiens
cattcaaatcagtgatctatgt

SEQ ID NO: 779470 - DNA, 23 bp, Homo sapiens
cattcaaattaagggttaagaaa

SEQ ID NO: 779471 - DNA, 13 bp, Homo sapiens
cattcaaatttgt

SEQ ID NO: 779472 - DNA, 18 bp, Homo sapiens
cattcaacagagactgaa

SEQ ID NO: 779473 - DNA, 15 bp, Homo sapiens
cattcaagcctgtga

SEQ ID NO: 779474 - DNA, 15 bp, Homo sapiens
cattcaagctattta

SEQ ID NO: 779475 - DNA, 18 bp, Homo sapiens
cattcaagtgtaaaatat

SEQ ID NO: 779476 - DNA, 22 bp, Homo sapiens
cattcaagtgtaaaatattttg

SEQ ID NO: 779477 - DNA, 23 bp, Homo sapiens
cattcaagtgtaaaatattttga

SEQ ID NO: 779478 - DNA, 21 bp, Homo sapiens
cattcaatttattcaagaaaa

SEQ ID NO: 779479 - DNA, 20 bp, Homo sapiens
cattcacaagcctcctgtac

SEQ ID NO: 779480 - DNA, 17 bp, Homo sapiens
cattcacacagggctct

SEQ ID NO: 779481 - DNA, 22 bp, Homo sapiens
cattcacactttttatttaatt

SEQ ID NO: 779482 - DNA, 19 bp, Homo sapiens
cattcacatttgatgtaca

SEQ ID NO: 779483 - DNA, 20 bp, Homo sapiens
cattcacatttgatgtacat

SEQ ID NO: 779484 - DNA, 15 bp, Homo sapiens
cattcacctgcccca

SEQ ID NO: 779485 - DNA, 16 bp, Homo sapiens
cattcacctgccccaa

SEQ ID NO: 779486 - DNA, 18 bp, Homo sapiens
cattcactgctgattttt

SEQ ID NO: 779487 - DNA, 15 bp, Homo sapiens
cattcacttcataat

SEQ ID NO: 779488 - DNA, 17 bp, Homo sapiens
cattcagaagaaaaaga

SEQ ID NO: 779489 - DNA, 18 bp, Homo sapiens
cattcagaagaaaaagaa

SEQ ID NO: 779490 - DNA, 19 bp, Homo sapiens
cattcagagactgcccttc

SEQ ID NO: 779491 - DNA, 21 bp, Homo sapiens
cattcagagactgcccttctc

SEQ ID NO: 779492 - DNA, 17 bp, Homo sapiens
cattcagatcactgaat

SEQ ID NO: 779493 - DNA, 21 bp, Homo sapiens
cattcagatcactgaatttat

SEQ ID NO: 779494 - DNA, 23 bp, Homo sapiens
cattcagatcactgaatttataa

SEQ ID NO: 779495 - DNA, 19 bp, Homo sapiens
cattcagcatctactctaa

SEQ ID NO: 779496 - DNA, 13 bp, Homo sapiens
cattcaggaattc

SEQ ID NO: 779497 - DNA, 20 bp, Homo sapiens
cattcagtgattactgtcaa

SEQ ID NO: 779498 - DNA, 18 bp, Homo sapiens
cattcatacttaaaaatt

SEQ ID NO: 779499 - DNA, 12 bp, Homo sapiens
cattcatcctga

SEQ ID NO: 779500 - DNA, 16 bp, Homo sapiens
cattcatcctgaccaa

SEQ ID NO: 779501 - DNA, 13 bp, Homo sapiens
cattcatctcatt

SEQ ID NO: 779502 - DNA, 19 bp, Homo sapiens
cattcatgtaactctccag

SEQ ID NO: 779503 - DNA, 18 bp, Homo sapiens
cattcattacctgtttat

SEQ ID NO: 779504 - DNA, 24 bp, Homo sapiens
cattccaaaatacaatgttatcaa

SEQ ID NO: 779505 - DNA, 15 bp, Homo sapiens
catgtattggcctgg

SEQ ID NO: 779506 - DNA, 19 bp, Homo sapiens
catgtatttcagggacctc

SEQ ID NO: 779507 - DNA, 14 bp, Homo sapiens
catgtattttatga

SEQ ID NO: 779508 - DNA, 19 bp, Homo sapiens
catgtcaagagtcgctgtg

SEQ ID NO: 779509 - DNA, 21 bp, Homo sapiens
catgtcaagagtcgctgtgcc

SEQ ID NO: 779510 - DNA, 16 bp, Homo sapiens
catgtcacaatacagt

SEQ ID NO: 779511 - DNA, 19 bp, Homo sapiens
catgtcaccggtcagtgcc

SEQ ID NO: 779512 - DNA, 23 bp, Homo sapiens
catgtcaccgtggaccttcctgc

SEQ ID NO: 779513 - DNA, 12 bp, Homo sapiens
catgtcacctca

SEQ ID NO: 779514 - DNA, 15 bp, Homo sapiens
catgtcacctcagct

SEQ ID NO: 779515 - DNA, 16 bp, Homo sapiens
catgtcacctggctgc

SEQ ID NO: 779516 - DNA, 13 bp, Homo sapiens
catgtcagacaca

SEQ ID NO: 779517 - DNA, 19 bp, Homo sapiens
catgtcagaggaccccagg

SEQ ID NO: 779518 - DNA, 23 bp, Homo sapiens
catgtcagaggaccccagggtgg

SEQ ID NO: 779519 - DNA, 20 bp, Homo sapiens
catgtcagataagtgtaaat

SEQ ID NO: 779520 - DNA, 22 bp, Homo sapiens
catgtcagataagtgtaaatag

SEQ ID NO: 779521 - DNA, 22 bp, Homo sapiens
catgtcagcaaaaagcaaaatc

SEQ ID NO: 779522 - DNA, 23 bp, Homo sapiens
catgtcagcaaaaagcaaaatca

SEQ ID NO: 779523 - DNA, 19 bp, Homo sapiens
catgtcaggccagcctgtc

SEQ ID NO: 779524 - DNA, 21 bp, Homo sapiens
catgtcaggcctgtgtgtgaa

SEQ ID NO: 779525 - DNA, 18 bp, Homo sapiens
catgtcatttcagaagtt

SEQ ID NO: 779526 - DNA, 20 bp, Homo sapiens
catgtcatttgactgtctca

SEQ ID NO: 779527 - DNA, 13 bp, Homo sapiens
catgtccaaagag

SEQ ID NO: 779528 - DNA, 15 bp, Homo sapiens
catgtccaaagaggc

SEQ ID NO: 779529 - DNA, 16 bp, Homo sapiens
catgtccaaagaggct

SEQ ID NO: 779530 - DNA, 19 bp, Homo sapiens
catgtccaaagaggctgcc

SEQ ID NO: 779531 - DNA, 20 bp, Homo sapiens
catgtccaaagaggctgccc

SEQ ID NO: 779532 - DNA, 22 bp, Homo sapiens
catgtccaagtccaacctgcct

SEQ ID NO: 779533 - DNA, 20 bp, Homo sapiens
catgtccaagttcttcacct

SEQ ID NO: 779534 - DNA, 18 bp, Homo sapiens
catgtcccacccacccgc

SEQ ID NO: 779535 - DNA, 13 bp, Homo sapiens
catgtccccttcc

SEQ ID NO: 779536 - DNA, 18 bp, Homo sapiens
catgtccctacaaagaac

SEQ ID NO: 779537 - DNA, 17 bp, Homo sapiens
catgtccctacacccct

SEQ ID NO: 779538 - DNA, 16 bp, Homo sapiens
catgtccctaccgagt

SEQ ID NO: 779539 - DNA, 18 bp, Homo sapiens
catgtccctgtccccagg

SEQ ID NO: 779540 - DNA, 20 bp, Homo sapiens
catgtccctgtccccaggcc

SEQ ID NO: 779541 - DNA, 13 bp, Homo sapiens
catgtcctgccta

SEQ ID NO: 779542 - DNA, 19 bp, Homo sapiens
catgtccttgtgtgttttg

SEQ ID NO: 779543 - DNA, 17 bp, Homo sapiens
catgtcctttccatctg

SEQ ID NO: 779544 - DNA, 18 bp, Homo sapiens
catgtcctttccatctgt

SEQ ID NO: 779545 - DNA, 19 bp, Homo sapiens
catgtcctttccatctgtc

SEQ ID NO: 779546 - DNA, 20 bp, Homo sapiens
catgtcctttccatctgtcc

SEQ ID NO: 779547 - DNA, 22 bp, Homo sapiens
catgtcctttccatctgtccac

SEQ ID NO: 779548 - DNA, 14 bp, Homo sapiens
catgtcgcacaatg

SEQ ID NO: 779549 - DNA, 15 bp, Homo sapiens
catgtcgcctctgca

SEQ ID NO: 779550 - DNA, 22 bp, Homo sapiens
catgtcgcgctcagcatgcatc

SEQ ID NO: 779551 - DNA, 22 bp, Homo sapiens
catgtcgctagccagtgctcca

SEQ ID NO: 779552 - DNA, 13 bp, Homo sapiens
catgtcgcttttg

SEQ ID NO: 779553 - DNA, 15 bp, Homo sapiens
catgtctacttttta

SEQ ID NO: 779554 - DNA, 16 bp, Homo sapiens
catgtctactttttaa

SEQ ID NO: 779555 - DNA, 20 bp, Homo sapiens
catgtctactttttaatttt

SEQ ID NO: 779556 - DNA, 13 bp, Homo sapiens
catgtctattgtc

SEQ ID NO: 779557 - DNA, 12 bp, Homo sapiens
catgtctctctg

SEQ ID NO: 779558 - DNA, 16 bp, Homo sapiens
catgtctctgcttcca

SEQ ID NO: 779559 - DNA, 14 bp, Homo sapiens
catgtctgtatact

SEQ ID NO: 779560 - DNA, 19 bp, Homo sapiens
catgtctgtcctcagagca

SEQ ID NO: 779561 - DNA, 14 bp, Homo sapiens
catgtcttctgctg

SEQ ID NO: 779562 - DNA, 18 bp, Homo sapiens
catgtcttctgctgttct

SEQ ID NO: 779563 - DNA, 14 bp, Homo sapiens
catgtcttgtcata

SEQ ID NO: 779564 - DNA, 15 bp, Homo sapiens
catgtcttttaaaat

SEQ ID NO: 779565 - DNA, 22 bp, Homo sapiens
catgtgaaaaggcaaaaagcat

SEQ ID NO: 779566 - DNA, 15 bp, Homo sapiens
catgtgaacccggga

SEQ ID NO: 779567 - DNA, 21 bp, Homo sapiens
catgtgaccacatacgtgtta

SEQ ID NO: 779568 - DNA, 18 bp, Homo sapiens
catgtgaccactctgtct

SEQ ID NO: 779569 - DNA, 17 bp, Homo sapiens
catgtgaccattctgcc

SEQ ID NO: 779570 - DNA, 23 bp, Homo sapiens
catgtgaccattctgcctctcct

SEQ ID NO: 779571 - DNA, 16 bp, Homo sapiens
catgtgaggaggaaaa

SEQ ID NO: 779572 - DNA, 17 bp, Homo sapiens
catgtgaggaggaaaag

SEQ ID NO: 779573 - DNA, 17 bp, Homo sapiens
catgtgatggacactcc

SEQ ID NO: 779574 - DNA, 22 bp, Homo sapiens
catgtgattaatgttttcatta

SEQ ID NO: 779575 - DNA, 22 bp, Homo sapiens
catgtgccagggcaatgatgaa

SEQ ID NO: 779576 - DNA, 24 bp, Homo sapiens
catgtgccagggcaatgatgaatg

SEQ ID NO: 779577 - DNA, 14 bp, Homo sapiens
catgtgccatctgt

SEQ ID NO: 779578 - DNA, 18 bp, Homo sapiens
catgtgccatctgtacat

SEQ ID NO: 779579 - DNA, 22 bp, Homo sapiens
catgtgcctatagtcccagcta

SEQ ID NO: 779580 - DNA, 16 bp, Homo sapiens
catgtgccttttctga

SEQ ID NO: 779581 - DNA, 18 bp, Homo sapiens
catgtgcggctgaactga

SEQ ID NO: 779582 - DNA, 20 bp, Homo sapiens
catgtgcggctgaactgaga

SEQ ID NO: 779583 - DNA, 20 bp, Homo sapiens
catgtgctgggaaatgcaga

SEQ ID NO: 779584 - DNA, 13 bp, Homo sapiens
catgtgctgtctc

SEQ ID NO: 779585 - DNA, 17 bp, Homo sapiens
catgtgctgtctccatg

SEQ ID NO: 779586 - DNA, 20 bp, Homo sapiens
catgtggaaagtgaatttga

SEQ ID NO: 779587 - DNA, 23 bp, Homo sapiens
catgtggaaagtgaatttgaatg

SEQ ID NO: 779588 - DNA, 21 bp, Homo sapiens
catgtggccatggcctctgca

SEQ ID NO: 779589 - DNA, 14 bp, Homo sapiens
catgtggcctgccc

SEQ ID NO: 779590 - DNA, 13 bp, Homo sapiens
catgtggctggaa

SEQ ID NO: 779591 - DNA, 22 bp, Homo sapiens
catgtggctgtagatcccaaga

SEQ ID NO: 779592 - DNA, 18 bp, Homo sapiens
catgtggcttctctgtct

SEQ ID NO: 779593 - DNA, 15 bp, Homo sapiens
catgtggggccaggt

SEQ ID NO: 779594 - DNA, 23 bp, Homo sapiens
catgtggggccaggtcacccttt

SEQ ID NO: 779595 - DNA, 15 bp, Homo sapiens
catgtgggtcttcca

SEQ ID NO: 779596 - DNA, 23 bp, Homo sapiens
catgtgggtgagccagtggaaca

SEQ ID NO: 779597 - DNA, 15 bp, Homo sapiens
catgtgggtgctagg

SEQ ID NO: 779598 - DNA, 22 bp, Homo sapiens
catgtggtggcacaggccccct

SEQ ID NO: 779599 - DNA, 15 bp, Homo sapiens
catgtggtttataga

SEQ ID NO: 779600 - DNA, 15 bp, Homo sapiens
catgtgtacattctg

SEQ ID NO: 779601 - DNA, 15 bp, Homo sapiens
catgtgtatgtgtct

SEQ ID NO: 779602 - DNA, 16 bp, Homo sapiens
catgtgtatgtgtctg

SEQ ID NO: 779603 - DNA, 17 bp, Homo sapiens
catgtgtcacttgtgct

SEQ ID NO: 779604 - DNA, 22 bp, Homo sapiens
catgtgtcacttgtgctttgct

SEQ ID NO: 779605 - DNA, 24 bp, Homo sapiens
catgtgtcatgaagaatgtttctg

SEQ ID NO: 779606 - DNA, 14 bp, Homo sapiens
catgtgtcccagga

SEQ ID NO: 779607 - DNA, 15 bp, Homo sapiens
catgtgtcccctcac

SEQ ID NO: 779608 - DNA, 20 bp, Homo sapiens
catgtgtcccctcactctgt

SEQ ID NO: 779609 - DNA, 24 bp, Homo sapiens
catgtgtcccctcactctgtcagc

SEQ ID NO: 779610 - DNA, 21 bp, Homo sapiens
catgtgtcctggttcccgttt

SEQ ID NO: 779611 - DNA, 12 bp, Homo sapiens
catgtgtgcatg

SEQ ID NO: 779612 - DNA, 17 bp, Homo sapiens
catgtgtgcctgtggca

SEQ ID NO: 779613 - DNA, 19 bp, Homo sapiens
catgtgtgcctgtggcaga

SEQ ID NO: 779614 - DNA, 17 bp, Homo sapiens
catgtgtgcgagtgtgt

SEQ ID NO: 779615 - DNA, 13 bp, Homo sapiens
catgtgtgcgtgt

SEQ ID NO: 779616 - DNA, 15 bp, Homo sapiens
catgtgtgtgcaagt

SEQ ID NO: 779617 - DNA, 13 bp, Homo sapiens
catgtgtgtgtct

SEQ ID NO: 779618 - DNA, 13 bp, Homo sapiens
catgtgtgtgtgt

SEQ ID NO: 779619 - DNA, 17 bp, Homo sapiens
catgtgttaaaatactc

SEQ ID NO: 779620 - DNA, 18 bp, Homo sapiens
catgtgttttataaaatc

SEQ ID NO: 779621 - DNA, 19 bp, Homo sapiens
catgttaaaaatagcagta

SEQ ID NO: 779622 - DNA, 15 bp, Homo sapiens
catgttaaattagaa

SEQ ID NO: 779623 - DNA, 15 bp, Homo sapiens
catgttaagtgccat

SEQ ID NO: 779624 - DNA, 22 bp, Homo sapiens
catgttactgcttcattttgga

SEQ ID NO: 779625 - DNA, 13 bp, Homo sapiens
catgttagcctta

SEQ ID NO: 779626 - DNA, 22 bp, Homo sapiens
catgttagttaccttatagtta

SEQ ID NO: 779627 - DNA, 14 bp, Homo sapiens
catgttatatattt

SEQ ID NO: 779628 - DNA, 12 bp, Homo sapiens
catgttatgctg

SEQ ID NO: 779629 - DNA, 12 bp, Homo sapiens
cattccaaagtt

SEQ ID NO: 779630 - DNA, 17 bp, Homo sapiens
cattccaccttcccatg

SEQ ID NO: 779631 - DNA, 18 bp, Homo sapiens
cattccacgtgccccttg

SEQ ID NO: 779632 - DNA, 14 bp, Homo sapiens
cattccactccact

SEQ ID NO: 779633 - DNA, 14 bp, Homo sapiens
cattccagaatctt

SEQ ID NO: 779634 - DNA, 13 bp, Homo sapiens
cattccagcagct

SEQ ID NO: 779635 - DNA, 14 bp, Homo sapiens
cattccagcagctg

SEQ ID NO: 779636 - DNA, 16 bp, Homo sapiens
cattccagctctgccc

SEQ ID NO: 779637 - DNA, 14 bp, Homo sapiens
cattccagggctgg

SEQ ID NO: 779638 - DNA, 21 bp, Homo sapiens
cattccagggctggggtgagc

SEQ ID NO: 779639 - DNA, 14 bp, Homo sapiens
cattccagggttgg

SEQ ID NO: 779640 - DNA, 15 bp, Homo sapiens
cattccagtaacttt

SEQ ID NO: 779641 - DNA, 16 bp, Homo sapiens
cattccagtaactttt

SEQ ID NO: 779642 - DNA, 17 bp, Homo sapiens
cattccagtaacttttt

SEQ ID NO: 779643 - DNA, 20 bp, Homo sapiens
cattccagtaacttttttgt

SEQ ID NO: 779644 - DNA, 22 bp, Homo sapiens
cattccagtacagtattctttt

SEQ ID NO: 779645 - DNA, 23 bp, Homo sapiens
cattccagtcaaatctgggctca

SEQ ID NO: 779646 - DNA, 17 bp, Homo sapiens
cattccatcccttcctg

SEQ ID NO: 779647 - DNA, 14 bp, Homo sapiens
cattccattgccta

SEQ ID NO: 779648 - DNA, 14 bp, Homo sapiens
cattcccactgcca

SEQ ID NO: 779649 - DNA, 23 bp, Homo sapiens
cattcccagagtcagaggagaag

SEQ ID NO: 779650 - DNA, 13 bp, Homo sapiens
cattccccaggtg

SEQ ID NO: 779651 - DNA, 23 bp, Homo sapiens
cattccccaggtggctgacccag

SEQ ID NO: 779652 - DNA, 13 bp, Homo sapiens
cattccccatggg

SEQ ID NO: 779653 - DNA, 20 bp, Homo sapiens
cattcccccatgtggctgaa

SEQ ID NO: 779654 - DNA, 21 bp, Homo sapiens
cattcccccatgtggctgaag

SEQ ID NO: 779655 - DNA, 20 bp, Homo sapiens
cattcccctccccactcctc

SEQ ID NO: 779656 - DNA, 15 bp, Homo sapiens
cattccctctcctgc

SEQ ID NO: 779657 - DNA, 14 bp, Homo sapiens
cattccctgaatct

SEQ ID NO: 779658 - DNA, 16 bp, Homo sapiens
cattccctgaatctgt

SEQ ID NO: 779659 - DNA, 20 bp, Homo sapiens
cattccctgagtcaccagga

SEQ ID NO: 779660 - DNA, 15 bp, Homo sapiens
cattccctgggatct

SEQ ID NO: 779661 - DNA, 15 bp, Homo sapiens
cattccggccacatc

SEQ ID NO: 779662 - DNA, 21 bp, Homo sapiens
cattccggccacatcattctg

SEQ ID NO: 779663 - DNA, 16 bp, Homo sapiens
cattccgttgtctgtg

SEQ ID NO: 779664 - DNA, 15 bp, Homo sapiens
cattcctaactagaa

SEQ ID NO: 779665 - DNA, 12 bp, Homo sapiens
cattcctcagct

SEQ ID NO: 779666 - DNA, 13 bp, Homo sapiens
cattcctcaggga

SEQ ID NO: 779667 - DNA, 23 bp, Homo sapiens
cattcctcagggacagagacacc

SEQ ID NO: 779668 - DNA, 14 bp, Homo sapiens
cattcctccagcct

SEQ ID NO: 779669 - DNA, 14 bp, Homo sapiens
cattcctctgccct

SEQ ID NO: 779670 - DNA, 21 bp, Homo sapiens
cattcctgcctttaagccaaa

SEQ ID NO: 779671 - DNA, 17 bp, Homo sapiens
cattcctggtacccagc

SEQ ID NO: 779672 - DNA, 13 bp, Homo sapiens
cattcctgtgccc

SEQ ID NO: 779673 - DNA, 18 bp, Homo sapiens
cattccttcaaataaaga

SEQ ID NO: 779674 - DNA, 22 bp, Homo sapiens
cattccttcaaataaagaaatt

SEQ ID NO: 779675 - DNA, 21 bp, Homo sapiens
cattccttctggcctctgctg

SEQ ID NO: 779676 - DNA, 16 bp, Homo sapiens
cattccttgaggacag

SEQ ID NO: 779677 - DNA, 15 bp, Homo sapiens
cattccttgcgcctc

SEQ ID NO: 779678 - DNA, 23 bp, Homo sapiens
cattcgaggtgtcaccctgcaga

SEQ ID NO: 779679 - DNA, 16 bp, Homo sapiens
cattcgcctttgtctt

SEQ ID NO: 779680 - DNA, 22 bp, Homo sapiens
cattcgctactatgatttaatt

SEQ ID NO: 779681 - DNA, 13 bp, Homo sapiens
cattcggctccct

SEQ ID NO: 779682 - DNA, 15 bp, Homo sapiens
cattcgtgagctggg

SEQ ID NO: 779683 - DNA, 18 bp, Homo sapiens
cattcgtgagctggggac

SEQ ID NO: 779684 - DNA, 21 bp, Homo sapiens
cattcgttgtgttttttaaga

SEQ ID NO: 779685 - DNA, 15 bp, Homo sapiens
cattctaaaccaaaa

SEQ ID NO: 779686 - DNA, 18 bp, Homo sapiens
cattctaaaccaaaacag

SEQ ID NO: 779687 - DNA, 16 bp, Homo sapiens
cattctacacagagca

SEQ ID NO: 779688 - DNA, 14 bp, Homo sapiens
cattctacctgagg

SEQ ID NO: 779689 - DNA, 14 bp, Homo sapiens
cattctacttcagc

SEQ ID NO: 779690 - DNA, 16 bp, Homo sapiens
cattctagatcctgca

SEQ ID NO: 779691 - DNA, 23 bp, Homo sapiens
cattctagatcctgcaccccagc

SEQ ID NO: 779692 - DNA, 15 bp, Homo sapiens
cattctatagccata

SEQ ID NO: 779693 - DNA, 22 bp, Homo sapiens
cattctatagccataaacctga

SEQ ID NO: 779694 - DNA, 22 bp, Homo sapiens
cattctatcggccaggctggag

SEQ ID NO: 779695 - DNA, 11 bp, Homo sapiens
cattctcacat

SEQ ID NO: 779696 - DNA, 23 bp, Homo sapiens
cattctcagaattcggtgtgctg

SEQ ID NO: 779697 - DNA, 11 bp, Homo sapiens
cattctcccag

SEQ ID NO: 779698 - DNA, 21 bp, Homo sapiens
cattctcccaggtaccagctg

SEQ ID NO: 779699 - DNA, 15 bp, Homo sapiens
cattctcccagtctc

SEQ ID NO: 779700 - DNA, 13 bp, Homo sapiens
cattctcctgcct

SEQ ID NO: 779701 - DNA, 16 bp, Homo sapiens
cattctcctgcctcag

SEQ ID NO: 779702 - DNA, 15 bp, Homo sapiens
cattctcctgcctgt

SEQ ID NO: 779703 - DNA, 23 bp, Homo sapiens
cattctcctgcctgtagcagtga

SEQ ID NO: 779704 - DNA, 16 bp, Homo sapiens
cattctccttgtgtta

SEQ ID NO: 779705 - DNA, 23 bp, Homo sapiens
cattctcgtgagtcatttaaatg

SEQ ID NO: 779706 - DNA, 18 bp, Homo sapiens
cattctctatgtactatg

SEQ ID NO: 779707 - DNA, 12 bp, Homo sapiens
cattctctctcc

SEQ ID NO: 779708 - DNA, 18 bp, Homo sapiens
cattctctctcctgtcca

SEQ ID NO: 779709 - DNA, 14 bp, Homo sapiens
cattctctgtctca

SEQ ID NO: 779710 - DNA, 23 bp, Homo sapiens
cattctgaatcaagcacactgta

SEQ ID NO: 779711 - DNA, 15 bp, Homo sapiens
cattctgaattaatt

SEQ ID NO: 779712 - DNA, 17 bp, Homo sapiens
cattctgaccatttcag

SEQ ID NO: 779713 - DNA, 18 bp, Homo sapiens
cattctgacccagggcct

SEQ ID NO: 779714 - DNA, 16 bp, Homo sapiens
cattctgactcggttt

SEQ ID NO: 779715 - DNA, 15 bp, Homo sapiens
cattctgagaccaaa

SEQ ID NO: 779716 - DNA, 18 bp, Homo sapiens
cattctgagctccccatc

SEQ ID NO: 779717 - DNA, 19 bp, Homo sapiens
cattctgagctccccatca

SEQ ID NO: 779718 - DNA, 22 bp, Homo sapiens
cattctgcacgctgcccagggg

SEQ ID NO: 779719 - DNA, 21 bp, Homo sapiens
cattctgccgccccctcctga

SEQ ID NO: 779720 - DNA, 20 bp, Homo sapiens
cattctgctttcatcttggt

SEQ ID NO: 779721 - DNA, 18 bp, Homo sapiens
cattctggatagagtcct

SEQ ID NO: 779722 - DNA, 12 bp, Homo sapiens
cattctggatct

SEQ ID NO: 779723 - DNA, 18 bp, Homo sapiens
cattctggatctgaccct

SEQ ID NO: 779724 - DNA, 21 bp, Homo sapiens
cattctggatctgaccctccc

SEQ ID NO: 779725 - DNA, 22 bp, Homo sapiens
cattctggatctgaccctccca

SEQ ID NO: 779726 - DNA, 22 bp, Homo sapiens
cattctggtctcgtcttccgtc

SEQ ID NO: 779727 - DNA, 17 bp, Homo sapiens
cattctgttttccccca

SEQ ID NO: 779728 - DNA, 18 bp, Homo sapiens
cattctgttttcccccag

SEQ ID NO: 779729 - DNA, 21 bp, Homo sapiens
cattctgttttcccccagcaa

SEQ ID NO: 779730 - DNA, 21 bp, Homo sapiens
cattcttaaaattcaagaaaa

SEQ ID NO: 779731 - DNA, 18 bp, Homo sapiens
cattcttaacaaactctt

SEQ ID NO: 779732 - DNA, 20 bp, Homo sapiens
cattcttaacaaactcttca

SEQ ID NO: 779733 - DNA, 22 bp, Homo sapiens
cattcttactaaaaagtataaa

SEQ ID NO: 779734 - DNA, 19 bp, Homo sapiens
cattcttcagtgtctctgt

SEQ ID NO: 779735 - DNA, 22 bp, Homo sapiens
cattcttcagtgtctctgtttt

SEQ ID NO: 779736 - DNA, 21 bp, Homo sapiens
cattcttccatcatcactgta

SEQ ID NO: 779737 - DNA, 18 bp, Homo sapiens
cattcttcctagttttct

SEQ ID NO: 779738 - DNA, 19 bp, Homo sapiens
cattcttcgacatccgtca

SEQ ID NO: 779739 - DNA, 21 bp, Homo sapiens
cattcttctctgttgtcgtaa

SEQ ID NO: 779740 - DNA, 19 bp, Homo sapiens
cattcttctgagcactgtt

SEQ ID NO: 779741 - DNA, 17 bp, Homo sapiens
cattcttgaaagctgtg

SEQ ID NO: 779742 - DNA, 14 bp, Homo sapiens
cattcttgagtttt

SEQ ID NO: 779743 - DNA, 17 bp, Homo sapiens
cattcttgtgggagaca

SEQ ID NO: 779744 - DNA, 22 bp, Homo sapiens
cattcttgttggtagcatgtac

SEQ ID NO: 779745 - DNA, 10 bp, Homo sapiens
cattctttcc

SEQ ID NO: 779746 - DNA, 15 bp, Homo sapiens
cattctttcccctca

SEQ ID NO: 779747 - DNA, 20 bp, Homo sapiens
cattctttcccctcagagct

SEQ ID NO: 779748 - DNA, 22 bp, Homo sapiens
cattctttcccctcagagctct

SEQ ID NO: 779749 - DNA, 15 bp, Homo sapiens
cattctttgaacatg

SEQ ID NO: 779750 - DNA, 13 bp, Homo sapiens
cattctttgcagg

SEQ ID NO: 779751 - DNA, 17 bp, Homo sapiens
cattctttggtaatttt

SEQ ID NO: 779752 - DNA, 19 bp, Homo sapiens
cattcttttaaaagacaag

SEQ ID NO: 779753 - DNA, 12 bp, Homo sapiens
cattcttttgta

SEQ ID NO: 779754 - DNA, 14 bp, Homo sapiens
cattcttttgtaat

SEQ ID NO: 779755 - DNA, 15 bp, Homo sapiens
cattcttttgtaatt

SEQ ID NO: 779756 - DNA, 22 bp, Homo sapiens
cattgaaagagaaccagtttca

SEQ ID NO: 779757 - DNA, 19 bp, Homo sapiens
cattgaaatcagcatgaca

SEQ ID NO: 779758 - DNA, 20 bp, Homo sapiens
cattgaaatgagcacctcca

SEQ ID NO: 779759 - DNA, 22 bp, Homo sapiens
cattgaacacaaactgtaaata

SEQ ID NO: 779760 - DNA, 17 bp, Homo sapiens
cattgaacagctgtgag

SEQ ID NO: 779761 - DNA, 21 bp, Homo sapiens
cattgaagaagaaccagccca

SEQ ID NO: 779762 - DNA, 21 bp, Homo sapiens
cattgaagaatgttagagtaa

SEQ ID NO: 779763 - DNA, 20 bp, Homo sapiens
cattgaagagaactgcaact

SEQ ID NO: 779764 - DNA, 16 bp, Homo sapiens
cattgaagccgactct

SEQ ID NO: 779765 - DNA, 17 bp, Homo sapiens
cattgaagccgactctg

SEQ ID NO: 779766 - DNA, 23 bp, Homo sapiens
cattgaagccgactctggccctg

SEQ ID NO: 779767 - DNA, 16 bp, Homo sapiens
cattgaccaagaactg

SEQ ID NO: 779768 - DNA, 15 bp, Homo sapiens
cattgacctatttcc

SEQ ID NO: 779769 - DNA, 21 bp, Homo sapiens
cattgacctatttccagaaat

SEQ ID NO: 779770 - DNA, 14 bp, Homo sapiens
cattgacctcagct

SEQ ID NO: 779771 - DNA, 23 bp, Homo sapiens
cattgacctcagctgcacattcc

SEQ ID NO: 779772 - DNA, 23 bp, Homo sapiens
cattgactggtttacaggccctg

SEQ ID NO: 779773 - DNA, 14 bp, Homo sapiens
cattgacttcttgg

SEQ ID NO: 779774 - DNA, 14 bp, Homo sapiens
cattgagatctcca

SEQ ID NO: 779775 - DNA, 17 bp, Homo sapiens
cattgaggaagagtctt

SEQ ID NO: 779776 - DNA, 15 bp, Homo sapiens
cattgagtaatatag

SEQ ID NO: 779777 - DNA, 18 bp, Homo sapiens
cattgagtgctgggggag

SEQ ID NO: 779778 - DNA, 18 bp, Homo sapiens
cattgagttggttacttc

SEQ ID NO: 779779 - DNA, 20 bp, Homo sapiens
cattgataatcttcaggtga

SEQ ID NO: 779780 - DNA, 19 bp, Homo sapiens
cattgattttataattggt

SEQ ID NO: 779781 - DNA, 21 bp, Homo sapiens
cattgcactcatcatattttg

SEQ ID NO: 779782 - DNA, 17 bp, Homo sapiens
cattgcactccagcctg

SEQ ID NO: 779783 - DNA, 18 bp, Homo sapiens
cattgcactttataaaca

SEQ ID NO: 779784 - DNA, 13 bp, Homo sapiens
cattgcagccttg

SEQ ID NO: 779785 - DNA, 14 bp, Homo sapiens
cattgcagccttgc

SEQ ID NO: 779786 - DNA, 15 bp, Homo sapiens
cattgcagccttgcg

SEQ ID NO: 779787 - DNA, 13 bp, Homo sapiens
cattgcagcttca

SEQ ID NO: 779788 - DNA, 20 bp, Homo sapiens
cattgcagtttaagagcaga

SEQ ID NO: 779789 - DNA, 11 bp, Homo sapiens
cattgcatttc

SEQ ID NO: 779790 - DNA, 15 bp, Homo sapiens
cattgcatttccaga

SEQ ID NO: 779791 - DNA, 19 bp, Homo sapiens
cattgcccatggctgggaa

SEQ ID NO: 779792 - DNA, 16 bp, Homo sapiens
cattgcctagctcttt

SEQ ID NO: 779793 - DNA, 16 bp, Homo sapiens
cattgcctcctgttct

SEQ ID NO: 779794 - DNA, 18 bp, Homo sapiens
cattgcctcctgttctgc

SEQ ID NO: 779795 - DNA, 22 bp, Homo sapiens
cattgcctcctgttctgcccac

SEQ ID NO: 779796 - DNA, 16 bp, Homo sapiens
cattgcctgttctgct

SEQ ID NO: 779797 - DNA, 19 bp, Homo sapiens
cattgcctgttctgcttcg

SEQ ID NO: 779798 - DNA, 16 bp, Homo sapiens
cattgcctttccaggg

SEQ ID NO: 779799 - DNA, 22 bp, Homo sapiens
cattgcctttgaatgttaattt

SEQ ID NO: 779800 - DNA, 14 bp, Homo sapiens
cattgctaaaaaat

SEQ ID NO: 779801 - DNA, 15 bp, Homo sapiens
cattgctcccctgat

SEQ ID NO: 779802 - DNA, 17 bp, Homo sapiens
cattgctctatgtctgc

SEQ ID NO: 779803 - DNA, 11 bp, Homo sapiens
cattgctctct

SEQ ID NO: 779804 - DNA, 13 bp, Homo sapiens
cattgctctctgg

SEQ ID NO: 779805 - DNA, 20 bp, Homo sapiens
cattgctcttagtcccaagc

SEQ ID NO: 779806 - DNA, 22 bp, Homo sapiens
cattgctgaaaatggtattttc

SEQ ID NO: 779807 - DNA, 18 bp, Homo sapiens
cattgctgagcctctgct

SEQ ID NO: 779808 - DNA, 11 bp, Homo sapiens
cattgctgcca

SEQ ID NO: 779809 - DNA, 13 bp, Homo sapiens
cattgctgctgct

SEQ ID NO: 779810 - DNA, 17 bp, Homo sapiens
cattgctgctgctacca

SEQ ID NO: 779811 - DNA, 19 bp, Homo sapiens
cattgctggtagagacccc

SEQ ID NO: 779812 - DNA, 15 bp, Homo sapiens
cattgctggttctat

SEQ ID NO: 779813 - DNA, 21 bp, Homo sapiens
cattgctggttctatttaatg

SEQ ID NO: 779814 - DNA, 14 bp, Homo sapiens
cattgctgtcttgc

SEQ ID NO: 779815 - DNA, 18 bp, Homo sapiens
cattgctgtcttgcccca

SEQ ID NO: 779816 - DNA, 15 bp, Homo sapiens
cattgcttcactacc

SEQ ID NO: 779817 - DNA, 22 bp, Homo sapiens
cattgcttgtgccacaccctcc

SEQ ID NO: 779818 - DNA, 19 bp, Homo sapiens
cattgctttcgtgtaaatt

SEQ ID NO: 779819 - DNA, 12 bp, Homo sapiens
cattgctttctg

SEQ ID NO: 779820 - DNA, 11 bp, Homo sapiens
cattgcttttc

SEQ ID NO: 779821 - DNA, 20 bp, Homo sapiens
cattggaagaccccacccaa

SEQ ID NO: 779822 - DNA, 14 bp, Homo sapiens
cattggaagagccc

SEQ ID NO: 779823 - DNA, 17 bp, Homo sapiens
cattggaataaggcatg

SEQ ID NO: 779824 - DNA, 16 bp, Homo sapiens
cattggaatgttctca

SEQ ID NO: 779825 - DNA, 23 bp, Homo sapiens
cattggacagtctccctgatgga

SEQ ID NO: 779826 - DNA, 18 bp, Homo sapiens
cattggagcacctgggcc

SEQ ID NO: 779827 - DNA, 19 bp, Homo sapiens
cattggagcacctgggccc

SEQ ID NO: 779828 - DNA, 18 bp, Homo sapiens
cattggcaagatgaaata

SEQ ID NO: 779829 - DNA, 21 bp, Homo sapiens
cattggcaagatgaaataatt

SEQ ID NO: 779830 - DNA, 13 bp, Homo sapiens
cattggccgagct

SEQ ID NO: 779831 - DNA, 17 bp, Homo sapiens
cattggccgagctcctg

SEQ ID NO: 779832 - DNA, 19 bp, Homo sapiens
cattggccgagctcctggg

SEQ ID NO: 779833 - DNA, 19 bp, Homo sapiens
cattggcctcttgtccctt

SEQ ID NO: 779834 - DNA, 18 bp, Homo sapiens
cattggctatttaaaact

SEQ ID NO: 779835 - DNA, 19 bp, Homo sapiens
cattggctatttaaaactt

SEQ ID NO: 779836 - DNA, 22 bp, Homo sapiens
cattgggcacagtccagaccca

SEQ ID NO: 779837 - DNA, 19 bp, Homo sapiens
cattggggggccgggcagg

SEQ ID NO: 779838 - DNA, 23 bp, Homo sapiens
cattggggtagttgtgtttcaac

SEQ ID NO: 779839 - DNA, 18 bp, Homo sapiens
cattgggtgggtaaattc

SEQ ID NO: 779840 - DNA, 23 bp, Homo sapiens
cattgggttgtagccaaaggttc

SEQ ID NO: 779841 - DNA, 17 bp, Homo sapiens
cattgggtttggggcca

SEQ ID NO: 779842 - DNA, 23 bp, Homo sapiens
cattggtacacgtgtaacaagaa

SEQ ID NO: 779843 - DNA, 14 bp, Homo sapiens
cattggtgactcac

SEQ ID NO: 779844 - DNA, 17 bp, Homo sapiens
cattggttggaagctac

SEQ ID NO: 779845 - DNA, 22 bp, Homo sapiens
cattgtaaaagcattttgtaat

SEQ ID NO: 779846 - DNA, 13 bp, Homo sapiens
cattgtaaaataa

SEQ ID NO: 779847 - DNA, 14 bp, Homo sapiens
cattgtaaaataat

SEQ ID NO: 779848 - DNA, 13 bp, Homo sapiens
cattgtaaacaaa

SEQ ID NO: 779849 - DNA, 15 bp, Homo sapiens
cattgtaaacaaact

SEQ ID NO: 779850 - DNA, 13 bp, Homo sapiens
cattgtaaaccac

SEQ ID NO: 779851 - DNA, 20 bp, Homo sapiens
cattgtaaatctgaagaaag

SEQ ID NO: 779852 - DNA, 13 bp, Homo sapiens
cattgtaactatt

SEQ ID NO: 779853 - DNA, 17 bp, Homo sapiens
cattgtaactattaacc

SEQ ID NO: 779854 - DNA, 17 bp, Homo sapiens
cattgtaatttgaagat

SEQ ID NO: 779855 - DNA, 18 bp, Homo sapiens
cattgtacaagtattaca

SEQ ID NO: 779856 - DNA, 16 bp, Homo sapiens
cattgtactccagcct

SEQ ID NO: 779857 - DNA, 19 bp, Homo sapiens
cattgtactccagcctggg

SEQ ID NO: 779858 - DNA, 13 bp, Homo sapiens
cattgtactgttg

SEQ ID NO: 779859 - DNA, 18 bp, Homo sapiens
cattgtactgttgcttta

SEQ ID NO: 779860 - DNA, 19 bp, Homo sapiens
cattgtacttaaacctcct

SEQ ID NO: 779861 - DNA, 17 bp, Homo sapiens
cattgtagagcttctgg

SEQ ID NO: 779862 - DNA, 17 bp, Homo sapiens
cattgtataggccatct

SEQ ID NO: 779863 - DNA, 20 bp, Homo sapiens
cattgtataggccatctgta

SEQ ID NO: 779864 - DNA, 22 bp, Homo sapiens
cattgtatgatgtgttgtgata

SEQ ID NO: 779865 - DNA, 15 bp, Homo sapiens
cattgtatgcaggga

SEQ ID NO: 779866 - DNA, 18 bp, Homo sapiens
cattgtcaataaggagca

SEQ ID NO: 779867 - DNA, 15 bp, Homo sapiens
cattgtcataagtaa

SEQ ID NO: 779868 - DNA, 18 bp, Homo sapiens
cattgtccctctgcccca

SEQ ID NO: 779869 - DNA, 14 bp, Homo sapiens
cattgtcctccttt

SEQ ID NO: 779870 - DNA, 16 bp, Homo sapiens
cattgtcctccttttc

SEQ ID NO: 779871 - DNA, 20 bp, Homo sapiens
cattgtcctccttttcactt

SEQ ID NO: 779872 - DNA, 11 bp, Homo sapiens
cattgtcctgt

SEQ ID NO: 779873 - DNA, 16 bp, Homo sapiens
cattgtctttgctgta

SEQ ID NO: 779874 - DNA, 21 bp, Homo sapiens
cattgtctttgctgtactctt

SEQ ID NO: 779875 - DNA, 17 bp, Homo sapiens
cattgtgaaccaatgca

SEQ ID NO: 779876 - DNA, 18 bp, Homo sapiens
cattgtgaactgacaggc

SEQ ID NO: 779877 - DNA, 17 bp, Homo sapiens
cattgtgagctctggtt

SEQ ID NO: 779878 - DNA, 16 bp, Homo sapiens
catttcatctatttct

SEQ ID NO: 779879 - DNA, 18 bp, Homo sapiens
catttcatctatttctga

SEQ ID NO: 779880 - DNA, 14 bp, Homo sapiens
catttcatctgggt

SEQ ID NO: 779881 - DNA, 23 bp, Homo sapiens
catttcatgaaaaagctgcttct

SEQ ID NO: 779882 - DNA, 17 bp, Homo sapiens
catttcatgaaaatgac

SEQ ID NO: 779883 - DNA, 15 bp, Homo sapiens
catttcatgtatagt

SEQ ID NO: 779884 - DNA, 16 bp, Homo sapiens
catttcatgtatagtt

SEQ ID NO: 779885 - DNA, 16 bp, Homo sapiens
catttcattatgcttt

SEQ ID NO: 779886 - DNA, 16 bp, Homo sapiens
catttcattcaaatca

SEQ ID NO: 779887 - DNA, 21 bp, Homo sapiens
catttcattcctaacacagca

SEQ ID NO: 779888 - DNA, 12 bp, Homo sapiens
catttcattgta

SEQ ID NO: 779889 - DNA, 20 bp, Homo sapiens
catttcattgtacaagtatt

SEQ ID NO: 779890 - DNA, 16 bp, Homo sapiens
catttccaaacttgaa

SEQ ID NO: 779891 - DNA, 13 bp, Homo sapiens
catttccaacacc

SEQ ID NO: 779892 - DNA, 19 bp, Homo sapiens
catttccaacaccacagac

SEQ ID NO: 779893 - DNA, 21 bp, Homo sapiens
catttccaacaccacagacac

SEQ ID NO: 779894 - DNA, 19 bp, Homo sapiens
catttccacaccaagcagc

SEQ ID NO: 779895 - DNA, 16 bp, Homo sapiens
catttccactgtatat

SEQ ID NO: 779896 - DNA, 19 bp, Homo sapiens
catttccatttaagcaatt

SEQ ID NO: 779897 - DNA, 20 bp, Homo sapiens
catttccatttattgtttga

SEQ ID NO: 779898 - DNA, 18 bp, Homo sapiens
catttcccaacacaaaga

SEQ ID NO: 779899 - DNA, 16 bp, Homo sapiens
catttccccctcctca

SEQ ID NO: 779900 - DNA, 15 bp, Homo sapiens
catttccggctgctg

SEQ ID NO: 779901 - DNA, 12 bp, Homo sapiens
catttcctaatg

SEQ ID NO: 779902 - DNA, 19 bp, Homo sapiens
catttcctatgtaactgca

SEQ ID NO: 779903 - DNA, 10 bp, Homo sapiens
catttcctga

SEQ ID NO: 779904 - DNA, 12 bp, Homo sapiens
catttcctgatc

SEQ ID NO: 779905 - DNA, 11 bp, Homo sapiens
catttcctgcc

SEQ ID NO: 779906 - DNA, 19 bp, Homo sapiens
catttcctgcccttcctca

SEQ ID NO: 779907 - DNA, 23 bp, Homo sapiens
catttcctgcccttcctcagttt

SEQ ID NO: 779908 - DNA, 11 bp, Homo sapiens
catttcctgct

SEQ ID NO: 779909 - DNA, 13 bp, Homo sapiens
catttcctgctga

SEQ ID NO: 779910 - DNA, 17 bp, Homo sapiens
catttcctgggagaaag

SEQ ID NO: 779911 - DNA, 22 bp, Homo sapiens
catttcgggaagggcatgcacg

SEQ ID NO: 779912 - DNA, 14 bp, Homo sapiens
catttctagactca

SEQ ID NO: 779913 - DNA, 13 bp, Homo sapiens
catttctatactt

SEQ ID NO: 779914 - DNA, 23 bp, Homo sapiens
catttctatttcataatgaaaaa

SEQ ID NO: 779915 - DNA, 18 bp, Homo sapiens
catttctcaatcagtgca

SEQ ID NO: 779916 - DNA, 21 bp, Homo sapiens
catttctcatgttttccattg

SEQ ID NO: 779917 - DNA, 13 bp, Homo sapiens
catttctctgagc

SEQ ID NO: 779918 - DNA, 22 bp, Homo sapiens
catttctgaattgttggggttt

SEQ ID NO: 779919 - DNA, 19 bp, Homo sapiens
catttctgatactttctgt

SEQ ID NO: 779920 - DNA, 18 bp, Homo sapiens
catttctgccatgatgtt

SEQ ID NO: 779921 - DNA, 18 bp, Homo sapiens
catttctgtatactgtaa

SEQ ID NO: 779922 - DNA, 23 bp, Homo sapiens
catttctgtatactgtaaaagtt

SEQ ID NO: 779923 - DNA, 19 bp, Homo sapiens
catttcttataccttctga

SEQ ID NO: 779924 - DNA, 16 bp, Homo sapiens
catttcttatcacata

SEQ ID NO: 779925 - DNA, 17 bp, Homo sapiens
catttcttcagagggaa

SEQ ID NO: 779926 - DNA, 18 bp, Homo sapiens
catttcttctctctgttc

SEQ ID NO: 779927 - DNA, 23 bp, Homo sapiens
catttcttgaaaagccttggaga

SEQ ID NO: 779928 - DNA, 14 bp, Homo sapiens
catttcttgggccc

SEQ ID NO: 779929 - DNA, 16 bp, Homo sapiens
catttctttcttccat

SEQ ID NO: 779930 - DNA, 24 bp, Homo sapiens
catttctttcttccattccttcat

SEQ ID NO: 779931 - DNA, 17 bp, Homo sapiens
catttctttcttgctgg

SEQ ID NO: 779932 - DNA, 18 bp, Homo sapiens
catttctttcttgctggc

SEQ ID NO: 779933 - DNA, 21 bp, Homo sapiens
catttctttcttgctggctct

SEQ ID NO: 779934 - DNA, 15 bp, Homo sapiens
catttctttgtcttt

SEQ ID NO: 779935 - DNA, 14 bp, Homo sapiens
catttcttttactc

SEQ ID NO: 779936 - DNA, 19 bp, Homo sapiens
catttgaaaattttgatgt

SEQ ID NO: 779937 - DNA, 19 bp, Homo sapiens
catttgaaacccctgtagg

SEQ ID NO: 779938 - DNA, 13 bp, Homo sapiens
catttgaatgaga

SEQ ID NO: 779939 - DNA, 12 bp, Homo sapiens
catttgaattct

SEQ ID NO: 779940 - DNA, 13 bp, Homo sapiens
catttgaattctt

SEQ ID NO: 779941 - DNA, 15 bp, Homo sapiens
catttgaattcttga

SEQ ID NO: 779942 - DNA, 16 bp, Homo sapiens
catttgaattcttgat

SEQ ID NO: 779943 - DNA, 18 bp, Homo sapiens
catttgaattcttgatct

SEQ ID NO: 779944 - DNA, 19 bp, Homo sapiens
catttgaattcttgatctc

SEQ ID NO: 779945 - DNA, 21 bp, Homo sapiens
catttgaattcttgatctcta

SEQ ID NO: 779946 - DNA, 22 bp, Homo sapiens
catttgaattcttgatctctaa

SEQ ID NO: 779947 - DNA, 19 bp, Homo sapiens
catttgacacaaagcttct

SEQ ID NO: 779948 - DNA, 15 bp, Homo sapiens
catttgacttgaacc

SEQ ID NO: 779949 - DNA, 23 bp, Homo sapiens
catttgagagaagccacgctgtc

SEQ ID NO: 779950 - DNA, 22 bp, Homo sapiens
catttgagggcccagccaggag

SEQ ID NO: 779951 - DNA, 20 bp, Homo sapiens
catttgaggggccaggggca

SEQ ID NO: 779952 - DNA, 22 bp, Homo sapiens
catttgaggtctgttctttcca

SEQ ID NO: 779953 - DNA, 14 bp, Homo sapiens
catttgagtctctt

SEQ ID NO: 779954 - DNA, 15 bp, Homo sapiens
catttgatatttttc

SEQ ID NO: 779955 - DNA, 17 bp, Homo sapiens
catttgatctgttgcaa

SEQ ID NO: 779956 - DNA, 19 bp, Homo sapiens
catttgatgcatgtctttt

SEQ ID NO: 779957 - DNA, 20 bp, Homo sapiens
catttgatgcatgtctttta

SEQ ID NO: 779958 - DNA, 14 bp, Homo sapiens
catttgatgtacat

SEQ ID NO: 779959 - DNA, 14 bp, Homo sapiens
catttgattgtttt

SEQ ID NO: 779960 - DNA, 16 bp, Homo sapiens
catttgcaataacagc

SEQ ID NO: 779961 - DNA, 20 bp, Homo sapiens
catttgcaataacagctgca

SEQ ID NO: 779962 - DNA, 20 bp, Homo sapiens
catttgcactggagttctat

SEQ ID NO: 779963 - DNA, 19 bp, Homo sapiens
catttgcagggtcctcttc

SEQ ID NO: 779964 - DNA, 15 bp, Homo sapiens
catttgcattgggca

SEQ ID NO: 779965 - DNA, 16 bp, Homo sapiens
catttgcattgggcat

SEQ ID NO: 779966 - DNA, 13 bp, Homo sapiens
catttgcatttgt

SEQ ID NO: 779967 - DNA, 14 bp, Homo sapiens
catttgcatttgtt

SEQ ID NO: 779968 - DNA, 17 bp, Homo sapiens
catttgccaattttcct

SEQ ID NO: 779969 - DNA, 15 bp, Homo sapiens
catttgccttgcaga

SEQ ID NO: 779970 - DNA, 19 bp, Homo sapiens
catttgccttgcagaactg

SEQ ID NO: 779971 - DNA, 14 bp, Homo sapiens
catttgccttgctg

SEQ ID NO: 779972 - DNA, 21 bp, Homo sapiens
catttgcgaatggttccattc

SEQ ID NO: 779973 - DNA, 20 bp, Homo sapiens
catttgctagttctgctgcc

SEQ ID NO: 779974 - DNA, 17 bp, Homo sapiens
catttgctgaactcagc

SEQ ID NO: 779975 - DNA, 18 bp, Homo sapiens
catttgtattttgtgtga

SEQ ID NO: 779976 - DNA, 20 bp, Homo sapiens
catttgtcaaagcattgaga

SEQ ID NO: 779977 - DNA, 22 bp, Homo sapiens
catttgtcatcgttccccaccc

SEQ ID NO: 779978 - DNA, 14 bp, Homo sapiens
catttgtgaaatga

SEQ ID NO: 779979 - DNA, 14 bp, Homo sapiens
catttgtgaagaat

SEQ ID NO: 779980 - DNA, 11 bp, Homo sapiens
catttgtgagg

SEQ ID NO: 779981 - DNA, 23 bp, Homo sapiens
catttgtgatcagcattgtgact

SEQ ID NO: 779982 - DNA, 13 bp, Homo sapiens
catttgtgccaca

SEQ ID NO: 779983 - DNA, 16 bp, Homo sapiens
catttgtgccacacgc

SEQ ID NO: 779984 - DNA, 16 bp, Homo sapiens
catttgtgctagaaat

SEQ ID NO: 779985 - DNA, 19 bp, Homo sapiens
catttgtggttagaatctt

SEQ ID NO: 779986 - DNA, 22 bp, Homo sapiens
catttgtggttagaatcttgtt

SEQ ID NO: 779987 - DNA, 22 bp, Homo sapiens
catttgtgtgtgtgcaagtgtg

SEQ ID NO: 779988 - DNA, 13 bp, Homo sapiens
catttgttaaaat

SEQ ID NO: 779989 - DNA, 18 bp, Homo sapiens
catttgttaaaattatca

SEQ ID NO: 779990 - DNA, 13 bp, Homo sapiens
catttgttcctgc

SEQ ID NO: 779991 - DNA, 17 bp, Homo sapiens
catttgttcctgcttcc

SEQ ID NO: 779992 - DNA, 18 bp, Homo sapiens
catttgtttatgtaattt

SEQ ID NO: 779993 - DNA, 20 bp, Homo sapiens
catttgtttatgtaatttca

SEQ ID NO: 779994 - DNA, 20 bp, Homo sapiens
catttgtttgaactgataaa

SEQ ID NO: 779995 - DNA, 22 bp, Homo sapiens
catttgtttgaactgataaaga

SEQ ID NO: 779996 - DNA, 12 bp, Homo sapiens
catttgtttgct

SEQ ID NO: 779997 - DNA, 13 bp, Homo sapiens
catttgttttgct

SEQ ID NO: 779998 - DNA, 16 bp, Homo sapiens
catttgtttttctcac

SEQ ID NO: 779999 - DNA, 21 bp, Homo sapiens
cattttaaaaacatagaaaaa

SEQ ID NO: 780000 - DNA, 16 bp, Homo sapiens
cattttaaaaacttta

SEQ ID NO: 780001 - DNA, 18 bp, Homo sapiens
cattttaaagttaaacat

SEQ ID NO: 780002 - DNA, 15 bp, Homo sapiens
cattttaaattttat

SEQ ID NO: 780003 - DNA, 20 bp, Homo sapiens
cattttaagtgcttcacatt

SEQ ID NO: 780004 - DNA, 21 bp, Homo sapiens
cattttaagtgcttcacattt

SEQ ID NO: 780005 - DNA, 23 bp, Homo sapiens
cattttaatagttggttaggcta

SEQ ID NO: 780006 - DNA, 17 bp, Homo sapiens
cattttaattattattc

SEQ ID NO: 780007 - DNA, 23 bp, Homo sapiens
cattttaatttattaattgcttt

SEQ ID NO: 780008 - DNA, 16 bp, Homo sapiens
cattttacacagcacc

SEQ ID NO: 780009 - DNA, 18 bp, Homo sapiens
cattttacattaaatttt

SEQ ID NO: 780010 - DNA, 21 bp, Homo sapiens
cattttagcccagtgttttct

SEQ ID NO: 780011 - DNA, 23 bp, Homo sapiens
cattttaggaaaaaaaaaagcat

SEQ ID NO: 780012 - DNA, 16 bp, Homo sapiens
cattttaggaataata

SEQ ID NO: 780013 - DNA, 21 bp, Homo sapiens
cattttaggggtgttgacaca

SEQ ID NO: 780014 - DNA, 15 bp, Homo sapiens
cattttagtgactgt

SEQ ID NO: 780015 - DNA, 14 bp, Homo sapiens
cattttatactgta

SEQ ID NO: 780016 - DNA, 16 bp, Homo sapiens
cattttatatgtcaaa

SEQ ID NO: 780017 - DNA, 19 bp, Homo sapiens
cattttatatttttgtaca

SEQ ID NO: 780018 - DNA, 18 bp, Homo sapiens
cattttatcattaaaaat

SEQ ID NO: 780019 - DNA, 20 bp, Homo sapiens
cattttatcattaaaaatta

SEQ ID NO: 780020 - DNA, 11 bp, Homo sapiens
cattttatgca

SEQ ID NO: 780021 - DNA, 21 bp, Homo sapiens
cattttattaagctttttgga

SEQ ID NO: 780022 - DNA, 14 bp, Homo sapiens
cattttattgcttg

SEQ ID NO: 780023 - DNA, 23 bp, Homo sapiens
cattttattttattatgcatgaa

SEQ ID NO: 780024 - DNA, 17 bp, Homo sapiens
cattttcaactgctttg

SEQ ID NO: 780025 - DNA, 17 bp, Homo sapiens
cattttcagttccctcc

SEQ ID NO: 780026 - DNA, 17 bp, Homo sapiens
cattttccatatcctgg

SEQ ID NO: 780027 - DNA, 12 bp, Homo sapiens
cattttcccaga

SEQ ID NO: 780028 - DNA, 14 bp, Homo sapiens
cattttcccatcat

SEQ ID NO: 780029 - DNA, 20 bp, Homo sapiens
cattttcccatcatcctttg

SEQ ID NO: 780030 - DNA, 15 bp, Homo sapiens
cattttccccccact

SEQ ID NO: 780031 - DNA, 15 bp, Homo sapiens
cattttccccttcct

SEQ ID NO: 780032 - DNA, 13 bp, Homo sapiens
cattttcctcctc

SEQ ID NO: 780033 - DNA, 23 bp, Homo sapiens
cattttcctcttgtcctggccct

SEQ ID NO: 780034 - DNA, 11 bp, Homo sapiens
cattttcctgt

SEQ ID NO: 780035 - DNA, 14 bp, Homo sapiens
cattttcgtcctgt

SEQ ID NO: 780036 - DNA, 15 bp, Homo sapiens
cattttcgtttttaa

SEQ ID NO: 780037 - DNA, 11 bp, Homo sapiens
cattttctaaa

SEQ ID NO: 780038 - DNA, 21 bp, Homo sapiens
cattttctacgtcatgtattt

SEQ ID NO: 780039 - DNA, 22 bp, Homo sapiens
cattttctacgtcatgtatttt

SEQ ID NO: 780040 - DNA, 13 bp, Homo sapiens
cattttctagata

SEQ ID NO: 780041 - DNA, 21 bp, Homo sapiens
cattttctagatacaataaat

SEQ ID NO: 780042 - DNA, 11 bp, Homo sapiens
cattttctata

SEQ ID NO: 780043 - DNA, 22 bp, Homo sapiens
cattttctggtttggcatggtg

SEQ ID NO: 780044 - DNA, 12 bp, Homo sapiens
cattttctgtgg

SEQ ID NO: 780045 - DNA, 22 bp, Homo sapiens
cattttcttcagagagctaaat

SEQ ID NO: 780046 - DNA, 22 bp, Homo sapiens
cattttctttaggacataaaga

SEQ ID NO: 780047 - DNA, 19 bp, Homo sapiens
cattttctttctttttctg

SEQ ID NO: 780048 - DNA, 14 bp, Homo sapiens
cattttgacctact

SEQ ID NO: 780049 - DNA, 22 bp, Homo sapiens
cattttgagctgaaatgctgca

SEQ ID NO: 780050 - DNA, 23 bp, Homo sapiens
cattttgagctgaaatgctgcat

SEQ ID NO: 780051 - DNA, 15 bp, Homo sapiens
cattttgagtatttt

SEQ ID NO: 780052 - DNA, 17 bp, Homo sapiens
cattttgagtgactcga

SEQ ID NO: 780053 - DNA, 14 bp, Homo sapiens
cattttgcaaaatt

SEQ ID NO: 780054 - DNA, 17 bp, Homo sapiens
cattttgcaaaatttcc

SEQ ID NO: 780055 - DNA, 12 bp, Homo sapiens
cattttgcaaac

SEQ ID NO: 780056 - DNA, 13 bp, Homo sapiens
cattttgcaaacc

SEQ ID NO: 780057 - DNA, 15 bp, Homo sapiens
cattttgcagaagga

SEQ ID NO: 780058 - DNA, 23 bp, Homo sapiens
cattttgcagaaggaaatgatgg

SEQ ID NO: 780059 - DNA, 15 bp, Homo sapiens
cattttgcattcaaa

SEQ ID NO: 780060 - DNA, 13 bp, Homo sapiens
cattttgcctttc

SEQ ID NO: 780061 - DNA, 20 bp, Homo sapiens
cattttggaagttttcagga

SEQ ID NO: 780062 - DNA, 13 bp, Homo sapiens
cattttgtaaaat

SEQ ID NO: 780063 - DNA, 12 bp, Homo sapiens
cattttgtaata

SEQ ID NO: 780064 - DNA, 13 bp, Homo sapiens
cattttgtacaaa

SEQ ID NO: 780065 - DNA, 13 bp, Homo sapiens
cattttgtatcaa

SEQ ID NO: 780066 - DNA, 22 bp, Homo sapiens
cattttgtggtcattaagcatt

SEQ ID NO: 780067 - DNA, 19 bp, Homo sapiens
ccaaagagggcttcctcta

SEQ ID NO: 780068 - DNA, 17 bp, Homo sapiens
ccaaagcaaagaaaata

SEQ ID NO: 780069 - DNA, 22 bp, Homo sapiens
ccaaagcacatgcttagcttat

SEQ ID NO: 780070 - DNA, 17 bp, Homo sapiens
ccaaagcacttttaaaa

SEQ ID NO: 780071 - DNA, 17 bp, Homo sapiens
ccaaagccaagaaagaa

SEQ ID NO: 780072 - DNA, 13 bp, Homo sapiens
ccaaagccaccag

SEQ ID NO: 780073 - DNA, 22 bp, Homo sapiens
ccaaagccaccagactgacaaa

SEQ ID NO: 780074 - DNA, 15 bp, Homo sapiens
ccaaagccccatgtg

SEQ ID NO: 780075 - DNA, 17 bp, Homo sapiens
ccaaagcctcctccagc

SEQ ID NO: 780076 - DNA, 16 bp, Homo sapiens
ccaaagcctcttcaaa

SEQ ID NO: 780077 - DNA, 16 bp, Homo sapiens
ccaaagcctgtcccag

SEQ ID NO: 780078 - DNA, 18 bp, Homo sapiens
ccaaagcctgtcccagga

SEQ ID NO: 780079 - DNA, 18 bp, Homo sapiens
ccaaagctagggtggccc

SEQ ID NO: 780080 - DNA, 20 bp, Homo sapiens
ccaaagctgcccactgtttc

SEQ ID NO: 780081 - DNA, 21 bp, Homo sapiens
ccaaagctgcccactgtttct

SEQ ID NO: 780082 - DNA, 12 bp, Homo sapiens
ccaaagctgcct

SEQ ID NO: 780083 - DNA, 16 bp, Homo sapiens
ccaaagctgcctgtgc

SEQ ID NO: 780084 - DNA, 17 bp, Homo sapiens
ccaaagctgcctgtgcc

SEQ ID NO: 780085 - DNA, 17 bp, Homo sapiens
ccaaagctggaactgaa

SEQ ID NO: 780086 - DNA, 13 bp, Homo sapiens
ccaaagctggtct

SEQ ID NO: 780087 - DNA, 17 bp, Homo sapiens
ccaaagcttcccacggc

SEQ ID NO: 780088 - DNA, 16 bp, Homo sapiens
ccaaagctttcctgcc

SEQ ID NO: 780089 - DNA, 19 bp, Homo sapiens
ccaaagctttcctgcccca

SEQ ID NO: 780090 - DNA, 20 bp, Homo sapiens
ccaaaggaaaatgtctgtaa

SEQ ID NO: 780091 - DNA, 14 bp, Homo sapiens
ccaaaggaaggaac

SEQ ID NO: 780092 - DNA, 16 bp, Homo sapiens
ccaaaggaaggggttt

SEQ ID NO: 780093 - DNA, 16 bp, Homo sapiens
ccaaaggatgtgatat

SEQ ID NO: 780094 - DNA, 19 bp, Homo sapiens
ccaaaggatgtgatatata

SEQ ID NO: 780095 - DNA, 23 bp, Homo sapiens
ccaaaggggacaggcctcacctc

SEQ ID NO: 780096 - DNA, 15 bp, Homo sapiens
ccaaaggggagccag

SEQ ID NO: 780097 - DNA, 20 bp, Homo sapiens
ccaaaggggctgctggggca

SEQ ID NO: 780098 - DNA, 21 bp, Homo sapiens
ccaaagggtgaagctatttat

SEQ ID NO: 780099 - DNA, 23 bp, Homo sapiens
ccaaagggtgaagctatttatct

SEQ ID NO: 780100 - DNA, 15 bp, Homo sapiens
ccaaagtacactgtt

SEQ ID NO: 780101 - DNA, 22 bp, Homo sapiens
ccaaagtacagaatttgaatta

SEQ ID NO: 780102 - DNA, 15 bp, Homo sapiens
ccaaagtagtcctgg

SEQ ID NO: 780103 - DNA, 17 bp, Homo sapiens
ccaaagtctgccgccca

SEQ ID NO: 780104 - DNA, 23 bp, Homo sapiens
ccaaagtctgccgcccacctcgc

SEQ ID NO: 780105 - DNA, 15 bp, Homo sapiens
ccaaagtgcagccct

SEQ ID NO: 780106 - DNA, 13 bp, Homo sapiens
ccaaagtgcctgg

SEQ ID NO: 780107 - DNA, 14 bp, Homo sapiens
ccaaagtgctggga

SEQ ID NO: 780108 - DNA, 12 bp, Homo sapiens
ccaaataaataa

SEQ ID NO: 780109 - DNA, 16 bp, Homo sapiens
ccaaataacttcagtc

SEQ ID NO: 780110 - DNA, 18 bp, Homo sapiens
ccaaataacttcagtcct

SEQ ID NO: 780111 - DNA, 20 bp, Homo sapiens
ccaaatacctcaatttttgt

SEQ ID NO: 780112 - DNA, 21 bp, Homo sapiens
ccaaatacgaagccctcttgc

SEQ ID NO: 780113 - DNA, 17 bp, Homo sapiens
ccaaatagccccagact

SEQ ID NO: 780114 - DNA, 19 bp, Homo sapiens
ccaaataggattaaacaca

SEQ ID NO: 780115 - DNA, 19 bp, Homo sapiens
ccaaatagtgtgaaatata

SEQ ID NO: 780116 - DNA, 15 bp, Homo sapiens
ccaaatatgcacttt

SEQ ID NO: 780117 - DNA, 13 bp, Homo sapiens
ccaaatatgtcct

SEQ ID NO: 780118 - DNA, 15 bp, Homo sapiens
ccaaatatgtcctgg

SEQ ID NO: 780119 - DNA, 21 bp, Homo sapiens
ccaaatattattcaagtgcct

SEQ ID NO: 780120 - DNA, 13 bp, Homo sapiens
ccaaatattttag

SEQ ID NO: 780121 - DNA, 20 bp, Homo sapiens
ccaaatattttagccttaaa

SEQ ID NO: 780122 - DNA, 15 bp, Homo sapiens
ccaaatcagctgcta

SEQ ID NO: 780123 - DNA, 15 bp, Homo sapiens
ccaaatcccctaagc

SEQ ID NO: 780124 - DNA, 22 bp, Homo sapiens
ccaaatcgtggcacgtattgct

SEQ ID NO: 780125 - DNA, 23 bp, Homo sapiens
ccaaatctagccagagcccttca

SEQ ID NO: 780126 - DNA, 16 bp, Homo sapiens
ccaaatctgcctagaa

SEQ ID NO: 780127 - DNA, 14 bp, Homo sapiens
ccaaatctgtcctc

SEQ ID NO: 780128 - DNA, 16 bp, Homo sapiens
ccaaatctgtcctctg

SEQ ID NO: 780129 - DNA, 19 bp, Homo sapiens
ccaaatctgtcctctgtag

SEQ ID NO: 780130 - DNA, 22 bp, Homo sapiens
ccaaatctgtcctctgtagtat

SEQ ID NO: 780131 - DNA, 19 bp, Homo sapiens
ccaaatcttgaatttctgc

SEQ ID NO: 780132 - DNA, 16 bp, Homo sapiens
ccaaatgcaatttgat

SEQ ID NO: 780133 - DNA, 18 bp, Homo sapiens
ccaaatgcacaagctcag

SEQ ID NO: 780134 - DNA, 21 bp, Homo sapiens
ccaaatgcacaagctcagaat

SEQ ID NO: 780135 - DNA, 21 bp, Homo sapiens
ccaaatgcagggaggggaggc

SEQ ID NO: 780136 - DNA, 17 bp, Homo sapiens
ccaaatgcatggtgcag

SEQ ID NO: 780137 - DNA, 13 bp, Homo sapiens
ccaaatgcccaag

SEQ ID NO: 780138 - DNA, 18 bp, Homo sapiens
ccaaatggagaagctgca

SEQ ID NO: 780139 - DNA, 16 bp, Homo sapiens
ccaaatggccatttta

SEQ ID NO: 780140 - DNA, 12 bp, Homo sapiens
ccaaatgtattg

SEQ ID NO: 780141 - DNA, 15 bp, Homo sapiens
ccaaatgtccctcca

SEQ ID NO: 780142 - DNA, 18 bp, Homo sapiens
ccaaatgtcggggttggg

SEQ ID NO: 780143 - DNA, 17 bp, Homo sapiens
ccaaatgttaactgcca

SEQ ID NO: 780144 - DNA, 22 bp, Homo sapiens
ccaacatggagaaaccctgtct

SEQ ID NO: 780145 - DNA, 23 bp, Homo sapiens
ccaacatggagaaaccctgtctc

SEQ ID NO: 780146 - DNA, 14 bp, Homo sapiens
ccaacatgggaggg

SEQ ID NO: 780147 - DNA, 22 bp, Homo sapiens
ccaacatgggagggatcagccc

SEQ ID NO: 780148 - DNA, 14 bp, Homo sapiens
ccaaccaaccagca

SEQ ID NO: 780149 - DNA, 15 bp, Homo sapiens
ccaaccaaccagcag

SEQ ID NO: 780150 - DNA, 16 bp, Homo sapiens
ccaaccaaccagcagg

SEQ ID NO: 780151 - DNA, 23 bp, Homo sapiens
ccaaccaacttggttctgcttca

SEQ ID NO: 780152 - DNA, 21 bp, Homo sapiens
ccaaccaagaggatttcttca

SEQ ID NO: 780153 - DNA, 16 bp, Homo sapiens
ccaaccaaggaaggag

SEQ ID NO: 780154 - DNA, 13 bp, Homo sapiens
ccaaccacagaga

SEQ ID NO: 780155 - DNA, 21 bp, Homo sapiens
ccaaccacagcatcgggagca

SEQ ID NO: 780156 - DNA, 16 bp, Homo sapiens
ccaaccactgtgccac

SEQ ID NO: 780157 - DNA, 21 bp, Homo sapiens
ccaaccactgtgccactgact

SEQ ID NO: 780158 - DNA, 15 bp, Homo sapiens
ccaaccagactttga

SEQ ID NO: 780159 - DNA, 20 bp, Homo sapiens
ccaaccaggttgcagtagca

SEQ ID NO: 780160 - DNA, 20 bp, Homo sapiens
ccaacccaataaaactgatg

SEQ ID NO: 780161 - DNA, 13 bp, Homo sapiens
ccaacccccaccc

SEQ ID NO: 780162 - DNA, 20 bp, Homo sapiens
ccaacccccaccccacactt

SEQ ID NO: 780163 - DNA, 14 bp, Homo sapiens
ccaacccccagagg

SEQ ID NO: 780164 - DNA, 19 bp, Homo sapiens
ccaacccccagaggtggcc

SEQ ID NO: 780165 - DNA, 21 bp, Homo sapiens
ccaacccccagaggtggccct

SEQ ID NO: 780166 - DNA, 23 bp, Homo sapiens
ccaacccccagaggtggcccttg

SEQ ID NO: 780167 - DNA, 17 bp, Homo sapiens
ccaacccccctcctgct

SEQ ID NO: 780168 - DNA, 20 bp, Homo sapiens
ccaacccccgcaccaagcag

SEQ ID NO: 780169 - DNA, 14 bp, Homo sapiens
ccaaccccggggca

SEQ ID NO: 780170 - DNA, 15 bp, Homo sapiens
ccaaccccggggcat

SEQ ID NO: 780171 - DNA, 12 bp, Homo sapiens
ccaacccctgtg

SEQ ID NO: 780172 - DNA, 22 bp, Homo sapiens
ccaacccgtctggcccaccagg

SEQ ID NO: 780173 - DNA, 19 bp, Homo sapiens
ccaaccctaggttccctgt

SEQ ID NO: 780174 - DNA, 14 bp, Homo sapiens
ccaaccctgcccct

SEQ ID NO: 780175 - DNA, 12 bp, Homo sapiens
ccaaccctgccg

SEQ ID NO: 780176 - DNA, 18 bp, Homo sapiens
ccaaccctgcctgccgct

SEQ ID NO: 780177 - DNA, 17 bp, Homo sapiens
ccaaccctggcttgggg

SEQ ID NO: 780178 - DNA, 16 bp, Homo sapiens
ccaaccctggggaagg

SEQ ID NO: 780179 - DNA, 17 bp, Homo sapiens
ccaaccctggggaagga

SEQ ID NO: 780180 - DNA, 18 bp, Homo sapiens
ccaaccctggggaaggag

SEQ ID NO: 780181 - DNA, 11 bp, Homo sapiens
ccaacccttct

SEQ ID NO: 780182 - DNA, 13 bp, Homo sapiens
ccaacccttctcc

SEQ ID NO: 780183 - DNA, 15 bp, Homo sapiens
ccaacctcaatgccc

SEQ ID NO: 780184 - DNA, 16 bp, Homo sapiens
ccaacctcaatgccct

SEQ ID NO: 780185 - DNA, 23 bp, Homo sapiens
ccaacctcaatgccctgccatta

SEQ ID NO: 780186 - DNA, 22 bp, Homo sapiens
ccaacctcagggctcccagggg

SEQ ID NO: 780187 - DNA, 23 bp, Homo sapiens
ccaacctccagtgtcagggtcca

SEQ ID NO: 780188 - DNA, 21 bp, Homo sapiens
ccaacctcggcttgtgggctg

SEQ ID NO: 780189 - DNA, 14 bp, Homo sapiens
ccaacctgctctgt

SEQ ID NO: 780190 - DNA, 23 bp, Homo sapiens
ccaacctttccctcaccccctcc

SEQ ID NO: 780191 - DNA, 19 bp, Homo sapiens
ccaacgagcctcctcaggg

SEQ ID NO: 780192 - DNA, 22 bp, Homo sapiens
ccaacgagcctcctcagggggt

SEQ ID NO: 780193 - DNA, 18 bp, Homo sapiens
ccaacgcccctgtggcca

SEQ ID NO: 780194 - DNA, 21 bp, Homo sapiens
ccaacggccctgcagccagct

SEQ ID NO: 780195 - DNA, 13 bp, Homo sapiens
ccaacggggtggg

SEQ ID NO: 780196 - DNA, 16 bp, Homo sapiens
ccaacggggtggggag

SEQ ID NO: 780197 - DNA, 19 bp, Homo sapiens
ccaacggggtggggagggt

SEQ ID NO: 780198 - DNA, 16 bp, Homo sapiens
ccaacgtcccctccgc

SEQ ID NO: 780199 - DNA, 18 bp, Homo sapiens
ccaacgttactcagggct

SEQ ID NO: 780200 - DNA, 23 bp, Homo sapiens
ccaactacaaccaagctctctgc

SEQ ID NO: 780201 - DNA, 22 bp, Homo sapiens
ccaactactaatagaataaagg

SEQ ID NO: 780202 - DNA, 15 bp, Homo sapiens
ccaactagctgggac

SEQ ID NO: 780203 - DNA, 14 bp, Homo sapiens
ccaactatgattat

SEQ ID NO: 780204 - DNA, 16 bp, Homo sapiens
ccaactcacttccagt

SEQ ID NO: 780205 - DNA, 13 bp, Homo sapiens
ccaactccagcaa

SEQ ID NO: 780206 - DNA, 15 bp, Homo sapiens
ccaactccagcaact

SEQ ID NO: 780207 - DNA, 21 bp, Homo sapiens
ccaactccatggggttcgaga

SEQ ID NO: 780208 - DNA, 19 bp, Homo sapiens
ccaactccgcccagcctct

SEQ ID NO: 780209 - DNA, 20 bp, Homo sapiens
ccaactccgcccagcctctc

SEQ ID NO: 780210 - DNA, 21 bp, Homo sapiens
ccaactcctgatgccctcttc

SEQ ID NO: 780211 - DNA, 15 bp, Homo sapiens
ccaactcgggctccc

SEQ ID NO: 780212 - DNA, 21 bp, Homo sapiens
ccaactctagctgggggtggg

SEQ ID NO: 780213 - DNA, 13 bp, Homo sapiens
ccaactctcccca

SEQ ID NO: 780214 - DNA, 13 bp, Homo sapiens
ccaactctcctgg

SEQ ID NO: 780215 - DNA, 14 bp, Homo sapiens
ccaactctgagccc

SEQ ID NO: 780216 - DNA, 15 bp, Homo sapiens
ccaactctgagccca

SEQ ID NO: 780217 - DNA, 13 bp, Homo sapiens
ccaactctgcact

SEQ ID NO: 780218 - DNA, 17 bp, Homo sapiens
ccaactcttcctcccct

SEQ ID NO: 780219 - DNA, 18 bp, Homo sapiens
ccaactcttcctcccctc

SEQ ID NO: 780220 - DNA, 18 bp, Homo sapiens
ccaactgaagccttcttc

SEQ ID NO: 780221 - DNA, 20 bp, Homo sapiens
ccaactgaagccttcttctg

SEQ ID NO: 780222 - DNA, 12 bp, Homo sapiens
ccaactgaaggc

SEQ ID NO: 780223 - DNA, 15 bp, Homo sapiens
ccaactgattttgta

SEQ ID NO: 780224 - DNA, 22 bp, Homo sapiens
ccaactgattttgtatgtaaat

SEQ ID NO: 780225 - DNA, 19 bp, Homo sapiens
ccaactgcaaaaaaagcct

SEQ ID NO: 780226 - DNA, 21 bp, Homo sapiens
ccaactgcaaaaaaagcctcc

SEQ ID NO: 780227 - DNA, 18 bp, Homo sapiens
ccaactgctaatgcaaat

SEQ ID NO: 780228 - DNA, 17 bp, Homo sapiens
ccaactggcttctgtgc

SEQ ID NO: 780229 - DNA, 16 bp, Homo sapiens
ccaactgggcccaaga

SEQ ID NO: 780230 - DNA, 11 bp, Homo sapiens
ccaactgtgtt

SEQ ID NO: 780231 - DNA, 18 bp, Homo sapiens
ccaacttcaccaccccct

SEQ ID NO: 780232 - DNA, 13 bp, Homo sapiens
ccaacttctccca

SEQ ID NO: 780233 - DNA, 14 bp, Homo sapiens
ccaacttctcccac

SEQ ID NO: 780234 - DNA, 16 bp, Homo sapiens
ccaacttctcccaccc

SEQ ID NO: 780235 - DNA, 20 bp, Homo sapiens
ccaacttctcccaccccttg

SEQ ID NO: 780236 - DNA, 13 bp, Homo sapiens
ccaacttgccaaa

SEQ ID NO: 780237 - DNA, 16 bp, Homo sapiens
ccaacttggcagcttt

SEQ ID NO: 780238 - DNA, 19 bp, Homo sapiens
ccaacttggttctgcttca

SEQ ID NO: 780239 - DNA, 16 bp, Homo sapiens
ccaacttgtctgggaa

SEQ ID NO: 780240 - DNA, 17 bp, Homo sapiens
ccaactttctgtaaact

SEQ ID NO: 780241 - DNA, 22 bp, Homo sapiens
ccaactttgtggatgtcttcct

SEQ ID NO: 780242 - DNA, 18 bp, Homo sapiens
ccaagaaaatgaagggat

SEQ ID NO: 780243 - DNA, 23 bp, Homo sapiens
ccaagaaagcttcttcagagtga

SEQ ID NO: 780244 - DNA, 18 bp, Homo sapiens
ccaagaaaggaaaccttt

SEQ ID NO: 780245 - DNA, 23 bp, Homo sapiens
ccaagaactgcagatagcccagg

SEQ ID NO: 780246 - DNA, 14 bp, Homo sapiens
ccaagaagcagtgg

SEQ ID NO: 780247 - DNA, 15 bp, Homo sapiens
ccaagaatattgcaa

SEQ ID NO: 780248 - DNA, 16 bp, Homo sapiens
ccaagaatattgcaaa

SEQ ID NO: 780249 - DNA, 21 bp, Homo sapiens
ccaagaatattgcaaaataca

SEQ ID NO: 780250 - DNA, 18 bp, Homo sapiens
ccaagaatggaagcctga

SEQ ID NO: 780251 - DNA, 13 bp, Homo sapiens
ccaagacaaatca

SEQ ID NO: 780252 - DNA, 14 bp, Homo sapiens
ccaagacagatgga

SEQ ID NO: 780253 - DNA, 22 bp, Homo sapiens
ccaagacagtgctgagattgga

SEQ ID NO: 780254 - DNA, 12 bp, Homo sapiens
ccaagacattgt

SEQ ID NO: 780255 - DNA, 14 bp, Homo sapiens
ccaagaccatccct

SEQ ID NO: 780256 - DNA, 15 bp, Homo sapiens
ccaagactcctcagg

SEQ ID NO: 780257 - DNA, 14 bp, Homo sapiens
ccaagactgggctg

SEQ ID NO: 780258 - DNA, 20 bp, Homo sapiens
ccaagagaaggggaagcact

SEQ ID NO: 780259 - DNA, 15 bp, Homo sapiens
ccaagagagaaagaa

SEQ ID NO: 780260 - DNA, 15 bp, Homo sapiens
ccaagagaggaagga

SEQ ID NO: 780261 - DNA, 16 bp, Homo sapiens
ccaagagaggaaggac

SEQ ID NO: 780262 - DNA, 20 bp, Homo sapiens
ccaagagaggaaggacccct

SEQ ID NO: 780263 - DNA, 23 bp, Homo sapiens
ccaagagaggaaggacccctcac

SEQ ID NO: 780264 - DNA, 16 bp, Homo sapiens
ccaagagcagagtctg

SEQ ID NO: 780265 - DNA, 21 bp, Homo sapiens
ccaagagcagagtctgggcct

SEQ ID NO: 780266 - DNA, 17 bp, Homo sapiens
ccaagagccctgtggcc

SEQ ID NO: 780267 - DNA, 22 bp, Homo sapiens
ccaagagctacgtatttaatag

SEQ ID NO: 780268 - DNA, 19 bp, Homo sapiens
ccaagaggaagttcagatc

SEQ ID NO: 780269 - DNA, 10 bp, Homo sapiens
ccaagaggct

SEQ ID NO: 780270 - DNA, 17 bp, Homo sapiens
ccaagaggggcgggctc

SEQ ID NO: 780271 - DNA, 22 bp, Homo sapiens
ccaagaggggcgggctcagagc

SEQ ID NO: 780272 - DNA, 13 bp, Homo sapiens
ccaagagggtgga

SEQ ID NO: 780273 - DNA, 19 bp, Homo sapiens
ccaagaggtctgagccctg

SEQ ID NO: 780274 - DNA, 18 bp, Homo sapiens
ccaagagtccaggaggcc

SEQ ID NO: 780275 - DNA, 18 bp, Homo sapiens
ccaagatacttaagtgct

SEQ ID NO: 780276 - DNA, 21 bp, Homo sapiens
ccaagataggaccttgggcca

SEQ ID NO: 780277 - DNA, 13 bp, Homo sapiens
ccaagatgaatta

SEQ ID NO: 780278 - DNA, 16 bp, Homo sapiens
ccaagatgagctgcag

SEQ ID NO: 780279 - DNA, 17 bp, Homo sapiens
ccaagatgtaaaacaag

SEQ ID NO: 780280 - DNA, 14 bp, Homo sapiens
ccaagattatgtga

SEQ ID NO: 780281 - DNA, 21 bp, Homo sapiens
ccaagattcacacctgactct

SEQ ID NO: 780282 - DNA, 17 bp, Homo sapiens
ccaagcaacatttgtat

SEQ ID NO: 780283 - DNA, 15 bp, Homo sapiens
ccaagcacagagcct

SEQ ID NO: 780284 - DNA, 17 bp, Homo sapiens
ccaagcacagagcctgg

SEQ ID NO: 780285 - DNA, 18 bp, Homo sapiens
ccaagcacagagcctggc

SEQ ID NO: 780286 - DNA, 20 bp, Homo sapiens
ccaagcactcgagaccatcc

SEQ ID NO: 780287 - DNA, 11 bp, Homo sapiens
ccaagcagaaa

SEQ ID NO: 780288 - DNA, 12 bp, Homo sapiens
ccaagcagccag

SEQ ID NO: 780289 - DNA, 17 bp, Homo sapiens
ccaagcagtgcctgcct

SEQ ID NO: 780290 - DNA, 19 bp, Homo sapiens
ccaagcatcagggggaaga

SEQ ID NO: 780291 - DNA, 22 bp, Homo sapiens
ccaagcatcttgggggggtggc

SEQ ID NO: 780292 - DNA, 15 bp, Homo sapiens
ccaagccccatctca

SEQ ID NO: 780293 - DNA, 19 bp, Homo sapiens
ccaagccccatctcatcct

SEQ ID NO: 780294 - DNA, 20 bp, Homo sapiens
ccaagccccatctcatcctg

SEQ ID NO: 780295 - DNA, 22 bp, Homo sapiens
ccaagccccatctcatcctggc

SEQ ID NO: 780296 - DNA, 24 bp, Homo sapiens
ccaagccccatctcatcctggcac

SEQ ID NO: 780297 - DNA, 17 bp, Homo sapiens
ccaagccccctggcagc

SEQ ID NO: 780298 - DNA, 17 bp, Homo sapiens
ccaagcccgacttgctg

SEQ ID NO: 780299 - DNA, 14 bp, Homo sapiens
ccaagccctaagcc

SEQ ID NO: 780300 - DNA, 11 bp, Homo sapiens
ccaagcccttt

SEQ ID NO: 780301 - DNA, 17 bp, Homo sapiens
ccaagccgaccttccct

SEQ ID NO: 780302 - DNA, 14 bp, Homo sapiens
ccaagcctccacag

SEQ ID NO: 780303 - DNA, 18 bp, Homo sapiens
ccaagcctgctggctgcg

SEQ ID NO: 780304 - DNA, 14 bp, Homo sapiens
ccaagcctgctgtg

SEQ ID NO: 780305 - DNA, 23 bp, Homo sapiens
ccaagcctgctgtgtccttcctc

SEQ ID NO: 780306 - DNA, 15 bp, Homo sapiens
ccaagcctggcaagg

SEQ ID NO: 780307 - DNA, 20 bp, Homo sapiens
ccaagcgaggtcaacagaga

SEQ ID NO: 780308 - DNA, 17 bp, Homo sapiens
ccaagcggccctgtgtg

SEQ ID NO: 780309 - DNA, 22 bp, Homo sapiens
ccaagcggccttttccaaatgc

SEQ ID NO: 780310 - DNA, 17 bp, Homo sapiens
ccaagcgggggcgtggc

SEQ ID NO: 780311 - DNA, 18 bp, Homo sapiens
ccaagcgggggcgtggct

SEQ ID NO: 780312 - DNA, 13 bp, Homo sapiens
ccaagcgttcctg

SEQ ID NO: 780313 - DNA, 15 bp, Homo sapiens
ccaagcgttcctggc

SEQ ID NO: 780314 - DNA, 19 bp, Homo sapiens
ccaagcgttcctggccttc

SEQ ID NO: 780315 - DNA, 17 bp, Homo sapiens
ccaagctaatctgcctg

SEQ ID NO: 780316 - DNA, 15 bp, Homo sapiens
ccaagctaatttata

SEQ ID NO: 780317 - DNA, 18 bp, Homo sapiens
ccaagctattcctttccc

SEQ ID NO: 780318 - DNA, 17 bp, Homo sapiens
ccaagctcacagttcct

SEQ ID NO: 780319 - DNA, 18 bp, Homo sapiens
ccaagctcacagttcctc

SEQ ID NO: 780320 - DNA, 19 bp, Homo sapiens
ccaagctcacagttcctcg

SEQ ID NO: 780321 - DNA, 17 bp, Homo sapiens
ccatgtatttcagggac

SEQ ID NO: 780322 - DNA, 19 bp, Homo sapiens
ccatgtatttcagggacct

SEQ ID NO: 780323 - DNA, 22 bp, Homo sapiens
ccatgtatttcagggacctcag

SEQ ID NO: 780324 - DNA, 16 bp, Homo sapiens
ccatgtcaaacaaata

SEQ ID NO: 780325 - DNA, 21 bp, Homo sapiens
ccatgtcaccggtcagtgcct

SEQ ID NO: 780326 - DNA, 13 bp, Homo sapiens
ccatgtcacctca

SEQ ID NO: 780327 - DNA, 17 bp, Homo sapiens
ccatgtcacctcagctg

SEQ ID NO: 780328 - DNA, 13 bp, Homo sapiens
ccatgtcactgtg

SEQ ID NO: 780329 - DNA, 22 bp, Homo sapiens
ccatgtcagataagtgtaaata

SEQ ID NO: 780330 - DNA, 17 bp, Homo sapiens
ccatgtcagcaaaaagc

SEQ ID NO: 780331 - DNA, 18 bp, Homo sapiens
ccatgtcagcaaaaagca

SEQ ID NO: 780332 - DNA, 21 bp, Homo sapiens
ccatgtcaggccagcctgtcc

SEQ ID NO: 780333 - DNA, 14 bp, Homo sapiens
ccatgtccaaagag

SEQ ID NO: 780334 - DNA, 23 bp, Homo sapiens
ccatgtccaagttcttcacctct

SEQ ID NO: 780335 - DNA, 15 bp, Homo sapiens
ccatgtcctcagcat

SEQ ID NO: 780336 - DNA, 13 bp, Homo sapiens
ccatgtcttctgc

SEQ ID NO: 780337 - DNA, 18 bp, Homo sapiens
ccatgtgaccattctgcc

SEQ ID NO: 780338 - DNA, 22 bp, Homo sapiens
ccatgtgatggacactccaggg

SEQ ID NO: 780339 - DNA, 13 bp, Homo sapiens
ccatgtgccttgt

SEQ ID NO: 780340 - DNA, 21 bp, Homo sapiens
ccatgtgccttgtccaggaac

SEQ ID NO: 780341 - DNA, 23 bp, Homo sapiens
ccatgtgctgggaaatgcagaaa

SEQ ID NO: 780342 - DNA, 23 bp, Homo sapiens
ccatgtggatatcagttaccaaa

SEQ ID NO: 780343 - DNA, 17 bp, Homo sapiens
ccatgtggatgcagcac

SEQ ID NO: 780344 - DNA, 17 bp, Homo sapiens
ccatgtggcagcccatg

SEQ ID NO: 780345 - DNA, 13 bp, Homo sapiens
ccatgtggcctgc

SEQ ID NO: 780346 - DNA, 16 bp, Homo sapiens
ccatgtggcctgccca

SEQ ID NO: 780347 - DNA, 13 bp, Homo sapiens
ccatgtggctgaa

SEQ ID NO: 780348 - DNA, 14 bp, Homo sapiens
ccatgtggctgaag

SEQ ID NO: 780349 - DNA, 18 bp, Homo sapiens
ccatgtggtggcacaggc

SEQ ID NO: 780350 - DNA, 18 bp, Homo sapiens
ccatgtgtatgcgtgtcc

SEQ ID NO: 780351 - DNA, 19 bp, Homo sapiens
ccatgtgtcacttgtgctt

SEQ ID NO: 780352 - DNA, 12 bp, Homo sapiens
ccatgtgtcccc

SEQ ID NO: 780353 - DNA, 13 bp, Homo sapiens
ccatgtgtcccct

SEQ ID NO: 780354 - DNA, 17 bp, Homo sapiens
ccatgtgtcccctcact

SEQ ID NO: 780355 - DNA, 18 bp, Homo sapiens
ccatgtgtcccctcactc

SEQ ID NO: 780356 - DNA, 11 bp, Homo sapiens
ccatgtgtgag

SEQ ID NO: 780357 - DNA, 21 bp, Homo sapiens
ccatgtgtgctaatatacttt

SEQ ID NO: 780358 - DNA, 12 bp, Homo sapiens
ccatgtgtgtgc

SEQ ID NO: 780359 - DNA, 16 bp, Homo sapiens
ccatgtgttatgtttt

SEQ ID NO: 780360 - DNA, 14 bp, Homo sapiens
ccatgttaaatgac

SEQ ID NO: 780361 - DNA, 17 bp, Homo sapiens
ccatgttaaatgacttg

SEQ ID NO: 780362 - DNA, 20 bp, Homo sapiens
ccatgttaagtcctccctga

SEQ ID NO: 780363 - DNA, 20 bp, Homo sapiens
ccatgttagggttatgtttt

SEQ ID NO: 780364 - DNA, 22 bp, Homo sapiens
ccatgttcacaccgctgcactc

SEQ ID NO: 780365 - DNA, 14 bp, Homo sapiens
ccatgttctgcccc

SEQ ID NO: 780366 - DNA, 16 bp, Homo sapiens
ccatgttctgccccca

SEQ ID NO: 780367 - DNA, 17 bp, Homo sapiens
ccatgttctgcccccag

SEQ ID NO: 780368 - DNA, 21 bp, Homo sapiens
ccatgttctgcccccagccca

SEQ ID NO: 780369 - DNA, 20 bp, Homo sapiens
ccatgttggtcaggatggtc

SEQ ID NO: 780370 - DNA, 17 bp, Homo sapiens
ccatgttgtaatgctgc

SEQ ID NO: 780371 - DNA, 22 bp, Homo sapiens
ccatgttgtaatgctgcacttc

SEQ ID NO: 780372 - DNA, 13 bp, Homo sapiens
ccatgtttgtaaa

SEQ ID NO: 780373 - DNA, 16 bp, Homo sapiens
ccatgtttttggggac

SEQ ID NO: 780374 - DNA, 14 bp, Homo sapiens
ccattaaaataaaa

SEQ ID NO: 780375 - DNA, 14 bp, Homo sapiens
ccattaaagtcaga

SEQ ID NO: 780376 - DNA, 14 bp, Homo sapiens
ccattaacagcaat

SEQ ID NO: 780377 - DNA, 13 bp, Homo sapiens
ccattaacatttt

SEQ ID NO: 780378 - DNA, 17 bp, Homo sapiens
ccattaatcagttcatt

SEQ ID NO: 780379 - DNA, 14 bp, Homo sapiens
ccattaccatggag

SEQ ID NO: 780380 - DNA, 16 bp, Homo sapiens
ccattacctgtacctg

SEQ ID NO: 780381 - DNA, 13 bp, Homo sapiens
ccattactactgt

SEQ ID NO: 780382 - DNA, 16 bp, Homo sapiens
ccattactactgtaca

SEQ ID NO: 780383 - DNA, 16 bp, Homo sapiens
ccattagaatgtgatt

SEQ ID NO: 780384 - DNA, 19 bp, Homo sapiens
ccattagagcacagcttct

SEQ ID NO: 780385 - DNA, 20 bp, Homo sapiens
ccattagagcacagcttctt

SEQ ID NO: 780386 - DNA, 22 bp, Homo sapiens
ccattagagcacagcttcttct

SEQ ID NO: 780387 - DNA, 20 bp, Homo sapiens
ccattaggccagcaacgctt

SEQ ID NO: 780388 - DNA, 13 bp, Homo sapiens
ccattatatttgc

SEQ ID NO: 780389 - DNA, 13 bp, Homo sapiens
ccattatgcaaat

SEQ ID NO: 780390 - DNA, 19 bp, Homo sapiens
ccattatgcaaatggagat

SEQ ID NO: 780391 - DNA, 15 bp, Homo sapiens
ccattattatgatgt

SEQ ID NO: 780392 - DNA, 16 bp, Homo sapiens
ccattattatttctgt

SEQ ID NO: 780393 - DNA, 16 bp, Homo sapiens
ccattattttctgtca

SEQ ID NO: 780394 - DNA, 18 bp, Homo sapiens
ccattattttctgtcaga

SEQ ID NO: 780395 - DNA, 16 bp, Homo sapiens
ccattcacaagcctcc

SEQ ID NO: 780396 - DNA, 13 bp, Homo sapiens
ccattcacaccag

SEQ ID NO: 780397 - DNA, 19 bp, Homo sapiens
ccattcactcttccagaat

SEQ ID NO: 780398 - DNA, 20 bp, Homo sapiens
ccattcacttcataatccag

SEQ ID NO: 780399 - DNA, 21 bp, Homo sapiens
ccattcagaaagcttcaaatt

SEQ ID NO: 780400 - DNA, 15 bp, Homo sapiens
ccattcatgtcctgt

SEQ ID NO: 780401 - DNA, 16 bp, Homo sapiens
ccattcattaattagt

SEQ ID NO: 780402 - DNA, 16 bp, Homo sapiens
ccattccagaatatct

SEQ ID NO: 780403 - DNA, 15 bp, Homo sapiens
ccattccatggaaat

SEQ ID NO: 780404 - DNA, 15 bp, Homo sapiens
ccattccctagtcat

SEQ ID NO: 780405 - DNA, 19 bp, Homo sapiens
ccattccctgggatctggt

SEQ ID NO: 780406 - DNA, 13 bp, Homo sapiens
ccattcctcaggg

SEQ ID NO: 780407 - DNA, 14 bp, Homo sapiens
ccattcctccactc

SEQ ID NO: 780408 - DNA, 20 bp, Homo sapiens
ccattcctccactctgtatc

SEQ ID NO: 780409 - DNA, 17 bp, Homo sapiens
ccattcctggtacccag

SEQ ID NO: 780410 - DNA, 21 bp, Homo sapiens
ccattcctggtacccagccat

SEQ ID NO: 780411 - DNA, 18 bp, Homo sapiens
ccattcctgtccctttgt

SEQ ID NO: 780412 - DNA, 15 bp, Homo sapiens
ccattccttcaaata

SEQ ID NO: 780413 - DNA, 17 bp, Homo sapiens
ccattcgtctgtcccag

SEQ ID NO: 780414 - DNA, 19 bp, Homo sapiens
ccattcgtctgtcccagag

SEQ ID NO: 780415 - DNA, 12 bp, Homo sapiens
ccattctagatc

SEQ ID NO: 780416 - DNA, 15 bp, Homo sapiens
ccattctagatcctg

SEQ ID NO: 780417 - DNA, 18 bp, Homo sapiens
ccattctagatcctgcac

SEQ ID NO: 780418 - DNA, 16 bp, Homo sapiens
ccattctcatctgcac

SEQ ID NO: 780419 - DNA, 13 bp, Homo sapiens
ccattctcccagg

SEQ ID NO: 780420 - DNA, 14 bp, Homo sapiens
ccattctcccaggt

SEQ ID NO: 780421 - DNA, 15 bp, Homo sapiens
ccattctcccaggta

SEQ ID NO: 780422 - DNA, 23 bp, Homo sapiens
ccattctcccaggtaccagctgc

SEQ ID NO: 780423 - DNA, 12 bp, Homo sapiens
ccattctcctgc

SEQ ID NO: 780424 - DNA, 14 bp, Homo sapiens
ccattctctctcct

SEQ ID NO: 780425 - DNA, 16 bp, Homo sapiens
ccattctgaccatttc

SEQ ID NO: 780426 - DNA, 20 bp, Homo sapiens
ccattctgactcggtttctc

SEQ ID NO: 780427 - DNA, 20 bp, Homo sapiens
ccattcttcctagttttctc

SEQ ID NO: 780428 - DNA, 13 bp, Homo sapiens
ccattcttctggg

SEQ ID NO: 780429 - DNA, 15 bp, Homo sapiens
ccattcttctgggtg

SEQ ID NO: 780430 - DNA, 17 bp, Homo sapiens
ccattcttttaaatatt

SEQ ID NO: 780431 - DNA, 18 bp, Homo sapiens
ccattcttttgtaattta

SEQ ID NO: 780432 - DNA, 22 bp, Homo sapiens
ccattcttttgtaatttaaatg

SEQ ID NO: 780433 - DNA, 19 bp, Homo sapiens
ccattgaaatcagcatgac

SEQ ID NO: 780434 - DNA, 13 bp, Homo sapiens
ccattgacctcag

SEQ ID NO: 780435 - DNA, 14 bp, Homo sapiens
ccattgacctcagc

SEQ ID NO: 780436 - DNA, 13 bp, Homo sapiens
ccattgagtgctg

SEQ ID NO: 780437 - DNA, 21 bp, Homo sapiens
ccattgccaccaggagaacca

SEQ ID NO: 780438 - DNA, 17 bp, Homo sapiens
ccattgccaggagatgg

SEQ ID NO: 780439 - DNA, 21 bp, Homo sapiens
ccattgctcttagtcccaagc

SEQ ID NO: 780440 - DNA, 12 bp, Homo sapiens
ccattgcttcac

SEQ ID NO: 780441 - DNA, 17 bp, Homo sapiens
ccattggagcacctggg

SEQ ID NO: 780442 - DNA, 15 bp, Homo sapiens
ccattggatctcatt

SEQ ID NO: 780443 - DNA, 16 bp, Homo sapiens
ccattggcctcttgtc

SEQ ID NO: 780444 - DNA, 19 bp, Homo sapiens
ccattgggcacagtccaga

SEQ ID NO: 780445 - DNA, 18 bp, Homo sapiens
ccattgggtttggggcca

SEQ ID NO: 780446 - DNA, 13 bp, Homo sapiens
ccattggtgttgt

SEQ ID NO: 780447 - DNA, 14 bp, Homo sapiens
ccatgaggtactgg

SEQ ID NO: 780448 - DNA, 14 bp, Homo sapiens
ccatgataagaaca

SEQ ID NO: 780449 - DNA, 18 bp, Homo sapiens
ccatgatagctggggctt

SEQ ID NO: 780450 - DNA, 23 bp, Homo sapiens
ccatgatcagacatacagctgcc

SEQ ID NO: 780451 - DNA, 24 bp, Homo sapiens
ccatgatcagacatacagctgcct

SEQ ID NO: 780452 - DNA, 18 bp, Homo sapiens
ccatgatgtagtgcctct

SEQ ID NO: 780453 - DNA, 15 bp, Homo sapiens
ccatgatttgtccca

SEQ ID NO: 780454 - DNA, 16 bp, Homo sapiens
ccatgattttctaaaa

SEQ ID NO: 780455 - DNA, 23 bp, Homo sapiens
ccatgcacactcatgcacacaga

SEQ ID NO: 780456 - DNA, 21 bp, Homo sapiens
ccatgcaccctcatacacaga

SEQ ID NO: 780457 - DNA, 19 bp, Homo sapiens
ccatgcactatatttgtat

SEQ ID NO: 780458 - DNA, 14 bp, Homo sapiens
ccatgcagcccctg

SEQ ID NO: 780459 - DNA, 13 bp, Homo sapiens
ccatgcagccttg

SEQ ID NO: 780460 - DNA, 23 bp, Homo sapiens
ccatgcaggaagaggcccactag

SEQ ID NO: 780461 - DNA, 13 bp, Homo sapiens
ccatgcaggaggt

SEQ ID NO: 780462 - DNA, 16 bp, Homo sapiens
ccatgcaggaggtgga

SEQ ID NO: 780463 - DNA, 13 bp, Homo sapiens
ccatgcaggccct

SEQ ID NO: 780464 - DNA, 16 bp, Homo sapiens
ccatgcatttaaagta

SEQ ID NO: 780465 - DNA, 13 bp, Homo sapiens
ccatgccacgttc

SEQ ID NO: 780466 - DNA, 18 bp, Homo sapiens
ccatgccacgttccacag

SEQ ID NO: 780467 - DNA, 15 bp, Homo sapiens
ccatgccactgccag

SEQ ID NO: 780468 - DNA, 18 bp, Homo sapiens
ccatgccactgccaggca

SEQ ID NO: 780469 - DNA, 19 bp, Homo sapiens
ccatgccactgccaggcac

SEQ ID NO: 780470 - DNA, 23 bp, Homo sapiens
ccatgccactgccaggcacctgg

SEQ ID NO: 780471 - DNA, 19 bp, Homo sapiens
ccatgccagattctgcctc

SEQ ID NO: 780472 - DNA, 14 bp, Homo sapiens
ccatgccagctggc

SEQ ID NO: 780473 - DNA, 15 bp, Homo sapiens
ccatgccaggaacct

SEQ ID NO: 780474 - DNA, 17 bp, Homo sapiens
ccatgcccacctgccca

SEQ ID NO: 780475 - DNA, 11 bp, Homo sapiens
ccatgccccac

SEQ ID NO: 780476 - DNA, 19 bp, Homo sapiens
ccatgccccacccccctcc

SEQ ID NO: 780477 - DNA, 16 bp, Homo sapiens
ccatgccccagctctg

SEQ ID NO: 780478 - DNA, 14 bp, Homo sapiens
ccatgccctagacc

SEQ ID NO: 780479 - DNA, 15 bp, Homo sapiens
ccatgccctcccagg

SEQ ID NO: 780480 - DNA, 18 bp, Homo sapiens
ccatgccctcccaggacc

SEQ ID NO: 780481 - DNA, 12 bp, Homo sapiens
ccatgcctcagc

SEQ ID NO: 780482 - DNA, 15 bp, Homo sapiens
ccatgcctcatgcca

SEQ ID NO: 780483 - DNA, 17 bp, Homo sapiens
ccatgcctcatgccaca

SEQ ID NO: 780484 - DNA, 11 bp, Homo sapiens
ccatgcctccc

SEQ ID NO: 780485 - DNA, 20 bp, Homo sapiens
ccatgcctccctgggccacc

SEQ ID NO: 780486 - DNA, 16 bp, Homo sapiens
ccatgcctcctcagga

SEQ ID NO: 780487 - DNA, 12 bp, Homo sapiens
ccatgcctctgg

SEQ ID NO: 780488 - DNA, 16 bp, Homo sapiens
ccatgcctgagggtgg

SEQ ID NO: 780489 - DNA, 22 bp, Homo sapiens
ccatgcctgcccccctcatctc

SEQ ID NO: 780490 - DNA, 14 bp, Homo sapiens
ccatgcctggtccc

SEQ ID NO: 780491 - DNA, 18 bp, Homo sapiens
ccatgcctgtccagcctg

SEQ ID NO: 780492 - DNA, 19 bp, Homo sapiens
ccatgcctgtccagcctgg

SEQ ID NO: 780493 - DNA, 14 bp, Homo sapiens
ccatgcgaggggcc

SEQ ID NO: 780494 - DNA, 22 bp, Homo sapiens
ccatgcgaggggccagcagagg

SEQ ID NO: 780495 - DNA, 23 bp, Homo sapiens
ccatgcgaggggccagcagaggg

SEQ ID NO: 780496 - DNA, 20 bp, Homo sapiens
ccatgcgccccctccgccct

SEQ ID NO: 780497 - DNA, 18 bp, Homo sapiens
ccatgcgtgccgcctgct

SEQ ID NO: 780498 - DNA, 21 bp, Homo sapiens
ccatgcgtgccgcctgctcct

SEQ ID NO: 780499 - DNA, 14 bp, Homo sapiens
ccatgctacagtta

SEQ ID NO: 780500 - DNA, 22 bp, Homo sapiens
ccatgctatctgttcctatctg

SEQ ID NO: 780501 - DNA, 21 bp, Homo sapiens
ccatgctcaacccccctccca

SEQ ID NO: 780502 - DNA, 18 bp, Homo sapiens
ccatgctcatctgctggt

SEQ ID NO: 780503 - DNA, 13 bp, Homo sapiens
ccatgctctgccc

SEQ ID NO: 780504 - DNA, 14 bp, Homo sapiens
ccatgctctgcccc

SEQ ID NO: 780505 - DNA, 23 bp, Homo sapiens
ccatgctctgccccaagccccca

SEQ ID NO: 780506 - DNA, 16 bp, Homo sapiens
ccatgctgaagggacc

SEQ ID NO: 780507 - DNA, 15 bp, Homo sapiens
ccatgctgaggcctg

SEQ ID NO: 780508 - DNA, 17 bp, Homo sapiens
ccatgctgaggcctggg

SEQ ID NO: 780509 - DNA, 20 bp, Homo sapiens
ccatgctgaggcctgggccg

SEQ ID NO: 780510 - DNA, 18 bp, Homo sapiens
ccatgctgccttcaggga

SEQ ID NO: 780511 - DNA, 19 bp, Homo sapiens
ccatgctggcggcgcagag

SEQ ID NO: 780512 - DNA, 21 bp, Homo sapiens
ccatgctgggaagacgcctga

SEQ ID NO: 780513 - DNA, 17 bp, Homo sapiens
ccatgctgtccctgcac

SEQ ID NO: 780514 - DNA, 22 bp, Homo sapiens
ccatgctgtgcgcccagggctg

SEQ ID NO: 780515 - DNA, 18 bp, Homo sapiens
ccatgcttagtcactgcc

SEQ ID NO: 780516 - DNA, 19 bp, Homo sapiens
ccatgcttagtcactgcct

SEQ ID NO: 780517 - DNA, 21 bp, Homo sapiens
ccatgcttagtcactgcctgc

SEQ ID NO: 780518 - DNA, 15 bp, Homo sapiens
ccatgcttgggtgta

SEQ ID NO: 780519 - DNA, 16 bp, Homo sapiens
ccatggaaaaatgcca

SEQ ID NO: 780520 - DNA, 13 bp, Homo sapiens
ccatggaaataaa

SEQ ID NO: 780521 - DNA, 19 bp, Homo sapiens
ccatggaaggtgccagaag

SEQ ID NO: 780522 - DNA, 21 bp, Homo sapiens
ccatggacaatataaactgaa

SEQ ID NO: 780523 - DNA, 19 bp, Homo sapiens
ccatggacactacacccag

SEQ ID NO: 780524 - DNA, 19 bp, Homo sapiens
ccatggacactccagtgcc

SEQ ID NO: 780525 - DNA, 18 bp, Homo sapiens
ccatggacaggctggctc

SEQ ID NO: 780526 - DNA, 17 bp, Homo sapiens
ccatggacgaatatgaa

SEQ ID NO: 780527 - DNA, 19 bp, Homo sapiens
ccatggacgaatatgaatg

SEQ ID NO: 780528 - DNA, 16 bp, Homo sapiens
ccatggatctgatctg

SEQ ID NO: 780529 - DNA, 15 bp, Homo sapiens
ccatggcaaatgggc

SEQ ID NO: 780530 - DNA, 15 bp, Homo sapiens
ccatggcaccagccc

SEQ ID NO: 780531 - DNA, 16 bp, Homo sapiens
ccatggcaccagcccc

SEQ ID NO: 780532 - DNA, 16 bp, Homo sapiens
ccatggcccccaataa

SEQ ID NO: 780533 - DNA, 17 bp, Homo sapiens
ccatggcccccaataaa

SEQ ID NO: 780534 - DNA, 18 bp, Homo sapiens
ccatggcccccaataaag

SEQ ID NO: 780535 - DNA, 22 bp, Homo sapiens
ccatggcccccaataaaggcag

SEQ ID NO: 780536 - DNA, 13 bp, Homo sapiens
cccaaaccttggg

SEQ ID NO: 780537 - DNA, 22 bp, Homo sapiens
cccaaacgccctttcctcctca

SEQ ID NO: 780538 - DNA, 15 bp, Homo sapiens
cccaaactccccttc

SEQ ID NO: 780539 - DNA, 18 bp, Homo sapiens
cccaaactccccttccct

SEQ ID NO: 780540 - DNA, 13 bp, Homo sapiens
cccaaactccttt

SEQ ID NO: 780541 - DNA, 15 bp, Homo sapiens
cccaaactttaaaat

SEQ ID NO: 780542 - DNA, 20 bp, Homo sapiens
cccaaactttaaaatgcgaa

SEQ ID NO: 780543 - DNA, 22 bp, Homo sapiens
cccaaacttttaaaagtaggaa

SEQ ID NO: 780544 - DNA, 23 bp, Homo sapiens
cccaaagcagcaggcctctggtt

SEQ ID NO: 780545 - DNA, 21 bp, Homo sapiens
cccaaagcggccgatgggagt

SEQ ID NO: 780546 - DNA, 15 bp, Homo sapiens
cccaaagctttcctg

SEQ ID NO: 780547 - DNA, 21 bp, Homo sapiens
cccaaaggatgagaatgtgac

SEQ ID NO: 780548 - DNA, 12 bp, Homo sapiens
cccaaaggccca

SEQ ID NO: 780549 - DNA, 17 bp, Homo sapiens
cccaaaggcccagggag

SEQ ID NO: 780550 - DNA, 20 bp, Homo sapiens
cccaaaggggacaggcctca

SEQ ID NO: 780551 - DNA, 15 bp, Homo sapiens
cccaaagtcctctgc

SEQ ID NO: 780552 - DNA, 18 bp, Homo sapiens
cccaaagtcctctgctcc

SEQ ID NO: 780553 - DNA, 20 bp, Homo sapiens
cccaaagtgctgagattgca

SEQ ID NO: 780554 - DNA, 15 bp, Homo sapiens
cccaaagtgctggga

SEQ ID NO: 780555 - DNA, 20 bp, Homo sapiens
cccaaagtggtatagaaatg

SEQ ID NO: 780556 - DNA, 18 bp, Homo sapiens
cccaaataacttcagtcc

SEQ ID NO: 780557 - DNA, 21 bp, Homo sapiens
cccaaataacttcagtcctgc

SEQ ID NO: 780558 - DNA, 14 bp, Homo sapiens
cccaaatgagccat

SEQ ID NO: 780559 - DNA, 17 bp, Homo sapiens
cccaaatgatggatcac

SEQ ID NO: 780560 - DNA, 11 bp, Homo sapiens
cccaaatgtat

SEQ ID NO: 780561 - DNA, 15 bp, Homo sapiens
cccaaatgtgtacac

SEQ ID NO: 780562 - DNA, 19 bp, Homo sapiens
cccaaatttgattgatttg

SEQ ID NO: 780563 - DNA, 14 bp, Homo sapiens
cccaacacaggcaa

SEQ ID NO: 780564 - DNA, 16 bp, Homo sapiens
cccaacacctgcctct

SEQ ID NO: 780565 - DNA, 15 bp, Homo sapiens
cccaacacctgctgc

SEQ ID NO: 780566 - DNA, 18 bp, Homo sapiens
cccaacacctgctgcgct

SEQ ID NO: 780567 - DNA, 16 bp, Homo sapiens
cccaacactgtgccct

SEQ ID NO: 780568 - DNA, 19 bp, Homo sapiens
cccaacactgtgccctggt

SEQ ID NO: 780569 - DNA, 16 bp, Homo sapiens
cccaacagccttagct

SEQ ID NO: 780570 - DNA, 14 bp, Homo sapiens
cccaacatgggagg

SEQ ID NO: 780571 - DNA, 16 bp, Homo sapiens
cccaacatgggaggga

SEQ ID NO: 780572 - DNA, 19 bp, Homo sapiens
cccaacatgggagggatca

SEQ ID NO: 780573 - DNA, 21 bp, Homo sapiens
cccaacatgggagggatcagc

SEQ ID NO: 780574 - DNA, 12 bp, Homo sapiens
cccaacattctg

SEQ ID NO: 780575 - DNA, 13 bp, Homo sapiens
cccaacattctgc

SEQ ID NO: 780576 - DNA, 23 bp, Homo sapiens
cccaaccaaggaaggagcccctg

SEQ ID NO: 780577 - DNA, 14 bp, Homo sapiens
cccaaccaggccct

SEQ ID NO: 780578 - DNA, 17 bp, Homo sapiens
cccaacccaaaccatga

SEQ ID NO: 780579 - DNA, 15 bp, Homo sapiens
cccaacccaataaaa

SEQ ID NO: 780580 - DNA, 12 bp, Homo sapiens
cccaacccccag

SEQ ID NO: 780581 - DNA, 14 bp, Homo sapiens
cccaacccccctcc

SEQ ID NO: 780582 - DNA, 14 bp, Homo sapiens
cccaagtcttctcc

SEQ ID NO: 780583 - DNA, 14 bp, Homo sapiens
cccaagtgaccagg

SEQ ID NO: 780584 - DNA, 12 bp, Homo sapiens
cccaagtgcctg

SEQ ID NO: 780585 - DNA, 16 bp, Homo sapiens
cccaagtgcctgcttt

SEQ ID NO: 780586 - DNA, 16 bp, Homo sapiens
cccaagtgggcagtca

SEQ ID NO: 780587 - DNA, 24 bp, Homo sapiens
cccaagtgggcagtcaccacccag

SEQ ID NO: 780588 - DNA, 23 bp, Homo sapiens
cccaagtgggggcagagggcaga

SEQ ID NO: 780589 - DNA, 16 bp, Homo sapiens
cccaagtgtgaacaaa

SEQ ID NO: 780590 - DNA, 19 bp, Homo sapiens
cccaagttcatgcagctgt

SEQ ID NO: 780591 - DNA, 21 bp, Homo sapiens
cccaagtttccatagcaacag

SEQ ID NO: 780592 - DNA, 23 bp, Homo sapiens
cccaagtttccatagcaacagga

SEQ ID NO: 780593 - DNA, 15 bp, Homo sapiens
cccaataaaggcagc

SEQ ID NO: 780594 - DNA, 17 bp, Homo sapiens
cccaataaaggcagctg

SEQ ID NO: 780595 - DNA, 21 bp, Homo sapiens
cccaataaaggcagctgcctc

SEQ ID NO: 780596 - DNA, 22 bp, Homo sapiens
cccaataaaggcagctgcctct

SEQ ID NO: 780597 - DNA, 23 bp, Homo sapiens
cccaataaaggcagctgcctctg

SEQ ID NO: 780598 - DNA, 12 bp, Homo sapiens
cccaatattata

SEQ ID NO: 780599 - DNA, 17 bp, Homo sapiens
cccaatattataatttt

SEQ ID NO: 780600 - DNA, 20 bp, Homo sapiens
cccaatcaaagaattacagt

SEQ ID NO: 780601 - DNA, 23 bp, Homo sapiens
cccaatcacgagatcttccttcc

SEQ ID NO: 780602 - DNA, 17 bp, Homo sapiens
cccaatccatgcttcac

SEQ ID NO: 780603 - DNA, 12 bp, Homo sapiens
cccaatccctct

SEQ ID NO: 780604 - DNA, 13 bp, Homo sapiens
cccaatccctctc

SEQ ID NO: 780605 - DNA, 14 bp, Homo sapiens
cccaatccctctcc

SEQ ID NO: 780606 - DNA, 19 bp, Homo sapiens
cccaatccctgccactggg

SEQ ID NO: 780607 - DNA, 22 bp, Homo sapiens
cccaatccctgccactgggctc

SEQ ID NO: 780608 - DNA, 23 bp, Homo sapiens
cccaatccctgccactgggctct

SEQ ID NO: 780609 - DNA, 12 bp, Homo sapiens
cccaatgaatta

SEQ ID NO: 780610 - DNA, 18 bp, Homo sapiens
cccaatgacacccatgcc

SEQ ID NO: 780611 - DNA, 14 bp, Homo sapiens
cccaatgcctgtga

SEQ ID NO: 780612 - DNA, 24 bp, Homo sapiens
cccaatgctttgggaggccaaggc

SEQ ID NO: 780613 - DNA, 14 bp, Homo sapiens
cccaattagcttgg

SEQ ID NO: 780614 - DNA, 14 bp, Homo sapiens
cccaattaggaagt

SEQ ID NO: 780615 - DNA, 18 bp, Homo sapiens
cccacaaaagacagaccc

SEQ ID NO: 780616 - DNA, 19 bp, Homo sapiens
cccacaaaagacagaccca

SEQ ID NO: 780617 - DNA, 21 bp, Homo sapiens
cccacaaccttcggctccggg

SEQ ID NO: 780618 - DNA, 16 bp, Homo sapiens
cccacaagctgcctct

SEQ ID NO: 780619 - DNA, 22 bp, Homo sapiens
cccacaaggaaccctcaggcca

SEQ ID NO: 780620 - DNA, 13 bp, Homo sapiens
cccacaagtggtg

SEQ ID NO: 780621 - DNA, 14 bp, Homo sapiens
cccacaagtggtgg

SEQ ID NO: 780622 - DNA, 20 bp, Homo sapiens
cccacaagtggtggtaaccc

SEQ ID NO: 780623 - DNA, 23 bp, Homo sapiens
cccacaagtggtggtaaccctgg

SEQ ID NO: 780624 - DNA, 20 bp, Homo sapiens
cccacacacaggccttctgt

SEQ ID NO: 780625 - DNA, 12 bp, Homo sapiens
cccacacagcct

SEQ ID NO: 780626 - DNA, 16 bp, Homo sapiens
cccacacagctgccct

SEQ ID NO: 780627 - DNA, 14 bp, Homo sapiens
cccacacagggcac

SEQ ID NO: 780628 - DNA, 20 bp, Homo sapiens
cccacacattccagggctgg

SEQ ID NO: 780629 - DNA, 23 bp, Homo sapiens
cccacacattccagggctggggt

SEQ ID NO: 780630 - DNA, 20 bp, Homo sapiens
cccacaccaggccgtcctcc

SEQ ID NO: 780631 - DNA, 18 bp, Homo sapiens
cccacacccacccttttt

SEQ ID NO: 780632 - DNA, 13 bp, Homo sapiens
cccaccttcccca

SEQ ID NO: 780633 - DNA, 18 bp, Homo sapiens
cccaccttccccagactc

SEQ ID NO: 780634 - DNA, 21 bp, Homo sapiens
cccaccttggtccctctcaga

SEQ ID NO: 780635 - DNA, 21 bp, Homo sapiens
cccaccttgttggagcctgca

SEQ ID NO: 780636 - DNA, 19 bp, Homo sapiens
cccacctttgggatcagcc

SEQ ID NO: 780637 - DNA, 18 bp, Homo sapiens
cccacgaaactgccctgg

SEQ ID NO: 780638 - DNA, 20 bp, Homo sapiens
cccacgaaactgccctggct

SEQ ID NO: 780639 - DNA, 13 bp, Homo sapiens
cccacgacaaaaa

SEQ ID NO: 780640 - DNA, 23 bp, Homo sapiens
cccacgacaaaaacaagactgcc

SEQ ID NO: 780641 - DNA, 21 bp, Homo sapiens
cccacgactgcccggcagggt

SEQ ID NO: 780642 - DNA, 15 bp, Homo sapiens
cccacgaggagcagc

SEQ ID NO: 780643 - DNA, 16 bp, Homo sapiens
cccacgaggagcagca

SEQ ID NO: 780644 - DNA, 13 bp, Homo sapiens
cccacgagggctg

SEQ ID NO: 780645 - DNA, 16 bp, Homo sapiens
cccacgagggtcagga

SEQ ID NO: 780646 - DNA, 22 bp, Homo sapiens
cccacgagggtctcccctcctg

SEQ ID NO: 780647 - DNA, 23 bp, Homo sapiens
cccacgagggtctcccctcctgc

SEQ ID NO: 780648 - DNA, 18 bp, Homo sapiens
cccacgagtcacctgcaa

SEQ ID NO: 780649 - DNA, 22 bp, Homo sapiens
cccacgagtcacctgcaagccc

SEQ ID NO: 780650 - DNA, 16 bp, Homo sapiens
cccacgatcccctccc

SEQ ID NO: 780651 - DNA, 19 bp, Homo sapiens
cccacgatcccctccccca

SEQ ID NO: 780652 - DNA, 18 bp, Homo sapiens
cccacgattttctccagc

SEQ ID NO: 780653 - DNA, 20 bp, Homo sapiens
cccacgcagacctgcagcgg

SEQ ID NO: 780654 - DNA, 14 bp, Homo sapiens
cccacgcagaggac

SEQ ID NO: 780655 - DNA, 21 bp, Homo sapiens
cccacgcatacacacatgccc

SEQ ID NO: 780656 - DNA, 16 bp, Homo sapiens
cccacgccggcctctg

SEQ ID NO: 780657 - DNA, 14 bp, Homo sapiens
cccacggaggagtt

SEQ ID NO: 780658 - DNA, 20 bp, Homo sapiens
cccacggagtcgtggggtgt

SEQ ID NO: 780659 - DNA, 15 bp, Homo sapiens
cccacggcctttcta

SEQ ID NO: 780660 - DNA, 14 bp, Homo sapiens
cccacgggaggaca

SEQ ID NO: 780661 - DNA, 17 bp, Homo sapiens
cccacggggatcacagc

SEQ ID NO: 780662 - DNA, 21 bp, Homo sapiens
cccacggggcagttagagcag

SEQ ID NO: 780663 - DNA, 22 bp, Homo sapiens
cccacggggcagttagagcagc

SEQ ID NO: 780664 - DNA, 15 bp, Homo sapiens
cccacggtctgagct

SEQ ID NO: 780665 - DNA, 24 bp, Homo sapiens
cccacggtctgagctagctagcgc

SEQ ID NO: 780666 - DNA, 19 bp, Homo sapiens
cccacgtagggggctctgg

SEQ ID NO: 780667 - DNA, 21 bp, Homo sapiens
cccacgtgagagaatctgcct

SEQ ID NO: 780668 - DNA, 23 bp, Homo sapiens
cccacgtgagagaatctgcctgt

SEQ ID NO: 780669 - DNA, 12 bp, Homo sapiens
cccacgtgggag

SEQ ID NO: 780670 - DNA, 19 bp, Homo sapiens
cccacgtgtcttccacttt

SEQ ID NO: 780671 - DNA, 20 bp, Homo sapiens
cccacgttctcacacccacc

SEQ ID NO: 780672 - DNA, 21 bp, Homo sapiens
cccacgttctcacacccaccg

SEQ ID NO: 780673 - DNA, 22 bp, Homo sapiens
cccacgtttgttcgcttcctga

SEQ ID NO: 780674 - DNA, 19 bp, Homo sapiens
cccactagagggcccatca

SEQ ID NO: 780675 - DNA, 13 bp, Homo sapiens
cccactcaccagc

SEQ ID NO: 780676 - DNA, 16 bp, Homo sapiens
cccactcaccagccct

SEQ ID NO: 780677 - DNA, 18 bp, Homo sapiens
cccactcaccagccctag

SEQ ID NO: 780678 - DNA, 15 bp, Homo sapiens
cccactcaccagggt

SEQ ID NO: 780679 - DNA, 13 bp, Homo sapiens
cccactcaccccc

SEQ ID NO: 780680 - DNA, 15 bp, Homo sapiens
cccactcaggggacc

SEQ ID NO: 780681 - DNA, 14 bp, Homo sapiens
cccactcccatctc

SEQ ID NO: 780682 - DNA, 16 bp, Homo sapiens
cccactcccatctcct

SEQ ID NO: 780683 - DNA, 17 bp, Homo sapiens
cccactcccatctcctt

SEQ ID NO: 780684 - DNA, 17 bp, Homo sapiens
cccactccccaccttca

SEQ ID NO: 780685 - DNA, 15 bp, Homo sapiens
cccactcccccttcc

SEQ ID NO: 780686 - DNA, 14 bp, Homo sapiens
cccactcccctcac

SEQ ID NO: 780687 - DNA, 15 bp, Homo sapiens
cccactccctgccta

SEQ ID NO: 780688 - DNA, 17 bp, Homo sapiens
cccactccggcttgtcc

SEQ ID NO: 780689 - DNA, 17 bp, Homo sapiens
cccactcctctcccaca

SEQ ID NO: 780690 - DNA, 13 bp, Homo sapiens
cccactctcattc

SEQ ID NO: 780691 - DNA, 17 bp, Homo sapiens
cccactctccccacact

SEQ ID NO: 780692 - DNA, 20 bp, Homo sapiens
cccactctctcacccaccag

SEQ ID NO: 780693 - DNA, 14 bp, Homo sapiens
cccactctgcctgc

SEQ ID NO: 780694 - DNA, 16 bp, Homo sapiens
cccactctgcctgcct

SEQ ID NO: 780695 - DNA, 13 bp, Homo sapiens
cccactctggtgg

SEQ ID NO: 780696 - DNA, 14 bp, Homo sapiens
cccactctgtaata

SEQ ID NO: 780697 - DNA, 19 bp, Homo sapiens
cccactgaaatgaccaaga

SEQ ID NO: 780698 - DNA, 19 bp, Homo sapiens
cccactgcaggccccgctt

SEQ ID NO: 780699 - DNA, 23 bp, Homo sapiens
cccactgcaggccccgcttgtcc

SEQ ID NO: 780700 - DNA, 17 bp, Homo sapiens
cccactgccagcagcag

SEQ ID NO: 780701 - DNA, 22 bp, Homo sapiens
cccactgctcgtggactgtgct

SEQ ID NO: 780702 - DNA, 13 bp, Homo sapiens
cccactggaagat

SEQ ID NO: 780703 - DNA, 15 bp, Homo sapiens
cccactggcagcatc

SEQ ID NO: 780704 - DNA, 12 bp, Homo sapiens
cccactggccgc

SEQ ID NO: 780705 - DNA, 16 bp, Homo sapiens
cccactggctgagaat

SEQ ID NO: 780706 - DNA, 19 bp, Homo sapiens
cccactgggaccaaccctg

SEQ ID NO: 780707 - DNA, 18 bp, Homo sapiens
cccactgggactcccagc

SEQ ID NO: 780708 - DNA, 20 bp, Homo sapiens
cccactgggccagccctgca

SEQ ID NO: 780709 - DNA, 21 bp, Homo sapiens
cccactgtccccctacccacc

SEQ ID NO: 780710 - DNA, 13 bp, Homo sapiens
cccactgtcctgg

SEQ ID NO: 780711 - DNA, 16 bp, Homo sapiens
cccactgtcctgggcg

SEQ ID NO: 780712 - DNA, 23 bp, Homo sapiens
cccactgtcctgggcgccctgga

SEQ ID NO: 780713 - DNA, 16 bp, Homo sapiens
cccactgtgcctcaga

SEQ ID NO: 780714 - DNA, 15 bp, Homo sapiens
cccacttagtgctgg

SEQ ID NO: 780715 - DNA, 14 bp, Homo sapiens
cccacttcaccccc

SEQ ID NO: 780716 - DNA, 15 bp, Homo sapiens
cccacttcccatctc

SEQ ID NO: 780717 - DNA, 13 bp, Homo sapiens
cccacttcctcct

SEQ ID NO: 780718 - DNA, 18 bp, Homo sapiens
cccacttcctcctacctg

SEQ ID NO: 780719 - DNA, 12 bp, Homo sapiens
cccacttcctgt

SEQ ID NO: 780720 - DNA, 16 bp, Homo sapiens
cccacttcctttccta

SEQ ID NO: 780721 - DNA, 12 bp, Homo sapiens
cccacttctcaa

SEQ ID NO: 780722 - DNA, 18 bp, Homo sapiens
cccacttctggcatggga

SEQ ID NO: 780723 - DNA, 14 bp, Homo sapiens
cccacttctggcca

SEQ ID NO: 780724 - DNA, 15 bp, Homo sapiens
cccacttctggccac

SEQ ID NO: 780725 - DNA, 14 bp, Homo sapiens
cccacttctggcct

SEQ ID NO: 780726 - DNA, 20 bp, Homo sapiens
cccacttctggcctccagcc

SEQ ID NO: 780727 - DNA, 23 bp, Homo sapiens
cccactttgtctgtacatactgg

SEQ ID NO: 780728 - DNA, 19 bp, Homo sapiens
cccagaaaaactggctctg

SEQ ID NO: 780729 - DNA, 13 bp, Homo sapiens
cccagaaaagaaa

SEQ ID NO: 780730 - DNA, 16 bp, Homo sapiens
cccagaaactgaacca

SEQ ID NO: 780731 - DNA, 16 bp, Homo sapiens
cccagaaagattttct

SEQ ID NO: 780732 - DNA, 15 bp, Homo sapiens
cccagaaagcctcct

SEQ ID NO: 780733 - DNA, 20 bp, Homo sapiens
cccagaaagcctcctgcccc

SEQ ID NO: 780734 - DNA, 19 bp, Homo sapiens
cccagaaagcctctctctc

SEQ ID NO: 780735 - DNA, 13 bp, Homo sapiens
cccagaaagctgc

SEQ ID NO: 780736 - DNA, 16 bp, Homo sapiens
cccagaaagctgccag

SEQ ID NO: 780737 - DNA, 17 bp, Homo sapiens
cccagaaatcactgtga

SEQ ID NO: 780738 - DNA, 16 bp, Homo sapiens
cccagaactggctggg

SEQ ID NO: 780739 - DNA, 17 bp, Homo sapiens
cccagaactggctgggc

SEQ ID NO: 780740 - DNA, 13 bp, Homo sapiens
cccagaaggcagg

SEQ ID NO: 780741 - DNA, 19 bp, Homo sapiens
cccagaagtggctactgac

SEQ ID NO: 780742 - DNA, 19 bp, Homo sapiens
cccagaatccataaatgtg

SEQ ID NO: 780743 - DNA, 12 bp, Homo sapiens
cccagaatccca

SEQ ID NO: 780744 - DNA, 21 bp, Homo sapiens
cccagaatccccaagtgcctg

SEQ ID NO: 780745 - DNA, 18 bp, Homo sapiens
cccagacaacagcccagg

SEQ ID NO: 780746 - DNA, 20 bp, Homo sapiens
cccagacaacagcccaggca

SEQ ID NO: 780747 - DNA, 14 bp, Homo sapiens
cccagacaaccaaa

SEQ ID NO: 780748 - DNA, 23 bp, Homo sapiens
cccagacaacgggcccatggcct

SEQ ID NO: 780749 - DNA, 19 bp, Homo sapiens
cccagacaaggagagcgga

SEQ ID NO: 780750 - DNA, 19 bp, Homo sapiens
cccatctctgtctggggct

SEQ ID NO: 780751 - DNA, 15 bp, Homo sapiens
cccatctgagctggg

SEQ ID NO: 780752 - DNA, 19 bp, Homo sapiens
cccatctgcaccccttctc

SEQ ID NO: 780753 - DNA, 12 bp, Homo sapiens
cccatctgccct

SEQ ID NO: 780754 - DNA, 16 bp, Homo sapiens
cccatctgggagtccc

SEQ ID NO: 780755 - DNA, 14 bp, Homo sapiens
cccatcttccacct

SEQ ID NO: 780756 - DNA, 16 bp, Homo sapiens
cccatcttccacctgt

SEQ ID NO: 780757 - DNA, 12 bp, Homo sapiens
cccatcttcctg

SEQ ID NO: 780758 - DNA, 17 bp, Homo sapiens
cccatcttcctgctgct

SEQ ID NO: 780759 - DNA, 18 bp, Homo sapiens
cccatcttcctgctgctg

SEQ ID NO: 780760 - DNA, 23 bp, Homo sapiens
cccatcttgatctttgagcccat

SEQ ID NO: 780761 - DNA, 18 bp, Homo sapiens
cccatgaagaaagcccct

SEQ ID NO: 780762 - DNA, 13 bp, Homo sapiens
cccatgacccacc

SEQ ID NO: 780763 - DNA, 20 bp, Homo sapiens
cccatgacccacccctgtgc

SEQ ID NO: 780764 - DNA, 21 bp, Homo sapiens
cccatgacccacccctgtgct

SEQ ID NO: 780765 - DNA, 18 bp, Homo sapiens
cccatgaccccaaagcca

SEQ ID NO: 780766 - DNA, 15 bp, Homo sapiens
cccatgactcttgga

SEQ ID NO: 780767 - DNA, 19 bp, Homo sapiens
cccatgactgcacccagct

SEQ ID NO: 780768 - DNA, 22 bp, Homo sapiens
cccatgactgcacccagctcca

SEQ ID NO: 780769 - DNA, 14 bp, Homo sapiens
cccatgagcctgcc

SEQ ID NO: 780770 - DNA, 13 bp, Homo sapiens
cccatgaggtctt

SEQ ID NO: 780771 - DNA, 17 bp, Homo sapiens
cccatgccacgttccac

SEQ ID NO: 780772 - DNA, 15 bp, Homo sapiens
cccatgccagagagg

SEQ ID NO: 780773 - DNA, 14 bp, Homo sapiens
cccatgccccagtc

SEQ ID NO: 780774 - DNA, 13 bp, Homo sapiens
cccatgcctgtcc

SEQ ID NO: 780775 - DNA, 16 bp, Homo sapiens
cccatgcctgtccagc

SEQ ID NO: 780776 - DNA, 13 bp, Homo sapiens
cccatgcctgtct

SEQ ID NO: 780777 - DNA, 21 bp, Homo sapiens
cccatgcgtgccgcctgctcc

SEQ ID NO: 780778 - DNA, 12 bp, Homo sapiens
cccatgctctgc

SEQ ID NO: 780779 - DNA, 14 bp, Homo sapiens
cccatgctctgccc

SEQ ID NO: 780780 - DNA, 16 bp, Homo sapiens
cccatgctctgcccca

SEQ ID NO: 780781 - DNA, 19 bp, Homo sapiens
cccatggagccagctccct

SEQ ID NO: 780782 - DNA, 16 bp, Homo sapiens
cccatggcccccaata

SEQ ID NO: 780783 - DNA, 22 bp, Homo sapiens
cccatggcccccaataaaggca

SEQ ID NO: 780784 - DNA, 18 bp, Homo sapiens
cccatggctgaagctgga

SEQ ID NO: 780785 - DNA, 20 bp, Homo sapiens
cccatggcttgttctctgga

SEQ ID NO: 780786 - DNA, 11 bp, Homo sapiens
cccatgggctg

SEQ ID NO: 780787 - DNA, 21 bp, Homo sapiens
cccatgggctgagtggggagc

SEQ ID NO: 780788 - DNA, 19 bp, Homo sapiens
cccatgggggtgagaccct

SEQ ID NO: 780789 - DNA, 23 bp, Homo sapiens
cccatgtatttatctctatttaa

SEQ ID NO: 780790 - DNA, 21 bp, Homo sapiens
cccatgtcaccggtcagtgcc

SEQ ID NO: 780791 - DNA, 12 bp, Homo sapiens
cccatgtcacct

SEQ ID NO: 780792 - DNA, 17 bp, Homo sapiens
cccatgtcacctcagct

SEQ ID NO: 780793 - DNA, 19 bp, Homo sapiens
cccatgtcgcgctcagcat

SEQ ID NO: 780794 - DNA, 16 bp, Homo sapiens
cccatgtctctcagaa

SEQ ID NO: 780795 - DNA, 12 bp, Homo sapiens
cccatgtcttct

SEQ ID NO: 780796 - DNA, 15 bp, Homo sapiens
cccatgtcttctgct

SEQ ID NO: 780797 - DNA, 17 bp, Homo sapiens
cccatgtcttctgctgt

SEQ ID NO: 780798 - DNA, 17 bp, Homo sapiens
cccatgtggcagcccat

SEQ ID NO: 780799 - DNA, 17 bp, Homo sapiens
cccatgtgtacattctg

SEQ ID NO: 780800 - DNA, 21 bp, Homo sapiens
cccatgtgtacattctgccta

SEQ ID NO: 780801 - DNA, 22 bp, Homo sapiens
cccatgtgtcccctcactctgt

SEQ ID NO: 780802 - DNA, 20 bp, Homo sapiens
cccatgttgtaatgctgcac

SEQ ID NO: 780803 - DNA, 13 bp, Homo sapiens
cccatgtttcaaa

SEQ ID NO: 780804 - DNA, 21 bp, Homo sapiens
cccattaggacaatcagtccc

SEQ ID NO: 780805 - DNA, 20 bp, Homo sapiens
cccattatgcgctgtggcca

SEQ ID NO: 780806 - DNA, 18 bp, Homo sapiens
cccattcagagactgtcc

SEQ ID NO: 780807 - DNA, 12 bp, Homo sapiens
cccattccctgg

SEQ ID NO: 780808 - DNA, 17 bp, Homo sapiens
cccattccctgggatct

SEQ ID NO: 780809 - DNA, 14 bp, Homo sapiens
cccattcctccctc

SEQ ID NO: 780810 - DNA, 18 bp, Homo sapiens
cccattccttgcgcctca

SEQ ID NO: 780811 - DNA, 19 bp, Homo sapiens
cccattctacacagagcag

SEQ ID NO: 780812 - DNA, 15 bp, Homo sapiens
cccattctagatcct

SEQ ID NO: 780813 - DNA, 18 bp, Homo sapiens
cccattctagatcctgca

SEQ ID NO: 780814 - DNA, 17 bp, Homo sapiens
cccattctcccagtctc

SEQ ID NO: 780815 - DNA, 19 bp, Homo sapiens
cccattctctctcctgtcc

SEQ ID NO: 780816 - DNA, 22 bp, Homo sapiens
cccattctgttttcccccagca

SEQ ID NO: 780817 - DNA, 21 bp, Homo sapiens
cccattcttctgggtgtgctt

SEQ ID NO: 780818 - DNA, 20 bp, Homo sapiens
cccattcttttgtaatttaa

SEQ ID NO: 780819 - DNA, 14 bp, Homo sapiens
cccattgccctggt

SEQ ID NO: 780820 - DNA, 17 bp, Homo sapiens
cccattggtgttgtcat

SEQ ID NO: 780821 - DNA, 21 bp, Homo sapiens
cccattggtgttgtcattgta

SEQ ID NO: 780822 - DNA, 12 bp, Homo sapiens
cccattgtcctc

SEQ ID NO: 780823 - DNA, 16 bp, Homo sapiens
cccattgtcctccttt

SEQ ID NO: 780824 - DNA, 18 bp, Homo sapiens
cccattgtgacagcgatg

SEQ ID NO: 780825 - DNA, 15 bp, Homo sapiens
cccattgtggctcct

SEQ ID NO: 780826 - DNA, 13 bp, Homo sapiens
cccatttcagctg

SEQ ID NO: 780827 - DNA, 14 bp, Homo sapiens
cccatttcccgcac

SEQ ID NO: 780828 - DNA, 13 bp, Homo sapiens
cccatttcctgta

SEQ ID NO: 780829 - DNA, 15 bp, Homo sapiens
cccatttctatttat

SEQ ID NO: 780830 - DNA, 17 bp, Homo sapiens
cccatttctatttattt

SEQ ID NO: 780831 - DNA, 23 bp, Homo sapiens
cccatttctgttgctggaggggc

SEQ ID NO: 780832 - DNA, 22 bp, Homo sapiens
cccattttcatcctgagcccaa

SEQ ID NO: 780833 - DNA, 14 bp, Homo sapiens
cccattttctgtgg

SEQ ID NO: 780834 - DNA, 22 bp, Homo sapiens
cccattttggaagttttcagga

SEQ ID NO: 780835 - DNA, 20 bp, Homo sapiens
cccatttttatatcgatctc

SEQ ID NO: 780836 - DNA, 16 bp, Homo sapiens
ccccaaaatccaaaac

SEQ ID NO: 780837 - DNA, 23 bp, Homo sapiens
ccccaaacacaaaacattcatgt

SEQ ID NO: 780838 - DNA, 17 bp, Homo sapiens
ccccaaacaggacagca

SEQ ID NO: 780839 - DNA, 16 bp, Homo sapiens
ccccaaacatagcccc

SEQ ID NO: 780840 - DNA, 16 bp, Homo sapiens
ccccaaacccagaaag

SEQ ID NO: 780841 - DNA, 17 bp, Homo sapiens
ccccaaacccagaaaga

SEQ ID NO: 780842 - DNA, 19 bp, Homo sapiens
ccccaaagagcctggagaa

SEQ ID NO: 780843 - DNA, 20 bp, Homo sapiens
ccccaaagagcctggagaag

SEQ ID NO: 780844 - DNA, 20 bp, Homo sapiens
ccccaaaggacgcctgcagg

SEQ ID NO: 780845 - DNA, 23 bp, Homo sapiens
ccccaaaggacgcctgcaggaga

SEQ ID NO: 780846 - DNA, 22 bp, Homo sapiens
ccccaacaaaccatccagtgac

SEQ ID NO: 780847 - DNA, 14 bp, Homo sapiens
ccccaacacaggca

SEQ ID NO: 780848 - DNA, 20 bp, Homo sapiens
ccccaacacaggcaagtcca

SEQ ID NO: 780849 - DNA, 18 bp, Homo sapiens
ccccaacacctgcctctg

SEQ ID NO: 780850 - DNA, 16 bp, Homo sapiens
ccccaacactgtgccc

SEQ ID NO: 780851 - DNA, 21 bp, Homo sapiens
ccccaacactgtgccctggtg

SEQ ID NO: 780852 - DNA, 16 bp, Homo sapiens
ccccaacatgcactga

SEQ ID NO: 780853 - DNA, 20 bp, Homo sapiens
ccccaaccaaggaaggagcc

SEQ ID NO: 780854 - DNA, 23 bp, Homo sapiens
ccccaacccccgcaccaagcaga

SEQ ID NO: 780855 - DNA, 15 bp, Homo sapiens
ccccaaccctgcccc

SEQ ID NO: 780856 - DNA, 16 bp, Homo sapiens
ccccaacgtcccctcc

SEQ ID NO: 780857 - DNA, 19 bp, Homo sapiens
ccccaacgtcccctccgcc

SEQ ID NO: 780858 - DNA, 15 bp, Homo sapiens
ccccaactccagggg

SEQ ID NO: 780859 - DNA, 14 bp, Homo sapiens
ccccaactccatgg

SEQ ID NO: 780860 - DNA, 19 bp, Homo sapiens
ccccaactccatggggttc

SEQ ID NO: 780861 - DNA, 17 bp, Homo sapiens
ccccaactctgagccca

SEQ ID NO: 780862 - DNA, 19 bp, Homo sapiens
ccccaactctgagcccatg

SEQ ID NO: 780863 - DNA, 17 bp, Homo sapiens
ccccaactcttcctccc

SEQ ID NO: 780864 - DNA, 20 bp, Homo sapiens
ccccaacttccctagtcccc

SEQ ID NO: 780865 - DNA, 22 bp, Homo sapiens
ccccaacttggcagctttttct

SEQ ID NO: 780866 - DNA, 23 bp, Homo sapiens
ccccaacttggcagctttttctg

SEQ ID NO: 780867 - DNA, 16 bp, Homo sapiens
cccccaaccccctgca

SEQ ID NO: 780868 - DNA, 22 bp, Homo sapiens
ccccctcaaaccctgccctcct

SEQ ID NO: 780869 - DNA, 21 bp, Homo sapiens
ccccctcaaggggcagggagg

SEQ ID NO: 780870 - DNA, 16 bp, Homo sapiens
ccccctcccaccccca

SEQ ID NO: 780871 - DNA, 12 bp, Homo sapiens
ccccctcccaga

SEQ ID NO: 780872 - DNA, 13 bp, Homo sapiens
ccccctccctgcc

SEQ ID NO: 780873 - DNA, 19 bp, Homo sapiens
ccccctccgccctgccact

SEQ ID NO: 780874 - DNA, 13 bp, Homo sapiens
ccccctcctcaga

SEQ ID NO: 780875 - DNA, 12 bp, Homo sapiens
ccccctcctcca

SEQ ID NO: 780876 - DNA, 14 bp, Homo sapiens
ccccctcctccagt

SEQ ID NO: 780877 - DNA, 18 bp, Homo sapiens
ccccctcctcccagggcc

SEQ ID NO: 780878 - DNA, 22 bp, Homo sapiens
ccccctcctctcccatccccct

SEQ ID NO: 780879 - DNA, 13 bp, Homo sapiens
cccgccccagagt

SEQ ID NO: 780880 - DNA, 12 bp, Homo sapiens
cccgccccaggc

SEQ ID NO: 780881 - DNA, 18 bp, Homo sapiens
cccgcccccaccgggctg

SEQ ID NO: 780882 - DNA, 20 bp, Homo sapiens
cccgccccccacacttccct

SEQ ID NO: 780883 - DNA, 23 bp, Homo sapiens
cccgccccccagagccagggctg

SEQ ID NO: 780884 - DNA, 13 bp, Homo sapiens
cccgccccgcccc

SEQ ID NO: 780885 - DNA, 17 bp, Homo sapiens
cccgccccgcccccgcc

SEQ ID NO: 780886 - DNA, 14 bp, Homo sapiens
cccgccccgggctg

SEQ ID NO: 780887 - DNA, 20 bp, Homo sapiens
cccgccccgggctggccctg

SEQ ID NO: 780888 - DNA, 23 bp, Homo sapiens
cccgccccgggctggccctgtgc

SEQ ID NO: 780889 - DNA, 20 bp, Homo sapiens
cccgccccgttgtgagctgg

SEQ ID NO: 780890 - DNA, 13 bp, Homo sapiens
cccgccctcacct

SEQ ID NO: 780891 - DNA, 17 bp, Homo sapiens
cccgccgccctggacag

SEQ ID NO: 780892 - DNA, 16 bp, Homo sapiens
cccgccgcctcccacg

SEQ ID NO: 780893 - DNA, 15 bp, Homo sapiens
cccgccgtctgcagg

SEQ ID NO: 780894 - DNA, 16 bp, Homo sapiens
cccgcctagctgctgt

SEQ ID NO: 780895 - DNA, 19 bp, Homo sapiens
cccgcctccactctagttc

SEQ ID NO: 780896 - DNA, 22 bp, Homo sapiens
cccgcctccactctagttctag

SEQ ID NO: 780897 - DNA, 12 bp, Homo sapiens
cccgcctcctcc

SEQ ID NO: 780898 - DNA, 21 bp, Homo sapiens
cccgcctctcccgtcagggcc

SEQ ID NO: 780899 - DNA, 12 bp, Homo sapiens
cccgcctgccac

SEQ ID NO: 780900 - DNA, 16 bp, Homo sapiens
cccgcctgcccagact

SEQ ID NO: 780901 - DNA, 12 bp, Homo sapiens
cccgcctgccct

SEQ ID NO: 780902 - DNA, 11 bp, Homo sapiens
cccgcctgcct

SEQ ID NO: 780903 - DNA, 17 bp, Homo sapiens
cccgcctggcagaactg

SEQ ID NO: 780904 - DNA, 22 bp, Homo sapiens
cccgcctggcagaactgagctc

SEQ ID NO: 780905 - DNA, 19 bp, Homo sapiens
cccgccttccctcactctt

SEQ ID NO: 780906 - DNA, 20 bp, Homo sapiens
cccgccttcctcctccacag

SEQ ID NO: 780907 - DNA, 22 bp, Homo sapiens
cccgccttcgtgtgctgctgct

SEQ ID NO: 780908 - DNA, 16 bp, Homo sapiens
cccgcgctcgcccagc

SEQ ID NO: 780909 - DNA, 22 bp, Homo sapiens
cccgcgcttcgaactccaggct

SEQ ID NO: 780910 - DNA, 13 bp, Homo sapiens
cccgcggcctgca

SEQ ID NO: 780911 - DNA, 13 bp, Homo sapiens
cccgcggcctgga

SEQ ID NO: 780912 - DNA, 20 bp, Homo sapiens
cccgcggcgcgaccctcccc

SEQ ID NO: 780913 - DNA, 21 bp, Homo sapiens
cccgcgggagacagcttctct

SEQ ID NO: 780914 - DNA, 15 bp, Homo sapiens
cccgcgggcacagcc

SEQ ID NO: 780915 - DNA, 17 bp, Homo sapiens
cccgcgggttctagacg

SEQ ID NO: 780916 - DNA, 20 bp, Homo sapiens
cccgcggtgctctggcggct

SEQ ID NO: 780917 - DNA, 21 bp, Homo sapiens
cccgcgtccaaccccggggca

SEQ ID NO: 780918 - DNA, 14 bp, Homo sapiens
cccgcgttcaagac

SEQ ID NO: 780919 - DNA, 17 bp, Homo sapiens
cccgcgttcaagacttg

SEQ ID NO: 780920 - DNA, 20 bp, Homo sapiens
cccgctatgatggaagtgtt

SEQ ID NO: 780921 - DNA, 15 bp, Homo sapiens
cccgctcagccctcc

SEQ ID NO: 780922 - DNA, 12 bp, Homo sapiens
cccgctcaggcc

SEQ ID NO: 780923 - DNA, 12 bp, Homo sapiens
cccgctcccaca

SEQ ID NO: 780924 - DNA, 21 bp, Homo sapiens
cccgctccgtctctgtcctcg

SEQ ID NO: 780925 - DNA, 16 bp, Homo sapiens
cccgctctctggctgt

SEQ ID NO: 780926 - DNA, 12 bp, Homo sapiens
cccgctctggac

SEQ ID NO: 780927 - DNA, 14 bp, Homo sapiens
cccgctctggacca

SEQ ID NO: 780928 - DNA, 12 bp, Homo sapiens
cccgctgcacac

SEQ ID NO: 780929 - DNA, 19 bp, Homo sapiens
cccgctgcacacagacggc

SEQ ID NO: 780930 - DNA, 19 bp, Homo sapiens
cccgctgcagcctctgcct

SEQ ID NO: 780931 - DNA, 14 bp, Homo sapiens
cccgctgcctcttg

SEQ ID NO: 780932 - DNA, 11 bp, Homo sapiens
cccgctgctgt

SEQ ID NO: 780933 - DNA, 22 bp, Homo sapiens
cccgctggagcccacagcgagc

SEQ ID NO: 780934 - DNA, 23 bp, Homo sapiens
cccgctggaggatgtgggcagct

SEQ ID NO: 780935 - DNA, 12 bp, Homo sapiens
cccgctggctca

SEQ ID NO: 780936 - DNA, 12 bp, Homo sapiens
cccgctgggctg

SEQ ID NO: 780937 - DNA, 15 bp, Homo sapiens
cccgctgtggccgca

SEQ ID NO: 780938 - DNA, 16 bp, Homo sapiens
cccgcttagccccgct

SEQ ID NO: 780939 - DNA, 18 bp, Homo sapiens
cccgcttagcctgcctca

SEQ ID NO: 780940 - DNA, 17 bp, Homo sapiens
cccgcttagcgctctgg

SEQ ID NO: 780941 - DNA, 21 bp, Homo sapiens
cccgcttagcgctctggacag

SEQ ID NO: 780942 - DNA, 16 bp, Homo sapiens
cccgcttcaagctctc

SEQ ID NO: 780943 - DNA, 14 bp, Homo sapiens
cccgcttgtccagc

SEQ ID NO: 780944 - DNA, 19 bp, Homo sapiens
cccggacaggtggggcctc

SEQ ID NO: 780945 - DNA, 15 bp, Homo sapiens
cccggacctacctcc

SEQ ID NO: 780946 - DNA, 21 bp, Homo sapiens
cccggactcaccaacttgcca

SEQ ID NO: 780947 - DNA, 15 bp, Homo sapiens
cccggagcacagccc

SEQ ID NO: 780948 - DNA, 16 bp, Homo sapiens
cccggagcacagccct

SEQ ID NO: 780949 - DNA, 18 bp, Homo sapiens
cccggagcacagccctgg

SEQ ID NO: 780950 - DNA, 20 bp, Homo sapiens
cccggagcacagccctggga

SEQ ID NO: 780951 - DNA, 13 bp, Homo sapiens
cccggagcagcag

SEQ ID NO: 780952 - DNA, 20 bp, Homo sapiens
cccggaggaaatctgcagag

SEQ ID NO: 780953 - DNA, 23 bp, Homo sapiens
cccggaggcgtggaggagaggag

SEQ ID NO: 780954 - DNA, 18 bp, Homo sapiens
cccggaggggcctggcag

SEQ ID NO: 780955 - DNA, 18 bp, Homo sapiens
cccggaggttgggtgggc

SEQ ID NO: 780956 - DNA, 14 bp, Homo sapiens
cccggattctggga

SEQ ID NO: 780957 - DNA, 16 bp, Homo sapiens
cccggattctgggagg

SEQ ID NO: 780958 - DNA, 15 bp, Homo sapiens
cccggcaggcctgag

SEQ ID NO: 780959 - DNA, 18 bp, Homo sapiens
cccggcaggcctgagaat

SEQ ID NO: 780960 - DNA, 21 bp, Homo sapiens
cccggcagggcgggcagaggg

SEQ ID NO: 780961 - DNA, 16 bp, Homo sapiens
cccggcagggtcctag

SEQ ID NO: 780962 - DNA, 17 bp, Homo sapiens
cccggcatgggaaagcc

SEQ ID NO: 780963 - DNA, 11 bp, Homo sapiens
cccggccagcc

SEQ ID NO: 780964 - DNA, 21 bp, Homo sapiens
cccggcccaacccagcccagc

SEQ ID NO: 780965 - DNA, 22 bp, Homo sapiens
cccggcccagagaccccttcct

SEQ ID NO: 780966 - DNA, 21 bp, Homo sapiens
cccggccccaccccctgggca

SEQ ID NO: 780967 - DNA, 14 bp, Homo sapiens
cccggccccagcca

SEQ ID NO: 780968 - DNA, 20 bp, Homo sapiens
cccggcccctcaccctctgt

SEQ ID NO: 780969 - DNA, 17 bp, Homo sapiens
cccggccctcccccagc

SEQ ID NO: 780970 - DNA, 20 bp, Homo sapiens
cccggccctcccccagctcc

SEQ ID NO: 780971 - DNA, 19 bp, Homo sapiens
cccggcctcttccacccat

SEQ ID NO: 780972 - DNA, 21 bp, Homo sapiens
cccggcctgctcccagcagcc

SEQ ID NO: 780973 - DNA, 22 bp, Homo sapiens
cccggcgaggccggagagctgg

SEQ ID NO: 780974 - DNA, 14 bp, Homo sapiens
cccggcgccgggca

SEQ ID NO: 780975 - DNA, 15 bp, Homo sapiens
cccggcgccgggcac

SEQ ID NO: 780976 - DNA, 16 bp, Homo sapiens
cccggcgccgggcacc

SEQ ID NO: 780977 - DNA, 20 bp, Homo sapiens
cccggcgcctgccctgccca

SEQ ID NO: 780978 - DNA, 22 bp, Homo sapiens
cccggcgcggtggctcacgcct

SEQ ID NO: 780979 - DNA, 21 bp, Homo sapiens
cccggcggtgccgcgctccga

SEQ ID NO: 780980 - DNA, 17 bp, Homo sapiens
cccggctaatttttgta

SEQ ID NO: 780981 - DNA, 22 bp, Homo sapiens
cccggctcgagcagtcctgcct

SEQ ID NO: 780982 - DNA, 17 bp, Homo sapiens
cccggctggttttgtaa

SEQ ID NO: 780983 - DNA, 16 bp, Homo sapiens
cccgggacaccgtggg

SEQ ID NO: 780984 - DNA, 16 bp, Homo sapiens
cccgggagcctaggac

SEQ ID NO: 780985 - DNA, 19 bp, Homo sapiens
cccgggagcctaggaccac

SEQ ID NO: 780986 - DNA, 13 bp, Homo sapiens
cccgggatgcacc

SEQ ID NO: 780987 - DNA, 13 bp, Homo sapiens
cccgggcaggcca

SEQ ID NO: 780988 - DNA, 15 bp, Homo sapiens
cccgggcaggccagc

SEQ ID NO: 780989 - DNA, 22 bp, Homo sapiens
cccgggccacgccccagcccga

SEQ ID NO: 780990 - DNA, 14 bp, Homo sapiens
cccgggccagggct

SEQ ID NO: 780991 - DNA, 15 bp, Homo sapiens
cccgggcccccgccc

SEQ ID NO: 780992 - DNA, 18 bp, Homo sapiens
cccgggcccccgccccgc

SEQ ID NO: 780993 - DNA, 18 bp, Homo sapiens
cccgggccctcccttgga

SEQ ID NO: 780994 - DNA, 21 bp, Homo sapiens
cccgggccgaccctgcggcct

SEQ ID NO: 780995 - DNA, 14 bp, Homo sapiens
cccgggcctgcaca

SEQ ID NO: 780996 - DNA, 15 bp, Homo sapiens
cccgggcctgcacag

SEQ ID NO: 780997 - DNA, 16 bp, Homo sapiens
cccgggctctctgctg

SEQ ID NO: 780998 - DNA, 16 bp, Homo sapiens
cccgggctctggccac

SEQ ID NO: 780999 - DNA, 15 bp, Homo sapiens
cccgggctgcctggg

SEQ ID NO: 781000 - DNA, 16 bp, Homo sapiens
cccgggctgcctgggc

SEQ ID NO: 781001 - DNA, 15 bp, Homo sapiens
cccggggaccctgtg

SEQ ID NO: 781002 - DNA, 18 bp, Homo sapiens
cccggggaccctgtgaca

SEQ ID NO: 781003 - DNA, 12 bp, Homo sapiens
cccggggcagct

SEQ ID NO: 781004 - DNA, 20 bp, Homo sapiens
cccggggcatggacagggcc

SEQ ID NO: 781005 - DNA, 17 bp, Homo sapiens
cccggggccagagacat

SEQ ID NO: 781006 - DNA, 14 bp, Homo sapiens
cccggggcccagga

SEQ ID NO: 781007 - DNA, 16 bp, Homo sapiens
cccggggcccaggact

SEQ ID NO: 781008 - DNA, 16 bp, Homo sapiens
cccggggctggcaagc

SEQ ID NO: 781009 - DNA, 23 bp, Homo sapiens
cccggggctggcaagcagggaaa

SEQ ID NO: 781010 - DNA, 21 bp, Homo sapiens
cccgggggacgcctgccctgc

SEQ ID NO: 781011 - DNA, 21 bp, Homo sapiens
cccggggtgcccacaggccgc

SEQ ID NO: 781012 - DNA, 19 bp, Homo sapiens
cccgggtgcctcagagcag

SEQ ID NO: 781013 - DNA, 18 bp, Homo sapiens
cccgggtgtgcctgccct

SEQ ID NO: 781014 - DNA, 20 bp, Homo sapiens
cccgggtttggcgggccaag

SEQ ID NO: 781015 - DNA, 22 bp, Homo sapiens
cccgggtttggctgagcctggc

SEQ ID NO: 781016 - DNA, 22 bp, Homo sapiens
cccggtctatgtcgagagctgg

SEQ ID NO: 781017 - DNA, 18 bp, Homo sapiens
cccggtgcccaagaatag

SEQ ID NO: 781018 - DNA, 23 bp, Homo sapiens
cccggtgtatcctggccctgggg

SEQ ID NO: 781019 - DNA, 17 bp, Homo sapiens
cccggttcaccttgccg

SEQ ID NO: 781020 - DNA, 15 bp, Homo sapiens
cccggttcttccagt

SEQ ID NO: 781021 - DNA, 14 bp, Homo sapiens
cccgtaatgcttag

SEQ ID NO: 781022 - DNA, 14 bp, Homo sapiens
cccgtacctcttcc

SEQ ID NO: 781023 - DNA, 22 bp, Homo sapiens
cccgtactttgtcccgtggcat

SEQ ID NO: 781024 - DNA, 14 bp, Homo sapiens
cccgtagagaatgt

SEQ ID NO: 781025 - DNA, 15 bp, Homo sapiens
cccgtagtctcctgg

SEQ ID NO: 781026 - DNA, 17 bp, Homo sapiens
cccgtagtctcctgggt

SEQ ID NO: 781027 - DNA, 12 bp, Homo sapiens
cccgtcagctgc

SEQ ID NO: 781028 - DNA, 22 bp, Homo sapiens
cccgtcagctgcttctgctgcc

SEQ ID NO: 781029 - DNA, 19 bp, Homo sapiens
cccgtcaggacgttgagga

SEQ ID NO: 781030 - DNA, 17 bp, Homo sapiens
cccgtcagggcccaagt

SEQ ID NO: 781031 - DNA, 18 bp, Homo sapiens
cccgtcatgttcctcaaa

SEQ ID NO: 781032 - DNA, 16 bp, Homo sapiens
cccgtcccctgcagcc

SEQ ID NO: 781033 - DNA, 13 bp, Homo sapiens
cccgtcctgcctg

SEQ ID NO: 781034 - DNA, 16 bp, Homo sapiens
cccgtcggaatggtaa

SEQ ID NO: 781035 - DNA, 12 bp, Homo sapiens
cccgtcggagct

SEQ ID NO: 781036 - DNA, 17 bp, Homo sapiens
cccgtcggagctgcctg

SEQ ID NO: 781037 - DNA, 20 bp, Homo sapiens
cccgtcggagctgcctgcag

SEQ ID NO: 781038 - DNA, 17 bp, Homo sapiens
cccgtcggccctgcgtc

SEQ ID NO: 781039 - DNA, 13 bp, Homo sapiens
cccgtcgtgtgct

SEQ ID NO: 781040 - DNA, 20 bp, Homo sapiens
cccgtcgtgtgctgaagaca

SEQ ID NO: 781041 - DNA, 12 bp, Homo sapiens
cccgtctcagtg

SEQ ID NO: 781042 - DNA, 13 bp, Homo sapiens
cccgtctcagtgt

SEQ ID NO: 781043 - DNA, 13 bp, Homo sapiens
cccgtcttcagcc

SEQ ID NO: 781044 - DNA, 20 bp, Homo sapiens
cccgtgaaagaattattttt

SEQ ID NO: 781045 - DNA, 18 bp, Homo sapiens
cccgtgaagcagtgcctc

SEQ ID NO: 781046 - DNA, 22 bp, Homo sapiens
cccgtgacagactcctgaggac

SEQ ID NO: 781047 - DNA, 17 bp, Homo sapiens
cccgtgcagtacaggca

SEQ ID NO: 781048 - DNA, 17 bp, Homo sapiens
cccgtgcccctttcctt

SEQ ID NO: 781049 - DNA, 15 bp, Homo sapiens
cccgtgcctgggccc

SEQ ID NO: 781050 - DNA, 20 bp, Homo sapiens
cccgtgcctgggcccctccc

SEQ ID NO: 781051 - DNA, 11 bp, Homo sapiens
cccgtggcctg

SEQ ID NO: 781052 - DNA, 15 bp, Homo sapiens
cccgtggcctggcat

SEQ ID NO: 781053 - DNA, 19 bp, Homo sapiens
cccgtggcctggcatctgt

SEQ ID NO: 781054 - DNA, 20 bp, Homo sapiens
cccgtggcctggcatctgtg

SEQ ID NO: 781055 - DNA, 23 bp, Homo sapiens
cccgtgggcgcaaaggtgcctca

SEQ ID NO: 781056 - DNA, 21 bp, Homo sapiens
cccgtggtggcggtggctgcc

SEQ ID NO: 781057 - DNA, 14 bp, Homo sapiens
cccgtgtggcccct

SEQ ID NO: 781058 - DNA, 18 bp, Homo sapiens
cccgtgtggccccttcac

SEQ ID NO: 781059 - DNA, 22 bp, Homo sapiens
cccgtgtggccccttcacttct

SEQ ID NO: 781060 - DNA, 17 bp, Homo sapiens
cccgtgtgtatttctaa

SEQ ID NO: 781061 - DNA, 20 bp, Homo sapiens
cccgttccctgtcagaggct

SEQ ID NO: 781062 - DNA, 23 bp, Homo sapiens
cccgtttcagaaggaccaattga

SEQ ID NO: 781063 - DNA, 22 bp, Homo sapiens
cccgtttcccggttcaggacca

SEQ ID NO: 781064 - DNA, 22 bp, Homo sapiens
cccgttttaccaataaactgag

SEQ ID NO: 781065 - DNA, 19 bp, Homo sapiens
cccgttttatgatttactc

SEQ ID NO: 781066 - DNA, 20 bp, Homo sapiens
ccctaaaatggcgaacatgt

SEQ ID NO: 781067 - DNA, 22 bp, Homo sapiens
ccctaaaatggcgaacatgtgt

SEQ ID NO: 781068 - DNA, 22 bp, Homo sapiens
ccctaaactgcagcctctctgg

SEQ ID NO: 781069 - DNA, 21 bp, Homo sapiens
ccctaaagcaaatctgccacc

SEQ ID NO: 781070 - DNA, 17 bp, Homo sapiens
ccctaaagtgtattttt

SEQ ID NO: 781071 - DNA, 21 bp, Homo sapiens
ccctaacccccagtcctcact

SEQ ID NO: 781072 - DNA, 14 bp, Homo sapiens
ccctaactgcagac

SEQ ID NO: 781073 - DNA, 15 bp, Homo sapiens
ccctaagactgcctt

SEQ ID NO: 781074 - DNA, 16 bp, Homo sapiens
ccctaagactgccttc

SEQ ID NO: 781075 - DNA, 17 bp, Homo sapiens
ccctaagcctgtcccca

SEQ ID NO: 781076 - DNA, 21 bp, Homo sapiens
ccctaagcctgtccccagacc

SEQ ID NO: 781077 - DNA, 13 bp, Homo sapiens
ccctaagggcagc

SEQ ID NO: 781078 - DNA, 15 bp, Homo sapiens
ccctaagggcagccc

SEQ ID NO: 781079 - DNA, 14 bp, Homo sapiens
ccctaattttgtac

SEQ ID NO: 781080 - DNA, 18 bp, Homo sapiens
ccctacacccctcccctg

SEQ ID NO: 781081 - DNA, 20 bp, Homo sapiens
ccctacagttgaaaaacagc

SEQ ID NO: 781082 - DNA, 13 bp, Homo sapiens
ccctaccactgtg

SEQ ID NO: 781083 - DNA, 22 bp, Homo sapiens
ccctaccagcgcccgctgggct

SEQ ID NO: 781084 - DNA, 14 bp, Homo sapiens
ccctaccagctcct

SEQ ID NO: 781085 - DNA, 17 bp, Homo sapiens
ccctaccagctcctcca

SEQ ID NO: 781086 - DNA, 20 bp, Homo sapiens
ccctaccagctcctccagcc

SEQ ID NO: 781087 - DNA, 21 bp, Homo sapiens
ccctaccagctcctccagccc

SEQ ID NO: 781088 - DNA, 12 bp, Homo sapiens
ccctacccaccg

SEQ ID NO: 781089 - DNA, 23 bp, Homo sapiens
ccctacccatatccctcccgtgt

SEQ ID NO: 781090 - DNA, 21 bp, Homo sapiens
ccctaccccacaccaggccgt

SEQ ID NO: 781091 - DNA, 12 bp, Homo sapiens
ccctaccccctc

SEQ ID NO: 781092 - DNA, 18 bp, Homo sapiens
ccctaccccctcatcccc

SEQ ID NO: 781093 - DNA, 21 bp, Homo sapiens
ccctaccccctcatcccccag

SEQ ID NO: 781094 - DNA, 18 bp, Homo sapiens
ccctaccgagtctcttct

SEQ ID NO: 781095 - DNA, 16 bp, Homo sapiens
ccctacctcaggcagg

SEQ ID NO: 781096 - DNA, 17 bp, Homo sapiens
ccctacctccctcctca

SEQ ID NO: 781097 - DNA, 20 bp, Homo sapiens
ccctacctccctcctcaggg

SEQ ID NO: 781098 - DNA, 22 bp, Homo sapiens
ccctacctgattggtgcaaccc

SEQ ID NO: 781099 - DNA, 14 bp, Homo sapiens
ccctacctgtgcct

SEQ ID NO: 781100 - DNA, 19 bp, Homo sapiens
ccctacctgttcagtgtcc

SEQ ID NO: 781101 - DNA, 20 bp, Homo sapiens
ccctactacccattgttccc

SEQ ID NO: 781102 - DNA, 16 bp, Homo sapiens
ccctactcccctgggc

SEQ ID NO: 781103 - DNA, 17 bp, Homo sapiens
ccctactgctgtgaacc

SEQ ID NO: 781104 - DNA, 15 bp, Homo sapiens
ccctactgtggggag

SEQ ID NO: 781105 - DNA, 16 bp, Homo sapiens
ccctacttccaggatg

SEQ ID NO: 781106 - DNA, 13 bp, Homo sapiens
ccctacttgcagc

SEQ ID NO: 781107 - DNA, 17 bp, Homo sapiens
ccctagaaacttccaaa

SEQ ID NO: 781108 - DNA, 19 bp, Homo sapiens
ccctagaaaggagagaacg

SEQ ID NO: 781109 - DNA, 17 bp, Homo sapiens
ccctagaagaaaacccg

SEQ ID NO: 781110 - DNA, 13 bp, Homo sapiens
ccctagaagagca

SEQ ID NO: 781111 - DNA, 14 bp, Homo sapiens
ccctagaagagcac

SEQ ID NO: 781112 - DNA, 19 bp, Homo sapiens
ccctagaatcagcctaggg

SEQ ID NO: 781113 - DNA, 19 bp, Homo sapiens
ccctagacctccccctcac

SEQ ID NO: 781114 - DNA, 14 bp, Homo sapiens
ccctagcaaaactc

SEQ ID NO: 781115 - DNA, 20 bp, Homo sapiens
ccctagccaatgtctcctcc

SEQ ID NO: 781116 - DNA, 19 bp, Homo sapiens
ccctagccagagaatagat

SEQ ID NO: 781117 - DNA, 14 bp, Homo sapiens
ccctagcccagact

SEQ ID NO: 781118 - DNA, 17 bp, Homo sapiens
ccctagcccagactctg

SEQ ID NO: 781119 - DNA, 21 bp, Homo sapiens
ccctagcccagactctgagct

SEQ ID NO: 781120 - DNA, 15 bp, Homo sapiens
ccctagcccttccag

SEQ ID NO: 781121 - DNA, 20 bp, Homo sapiens
ccctagcggcagaaaggaaa

SEQ ID NO: 781122 - DNA, 14 bp, Homo sapiens
ccctagctgtccca

SEQ ID NO: 781123 - DNA, 19 bp, Homo sapiens
ccctagctttagaccctgg

SEQ ID NO: 781124 - DNA, 20 bp, Homo sapiens
ccctaggatgctgcagcaga

SEQ ID NO: 781125 - DNA, 16 bp, Homo sapiens
ccctaggctttctcct

SEQ ID NO: 781126 - DNA, 17 bp, Homo sapiens
ccctaggggacacttcc

SEQ ID NO: 781127 - DNA, 19 bp, Homo sapiens
ccctaggggacacttccct

SEQ ID NO: 781128 - DNA, 19 bp, Homo sapiens
ccccgggtttggcgggcca

SEQ ID NO: 781129 - DNA, 16 bp, Homo sapiens
ccccggtcccttgaga

SEQ ID NO: 781130 - DNA, 16 bp, Homo sapiens
ccccgtcccctgcagc

SEQ ID NO: 781131 - DNA, 14 bp, Homo sapiens
ccccgtcggaatgg

SEQ ID NO: 781132 - DNA, 22 bp, Homo sapiens
ccccgtctggggttcagcccct

SEQ ID NO: 781133 - DNA, 12 bp, Homo sapiens
ccccgtgcccct

SEQ ID NO: 781134 - DNA, 19 bp, Homo sapiens
ccccgtggctctgggagag

SEQ ID NO: 781135 - DNA, 22 bp, Homo sapiens
ccccgtgtgaatgtagcttcca

SEQ ID NO: 781136 - DNA, 21 bp, Homo sapiens
ccccgttccctgtcagaggct

SEQ ID NO: 781137 - DNA, 18 bp, Homo sapiens
cccctaacccccagtcct

SEQ ID NO: 781138 - DNA, 19 bp, Homo sapiens
cccctaacccccagtcctc

SEQ ID NO: 781139 - DNA, 16 bp, Homo sapiens
cccctaagccccgtcc

SEQ ID NO: 781140 - DNA, 21 bp, Homo sapiens
cccctaagctggctgtacctg

SEQ ID NO: 781141 - DNA, 21 bp, Homo sapiens
cccctaagtggattggctttg

SEQ ID NO: 781142 - DNA, 22 bp, Homo sapiens
cccctaccccacaccaggccgt

SEQ ID NO: 781143 - DNA, 15 bp, Homo sapiens
cccctaccccctcat

SEQ ID NO: 781144 - DNA, 17 bp, Homo sapiens
ccctcccatcctccagc

SEQ ID NO: 781145 - DNA, 19 bp, Homo sapiens
ccctcccatcctccagccc

SEQ ID NO: 781146 - DNA, 14 bp, Homo sapiens
ccctcccatctggg

SEQ ID NO: 781147 - DNA, 10 bp, Homo sapiens
ccctccccac

SEQ ID NO: 781148 - DNA, 19 bp, Homo sapiens
ccctccccacacctcccta

SEQ ID NO: 781149 - DNA, 12 bp, Homo sapiens
ccctccccaccc

SEQ ID NO: 781150 - DNA, 14 bp, Homo sapiens
ccctccccacccaa

SEQ ID NO: 781151 - DNA, 11 bp, Homo sapiens
ccctccccaga

SEQ ID NO: 781152 - DNA, 15 bp, Homo sapiens
ccctccccagagcac

SEQ ID NO: 781153 - DNA, 14 bp, Homo sapiens
ccctccccagccag

SEQ ID NO: 781154 - DNA, 16 bp, Homo sapiens
ccctccccatcccatg

SEQ ID NO: 781155 - DNA, 23 bp, Homo sapiens
ccctccccatctcggggctgctg

SEQ ID NO: 781156 - DNA, 22 bp, Homo sapiens
ccctccccatgcaggtggtgtc

SEQ ID NO: 781157 - DNA, 15 bp, Homo sapiens
ccctcccccagcaga

SEQ ID NO: 781158 - DNA, 13 bp, Homo sapiens
ccctcccccagct

SEQ ID NO: 781159 - DNA, 15 bp, Homo sapiens
ccctcccccagctcc

SEQ ID NO: 781160 - DNA, 17 bp, Homo sapiens
ccctcccccagctcctt

SEQ ID NO: 781161 - DNA, 12 bp, Homo sapiens
ccctcccccagg

SEQ ID NO: 781162 - DNA, 17 bp, Homo sapiens
ccctccccccagactct

SEQ ID NO: 781163 - DNA, 21 bp, Homo sapiens
ccctcccccgccactcctgaa

SEQ ID NO: 781164 - DNA, 13 bp, Homo sapiens
ccctccccctcct

SEQ ID NO: 781165 - DNA, 15 bp, Homo sapiens
ccctcccccttcccc

SEQ ID NO: 781166 - DNA, 17 bp, Homo sapiens
ccctccccgcacccccc

SEQ ID NO: 781167 - DNA, 15 bp, Homo sapiens
ccctccccgcccctg

SEQ ID NO: 781168 - DNA, 20 bp, Homo sapiens
ccctccccgcgcgttccttc

SEQ ID NO: 781169 - DNA, 16 bp, Homo sapiens
ccctccccgctgccct

SEQ ID NO: 781170 - DNA, 22 bp, Homo sapiens
ccctccccggccctaccagcgc

SEQ ID NO: 781171 - DNA, 15 bp, Homo sapiens
ccctcccctcagcct

SEQ ID NO: 781172 - DNA, 17 bp, Homo sapiens
ccctcccctcagcctgc

SEQ ID NO: 781173 - DNA, 15 bp, Homo sapiens
ccctcccctcagcgc

SEQ ID NO: 781174 - DNA, 18 bp, Homo sapiens
ccctcccctcccagtcct

SEQ ID NO: 781175 - DNA, 18 bp, Homo sapiens
ccctcccgcaccttcctc

SEQ ID NO: 781176 - DNA, 14 bp, Homo sapiens
ccctccctagccct

SEQ ID NO: 781177 - DNA, 16 bp, Homo sapiens
ccctccctagcccttc

SEQ ID NO: 781178 - DNA, 19 bp, Homo sapiens
ccctccctagcccttccag

SEQ ID NO: 781179 - DNA, 21 bp, Homo sapiens
ccctccctatatgcacccctg

SEQ ID NO: 781180 - DNA, 13 bp, Homo sapiens
ccctccctcagcc

SEQ ID NO: 781181 - DNA, 23 bp, Homo sapiens
ccctccctcagccgtcagccatc

SEQ ID NO: 781182 - DNA, 16 bp, Homo sapiens
ccctccctcagggagc

SEQ ID NO: 781183 - DNA, 14 bp, Homo sapiens
ccctccctccctag

SEQ ID NO: 781184 - DNA, 15 bp, Homo sapiens
ccctccctccctctt

SEQ ID NO: 781185 - DNA, 14 bp, Homo sapiens
ccctccctcgtggg

SEQ ID NO: 781186 - DNA, 16 bp, Homo sapiens
ccctccctcgtgggct

SEQ ID NO: 781187 - DNA, 14 bp, Homo sapiens
ccctccctctccgc

SEQ ID NO: 781188 - DNA, 13 bp, Homo sapiens
ccctccctgactc

SEQ ID NO: 781189 - DNA, 23 bp, Homo sapiens
ccctccctgcccaaactcccctt

SEQ ID NO: 781190 - DNA, 16 bp, Homo sapiens
ccctccctgcctgctc

SEQ ID NO: 781191 - DNA, 15 bp, Homo sapiens
ccctccctggcctgt

SEQ ID NO: 781192 - DNA, 14 bp, Homo sapiens
ccctccctggctcc

SEQ ID NO: 781193 - DNA, 19 bp, Homo sapiens
ccctccctggctcccatga

SEQ ID NO: 781194 - DNA, 13 bp, Homo sapiens
ccctccctgggtt

SEQ ID NO: 781195 - DNA, 11 bp, Homo sapiens
ccctccctgtc

SEQ ID NO: 781196 - DNA, 14 bp, Homo sapiens
ccctccctgtccca

SEQ ID NO: 781197 - DNA, 18 bp, Homo sapiens
ccctccctgtctccaggg

SEQ ID NO: 781198 - DNA, 23 bp, Homo sapiens
ccctcccttggaaacctgccctg

SEQ ID NO: 781199 - DNA, 16 bp, Homo sapiens
ccctccgactccagat

SEQ ID NO: 781200 - DNA, 15 bp, Homo sapiens
ccctccgccctgcca

SEQ ID NO: 781201 - DNA, 16 bp, Homo sapiens
ccctccgccctgccac

SEQ ID NO: 781202 - DNA, 16 bp, Homo sapiens
ccctccgcctccagga

SEQ ID NO: 781203 - DNA, 15 bp, Homo sapiens
ccctccgcctgggat

SEQ ID NO: 781204 - DNA, 13 bp, Homo sapiens
ccctccgccttca

SEQ ID NO: 781205 - DNA, 21 bp, Homo sapiens
ccctccgccttcactccggtg

SEQ ID NO: 781206 - DNA, 14 bp, Homo sapiens
ccctccgggcaggg

SEQ ID NO: 781207 - DNA, 19 bp, Homo sapiens
ccctcctagctctcccagt

SEQ ID NO: 781208 - DNA, 21 bp, Homo sapiens
ccctcctcacagttgccatgt

SEQ ID NO: 781209 - DNA, 17 bp, Homo sapiens
ccctcctcacctctgga

SEQ ID NO: 781210 - DNA, 18 bp, Homo sapiens
ccctcctcacctctggac

SEQ ID NO: 781211 - DNA, 12 bp, Homo sapiens
ccctcctcaggg

SEQ ID NO: 781212 - DNA, 19 bp, Homo sapiens
ccctcctccagcccctgtc

SEQ ID NO: 781213 - DNA, 20 bp, Homo sapiens
ccctcctcccagggcctcct

SEQ ID NO: 781214 - DNA, 16 bp, Homo sapiens
ccctcctcccccagtg

SEQ ID NO: 781215 - DNA, 13 bp, Homo sapiens
ccctcctccccct

SEQ ID NO: 781216 - DNA, 18 bp, Homo sapiens
ccctcctccccctttggg

SEQ ID NO: 781217 - DNA, 11 bp, Homo sapiens
ccctcctcctt

SEQ ID NO: 781218 - DNA, 12 bp, Homo sapiens
ccctcctccttt

SEQ ID NO: 781219 - DNA, 19 bp, Homo sapiens
ccctcctctagccatccct

SEQ ID NO: 781220 - DNA, 20 bp, Homo sapiens
ccctcctctagccatccctt

SEQ ID NO: 781221 - DNA, 19 bp, Homo sapiens
ccctcctctagctgtgggg

SEQ ID NO: 781222 - DNA, 14 bp, Homo sapiens
ccctcctctccctg

SEQ ID NO: 781223 - DNA, 14 bp, Homo sapiens
ccctcctctctgcc

SEQ ID NO: 781224 - DNA, 18 bp, Homo sapiens
ccctctggaatcttcccc

SEQ ID NO: 781225 - DNA, 21 bp, Homo sapiens
ccctctggagtggccactaag

SEQ ID NO: 781226 - DNA, 16 bp, Homo sapiens
ccctctggattccctt

SEQ ID NO: 781227 - DNA, 18 bp, Homo sapiens
ccctctggccaggatgga

SEQ ID NO: 781228 - DNA, 12 bp, Homo sapiens
ccctctggcttc

SEQ ID NO: 781229 - DNA, 13 bp, Homo sapiens
ccctctggcttcc

SEQ ID NO: 781230 - DNA, 16 bp, Homo sapiens
ccctctgggaacctcc

SEQ ID NO: 781231 - DNA, 23 bp, Homo sapiens
ccctctgggcacgcctgctggcc

SEQ ID NO: 781232 - DNA, 22 bp, Homo sapiens
ccctctggtcgctcctgcccac

SEQ ID NO: 781233 - DNA, 12 bp, Homo sapiens
ccctctggtgtg

SEQ ID NO: 781234 - DNA, 22 bp, Homo sapiens
ccctctgtcatcactccctgga

SEQ ID NO: 781235 - DNA, 23 bp, Homo sapiens
ccctctgtcatcactccctggat

SEQ ID NO: 781236 - DNA, 15 bp, Homo sapiens
ccctctgtcatcctc

SEQ ID NO: 781237 - DNA, 17 bp, Homo sapiens
ccctctgtccccacgag

SEQ ID NO: 781238 - DNA, 15 bp, Homo sapiens
ccctctgtccccagg

SEQ ID NO: 781239 - DNA, 16 bp, Homo sapiens
ccctctgtccccaggc

SEQ ID NO: 781240 - DNA, 17 bp, Homo sapiens
ccctctgtctgtcttct

SEQ ID NO: 781241 - DNA, 20 bp, Homo sapiens
ccctctgtcttttctcctcc

SEQ ID NO: 781242 - DNA, 12 bp, Homo sapiens
ccctctgttagg

SEQ ID NO: 781243 - DNA, 18 bp, Homo sapiens
ccctctgttctctcccct

SEQ ID NO: 781244 - DNA, 20 bp, Homo sapiens
ccctctgttctgcacacagc

SEQ ID NO: 781245 - DNA, 11 bp, Homo sapiens
ccctcttccct

SEQ ID NO: 781246 - DNA, 11 bp, Homo sapiens
ccctcttcctc

SEQ ID NO: 781247 - DNA, 12 bp, Homo sapiens
ccctcttcctga

SEQ ID NO: 781248 - DNA, 14 bp, Homo sapiens
ccctcttcctgtga

SEQ ID NO: 781249 - DNA, 12 bp, Homo sapiens
ccctcttccttc

SEQ ID NO: 781250 - DNA, 17 bp, Homo sapiens
ccctcttccttccccca

SEQ ID NO: 781251 - DNA, 20 bp, Homo sapiens
ccctcttctcaagtgcctta

SEQ ID NO: 781252 - DNA, 13 bp, Homo sapiens
ccctcttctctcc

SEQ ID NO: 781253 - DNA, 13 bp, Homo sapiens
ccctcttctgccc

SEQ ID NO: 781254 - DNA, 22 bp, Homo sapiens
ccctcttgacccatctccccct

SEQ ID NO: 781255 - DNA, 19 bp, Homo sapiens
ccctcttgccagcctcctt

SEQ ID NO: 781256 - DNA, 13 bp, Homo sapiens
ccctcttgccatc

SEQ ID NO: 781257 - DNA, 17 bp, Homo sapiens
ccctcttgcccatcctg

SEQ ID NO: 781258 - DNA, 22 bp, Homo sapiens
ccctcttgccccccaccccagc

SEQ ID NO: 781259 - DNA, 21 bp, Homo sapiens
ccctcttgcccgcacccctcc

SEQ ID NO: 781260 - DNA, 15 bp, Homo sapiens
ccctcttgcgggcct

SEQ ID NO: 781261 - DNA, 17 bp, Homo sapiens
ccctcttgcgggcctgg

SEQ ID NO: 781262 - DNA, 15 bp, Homo sapiens
ccctcttggagaagt

SEQ ID NO: 781263 - DNA, 20 bp, Homo sapiens
ccctcttgtccctttcccta

SEQ ID NO: 781264 - DNA, 21 bp, Homo sapiens
ccctcttgtccctttccctac

SEQ ID NO: 781265 - DNA, 16 bp, Homo sapiens
ccctcttgtctcccct

SEQ ID NO: 781266 - DNA, 17 bp, Homo sapiens
ccctctttaatgctgtc

SEQ ID NO: 781267 - DNA, 19 bp, Homo sapiens
ccctctttaatgctgtctt

SEQ ID NO: 781268 - DNA, 22 bp, Homo sapiens
ccctctttaatgctgtctttgt

SEQ ID NO: 781269 - DNA, 15 bp, Homo sapiens
ccctctttccctgcg

SEQ ID NO: 781270 - DNA, 16 bp, Homo sapiens
ccctctttccctgcga

SEQ ID NO: 781271 - DNA, 16 bp, Homo sapiens
ccctctttctctttct

SEQ ID NO: 781272 - DNA, 22 bp, Homo sapiens
ccctctttctctttcttccttt

SEQ ID NO: 781273 - DNA, 17 bp, Homo sapiens
ccctctttgaatctctg

SEQ ID NO: 781274 - DNA, 19 bp, Homo sapiens
ccctctttgcacagcatga

SEQ ID NO: 781275 - DNA, 20 bp, Homo sapiens
ccctctttggctcccctgta

SEQ ID NO: 781276 - DNA, 22 bp, Homo sapiens
ccctcttttcttactcctcctc

SEQ ID NO: 781277 - DNA, 23 bp, Homo sapiens
ccctcttttcttactcctcctct

SEQ ID NO: 781278 - DNA, 16 bp, Homo sapiens
ccctgaaaacccagag

SEQ ID NO: 781279 - DNA, 23 bp, Homo sapiens
ccctgaaaatgtttttctgccag

SEQ ID NO: 781280 - DNA, 13 bp, Homo sapiens
ccctgaaacacga

SEQ ID NO: 781281 - DNA, 15 bp, Homo sapiens
ccctgaaagccctga

SEQ ID NO: 781282 - DNA, 15 bp, Homo sapiens
ccctgaaccacgagg

SEQ ID NO: 781283 - DNA, 16 bp, Homo sapiens
ccctgaacccacacct

SEQ ID NO: 781284 - DNA, 19 bp, Homo sapiens
ccctgaacccctcttggat

SEQ ID NO: 781285 - DNA, 14 bp, Homo sapiens
ccctgaacccctgg

SEQ ID NO: 781286 - DNA, 15 bp, Homo sapiens
ccctgaacccctggc

SEQ ID NO: 781287 - DNA, 20 bp, Homo sapiens
ccctgaacccctggccagct

SEQ ID NO: 781288 - DNA, 20 bp, Homo sapiens
ccctgaacgttttcttcttt

SEQ ID NO: 781289 - DNA, 22 bp, Homo sapiens
ccctgaacgttttcttctttcc

SEQ ID NO: 781290 - DNA, 15 bp, Homo sapiens
ccctgaagagacagg

SEQ ID NO: 781291 - DNA, 21 bp, Homo sapiens
ccctgaagcctccgtggaaca

SEQ ID NO: 781292 - DNA, 23 bp, Homo sapiens
ccctgaaggaacattccttagtc

SEQ ID NO: 781293 - DNA, 20 bp, Homo sapiens
ccctgaatggttccatgcct

SEQ ID NO: 781294 - DNA, 20 bp, Homo sapiens
ccctgacagtccctcctctc

SEQ ID NO: 781295 - DNA, 12 bp, Homo sapiens
ccctgaccctgt

SEQ ID NO: 781296 - DNA, 16 bp, Homo sapiens
ccctgaccctgtatat

SEQ ID NO: 781297 - DNA, 15 bp, Homo sapiens
ccctgaccctgtgga

SEQ ID NO: 781298 - DNA, 15 bp, Homo sapiens
ccctgacctcactgt

SEQ ID NO: 781299 - DNA, 17 bp, Homo sapiens
ccctgacctcccagccc

SEQ ID NO: 781300 - DNA, 18 bp, Homo sapiens
ccctgacctccgcccctg

SEQ ID NO: 781301 - DNA, 19 bp, Homo sapiens
ccctgacctccgcccctgc

SEQ ID NO: 781302 - DNA, 23 bp, Homo sapiens
ccctgaccttggctgactggggc

SEQ ID NO: 781303 - DNA, 15 bp, Homo sapiens
ccctgactcattctg

SEQ ID NO: 781304 - DNA, 16 bp, Homo sapiens
ccctgactccctgtgg

SEQ ID NO: 781305 - DNA, 19 bp, Homo sapiens
ccctgactcctctggcttt

SEQ ID NO: 781306 - DNA, 23 bp, Homo sapiens
ccctgactcctctggctttccca

SEQ ID NO: 781307 - DNA, 18 bp, Homo sapiens
ccctgactcctggactcc

SEQ ID NO: 781308 - DNA, 22 bp, Homo sapiens
ccctgactgtcagggagggcca

SEQ ID NO: 781309 - DNA, 15 bp, Homo sapiens
ccctgagactccaga

SEQ ID NO: 781310 - DNA, 22 bp, Homo sapiens
ccctgagacttttcaggagagc

SEQ ID NO: 781311 - DNA, 13 bp, Homo sapiens
ccctgagaggttt

SEQ ID NO: 781312 - DNA, 23 bp, Homo sapiens
ccctgagagtggtgccctggaac

SEQ ID NO: 781313 - DNA, 19 bp, Homo sapiens
ccctgagagtttcctcaga

SEQ ID NO: 781314 - DNA, 16 bp, Homo sapiens
ccctgagatcccctga

SEQ ID NO: 781315 - DNA, 18 bp, Homo sapiens
ccctgagccccagggtgc

SEQ ID NO: 781316 - DNA, 12 bp, Homo sapiens
ccctgagccggc

SEQ ID NO: 781317 - DNA, 14 bp, Homo sapiens
ccctgagcctgcat

SEQ ID NO: 781318 - DNA, 12 bp, Homo sapiens
ccctgagctcgg

SEQ ID NO: 781319 - DNA, 16 bp, Homo sapiens
ccctgagctttctgct

SEQ ID NO: 781320 - DNA, 12 bp, Homo sapiens
ccctgaggactg

SEQ ID NO: 781321 - DNA, 14 bp, Homo sapiens
ccctgaggagccag

SEQ ID NO: 781322 - DNA, 17 bp, Homo sapiens
ccctgaggaggccgctt

SEQ ID NO: 781323 - DNA, 21 bp, Homo sapiens
ccctgaggaggccgcttagtg

SEQ ID NO: 781324 - DNA, 14 bp, Homo sapiens
ccctgaggccctgg

SEQ ID NO: 781325 - DNA, 17 bp, Homo sapiens
ccctgaggccctgggct

SEQ ID NO: 781326 - DNA, 23 bp, Homo sapiens
ccctgaggcggaggctgtgctcc

SEQ ID NO: 781327 - DNA, 13 bp, Homo sapiens
ccctgaggcttca

SEQ ID NO: 781328 - DNA, 17 bp, Homo sapiens
ccctgaggggctgggct

SEQ ID NO: 781329 - DNA, 19 bp, Homo sapiens
ccctgaggggctggggagg

SEQ ID NO: 781330 - DNA, 21 bp, Homo sapiens
ccctgaggggctggggagggg

SEQ ID NO: 781331 - DNA, 21 bp, Homo sapiens
ccctgaggtgtgggggctgca

SEQ ID NO: 781332 - DNA, 13 bp, Homo sapiens
ccctgagtccgcc

SEQ ID NO: 781333 - DNA, 19 bp, Homo sapiens
ccctgagtccgcctgcgcc

SEQ ID NO: 781334 - DNA, 17 bp, Homo sapiens
ccctgagtctggacctc

SEQ ID NO: 781335 - DNA, 14 bp, Homo sapiens
ccctgagtgcgggc

SEQ ID NO: 781336 - DNA, 23 bp, Homo sapiens
ccctgagtgcgggctgaggccag

SEQ ID NO: 781337 - DNA, 21 bp, Homo sapiens
ccctgagtggatctccaagga

SEQ ID NO: 781338 - DNA, 23 bp, Homo sapiens
ccctgagtggatctccaaggacc

SEQ ID NO: 781339 - DNA, 20 bp, Homo sapiens
ccctgagttcatccaggccc

SEQ ID NO: 781340 - DNA, 16 bp, Homo sapiens
ccctgatcccattttc

SEQ ID NO: 781341 - DNA, 18 bp, Homo sapiens
ccctgatcccattttcct

SEQ ID NO: 781342 - DNA, 14 bp, Homo sapiens
ccctgatctctgac

SEQ ID NO: 781343 - DNA, 15 bp, Homo sapiens
ccctgttttttgtag

SEQ ID NO: 781344 - DNA, 16 bp, Homo sapiens
ccctgttttttgtaga

SEQ ID NO: 781345 - DNA, 14 bp, Homo sapiens
cccttaacccaagg

SEQ ID NO: 781346 - DNA, 22 bp, Homo sapiens
cccttaacccaaggagcacagg

SEQ ID NO: 781347 - DNA, 13 bp, Homo sapiens
cccttaactccaa

SEQ ID NO: 781348 - DNA, 23 bp, Homo sapiens
cccttaactctaaccctgtggaa

SEQ ID NO: 781349 - DNA, 16 bp, Homo sapiens
cccttaacttttcctt

SEQ ID NO: 781350 - DNA, 21 bp, Homo sapiens
cccttaatattgaggctgcag

SEQ ID NO: 781351 - DNA, 22 bp, Homo sapiens
cccttaatattgaggctgcagc

SEQ ID NO: 781352 - DNA, 17 bp, Homo sapiens
cccttacagcctctgac

SEQ ID NO: 781353 - DNA, 19 bp, Homo sapiens
cccttacagcctctgactt

SEQ ID NO: 781354 - DNA, 22 bp, Homo sapiens
cccttaccccttagcctccctg

SEQ ID NO: 781355 - DNA, 17 bp, Homo sapiens
cccttaccctcctctgc

SEQ ID NO: 781356 - DNA, 13 bp, Homo sapiens
cccttaccttccc

SEQ ID NO: 781357 - DNA, 12 bp, Homo sapiens
cccttacttcct

SEQ ID NO: 781358 - DNA, 19 bp, Homo sapiens
cccttacttcctggcctct

SEQ ID NO: 781359 - DNA, 16 bp, Homo sapiens
cccttagaaaatgtgt

SEQ ID NO: 781360 - DNA, 22 bp, Homo sapiens
cccttagagattgccccagagc

SEQ ID NO: 781361 - DNA, 23 bp, Homo sapiens
cccttagagattgccccagagcc

SEQ ID NO: 781362 - DNA, 17 bp, Homo sapiens
cccttagcacagagagg

SEQ ID NO: 781363 - DNA, 16 bp, Homo sapiens
cccttagcaccttcag

SEQ ID NO: 781364 - DNA, 17 bp, Homo sapiens
cccttagcctccctgaa

SEQ ID NO: 781365 - DNA, 19 bp, Homo sapiens
cccttagcctctcccaccc

SEQ ID NO: 781366 - DNA, 20 bp, Homo sapiens
cccttaggatggggctccca

SEQ ID NO: 781367 - DNA, 16 bp, Homo sapiens
cccttaggcattattt

SEQ ID NO: 781368 - DNA, 18 bp, Homo sapiens
cccttagggaagttgtct

SEQ ID NO: 781369 - DNA, 15 bp, Homo sapiens
cccttatcaccagct

SEQ ID NO: 781370 - DNA, 21 bp, Homo sapiens
cccttattgctgccaaaacca

SEQ ID NO: 781371 - DNA, 13 bp, Homo sapiens
cccttcacaaagc

SEQ ID NO: 781372 - DNA, 21 bp, Homo sapiens
cccttcaccgctccccacagc

SEQ ID NO: 781373 - DNA, 15 bp, Homo sapiens
cccttcagaccccag

SEQ ID NO: 781374 - DNA, 17 bp, Homo sapiens
cccttcagctcctgagt

SEQ ID NO: 781375 - DNA, 22 bp, Homo sapiens
cccttcagggattccctgtccc

SEQ ID NO: 781376 - DNA, 19 bp, Homo sapiens
cccttcagggccagaagga

SEQ ID NO: 781377 - DNA, 20 bp, Homo sapiens
cccttcagtaccctctcagc

SEQ ID NO: 781378 - DNA, 13 bp, Homo sapiens
cccttcagtctgc

SEQ ID NO: 781379 - DNA, 17 bp, Homo sapiens
cccttcagtctgctcca

SEQ ID NO: 781380 - DNA, 20 bp, Homo sapiens
cccttcagtctgctccacca

SEQ ID NO: 781381 - DNA, 20 bp, Homo sapiens
cccttcatccgcctgtgggc

SEQ ID NO: 781382 - DNA, 16 bp, Homo sapiens
cccttcatcttcctgt

SEQ ID NO: 781383 - DNA, 14 bp, Homo sapiens
cccttcatttaaac

SEQ ID NO: 781384 - DNA, 18 bp, Homo sapiens
cccttccaaatgtccctc

SEQ ID NO: 781385 - DNA, 22 bp, Homo sapiens
cccttccaaatgtccctccaac

SEQ ID NO: 781386 - DNA, 13 bp, Homo sapiens
cccttccactgag

SEQ ID NO: 781387 - DNA, 12 bp, Homo sapiens
cccttccaggaa

SEQ ID NO: 781388 - DNA, 16 bp, Homo sapiens
cccttccaggtgggtg

SEQ ID NO: 781389 - DNA, 13 bp, Homo sapiens
cccttccagtggg

SEQ ID NO: 781390 - DNA, 18 bp, Homo sapiens
cccttccatgccctggga

SEQ ID NO: 781391 - DNA, 14 bp, Homo sapiens
cccttcccacagga

SEQ ID NO: 781392 - DNA, 16 bp, Homo sapiens
cccttcccacatgcct

SEQ ID NO: 781393 - DNA, 19 bp, Homo sapiens
cccttcccacctactgcac

SEQ ID NO: 781394 - DNA, 14 bp, Homo sapiens
cccttcccagccct

SEQ ID NO: 781395 - DNA, 17 bp, Homo sapiens
cccttcccagccctcat

SEQ ID NO: 781396 - DNA, 14 bp, Homo sapiens
cccttccccaagaa

SEQ ID NO: 781397 - DNA, 12 bp, Homo sapiens
cccttccccact

SEQ ID NO: 781398 - DNA, 13 bp, Homo sapiens
cccttccccaggc

SEQ ID NO: 781399 - DNA, 17 bp, Homo sapiens
cccttccccaggcccac

SEQ ID NO: 781400 - DNA, 13 bp, Homo sapiens
cccttcccccacc

SEQ ID NO: 781401 - DNA, 21 bp, Homo sapiens
cccttcccccatccctaccac

SEQ ID NO: 781402 - DNA, 22 bp, Homo sapiens
cccttccccgtcccctgcagcc

SEQ ID NO: 781403 - DNA, 10 bp, Homo sapiens
cccttcccct

SEQ ID NO: 781404 - DNA, 22 bp, Homo sapiens
cccttcccctccctggctccca

SEQ ID NO: 781405 - DNA, 20 bp, Homo sapiens
cccttcccgacccagccagc

SEQ ID NO: 781406 - DNA, 21 bp, Homo sapiens
cccttcccgacccagccagct

SEQ ID NO: 781407 - DNA, 22 bp, Homo sapiens
cccttcccgacccagccagctg

SEQ ID NO: 781408 - DNA, 17 bp, Homo sapiens
cccttccctcacccctg

SEQ ID NO: 781409 - DNA, 12 bp, Homo sapiens
cccttccctcct

SEQ ID NO: 781410 - DNA, 17 bp, Homo sapiens
cccttccctcctcccat

SEQ ID NO: 781411 - DNA, 21 bp, Homo sapiens
cccttccctctgggcacgcct

SEQ ID NO: 781412 - DNA, 13 bp, Homo sapiens
cccttccctgcac

SEQ ID NO: 781413 - DNA, 14 bp, Homo sapiens
cccttccctgtccc

SEQ ID NO: 781414 - DNA, 16 bp, Homo sapiens
cccttccctgtccctc

SEQ ID NO: 781415 - DNA, 18 bp, Homo sapiens
cccttcccttgagatgag

SEQ ID NO: 781416 - DNA, 14 bp, Homo sapiens
cccttccgaccctc

SEQ ID NO: 781417 - DNA, 15 bp, Homo sapiens
cccttccgaccctct

SEQ ID NO: 781418 - DNA, 16 bp, Homo sapiens
cccttccgaccctctg

SEQ ID NO: 781419 - DNA, 18 bp, Homo sapiens
cccttccgtccatccccc

SEQ ID NO: 781420 - DNA, 23 bp, Homo sapiens
cccttccgtccatcccccttctt

SEQ ID NO: 781421 - DNA, 24 bp, Homo sapiens
cccttccgtccatcccccttcttc

SEQ ID NO: 781422 - DNA, 18 bp, Homo sapiens
cccttcctaaatatccaa

SEQ ID NO: 781423 - DNA, 19 bp, Homo sapiens
cccttcctaattccacagc

SEQ ID NO: 781424 - DNA, 22 bp, Homo sapiens
cccttcctactcctcatagcat

SEQ ID NO: 781425 - DNA, 22 bp, Homo sapiens
cccttcctattctcctgccatg

SEQ ID NO: 781426 - DNA, 14 bp, Homo sapiens
cccttcctccccac

SEQ ID NO: 781427 - DNA, 19 bp, Homo sapiens
cccttcctccccacactcc

SEQ ID NO: 781428 - DNA, 21 bp, Homo sapiens
cccttcctctccactgccttc

SEQ ID NO: 781429 - DNA, 16 bp, Homo sapiens
cccttcctctctcctt

SEQ ID NO: 781430 - DNA, 12 bp, Homo sapiens
cccttcctcttc

SEQ ID NO: 781431 - DNA, 17 bp, Homo sapiens
cccttcctcttcctgcc

SEQ ID NO: 781432 - DNA, 18 bp, Homo sapiens
cccttcctcttcctgccc

SEQ ID NO: 781433 - DNA, 20 bp, Homo sapiens
cccttcctcttcctgccctt

SEQ ID NO: 781434 - DNA, 21 bp, Homo sapiens
cccttcctcttcctgcccttg

SEQ ID NO: 781435 - DNA, 21 bp, Homo sapiens
cccttcctgcatttctcttct

SEQ ID NO: 781436 - DNA, 15 bp, Homo sapiens
cccttcctggaaaca

SEQ ID NO: 781437 - DNA, 17 bp, Homo sapiens
cccttcctggaaacagc

SEQ ID NO: 781438 - DNA, 22 bp, Homo sapiens
cccttcctggaaacagcatgaa

SEQ ID NO: 781439 - DNA, 14 bp, Homo sapiens
cccttcctggccca

SEQ ID NO: 781440 - DNA, 17 bp, Homo sapiens
cccttcctggcccaggc

SEQ ID NO: 781441 - DNA, 19 bp, Homo sapiens
cccttcctggcccaggcct

SEQ ID NO: 781442 - DNA, 14 bp, Homo sapiens
cccttcctggcctc

SEQ ID NO: 781443 - DNA, 23 bp, Homo sapiens
cccttcctggcctcactggctgg

SEQ ID NO: 781444 - DNA, 10 bp, Homo sapiens
cccttcctgt

SEQ ID NO: 781445 - DNA, 16 bp, Homo sapiens
cccttcctgtcctgcc

SEQ ID NO: 781446 - DNA, 21 bp, Homo sapiens
cccttcctgttccctcctggt

SEQ ID NO: 781447 - DNA, 17 bp, Homo sapiens
cccttcctgttcttcct

SEQ ID NO: 781448 - DNA, 11 bp, Homo sapiens
cccttccttta

SEQ ID NO: 781449 - DNA, 11 bp, Homo sapiens
cccttcctttc

SEQ ID NO: 781450 - DNA, 19 bp, Homo sapiens
cccttcctttcctctgcag

SEQ ID NO: 781451 - DNA, 16 bp, Homo sapiens
cccttcctttctcccc

SEQ ID NO: 781452 - DNA, 18 bp, Homo sapiens
cccttccttttccctgct

SEQ ID NO: 781453 - DNA, 19 bp, Homo sapiens
cccttccttttccctgctt

SEQ ID NO: 781454 - DNA, 17 bp, Homo sapiens
cccttcgacatgctgcc

SEQ ID NO: 781455 - DNA, 18 bp, Homo sapiens
cccttcgacatgctgcca

SEQ ID NO: 781456 - DNA, 21 bp, Homo sapiens
cccttcgacatgctgccagga

SEQ ID NO: 781457 - DNA, 22 bp, Homo sapiens
cccttcgacatgctgccaggaa

SEQ ID NO: 781458 - DNA, 15 bp, Homo sapiens
cccttctcagaatct

SEQ ID NO: 781459 - DNA, 16 bp, Homo sapiens
cccttctcagaatcta

SEQ ID NO: 781460 - DNA, 13 bp, Homo sapiens
cccttctcccaca

SEQ ID NO: 781461 - DNA, 15 bp, Homo sapiens
cccttctcccacact

SEQ ID NO: 781462 - DNA, 13 bp, Homo sapiens
cccttctccccct

SEQ ID NO: 781463 - DNA, 14 bp, Homo sapiens
cccttctccccctt

SEQ ID NO: 781464 - DNA, 15 bp, Homo sapiens
cccttctcccccttg

SEQ ID NO: 781465 - DNA, 19 bp, Homo sapiens
cccttctcccggccctcac

SEQ ID NO: 781466 - DNA, 17 bp, Homo sapiens
cccttctcctcttgtaa

SEQ ID NO: 781467 - DNA, 12 bp, Homo sapiens
cccttctctctc

SEQ ID NO: 781468 - DNA, 15 bp, Homo sapiens
ccgctggcccttaga

SEQ ID NO: 781469 - DNA, 22 bp, Homo sapiens
ccgctggcccttagagaccccg

SEQ ID NO: 781470 - DNA, 18 bp, Homo sapiens
ccgctggctggtgggccc

SEQ ID NO: 781471 - DNA, 14 bp, Homo sapiens
ccgctgggctgagc

SEQ ID NO: 781472 - DNA, 18 bp, Homo sapiens
ccgctgtcgccccaggcc

SEQ ID NO: 781473 - DNA, 21 bp, Homo sapiens
ccgctgtcgccccaggccctc

SEQ ID NO: 781474 - DNA, 19 bp, Homo sapiens
ccgctgtgagcccctggtc

SEQ ID NO: 781475 - DNA, 20 bp, Homo sapiens
ccgctgtgagcccctggtcc

SEQ ID NO: 781476 - DNA, 21 bp, Homo sapiens
ccgctgtggccgcacgcctct

SEQ ID NO: 781477 - DNA, 14 bp, Homo sapiens
ccgctgttcaccca

SEQ ID NO: 781478 - DNA, 19 bp, Homo sapiens
ccgctgttcacccacaggg

SEQ ID NO: 781479 - DNA, 14 bp, Homo sapiens
ccgcttagcctgcc

SEQ ID NO: 781480 - DNA, 15 bp, Homo sapiens
ccgcttagcctgcct

SEQ ID NO: 781481 - DNA, 19 bp, Homo sapiens
ccgcttagcgctctggaca

SEQ ID NO: 781482 - DNA, 14 bp, Homo sapiens
ccgcttatcctgct

SEQ ID NO: 781483 - DNA, 17 bp, Homo sapiens
ccgcttcaagctctctg

SEQ ID NO: 781484 - DNA, 14 bp, Homo sapiens
ccgcttccccttgc

SEQ ID NO: 781485 - DNA, 15 bp, Homo sapiens
ccgcttccctattta

SEQ ID NO: 781486 - DNA, 13 bp, Homo sapiens
ccgcttcctgttt

SEQ ID NO: 781487 - DNA, 15 bp, Homo sapiens
ccgcttctgcctgca

SEQ ID NO: 781488 - DNA, 23 bp, Homo sapiens
ccgcttgaaaagctagtgtacct

SEQ ID NO: 781489 - DNA, 13 bp, Homo sapiens
ccgcttggtggcc

SEQ ID NO: 781490 - DNA, 18 bp, Homo sapiens
ccgcttgtccagcgccta

SEQ ID NO: 781491 - DNA, 19 bp, Homo sapiens
ccgcttgtccagcgcctag

SEQ ID NO: 781492 - DNA, 16 bp, Homo sapiens
ccgcttgtggggaccc

SEQ ID NO: 781493 - DNA, 17 bp, Homo sapiens
ccgcttgtggggaccca

SEQ ID NO: 781494 - DNA, 20 bp, Homo sapiens
ccgcttgtggggacccaggc

SEQ ID NO: 781495 - DNA, 18 bp, Homo sapiens
ccgcttttgcagcagagg

SEQ ID NO: 781496 - DNA, 19 bp, Homo sapiens
ccgcttttgttctcgcaaa

SEQ ID NO: 781497 - DNA, 14 bp, Homo sapiens
ccggaactgggctg

SEQ ID NO: 781498 - DNA, 17 bp, Homo sapiens
ccggaactgggctggcg

SEQ ID NO: 781499 - DNA, 22 bp, Homo sapiens
ccggaaggaatgtcagggccag

SEQ ID NO: 781500 - DNA, 21 bp, Homo sapiens
ccggaaggaggccaaccagcc

SEQ ID NO: 781501 - DNA, 22 bp, Homo sapiens
ccggaatagatgtcttcatcac

SEQ ID NO: 781502 - DNA, 14 bp, Homo sapiens
ccggaattgtattt

SEQ ID NO: 781503 - DNA, 22 bp, Homo sapiens
ccggacacacctctgctccaaa

SEQ ID NO: 781504 - DNA, 15 bp, Homo sapiens
ccggacaggtggggc

SEQ ID NO: 781505 - DNA, 20 bp, Homo sapiens
ccggacaggtggggcctcag

SEQ ID NO: 781506 - DNA, 21 bp, Homo sapiens
ccggacaggtggggcctcagc

SEQ ID NO: 781507 - DNA, 17 bp, Homo sapiens
ccggacccccgtcagct

SEQ ID NO: 781508 - DNA, 16 bp, Homo sapiens
ccggacctacctccct

SEQ ID NO: 781509 - DNA, 18 bp, Homo sapiens
ccggacctacctccctcc

SEQ ID NO: 781510 - DNA, 21 bp, Homo sapiens
ccggacgagttcatggggatc

SEQ ID NO: 781511 - DNA, 23 bp, Homo sapiens
ccggacggacgttggttctgcac

SEQ ID NO: 781512 - DNA, 18 bp, Homo sapiens
ccggagatgtagcaaaac

SEQ ID NO: 781513 - DNA, 19 bp, Homo sapiens
ccggagattggacggcctg

SEQ ID NO: 781514 - DNA, 14 bp, Homo sapiens
ccggagcacagccc

SEQ ID NO: 781515 - DNA, 18 bp, Homo sapiens
ccggagcacagccctggg

SEQ ID NO: 781516 - DNA, 14 bp, Homo sapiens
ccggagcagcagga

SEQ ID NO: 781517 - DNA, 21 bp, Homo sapiens
ccggagccatcaccctcaccc

SEQ ID NO: 781518 - DNA, 12 bp, Homo sapiens
ccggagcccaga

SEQ ID NO: 781519 - DNA, 19 bp, Homo sapiens
ccggagcctcatgttctct

SEQ ID NO: 781520 - DNA, 21 bp, Homo sapiens
ccggaggactgagcccccacc

SEQ ID NO: 781521 - DNA, 15 bp, Homo sapiens
ccggaggagcagcct

SEQ ID NO: 781522 - DNA, 18 bp, Homo sapiens
ccggaggagcagcctcga

SEQ ID NO: 781523 - DNA, 14 bp, Homo sapiens
ccggaggaggagat

SEQ ID NO: 781524 - DNA, 13 bp, Homo sapiens
ccggaggcagcag

SEQ ID NO: 781525 - DNA, 16 bp, Homo sapiens
ccggaggccgggccct

SEQ ID NO: 781526 - DNA, 21 bp, Homo sapiens
ccggaggccttggggtggggg

SEQ ID NO: 781527 - DNA, 22 bp, Homo sapiens
ccggaggccttggggtgggggc

SEQ ID NO: 781528 - DNA, 22 bp, Homo sapiens
ccggaggcgtggaggagaggag

SEQ ID NO: 781529 - DNA, 21 bp, Homo sapiens
ccggagggacgcggaggagga

SEQ ID NO: 781530 - DNA, 19 bp, Homo sapiens
ccggaggggacccagctcc

SEQ ID NO: 781531 - DNA, 20 bp, Homo sapiens
ccggaggggacccagctcct

SEQ ID NO: 781532 - DNA, 21 bp, Homo sapiens
ccggaggggacccagctcctc

SEQ ID NO: 781533 - DNA, 15 bp, Homo sapiens
ccggaggggcctggc

SEQ ID NO: 781534 - DNA, 17 bp, Homo sapiens
ccggaggggcctggcag

SEQ ID NO: 781535 - DNA, 21 bp, Homo sapiens
ccggaggggcctggcagccgt

SEQ ID NO: 781536 - DNA, 16 bp, Homo sapiens
ccggaggtcactccac

SEQ ID NO: 781537 - DNA, 22 bp, Homo sapiens
ccggagtgtctggaattgtggc

SEQ ID NO: 781538 - DNA, 17 bp, Homo sapiens
ccggatcagagcaggac

SEQ ID NO: 781539 - DNA, 14 bp, Homo sapiens
ccggatctgggctg

SEQ ID NO: 781540 - DNA, 14 bp, Homo sapiens
ccggatgtgctttt

SEQ ID NO: 781541 - DNA, 11 bp, Homo sapiens
ccggatttcta

SEQ ID NO: 781542 - DNA, 17 bp, Homo sapiens
ccggatttctaacagtc

SEQ ID NO: 781543 - DNA, 23 bp, Homo sapiens
ccggcaaccccagttctgctcct

SEQ ID NO: 781544 - DNA, 19 bp, Homo sapiens
ccggcaagccacaggaagg

SEQ ID NO: 781545 - DNA, 19 bp, Homo sapiens
ccggcaagcgagcacagta

SEQ ID NO: 781546 - DNA, 15 bp, Homo sapiens
ccggcactccatgct

SEQ ID NO: 781547 - DNA, 16 bp, Homo sapiens
ccggcaggcctgagaa

SEQ ID NO: 781548 - DNA, 11 bp, Homo sapiens
ccggcagggcg

SEQ ID NO: 781549 - DNA, 15 bp, Homo sapiens
ccggccaatggaaac

SEQ ID NO: 781550 - DNA, 14 bp, Homo sapiens
ccggccacacccag

SEQ ID NO: 781551 - DNA, 21 bp, Homo sapiens
ccggccacactggtcacaggc

SEQ ID NO: 781552 - DNA, 15 bp, Homo sapiens
ccggccagccatgtc

SEQ ID NO: 781553 - DNA, 11 bp, Homo sapiens
ccggccagccc

SEQ ID NO: 781554 - DNA, 16 bp, Homo sapiens
ccggccatactgcctt

SEQ ID NO: 781555 - DNA, 19 bp, Homo sapiens
ccggcccagatgtgtcccc

SEQ ID NO: 781556 - DNA, 18 bp, Homo sapiens
ccggcccagtgccactgc

SEQ ID NO: 781557 - DNA, 16 bp, Homo sapiens
ccggcccagtgccagc

SEQ ID NO: 781558 - DNA, 19 bp, Homo sapiens
ccggcccagtgccagctcc

SEQ ID NO: 781559 - DNA, 20 bp, Homo sapiens
ccggcccagtgccagctcca

SEQ ID NO: 781560 - DNA, 20 bp, Homo sapiens
ccggccccaccccctgggca

SEQ ID NO: 781561 - DNA, 12 bp, Homo sapiens
ccggccccagcc

SEQ ID NO: 781562 - DNA, 21 bp, Homo sapiens
ccggccccccgcgctcgccca

SEQ ID NO: 781563 - DNA, 13 bp, Homo sapiens
ccggcccccctct

SEQ ID NO: 781564 - DNA, 16 bp, Homo sapiens
ccggcccccctctcgg

SEQ ID NO: 781565 - DNA, 20 bp, Homo sapiens
ccggcccccctctcgggctc

SEQ ID NO: 781566 - DNA, 12 bp, Homo sapiens
ccggcccctcac

SEQ ID NO: 781567 - DNA, 16 bp, Homo sapiens
ccggcccctcaccctc

SEQ ID NO: 781568 - DNA, 22 bp, Homo sapiens
ccggcccctcaccctctgtccc

SEQ ID NO: 781569 - DNA, 23 bp, Homo sapiens
ccggcccctcaccctctgtcccc

SEQ ID NO: 781570 - DNA, 20 bp, Homo sapiens
ccggcccctggcagcacagc

SEQ ID NO: 781571 - DNA, 16 bp, Homo sapiens
cctcgaattctcagac

SEQ ID NO: 781572 - DNA, 18 bp, Homo sapiens
cctcgaattctcagacga

SEQ ID NO: 781573 - DNA, 17 bp, Homo sapiens
cctcgaattttatctgt

SEQ ID NO: 781574 - DNA, 20 bp, Homo sapiens
cctcgacagggcctggagcc

SEQ ID NO: 781575 - DNA, 14 bp, Homo sapiens
cctcgaggcctaca

SEQ ID NO: 781576 - DNA, 15 bp, Homo sapiens
cctcgaggcctacag

SEQ ID NO: 781577 - DNA, 13 bp, Homo sapiens
cctcgaggctggt

SEQ ID NO: 781578 - DNA, 15 bp, Homo sapiens
cctcgaggctggtgg

SEQ ID NO: 781579 - DNA, 15 bp, Homo sapiens
cctcgagggccgcct

SEQ ID NO: 781580 - DNA, 21 bp, Homo sapiens
cctcgagggccgcctgcctta

SEQ ID NO: 781581 - DNA, 18 bp, Homo sapiens
cctcgaggggcctcccgg

SEQ ID NO: 781582 - DNA, 13 bp, Homo sapiens
cctcgcacacagg

SEQ ID NO: 781583 - DNA, 19 bp, Homo sapiens
cctcgcacacagggctcac

SEQ ID NO: 781584 - DNA, 15 bp, Homo sapiens
cctcgcacaggccct

SEQ ID NO: 781585 - DNA, 18 bp, Homo sapiens
cctcgcacaggccctagc

SEQ ID NO: 781586 - DNA, 19 bp, Homo sapiens
cctcgcacaggccctagct

SEQ ID NO: 781587 - DNA, 19 bp, Homo sapiens
cctcgcacttgcagaggag

SEQ ID NO: 781588 - DNA, 22 bp, Homo sapiens
cctcgcagcctctcagtgccct

SEQ ID NO: 781589 - DNA, 12 bp, Homo sapiens
cctcgccagctt

SEQ ID NO: 781590 - DNA, 22 bp, Homo sapiens
cctcgccccaaggttccagagg

SEQ ID NO: 781591 - DNA, 23 bp, Homo sapiens
cctcgccccaaggttccagaggc

SEQ ID NO: 781592 - DNA, 14 bp, Homo sapiens
cctcgcccccacca

SEQ ID NO: 781593 - DNA, 16 bp, Homo sapiens
cctcgcccccaccagt

SEQ ID NO: 781594 - DNA, 15 bp, Homo sapiens
cctcgcccctccagt

SEQ ID NO: 781595 - DNA, 18 bp, Homo sapiens
cctcgccggatctgaggg

SEQ ID NO: 781596 - DNA, 16 bp, Homo sapiens
cctcgcctaggcctgt

SEQ ID NO: 781597 - DNA, 17 bp, Homo sapiens
cctcgcctaggcctgtg

SEQ ID NO: 781598 - DNA, 15 bp, Homo sapiens
cctcgcctccccacc

SEQ ID NO: 781599 - DNA, 21 bp, Homo sapiens
cctcgcctgtggagctcagcc

SEQ ID NO: 781600 - DNA, 22 bp, Homo sapiens
cctcgcctgtggagctcagccc

SEQ ID NO: 781601 - DNA, 15 bp, Homo sapiens
cctcgctcaccgctg

SEQ ID NO: 781602 - DNA, 21 bp, Homo sapiens
cctcgctcaccgctggccctt

SEQ ID NO: 781603 - DNA, 15 bp, Homo sapiens
cctcgctcccctctg

SEQ ID NO: 781604 - DNA, 18 bp, Homo sapiens
cctcgctcccctctggaa

SEQ ID NO: 781605 - DNA, 16 bp, Homo sapiens
cctcgctcctccttcc

SEQ ID NO: 781606 - DNA, 14 bp, Homo sapiens
cctcgctgccagct

SEQ ID NO: 781607 - DNA, 12 bp, Homo sapiens
cctcgctgctgc

SEQ ID NO: 781608 - DNA, 13 bp, Homo sapiens
cctcgctgctgct

SEQ ID NO: 781609 - DNA, 21 bp, Homo sapiens
cctcgctgctgctactacccg

SEQ ID NO: 781610 - DNA, 12 bp, Homo sapiens
cctcgctgcttc

SEQ ID NO: 781611 - DNA, 18 bp, Homo sapiens
cctcggaaccgctcacct

SEQ ID NO: 781612 - DNA, 14 bp, Homo sapiens
cctcggagagcagc

SEQ ID NO: 781613 - DNA, 15 bp, Homo sapiens
cctcggagagcagca

SEQ ID NO: 781614 - DNA, 19 bp, Homo sapiens
cctcggagagcagcagcac

SEQ ID NO: 781615 - DNA, 16 bp, Homo sapiens
cctcggagcctcatcc

SEQ ID NO: 781616 - DNA, 17 bp, Homo sapiens
cctcggagctgccagcc

SEQ ID NO: 781617 - DNA, 23 bp, Homo sapiens
cctcggagctggctgtgcctgct

SEQ ID NO: 781618 - DNA, 22 bp, Homo sapiens
cctcggagggatggagaaagaa

SEQ ID NO: 781619 - DNA, 14 bp, Homo sapiens
cctcggcacacact

SEQ ID NO: 781620 - DNA, 17 bp, Homo sapiens
cctcggcacacactgtg

SEQ ID NO: 781621 - DNA, 22 bp, Homo sapiens
cctcggccccacccaccctctg

SEQ ID NO: 781622 - DNA, 22 bp, Homo sapiens
cctcggcctcccaaagtgctgg

SEQ ID NO: 781623 - DNA, 22 bp, Homo sapiens
cctcggcctccgaggctccccg

SEQ ID NO: 781624 - DNA, 20 bp, Homo sapiens
cctcggcgttagtccctagc

SEQ ID NO: 781625 - DNA, 15 bp, Homo sapiens
cctcggctctggagg

SEQ ID NO: 781626 - DNA, 15 bp, Homo sapiens
cctcggcttgtgggc

SEQ ID NO: 781627 - DNA, 16 bp, Homo sapiens
cctcggcttgtgggct

SEQ ID NO: 781628 - DNA, 17 bp, Homo sapiens
cctcggcttgtgggctg

SEQ ID NO: 781629 - DNA, 21 bp, Homo sapiens
cctcggcttgtgggctggtgc

SEQ ID NO: 781630 - DNA, 20 bp, Homo sapiens
cctcgggcccacctggccac

SEQ ID NO: 781631 - DNA, 22 bp, Homo sapiens
cctcgggcccacctggccacct

SEQ ID NO: 781632 - DNA, 20 bp, Homo sapiens
cctcgggctggagcctccga

SEQ ID NO: 781633 - DNA, 15 bp, Homo sapiens
cctcggggacaccag

SEQ ID NO: 781634 - DNA, 19 bp, Homo sapiens
cctcggggacaccagagct

SEQ ID NO: 781635 - DNA, 13 bp, Homo sapiens
cctcggggatggg

SEQ ID NO: 781636 - DNA, 17 bp, Homo sapiens
cctcgggggctcttccc

SEQ ID NO: 781637 - DNA, 18 bp, Homo sapiens
cctcgggggctcttcccc

SEQ ID NO: 781638 - DNA, 15 bp, Homo sapiens
cctcggtactcccat

SEQ ID NO: 781639 - DNA, 22 bp, Homo sapiens
cctcggtctcccaaagtgctgg

SEQ ID NO: 781640 - DNA, 15 bp, Homo sapiens
cctcggtctcccttc

SEQ ID NO: 781641 - DNA, 19 bp, Homo sapiens
cctcggtctcccttccgtc

SEQ ID NO: 781642 - DNA, 22 bp, Homo sapiens
cctcggtggccctgactgtcag

SEQ ID NO: 781643 - DNA, 13 bp, Homo sapiens
cctcggtggctct

SEQ ID NO: 781644 - DNA, 14 bp, Homo sapiens
cctcggtggctctg

SEQ ID NO: 781645 - DNA, 15 bp, Homo sapiens
cctcggtggctctgg

SEQ ID NO: 781646 - DNA, 19 bp, Homo sapiens
cctcggtgggccagagctg

SEQ ID NO: 781647 - DNA, 18 bp, Homo sapiens
cctcgtcaagagcatgca

SEQ ID NO: 781648 - DNA, 22 bp, Homo sapiens
cctcgtcaagagcatgcacatg

SEQ ID NO: 781649 - DNA, 17 bp, Homo sapiens
cctcgtccacaggggca

SEQ ID NO: 781650 - DNA, 23 bp, Homo sapiens
cctcgtccacaggggcaggcctg

SEQ ID NO: 781651 - DNA, 22 bp, Homo sapiens
cctcgtcccatccagctaccac

SEQ ID NO: 781652 - DNA, 15 bp, Homo sapiens
cctcgtcctgtccca

SEQ ID NO: 781653 - DNA, 17 bp, Homo sapiens
cctcgtgcagagctggg

SEQ ID NO: 781654 - DNA, 13 bp, Homo sapiens
cctcgtgccagca

SEQ ID NO: 781655 - DNA, 17 bp, Homo sapiens
cctcgtgccagcagcct

SEQ ID NO: 781656 - DNA, 19 bp, Homo sapiens
cctcgtgccagcagcctcg

SEQ ID NO: 781657 - DNA, 13 bp, Homo sapiens
cctcgtggccagc

SEQ ID NO: 781658 - DNA, 16 bp, Homo sapiens
cctcgtggccagcccg

SEQ ID NO: 781659 - DNA, 22 bp, Homo sapiens
cctcgtggccagcccggctggt

SEQ ID NO: 781660 - DNA, 22 bp, Homo sapiens
cctcgtgggcttgtgctcggga

SEQ ID NO: 781661 - DNA, 15 bp, Homo sapiens
cctcgtgtcagctca

SEQ ID NO: 781662 - DNA, 21 bp, Homo sapiens
cctcgttgcccagcactgtct

SEQ ID NO: 781663 - DNA, 14 bp, Homo sapiens
cctcgttggagagc

SEQ ID NO: 781664 - DNA, 18 bp, Homo sapiens
cctcgttggagagcagca

SEQ ID NO: 781665 - DNA, 15 bp, Homo sapiens
cctctaaagaaactt

SEQ ID NO: 781666 - DNA, 13 bp, Homo sapiens
cctctaaagcaga

SEQ ID NO: 781667 - DNA, 19 bp, Homo sapiens
cctctaagccactcttcca

SEQ ID NO: 781668 - DNA, 22 bp, Homo sapiens
cctctaggggcagcctccgtca

SEQ ID NO: 781669 - DNA, 21 bp, Homo sapiens
cctctagtgaatgtaggctgg

SEQ ID NO: 781670 - DNA, 13 bp, Homo sapiens
cctctagtgcctt

SEQ ID NO: 781671 - DNA, 17 bp, Homo sapiens
cctctatacatctctcc

SEQ ID NO: 781672 - DNA, 22 bp, Homo sapiens
cctctatcatggtgaaaagctc

SEQ ID NO: 781673 - DNA, 17 bp, Homo sapiens
cctctatgccctgcaga

SEQ ID NO: 781674 - DNA, 19 bp, Homo sapiens
cctctatgccctgcagagc

SEQ ID NO: 781675 - DNA, 20 bp, Homo sapiens
cctctatgccctgcagagca

SEQ ID NO: 781676 - DNA, 21 bp, Homo sapiens
cctctatgccctgcagagcaa

SEQ ID NO: 781677 - DNA, 17 bp, Homo sapiens
cctctcaactgcctcag

SEQ ID NO: 781678 - DNA, 19 bp, Homo sapiens
cctctcaactgcctcagcg

SEQ ID NO: 781679 - DNA, 19 bp, Homo sapiens
cctctcacgccacccccgc

SEQ ID NO: 781680 - DNA, 16 bp, Homo sapiens
cctctcactaaacttt

SEQ ID NO: 781681 - DNA, 13 bp, Homo sapiens
cctctcactccag

SEQ ID NO: 781682 - DNA, 15 bp, Homo sapiens
cctctcactccagcc

SEQ ID NO: 781683 - DNA, 16 bp, Homo sapiens
cctctcactccagcca

SEQ ID NO: 781684 - DNA, 22 bp, Homo sapiens
cctctcactccagccaaagaaa

SEQ ID NO: 781685 - DNA, 24 bp, Homo sapiens
cctctcacttaccccgagacctca

SEQ ID NO: 781686 - DNA, 19 bp, Homo sapiens
cctctcagaacatactgat

SEQ ID NO: 781687 - DNA, 20 bp, Homo sapiens
cctctcagatacccagtgga

SEQ ID NO: 781688 - DNA, 20 bp, Homo sapiens
cctctcagcatagcctgcct

SEQ ID NO: 781689 - DNA, 11 bp, Homo sapiens
cctctcaggag

SEQ ID NO: 781690 - DNA, 21 bp, Homo sapiens
cctctcaggcatgcctgtgtg

SEQ ID NO: 781691 - DNA, 13 bp, Homo sapiens
cctctcaggtggg

SEQ ID NO: 781692 - DNA, 14 bp, Homo sapiens
cctctcagtgccct

SEQ ID NO: 781693 - DNA, 16 bp, Homo sapiens
cctctcagtgccctcc

SEQ ID NO: 781694 - DNA, 17 bp, Homo sapiens
cctctcagttctctccc

SEQ ID NO: 781695 - DNA, 22 bp, Homo sapiens
cctctcagttctctcccttcct

SEQ ID NO: 781696 - DNA, 21 bp, Homo sapiens
cctctcatcatttgcattggg

SEQ ID NO: 781697 - DNA, 15 bp, Homo sapiens
cctctcatgtccctc

SEQ ID NO: 781698 - DNA, 17 bp, Homo sapiens
cctctccaaccactgtg

SEQ ID NO: 781699 - DNA, 21 bp, Homo sapiens
cctctccaagggcttctgcac

SEQ ID NO: 781700 - DNA, 23 bp, Homo sapiens
cctctccaagggcttctgcaccc

SEQ ID NO: 781701 - DNA, 21 bp, Homo sapiens
cctctccaagtctctctgtga

SEQ ID NO: 781702 - DNA, 23 bp, Homo sapiens
cctctccaagtctctctgtgaat

SEQ ID NO: 781703 - DNA, 22 bp, Homo sapiens
cctctccaccagacgccttcct

SEQ ID NO: 781704 - DNA, 20 bp, Homo sapiens
cctctccaccctcctctagc

SEQ ID NO: 781705 - DNA, 14 bp, Homo sapiens
cctctccactgctg

SEQ ID NO: 781706 - DNA, 12 bp, Homo sapiens
cctctccaggca

SEQ ID NO: 781707 - DNA, 18 bp, Homo sapiens
cctctccagtttgcacct

SEQ ID NO: 781708 - DNA, 19 bp, Homo sapiens
cctctccagtttgcacctg

SEQ ID NO: 781709 - DNA, 21 bp, Homo sapiens
cctctccagtttgcacctgtc

SEQ ID NO: 781710 - DNA, 21 bp, Homo sapiens
cctctccatacctgcccctgc

SEQ ID NO: 781711 - DNA, 20 bp, Homo sapiens
cctctccatatctccttccc

SEQ ID NO: 781712 - DNA, 22 bp, Homo sapiens
cctctccattttagcccagtgt

SEQ ID NO: 781713 - DNA, 19 bp, Homo sapiens
cctctcccacagagtgctg

SEQ ID NO: 781714 - DNA, 23 bp, Homo sapiens
cctctcccacagagtgctggact

SEQ ID NO: 781715 - DNA, 17 bp, Homo sapiens
cctctcccacccggcca

SEQ ID NO: 781716 - DNA, 21 bp, Homo sapiens
cctctcccacccggccacagc

SEQ ID NO: 781717 - DNA, 12 bp, Homo sapiens
cctctcccaggg

SEQ ID NO: 781718 - DNA, 15 bp, Homo sapiens
cctctcccatccccc

SEQ ID NO: 781719 - DNA, 17 bp, Homo sapiens
cctctcccatccccctg

SEQ ID NO: 781720 - DNA, 19 bp, Homo sapiens
cctctcccatccccctgcc

SEQ ID NO: 781721 - DNA, 21 bp, Homo sapiens
cctctccccaatccatgcttc

SEQ ID NO: 781722 - DNA, 22 bp, Homo sapiens
cctctccccaatccatgcttca

SEQ ID NO: 781723 - DNA, 20 bp, Homo sapiens
cctctcccccaaccccctgc

SEQ ID NO: 781724 - DNA, 17 bp, Homo sapiens
cctctccccctcctcca

SEQ ID NO: 781725 - DNA, 20 bp, Homo sapiens
cctctccccctcctccaggg

SEQ ID NO: 781726 - DNA, 14 bp, Homo sapiens
cctctcccccttca

SEQ ID NO: 781727 - DNA, 21 bp, Homo sapiens
cctctcccccttcagctcctg

SEQ ID NO: 781728 - DNA, 17 bp, Homo sapiens
cctctcccctctctgct

SEQ ID NO: 781729 - DNA, 18 bp, Homo sapiens
cctctcccctctctgctc

SEQ ID NO: 781730 - DNA, 11 bp, Homo sapiens
cctctcccctt

SEQ ID NO: 781731 - DNA, 23 bp, Homo sapiens
cctctcccggctgcctgccgccc

SEQ ID NO: 781732 - DNA, 22 bp, Homo sapiens
cctctccctgcactccctcctg

SEQ ID NO: 781733 - DNA, 14 bp, Homo sapiens
cctctccctgggga

SEQ ID NO: 781734 - DNA, 16 bp, Homo sapiens
cctctccctgggtctg

SEQ ID NO: 781735 - DNA, 13 bp, Homo sapiens
cctctccctgttg

SEQ ID NO: 781736 - DNA, 10 bp, Homo sapiens
cctctccctt

SEQ ID NO: 781737 - DNA, 17 bp, Homo sapiens
cctctcccttccctcct

SEQ ID NO: 781738 - DNA, 15 bp, Homo sapiens
cctctcctcaatgct

SEQ ID NO: 781739 - DNA, 20 bp, Homo sapiens
cctctcctcaatgctgggcc

SEQ ID NO: 781740 - DNA, 13 bp, Homo sapiens
cctctcctcccag

SEQ ID NO: 781741 - DNA, 14 bp, Homo sapiens
cctctcctcccagc

SEQ ID NO: 781742 - DNA, 15 bp, Homo sapiens
cctctcctcctcagc

SEQ ID NO: 781743 - DNA, 19 bp, Homo sapiens
cctctcctgcccaagcact

SEQ ID NO: 781744 - DNA, 13 bp, Homo sapiens
cctctcctgccct

SEQ ID NO: 781745 - DNA, 12 bp, Homo sapiens
cctctcctgcct

SEQ ID NO: 781746 - DNA, 16 bp, Homo sapiens
cctctcctgcctactc

SEQ ID NO: 781747 - DNA, 22 bp, Homo sapiens
cctctcctgggggtggcaggca

SEQ ID NO: 781748 - DNA, 23 bp, Homo sapiens
cctctccttcatgacagcctcca

SEQ ID NO: 781749 - DNA, 11 bp, Homo sapiens
cctctccttcc

SEQ ID NO: 781750 - DNA, 17 bp, Homo sapiens
cctctccttcccacaaa

SEQ ID NO: 781751 - DNA, 14 bp, Homo sapiens
cctctccttgggct

SEQ ID NO: 781752 - DNA, 18 bp, Homo sapiens
cctctccttgggctcctg

SEQ ID NO: 781753 - DNA, 13 bp, Homo sapiens
cctctccttttga

SEQ ID NO: 781754 - DNA, 24 bp, Homo sapiens
cctctcgcaagagggtctctttgt

SEQ ID NO: 781755 - DNA, 23 bp, Homo sapiens
cctctcgcacaatgcatgtgctg

SEQ ID NO: 781756 - DNA, 16 bp, Homo sapiens
cctctcgccccatccc

SEQ ID NO: 781757 - DNA, 20 bp, Homo sapiens
cctctcgccccatccctgct

SEQ ID NO: 781758 - DNA, 22 bp, Homo sapiens
cctctcgccccatccctgcttg

SEQ ID NO: 781759 - DNA, 14 bp, Homo sapiens
cctctcgcggccct

SEQ ID NO: 781760 - DNA, 21 bp, Homo sapiens
cctctcggctggaagaacatc

SEQ ID NO: 781761 - DNA, 15 bp, Homo sapiens
cctctctacccccca

SEQ ID NO: 781762 - DNA, 19 bp, Homo sapiens
cctctctcaggagtatctt

SEQ ID NO: 781763 - DNA, 21 bp, Homo sapiens
cctctctcccaccctaagggc

SEQ ID NO: 781764 - DNA, 16 bp, Homo sapiens
cctctctcccatttca

SEQ ID NO: 781765 - DNA, 13 bp, Homo sapiens
cctctctcctctc

SEQ ID NO: 781766 - DNA, 17 bp, Homo sapiens
cctctgggaacctccca

SEQ ID NO: 781767 - DNA, 11 bp, Homo sapiens
cctctgggagt

SEQ ID NO: 781768 - DNA, 21 bp, Homo sapiens
cctctgggagtccccatccca

SEQ ID NO: 781769 - DNA, 19 bp, Homo sapiens
cctctgggcacgcctgctg

SEQ ID NO: 781770 - DNA, 22 bp, Homo sapiens
cctctgggcacgcctgctggcc

SEQ ID NO: 781771 - DNA, 18 bp, Homo sapiens
cctctgggcagcctgctt

SEQ ID NO: 781772 - DNA, 14 bp, Homo sapiens
cctctgggcctggg

SEQ ID NO: 781773 - DNA, 22 bp, Homo sapiens
cctctggggacaggataataaa

SEQ ID NO: 781774 - DNA, 15 bp, Homo sapiens
cctctgggtccctcc

SEQ ID NO: 781775 - DNA, 21 bp, Homo sapiens
cctctggtccttctgacccca

SEQ ID NO: 781776 - DNA, 16 bp, Homo sapiens
cctctggtcgctcctg

SEQ ID NO: 781777 - DNA, 20 bp, Homo sapiens
cctctggtgtgtggtgaggg

SEQ ID NO: 781778 - DNA, 15 bp, Homo sapiens
cctctggttcctttc

SEQ ID NO: 781779 - DNA, 22 bp, Homo sapiens
cctctggttcctttcatctctc

SEQ ID NO: 781780 - DNA, 17 bp, Homo sapiens
cctctggttgcctcccc

SEQ ID NO: 781781 - DNA, 19 bp, Homo sapiens
cctctgtcagtcacagcca

SEQ ID NO: 781782 - DNA, 19 bp, Homo sapiens
cctctgtcatcactccctg

SEQ ID NO: 781783 - DNA, 21 bp, Homo sapiens
cctctgtcatcactccctgga

SEQ ID NO: 781784 - DNA, 22 bp, Homo sapiens
cctctgtcatcactccctggat

SEQ ID NO: 781785 - DNA, 17 bp, Homo sapiens
cctctgtccaggcactg

SEQ ID NO: 781786 - DNA, 14 bp, Homo sapiens
cctctgtccccacg

SEQ ID NO: 781787 - DNA, 18 bp, Homo sapiens
cctctgtccccacgaggg

SEQ ID NO: 781788 - DNA, 14 bp, Homo sapiens
cctctgtccccagg

SEQ ID NO: 781789 - DNA, 17 bp, Homo sapiens
cctctgtccccaggcct

SEQ ID NO: 781790 - DNA, 21 bp, Homo sapiens
cctctgtccccaggcctggct

SEQ ID NO: 781791 - DNA, 17 bp, Homo sapiens
cctctgtcctcccatcc

SEQ ID NO: 781792 - DNA, 22 bp, Homo sapiens
cctctgtcctcccatcccctca

SEQ ID NO: 781793 - DNA, 15 bp, Homo sapiens
cctctgtctaggact

SEQ ID NO: 781794 - DNA, 21 bp, Homo sapiens
cctctgtctaggactgcagtg

SEQ ID NO: 781795 - DNA, 20 bp, Homo sapiens
cctctgtctcatcctcctgg

SEQ ID NO: 781796 - DNA, 15 bp, Homo sapiens
cctctgtctcctccg

SEQ ID NO: 781797 - DNA, 17 bp, Homo sapiens
cctctgtctcctccgtg

SEQ ID NO: 781798 - DNA, 15 bp, Homo sapiens
cctctgtcttctcta

SEQ ID NO: 781799 - DNA, 22 bp, Homo sapiens
cctctgtcttggctttcatgtt

SEQ ID NO: 781800 - DNA, 15 bp, Homo sapiens
cctctgtcttttctc

SEQ ID NO: 781801 - DNA, 15 bp, Homo sapiens
cctctgtgattacat

SEQ ID NO: 781802 - DNA, 19 bp, Homo sapiens
cctctgtgattacatagat

SEQ ID NO: 781803 - DNA, 17 bp, Homo sapiens
cctctgtgcacagtggc

SEQ ID NO: 781804 - DNA, 21 bp, Homo sapiens
cctctgtgccttcttttgatt

SEQ ID NO: 781805 - DNA, 22 bp, Homo sapiens
cctctgtgcttcgactactgct

SEQ ID NO: 781806 - DNA, 12 bp, Homo sapiens
cctctgtggaag

SEQ ID NO: 781807 - DNA, 16 bp, Homo sapiens
cctctgtggaagagat

SEQ ID NO: 781808 - DNA, 20 bp, Homo sapiens
cctctgtggaagagattcct

SEQ ID NO: 781809 - DNA, 14 bp, Homo sapiens
cctctgtggagcgc

SEQ ID NO: 781810 - DNA, 18 bp, Homo sapiens
cctctgtggcctgtctct

SEQ ID NO: 781811 - DNA, 21 bp, Homo sapiens
cctctgtgtagccgccctgag

SEQ ID NO: 781812 - DNA, 22 bp, Homo sapiens
cctctgtgtagccgccctgaga

SEQ ID NO: 781813 - DNA, 20 bp, Homo sapiens
cctctgttaggtccattttc

SEQ ID NO: 781814 - DNA, 21 bp, Homo sapiens
cctctgttcacaaactacctc

SEQ ID NO: 781815 - DNA, 14 bp, Homo sapiens
cctctgttctctcc

SEQ ID NO: 781816 - DNA, 21 bp, Homo sapiens
cctctgttctctcccctcaca

SEQ ID NO: 781817 - DNA, 21 bp, Homo sapiens
cctctgttctgcacacagcac

SEQ ID NO: 781818 - DNA, 19 bp, Homo sapiens
cctcttaagatctgactgc

SEQ ID NO: 781819 - DNA, 21 bp, Homo sapiens
cctcttaatgtatgattacat

SEQ ID NO: 781820 - DNA, 17 bp, Homo sapiens
cctcttaccgtagcctc

SEQ ID NO: 781821 - DNA, 19 bp, Homo sapiens
cctcttaccgtagcctccg

SEQ ID NO: 781822 - DNA, 14 bp, Homo sapiens
cctcttagctgagt

SEQ ID NO: 781823 - DNA, 16 bp, Homo sapiens
cctcttcaaagcagag

SEQ ID NO: 781824 - DNA, 13 bp, Homo sapiens
cctcttcactccc

SEQ ID NO: 781825 - DNA, 16 bp, Homo sapiens
cctcttcactgtggcc

SEQ ID NO: 781826 - DNA, 13 bp, Homo sapiens
cctcttcagaact

SEQ ID NO: 781827 - DNA, 12 bp, Homo sapiens
cctcttccagtc

SEQ ID NO: 781828 - DNA, 23 bp, Homo sapiens
cctcttcccatgactgcacccag

SEQ ID NO: 781829 - DNA, 14 bp, Homo sapiens
cctcttccccagaa

SEQ ID NO: 781830 - DNA, 22 bp, Homo sapiens
cctcttccccagaaaggagact

SEQ ID NO: 781831 - DNA, 16 bp, Homo sapiens
cctcttcccccaagat

SEQ ID NO: 781832 - DNA, 13 bp, Homo sapiens
cctcttccctctg

SEQ ID NO: 781833 - DNA, 15 bp, Homo sapiens
cctcttccctctgat

SEQ ID NO: 781834 - DNA, 22 bp, Homo sapiens
cctcttcccttagcctctccca

SEQ ID NO: 781835 - DNA, 21 bp, Homo sapiens
cctcttcccttcctccattgc

SEQ ID NO: 781836 - DNA, 16 bp, Homo sapiens
cctcttccgagctgct

SEQ ID NO: 781837 - DNA, 18 bp, Homo sapiens
cctcttccgtgacgtcac

SEQ ID NO: 781838 - DNA, 20 bp, Homo sapiens
cctcttcctaccctgcctcc

SEQ ID NO: 781839 - DNA, 16 bp, Homo sapiens
cctcttcctccctggg

SEQ ID NO: 781840 - DNA, 17 bp, Homo sapiens
cctcttcctccctgggg

SEQ ID NO: 781841 - DNA, 11 bp, Homo sapiens
cctcttcctct

SEQ ID NO: 781842 - DNA, 14 bp, Homo sapiens
cctcttcctctggg

SEQ ID NO: 781843 - DNA, 14 bp, Homo sapiens
cctcttcctctggt

SEQ ID NO: 781844 - DNA, 16 bp, Homo sapiens
cctcttcctctggttc

SEQ ID NO: 781845 - DNA, 20 bp, Homo sapiens
cctcttcctcttgaccctgc

SEQ ID NO: 781846 - DNA, 20 bp, Homo sapiens
cctcttcctgacgaaactgg

SEQ ID NO: 781847 - DNA, 13 bp, Homo sapiens
cctcttcctgccc

SEQ ID NO: 781848 - DNA, 15 bp, Homo sapiens
cctcttcctttagga

SEQ ID NO: 781849 - DNA, 14 bp, Homo sapiens
cctcttctacttgt

SEQ ID NO: 781850 - DNA, 16 bp, Homo sapiens
cctcttctcaagtgcc

SEQ ID NO: 781851 - DNA, 17 bp, Homo sapiens
cctcttctcaagtgcct

SEQ ID NO: 781852 - DNA, 19 bp, Homo sapiens
cctcttctcgtgcctcccc

SEQ ID NO: 781853 - DNA, 12 bp, Homo sapiens
cctcttctctcc

SEQ ID NO: 781854 - DNA, 16 bp, Homo sapiens
cctcttctctcctcag

SEQ ID NO: 781855 - DNA, 14 bp, Homo sapiens
cctcttctcttcct

SEQ ID NO: 781856 - DNA, 16 bp, Homo sapiens
cctcttctcttcctgt

SEQ ID NO: 781857 - DNA, 17 bp, Homo sapiens
cctcttctcttcctgta

SEQ ID NO: 781858 - DNA, 14 bp, Homo sapiens
cctcttctgcatct

SEQ ID NO: 781859 - DNA, 15 bp, Homo sapiens
cctcttctgctcctt

SEQ ID NO: 781860 - DNA, 18 bp, Homo sapiens
cctcttctgggagggcag

SEQ ID NO: 781861 - DNA, 19 bp, Homo sapiens
cctcttctgggctactgcc

SEQ ID NO: 781862 - DNA, 20 bp, Homo sapiens
cctcttctgtccctgttaga

SEQ ID NO: 781863 - DNA, 16 bp, Homo sapiens
cctcttcttcttcaga

SEQ ID NO: 781864 - DNA, 18 bp, Homo sapiens
cctcttcttcttttctat

SEQ ID NO: 781865 - DNA, 13 bp, Homo sapiens
cctcttgaccagg

SEQ ID NO: 781866 - DNA, 15 bp, Homo sapiens
cctcttgaccaggct

SEQ ID NO: 781867 - DNA, 16 bp, Homo sapiens
cctcttgaccctgcac

SEQ ID NO: 781868 - DNA, 15 bp, Homo sapiens
cctcttgagcagtgg

SEQ ID NO: 781869 - DNA, 24 bp, Homo sapiens
cctcttgagcagtggctggtccag

SEQ ID NO: 781870 - DNA, 13 bp, Homo sapiens
cctcttgagcctt

SEQ ID NO: 781871 - DNA, 15 bp, Homo sapiens
cctcttgcaggctga

SEQ ID NO: 781872 - DNA, 22 bp, Homo sapiens
cctgacatcatcattcttgtgg

SEQ ID NO: 781873 - DNA, 23 bp, Homo sapiens
cctgaccaaacagccaactagcc

SEQ ID NO: 781874 - DNA, 12 bp, Homo sapiens
cctgaccaccct

SEQ ID NO: 781875 - DNA, 17 bp, Homo sapiens
cctgaccaccctcccct

SEQ ID NO: 781876 - DNA, 21 bp, Homo sapiens
cctgaccaccctcccctctct

SEQ ID NO: 781877 - DNA, 14 bp, Homo sapiens
cctgaccagctgct

SEQ ID NO: 781878 - DNA, 21 bp, Homo sapiens
cctgaccagctgctccgagga

SEQ ID NO: 781879 - DNA, 18 bp, Homo sapiens
cctgacccacggggcagt

SEQ ID NO: 781880 - DNA, 21 bp, Homo sapiens
cctgacccaggccgcagctct

SEQ ID NO: 781881 - DNA, 14 bp, Homo sapiens
cctgacccatccct

SEQ ID NO: 781882 - DNA, 20 bp, Homo sapiens
cctgacccatcccttttcct

SEQ ID NO: 781883 - DNA, 19 bp, Homo sapiens
cctgacccctccctgcagg

SEQ ID NO: 781884 - DNA, 16 bp, Homo sapiens
cctgacccctgctcag

SEQ ID NO: 781885 - DNA, 21 bp, Homo sapiens
cctgaccccttgctcccttca

SEQ ID NO: 781886 - DNA, 12 bp, Homo sapiens
cctgacccgtct

SEQ ID NO: 781887 - DNA, 22 bp, Homo sapiens
cctgacccgtctaatatataaa

SEQ ID NO: 781888 - DNA, 21 bp, Homo sapiens
cctgaccctcctccactccac

SEQ ID NO: 781889 - DNA, 23 bp, Homo sapiens
cctgacctaaattagataaattg

SEQ ID NO: 781890 - DNA, 14 bp, Homo sapiens
cctgacctcaagtg

SEQ ID NO: 781891 - DNA, 13 bp, Homo sapiens
cctgacctcaggt

SEQ ID NO: 781892 - DNA, 19 bp, Homo sapiens
cctgacctcttgctgccag

SEQ ID NO: 781893 - DNA, 21 bp, Homo sapiens
cctgacctcttgctgtctctg

SEQ ID NO: 781894 - DNA, 23 bp, Homo sapiens
cctgacctcttgctgtctctgct

SEQ ID NO: 781895 - DNA, 18 bp, Homo sapiens
cctgacctgtgagcccag

SEQ ID NO: 781896 - DNA, 20 bp, Homo sapiens
cctgacctgtgagcccagct

SEQ ID NO: 781897 - DNA, 21 bp, Homo sapiens
cctgacctgtgagcccagctg

SEQ ID NO: 781898 - DNA, 17 bp, Homo sapiens
cctgaccttagcgttct

SEQ ID NO: 781899 - DNA, 18 bp, Homo sapiens
cctgaccttagcgttctg

SEQ ID NO: 781900 - DNA, 19 bp, Homo sapiens
cctgaccttagcgttctgg

SEQ ID NO: 781901 - DNA, 21 bp, Homo sapiens
cctgaccttagcgttctggac

SEQ ID NO: 781902 - DNA, 24 bp, Homo sapiens
cctgaccttggctgactggggctg

SEQ ID NO: 781903 - DNA, 17 bp, Homo sapiens
cctgacgaaactggccc

SEQ ID NO: 781904 - DNA, 21 bp, Homo sapiens
cctgacgaaactggccccgga

SEQ ID NO: 781905 - DNA, 13 bp, Homo sapiens
cctgacgccctgc

SEQ ID NO: 781906 - DNA, 20 bp, Homo sapiens
cctgacggcgcccccagtgt

SEQ ID NO: 781907 - DNA, 24 bp, Homo sapiens
cctgacggctgccattggtccacc

SEQ ID NO: 781908 - DNA, 13 bp, Homo sapiens
cctgactcattct

SEQ ID NO: 781909 - DNA, 21 bp, Homo sapiens
cctgactccctgtgggggtgg

SEQ ID NO: 781910 - DNA, 13 bp, Homo sapiens
cctgactcctcta

SEQ ID NO: 781911 - DNA, 14 bp, Homo sapiens
cctgactcctgact

SEQ ID NO: 781912 - DNA, 14 bp, Homo sapiens
cctgactcctggac

SEQ ID NO: 781913 - DNA, 16 bp, Homo sapiens
cctgactcctggactc

SEQ ID NO: 781914 - DNA, 13 bp, Homo sapiens
cctgactcctggg

SEQ ID NO: 781915 - DNA, 14 bp, Homo sapiens
cctgactcctgggt

SEQ ID NO: 781916 - DNA, 16 bp, Homo sapiens
cctgactctctgtgac

SEQ ID NO: 781917 - DNA, 18 bp, Homo sapiens
cctgactctctgtgacct

SEQ ID NO: 781918 - DNA, 23 bp, Homo sapiens
cctgactgccaggaccccaggtc

SEQ ID NO: 781919 - DNA, 13 bp, Homo sapiens
cctgactgctcag

SEQ ID NO: 781920 - DNA, 23 bp, Homo sapiens
cctgactggtgctataggctgga

SEQ ID NO: 781921 - DNA, 16 bp, Homo sapiens
cctgactggttgtcag

SEQ ID NO: 781922 - DNA, 18 bp, Homo sapiens
cctgactggttgtcagaa

SEQ ID NO: 781923 - DNA, 19 bp, Homo sapiens
cctgactgtcagggagggc

SEQ ID NO: 781924 - DNA, 20 bp, Homo sapiens
cctgactgtcagggagggcc

SEQ ID NO: 781925 - DNA, 20 bp, Homo sapiens
cctgactgttgccccccagg

SEQ ID NO: 781926 - DNA, 17 bp, Homo sapiens
cctgacttcctctgcca

SEQ ID NO: 781927 - DNA, 15 bp, Homo sapiens
cctgacttctggaga

SEQ ID NO: 781928 - DNA, 12 bp, Homo sapiens
cctgacttgagc

SEQ ID NO: 781929 - DNA, 16 bp, Homo sapiens
cctgacttgagccact

SEQ ID NO: 781930 - DNA, 12 bp, Homo sapiens
cctgacttgagt

SEQ ID NO: 781931 - DNA, 23 bp, Homo sapiens
cctgacttgagtgttccttttta

SEQ ID NO: 781932 - DNA, 18 bp, Homo sapiens
cctgacttttctgtggat

SEQ ID NO: 781933 - DNA, 14 bp, Homo sapiens
cctgagaaagctca

SEQ ID NO: 781934 - DNA, 21 bp, Homo sapiens
cctgagaagaagtggctgcca

SEQ ID NO: 781935 - DNA, 23 bp, Homo sapiens
cctgagaagctgctccaggcctg

SEQ ID NO: 781936 - DNA, 14 bp, Homo sapiens
cctgagaaggcgag

SEQ ID NO: 781937 - DNA, 19 bp, Homo sapiens
cctgagaaggcgaggagag

SEQ ID NO: 781938 - DNA, 17 bp, Homo sapiens
cctgagaatgagtggga

SEQ ID NO: 781939 - DNA, 19 bp, Homo sapiens
cctgagaatgagtgggaat

SEQ ID NO: 781940 - DNA, 22 bp, Homo sapiens
cctgagaatgagtgggaatccg

SEQ ID NO: 781941 - DNA, 14 bp, Homo sapiens
cctgagacagcacc

SEQ ID NO: 781942 - DNA, 21 bp, Homo sapiens
cctgagaccagttgggagcac

SEQ ID NO: 781943 - DNA, 18 bp, Homo sapiens
cctgagaccctgggagag

SEQ ID NO: 781944 - DNA, 19 bp, Homo sapiens
cctgagaccctgggagaga

SEQ ID NO: 781945 - DNA, 23 bp, Homo sapiens
cctgagactcacactctctgcag

SEQ ID NO: 781946 - DNA, 13 bp, Homo sapiens
cctgagactccag

SEQ ID NO: 781947 - DNA, 23 bp, Homo sapiens
cctgagactgtcggagaggctgt

SEQ ID NO: 781948 - DNA, 22 bp, Homo sapiens
cctgagagtcagctctctgccc

SEQ ID NO: 781949 - DNA, 14 bp, Homo sapiens
cctgagagtttcct

SEQ ID NO: 781950 - DNA, 20 bp, Homo sapiens
cctgagagtttcctcagaac

SEQ ID NO: 781951 - DNA, 17 bp, Homo sapiens
cctgagatggagctgcc

SEQ ID NO: 781952 - DNA, 22 bp, Homo sapiens
cctgagattattccttcttcta

SEQ ID NO: 781953 - DNA, 17 bp, Homo sapiens
cctgagattcagatgtc

SEQ ID NO: 781954 - DNA, 13 bp, Homo sapiens
cctgagcaactct

SEQ ID NO: 781955 - DNA, 14 bp, Homo sapiens
cctgagcaactctt

SEQ ID NO: 781956 - DNA, 13 bp, Homo sapiens
cctgagcagggcg

SEQ ID NO: 781957 - DNA, 13 bp, Homo sapiens
cctgagccaagga

SEQ ID NO: 781958 - DNA, 19 bp, Homo sapiens
cctgagcccaaccaggccc

SEQ ID NO: 781959 - DNA, 23 bp, Homo sapiens
cctgagcccaaccaggccctgcc

SEQ ID NO: 781960 - DNA, 15 bp, Homo sapiens
cctgagcccagagaa

SEQ ID NO: 781961 - DNA, 22 bp, Homo sapiens
cctgagccccgccctcttcctg

SEQ ID NO: 781962 - DNA, 23 bp, Homo sapiens
cctgagccccgccctcttcctga

SEQ ID NO: 781963 - DNA, 12 bp, Homo sapiens
cctgagcccctt

SEQ ID NO: 781964 - DNA, 14 bp, Homo sapiens
cctgagccccttcc

SEQ ID NO: 781965 - DNA, 15 bp, Homo sapiens
cctgagccccttcct

SEQ ID NO: 781966 - DNA, 16 bp, Homo sapiens
cctgagccccttcctt

SEQ ID NO: 781967 - DNA, 13 bp, Homo sapiens
cctgagcccggcc

SEQ ID NO: 781968 - DNA, 17 bp, Homo sapiens
cctgagccggccccagg

SEQ ID NO: 781969 - DNA, 14 bp, Homo sapiens
cctgagcgctgtgg

SEQ ID NO: 781970 - DNA, 18 bp, Homo sapiens
cctgagcggaggctcggc

SEQ ID NO: 781971 - DNA, 20 bp, Homo sapiens
cctgagcggcaccctggtct

SEQ ID NO: 781972 - DNA, 21 bp, Homo sapiens
cctgagctattttcctctggc

SEQ ID NO: 781973 - DNA, 15 bp, Homo sapiens
cctgagctcggtgga

SEQ ID NO: 781974 - DNA, 16 bp, Homo sapiens
cctgagctcggtggac

SEQ ID NO: 781975 - DNA, 18 bp, Homo sapiens
cctgagctcggtggaccc

SEQ ID NO: 781976 - DNA, 22 bp, Homo sapiens
cctgagctcggtggacccaggg

SEQ ID NO: 781977 - DNA, 15 bp, Homo sapiens
cctgagctgaggcag

SEQ ID NO: 781978 - DNA, 16 bp, Homo sapiens
cctgagctgaggcagc

SEQ ID NO: 781979 - DNA, 12 bp, Homo sapiens
cctgagctgggg

SEQ ID NO: 781980 - DNA, 13 bp, Homo sapiens
cctgagctgggga

SEQ ID NO: 781981 - DNA, 14 bp, Homo sapiens
cctgagctggggaa

SEQ ID NO: 781982 - DNA, 15 bp, Homo sapiens
cctgagctggggaag

SEQ ID NO: 781983 - DNA, 16 bp, Homo sapiens
cctgagctggggccac

SEQ ID NO: 781984 - DNA, 13 bp, Homo sapiens
cctgaggaggccg

SEQ ID NO: 781985 - DNA, 15 bp, Homo sapiens
cctgaggaggccgct

SEQ ID NO: 781986 - DNA, 20 bp, Homo sapiens
cctgaggaggccgcttagtg

SEQ ID NO: 781987 - DNA, 17 bp, Homo sapiens
cctgaggatgagctgga

SEQ ID NO: 781988 - DNA, 12 bp, Homo sapiens
cctgaggcagga

SEQ ID NO: 781989 - DNA, 22 bp, Homo sapiens
cctgaggccagtggcccccggg

SEQ ID NO: 781990 - DNA, 23 bp, Homo sapiens
cctgaggccctcactgagcctca

SEQ ID NO: 781991 - DNA, 18 bp, Homo sapiens
cctgaggcctagactctg

SEQ ID NO: 781992 - DNA, 21 bp, Homo sapiens
cctgaggcctctggaaagcaa

SEQ ID NO: 781993 - DNA, 17 bp, Homo sapiens
cctgaggcggaggctgt

SEQ ID NO: 781994 - DNA, 22 bp, Homo sapiens
cctgaggcggaggctgtgctcc

SEQ ID NO: 781995 - DNA, 21 bp, Homo sapiens
cctgaggctgagactgcggga

SEQ ID NO: 781996 - DNA, 14 bp, Homo sapiens
cctgaggctgtggt

SEQ ID NO: 781997 - DNA, 17 bp, Homo sapiens
cctgaggctgtggtcac

SEQ ID NO: 781998 - DNA, 13 bp, Homo sapiens
cctgaggcttcac

SEQ ID NO: 781999 - DNA, 20 bp, Homo sapiens
cctgaggctttggatttgac

SEQ ID NO: 782000 - DNA, 21 bp, Homo sapiens
cctgagggcagtaccctccat

SEQ ID NO: 782001 - DNA, 13 bp, Homo sapiens
cctgagggcccct

SEQ ID NO: 782002 - DNA, 14 bp, Homo sapiens
cctgagggcccctc

SEQ ID NO: 782003 - DNA, 16 bp, Homo sapiens
cctgagggcccctctg

SEQ ID NO: 782004 - DNA, 18 bp, Homo sapiens
cctgaggggcatctgccc

SEQ ID NO: 782005 - DNA, 19 bp, Homo sapiens
cctgaggggcatctgcccc

SEQ ID NO: 782006 - DNA, 20 bp, Homo sapiens
cctgaggggcatctgcccct

SEQ ID NO: 782007 - DNA, 14 bp, Homo sapiens
cctgaggggctggg

SEQ ID NO: 782008 - DNA, 19 bp, Homo sapiens
cctgaggggctggggaggg

SEQ ID NO: 782009 - DNA, 20 bp, Homo sapiens
cctgaggggctggggagggg

SEQ ID NO: 782010 - DNA, 13 bp, Homo sapiens
cctgagggtcccc

SEQ ID NO: 782011 - DNA, 14 bp, Homo sapiens
cctgaggtcaggga

SEQ ID NO: 782012 - DNA, 22 bp, Homo sapiens
cctgaggtcagggagtgctggc

SEQ ID NO: 782013 - DNA, 21 bp, Homo sapiens
cctgaggtgggcccaggacca

SEQ ID NO: 782014 - DNA, 19 bp, Homo sapiens
cctgaggtgggctggggct

SEQ ID NO: 782015 - DNA, 19 bp, Homo sapiens
cctgaggtgtgggggctgc

SEQ ID NO: 782016 - DNA, 22 bp, Homo sapiens
cctgaggtgtgggggctgcagc

SEQ ID NO: 782017 - DNA, 21 bp, Homo sapiens
cctgaggttaaacggtgccca

SEQ ID NO: 782018 - DNA, 22 bp, Homo sapiens
cctgagtaccttctacaggccc

SEQ ID NO: 782019 - DNA, 12 bp, Homo sapiens
cctgagtagctg

SEQ ID NO: 782020 - DNA, 13 bp, Homo sapiens
cctgagtagctgg

SEQ ID NO: 782021 - DNA, 19 bp, Homo sapiens
cctgagtagctggattaca

SEQ ID NO: 782022 - DNA, 15 bp, Homo sapiens
cctgagtagctggga

SEQ ID NO: 782023 - DNA, 21 bp, Homo sapiens
cctgagtagctgggattacag

SEQ ID NO: 782024 - DNA, 18 bp, Homo sapiens
cctgagtagctgggcctg

SEQ ID NO: 782025 - DNA, 19 bp, Homo sapiens
cctgagtagctgggcctgt

SEQ ID NO: 782026 - DNA, 23 bp, Homo sapiens
cctgagtagctgggcctgtgcac

SEQ ID NO: 782027 - DNA, 19 bp, Homo sapiens
cctgagtcaactggagcaa

SEQ ID NO: 782028 - DNA, 13 bp, Homo sapiens
cctgagtcaccag

SEQ ID NO: 782029 - DNA, 15 bp, Homo sapiens
cctgagtcaccagga

SEQ ID NO: 782030 - DNA, 15 bp, Homo sapiens
cctgagtcacccatg

SEQ ID NO: 782031 - DNA, 16 bp, Homo sapiens
cctgagtcagtgctct

SEQ ID NO: 782032 - DNA, 17 bp, Homo sapiens
cctgagtccgcctgcgc

SEQ ID NO: 782033 - DNA, 19 bp, Homo sapiens
cctgagtccgcctgcgcct

SEQ ID NO: 782034 - DNA, 14 bp, Homo sapiens
cctgagtcggcccc

SEQ ID NO: 782035 - DNA, 15 bp, Homo sapiens
cctgagtcggcccca

SEQ ID NO: 782036 - DNA, 15 bp, Homo sapiens
cctgagtctcctgtg

SEQ ID NO: 782037 - DNA, 16 bp, Homo sapiens
cctgagtctcctgtgc

SEQ ID NO: 782038 - DNA, 17 bp, Homo sapiens
cctgagtctggacctcc

SEQ ID NO: 782039 - DNA, 22 bp, Homo sapiens
cctgagtgccccacttctggcc

SEQ ID NO: 782040 - DNA, 17 bp, Homo sapiens
cctgagtgcgggctgag

SEQ ID NO: 782041 - DNA, 19 bp, Homo sapiens
cctgagtgcgggctgaggc

SEQ ID NO: 782042 - DNA, 23 bp, Homo sapiens
cctgagtgcgggctgaggccaga

SEQ ID NO: 782043 - DNA, 13 bp, Homo sapiens
cctgagtggatct

SEQ ID NO: 782044 - DNA, 18 bp, Homo sapiens
cctgagtggatctccaag

SEQ ID NO: 782045 - DNA, 15 bp, Homo sapiens
cctgagtggtcactg

SEQ ID NO: 782046 - DNA, 20 bp, Homo sapiens
cctgagttcatccaggccca

SEQ ID NO: 782047 - DNA, 17 bp, Homo sapiens
cctgagttgggcagcca

SEQ ID NO: 782048 - DNA, 13 bp, Homo sapiens
cctgagtttggga

SEQ ID NO: 782049 - DNA, 15 bp, Homo sapiens
cctgagtttgggaga

SEQ ID NO: 782050 - DNA, 19 bp, Homo sapiens
cctgagtttgggagagtgg

SEQ ID NO: 782051 - DNA, 15 bp, Homo sapiens
cctgatataaatgca

SEQ ID NO: 782052 - DNA, 19 bp, Homo sapiens
cctgatcagaccacggctc

SEQ ID NO: 782053 - DNA, 17 bp, Homo sapiens
cctgatccagcctttcc

SEQ ID NO: 782054 - DNA, 14 bp, Homo sapiens
cctgatcccacccc

SEQ ID NO: 782055 - DNA, 15 bp, Homo sapiens
cctgatcccaccccc

SEQ ID NO: 782056 - DNA, 21 bp, Homo sapiens
cctgatcccagacccattcct

SEQ ID NO: 782057 - DNA, 12 bp, Homo sapiens
cctgatccctga

SEQ ID NO: 782058 - DNA, 22 bp, Homo sapiens
cctgatccctgaacccctggcc

SEQ ID NO: 782059 - DNA, 18 bp, Homo sapiens
cctgatctctgacctctg

SEQ ID NO: 782060 - DNA, 15 bp, Homo sapiens
cctgatctcttcctg

SEQ ID NO: 782061 - DNA, 13 bp, Homo sapiens
cctgatctggacc

SEQ ID NO: 782062 - DNA, 14 bp, Homo sapiens
cctgatctgtgata

SEQ ID NO: 782063 - DNA, 22 bp, Homo sapiens
cctgatgaaaaatatgtgcttg

SEQ ID NO: 782064 - DNA, 13 bp, Homo sapiens
cctgatgacagag

SEQ ID NO: 782065 - DNA, 16 bp, Homo sapiens
cctgatgagattttta

SEQ ID NO: 782066 - DNA, 13 bp, Homo sapiens
cctgatgcagcct

SEQ ID NO: 782067 - DNA, 17 bp, Homo sapiens
cctgatgcagcctgtgg

SEQ ID NO: 782068 - DNA, 18 bp, Homo sapiens
cctgatgcccaggtcacc

SEQ ID NO: 782069 - DNA, 12 bp, Homo sapiens
cctgatgcccct

SEQ ID NO: 782070 - DNA, 19 bp, Homo sapiens
cctgatgccctcttctcct

SEQ ID NO: 782071 - DNA, 13 bp, Homo sapiens
cctgatgctccct

SEQ ID NO: 782072 - DNA, 23 bp, Homo sapiens
cctgatgctgacattcacctgcc

SEQ ID NO: 782073 - DNA, 13 bp, Homo sapiens
cctgatggaccct

SEQ ID NO: 782074 - DNA, 16 bp, Homo sapiens
cctgatggagtgtgca

SEQ ID NO: 782075 - DNA, 21 bp, Homo sapiens
cctgatggagtgtgcagacag

SEQ ID NO: 782076 - DNA, 22 bp, Homo sapiens
cctgatggagtgtgcagacagc

SEQ ID NO: 782077 - DNA, 14 bp, Homo sapiens
cctgatggccaaga

SEQ ID NO: 782078 - DNA, 17 bp, Homo sapiens
cctgatggccaagagca

SEQ ID NO: 782079 - DNA, 19 bp, Homo sapiens
cctgatggcctttggaccc

SEQ ID NO: 782080 - DNA, 21 bp, Homo sapiens
cctgatggcctttggacccag

SEQ ID NO: 782081 - DNA, 22 bp, Homo sapiens
cctgatggtgtcattctgcctg

SEQ ID NO: 782082 - DNA, 18 bp, Homo sapiens
cctgatgtagcttgagat

SEQ ID NO: 782083 - DNA, 23 bp, Homo sapiens
cctgattaaaaagggagaaagaa

SEQ ID NO: 782084 - DNA, 22 bp, Homo sapiens
cctgattaccagtctgattata

SEQ ID NO: 782085 - DNA, 18 bp, Homo sapiens
cctgattcatactccttt

SEQ ID NO: 782086 - DNA, 15 bp, Homo sapiens
cctgattccaaatat

SEQ ID NO: 782087 - DNA, 20 bp, Homo sapiens
cctgattcttgattcctggc

SEQ ID NO: 782088 - DNA, 19 bp, Homo sapiens
cctgattgatcacacagtg

SEQ ID NO: 782089 - DNA, 18 bp, Homo sapiens
cctgatttagatatgcaa

SEQ ID NO: 782090 - DNA, 16 bp, Homo sapiens
cctgatttcagaagag

SEQ ID NO: 782091 - DNA, 18 bp, Homo sapiens
cctgatttcttattgaat

SEQ ID NO: 782092 - DNA, 15 bp, Homo sapiens
cctgatttcttcagg

SEQ ID NO: 782093 - DNA, 15 bp, Homo sapiens
cctgcaaaaatataa

SEQ ID NO: 782094 - DNA, 22 bp, Homo sapiens
cctgcaaaaattcagagtcctt

SEQ ID NO: 782095 - DNA, 21 bp, Homo sapiens
cctgcaaacagaacagggtca

SEQ ID NO: 782096 - DNA, 17 bp, Homo sapiens
cctgcaaaccttcctgg

SEQ ID NO: 782097 - DNA, 14 bp, Homo sapiens
cctgcaaactcact

SEQ ID NO: 782098 - DNA, 17 bp, Homo sapiens
cctgcaaactcactgct

SEQ ID NO: 782099 - DNA, 23 bp, Homo sapiens
cctgcaaaggcccttgtcattgc

SEQ ID NO: 782100 - DNA, 18 bp, Homo sapiens
cctgcaagaccacggagg

SEQ ID NO: 782101 - DNA, 21 bp, Homo sapiens
cctgcaagccccagggcctgg

SEQ ID NO: 782102 - DNA, 14 bp, Homo sapiens
cctgcaatgaaagg

SEQ ID NO: 782103 - DNA, 22 bp, Homo sapiens
cctgcacaaagcccttccatgt

SEQ ID NO: 782104 - DNA, 20 bp, Homo sapiens
cctgcacaataaaaatgttt

SEQ ID NO: 782105 - DNA, 21 bp, Homo sapiens
cctgcacacagaatgctcagg

SEQ ID NO: 782106 - DNA, 14 bp, Homo sapiens
cctgcacacaggac

SEQ ID NO: 782107 - DNA, 14 bp, Homo sapiens
cctgcacacagggc

SEQ ID NO: 782108 - DNA, 17 bp, Homo sapiens
cctgcacagatacctca

SEQ ID NO: 782109 - DNA, 19 bp, Homo sapiens
cctgcacagatacctcatc

SEQ ID NO: 782110 - DNA, 20 bp, Homo sapiens
cctgcacagatacctcatca

SEQ ID NO: 782111 - DNA, 20 bp, Homo sapiens
cctgcacagtgacttctgag

SEQ ID NO: 782112 - DNA, 22 bp, Homo sapiens
cctgcacagtgacttctgagat

SEQ ID NO: 782113 - DNA, 21 bp, Homo sapiens
cctgcaccccagcattccagc

SEQ ID NO: 782114 - DNA, 22 bp, Homo sapiens
cctgcaccccagcattccagct

SEQ ID NO: 782115 - DNA, 15 bp, Homo sapiens
cctgcaccctggaaa

SEQ ID NO: 782116 - DNA, 20 bp, Homo sapiens
cctgcaccctggaaagggga

SEQ ID NO: 782117 - DNA, 17 bp, Homo sapiens
cctgcaccgaccccggg

SEQ ID NO: 782118 - DNA, 22 bp, Homo sapiens
cctgcaccgaccccgggccgga

SEQ ID NO: 782119 - DNA, 21 bp, Homo sapiens
cctgcaccgccgcagaagcag

SEQ ID NO: 782120 - DNA, 19 bp, Homo sapiens
cctgcaccgccgccaccct

SEQ ID NO: 782121 - DNA, 18 bp, Homo sapiens
cctgcacctccccccact

SEQ ID NO: 782122 - DNA, 19 bp, Homo sapiens
cctgcacctccccccactg

SEQ ID NO: 782123 - DNA, 23 bp, Homo sapiens
cctgcacctgctgcgtccccact

SEQ ID NO: 782124 - DNA, 14 bp, Homo sapiens
cctgcacctggcct

SEQ ID NO: 782125 - DNA, 16 bp, Homo sapiens
cctgcacctggcctgg

SEQ ID NO: 782126 - DNA, 14 bp, Homo sapiens
cctgcacctgtgca

SEQ ID NO: 782127 - DNA, 15 bp, Homo sapiens
cctgcacctgtgcag

SEQ ID NO: 782128 - DNA, 14 bp, Homo sapiens
cctgcactaaagcc

SEQ ID NO: 782129 - DNA, 20 bp, Homo sapiens
cctgcactaaagccagcctg

SEQ ID NO: 782130 - DNA, 17 bp, Homo sapiens
cctgcactaacagagtg

SEQ ID NO: 782131 - DNA, 21 bp, Homo sapiens
cctgcactccctcctggagct

SEQ ID NO: 782132 - DNA, 19 bp, Homo sapiens
cctgcactccctggccttg

SEQ ID NO: 782133 - DNA, 19 bp, Homo sapiens
cctgcactgaaacctgaga

SEQ ID NO: 782134 - DNA, 19 bp, Homo sapiens
cctgcactgggaaggaaac

SEQ ID NO: 782135 - DNA, 17 bp, Homo sapiens
cctgcagaagccagaag

SEQ ID NO: 782136 - DNA, 23 bp, Homo sapiens
cctgcagacacctggactgagcc

SEQ ID NO: 782137 - DNA, 18 bp, Homo sapiens
cctgcagacctcaagcca

SEQ ID NO: 782138 - DNA, 20 bp, Homo sapiens
cctgcagacctcaagccatc

SEQ ID NO: 782139 - DNA, 16 bp, Homo sapiens
cctgcagagagaagcc

SEQ ID NO: 782140 - DNA, 18 bp, Homo sapiens
cctgcagagcaataacac

SEQ ID NO: 782141 - DNA, 21 bp, Homo sapiens
cctgcagagcaataacactat

SEQ ID NO: 782142 - DNA, 16 bp, Homo sapiens
cctgcagaggaccaca

SEQ ID NO: 782143 - DNA, 19 bp, Homo sapiens
cctgcagaggggaaaccag

SEQ ID NO: 782144 - DNA, 15 bp, Homo sapiens
cctgcagagtagtta

SEQ ID NO: 782145 - DNA, 24 bp, Homo sapiens
cctgcagcaaacactccaccctcc

SEQ ID NO: 782146 - DNA, 12 bp, Homo sapiens
cctgcagcacat

SEQ ID NO: 782147 - DNA, 23 bp, Homo sapiens
cctgcagcatggtccctgcctta

SEQ ID NO: 782148 - DNA, 13 bp, Homo sapiens
cctgcagccagct

SEQ ID NO: 782149 - DNA, 13 bp, Homo sapiens
cctgcagcccacc

SEQ ID NO: 782150 - DNA, 18 bp, Homo sapiens
cctgcagcccaccagacg

SEQ ID NO: 782151 - DNA, 22 bp, Homo sapiens
cctgcagccccgcgcctccttc

SEQ ID NO: 782152 - DNA, 15 bp, Homo sapiens
cctgcagcctcctcc

SEQ ID NO: 782153 - DNA, 11 bp, Homo sapiens
cctgcagcctg

SEQ ID NO: 782154 - DNA, 16 bp, Homo sapiens
cctgcagcctgcagga

SEQ ID NO: 782155 - DNA, 12 bp, Homo sapiens
cctgcagcctgg

SEQ ID NO: 782156 - DNA, 13 bp, Homo sapiens
cctgcagcctggg

SEQ ID NO: 782157 - DNA, 14 bp, Homo sapiens
cctgcagcctgggt

SEQ ID NO: 782158 - DNA, 23 bp, Homo sapiens
cctgcagcctgggtctggatggg

SEQ ID NO: 782159 - DNA, 20 bp, Homo sapiens
cctgcagcgcctcccttgtc

SEQ ID NO: 782160 - DNA, 16 bp, Homo sapiens
cctgcagcgggcaaag

SEQ ID NO: 782161 - DNA, 19 bp, Homo sapiens
cctgcaggaacgagcactg

SEQ ID NO: 782162 - DNA, 22 bp, Homo sapiens
cctgcaggaacgagcactggcc

SEQ ID NO: 782163 - DNA, 13 bp, Homo sapiens
cctgcaggaccct

SEQ ID NO: 782164 - DNA, 22 bp, Homo sapiens
cctgcaggaccctgtcctgcag

SEQ ID NO: 782165 - DNA, 17 bp, Homo sapiens
cctgcaggacctcgtgc

SEQ ID NO: 782166 - DNA, 18 bp, Homo sapiens
cctgcaggagagagcagc

SEQ ID NO: 782167 - DNA, 23 bp, Homo sapiens
cctgcaggagagagcagcactcc

SEQ ID NO: 782168 - DNA, 14 bp, Homo sapiens
cctgcaggcacaga

SEQ ID NO: 782169 - DNA, 15 bp, Homo sapiens
cctgcaggcagagct

SEQ ID NO: 782170 - DNA, 17 bp, Homo sapiens
cctgcaggcagagctgg

SEQ ID NO: 782171 - DNA, 23 bp, Homo sapiens
cctgcaggcaggaacaaacaggg

SEQ ID NO: 782172 - DNA, 16 bp, Homo sapiens
cctgcaggccaagagc

SEQ ID NO: 782173 - DNA, 21 bp, Homo sapiens
cctgcaggctgcaggagggca

SEQ ID NO: 782174 - DNA, 17 bp, Homo sapiens
cctgcaggctggagact

SEQ ID NO: 782175 - DNA, 19 bp, Homo sapiens
cctgcagggcgcccctggg

SEQ ID NO: 782176 - DNA, 14 bp, Homo sapiens
cctgcaggggagca

SEQ ID NO: 782177 - DNA, 11 bp, Homo sapiens
cctgcaggggg

SEQ ID NO: 782178 - DNA, 21 bp, Homo sapiens
cctgcagggtggtgctgggac

SEQ ID NO: 782179 - DNA, 22 bp, Homo sapiens
cctgcagggtggtgctgggact

SEQ ID NO: 782180 - DNA, 17 bp, Homo sapiens
cctgcaggtcagttgta

SEQ ID NO: 782181 - DNA, 23 bp, Homo sapiens
cctgcaggtcagttgtaataaat

SEQ ID NO: 782182 - DNA, 17 bp, Homo sapiens
cctgcagtgaggggccc

SEQ ID NO: 782183 - DNA, 21 bp, Homo sapiens
cctgcagtgaggggccctcca

SEQ ID NO: 782184 - DNA, 15 bp, Homo sapiens
cctgcagttcctgag

SEQ ID NO: 782185 - DNA, 17 bp, Homo sapiens
cctgcagtttggccctg

SEQ ID NO: 782186 - DNA, 18 bp, Homo sapiens
cctgcagtttggccctgg

SEQ ID NO: 782187 - DNA, 21 bp, Homo sapiens
cctgcagtttggccctggagc

SEQ ID NO: 782188 - DNA, 24 bp, Homo sapiens
cctgcagtttggccctggagccag

SEQ ID NO: 782189 - DNA, 13 bp, Homo sapiens
cctgcatctaagc

SEQ ID NO: 782190 - DNA, 20 bp, Homo sapiens
cctgcatctaagcatctggg

SEQ ID NO: 782191 - DNA, 15 bp, Homo sapiens
cctgcatggagaagg

SEQ ID NO: 782192 - DNA, 10 bp, Homo sapiens
cctgcatggg

SEQ ID NO: 782193 - DNA, 19 bp, Homo sapiens
cctgcatggggcagaggct

SEQ ID NO: 782194 - DNA, 14 bp, Homo sapiens
cctgcattcatgta

SEQ ID NO: 782195 - DNA, 23 bp, Homo sapiens
cctgcattctgcacgctgcccag

SEQ ID NO: 782196 - DNA, 14 bp, Homo sapiens
cctgcatttctgag

SEQ ID NO: 782197 - DNA, 15 bp, Homo sapiens
cctgcattttcctct

SEQ ID NO: 782198 - DNA, 17 bp, Homo sapiens
cctgcattttcctcttg

SEQ ID NO: 782199 - DNA, 22 bp, Homo sapiens
cctgcattttcctcttgtcctg

SEQ ID NO: 782200 - DNA, 12 bp, Homo sapiens
cctgccaaagta

SEQ ID NO: 782201 - DNA, 21 bp, Homo sapiens
cctgccaaagtgcctgggaag

SEQ ID NO: 782202 - DNA, 22 bp, Homo sapiens
cctgccaaagtgcctgggaagc

SEQ ID NO: 782203 - DNA, 21 bp, Homo sapiens
cctgccacactgatggctcaa

SEQ ID NO: 782204 - DNA, 12 bp, Homo sapiens
cctgccacagcc

SEQ ID NO: 782205 - DNA, 13 bp, Homo sapiens
cctgccacagcca

SEQ ID NO: 782206 - DNA, 18 bp, Homo sapiens
cctgccacagccagagga

SEQ ID NO: 782207 - DNA, 13 bp, Homo sapiens
cctgccaccagca

SEQ ID NO: 782208 - DNA, 14 bp, Homo sapiens
cctgccaccagcat

SEQ ID NO: 782209 - DNA, 13 bp, Homo sapiens
cctgccaccaggg

SEQ ID NO: 782210 - DNA, 14 bp, Homo sapiens
cctgccaccaggga

SEQ ID NO: 782211 - DNA, 14 bp, Homo sapiens
cctgccaccagtca

SEQ ID NO: 782212 - DNA, 13 bp, Homo sapiens
cctgccaccccca

SEQ ID NO: 782213 - DNA, 14 bp, Homo sapiens
cctgccacccccag

SEQ ID NO: 782214 - DNA, 14 bp, Homo sapiens
cctgccacctccct

SEQ ID NO: 782215 - DNA, 16 bp, Homo sapiens
cctgccacctccctga

SEQ ID NO: 782216 - DNA, 23 bp, Homo sapiens
cctgccacgtcccgctgcctcct

SEQ ID NO: 782217 - DNA, 16 bp, Homo sapiens
cctgccactcactagg

SEQ ID NO: 782218 - DNA, 21 bp, Homo sapiens
cctgccactctctgggactct

SEQ ID NO: 782219 - DNA, 22 bp, Homo sapiens
cctgccactctctgggactctc

SEQ ID NO: 782220 - DNA, 12 bp, Homo sapiens
cctgccagacac

SEQ ID NO: 782221 - DNA, 22 bp, Homo sapiens
cctgccagcaggccagggactc

SEQ ID NO: 782222 - DNA, 15 bp, Homo sapiens
cctgccagccgaccc

SEQ ID NO: 782223 - DNA, 17 bp, Homo sapiens
cctgccagcctggcttc

SEQ ID NO: 782224 - DNA, 17 bp, Homo sapiens
cctgccagctgccttcc

SEQ ID NO: 782225 - DNA, 21 bp, Homo sapiens
cctgccaggagctttggacct

SEQ ID NO: 782226 - DNA, 13 bp, Homo sapiens
cctgccaggcaca

SEQ ID NO: 782227 - DNA, 12 bp, Homo sapiens
cctgccaggccg

SEQ ID NO: 782228 - DNA, 19 bp, Homo sapiens
cctgccagggcagggcccc

SEQ ID NO: 782229 - DNA, 19 bp, Homo sapiens
cctgccagggtgagcaggg

SEQ ID NO: 782230 - DNA, 21 bp, Homo sapiens
cctgccagtgaagtccttcag

SEQ ID NO: 782231 - DNA, 16 bp, Homo sapiens
cctgccagtgccaggg

SEQ ID NO: 782232 - DNA, 13 bp, Homo sapiens
cctgccagtgcct

SEQ ID NO: 782233 - DNA, 17 bp, Homo sapiens
cctgccagtgccttacc

SEQ ID NO: 782234 - DNA, 23 bp, Homo sapiens
cctgccagtgccttacctcctgc

SEQ ID NO: 782235 - DNA, 15 bp, Homo sapiens
cctgccatcttccca

SEQ ID NO: 782236 - DNA, 18 bp, Homo sapiens
cctgccatcttcccagca

SEQ ID NO: 782237 - DNA, 19 bp, Homo sapiens
cctgccatgccaggaacct

SEQ ID NO: 782238 - DNA, 16 bp, Homo sapiens
cctgccattggcctct

SEQ ID NO: 782239 - DNA, 19 bp, Homo sapiens
cctgccattggcctcttgt

SEQ ID NO: 782240 - DNA, 18 bp, Homo sapiens
cctgccatttaaaaagtt

SEQ ID NO: 782241 - DNA, 15 bp, Homo sapiens
cctgcccaaaccctt

SEQ ID NO: 782242 - DNA, 22 bp, Homo sapiens
cctgcccaaactccccttccct

SEQ ID NO: 782243 - DNA, 23 bp, Homo sapiens
cctgcccaaactccccttccctg

SEQ ID NO: 782244 - DNA, 15 bp, Homo sapiens
cctgcccaagtgacc

SEQ ID NO: 782245 - DNA, 21 bp, Homo sapiens
cctgcccaatgctttgggagg

SEQ ID NO: 782246 - DNA, 16 bp, Homo sapiens
cctgcccacccccggg

SEQ ID NO: 782247 - DNA, 17 bp, Homo sapiens
cctgcccacccccggga

SEQ ID NO: 782248 - DNA, 12 bp, Homo sapiens
cctgcccacccg

SEQ ID NO: 782249 - DNA, 13 bp, Homo sapiens
cctgcccacctct

SEQ ID NO: 782250 - DNA, 15 bp, Homo sapiens
cctgcccacctctcc

SEQ ID NO: 782251 - DNA, 13 bp, Homo sapiens
cctgcccagacaa

SEQ ID NO: 782252 - DNA, 15 bp, Homo sapiens
cctgcccagacaaga

SEQ ID NO: 782253 - DNA, 14 bp, Homo sapiens
cctgcccagactga

SEQ ID NO: 782254 - DNA, 20 bp, Homo sapiens
cctgcccagatgccctttgg

SEQ ID NO: 782255 - DNA, 13 bp, Homo sapiens
cctgcccagccac

SEQ ID NO: 782256 - DNA, 14 bp, Homo sapiens
cctgcccagccacc

SEQ ID NO: 782257 - DNA, 13 bp, Homo sapiens
cctgcccagcctc

SEQ ID NO: 782258 - DNA, 14 bp, Homo sapiens
cctgcccagctccc

SEQ ID NO: 782259 - DNA, 22 bp, Homo sapiens
cctgcccaggtggcctcctggc

SEQ ID NO: 782260 - DNA, 12 bp, Homo sapiens
cctgcccatgtg

SEQ ID NO: 782261 - DNA, 22 bp, Homo sapiens
cctgcccatgtgtcccctcact

SEQ ID NO: 782262 - DNA, 23 bp, Homo sapiens
cctgccccaaataacttcagtcc

SEQ ID NO: 782263 - DNA, 21 bp, Homo sapiens
cctgccccaactctcccctga

SEQ ID NO: 782264 - DNA, 19 bp, Homo sapiens
cctgccccacacctcctct

SEQ ID NO: 782265 - DNA, 21 bp, Homo sapiens
cctgccccacccaccccacag

SEQ ID NO: 782266 - DNA, 13 bp, Homo sapiens
cctgccccacccc

SEQ ID NO: 782267 - DNA, 21 bp, Homo sapiens
cctgccccaccccatccagcc

SEQ ID NO: 782268 - DNA, 24 bp, Homo sapiens
cctgccccaccccatccagccaga

SEQ ID NO: 782269 - DNA, 12 bp, Homo sapiens
cctgccccagcc

SEQ ID NO: 782270 - DNA, 14 bp, Homo sapiens
cctgccccagcccc

SEQ ID NO: 782271 - DNA, 20 bp, Homo sapiens
cctgccccagcccctaagcc

SEQ ID NO: 782272 - DNA, 12 bp, Homo sapiens
cctgccccaggc

SEQ ID NO: 782273 - DNA, 14 bp, Homo sapiens
cctgccccaggcct

SEQ ID NO: 782274 - DNA, 18 bp, Homo sapiens
cctgccccaggcctggac

SEQ ID NO: 782275 - DNA, 17 bp, Homo sapiens
cctgccccagggctccc

SEQ ID NO: 782276 - DNA, 16 bp, Homo sapiens
cctgcccccaatccat

SEQ ID NO: 782277 - DNA, 17 bp, Homo sapiens
cctgcccccacttcctg

SEQ ID NO: 782278 - DNA, 18 bp, Homo sapiens
cctgcccccagccccggg

SEQ ID NO: 782279 - DNA, 14 bp, Homo sapiens
cctgcccccatctc

SEQ ID NO: 782280 - DNA, 22 bp, Homo sapiens
cctgcccccatctccccaggcc

SEQ ID NO: 782281 - DNA, 15 bp, Homo sapiens
cctgccccccagcct

SEQ ID NO: 782282 - DNA, 22 bp, Homo sapiens
cctgccccctatcttgtcctgg

SEQ ID NO: 782283 - DNA, 13 bp, Homo sapiens
cctgccccctgcc

SEQ ID NO: 782284 - DNA, 15 bp, Homo sapiens
cctgccccctgccag

SEQ ID NO: 782285 - DNA, 16 bp, Homo sapiens
cctgccccctgccagt

SEQ ID NO: 782286 - DNA, 13 bp, Homo sapiens
cctgccccctggt

SEQ ID NO: 782287 - DNA, 15 bp, Homo sapiens
cctgccccctggtgg

SEQ ID NO: 782288 - DNA, 23 bp, Homo sapiens
cctgcccccttctcccacactgc

SEQ ID NO: 782289 - DNA, 13 bp, Homo sapiens
cctgccccgcccc

SEQ ID NO: 782290 - DNA, 17 bp, Homo sapiens
cctgccccgccccccag

SEQ ID NO: 782291 - DNA, 22 bp, Homo sapiens
cctgccccgccccccagagcca

SEQ ID NO: 782292 - DNA, 14 bp, Homo sapiens
cctgccccgcgggt

SEQ ID NO: 782293 - DNA, 20 bp, Homo sapiens
cctgccccggacctacctcc

SEQ ID NO: 782294 - DNA, 21 bp, Homo sapiens
cctgccccggacctacctccc

SEQ ID NO: 782295 - DNA, 23 bp, Homo sapiens
cctgccccgtcaccatctcaggc

SEQ ID NO: 782296 - DNA, 22 bp, Homo sapiens
cctgccccgtcggactgccccc

SEQ ID NO: 782297 - DNA, 18 bp, Homo sapiens
cctgcccctcccttcaac

SEQ ID NO: 782298 - DNA, 16 bp, Homo sapiens
cctgcccctctcccgc

SEQ ID NO: 782299 - DNA, 12 bp, Homo sapiens
cctgcccctctt

SEQ ID NO: 782300 - DNA, 16 bp, Homo sapiens
cctgcccggggagctg

SEQ ID NO: 782301 - DNA, 17 bp, Homo sapiens
cctgcccggggagctgc

SEQ ID NO: 782302 - DNA, 22 bp, Homo sapiens
cctgcccggggagctgcagagc

SEQ ID NO: 782303 - DNA, 22 bp, Homo sapiens
cctgccctagagcacactgtag

SEQ ID NO: 782304 - DNA, 13 bp, Homo sapiens
cctgccctcaagg

SEQ ID NO: 782305 - DNA, 12 bp, Homo sapiens
cctgccctcact

SEQ ID NO: 782306 - DNA, 13 bp, Homo sapiens
cctgccctcactc

SEQ ID NO: 782307 - DNA, 21 bp, Homo sapiens
cctgccctcatggcccctctg

SEQ ID NO: 782308 - DNA, 19 bp, Homo sapiens
cctgccctcccgcaccttc

SEQ ID NO: 782309 - DNA, 14 bp, Homo sapiens
cctgccctccctca

SEQ ID NO: 782310 - DNA, 13 bp, Homo sapiens
cctgccctccgga

SEQ ID NO: 782311 - DNA, 14 bp, Homo sapiens
cctgccctccggag

SEQ ID NO: 782312 - DNA, 16 bp, Homo sapiens
cctgccctccggagga

SEQ ID NO: 782313 - DNA, 19 bp, Homo sapiens
cctgccctcgtggccagcc

SEQ ID NO: 782314 - DNA, 12 bp, Homo sapiens
cctgccctctgc

SEQ ID NO: 782315 - DNA, 13 bp, Homo sapiens
cctgccctgcacg

SEQ ID NO: 782316 - DNA, 13 bp, Homo sapiens
cctgccctgcagc

SEQ ID NO: 782317 - DNA, 14 bp, Homo sapiens
cctgccctgcccaa

SEQ ID NO: 782318 - DNA, 18 bp, Homo sapiens
cctgccctgcccaagtga

SEQ ID NO: 782319 - DNA, 15 bp, Homo sapiens
cctgccctgccccca

SEQ ID NO: 782320 - DNA, 15 bp, Homo sapiens
cctgccctgcctcag

SEQ ID NO: 782321 - DNA, 15 bp, Homo sapiens
cctgccctgccttgc

SEQ ID NO: 782322 - DNA, 13 bp, Homo sapiens
cctgccctgctcc

SEQ ID NO: 782323 - DNA, 15 bp, Homo sapiens
cctgccctgctccta

SEQ ID NO: 782324 - DNA, 13 bp, Homo sapiens
cctgccctgctgc

SEQ ID NO: 782325 - DNA, 12 bp, Homo sapiens
cctgccctggtc

SEQ ID NO: 782326 - DNA, 23 bp, Homo sapiens
cctgccctgtgccgcactctggc

SEQ ID NO: 782327 - DNA, 17 bp, Homo sapiens
cctgcccttccctctgg

SEQ ID NO: 782328 - DNA, 20 bp, Homo sapiens
cctgcccttcctcagggccc

SEQ ID NO: 782329 - DNA, 16 bp, Homo sapiens
cctgcccttcctcctg

SEQ ID NO: 782330 - DNA, 15 bp, Homo sapiens
cctgcccttctgacc

SEQ ID NO: 782331 - DNA, 20 bp, Homo sapiens
cctgcccttggcaccaccag

SEQ ID NO: 782332 - DNA, 22 bp, Homo sapiens
cctgcccttggcaccaccaggg

SEQ ID NO: 782333 - DNA, 15 bp, Homo sapiens
cctgccgcatgctcc

SEQ ID NO: 782334 - DNA, 18 bp, Homo sapiens
cctgccgctgcaggaaac

SEQ ID NO: 782335 - DNA, 19 bp, Homo sapiens
cctgccgggctgagggcct

SEQ ID NO: 782336 - DNA, 21 bp, Homo sapiens
cctgccgggctgagggcctgc

SEQ ID NO: 782337 - DNA, 23 bp, Homo sapiens
cctgccgtcaccaccacccctac

SEQ ID NO: 782338 - DNA, 15 bp, Homo sapiens
cctgccgtgcatggc

SEQ ID NO: 782339 - DNA, 18 bp, Homo sapiens
cctgcctaaggttgtcta

SEQ ID NO: 782340 - DNA, 13 bp, Homo sapiens
cctgcctcaccca

SEQ ID NO: 782341 - DNA, 16 bp, Homo sapiens
cctgcctcacccacac

SEQ ID NO: 782342 - DNA, 14 bp, Homo sapiens
cctgcctcagccag

SEQ ID NO: 782343 - DNA, 16 bp, Homo sapiens
cctggctgctgccccc

SEQ ID NO: 782344 - DNA, 17 bp, Homo sapiens
cctggctgctgccccca

SEQ ID NO: 782345 - DNA, 16 bp, Homo sapiens
cctggctgctgcttct

SEQ ID NO: 782346 - DNA, 18 bp, Homo sapiens
cctggctgctgcttcttg

SEQ ID NO: 782347 - DNA, 18 bp, Homo sapiens
cctggctggaggagcagc

SEQ ID NO: 782348 - DNA, 14 bp, Homo sapiens
cctggctgtactgc

SEQ ID NO: 782349 - DNA, 16 bp, Homo sapiens
cctggctgtctgaggc

SEQ ID NO: 782350 - DNA, 21 bp, Homo sapiens
cctggctgtgcccagcaggcc

SEQ ID NO: 782351 - DNA, 23 bp, Homo sapiens
cctggctgtgcccagcaggccca

SEQ ID NO: 782352 - DNA, 13 bp, Homo sapiens
cctggctgtggag

SEQ ID NO: 782353 - DNA, 14 bp, Homo sapiens
cctggctgtggagg

SEQ ID NO: 782354 - DNA, 21 bp, Homo sapiens
cctggctgtggaggcctgatg

SEQ ID NO: 782355 - DNA, 23 bp, Homo sapiens
cctggctgtggaggcctgatgct

SEQ ID NO: 782356 - DNA, 17 bp, Homo sapiens
cctggcttctggagccc

SEQ ID NO: 782357 - DNA, 20 bp, Homo sapiens
cctggcttctggagcccttg

SEQ ID NO: 782358 - DNA, 15 bp, Homo sapiens
cctggcttgctccag

SEQ ID NO: 782359 - DNA, 16 bp, Homo sapiens
cctggcttgctccagg

SEQ ID NO: 782360 - DNA, 19 bp, Homo sapiens
cctggcttgctccagggtc

SEQ ID NO: 782361 - DNA, 20 bp, Homo sapiens
cctggcttgctccagggtct

SEQ ID NO: 782362 - DNA, 20 bp, Homo sapiens
cctggctttcccttccagtt

SEQ ID NO: 782363 - DNA, 17 bp, Homo sapiens
cctggcttttcactgct

SEQ ID NO: 782364 - DNA, 16 bp, Homo sapiens
cctgggaaaggaccca

SEQ ID NO: 782365 - DNA, 17 bp, Homo sapiens
cctgggaacacagttct

SEQ ID NO: 782366 - DNA, 17 bp, Homo sapiens
cctgggaacacatctgg

SEQ ID NO: 782367 - DNA, 19 bp, Homo sapiens
cctgggaacacatctggct

SEQ ID NO: 782368 - DNA, 15 bp, Homo sapiens
cctgggaacaggccc

SEQ ID NO: 782369 - DNA, 16 bp, Homo sapiens
cctgggaacaggcccc

SEQ ID NO: 782370 - DNA, 20 bp, Homo sapiens
cctgggaaccactcccacca

SEQ ID NO: 782371 - DNA, 20 bp, Homo sapiens
cctgggaatggaataactat

SEQ ID NO: 782372 - DNA, 12 bp, Homo sapiens
cctgggacacac

SEQ ID NO: 782373 - DNA, 15 bp, Homo sapiens
cctgggacacagacc

SEQ ID NO: 782374 - DNA, 21 bp, Homo sapiens
cctgggacatcaggagactgg

SEQ ID NO: 782375 - DNA, 12 bp, Homo sapiens
cctgggacccag

SEQ ID NO: 782376 - DNA, 22 bp, Homo sapiens
cctgggaccccctcgccagctt

SEQ ID NO: 782377 - DNA, 23 bp, Homo sapiens
cctgggaccccctcgccagcttg

SEQ ID NO: 782378 - DNA, 15 bp, Homo sapiens
cctgggacccttggc

SEQ ID NO: 782379 - DNA, 19 bp, Homo sapiens
cctgggacccttggctatg

SEQ ID NO: 782380 - DNA, 15 bp, Homo sapiens
cctgggactcccagt

SEQ ID NO: 782381 - DNA, 17 bp, Homo sapiens
cctgggactcccagtga

SEQ ID NO: 782382 - DNA, 20 bp, Homo sapiens
cctgggacttccatgcctta

SEQ ID NO: 782383 - DNA, 15 bp, Homo sapiens
cctgggagacaactg

SEQ ID NO: 782384 - DNA, 14 bp, Homo sapiens
cctgggagccaggg

SEQ ID NO: 782385 - DNA, 14 bp, Homo sapiens
cctgggagccagtc

SEQ ID NO: 782386 - DNA, 20 bp, Homo sapiens
cctgggagccagtcctccac

SEQ ID NO: 782387 - DNA, 21 bp, Homo sapiens
cctgggagccagtcctccact

SEQ ID NO: 782388 - DNA, 21 bp, Homo sapiens
cctgggagcccccaccacaaa

SEQ ID NO: 782389 - DNA, 15 bp, Homo sapiens
cctgggagccgcctg

SEQ ID NO: 782390 - DNA, 23 bp, Homo sapiens
cctgggaggacaggcaggccaga

SEQ ID NO: 782391 - DNA, 23 bp, Homo sapiens
cctgggagggttcccctggcctt

SEQ ID NO: 782392 - DNA, 22 bp, Homo sapiens
cctgggaggtcaaggctgcagt

SEQ ID NO: 782393 - DNA, 14 bp, Homo sapiens
cctgggatccagtg

SEQ ID NO: 782394 - DNA, 23 bp, Homo sapiens
cctgggatctggtggtcagccct

SEQ ID NO: 782395 - DNA, 13 bp, Homo sapiens
cctgggatgcagt

SEQ ID NO: 782396 - DNA, 18 bp, Homo sapiens
cctgggatgcagtgatgt

SEQ ID NO: 782397 - DNA, 18 bp, Homo sapiens
cctgggatgctgacccag

SEQ ID NO: 782398 - DNA, 21 bp, Homo sapiens
cctgggatgctgacccaggaa

SEQ ID NO: 782399 - DNA, 16 bp, Homo sapiens
cctgggatgggaccag

SEQ ID NO: 782400 - DNA, 18 bp, Homo sapiens
cctgggatgggaccaggg

SEQ ID NO: 782401 - DNA, 17 bp, Homo sapiens
cctgggcaacagagcaa

SEQ ID NO: 782402 - DNA, 22 bp, Homo sapiens
cctgggcaagtggatggcccag

SEQ ID NO: 782403 - DNA, 18 bp, Homo sapiens
cctgggcaatcagacacc

SEQ ID NO: 782404 - DNA, 20 bp, Homo sapiens
cctgggcacgcactgggttg

SEQ ID NO: 782405 - DNA, 13 bp, Homo sapiens
cctgggcagaaag

SEQ ID NO: 782406 - DNA, 18 bp, Homo sapiens
cctgggcagatgtccccc

SEQ ID NO: 782407 - DNA, 19 bp, Homo sapiens
cctgggcagccaggctgcc

SEQ ID NO: 782408 - DNA, 21 bp, Homo sapiens
cctgggcagccgttttcctca

SEQ ID NO: 782409 - DNA, 22 bp, Homo sapiens
cctgggcagcctttccagcctc

SEQ ID NO: 782410 - DNA, 15 bp, Homo sapiens
cctgggcagctcctc

SEQ ID NO: 782411 - DNA, 19 bp, Homo sapiens
cctgggcagcttctgttgg

SEQ ID NO: 782412 - DNA, 20 bp, Homo sapiens
cctgggcagcttctgttggc

SEQ ID NO: 782413 - DNA, 13 bp, Homo sapiens
cctgggcaggacc

SEQ ID NO: 782414 - DNA, 14 bp, Homo sapiens
cctgggcaggaccc

SEQ ID NO: 782415 - DNA, 19 bp, Homo sapiens
cctgggcaggaccctgctg

SEQ ID NO: 782416 - DNA, 21 bp, Homo sapiens
cctgggcaggaccctgctgac

SEQ ID NO: 782417 - DNA, 22 bp, Homo sapiens
cctgggcaggcggtccccatcc

SEQ ID NO: 782418 - DNA, 13 bp, Homo sapiens
cctgggcagggca

SEQ ID NO: 782419 - DNA, 17 bp, Homo sapiens
cctgggcaggtgggagc

SEQ ID NO: 782420 - DNA, 23 bp, Homo sapiens
cctgggcagtgagtgccatgctt

SEQ ID NO: 782421 - DNA, 14 bp, Homo sapiens
cctgggcagtgctc

SEQ ID NO: 782422 - DNA, 22 bp, Homo sapiens
cctgggcatatccaccacctcc

SEQ ID NO: 782423 - DNA, 23 bp, Homo sapiens
cctgggcatatccaccacctccc

SEQ ID NO: 782424 - DNA, 21 bp, Homo sapiens
cctgggcatcagggcctttct

SEQ ID NO: 782425 - DNA, 17 bp, Homo sapiens
cctgggcatgggtccag

SEQ ID NO: 782426 - DNA, 15 bp, Homo sapiens
cctgggcattgcttt

SEQ ID NO: 782427 - DNA, 12 bp, Homo sapiens
cctgggccacac

SEQ ID NO: 782428 - DNA, 13 bp, Homo sapiens
cctgggccacacc

SEQ ID NO: 782429 - DNA, 23 bp, Homo sapiens
cctgggccacacctgagcgctgt

SEQ ID NO: 782430 - DNA, 23 bp, Homo sapiens
cctgggccacagggcgagactcc

SEQ ID NO: 782431 - DNA, 16 bp, Homo sapiens
cctgggccacctccta

SEQ ID NO: 782432 - DNA, 17 bp, Homo sapiens
cctgggccacctcctac

SEQ ID NO: 782433 - DNA, 21 bp, Homo sapiens
cctgggccagcggggctgctc

SEQ ID NO: 782434 - DNA, 22 bp, Homo sapiens
cctgggccagcggggctgctca

SEQ ID NO: 782435 - DNA, 22 bp, Homo sapiens
cctgggcccacagagcctggct

SEQ ID NO: 782436 - DNA, 22 bp, Homo sapiens
cctgggcccatctccctgcttt

SEQ ID NO: 782437 - DNA, 14 bp, Homo sapiens
cctgggccccactg

SEQ ID NO: 782438 - DNA, 16 bp, Homo sapiens
cctgggccccactgga

SEQ ID NO: 782439 - DNA, 17 bp, Homo sapiens
cctgggccccactggac

SEQ ID NO: 782440 - DNA, 18 bp, Homo sapiens
cctgggccccactggaca

SEQ ID NO: 782441 - DNA, 21 bp, Homo sapiens
cctgggcccctccacgcctcc

SEQ ID NO: 782442 - DNA, 22 bp, Homo sapiens
cctgggcccctccacgcctcct

SEQ ID NO: 782443 - DNA, 20 bp, Homo sapiens
cctgggcccgggcaggccag

SEQ ID NO: 782444 - DNA, 15 bp, Homo sapiens
cctgggccctggagg

SEQ ID NO: 782445 - DNA, 13 bp, Homo sapiens
cctgggccctggg

SEQ ID NO: 782446 - DNA, 16 bp, Homo sapiens
cctgggccctgggctg

SEQ ID NO: 782447 - DNA, 19 bp, Homo sapiens
cctgggcccttgtgctcct

SEQ ID NO: 782448 - DNA, 17 bp, Homo sapiens
cctgggccgctgccacg

SEQ ID NO: 782449 - DNA, 19 bp, Homo sapiens
cctgggccggcgagggggc

SEQ ID NO: 782450 - DNA, 15 bp, Homo sapiens
cctgggcgccctgga

SEQ ID NO: 782451 - DNA, 19 bp, Homo sapiens
cctgggcgccctggaagcc

SEQ ID NO: 782452 - DNA, 17 bp, Homo sapiens
cctgggctcactgtgct

SEQ ID NO: 782453 - DNA, 17 bp, Homo sapiens
cctgggctctgaacaca

SEQ ID NO: 782454 - DNA, 14 bp, Homo sapiens
cctgggctctgccc

SEQ ID NO: 782455 - DNA, 24 bp, Homo sapiens
cctgggctctgccccagctctggc

SEQ ID NO: 782456 - DNA, 13 bp, Homo sapiens
cctgggctggact

SEQ ID NO: 782457 - DNA, 14 bp, Homo sapiens
cctgggctggactg

SEQ ID NO: 782458 - DNA, 12 bp, Homo sapiens
cctgggctgggg

SEQ ID NO: 782459 - DNA, 15 bp, Homo sapiens
cctgggctggggagg

SEQ ID NO: 782460 - DNA, 21 bp, Homo sapiens
cctgggctggggaggaggaga

SEQ ID NO: 782461 - DNA, 17 bp, Homo sapiens
cctgggctgtccagcct

SEQ ID NO: 782462 - DNA, 19 bp, Homo sapiens
cctgggctgtctgtcacca

SEQ ID NO: 782463 - DNA, 16 bp, Homo sapiens
cctgggctgttggcac

SEQ ID NO: 782464 - DNA, 14 bp, Homo sapiens
cctgggcttggcct

SEQ ID NO: 782465 - DNA, 15 bp, Homo sapiens
cctgggcttggctct

SEQ ID NO: 782466 - DNA, 12 bp, Homo sapiens
cctggggaagga

SEQ ID NO: 782467 - DNA, 18 bp, Homo sapiens
cctggggaaggagccagt

SEQ ID NO: 782468 - DNA, 14 bp, Homo sapiens
cctggggactcctc

SEQ ID NO: 782469 - DNA, 17 bp, Homo sapiens
cctggggagccctcagg

SEQ ID NO: 782470 - DNA, 18 bp, Homo sapiens
cctggggagccctcaggc

SEQ ID NO: 782471 - DNA, 15 bp, Homo sapiens
cctggggagctcctg

SEQ ID NO: 782472 - DNA, 17 bp, Homo sapiens
cctggggagctcctggg

SEQ ID NO: 782473 - DNA, 13 bp, Homo sapiens
cctggggaggccc

SEQ ID NO: 782474 - DNA, 15 bp, Homo sapiens
cctggggaggcccta

SEQ ID NO: 782475 - DNA, 18 bp, Homo sapiens
cctggggagtgggacaga

SEQ ID NO: 782476 - DNA, 23 bp, Homo sapiens
cctggggagtgggacagagtctg

SEQ ID NO: 782477 - DNA, 13 bp, Homo sapiens
cctggggatagtc

SEQ ID NO: 782478 - DNA, 16 bp, Homo sapiens
cctggggatcttccca

SEQ ID NO: 782479 - DNA, 19 bp, Homo sapiens
cctggggatcttgccccct

SEQ ID NO: 782480 - DNA, 12 bp, Homo sapiens
cctggggcagag

SEQ ID NO: 782481 - DNA, 17 bp, Homo sapiens
cctggggcagcactccc

SEQ ID NO: 782482 - DNA, 19 bp, Homo sapiens
cctggggcccaagttgcag

SEQ ID NO: 782483 - DNA, 21 bp, Homo sapiens
cctggggccgcctgccctgcc

SEQ ID NO: 782484 - DNA, 24 bp, Homo sapiens
cctggggccgcctgccctgccttg

SEQ ID NO: 782485 - DNA, 22 bp, Homo sapiens
cctggggcctccagaagctgct

SEQ ID NO: 782486 - DNA, 14 bp, Homo sapiens
cctggggcctgact

SEQ ID NO: 782487 - DNA, 18 bp, Homo sapiens
cctggggcctgactgctc

SEQ ID NO: 782488 - DNA, 13 bp, Homo sapiens
cctggggcctgag

SEQ ID NO: 782489 - DNA, 16 bp, Homo sapiens
cctggggcctgagaga

SEQ ID NO: 782490 - DNA, 16 bp, Homo sapiens
cctggggcctggacct

SEQ ID NO: 782491 - DNA, 19 bp, Homo sapiens
cctggggcctggacctgcc

SEQ ID NO: 782492 - DNA, 21 bp, Homo sapiens
cctggggcctggacctgcctc

SEQ ID NO: 782493 - DNA, 22 bp, Homo sapiens
cctggggcggcatgaaccctct

SEQ ID NO: 782494 - DNA, 13 bp, Homo sapiens
cctggggcgggca

SEQ ID NO: 782495 - DNA, 22 bp, Homo sapiens
cctggggctcctttctccagcc

SEQ ID NO: 782496 - DNA, 13 bp, Homo sapiens
cctggggctctct

SEQ ID NO: 782497 - DNA, 18 bp, Homo sapiens
cctggggctctctgaccc

SEQ ID NO: 782498 - DNA, 15 bp, Homo sapiens
cctggggctggcctc

SEQ ID NO: 782499 - DNA, 16 bp, Homo sapiens
cctggggctggcctcc

SEQ ID NO: 782500 - DNA, 17 bp, Homo sapiens
cctggggcttctcctga

SEQ ID NO: 782501 - DNA, 16 bp, Homo sapiens
cctgggggaagccctg

SEQ ID NO: 782502 - DNA, 18 bp, Homo sapiens
cctgggggagttttcctc

SEQ ID NO: 782503 - DNA, 20 bp, Homo sapiens
cctgggggagttttcctcta

SEQ ID NO: 782504 - DNA, 19 bp, Homo sapiens
cctgggggccccaggatgg

SEQ ID NO: 782505 - DNA, 19 bp, Homo sapiens
cctgggggccttgggtgag

SEQ ID NO: 782506 - DNA, 16 bp, Homo sapiens
cctgggggctctcatg

SEQ ID NO: 782507 - DNA, 19 bp, Homo sapiens
cctggggggagggacaggg

SEQ ID NO: 782508 - DNA, 13 bp, Homo sapiens
cctggggggcagg

SEQ ID NO: 782509 - DNA, 18 bp, Homo sapiens
cctgggggtagccccgcc

SEQ ID NO: 782510 - DNA, 14 bp, Homo sapiens
cctgggggtggcag

SEQ ID NO: 782511 - DNA, 22 bp, Homo sapiens
cctgggggtggcaggcacacag

SEQ ID NO: 782512 - DNA, 22 bp, Homo sapiens
cctggggtctctctccctacct

SEQ ID NO: 782513 - DNA, 21 bp, Homo sapiens
cctggggtgaatacttatttt

SEQ ID NO: 782514 - DNA, 15 bp, Homo sapiens
cctggggtgacctct

SEQ ID NO: 782515 - DNA, 14 bp, Homo sapiens
cctggggtggccag

SEQ ID NO: 782516 - DNA, 19 bp, Homo sapiens
cctggggtggcctggccct

SEQ ID NO: 782517 - DNA, 20 bp, Homo sapiens
cctggggtgggacagggagg

SEQ ID NO: 782518 - DNA, 15 bp, Homo sapiens
cctggggtggggtca

SEQ ID NO: 782519 - DNA, 17 bp, Homo sapiens
cctggggttctctacag

SEQ ID NO: 782520 - DNA, 16 bp, Homo sapiens
cctggggttgtccccg

SEQ ID NO: 782521 - DNA, 17 bp, Homo sapiens
cctggggttgtccccgc

SEQ ID NO: 782522 - DNA, 22 bp, Homo sapiens
cctggggttgtccccgctggct

SEQ ID NO: 782523 - DNA, 23 bp, Homo sapiens
cctgggtagctagcaccatggca

SEQ ID NO: 782524 - DNA, 17 bp, Homo sapiens
cctgggtatcccctgcc

SEQ ID NO: 782525 - DNA, 23 bp, Homo sapiens
cctgggtcaaagtggtacaggaa

SEQ ID NO: 782526 - DNA, 14 bp, Homo sapiens
cctgggtccttttc

SEQ ID NO: 782527 - DNA, 22 bp, Homo sapiens
cctgggtctggggacaggcccg

SEQ ID NO: 782528 - DNA, 14 bp, Homo sapiens
cctgggtctgtgtc

SEQ ID NO: 782529 - DNA, 20 bp, Homo sapiens
cctgggtctgtgtcagcggg

SEQ ID NO: 782530 - DNA, 16 bp, Homo sapiens
cctgggtctgtgtctc

SEQ ID NO: 782531 - DNA, 19 bp, Homo sapiens
cctgggtgacagagcgaga

SEQ ID NO: 782532 - DNA, 17 bp, Homo sapiens
cctgggtgccctggctc

SEQ ID NO: 782533 - DNA, 23 bp, Homo sapiens
cctgggtgctggctgcccagacc

SEQ ID NO: 782534 - DNA, 16 bp, Homo sapiens
cctgggtggccatcct

SEQ ID NO: 782535 - DNA, 17 bp, Homo sapiens
cctgggtgggctctgtg

SEQ ID NO: 782536 - DNA, 15 bp, Homo sapiens
cctgggtggggctgc

SEQ ID NO: 782537 - DNA, 16 bp, Homo sapiens
cctgggtggggctgct

SEQ ID NO: 782538 - DNA, 19 bp, Homo sapiens
cctgggtggggctgctcct

SEQ ID NO: 782539 - DNA, 20 bp, Homo sapiens
cctgggtggggctgctcctc

SEQ ID NO: 782540 - DNA, 19 bp, Homo sapiens
cctgggtgggtggtgggga

SEQ ID NO: 782541 - DNA, 21 bp, Homo sapiens
cctgggtgggtggtggggagg

SEQ ID NO: 782542 - DNA, 23 bp, Homo sapiens
cctgggtgggtggtggggagggg

SEQ ID NO: 782543 - DNA, 20 bp, Homo sapiens
cctgggttagggtgtgtgtt

SEQ ID NO: 782544 - DNA, 19 bp, Homo sapiens
cctgggttcagaaatgctg

SEQ ID NO: 782545 - DNA, 22 bp, Homo sapiens
cctgggttcagaaatgctgcct

SEQ ID NO: 782546 - DNA, 15 bp, Homo sapiens
cctgggttggaggga

SEQ ID NO: 782547 - DNA, 14 bp, Homo sapiens
cctgggttgtttcc

SEQ ID NO: 782548 - DNA, 17 bp, Homo sapiens
cctgggttgtttccagg

SEQ ID NO: 782549 - DNA, 21 bp, Homo sapiens
cctgggttgtttccaggagaa

SEQ ID NO: 782550 - DNA, 20 bp, Homo sapiens
cctgggttttgtattctctg

SEQ ID NO: 782551 - DNA, 14 bp, Homo sapiens
cctggtaattaaaa

SEQ ID NO: 782552 - DNA, 14 bp, Homo sapiens
cctggtacccagcc

SEQ ID NO: 782553 - DNA, 15 bp, Homo sapiens
cctggtacccagcca

SEQ ID NO: 782554 - DNA, 17 bp, Homo sapiens
cctggtacccagccatc

SEQ ID NO: 782555 - DNA, 20 bp, Homo sapiens
cctggtacccagccatctgc

SEQ ID NO: 782556 - DNA, 15 bp, Homo sapiens
cctggtaccctcctg

SEQ ID NO: 782557 - DNA, 19 bp, Homo sapiens
cctggtaggagtgtgtgat

SEQ ID NO: 782558 - DNA, 19 bp, Homo sapiens
cctggtagtgtagctgtgt

SEQ ID NO: 782559 - DNA, 18 bp, Homo sapiens
cctggtatatccaaaagc

SEQ ID NO: 782560 - DNA, 14 bp, Homo sapiens
cctggtccagggaa

SEQ ID NO: 782561 - DNA, 16 bp, Homo sapiens
cctggtccatgcaggg

SEQ ID NO: 782562 - DNA, 19 bp, Homo sapiens
cctggtccccactgctgag

SEQ ID NO: 782563 - DNA, 21 bp, Homo sapiens
cctggtccccactgctgagct

SEQ ID NO: 782564 - DNA, 22 bp, Homo sapiens
cctggtcccctcccccatcccc

SEQ ID NO: 782565 - DNA, 16 bp, Homo sapiens
cctggtccctgggagg

SEQ ID NO: 782566 - DNA, 12 bp, Homo sapiens
cctggtcctgga

SEQ ID NO: 782567 - DNA, 18 bp, Homo sapiens
cctggtcgtctatcccag

SEQ ID NO: 782568 - DNA, 21 bp, Homo sapiens
cctggtctgaggatgtagaga

SEQ ID NO: 782569 - DNA, 12 bp, Homo sapiens
cctggtcttctc

SEQ ID NO: 782570 - DNA, 16 bp, Homo sapiens
cctggtcttgagatgt

SEQ ID NO: 782571 - DNA, 12 bp, Homo sapiens
cctggtcttttt

SEQ ID NO: 782572 - DNA, 19 bp, Homo sapiens
cctggtgacctcctgtcac

SEQ ID NO: 782573 - DNA, 20 bp, Homo sapiens
cctggtgacctcctgtcact

SEQ ID NO: 782574 - DNA, 22 bp, Homo sapiens
cctggtgccccccacccctgga

SEQ ID NO: 782575 - DNA, 19 bp, Homo sapiens
cctggcagcacagcccagg

SEQ ID NO: 782576 - DNA, 20 bp, Homo sapiens
cctggcagcacagcccaggg

SEQ ID NO: 782577 - DNA, 15 bp, Homo sapiens
cctggcagcccagag

SEQ ID NO: 782578 - DNA, 17 bp, Homo sapiens
cctggcagcccagagac

SEQ ID NO: 782579 - DNA, 18 bp, Homo sapiens
cctggcagcccagagact

SEQ ID NO: 782580 - DNA, 19 bp, Homo sapiens
cctggcagccgtgccttca

SEQ ID NO: 782581 - DNA, 21 bp, Homo sapiens
cctggcagccgtgccttcagc

SEQ ID NO: 782582 - DNA, 12 bp, Homo sapiens
cctggcagctgc

SEQ ID NO: 782583 - DNA, 14 bp, Homo sapiens
cctggcagctgccc

SEQ ID NO: 782584 - DNA, 16 bp, Homo sapiens
cctggcagctgcccct

SEQ ID NO: 782585 - DNA, 21 bp, Homo sapiens
cctggcagctgcccctcctgg

SEQ ID NO: 782586 - DNA, 19 bp, Homo sapiens
cctgtgctggaccagctgg

SEQ ID NO: 782587 - DNA, 14 bp, Homo sapiens
cctgtgctggggga

SEQ ID NO: 782588 - DNA, 23 bp, Homo sapiens
cctgtgctggtgtcctgaccacc

SEQ ID NO: 782589 - DNA, 16 bp, Homo sapiens
cctgtgctttctgcat

SEQ ID NO: 782590 - DNA, 23 bp, Homo sapiens
cctgtggaacataaaaaggacat

SEQ ID NO: 782591 - DNA, 24 bp, Homo sapiens
cctgtggaacataaaaaggacatc

SEQ ID NO: 782592 - DNA, 16 bp, Homo sapiens
cctgtggaagggacta

SEQ ID NO: 782593 - DNA, 21 bp, Homo sapiens
cctgtggaatgagtgtgcatg

SEQ ID NO: 782594 - DNA, 17 bp, Homo sapiens
cctgtggagcccgcacc

SEQ ID NO: 782595 - DNA, 17 bp, Homo sapiens
cctgtggagctcagccc

SEQ ID NO: 782596 - DNA, 16 bp, Homo sapiens
cctgtggagtccagct

SEQ ID NO: 782597 - DNA, 20 bp, Homo sapiens
cctgtggatgggatcctctc

SEQ ID NO: 782598 - DNA, 19 bp, Homo sapiens
cctgtggcactcagggagc

SEQ ID NO: 782599 - DNA, 21 bp, Homo sapiens
cctgtggcagaaaagaggaga

SEQ ID NO: 782600 - DNA, 23 bp, Homo sapiens
cctgtggcagaaaagaggagacc

SEQ ID NO: 782601 - DNA, 14 bp, Homo sapiens
cctgtggcaggagg

SEQ ID NO: 782602 - DNA, 15 bp, Homo sapiens
cctgtggcaggaggc

SEQ ID NO: 782603 - DNA, 16 bp, Homo sapiens
cctgtggccaggaggt

SEQ ID NO: 782604 - DNA, 20 bp, Homo sapiens
cctgtggccccaccctgggc

SEQ ID NO: 782605 - DNA, 16 bp, Homo sapiens
cctgtggccgccacct

SEQ ID NO: 782606 - DNA, 13 bp, Homo sapiens
cctgtggcctgtg

SEQ ID NO: 782607 - DNA, 14 bp, Homo sapiens
cctgtggcctgtgt

SEQ ID NO: 782608 - DNA, 18 bp, Homo sapiens
cctgtggcctgtgtccca

SEQ ID NO: 782609 - DNA, 22 bp, Homo sapiens
cctgtggccttgcccgccagcc

SEQ ID NO: 782610 - DNA, 17 bp, Homo sapiens
cctgtggcggccttccg

SEQ ID NO: 782611 - DNA, 18 bp, Homo sapiens
cctgtggcggtgcctggg

SEQ ID NO: 782612 - DNA, 18 bp, Homo sapiens
cctgtgggaccgcctggc

SEQ ID NO: 782613 - DNA, 21 bp, Homo sapiens
cctgtgggaccgcctggccct

SEQ ID NO: 782614 - DNA, 14 bp, Homo sapiens
cctgtgggaggggg

SEQ ID NO: 782615 - DNA, 18 bp, Homo sapiens
cctgtgggagggggagga

SEQ ID NO: 782616 - DNA, 21 bp, Homo sapiens
cctgtgggcagcatgcccaga

SEQ ID NO: 782617 - DNA, 14 bp, Homo sapiens
cctgtgggcgcata

SEQ ID NO: 782618 - DNA, 18 bp, Homo sapiens
cctgtggggaacaggtct

SEQ ID NO: 782619 - DNA, 19 bp, Homo sapiens
cctgtggggcaggagtgcc

SEQ ID NO: 782620 - DNA, 21 bp, Homo sapiens
cctgtggggcaggagtgccag

SEQ ID NO: 782621 - DNA, 14 bp, Homo sapiens
cctgtggggcctga

SEQ ID NO: 782622 - DNA, 22 bp, Homo sapiens
cctgtggggggtaatccctgct

SEQ ID NO: 782623 - DNA, 22 bp, Homo sapiens
cctgtgggggtggccatccctg

SEQ ID NO: 782624 - DNA, 15 bp, Homo sapiens
cctgtgggtccccac

SEQ ID NO: 782625 - DNA, 18 bp, Homo sapiens
cctgtgggtccccactca

SEQ ID NO: 782626 - DNA, 18 bp, Homo sapiens
cctgtgggtctctgaagg

SEQ ID NO: 782627 - DNA, 19 bp, Homo sapiens
cctgtgggtctctgaaggg

SEQ ID NO: 782628 - DNA, 18 bp, Homo sapiens
cctgtgggtgtagccagg

SEQ ID NO: 782629 - DNA, 18 bp, Homo sapiens
cctgtgggtgtctccctc

SEQ ID NO: 782630 - DNA, 21 bp, Homo sapiens
cctgtgggtgtctccctcggg

SEQ ID NO: 782631 - DNA, 20 bp, Homo sapiens
cctgtggtaactttgcaggc

SEQ ID NO: 782632 - DNA, 16 bp, Homo sapiens
cctgtggtctggggag

SEQ ID NO: 782633 - DNA, 14 bp, Homo sapiens
cctgtggtgaagtg

SEQ ID NO: 782634 - DNA, 17 bp, Homo sapiens
cctgtggtgaagtgtgg

SEQ ID NO: 782635 - DNA, 22 bp, Homo sapiens
cctgtggtgaagtgtggctggt

SEQ ID NO: 782636 - DNA, 16 bp, Homo sapiens
cctgtggtgatgtgcc

SEQ ID NO: 782637 - DNA, 16 bp, Homo sapiens
cctgtggtggctcccc

SEQ ID NO: 782638 - DNA, 19 bp, Homo sapiens
cctgtggttacagtgcaga

SEQ ID NO: 782639 - DNA, 21 bp, Homo sapiens
cctgtggttacagtgcagaca

SEQ ID NO: 782640 - DNA, 22 bp, Homo sapiens
cctgtggttacagtgcagacag

SEQ ID NO: 782641 - DNA, 14 bp, Homo sapiens
cctgtgtatggaaa

SEQ ID NO: 782642 - DNA, 15 bp, Homo sapiens
cctgtgtcagagcct

SEQ ID NO: 782643 - DNA, 18 bp, Homo sapiens
cctgtgtcagagcctacc

SEQ ID NO: 782644 - DNA, 18 bp, Homo sapiens
cctgtgtccacctgtggg

SEQ ID NO: 782645 - DNA, 15 bp, Homo sapiens
cctgtgtccagcagc

SEQ ID NO: 782646 - DNA, 13 bp, Homo sapiens
cctgtgtcccatg

SEQ ID NO: 782647 - DNA, 20 bp, Homo sapiens
cctgtgtcccatgacccacc

SEQ ID NO: 782648 - DNA, 20 bp, Homo sapiens
cctgtgtcccctgacctgtc

SEQ ID NO: 782649 - DNA, 22 bp, Homo sapiens
cctgtgtcccctgacctgtcca

SEQ ID NO: 782650 - DNA, 14 bp, Homo sapiens
cctgtgtctgtcac

SEQ ID NO: 782651 - DNA, 13 bp, Homo sapiens
cctgtgtgcttgt

SEQ ID NO: 782652 - DNA, 22 bp, Homo sapiens
cctgtgtggatgctgagctgtg

SEQ ID NO: 782653 - DNA, 18 bp, Homo sapiens
cctgtgtgtactctgtcc

SEQ ID NO: 782654 - DNA, 21 bp, Homo sapiens
cctgtgtgtttgacatgtgaa

SEQ ID NO: 782655 - DNA, 20 bp, Homo sapiens
cctgtgttagtgtctgtcca

SEQ ID NO: 782656 - DNA, 21 bp, Homo sapiens
cctgtgttagtgtctgtccat

SEQ ID NO: 782657 - DNA, 13 bp, Homo sapiens
cctgtgttctggg

SEQ ID NO: 782658 - DNA, 15 bp, Homo sapiens
cctgtgttctgggct

SEQ ID NO: 782659 - DNA, 17 bp, Homo sapiens
cctgtgttctgggctgg

SEQ ID NO: 782660 - DNA, 21 bp, Homo sapiens
cctgtgttctgggctggggcc

SEQ ID NO: 782661 - DNA, 15 bp, Homo sapiens
cctgtgttcttgctg

SEQ ID NO: 782662 - DNA, 18 bp, Homo sapiens
cctgtgttgtcccatctg

SEQ ID NO: 782663 - DNA, 19 bp, Homo sapiens
cctgtgttgtcccatctgc

SEQ ID NO: 782664 - DNA, 18 bp, Homo sapiens
cctgtgtttttttctaaa

SEQ ID NO: 782665 - DNA, 14 bp, Homo sapiens
cctgttaaacagta

SEQ ID NO: 782666 - DNA, 22 bp, Homo sapiens
cctgttaaacagtagttgtatt

SEQ ID NO: 782667 - DNA, 13 bp, Homo sapiens
cctgttaaatata

SEQ ID NO: 782668 - DNA, 21 bp, Homo sapiens
cctgttaatttataatgtatt

SEQ ID NO: 782669 - DNA, 23 bp, Homo sapiens
cctgttaatttataatgtatttg

SEQ ID NO: 782670 - DNA, 15 bp, Homo sapiens
cctgttacccagaga

SEQ ID NO: 782671 - DNA, 17 bp, Homo sapiens
cctgttacctactttga

SEQ ID NO: 782672 - DNA, 19 bp, Homo sapiens
cctgttacctactttgact

SEQ ID NO: 782673 - DNA, 20 bp, Homo sapiens
cctgttacttgcttcagtgg

SEQ ID NO: 782674 - DNA, 16 bp, Homo sapiens
cctgttagcagacagg

SEQ ID NO: 782675 - DNA, 19 bp, Homo sapiens
cctgttattttatgtctgt

SEQ ID NO: 782676 - DNA, 20 bp, Homo sapiens
cctgttcacggtgacacagg

SEQ ID NO: 782677 - DNA, 13 bp, Homo sapiens
cctgttccctacc

SEQ ID NO: 782678 - DNA, 14 bp, Homo sapiens
cctgttccctaccc

SEQ ID NO: 782679 - DNA, 12 bp, Homo sapiens
cctgttccctcc

SEQ ID NO: 782680 - DNA, 16 bp, Homo sapiens
cctgtttggcctctct

SEQ ID NO: 782681 - DNA, 20 bp, Homo sapiens
cctgtttggcctctctatcc

SEQ ID NO: 782682 - DNA, 23 bp, Homo sapiens
cctgtttggtggggtggcacctg

SEQ ID NO: 782683 - DNA, 19 bp, Homo sapiens
cctgttttatactgtactt

SEQ ID NO: 782684 - DNA, 14 bp, Homo sapiens
cctgttttctccct

SEQ ID NO: 782685 - DNA, 12 bp, Homo sapiens
cctgttttctga

SEQ ID NO: 782686 - DNA, 13 bp, Homo sapiens
cctgttttctgaa

SEQ ID NO: 782687 - DNA, 17 bp, Homo sapiens
cctgttttctgagcccg

SEQ ID NO: 782688 - DNA, 19 bp, Homo sapiens
cctgttttctgtttcttct

SEQ ID NO: 782689 - DNA, 13 bp, Homo sapiens
cctgttttcttag

SEQ ID NO: 782690 - DNA, 16 bp, Homo sapiens
cctgtttttcacattt

SEQ ID NO: 782691 - DNA, 17 bp, Homo sapiens
cctgtttttctgggtgg

SEQ ID NO: 782692 - DNA, 17 bp, Homo sapiens
ccttaaaaggagagaag

SEQ ID NO: 782693 - DNA, 22 bp, Homo sapiens
ccttaaaaggagagaagaaagt

SEQ ID NO: 782694 - DNA, 17 bp, Homo sapiens
ccttaaaaggggcccaa

SEQ ID NO: 782695 - DNA, 15 bp, Homo sapiens
ccttaaactgtgtgg

SEQ ID NO: 782696 - DNA, 12 bp, Homo sapiens
ccttaaacttcc

SEQ ID NO: 782697 - DNA, 18 bp, Homo sapiens
ccttaaattaaacaattt

SEQ ID NO: 782698 - DNA, 20 bp, Homo sapiens
ccttaaatttttagccattt

SEQ ID NO: 782699 - DNA, 23 bp, Homo sapiens
ccttaaatttttagccatttctc

SEQ ID NO: 782700 - DNA, 16 bp, Homo sapiens
ccttaacagttgtatt

SEQ ID NO: 782701 - DNA, 17 bp, Homo sapiens
ccttaacagttgtattt

SEQ ID NO: 782702 - DNA, 15 bp, Homo sapiens
ccttaaccaataatg

SEQ ID NO: 782703 - DNA, 18 bp, Homo sapiens
ccttaacccaaggagcac

SEQ ID NO: 782704 - DNA, 20 bp, Homo sapiens
ccttaacccaaggagcacag

SEQ ID NO: 782705 - DNA, 16 bp, Homo sapiens
ccttaaccccaaggac

SEQ ID NO: 782706 - DNA, 21 bp, Homo sapiens
ccttaacctctctaagccaca

SEQ ID NO: 782707 - DNA, 20 bp, Homo sapiens
ccttaactctaaccctgtgg

SEQ ID NO: 782708 - DNA, 15 bp, Homo sapiens
ccttaagacactgtg

SEQ ID NO: 782709 - DNA, 16 bp, Homo sapiens
ccttaagacactgtga

SEQ ID NO: 782710 - DNA, 18 bp, Homo sapiens
ccttaagacactgtgaga

SEQ ID NO: 782711 - DNA, 16 bp, Homo sapiens
ccttaagcaaattttg

SEQ ID NO: 782712 - DNA, 19 bp, Homo sapiens
ccttaagcagaacaaatgt

SEQ ID NO: 782713 - DNA, 22 bp, Homo sapiens
ccttaagggttgaaggcagtct

SEQ ID NO: 782714 - DNA, 23 bp, Homo sapiens
ccttaataaatatgtaatataaa

SEQ ID NO: 782715 - DNA, 16 bp, Homo sapiens
ccttaatagacttctc

SEQ ID NO: 782716 - DNA, 19 bp, Homo sapiens
ccttaatattgaggctgca

SEQ ID NO: 782717 - DNA, 20 bp, Homo sapiens
ccttaatattgaggctgcag

SEQ ID NO: 782718 - DNA, 19 bp, Homo sapiens
ccttaatatttcttcaaat

SEQ ID NO: 782719 - DNA, 14 bp, Homo sapiens
ccttaatcttgctt

SEQ ID NO: 782720 - DNA, 13 bp, Homo sapiens
ccttaatttcctt

SEQ ID NO: 782721 - DNA, 15 bp, Homo sapiens
ccttaatttcctttt

SEQ ID NO: 782722 - DNA, 20 bp, Homo sapiens
ccttaatttcctttttgaca

SEQ ID NO: 782723 - DNA, 22 bp, Homo sapiens
ccttaatttcctttttgacact

SEQ ID NO: 782724 - DNA, 20 bp, Homo sapiens
ccttacaacgccgagtgcac

SEQ ID NO: 782725 - DNA, 22 bp, Homo sapiens
ccttacaagttagaaaacataa

SEQ ID NO: 782726 - DNA, 22 bp, Homo sapiens
ccttacacgtacctctcatcag

SEQ ID NO: 782727 - DNA, 21 bp, Homo sapiens
ccttacagtaggagcccagct

SEQ ID NO: 782728 - DNA, 21 bp, Homo sapiens
ccttaccaacagcttttccca

SEQ ID NO: 782729 - DNA, 17 bp, Homo sapiens
ccttaccaactttctgt

SEQ ID NO: 782730 - DNA, 19 bp, Homo sapiens
ccttaccaactttctgtaa

SEQ ID NO: 782731 - DNA, 15 bp, Homo sapiens
ccttaccccttagcc

SEQ ID NO: 782732 - DNA, 16 bp, Homo sapiens
ccttaccccttagcct

SEQ ID NO: 782733 - DNA, 20 bp, Homo sapiens
ccttaccctcctctgctggg

SEQ ID NO: 782734 - DNA, 13 bp, Homo sapiens
ccttacctcctgc

SEQ ID NO: 782735 - DNA, 14 bp, Homo sapiens
ccttacctcctgcc

SEQ ID NO: 782736 - DNA, 16 bp, Homo sapiens
ccttacctcctgccca

SEQ ID NO: 782737 - DNA, 18 bp, Homo sapiens
ccttacctcctgcccagg

SEQ ID NO: 782738 - DNA, 20 bp, Homo sapiens
ccttacctcctgcccaggag

SEQ ID NO: 782739 - DNA, 17 bp, Homo sapiens
ccttaccttggggctgg

SEQ ID NO: 782740 - DNA, 14 bp, Homo sapiens
ccttacctttttat

SEQ ID NO: 782741 - DNA, 17 bp, Homo sapiens
ccttacgtgagaaatag

SEQ ID NO: 782742 - DNA, 14 bp, Homo sapiens
ccttactctgagcc

SEQ ID NO: 782743 - DNA, 16 bp, Homo sapiens
ccttactctgagccca

SEQ ID NO: 782744 - DNA, 18 bp, Homo sapiens
ccttactctgagcccagg

SEQ ID NO: 782745 - DNA, 21 bp, Homo sapiens
ccttactctgagcccaggccg

SEQ ID NO: 782746 - DNA, 16 bp, Homo sapiens
ccttactcttcttgaa

SEQ ID NO: 782747 - DNA, 17 bp, Homo sapiens
ccttactcttcttgaaa

SEQ ID NO: 782748 - DNA, 13 bp, Homo sapiens
ccttactgtttac

SEQ ID NO: 782749 - DNA, 16 bp, Homo sapiens
ccttagaacctttctt

SEQ ID NO: 782750 - DNA, 14 bp, Homo sapiens
ccttagacctgagg

SEQ ID NO: 782751 - DNA, 16 bp, Homo sapiens
ccttagaccttccata

SEQ ID NO: 782752 - DNA, 17 bp, Homo sapiens
ccttagagattgcccca

SEQ ID NO: 782753 - DNA, 19 bp, Homo sapiens
ccttagaggtcctctggag

SEQ ID NO: 782754 - DNA, 20 bp, Homo sapiens
ccttagcaatgggggcctcc

SEQ ID NO: 782755 - DNA, 18 bp, Homo sapiens
ccttagcacagagaggga

SEQ ID NO: 782756 - DNA, 20 bp, Homo sapiens
ccttagccctgtctgctagg

SEQ ID NO: 782757 - DNA, 13 bp, Homo sapiens
ccttagcctctcc

SEQ ID NO: 782758 - DNA, 14 bp, Homo sapiens
ccttagcctctccc

SEQ ID NO: 782759 - DNA, 15 bp, Homo sapiens
ccttagcctctccca

SEQ ID NO: 782760 - DNA, 17 bp, Homo sapiens
ccttagcctctcccacc

SEQ ID NO: 782761 - DNA, 17 bp, Homo sapiens
ccttagcgttctggact

SEQ ID NO: 782762 - DNA, 23 bp, Homo sapiens
ccttagcgttctggactctgccc

SEQ ID NO: 782763 - DNA, 17 bp, Homo sapiens
ccttagctatttatccc

SEQ ID NO: 782764 - DNA, 18 bp, Homo sapiens
ccttagcttagacctcag

SEQ ID NO: 782765 - DNA, 23 bp, Homo sapiens
ccttagcttattgatcccacatt

SEQ ID NO: 782766 - DNA, 19 bp, Homo sapiens
ccttaggaaaatgcttctg

SEQ ID NO: 782767 - DNA, 21 bp, Homo sapiens
ccttaggatggggctcccagc

SEQ ID NO: 782768 - DNA, 14 bp, Homo sapiens
ccttaggccttcct

SEQ ID NO: 782769 - DNA, 20 bp, Homo sapiens
ccttagggaagttgtctcct

SEQ ID NO: 782770 - DNA, 21 bp, Homo sapiens
ccttagggaagttgtctcctt

SEQ ID NO: 782771 - DNA, 14 bp, Homo sapiens
ccttcctttcctct

SEQ ID NO: 782772 - DNA, 19 bp, Homo sapiens
ccttcctttcctctgcagc

SEQ ID NO: 782773 - DNA, 12 bp, Homo sapiens
ccttcctttctc

SEQ ID NO: 782774 - DNA, 16 bp, Homo sapiens
ccttcctttctccagg

SEQ ID NO: 782775 - DNA, 17 bp, Homo sapiens
ccttcctttctccagga

SEQ ID NO: 782776 - DNA, 16 bp, Homo sapiens
ccttccttttccctgc

SEQ ID NO: 782777 - DNA, 21 bp, Homo sapiens
ccttccttttccctgcttcca

SEQ ID NO: 782778 - DNA, 18 bp, Homo sapiens
ccttcgaaaggccttcag

SEQ ID NO: 782779 - DNA, 19 bp, Homo sapiens
ccttcgaaaggccttcaga

SEQ ID NO: 782780 - DNA, 23 bp, Homo sapiens
ccttcgaaaggccttcagacaca

SEQ ID NO: 782781 - DNA, 18 bp, Homo sapiens
ccttcgacatgctgccag

SEQ ID NO: 782782 - DNA, 20 bp, Homo sapiens
ccttcgacatgctgccagga

SEQ ID NO: 782783 - DNA, 21 bp, Homo sapiens
ccttcgcaccttgctgtgtga

SEQ ID NO: 782784 - DNA, 18 bp, Homo sapiens
ccttcgctccatgttttt

SEQ ID NO: 782785 - DNA, 17 bp, Homo sapiens
ccttcgggaccctgggg

SEQ ID NO: 782786 - DNA, 18 bp, Homo sapiens
ccttcgggtgctggaagt

SEQ ID NO: 782787 - DNA, 14 bp, Homo sapiens
ccttcggtcacctg

SEQ ID NO: 782788 - DNA, 15 bp, Homo sapiens
ccttcggtcacctgt

SEQ ID NO: 782789 - DNA, 15 bp, Homo sapiens
ccttcgtgtgctgct

SEQ ID NO: 782790 - DNA, 16 bp, Homo sapiens
ccttcgtgtgctgctg

SEQ ID NO: 782791 - DNA, 17 bp, Homo sapiens
ccttcgtgtgctgctgc

SEQ ID NO: 782792 - DNA, 14 bp, Homo sapiens
ccttctaaaggtgt

SEQ ID NO: 782793 - DNA, 22 bp, Homo sapiens
ccttctaaaggtgttgtccctt

SEQ ID NO: 782794 - DNA, 14 bp, Homo sapiens
ccttctacaaggac

SEQ ID NO: 782795 - DNA, 20 bp, Homo sapiens
ccttctaccccaaggccagt

SEQ ID NO: 782796 - DNA, 20 bp, Homo sapiens
ccttctagaacacctgcctt

SEQ ID NO: 782797 - DNA, 16 bp, Homo sapiens
ccttctagtgagcctg

SEQ ID NO: 782798 - DNA, 16 bp, Homo sapiens
ccttctagtttcccac

SEQ ID NO: 782799 - DNA, 17 bp, Homo sapiens
ccttctagtttcccaca

SEQ ID NO: 782800 - DNA, 14 bp, Homo sapiens
ccttctatgtatta

SEQ ID NO: 782801 - DNA, 22 bp, Homo sapiens
ccttctcacacacaactgtcca

SEQ ID NO: 782802 - DNA, 22 bp, Homo sapiens
ccttctccatccacatgggagc

SEQ ID NO: 782803 - DNA, 16 bp, Homo sapiens
ccttctcccacccctg

SEQ ID NO: 782804 - DNA, 16 bp, Homo sapiens
ccttctcccctctccc

SEQ ID NO: 782805 - DNA, 20 bp, Homo sapiens
ccttctccccttcctggaca

SEQ ID NO: 782806 - DNA, 15 bp, Homo sapiens
ccttctcccggccct

SEQ ID NO: 782807 - DNA, 14 bp, Homo sapiens
ccttctccctggat

SEQ ID NO: 782808 - DNA, 14 bp, Homo sapiens
ccttctcctctctg

SEQ ID NO: 782809 - DNA, 17 bp, Homo sapiens
ccttctcctctctgggc

SEQ ID NO: 782810 - DNA, 18 bp, Homo sapiens
ccttctcctctctgggcc

SEQ ID NO: 782811 - DNA, 19 bp, Homo sapiens
ccttctcctctctgggcct

SEQ ID NO: 782812 - DNA, 21 bp, Homo sapiens
ccttgagagtatcaggtctcc

SEQ ID NO: 782813 - DNA, 13 bp, Homo sapiens
ccttgagccctgg

SEQ ID NO: 782814 - DNA, 14 bp, Homo sapiens
ccttgagccctggc

SEQ ID NO: 782815 - DNA, 13 bp, Homo sapiens
ccttgagggctgc

SEQ ID NO: 782816 - DNA, 15 bp, Homo sapiens
ccttgaggggcccca

SEQ ID NO: 782817 - DNA, 23 bp, Homo sapiens
ccttgaggtcttttgacatgtgg

SEQ ID NO: 782818 - DNA, 14 bp, Homo sapiens
ccttgagtcagaaa

SEQ ID NO: 782819 - DNA, 17 bp, Homo sapiens
ccttgagtccccagggg

SEQ ID NO: 782820 - DNA, 20 bp, Homo sapiens
ccttgagttgattcagctct

SEQ ID NO: 782821 - DNA, 16 bp, Homo sapiens
ccttgataatatattg

SEQ ID NO: 782822 - DNA, 23 bp, Homo sapiens
ccttgataatatattgtgttgac

SEQ ID NO: 782823 - DNA, 20 bp, Homo sapiens
ccttgatcagccccaccctg

SEQ ID NO: 782824 - DNA, 18 bp, Homo sapiens
ccttgatcgacttcttgg

SEQ ID NO: 782825 - DNA, 15 bp, Homo sapiens
ccttgatgccagagg

SEQ ID NO: 782826 - DNA, 20 bp, Homo sapiens
ccttgatgccagagggccag

SEQ ID NO: 782827 - DNA, 22 bp, Homo sapiens
ccttgatgccagagggccagca

SEQ ID NO: 782828 - DNA, 23 bp, Homo sapiens
ccttgatggggtccagagagcct

SEQ ID NO: 782829 - DNA, 23 bp, Homo sapiens
ccttgattgttcgggtgtgcaat

SEQ ID NO: 782830 - DNA, 18 bp, Homo sapiens
ccttgatttgttcttaca

SEQ ID NO: 782831 - DNA, 20 bp, Homo sapiens
ccttgattttgccccctgag

SEQ ID NO: 782832 - DNA, 18 bp, Homo sapiens
ccttgcaacacacagaca

SEQ ID NO: 782833 - DNA, 20 bp, Homo sapiens
ccttgcaaccaggcagctga

SEQ ID NO: 782834 - DNA, 17 bp, Homo sapiens
ccttgcaacttcatgtc

SEQ ID NO: 782835 - DNA, 22 bp, Homo sapiens
ccttgcaagccataacgtgccc

SEQ ID NO: 782836 - DNA, 14 bp, Homo sapiens
ccttgcacacccac

SEQ ID NO: 782837 - DNA, 13 bp, Homo sapiens
ccttgcacccctc

SEQ ID NO: 782838 - DNA, 17 bp, Homo sapiens
ccttgcacccctcactc

SEQ ID NO: 782839 - DNA, 16 bp, Homo sapiens
ccttgcacggctgctc

SEQ ID NO: 782840 - DNA, 17 bp, Homo sapiens
ccttgcactcctcacac

SEQ ID NO: 782841 - DNA, 20 bp, Homo sapiens
ccttgcagcactcacacagg

SEQ ID NO: 782842 - DNA, 21 bp, Homo sapiens
ccttgcagcagggctgggcct

SEQ ID NO: 782843 - DNA, 15 bp, Homo sapiens
ccttgcagctagttt

SEQ ID NO: 782844 - DNA, 18 bp, Homo sapiens
ccttgcaggggtcccccc

SEQ ID NO: 782845 - DNA, 19 bp, Homo sapiens
ccttgcaggggtcccccct

SEQ ID NO: 782846 - DNA, 19 bp, Homo sapiens
ccttgcagttcagcaccac

SEQ ID NO: 782847 - DNA, 20 bp, Homo sapiens
ccttgcagttcagcaccacc

SEQ ID NO: 782848 - DNA, 22 bp, Homo sapiens
ccttgcagttcagcaccaccct

SEQ ID NO: 782849 - DNA, 18 bp, Homo sapiens
ccttgcatgtacttgaag

SEQ ID NO: 782850 - DNA, 12 bp, Homo sapiens
ccttgccatcac

SEQ ID NO: 782851 - DNA, 13 bp, Homo sapiens
ccttgcccacagg

SEQ ID NO: 782852 - DNA, 20 bp, Homo sapiens
ccttgcccagactacagggc

SEQ ID NO: 782853 - DNA, 12 bp, Homo sapiens
ccttgcccagag

SEQ ID NO: 782854 - DNA, 19 bp, Homo sapiens
ccttgcccagagatgcctc

SEQ ID NO: 782855 - DNA, 21 bp, Homo sapiens
ccttgcccagagatgcctcca

SEQ ID NO: 782856 - DNA, 23 bp, Homo sapiens
cctttatgtgaatttttaagctg

SEQ ID NO: 782857 - DNA, 23 bp, Homo sapiens
cctttatgtggaaaacagaacat

SEQ ID NO: 782858 - DNA, 17 bp, Homo sapiens
cctttattaaaaccatt

SEQ ID NO: 782859 - DNA, 19 bp, Homo sapiens
cctttattaaaaccattgt

SEQ ID NO: 782860 - DNA, 14 bp, Homo sapiens
cctttattaaaatc

SEQ ID NO: 782861 - DNA, 16 bp, Homo sapiens
cctttattaaaatctt

SEQ ID NO: 782862 - DNA, 23 bp, Homo sapiens
cctttattttattgaaatgtata

SEQ ID NO: 782863 - DNA, 13 bp, Homo sapiens
cctttattttcag

SEQ ID NO: 782864 - DNA, 16 bp, Homo sapiens
cctttcaaatttagaa

SEQ ID NO: 782865 - DNA, 17 bp, Homo sapiens
cctttcaactagaaaat

SEQ ID NO: 782866 - DNA, 15 bp, Homo sapiens
cctttcacaaccttc

SEQ ID NO: 782867 - DNA, 18 bp, Homo sapiens
cctttcaccctcatgaaa

SEQ ID NO: 782868 - DNA, 20 bp, Homo sapiens
cctttcagatgtcttctgcc

SEQ ID NO: 782869 - DNA, 21 bp, Homo sapiens
cctttcagatgtcttctgcct

SEQ ID NO: 782870 - DNA, 12 bp, Homo sapiens
cctttcagggaa

SEQ ID NO: 782871 - DNA, 17 bp, Homo sapiens
cctttcatctctctacc

SEQ ID NO: 782872 - DNA, 12 bp, Homo sapiens
cctttccaaaga

SEQ ID NO: 782873 - DNA, 13 bp, Homo sapiens
cctttccaaagag

SEQ ID NO: 782874 - DNA, 19 bp, Homo sapiens
cctttccaccacagccagc

SEQ ID NO: 782875 - DNA, 23 bp, Homo sapiens
cctttccagagaactgcagacct

SEQ ID NO: 782876 - DNA, 18 bp, Homo sapiens
cctttccagggttattta

SEQ ID NO: 782877 - DNA, 16 bp, Homo sapiens
cctttccatctgtcca

SEQ ID NO: 782878 - DNA, 19 bp, Homo sapiens
cctttcccaccattcctgc

SEQ ID NO: 782879 - DNA, 17 bp, Homo sapiens
cctttccctctcccagt

SEQ ID NO: 782880 - DNA, 13 bp, Homo sapiens
cctttccctggag

SEQ ID NO: 782881 - DNA, 16 bp, Homo sapiens
cctttccctggagctg

SEQ ID NO: 782882 - DNA, 15 bp, Homo sapiens
cctttcccttcctct

SEQ ID NO: 782883 - DNA, 14 bp, Homo sapiens
cctttccgctgtcg

SEQ ID NO: 782884 - DNA, 17 bp, Homo sapiens
cctttcctactgtcctg

SEQ ID NO: 782885 - DNA, 18 bp, Homo sapiens
cctttcctactgtcctgg

SEQ ID NO: 782886 - DNA, 20 bp, Homo sapiens
cctttcctaggcccaggcct

SEQ ID NO: 782887 - DNA, 20 bp, Homo sapiens
cctttcctcggtctcccttc

SEQ ID NO: 782888 - DNA, 21 bp, Homo sapiens
cctttcctctgcagcacttta

SEQ ID NO: 782889 - DNA, 20 bp, Homo sapiens
cctttcctgatgcccctgac

SEQ ID NO: 782890 - DNA, 14 bp, Homo sapiens
cctttcctggtttc

SEQ ID NO: 782891 - DNA, 20 bp, Homo sapiens
cctttcctgtgccaacctga

SEQ ID NO: 782892 - DNA, 18 bp, Homo sapiens
cctttccttccatcccta

SEQ ID NO: 782893 - DNA, 13 bp, Homo sapiens
cctttccttcctt

SEQ ID NO: 782894 - DNA, 21 bp, Homo sapiens
cctttccttccttccctggct

SEQ ID NO: 782895 - DNA, 19 bp, Homo sapiens
cctttcctttttggggagt

SEQ ID NO: 782896 - DNA, 16 bp, Homo sapiens
cctttcgaggcctgaa

SEQ ID NO: 782897 - DNA, 15 bp, Homo sapiens
cctttctaaacaaga

SEQ ID NO: 782898 - DNA, 14 bp, Homo sapiens
cctttctagcctta

SEQ ID NO: 782899 - DNA, 11 bp, Homo sapiens
cctttctcagg

SEQ ID NO: 782900 - DNA, 15 bp, Homo sapiens
cctttctccagccag

SEQ ID NO: 782901 - DNA, 16 bp, Homo sapiens
cctttctccagccagc

SEQ ID NO: 782902 - DNA, 17 bp, Homo sapiens
cctttctccagccagca

SEQ ID NO: 782903 - DNA, 18 bp, Homo sapiens
cctttctccagccagcaa

SEQ ID NO: 782904 - DNA, 20 bp, Homo sapiens
cctttctccagccagcaatg

SEQ ID NO: 782905 - DNA, 12 bp, Homo sapiens
cctttctccagg

SEQ ID NO: 782906 - DNA, 14 bp, Homo sapiens
cctttctccctgca

SEQ ID NO: 782907 - DNA, 17 bp, Homo sapiens
cctttctccctgcagcc

SEQ ID NO: 782908 - DNA, 13 bp, Homo sapiens
cctttctcctccc

SEQ ID NO: 782909 - DNA, 13 bp, Homo sapiens
cctttctctctcc

SEQ ID NO: 782910 - DNA, 22 bp, Homo sapiens
cctttctctctttatacagctg

SEQ ID NO: 782911 - DNA, 11 bp, Homo sapiens
cctttctctga

SEQ ID NO: 782912 - DNA, 18 bp, Homo sapiens
cctttctctttctctctt

SEQ ID NO: 782913 - DNA, 21 bp, Homo sapiens
cctttctctttctctcttccc

SEQ ID NO: 782914 - DNA, 22 bp, Homo sapiens
cctttctctttctctcttccct

SEQ ID NO: 782915 - DNA, 22 bp, Homo sapiens
cctttctcttttcccctttcct

SEQ ID NO: 782916 - DNA, 17 bp, Homo sapiens
cctttctgactgtccct

SEQ ID NO: 782917 - DNA, 18 bp, Homo sapiens
cctttctgactgtccctg

SEQ ID NO: 782918 - DNA, 12 bp, Homo sapiens
cctttctgcccc

SEQ ID NO: 782919 - DNA, 12 bp, Homo sapiens
cctttctgggct

SEQ ID NO: 782920 - DNA, 21 bp, Homo sapiens
cctttctgggctttctcctgg

SEQ ID NO: 782921 - DNA, 14 bp, Homo sapiens
cctttctgtagcct

SEQ ID NO: 782922 - DNA, 17 bp, Homo sapiens
cctttctgtgaagctaa

SEQ ID NO: 782923 - DNA, 13 bp, Homo sapiens
cctttctgtgccc

SEQ ID NO: 782924 - DNA, 19 bp, Homo sapiens
cctttctgtgccctactca

SEQ ID NO: 782925 - DNA, 20 bp, Homo sapiens
cctttctgtgccctactcat

SEQ ID NO: 782926 - DNA, 18 bp, Homo sapiens
cctttcttccaaactttt

SEQ ID NO: 782927 - DNA, 11 bp, Homo sapiens
cctttcttctg

SEQ ID NO: 782928 - DNA, 16 bp, Homo sapiens
cctttcttctgccctt

SEQ ID NO: 782929 - DNA, 15 bp, Homo sapiens
cctttcttggccagt

SEQ ID NO: 782930 - DNA, 18 bp, Homo sapiens
cctttcttggttcataaa

SEQ ID NO: 782931 - DNA, 16 bp, Homo sapiens
cctttctttttcttct

SEQ ID NO: 782932 - DNA, 21 bp, Homo sapiens
cctttgaatattttttgaagg

SEQ ID NO: 782933 - DNA, 18 bp, Homo sapiens
cctttgaatgttaatttt

SEQ ID NO: 782934 - DNA, 15 bp, Homo sapiens
cctttgacaaaagta

SEQ ID NO: 782935 - DNA, 15 bp, Homo sapiens
cctttgacctcggtg

SEQ ID NO: 782936 - DNA, 21 bp, Homo sapiens
cctttgacttcagctgcctga

SEQ ID NO: 782937 - DNA, 21 bp, Homo sapiens
cctttgagagacgccactccc

SEQ ID NO: 782938 - DNA, 22 bp, Homo sapiens
cctttgaggtctaaacaaataa

SEQ ID NO: 782939 - DNA, 14 bp, Homo sapiens
cctttgataaatgt

SEQ ID NO: 782940 - DNA, 19 bp, Homo sapiens
cctttgatagaagataatg

SEQ ID NO: 782941 - DNA, 19 bp, Homo sapiens
cctttgatgaattcttcct

SEQ ID NO: 782942 - DNA, 20 bp, Homo sapiens
cctttgatgaattcttcctc

SEQ ID NO: 782943 - DNA, 21 bp, Homo sapiens
cctttgattaaagactccagt

SEQ ID NO: 782944 - DNA, 18 bp, Homo sapiens
cctttgcaagatgcttgg

SEQ ID NO: 782945 - DNA, 14 bp, Homo sapiens
cctttgcacaggat

SEQ ID NO: 782946 - DNA, 15 bp, Homo sapiens
cctttgcacctgaga

SEQ ID NO: 782947 - DNA, 13 bp, Homo sapiens
cctttgcactgag

SEQ ID NO: 782948 - DNA, 22 bp, Homo sapiens
cctttgcagtgtgcagggtgga

SEQ ID NO: 782949 - DNA, 19 bp, Homo sapiens
cctttgcatagctctcctt

SEQ ID NO: 782950 - DNA, 16 bp, Homo sapiens
cctttgcccagaaaga

SEQ ID NO: 782951 - DNA, 11 bp, Homo sapiens
cctttgccgcg

SEQ ID NO: 782952 - DNA, 12 bp, Homo sapiens
cctttgcctctg

SEQ ID NO: 782953 - DNA, 16 bp, Homo sapiens
cctttgccttaaacct

SEQ ID NO: 782954 - DNA, 15 bp, Homo sapiens
cctttgctccctccc

SEQ ID NO: 782955 - DNA, 22 bp, Homo sapiens
cctttgctgtgaggctgtcctg

SEQ ID NO: 782956 - DNA, 18 bp, Homo sapiens
cctttgctttttcttctc

SEQ ID NO: 782957 - DNA, 22 bp, Homo sapiens
cctttggaacaagacagccttc

SEQ ID NO: 782958 - DNA, 22 bp, Homo sapiens
cctttggagcaaagaaggagct

SEQ ID NO: 782959 - DNA, 13 bp, Homo sapiens
cctttggagggga

SEQ ID NO: 782960 - DNA, 15 bp, Homo sapiens
cctttggccattcca

SEQ ID NO: 782961 - DNA, 11 bp, Homo sapiens
cctttggcttc

SEQ ID NO: 782962 - DNA, 18 bp, Homo sapiens
cctttggggggggcccgc

SEQ ID NO: 782963 - DNA, 21 bp, Homo sapiens
cctttggggtagaccttgagg

SEQ ID NO: 782964 - DNA, 19 bp, Homo sapiens
cctttgggtcctgggcagg

SEQ ID NO: 782965 - DNA, 21 bp, Homo sapiens
cctttgggttctttctggggg

SEQ ID NO: 782966 - DNA, 18 bp, Homo sapiens
cctttggtgaattccttc

SEQ ID NO: 782967 - DNA, 14 bp, Homo sapiens
cctttggttctggc

SEQ ID NO: 782968 - DNA, 18 bp, Homo sapiens
cctttgtaagacatttgt

SEQ ID NO: 782969 - DNA, 20 bp, Homo sapiens
cctttgtaagacatttgtat

SEQ ID NO: 782970 - DNA, 16 bp, Homo sapiens
cctttgtaagtgcagg

SEQ ID NO: 782971 - DNA, 15 bp, Homo sapiens
cctttgtaagttatt

SEQ ID NO: 782972 - DNA, 11 bp, Homo sapiens
cctttgtatta

SEQ ID NO: 782973 - DNA, 15 bp, Homo sapiens
cctttgtattataat

SEQ ID NO: 782974 - DNA, 23 bp, Homo sapiens
cctttgtattataattgttgata

SEQ ID NO: 782975 - DNA, 22 bp, Homo sapiens
cctttgtattctctcctgtacc

SEQ ID NO: 782976 - DNA, 23 bp, Homo sapiens
cctttgtcatcattgtatatatg

SEQ ID NO: 782977 - DNA, 14 bp, Homo sapiens
cctttgtccccaca

SEQ ID NO: 782978 - DNA, 17 bp, Homo sapiens
cctttgtcttgtacttc

SEQ ID NO: 782979 - DNA, 21 bp, Homo sapiens
cctttgtcttttttttcatcc

SEQ ID NO: 782980 - DNA, 16 bp, Homo sapiens
cctttgtgagtcaata

SEQ ID NO: 782981 - DNA, 15 bp, Homo sapiens
cctttgtgcagcttc

SEQ ID NO: 782982 - DNA, 21 bp, Homo sapiens
cctttgtgcagcttcgaggac

SEQ ID NO: 782983 - DNA, 12 bp, Homo sapiens
cctttgtgctgc

SEQ ID NO: 782984 - DNA, 19 bp, Homo sapiens
cctttgtgtgtactcactg

SEQ ID NO: 782985 - DNA, 13 bp, Homo sapiens
cctttgtgtttct

SEQ ID NO: 782986 - DNA, 15 bp, Homo sapiens
cctttgttaaattta

SEQ ID NO: 782987 - DNA, 15 bp, Homo sapiens
cctttgttaacctta

SEQ ID NO: 782988 - DNA, 15 bp, Homo sapiens
cctttgttctgagca

SEQ ID NO: 782989 - DNA, 13 bp, Homo sapiens
ccttttacagctc

SEQ ID NO: 782990 - DNA, 17 bp, Homo sapiens
ccttttacatactgctg

SEQ ID NO: 782991 - DNA, 18 bp, Homo sapiens
ccttttacattctgtgtg

SEQ ID NO: 782992 - DNA, 12 bp, Homo sapiens
ccttttactggt

SEQ ID NO: 782993 - DNA, 17 bp, Homo sapiens
ccttttacttttttata

SEQ ID NO: 782994 - DNA, 19 bp, Homo sapiens
ccttttataccagagacct

SEQ ID NO: 782995 - DNA, 11 bp, Homo sapiens
ccttttatata

SEQ ID NO: 782996 - DNA, 15 bp, Homo sapiens
ccttttatctgcaga

SEQ ID NO: 782997 - DNA, 17 bp, Homo sapiens
ccttttatctggtgcct

SEQ ID NO: 782998 - DNA, 19 bp, Homo sapiens
ccttttatttttttctaat

SEQ ID NO: 782999 - DNA, 15 bp, Homo sapiens
ccttttcactacacc

SEQ ID NO: 783000 - DNA, 14 bp, Homo sapiens
ccttttcagccctt

SEQ ID NO: 783001 - DNA, 15 bp, Homo sapiens
ccttttcagcccttt

SEQ ID NO: 783002 - DNA, 23 bp, Homo sapiens
ccttttcagcgatgtatgcagct

SEQ ID NO: 783003 - DNA, 14 bp, Homo sapiens
ccttttcaggaaaa

SEQ ID NO: 783004 - DNA, 12 bp, Homo sapiens
ccttttcagggc

SEQ ID NO: 783005 - DNA, 17 bp, Homo sapiens
ccttttcatctgttgtt

SEQ ID NO: 783006 - DNA, 11 bp, Homo sapiens
ccttttccaaa

SEQ ID NO: 783007 - DNA, 17 bp, Homo sapiens
ccttttcccctacagaa

SEQ ID NO: 783008 - DNA, 19 bp, Homo sapiens
ccttttccctgcttccagg

SEQ ID NO: 783009 - DNA, 18 bp, Homo sapiens
ccttttcctattctgttg

SEQ ID NO: 783010 - DNA, 14 bp, Homo sapiens
ccttttctataagt

SEQ ID NO: 783011 - DNA, 15 bp, Homo sapiens
ccttttctccccacg

SEQ ID NO: 783012 - DNA, 12 bp, Homo sapiens
ccttttctctgc

SEQ ID NO: 783013 - DNA, 19 bp, Homo sapiens
ccttttctctgcttgccta

SEQ ID NO: 783014 - DNA, 14 bp, Homo sapiens
ccttttctgcattt

SEQ ID NO: 783015 - DNA, 23 bp, Homo sapiens
ccttttctgtgccagacattgct

SEQ ID NO: 783016 - DNA, 14 bp, Homo sapiens
ccttttctgttcta

SEQ ID NO: 783017 - DNA, 12 bp, Homo sapiens
ccttttcttaaa

SEQ ID NO: 783018 - DNA, 19 bp, Homo sapiens
ccttttctttgttcaagat

SEQ ID NO: 783019 - DNA, 22 bp, Homo sapiens
ccttttcttttctaccctagcc

SEQ ID NO: 783020 - DNA, 19 bp, Homo sapiens
ccttttgatgttcagagtg

SEQ ID NO: 783021 - DNA, 23 bp, Homo sapiens
ccttttgatgttcagagtggctc

SEQ ID NO: 783022 - DNA, 14 bp, Homo sapiens
ccttttgcacccct

SEQ ID NO: 783023 - DNA, 15 bp, Homo sapiens
ccttttgcacccctc

SEQ ID NO: 783024 - DNA, 17 bp, Homo sapiens
ccttttgcacctgctct

SEQ ID NO: 783025 - DNA, 20 bp, Homo sapiens
ccttttgcacctgctctctt

SEQ ID NO: 783026 - DNA, 14 bp, Homo sapiens
ccttttgcctggct

SEQ ID NO: 783027 - DNA, 15 bp, Homo sapiens
ccttttgcctggctg

SEQ ID NO: 783028 - DNA, 19 bp, Homo sapiens
ccttttgcgcttatttgga

SEQ ID NO: 783029 - DNA, 11 bp, Homo sapiens
ccttttggaac

SEQ ID NO: 783030 - DNA, 22 bp, Homo sapiens
ccttttggaacatttctttctt

SEQ ID NO: 783031 - DNA, 21 bp, Homo sapiens
ccttttggcccccgagctggg

SEQ ID NO: 783032 - DNA, 15 bp, Homo sapiens
ccttttggtcttcag

SEQ ID NO: 783033 - DNA, 17 bp, Homo sapiens
ccttttggtcttcagcc

SEQ ID NO: 783034 - DNA, 13 bp, Homo sapiens
ccttttggtgtgt

SEQ ID NO: 783035 - DNA, 19 bp, Homo sapiens
ccttttgtatcttcctttc

SEQ ID NO: 783036 - DNA, 14 bp, Homo sapiens
ccttttgtccccag

SEQ ID NO: 783037 - DNA, 20 bp, Homo sapiens
ccttttgtgggtttctctgt

SEQ ID NO: 783038 - DNA, 18 bp, Homo sapiens
ccttttgttttgaagctg

SEQ ID NO: 783039 - DNA, 17 bp, Homo sapiens
cctttttaaaaaatacc

SEQ ID NO: 783040 - DNA, 21 bp, Homo sapiens
cctttttaaatgtgaattttt

SEQ ID NO: 783041 - DNA, 19 bp, Homo sapiens
cctttttaatatgcttaaa

SEQ ID NO: 783042 - DNA, 12 bp, Homo sapiens
cctttttcaatg

SEQ ID NO: 783043 - DNA, 22 bp, Homo sapiens
cctttttcatatgttgctcagt

SEQ ID NO: 783044 - DNA, 13 bp, Homo sapiens
cctttttcattta

SEQ ID NO: 783045 - DNA, 16 bp, Homo sapiens
cctttttctccagctg

SEQ ID NO: 783046 - DNA, 18 bp, Homo sapiens
cctttttctccctctgga

SEQ ID NO: 783047 - DNA, 14 bp, Homo sapiens
cctttttctgagat

SEQ ID NO: 783048 - DNA, 18 bp, Homo sapiens
cctttttctgagatgctc

SEQ ID NO: 783049 - DNA, 16 bp, Homo sapiens
cctttttctttataaa

SEQ ID NO: 783050 - DNA, 15 bp, Homo sapiens
cctttttgacactga

SEQ ID NO: 783051 - DNA, 14 bp, Homo sapiens
cctttttgactttt

SEQ ID NO: 783052 - DNA, 22 bp, Homo sapiens
cctttttgacttttccaagccc

SEQ ID NO: 783053 - DNA, 19 bp, Homo sapiens
cctttttgtataaaataga

SEQ ID NO: 783054 - DNA, 13 bp, Homo sapiens
ccttttttataac

SEQ ID NO: 783055 - DNA, 16 bp, Homo sapiens
ccttttttataactaa

SEQ ID NO: 783056 - DNA, 12 bp, Homo sapiens
ccttttttatac

SEQ ID NO: 783057 - DNA, 17 bp, Homo sapiens
ccttttttatacataaa

SEQ ID NO: 783058 - DNA, 22 bp, Homo sapiens
ccttttttcacggaagttttca

SEQ ID NO: 783059 - DNA, 20 bp, Homo sapiens
ccttttttctcttctgtcca

SEQ ID NO: 783060 - DNA, 14 bp, Homo sapiens
ccttttttgtagtt

SEQ ID NO: 783061 - DNA, 21 bp, Homo sapiens
ccttttttgtcattttatgaa

SEQ ID NO: 783062 - DNA, 17 bp, Homo sapiens
ccttttttgtcccccaa

SEQ ID NO: 783063 - DNA, 17 bp, Homo sapiens
cctttttttaggccaca

SEQ ID NO: 783064 - DNA, 16 bp, Homo sapiens
cctttttttttgaaac

SEQ ID NO: 783065 - DNA, 14 bp, Homo sapiens
cgaaaaatgtgtgg

SEQ ID NO: 783066 - DNA, 13 bp, Homo sapiens
cgaaaatcaaatg

SEQ ID NO: 783067 - DNA, 16 bp, Homo sapiens
cgaaaccaaagaagaa

SEQ ID NO: 783068 - DNA, 11 bp, Homo sapiens
cgaaactgcca

SEQ ID NO: 783069 - DNA, 16 bp, Homo sapiens
cgaaactgccaagggt

SEQ ID NO: 783070 - DNA, 19 bp, Homo sapiens
cgaaacttgttattgtgaa

SEQ ID NO: 783071 - DNA, 23 bp, Homo sapiens
cgaaacttgttattgtgaatgat

SEQ ID NO: 783072 - DNA, 22 bp, Homo sapiens
cgaaagcatcactgccttggcc

SEQ ID NO: 783073 - DNA, 20 bp, Homo sapiens
cgaaaggcaattatatctat

SEQ ID NO: 783074 - DNA, 19 bp, Homo sapiens
cgaaataattgttgttctg

SEQ ID NO: 783075 - DNA, 17 bp, Homo sapiens
cgaaatatcaaagtcat

SEQ ID NO: 783076 - DNA, 16 bp, Homo sapiens
cgaaatcagcccccag

SEQ ID NO: 783077 - DNA, 18 bp, Homo sapiens
cgaaatcagcccccagcc

SEQ ID NO: 783078 - DNA, 20 bp, Homo sapiens
cgaacatatcatttgtgaag

SEQ ID NO: 783079 - DNA, 13 bp, Homo sapiens
cgaacatgtgttt

SEQ ID NO: 783080 - DNA, 15 bp, Homo sapiens
cgaaccaaggcagcc

SEQ ID NO: 783081 - DNA, 16 bp, Homo sapiens
cgaaccaaggcagcct

SEQ ID NO: 783082 - DNA, 17 bp, Homo sapiens
cgaaccaaggcagcctc

SEQ ID NO: 783083 - DNA, 13 bp, Homo sapiens
cgaacgtatttct

SEQ ID NO: 783084 - DNA, 13 bp, Homo sapiens
cgaactccaggct

SEQ ID NO: 783085 - DNA, 22 bp, Homo sapiens
cgaagagtttaaagagaaaagg

SEQ ID NO: 783086 - DNA, 22 bp, Homo sapiens
cgaagccatcacttctccccgc

SEQ ID NO: 783087 - DNA, 20 bp, Homo sapiens
cgaagccatctttctttgga

SEQ ID NO: 783088 - DNA, 15 bp, Homo sapiens
cgaagccccttggag

SEQ ID NO: 783089 - DNA, 22 bp, Homo sapiens
cgaagcctgctgattgattttt

SEQ ID NO: 783090 - DNA, 17 bp, Homo sapiens
cgaaggccattgggttt

SEQ ID NO: 783091 - DNA, 18 bp, Homo sapiens
cgaaggccccgcctgggt

SEQ ID NO: 783092 - DNA, 16 bp, Homo sapiens
cgaagggagcatctgt

SEQ ID NO: 783093 - DNA, 15 bp, Homo sapiens
cgaagggattgtgta

SEQ ID NO: 783094 - DNA, 21 bp, Homo sapiens
cgaaggggccccggggctggc

SEQ ID NO: 783095 - DNA, 22 bp, Homo sapiens
cgaaggggccccggggctggca

SEQ ID NO: 783096 - DNA, 15 bp, Homo sapiens
cgaagtagcttgctc

SEQ ID NO: 783097 - DNA, 21 bp, Homo sapiens
cgaagtagcttgctccctgtg

SEQ ID NO: 783098 - DNA, 19 bp, Homo sapiens
cgaatacttttgccctttg

SEQ ID NO: 783099 - DNA, 15 bp, Homo sapiens
cgaatatagttctgt

SEQ ID NO: 783100 - DNA, 14 bp, Homo sapiens
cgaatatattactg

SEQ ID NO: 783101 - DNA, 15 bp, Homo sapiens
cgaatatattactga

SEQ ID NO: 783102 - DNA, 15 bp, Homo sapiens
cgaatatgaatgtca

SEQ ID NO: 783103 - DNA, 17 bp, Homo sapiens
cgaatattgagcaatat

SEQ ID NO: 783104 - DNA, 18 bp, Homo sapiens
cgaatccaagctccctgc

SEQ ID NO: 783105 - DNA, 22 bp, Homo sapiens
cgaatccaagctccctgcccca

SEQ ID NO: 783106 - DNA, 16 bp, Homo sapiens
cgaatctctgtgcctt

SEQ ID NO: 783107 - DNA, 23 bp, Homo sapiens
cgaatggggtagaaacattgtaa

SEQ ID NO: 783108 - DNA, 14 bp, Homo sapiens
cgaatgggttttct

SEQ ID NO: 783109 - DNA, 20 bp, Homo sapiens
cgaatggtctttgctccaga

SEQ ID NO: 783110 - DNA, 21 bp, Homo sapiens
cgaatggtctttgctccagat

SEQ ID NO: 783111 - DNA, 18 bp, Homo sapiens
cgaatgtaattggaatct

SEQ ID NO: 783112 - DNA, 21 bp, Homo sapiens
cgaatgtgcaggtttgttaca

SEQ ID NO: 783113 - DNA, 19 bp, Homo sapiens
cgaatgtgtctttagatag

SEQ ID NO: 783114 - DNA, 16 bp, Homo sapiens
cgaattaatagctttt

SEQ ID NO: 783115 - DNA, 15 bp, Homo sapiens
cgaattctcagacga

SEQ ID NO: 783116 - DNA, 23 bp, Homo sapiens
cgaattctcagacgacacctgga

SEQ ID NO: 783117 - DNA, 17 bp, Homo sapiens
cgaatttttcagatgat

SEQ ID NO: 783118 - DNA, 22 bp, Homo sapiens
cgacaaaaacaagactgcctcc

SEQ ID NO: 783119 - DNA, 23 bp, Homo sapiens
cgacaaaaacaagactgcctccc

SEQ ID NO: 783120 - DNA, 16 bp, Homo sapiens
cgacaaaggccacagg

SEQ ID NO: 783121 - DNA, 18 bp, Homo sapiens
cgacaaaggccacaggca

SEQ ID NO: 783122 - DNA, 12 bp, Homo sapiens
cgacaagtgctg

SEQ ID NO: 783123 - DNA, 19 bp, Homo sapiens
cgacaatgccctgctggcc

SEQ ID NO: 783124 - DNA, 23 bp, Homo sapiens
cgacaatgtcgagtatattatta

SEQ ID NO: 783125 - DNA, 19 bp, Homo sapiens
cgacacacggggctcgggc

SEQ ID NO: 783126 - DNA, 15 bp, Homo sapiens
cgacacatttaccaa

SEQ ID NO: 783127 - DNA, 16 bp, Homo sapiens
cgacacatttaccaaa

SEQ ID NO: 783128 - DNA, 20 bp, Homo sapiens
cgacacgtgggctcccctct

SEQ ID NO: 783129 - DNA, 13 bp, Homo sapiens
cgacactcagggc

SEQ ID NO: 783130 - DNA, 14 bp, Homo sapiens
cgacactcagggca

SEQ ID NO: 783131 - DNA, 15 bp, Homo sapiens
cgacactcagggcag

SEQ ID NO: 783132 - DNA, 21 bp, Homo sapiens
cgacactcagggcagctgcct

SEQ ID NO: 783133 - DNA, 16 bp, Homo sapiens
cgacactgctgcacca

SEQ ID NO: 783134 - DNA, 19 bp, Homo sapiens
cgacagattcataaagtaa

SEQ ID NO: 783135 - DNA, 20 bp, Homo sapiens
cgacaggtgggcctgggagg

SEQ ID NO: 783136 - DNA, 15 bp, Homo sapiens
cgacagtggctctcc

SEQ ID NO: 783137 - DNA, 15 bp, Homo sapiens
cgacagttctgaact

SEQ ID NO: 783138 - DNA, 18 bp, Homo sapiens
cgacatacatgctacttt

SEQ ID NO: 783139 - DNA, 19 bp, Homo sapiens
cgacatacatgctactttt

SEQ ID NO: 783140 - DNA, 18 bp, Homo sapiens
cgacatcccagaccagcc

SEQ ID NO: 783141 - DNA, 19 bp, Homo sapiens
cgacatcccagaccagcca

SEQ ID NO: 783142 - DNA, 20 bp, Homo sapiens
cgacatccctcccccagcag

SEQ ID NO: 783143 - DNA, 14 bp, Homo sapiens
cgaccaatccccag

SEQ ID NO: 783144 - DNA, 11 bp, Homo sapiens
cgaccaggaaa

SEQ ID NO: 783145 - DNA, 23 bp, Homo sapiens
cgacccagccagctgcagggcac

SEQ ID NO: 783146 - DNA, 13 bp, Homo sapiens
cgaccccagactg

SEQ ID NO: 783147 - DNA, 15 bp, Homo sapiens
cgaccccagactgta

SEQ ID NO: 783148 - DNA, 15 bp, Homo sapiens
cgacccccgcagagg

SEQ ID NO: 783149 - DNA, 12 bp, Homo sapiens
cgaccctcctgg

SEQ ID NO: 783150 - DNA, 13 bp, Homo sapiens
cgaccctcctggc

SEQ ID NO: 783151 - DNA, 18 bp, Homo sapiens
cgaccctcctggccttcc

SEQ ID NO: 783152 - DNA, 15 bp, Homo sapiens
cgaccctctgggaac

SEQ ID NO: 783153 - DNA, 19 bp, Homo sapiens
cgaccgaggctggagctgg

SEQ ID NO: 783154 - DNA, 20 bp, Homo sapiens
cgaccgaggctggagctggc

SEQ ID NO: 783155 - DNA, 14 bp, Homo sapiens
cgacctcagccttc

SEQ ID NO: 783156 - DNA, 12 bp, Homo sapiens
cgacctcggtgg

SEQ ID NO: 783157 - DNA, 23 bp, Homo sapiens
cgacctcgtcctccccctgccag

SEQ ID NO: 783158 - DNA, 16 bp, Homo sapiens
cgacctctctcagccc

SEQ ID NO: 783159 - DNA, 18 bp, Homo sapiens
cgacctggtttttaaata

SEQ ID NO: 783160 - DNA, 17 bp, Homo sapiens
cgaccttctggtatctt

SEQ ID NO: 783161 - DNA, 17 bp, Homo sapiens
cgacgccccgaacctca

SEQ ID NO: 783162 - DNA, 16 bp, Homo sapiens
cgacgcgggcttctgg

SEQ ID NO: 783163 - DNA, 17 bp, Homo sapiens
cgacggcctccaggagg

SEQ ID NO: 783164 - DNA, 22 bp, Homo sapiens
cgacggtgggcatttgtgaggc

SEQ ID NO: 783165 - DNA, 19 bp, Homo sapiens
cgacggtttcaaaccagga

SEQ ID NO: 783166 - DNA, 16 bp, Homo sapiens
cgacgtccccaaacct

SEQ ID NO: 783167 - DNA, 13 bp, Homo sapiens
cgactagccagga

SEQ ID NO: 783168 - DNA, 12 bp, Homo sapiens
cgactatagaaa

SEQ ID NO: 783169 - DNA, 12 bp, Homo sapiens
cgactcaaaatg

SEQ ID NO: 783170 - DNA, 21 bp, Homo sapiens
cgactccagatatgaacaggg

SEQ ID NO: 783171 - DNA, 20 bp, Homo sapiens
cgactctatagactctagga

SEQ ID NO: 783172 - DNA, 18 bp, Homo sapiens
cgactcttcctgcaaagg

SEQ ID NO: 783173 - DNA, 17 bp, Homo sapiens
cgactgaaaatattgtt

SEQ ID NO: 783174 - DNA, 18 bp, Homo sapiens
cgactgaaaatattgttt

SEQ ID NO: 783175 - DNA, 20 bp, Homo sapiens
cgactgaagtcagtgtagac

SEQ ID NO: 783176 - DNA, 16 bp, Homo sapiens
cgactgcccagccact

SEQ ID NO: 783177 - DNA, 11 bp, Homo sapiens
cgactgcctgt

SEQ ID NO: 783178 - DNA, 16 bp, Homo sapiens
cgactggatgctcgcc

SEQ ID NO: 783179 - DNA, 14 bp, Homo sapiens
cgactggccagggc

SEQ ID NO: 783180 - DNA, 14 bp, Homo sapiens
cgactggtccagct

SEQ ID NO: 783181 - DNA, 18 bp, Homo sapiens
cgactggtccagctctga

SEQ ID NO: 783182 - DNA, 17 bp, Homo sapiens
cgacttcccctgggcaa

SEQ ID NO: 783183 - DNA, 18 bp, Homo sapiens
cgacttcccctgggcaag

SEQ ID NO: 783184 - DNA, 15 bp, Homo sapiens
cgacttcctgactct

SEQ ID NO: 783185 - DNA, 23 bp, Homo sapiens
cgacttcttggttttctctctgg

SEQ ID NO: 783186 - DNA, 20 bp, Homo sapiens
cgacttgaccctttcctccc

SEQ ID NO: 783187 - DNA, 16 bp, Homo sapiens
cgacttggagactcct

SEQ ID NO: 783188 - DNA, 22 bp, Homo sapiens
cgacttggagactcctggtctg

SEQ ID NO: 783189 - DNA, 18 bp, Homo sapiens
cgacttttgttctcttct

SEQ ID NO: 783190 - DNA, 21 bp, Homo sapiens
cgagaaagaggcaccaggaag

SEQ ID NO: 783191 - DNA, 12 bp, Homo sapiens
cgagaagtgctc

SEQ ID NO: 783192 - DNA, 23 bp, Homo sapiens
cgagaagtgctcttggctgaccc

SEQ ID NO: 783193 - DNA, 15 bp, Homo sapiens
cgagacacattgcct

SEQ ID NO: 783194 - DNA, 17 bp, Homo sapiens
cgagacacattgccttc

SEQ ID NO: 783195 - DNA, 16 bp, Homo sapiens
cgagaccagcctggcc

SEQ ID NO: 783196 - DNA, 22 bp, Homo sapiens
cgagaccagcctggccatcatg

SEQ ID NO: 783197 - DNA, 16 bp, Homo sapiens
cgagaccatcctggcc

SEQ ID NO: 783198 - DNA, 16 bp, Homo sapiens
cgagaccatcctggct

SEQ ID NO: 783199 - DNA, 17 bp, Homo sapiens
cgagacccaagggcaga

SEQ ID NO: 783200 - DNA, 11 bp, Homo sapiens
cgagactctga

SEQ ID NO: 783201 - DNA, 18 bp, Homo sapiens
cgagacttggtttcaaaa

SEQ ID NO: 783202 - DNA, 17 bp, Homo sapiens
cgagagatcaaagatga

SEQ ID NO: 783203 - DNA, 15 bp, Homo sapiens
cgagaggccagttga

SEQ ID NO: 783204 - DNA, 16 bp, Homo sapiens
cgagagggagagagag

SEQ ID NO: 783205 - DNA, 15 bp, Homo sapiens
cgagaggtgggccag

SEQ ID NO: 783206 - DNA, 14 bp, Homo sapiens
cgagagtctgtctc

SEQ ID NO: 783207 - DNA, 20 bp, Homo sapiens
cgagataggggaggggggag

SEQ ID NO: 783208 - DNA, 18 bp, Homo sapiens
cgagatccccagggcagc

SEQ ID NO: 783209 - DNA, 22 bp, Homo sapiens
cgagatccccagggcagcctgg

SEQ ID NO: 783210 - DNA, 18 bp, Homo sapiens
cgagatcgggaagcagaa

SEQ ID NO: 783211 - DNA, 23 bp, Homo sapiens
cgagatggcagattcccactgcc

SEQ ID NO: 783212 - DNA, 16 bp, Homo sapiens
cgagatgtgagtcctg

SEQ ID NO: 783213 - DNA, 23 bp, Homo sapiens
cgagattatcgttttcttaaagt

SEQ ID NO: 783214 - DNA, 15 bp, Homo sapiens
cgagcaaacccagag

SEQ ID NO: 783215 - DNA, 12 bp, Homo sapiens
cgagcacccacg

SEQ ID NO: 783216 - DNA, 14 bp, Homo sapiens
cgagcactggccag

SEQ ID NO: 783217 - DNA, 17 bp, Homo sapiens
cgagcactggccagaga

SEQ ID NO: 783218 - DNA, 19 bp, Homo sapiens
cgagcactggccagagagg

SEQ ID NO: 783219 - DNA, 23 bp, Homo sapiens
cgagcatccccctcctctccctg

SEQ ID NO: 783220 - DNA, 22 bp, Homo sapiens
cgagcatgcggagccagcaggc

SEQ ID NO: 783221 - DNA, 15 bp, Homo sapiens
cgagcatgtcgtgga

SEQ ID NO: 783222 - DNA, 19 bp, Homo sapiens
cgagcatgttgttttttca

SEQ ID NO: 783223 - DNA, 17 bp, Homo sapiens
cgagccacaagctgcac

SEQ ID NO: 783224 - DNA, 16 bp, Homo sapiens
cgagccacaggaacgg

SEQ ID NO: 783225 - DNA, 18 bp, Homo sapiens
cgagccaccatgcttgcc

SEQ ID NO: 783226 - DNA, 14 bp, Homo sapiens
cgagcccagctaca

SEQ ID NO: 783227 - DNA, 19 bp, Homo sapiens
cgagcccagctacattcct

SEQ ID NO: 783228 - DNA, 15 bp, Homo sapiens
cgagcccaggcagct

SEQ ID NO: 783229 - DNA, 12 bp, Homo sapiens
cgagccctgact

SEQ ID NO: 783230 - DNA, 19 bp, Homo sapiens
cgagccctgactcctggac

SEQ ID NO: 783231 - DNA, 20 bp, Homo sapiens
cgagccctgactcctggact

SEQ ID NO: 783232 - DNA, 21 bp, Homo sapiens
cgagccctgactcctggactc

SEQ ID NO: 783233 - DNA, 22 bp, Homo sapiens
cgagccctgactcctggactcc

SEQ ID NO: 783234 - DNA, 15 bp, Homo sapiens
cgagccgggcctggg

SEQ ID NO: 783235 - DNA, 17 bp, Homo sapiens
cgagccgggcctggggc

SEQ ID NO: 783236 - DNA, 14 bp, Homo sapiens
cgagcctaatgaaa

SEQ ID NO: 783237 - DNA, 21 bp, Homo sapiens
cgagctactctcttgccagca

SEQ ID NO: 783238 - DNA, 10 bp, Homo sapiens
cgagctcctc

SEQ ID NO: 783239 - DNA, 17 bp, Homo sapiens
cgagctcctggggagct

SEQ ID NO: 783240 - DNA, 20 bp, Homo sapiens
cgagctcgtgtatcctgggg

SEQ ID NO: 783241 - DNA, 16 bp, Homo sapiens
cgagctgggggccatg

SEQ ID NO: 783242 - DNA, 23 bp, Homo sapiens
cgagctgggggccatgagctcca

SEQ ID NO: 783243 - DNA, 15 bp, Homo sapiens
cgagcttggccttgg

SEQ ID NO: 783244 - DNA, 20 bp, Homo sapiens
cgagcttggccttgggccgg

SEQ ID NO: 783245 - DNA, 19 bp, Homo sapiens
cgaggaaaaggtccttgcc

SEQ ID NO: 783246 - DNA, 18 bp, Homo sapiens
cgaggaaaggattttacc

SEQ ID NO: 783247 - DNA, 19 bp, Homo sapiens
cgaggaaccagagccatgg

SEQ ID NO: 783248 - DNA, 14 bp, Homo sapiens
cgaggaagcacagc

SEQ ID NO: 783249 - DNA, 20 bp, Homo sapiens
cgaggaagcacagcttgggt

SEQ ID NO: 783250 - DNA, 15 bp, Homo sapiens
cgaggacccaggaaa

SEQ ID NO: 783251 - DNA, 16 bp, Homo sapiens
cgaggagcagcagcgc

SEQ ID NO: 783252 - DNA, 11 bp, Homo sapiens
cgaggagctgg

SEQ ID NO: 783253 - DNA, 15 bp, Homo sapiens
cgaggagctgggccc

SEQ ID NO: 783254 - DNA, 12 bp, Homo sapiens
cgaggagtaaca

SEQ ID NO: 783255 - DNA, 14 bp, Homo sapiens
cgaggagtaacaat

SEQ ID NO: 783256 - DNA, 19 bp, Homo sapiens
cgaggcaccggcgctgcag

SEQ ID NO: 783257 - DNA, 21 bp, Homo sapiens
cgaggcaccggcgctgcaggt

SEQ ID NO: 783258 - DNA, 22 bp, Homo sapiens
cgaggcatggggcatgtccttt

SEQ ID NO: 783259 - DNA, 18 bp, Homo sapiens
cgaggccactcagaggcc

SEQ ID NO: 783260 - DNA, 20 bp, Homo sapiens
cgaggccactcagaggcccc

SEQ ID NO: 783261 - DNA, 19 bp, Homo sapiens
cgaggctccccgcctccac

SEQ ID NO: 783262 - DNA, 20 bp, Homo sapiens
cgaggctccccgcctccact

SEQ ID NO: 783263 - DNA, 21 bp, Homo sapiens
cgaggctccccgcctccactc

SEQ ID NO: 783264 - DNA, 22 bp, Homo sapiens
cgaggctccccgcctccactct

SEQ ID NO: 783265 - DNA, 12 bp, Homo sapiens
cgaggctgagaa

SEQ ID NO: 783266 - DNA, 14 bp, Homo sapiens
cgaggctgccccag

SEQ ID NO: 783267 - DNA, 15 bp, Homo sapiens
cgaggctgcccccat

SEQ ID NO: 783268 - DNA, 15 bp, Homo sapiens
cgaggctggagctgg

SEQ ID NO: 783269 - DNA, 14 bp, Homo sapiens
cgaggctggtggtt

SEQ ID NO: 783270 - DNA, 15 bp, Homo sapiens
cgagggatggtgccc

SEQ ID NO: 783271 - DNA, 16 bp, Homo sapiens
cgagggcaacagggag

SEQ ID NO: 783272 - DNA, 12 bp, Homo sapiens
cgagggccaggc

SEQ ID NO: 783273 - DNA, 13 bp, Homo sapiens
cgagggccaggca

SEQ ID NO: 783274 - DNA, 12 bp, Homo sapiens
cgagggccgcct

SEQ ID NO: 783275 - DNA, 20 bp, Homo sapiens
cgagggcgaaggccattggg

SEQ ID NO: 783276 - DNA, 16 bp, Homo sapiens
cgagggcggccaggga

SEQ ID NO: 783277 - DNA, 16 bp, Homo sapiens
cgagggctcagaagag

SEQ ID NO: 783278 - DNA, 19 bp, Homo sapiens
cgagggctcagaagagcag

SEQ ID NO: 783279 - DNA, 22 bp, Homo sapiens
cgagggctgaggagcagccagg

SEQ ID NO: 783280 - DNA, 21 bp, Homo sapiens
cgagggctgatggaggaaaaa

SEQ ID NO: 783281 - DNA, 19 bp, Homo sapiens
cgagggctggctggcctca

SEQ ID NO: 783282 - DNA, 23 bp, Homo sapiens
cgagggctggctggcctcaccca

SEQ ID NO: 783283 - DNA, 18 bp, Homo sapiens
cgaggggacccatggggg

SEQ ID NO: 783284 - DNA, 14 bp, Homo sapiens
cgaggggagggcag

SEQ ID NO: 783285 - DNA, 19 bp, Homo sapiens
cgaggggagggtggcaggt

SEQ ID NO: 783286 - DNA, 15 bp, Homo sapiens
cgaggggccagcaga

SEQ ID NO: 783287 - DNA, 17 bp, Homo sapiens
cgaggggccagcagagg

SEQ ID NO: 783288 - DNA, 18 bp, Homo sapiens
cgaggggccagcagaggg

SEQ ID NO: 783289 - DNA, 17 bp, Homo sapiens
cgaggggctcaggaaaa

SEQ ID NO: 783290 - DNA, 22 bp, Homo sapiens
cgagggggctgtcatgcggttt

SEQ ID NO: 783291 - DNA, 16 bp, Homo sapiens
cgagggtcctggctcc

SEQ ID NO: 783292 - DNA, 19 bp, Homo sapiens
cgagggtctcccctcctgc

SEQ ID NO: 783293 - DNA, 22 bp, Homo sapiens
cgagggtctcccctcctgcaca

SEQ ID NO: 783294 - DNA, 14 bp, Homo sapiens
cgaggtagagtttg

SEQ ID NO: 783295 - DNA, 21 bp, Homo sapiens
cgaggtcaacagagaaggcag

SEQ ID NO: 783296 - DNA, 14 bp, Homo sapiens
cgaggtcaggagat

SEQ ID NO: 783297 - DNA, 20 bp, Homo sapiens
cgaggtgtcaccctgcagag

SEQ ID NO: 783298 - DNA, 17 bp, Homo sapiens
cgaggttaaagaagctg

SEQ ID NO: 783299 - DNA, 17 bp, Homo sapiens
cgaggttcccagggctg

SEQ ID NO: 783300 - DNA, 17 bp, Homo sapiens
cgaggttgtggggaggc

SEQ ID NO: 783301 - DNA, 21 bp, Homo sapiens
cgaggttgtggggaggctgca

SEQ ID NO: 783302 - DNA, 16 bp, Homo sapiens
cgagtagaaaatgtga

SEQ ID NO: 783303 - DNA, 20 bp, Homo sapiens
cgagtagaaaatgtgaccct

SEQ ID NO: 783304 - DNA, 14 bp, Homo sapiens
cgagtatctgtaac

SEQ ID NO: 783305 - DNA, 16 bp, Homo sapiens
cgagtcaatcccctca

SEQ ID NO: 783306 - DNA, 13 bp, Homo sapiens
cgagtcacctgca

SEQ ID NO: 783307 - DNA, 20 bp, Homo sapiens
cgagtcattcgttctgtgga

SEQ ID NO: 783308 - DNA, 18 bp, Homo sapiens
cgagtccgcccatccctg

SEQ ID NO: 783309 - DNA, 16 bp, Homo sapiens
cgagtctcttctccac

SEQ ID NO: 783310 - DNA, 15 bp, Homo sapiens
cgagtctgggacaca

SEQ ID NO: 783311 - DNA, 13 bp, Homo sapiens
cgagtctggggac

SEQ ID NO: 783312 - DNA, 14 bp, Homo sapiens
cgagtgtagctgtg

SEQ ID NO: 783313 - DNA, 15 bp, Homo sapiens
cgagtgtagctgtga

SEQ ID NO: 783314 - DNA, 13 bp, Homo sapiens
cgagttcctctgg

SEQ ID NO: 783315 - DNA, 22 bp, Homo sapiens
cgagttgtggaaagcctctgct

SEQ ID NO: 783316 - DNA, 20 bp, Homo sapiens
cgataaaactaaatatatgt

SEQ ID NO: 783317 - DNA, 21 bp, Homo sapiens
cgatacaccgggcctggagaa

SEQ ID NO: 783318 - DNA, 15 bp, Homo sapiens
cgatatactctagat

SEQ ID NO: 783319 - DNA, 16 bp, Homo sapiens
cgatatttttaaagat

SEQ ID NO: 783320 - DNA, 15 bp, Homo sapiens
cgatcaagagaatca

SEQ ID NO: 783321 - DNA, 23 bp, Homo sapiens
cgatcaagttgttgactgtgatt

SEQ ID NO: 783322 - DNA, 21 bp, Homo sapiens
cgatcatatttccccttggac

SEQ ID NO: 783323 - DNA, 18 bp, Homo sapiens
cgatcatttatttcatga

SEQ ID NO: 783324 - DNA, 22 bp, Homo sapiens
cgatccacctgtctcagcctcc

SEQ ID NO: 783325 - DNA, 14 bp, Homo sapiens
cgatcccacacagg

SEQ ID NO: 783326 - DNA, 17 bp, Homo sapiens
cgatccccgcttcccct

SEQ ID NO: 783327 - DNA, 22 bp, Homo sapiens
cgatccccgcttccccttgcca

SEQ ID NO: 783328 - DNA, 14 bp, Homo sapiens
cgatcctcctgtct

SEQ ID NO: 783329 - DNA, 13 bp, Homo sapiens
cgatccttcctcc

SEQ ID NO: 783330 - DNA, 11 bp, Homo sapiens
cgatctcctga

SEQ ID NO: 783331 - DNA, 13 bp, Homo sapiens
cgatctctcctgg

SEQ ID NO: 783332 - DNA, 17 bp, Homo sapiens
cgatctctcctggccta

SEQ ID NO: 783333 - DNA, 17 bp, Homo sapiens
cgatctcttattttaca

SEQ ID NO: 783334 - DNA, 20 bp, Homo sapiens
cgatcttggttcactgcaac

SEQ ID NO: 783335 - DNA, 20 bp, Homo sapiens
cgatgagggaaggagcccag

SEQ ID NO: 783336 - DNA, 13 bp, Homo sapiens
cgatgatatctat

SEQ ID NO: 783337 - DNA, 20 bp, Homo sapiens
cgatgatgcttgtaacaaga

SEQ ID NO: 783338 - DNA, 21 bp, Homo sapiens
cgatgatgcttgtaacaagaa

SEQ ID NO: 783339 - DNA, 22 bp, Homo sapiens
cgatgatgcttgtaacaagaaa

SEQ ID NO: 783340 - DNA, 11 bp, Homo sapiens
cgatgcacagt

SEQ ID NO: 783341 - DNA, 14 bp, Homo sapiens
cgatgcactgacct

SEQ ID NO: 783342 - DNA, 10 bp, Homo sapiens
cgatgcattt

SEQ ID NO: 783343 - DNA, 23 bp, Homo sapiens
cgatgcatttaataaagatgagt

SEQ ID NO: 783344 - DNA, 17 bp, Homo sapiens
cgatgcctggcctgcca

SEQ ID NO: 783345 - DNA, 18 bp, Homo sapiens
cgatgcctggcctgccag

SEQ ID NO: 783346 - DNA, 17 bp, Homo sapiens
cgatgcctttgctgttt

SEQ ID NO: 783347 - DNA, 15 bp, Homo sapiens
cgatgcgtattctgt

SEQ ID NO: 783348 - DNA, 16 bp, Homo sapiens
cgatgcgtattctgtg

SEQ ID NO: 783349 - DNA, 18 bp, Homo sapiens
cgatgcgtattctgtggc

SEQ ID NO: 783350 - DNA, 19 bp, Homo sapiens
cgatgcgtattctgtggcc

SEQ ID NO: 783351 - DNA, 23 bp, Homo sapiens
cgatgctccagccaacccctgtg

SEQ ID NO: 783352 - DNA, 18 bp, Homo sapiens
cgatgctgctttcccctg

SEQ ID NO: 783353 - DNA, 18 bp, Homo sapiens
cgatgggcccctggcccc

SEQ ID NO: 783354 - DNA, 16 bp, Homo sapiens
cgatggggactctgcc

SEQ ID NO: 783355 - DNA, 17 bp, Homo sapiens
cgatggtcccaggaagc

SEQ ID NO: 783356 - DNA, 19 bp, Homo sapiens
cgatgtatgcagctatctg

SEQ ID NO: 783357 - DNA, 21 bp, Homo sapiens
cgcccgcccactgtcctgggc

SEQ ID NO: 783358 - DNA, 15 bp, Homo sapiens
cgcccgccgccctgg

SEQ ID NO: 783359 - DNA, 13 bp, Homo sapiens
cgcccgcgcccgc

SEQ ID NO: 783360 - DNA, 21 bp, Homo sapiens
cgcccgctcccttcctgccac

SEQ ID NO: 783361 - DNA, 12 bp, Homo sapiens
cgcccgtcctgc

SEQ ID NO: 783362 - DNA, 14 bp, Homo sapiens
cgcccgtcctgcct

SEQ ID NO: 783363 - DNA, 19 bp, Homo sapiens
cgccctactccactgccct

SEQ ID NO: 783364 - DNA, 22 bp, Homo sapiens
cgccctactccactgccctggc

SEQ ID NO: 783365 - DNA, 17 bp, Homo sapiens
cgccctcacctgcagag

SEQ ID NO: 783366 - DNA, 14 bp, Homo sapiens
cgccctcaggggcc

SEQ ID NO: 783367 - DNA, 18 bp, Homo sapiens
cgccctccatccgtgctg

SEQ ID NO: 783368 - DNA, 12 bp, Homo sapiens
cgccctcccagg

SEQ ID NO: 783369 - DNA, 14 bp, Homo sapiens
cgccctcccccatg

SEQ ID NO: 783370 - DNA, 16 bp, Homo sapiens
cgccctcctccacttg

SEQ ID NO: 783371 - DNA, 11 bp, Homo sapiens
cgccctccttt

SEQ ID NO: 783372 - DNA, 13 bp, Homo sapiens
cgccctcctttcc

SEQ ID NO: 783373 - DNA, 17 bp, Homo sapiens
cgccctcctttccctta

SEQ ID NO: 783374 - DNA, 19 bp, Homo sapiens
cgccctctctgctccttca

SEQ ID NO: 783375 - DNA, 15 bp, Homo sapiens
cgccctcttcctgac

SEQ ID NO: 783376 - DNA, 12 bp, Homo sapiens
cgccctgccact

SEQ ID NO: 783377 - DNA, 12 bp, Homo sapiens
cgccctgcctcc

SEQ ID NO: 783378 - DNA, 14 bp, Homo sapiens
cgccctgcgggcca

SEQ ID NO: 783379 - DNA, 15 bp, Homo sapiens
cgccctgcgggccac

SEQ ID NO: 783380 - DNA, 17 bp, Homo sapiens
cgccctgcgggccacag

SEQ ID NO: 783381 - DNA, 16 bp, Homo sapiens
cgccctggaagccggc

SEQ ID NO: 783382 - DNA, 13 bp, Homo sapiens
cgccctggacaga

SEQ ID NO: 783383 - DNA, 12 bp, Homo sapiens
cgccctgggctg

SEQ ID NO: 783384 - DNA, 14 bp, Homo sapiens
cgccctgggctgga

SEQ ID NO: 783385 - DNA, 22 bp, Homo sapiens
cgccctgggctgtctgtcacca

SEQ ID NO: 783386 - DNA, 21 bp, Homo sapiens
cgcccttagtcccccaactct

SEQ ID NO: 783387 - DNA, 11 bp, Homo sapiens
cgcccttctcc

SEQ ID NO: 783388 - DNA, 14 bp, Homo sapiens
cgcccttctcccgg

SEQ ID NO: 783389 - DNA, 19 bp, Homo sapiens
cgcccttctcccggccctc

SEQ ID NO: 783390 - DNA, 20 bp, Homo sapiens
cgcccttctcccggccctca

SEQ ID NO: 783391 - DNA, 17 bp, Homo sapiens
cgcccttggcttctgtg

SEQ ID NO: 783392 - DNA, 17 bp, Homo sapiens
cgccctttcctcctcag

SEQ ID NO: 783393 - DNA, 12 bp, Homo sapiens
cgccgactccct

SEQ ID NO: 783394 - DNA, 16 bp, Homo sapiens
cgccgatgccaccggc

SEQ ID NO: 783395 - DNA, 18 bp, Homo sapiens
cgccgccaccctgcccct

SEQ ID NO: 783396 - DNA, 21 bp, Homo sapiens
cgccgcccacgccggcctctg

SEQ ID NO: 783397 - DNA, 13 bp, Homo sapiens
cgccgccctccat

SEQ ID NO: 783398 - DNA, 18 bp, Homo sapiens
cgccgcctcccacggcac

SEQ ID NO: 783399 - DNA, 20 bp, Homo sapiens
cgccgcctggtactcaagcc

SEQ ID NO: 783400 - DNA, 15 bp, Homo sapiens
cgccggatctgaggg

SEQ ID NO: 783401 - DNA, 22 bp, Homo sapiens
cgccggcaaaactttggcactg

SEQ ID NO: 783402 - DNA, 13 bp, Homo sapiens
cgccggcctctgc

SEQ ID NO: 783403 - DNA, 14 bp, Homo sapiens
cgccggcctctgct

SEQ ID NO: 783404 - DNA, 19 bp, Homo sapiens
cgccggcctctgctgcccc

SEQ ID NO: 783405 - DNA, 18 bp, Homo sapiens
cgccggcgggcgggccgg

SEQ ID NO: 783406 - DNA, 13 bp, Homo sapiens
cgccgggcaccaa

SEQ ID NO: 783407 - DNA, 19 bp, Homo sapiens
cgccggtccggcgccccgc

SEQ ID NO: 783408 - DNA, 23 bp, Homo sapiens
cgccggtccggcgccccgcaccc

SEQ ID NO: 783409 - DNA, 12 bp, Homo sapiens
cgccgtctgcag

SEQ ID NO: 783410 - DNA, 13 bp, Homo sapiens
cgccgtctgcagg

SEQ ID NO: 783411 - DNA, 16 bp, Homo sapiens
cgccgtgctgggcagc

SEQ ID NO: 783412 - DNA, 17 bp, Homo sapiens
cgccgtgctgggcagcc

SEQ ID NO: 783413 - DNA, 19 bp, Homo sapiens
cgccgtgctgggcagcccg

SEQ ID NO: 783414 - DNA, 16 bp, Homo sapiens
cgccgtggggctccgg

SEQ ID NO: 783415 - DNA, 21 bp, Homo sapiens
cgccgtggggctccggagggg

SEQ ID NO: 783416 - DNA, 21 bp, Homo sapiens
cgcctactcttcagggtctaa

SEQ ID NO: 783417 - DNA, 15 bp, Homo sapiens
cgcctagctgctgtc

SEQ ID NO: 783418 - DNA, 22 bp, Homo sapiens
cgcctatgccctgcccttcctc

SEQ ID NO: 783419 - DNA, 17 bp, Homo sapiens
cgcctcaatgtggttgc

SEQ ID NO: 783420 - DNA, 16 bp, Homo sapiens
cgcctcaccagaacca

SEQ ID NO: 783421 - DNA, 14 bp, Homo sapiens
cgcctcagccctca

SEQ ID NO: 783422 - DNA, 15 bp, Homo sapiens
cgcctcagccctcag

SEQ ID NO: 783423 - DNA, 16 bp, Homo sapiens
cgcctccaaccctagc

SEQ ID NO: 783424 - DNA, 21 bp, Homo sapiens
cgcctccactctagttctaga

SEQ ID NO: 783425 - DNA, 14 bp, Homo sapiens
cgcctcccactggg

SEQ ID NO: 783426 - DNA, 16 bp, Homo sapiens
cgcctcccactggggt

SEQ ID NO: 783427 - DNA, 11 bp, Homo sapiens
cgcctcccagc

SEQ ID NO: 783428 - DNA, 15 bp, Homo sapiens
cgcctcccagcctgg

SEQ ID NO: 783429 - DNA, 15 bp, Homo sapiens
cgcctcccatcccgc

SEQ ID NO: 783430 - DNA, 16 bp, Homo sapiens
cgcctcccctgcccca

SEQ ID NO: 783431 - DNA, 15 bp, Homo sapiens
cgcctccctccaccc

SEQ ID NO: 783432 - DNA, 15 bp, Homo sapiens
cgcctccctctcaga

SEQ ID NO: 783433 - DNA, 12 bp, Homo sapiens
cgcctcctggcc

SEQ ID NO: 783434 - DNA, 16 bp, Homo sapiens
cgcctcctggccagac

SEQ ID NO: 783435 - DNA, 22 bp, Homo sapiens
cgcctcctggccagacgctgcc

SEQ ID NO: 783436 - DNA, 13 bp, Homo sapiens
cgcctcggcctcc

SEQ ID NO: 783437 - DNA, 15 bp, Homo sapiens
cgcctcgtgccagca

SEQ ID NO: 783438 - DNA, 18 bp, Homo sapiens
cgcctcgtgccagcagcc

SEQ ID NO: 783439 - DNA, 19 bp, Homo sapiens
cgcctcgtgccagcagcct

SEQ ID NO: 783440 - DNA, 13 bp, Homo sapiens
cgcctctcccgtc

SEQ ID NO: 783441 - DNA, 15 bp, Homo sapiens
cgcctctcctcggtt

SEQ ID NO: 783442 - DNA, 13 bp, Homo sapiens
cgcctctggccgc

SEQ ID NO: 783443 - DNA, 18 bp, Homo sapiens
cgcctctggccgccaccc

SEQ ID NO: 783444 - DNA, 16 bp, Homo sapiens
cgcctctgtctggagc

SEQ ID NO: 783445 - DNA, 13 bp, Homo sapiens
cgcctcttcctct

SEQ ID NO: 783446 - DNA, 16 bp, Homo sapiens
cgcctcttcctctggg

SEQ ID NO: 783447 - DNA, 19 bp, Homo sapiens
cgcctcttcttcttcagaa

SEQ ID NO: 783448 - DNA, 17 bp, Homo sapiens
cgcctcttgaccaggct

SEQ ID NO: 783449 - DNA, 15 bp, Homo sapiens
cgcctctttcaagca

SEQ ID NO: 783450 - DNA, 16 bp, Homo sapiens
cgcctgacagaaacca

SEQ ID NO: 783451 - DNA, 18 bp, Homo sapiens
cgcctgagacagcaccac

SEQ ID NO: 783452 - DNA, 16 bp, Homo sapiens
cgcctgagctcactcg

SEQ ID NO: 783453 - DNA, 14 bp, Homo sapiens
cgcctgagtcagtg

SEQ ID NO: 783454 - DNA, 22 bp, Homo sapiens
cgcctgagtcagtgctctcagc

SEQ ID NO: 783455 - DNA, 18 bp, Homo sapiens
cgcctgagtgagtgtgtg

SEQ ID NO: 783456 - DNA, 18 bp, Homo sapiens
cgcctgcaggagagagca

SEQ ID NO: 783457 - DNA, 23 bp, Homo sapiens
cgcctgcaggcagagctggagcc

SEQ ID NO: 783458 - DNA, 12 bp, Homo sapiens
cgcctgccaccg

SEQ ID NO: 783459 - DNA, 15 bp, Homo sapiens
cgcctgccaccggag

SEQ ID NO: 783460 - DNA, 16 bp, Homo sapiens
cgcctgcccagactga

SEQ ID NO: 783461 - DNA, 19 bp, Homo sapiens
cgcctgcccagactgatga

SEQ ID NO: 783462 - DNA, 17 bp, Homo sapiens
cgcctgccctcatggcc

SEQ ID NO: 783463 - DNA, 17 bp, Homo sapiens
cgcctgccctccccaga

SEQ ID NO: 783464 - DNA, 18 bp, Homo sapiens
cgcctgccctgcccaagt

SEQ ID NO: 783465 - DNA, 19 bp, Homo sapiens
cgcctgccctgcccaagtg

SEQ ID NO: 783466 - DNA, 16 bp, Homo sapiens
cgcctgccctgcccag

SEQ ID NO: 783467 - DNA, 15 bp, Homo sapiens
cgcctgccctgcctt

SEQ ID NO: 783468 - DNA, 17 bp, Homo sapiens
cgcctgccctgccttgc

SEQ ID NO: 783469 - DNA, 21 bp, Homo sapiens
cgcctgccctgccttgccgct

SEQ ID NO: 783470 - DNA, 22 bp, Homo sapiens
cgcctgccctgccttgccgctc

SEQ ID NO: 783471 - DNA, 17 bp, Homo sapiens
cgcctgccgtgcatggc

SEQ ID NO: 783472 - DNA, 20 bp, Homo sapiens
cgcctgccgtgcatggctcc

SEQ ID NO: 783473 - DNA, 16 bp, Homo sapiens
cgcctgctcccatcct

SEQ ID NO: 783474 - DNA, 17 bp, Homo sapiens
cgcctgctcccatcctc

SEQ ID NO: 783475 - DNA, 19 bp, Homo sapiens
cgcctgcttcttctctcca

SEQ ID NO: 783476 - DNA, 14 bp, Homo sapiens
cgcctggagggatg

SEQ ID NO: 783477 - DNA, 20 bp, Homo sapiens
cgcctggagggatgccccca

SEQ ID NO: 783478 - DNA, 21 bp, Homo sapiens
cgcctggcagtccgtgggacg

SEQ ID NO: 783479 - DNA, 14 bp, Homo sapiens
cgcctggccctccc

SEQ ID NO: 783480 - DNA, 19 bp, Homo sapiens
cgcctggctgcagcctgcg

SEQ ID NO: 783481 - DNA, 16 bp, Homo sapiens
cgcctggctgctgctt

SEQ ID NO: 783482 - DNA, 15 bp, Homo sapiens
cgcctgtagtcccag

SEQ ID NO: 783483 - DNA, 20 bp, Homo sapiens
cgcctgtagtcccagctact

SEQ ID NO: 783484 - DNA, 14 bp, Homo sapiens
cgcagaagcagccc

SEQ ID NO: 783485 - DNA, 20 bp, Homo sapiens
cgcagactgcttggccagat

SEQ ID NO: 783486 - DNA, 18 bp, Homo sapiens
cgcagagcttttcagatt

SEQ ID NO: 783487 - DNA, 19 bp, Homo sapiens
cgcagaggacgcacgctcg

SEQ ID NO: 783488 - DNA, 23 bp, Homo sapiens
cgcagaggacgcacgctcgctgc

SEQ ID NO: 783489 - DNA, 11 bp, Homo sapiens
cgcagaggcag

SEQ ID NO: 783490 - DNA, 12 bp, Homo sapiens
cgcagaggcaga

SEQ ID NO: 783491 - DNA, 13 bp, Homo sapiens
cgcagaggtccca

SEQ ID NO: 783492 - DNA, 19 bp, Homo sapiens
cgcagaggtcccagcccca

SEQ ID NO: 783493 - DNA, 19 bp, Homo sapiens
cgcagatctgtgcctggga

SEQ ID NO: 783494 - DNA, 22 bp, Homo sapiens
cgcagatgaggggccactgacc

SEQ ID NO: 783495 - DNA, 13 bp, Homo sapiens
cgcagatgctgtc

SEQ ID NO: 783496 - DNA, 22 bp, Homo sapiens
cgcagcacccttctcggagacc

SEQ ID NO: 783497 - DNA, 21 bp, Homo sapiens
cgcagccagccggtgcctggc

SEQ ID NO: 783498 - DNA, 14 bp, Homo sapiens
cgcagcccctttcc

SEQ ID NO: 783499 - DNA, 19 bp, Homo sapiens
cgcagcccgcctgccgtgc

SEQ ID NO: 783500 - DNA, 22 bp, Homo sapiens
cgcagccctaccttaaggaaag

SEQ ID NO: 783501 - DNA, 13 bp, Homo sapiens
cgcagccctgctt

SEQ ID NO: 783502 - DNA, 24 bp, Homo sapiens
cgcagccctgctttgggctgccct

SEQ ID NO: 783503 - DNA, 19 bp, Homo sapiens
cgcagcggtgggaaggaaa

SEQ ID NO: 783504 - DNA, 13 bp, Homo sapiens
cgcagctcttgcc

SEQ ID NO: 783505 - DNA, 12 bp, Homo sapiens
cgcagctgaagt

SEQ ID NO: 783506 - DNA, 13 bp, Homo sapiens
cgcaggagggagg

SEQ ID NO: 783507 - DNA, 14 bp, Homo sapiens
cgcaggagggaggc

SEQ ID NO: 783508 - DNA, 23 bp, Homo sapiens
cgcaggagggaggcggggaggag

SEQ ID NO: 783509 - DNA, 19 bp, Homo sapiens
cgcaggagtctctgccacc

SEQ ID NO: 783510 - DNA, 22 bp, Homo sapiens
cgcaggagtctctgccacccac

SEQ ID NO: 783511 - DNA, 18 bp, Homo sapiens
cgcaggatccgctgccac

SEQ ID NO: 783512 - DNA, 17 bp, Homo sapiens
cgcaggcagcgcagggc

SEQ ID NO: 783513 - DNA, 17 bp, Homo sapiens
cgcaggccacccgggct

SEQ ID NO: 783514 - DNA, 22 bp, Homo sapiens
cgcaggcccggactcaccaact

SEQ ID NO: 783515 - DNA, 12 bp, Homo sapiens
cgcaggccctgt

SEQ ID NO: 783516 - DNA, 17 bp, Homo sapiens
cgcaggcggccagggcg

SEQ ID NO: 783517 - DNA, 17 bp, Homo sapiens
cgcaggctgcagagccc

SEQ ID NO: 783518 - DNA, 18 bp, Homo sapiens
cgcagggaatgcagcagg

SEQ ID NO: 783519 - DNA, 18 bp, Homo sapiens
cgcagggacatggggcaa

SEQ ID NO: 783520 - DNA, 19 bp, Homo sapiens
cgcagggacatggggcaag

SEQ ID NO: 783521 - DNA, 18 bp, Homo sapiens
cgcagggccatgcagacc

SEQ ID NO: 783522 - DNA, 17 bp, Homo sapiens
cgcaggggccctgagcc

SEQ ID NO: 783523 - DNA, 18 bp, Homo sapiens
cgcaggggccctgagcca

SEQ ID NO: 783524 - DNA, 18 bp, Homo sapiens
cgcaggggtttgggtggg

SEQ ID NO: 783525 - DNA, 14 bp, Homo sapiens
cgcagggtggtggt

SEQ ID NO: 783526 - DNA, 16 bp, Homo sapiens
cgcaggtgggtgctgc

SEQ ID NO: 783527 - DNA, 20 bp, Homo sapiens
cgcaggtgggtgctgccctg

SEQ ID NO: 783528 - DNA, 13 bp, Homo sapiens
cgcagtccccagc

SEQ ID NO: 783529 - DNA, 19 bp, Homo sapiens
cgcagtgcttctctacaga

SEQ ID NO: 783530 - DNA, 12 bp, Homo sapiens
cgcagttttttt

SEQ ID NO: 783531 - DNA, 21 bp, Homo sapiens
cgcagttttttttttcttgtc

SEQ ID NO: 783532 - DNA, 22 bp, Homo sapiens
cgcatagactgaggtataaaga

SEQ ID NO: 783533 - DNA, 15 bp, Homo sapiens
cgcataggacctttc

SEQ ID NO: 783534 - DNA, 13 bp, Homo sapiens
cgcataggcccag

SEQ ID NO: 783535 - DNA, 12 bp, Homo sapiens
cgcatcatatgc

SEQ ID NO: 783536 - DNA, 12 bp, Homo sapiens
cgcatccagcaa

SEQ ID NO: 783537 - DNA, 14 bp, Homo sapiens
cgcatccagcaaga

SEQ ID NO: 783538 - DNA, 14 bp, Homo sapiens
cgcatcccatctct

SEQ ID NO: 783539 - DNA, 17 bp, Homo sapiens
cgcatccgtcctgggcg

SEQ ID NO: 783540 - DNA, 13 bp, Homo sapiens
cgcatcttctcca

SEQ ID NO: 783541 - DNA, 16 bp, Homo sapiens
cgcatcttctccatct

SEQ ID NO: 783542 - DNA, 13 bp, Homo sapiens
cgcatgctcagtg

SEQ ID NO: 783543 - DNA, 16 bp, Homo sapiens
cgcatgctcagtgcct

SEQ ID NO: 783544 - DNA, 18 bp, Homo sapiens
cgcatggagtgtgtattg

SEQ ID NO: 783545 - DNA, 22 bp, Homo sapiens
cgcatggagtgtgtattgttcc

SEQ ID NO: 783546 - DNA, 23 bp, Homo sapiens
cgcatggagtgtgtattgttccc

SEQ ID NO: 783547 - DNA, 16 bp, Homo sapiens
cgcatggtcacacact

SEQ ID NO: 783548 - DNA, 15 bp, Homo sapiens
cgcatgtctgcacct

SEQ ID NO: 783549 - DNA, 19 bp, Homo sapiens
cgcatgtctgcacctccgc

SEQ ID NO: 783550 - DNA, 11 bp, Homo sapiens
cgcatgtgtgc

SEQ ID NO: 783551 - DNA, 13 bp, Homo sapiens
cgcatgtgtgcct

SEQ ID NO: 783552 - DNA, 19 bp, Homo sapiens
cgcctgtcacaataaagtt

SEQ ID NO: 783553 - DNA, 20 bp, Homo sapiens
cgccttccaaaacctgcttc

SEQ ID NO: 783554 - DNA, 23 bp, Homo sapiens
cgccttccaaaacctgcttcctt

SEQ ID NO: 783555 - DNA, 12 bp, Homo sapiens
cgccttccctca

SEQ ID NO: 783556 - DNA, 18 bp, Homo sapiens
cgccttccctcactcttc

SEQ ID NO: 783557 - DNA, 13 bp, Homo sapiens
cgccttcctcctc

SEQ ID NO: 783558 - DNA, 18 bp, Homo sapiens
cgccttcctcctccacag

SEQ ID NO: 783559 - DNA, 17 bp, Homo sapiens
cgccttcctctctggat

SEQ ID NO: 783560 - DNA, 12 bp, Homo sapiens
cgccttcctggg

SEQ ID NO: 783561 - DNA, 16 bp, Homo sapiens
cgccttctcccctctc

SEQ ID NO: 783562 - DNA, 21 bp, Homo sapiens
cgccttctcccctctcccagg

SEQ ID NO: 783563 - DNA, 19 bp, Homo sapiens
cgccttgaccttcccaagg

SEQ ID NO: 783564 - DNA, 14 bp, Homo sapiens
cgcctttgtattat

SEQ ID NO: 783565 - DNA, 13 bp, Homo sapiens
cgcctttgtcttg

SEQ ID NO: 783566 - DNA, 14 bp, Homo sapiens
cgccttttcagccc

SEQ ID NO: 783567 - DNA, 18 bp, Homo sapiens
cgccttttcagccctttg

SEQ ID NO: 783568 - DNA, 15 bp, Homo sapiens
cgcgagactgagagg

SEQ ID NO: 783569 - DNA, 18 bp, Homo sapiens
cgcgagactgagaggcag

SEQ ID NO: 783570 - DNA, 18 bp, Homo sapiens
cgcgcccagcgctcgcca

SEQ ID NO: 783571 - DNA, 16 bp, Homo sapiens
cgcgccctcctgccca

SEQ ID NO: 783572 - DNA, 15 bp, Homo sapiens
cgcgcgactgagaac

SEQ ID NO: 783573 - DNA, 23 bp, Homo sapiens
cgcgcgactgagaaccgtgacat

SEQ ID NO: 783574 - DNA, 21 bp, Homo sapiens
cgcgctccgaaccccgggccc

SEQ ID NO: 783575 - DNA, 23 bp, Homo sapiens
cgcgctgttgattgtgttttcct

SEQ ID NO: 783576 - DNA, 14 bp, Homo sapiens
cgcgcttccctggg

SEQ ID NO: 783577 - DNA, 17 bp, Homo sapiens
cgcggacgtgctggcct

SEQ ID NO: 783578 - DNA, 21 bp, Homo sapiens
cgcggacgtgctggccttggt

SEQ ID NO: 783579 - DNA, 15 bp, Homo sapiens
cgcggagacctcctg

SEQ ID NO: 783580 - DNA, 16 bp, Homo sapiens
cgcggagcctgcattt

SEQ ID NO: 783581 - DNA, 15 bp, Homo sapiens
cgcggaggaggaaga

SEQ ID NO: 783582 - DNA, 16 bp, Homo sapiens
cgcggaggaggaagag

SEQ ID NO: 783583 - DNA, 23 bp, Homo sapiens
cgcggaggaggagggaggccagg

SEQ ID NO: 783584 - DNA, 15 bp, Homo sapiens
cgcggcccagaccca

SEQ ID NO: 783585 - DNA, 16 bp, Homo sapiens
cgcggcccagacccag

SEQ ID NO: 783586 - DNA, 18 bp, Homo sapiens
cgcggcccagacccagcc

SEQ ID NO: 783587 - DNA, 20 bp, Homo sapiens
cgcggcctgcaccgacccga

SEQ ID NO: 783588 - DNA, 16 bp, Homo sapiens
cgcggcggctctgccc

SEQ ID NO: 783589 - DNA, 14 bp, Homo sapiens
cgcgggcacagcca

SEQ ID NO: 783590 - DNA, 15 bp, Homo sapiens
cgcgggcacagccag

SEQ ID NO: 783591 - DNA, 15 bp, Homo sapiens
cgcggggacattggg

SEQ ID NO: 783592 - DNA, 14 bp, Homo sapiens
cgcggtgctctggc

SEQ ID NO: 783593 - DNA, 13 bp, Homo sapiens
cgcggtggctcac

SEQ ID NO: 783594 - DNA, 23 bp, Homo sapiens
cgcggtgtgtcctctgtgcccac

SEQ ID NO: 783595 - DNA, 15 bp, Homo sapiens
cgcgtcgccgccacc

SEQ ID NO: 783596 - DNA, 21 bp, Homo sapiens
cgcgtctcctgtttttctggg

SEQ ID NO: 783597 - DNA, 14 bp, Homo sapiens
cgcgtctgccccac

SEQ ID NO: 783598 - DNA, 15 bp, Homo sapiens
cgcgtctgccccacc

SEQ ID NO: 783599 - DNA, 16 bp, Homo sapiens
cgcttagcctgcctca

SEQ ID NO: 783600 - DNA, 18 bp, Homo sapiens
cgcttagcctgcctcacc

SEQ ID NO: 783601 - DNA, 20 bp, Homo sapiens
cgcttagcctgcctcaccca

SEQ ID NO: 783602 - DNA, 13 bp, Homo sapiens
cgcttagtgctgc

SEQ ID NO: 783603 - DNA, 19 bp, Homo sapiens
cgcttagttcttgaattgt

SEQ ID NO: 783604 - DNA, 13 bp, Homo sapiens
cgcttatttggaa

SEQ ID NO: 783605 - DNA, 23 bp, Homo sapiens
cgcttatttggaaattttagtta

SEQ ID NO: 783606 - DNA, 14 bp, Homo sapiens
cgcttcaagctctc

SEQ ID NO: 783607 - DNA, 13 bp, Homo sapiens
cgcttcacccctg

SEQ ID NO: 783608 - DNA, 18 bp, Homo sapiens
cgcttcgaactccaggct

SEQ ID NO: 783609 - DNA, 23 bp, Homo sapiens
cgcttctccaatgctctggagtg

SEQ ID NO: 783610 - DNA, 16 bp, Homo sapiens
cgcttctctcttttaa

SEQ ID NO: 783611 - DNA, 19 bp, Homo sapiens
cgcttctctcttttaaagt

SEQ ID NO: 783612 - DNA, 17 bp, Homo sapiens
cgcttctgaatgctgct

SEQ ID NO: 783613 - DNA, 18 bp, Homo sapiens
cgcttctgcagcctcggc

SEQ ID NO: 783614 - DNA, 20 bp, Homo sapiens
cgcttctgcagcctcggcct

SEQ ID NO: 783615 - DNA, 14 bp, Homo sapiens
cgcttctgcctgca

SEQ ID NO: 783616 - DNA, 17 bp, Homo sapiens
cgcttctgctggaggag

SEQ ID NO: 783617 - DNA, 15 bp, Homo sapiens
cgcttcttgcctctg

SEQ ID NO: 783618 - DNA, 17 bp, Homo sapiens
cgcttcttgcctctgtg

SEQ ID NO: 783619 - DNA, 22 bp, Homo sapiens
cgcttcttgcctctgtgctgtg

SEQ ID NO: 783620 - DNA, 21 bp, Homo sapiens
cgcttgaacctgggaggcaga

SEQ ID NO: 783621 - DNA, 16 bp, Homo sapiens
cgcttgagcccaggag

SEQ ID NO: 783622 - DNA, 17 bp, Homo sapiens
cgcttgagcccaggagt

SEQ ID NO: 783623 - DNA, 18 bp, Homo sapiens
cgcttgagcccaggagtt

SEQ ID NO: 783624 - DNA, 21 bp, Homo sapiens
cgcttgcctggtcaccctggg

SEQ ID NO: 783625 - DNA, 12 bp, Homo sapiens
cgcttgtagaac

SEQ ID NO: 783626 - DNA, 19 bp, Homo sapiens
cgcttgtagaactcactct

SEQ ID NO: 783627 - DNA, 22 bp, Homo sapiens
cgcttgtagaactcactctggg

SEQ ID NO: 783628 - DNA, 20 bp, Homo sapiens
cgcttgtggggacccaggct

SEQ ID NO: 783629 - DNA, 22 bp, Homo sapiens
cgctttattgcccatgggatat

SEQ ID NO: 783630 - DNA, 22 bp, Homo sapiens
cgctttcatgaccactgggcct

SEQ ID NO: 783631 - DNA, 16 bp, Homo sapiens
cgctttctagctgttg

SEQ ID NO: 783632 - DNA, 10 bp, Homo sapiens
cgctttctcc

SEQ ID NO: 783633 - DNA, 16 bp, Homo sapiens
cgctttgattcatagt

SEQ ID NO: 783634 - DNA, 12 bp, Homo sapiens
cgctttgtcaca

SEQ ID NO: 783635 - DNA, 18 bp, Homo sapiens
cgcttttgcagcagagga

SEQ ID NO: 783636 - DNA, 20 bp, Homo sapiens
cggaaaaaaaaaaagaaaaa

SEQ ID NO: 783637 - DNA, 15 bp, Homo sapiens
cggaaacatacagag

SEQ ID NO: 783638 - DNA, 20 bp, Homo sapiens
cggaaagtgaagagtcagaa

SEQ ID NO: 783639 - DNA, 19 bp, Homo sapiens
cggaacccaagcttagaac

SEQ ID NO: 783640 - DNA, 16 bp, Homo sapiens
cggaacgttggacttt

SEQ ID NO: 783641 - DNA, 20 bp, Homo sapiens
cggaagcagtgccttccata

SEQ ID NO: 783642 - DNA, 15 bp, Homo sapiens
cggaagcctgtcctc

SEQ ID NO: 783643 - DNA, 21 bp, Homo sapiens
cggaagggctttggttccttc

SEQ ID NO: 783644 - DNA, 18 bp, Homo sapiens
cggaagttttcaatgatg

SEQ ID NO: 783645 - DNA, 13 bp, Homo sapiens
cggaatggtaacc

SEQ ID NO: 783646 - DNA, 19 bp, Homo sapiens
cggaattcaccagtgttcc

SEQ ID NO: 783647 - DNA, 12 bp, Homo sapiens
cggacaaaatat

SEQ ID NO: 783648 - DNA, 13 bp, Homo sapiens
cggacaaagttca

SEQ ID NO: 783649 - DNA, 14 bp, Homo sapiens
cggacaccccctcg

SEQ ID NO: 783650 - DNA, 16 bp, Homo sapiens
cggacaccgtggcctg

SEQ ID NO: 783651 - DNA, 17 bp, Homo sapiens
cggacaccgtggcctgg

SEQ ID NO: 783652 - DNA, 12 bp, Homo sapiens
cggacagagtgg

SEQ ID NO: 783653 - DNA, 13 bp, Homo sapiens
cggacaggaggat

SEQ ID NO: 783654 - DNA, 15 bp, Homo sapiens
cggacaggaggattc

SEQ ID NO: 783655 - DNA, 18 bp, Homo sapiens
cggacaggtggggcctca

SEQ ID NO: 783656 - DNA, 17 bp, Homo sapiens
cggaccactcgaggcct

SEQ ID NO: 783657 - DNA, 18 bp, Homo sapiens
cggaccactcgaggcctg

SEQ ID NO: 783658 - DNA, 21 bp, Homo sapiens
cggacccaccccaactctccc

SEQ ID NO: 783659 - DNA, 22 bp, Homo sapiens
cggacccaccccaactctcccc

SEQ ID NO: 783660 - DNA, 18 bp, Homo sapiens
cggacccttcccagccct

SEQ ID NO: 783661 - DNA, 22 bp, Homo sapiens
cggaccgcttgtggggacccag

SEQ ID NO: 783662 - DNA, 16 bp, Homo sapiens
cggacctacctccctc

SEQ ID NO: 783663 - DNA, 17 bp, Homo sapiens
cggacctacctccctcc

SEQ ID NO: 783664 - DNA, 16 bp, Homo sapiens
cggacctgagcccgca

SEQ ID NO: 783665 - DNA, 22 bp, Homo sapiens
cggacctgagcccgcagcccag

SEQ ID NO: 783666 - DNA, 18 bp, Homo sapiens
cggacggggcaggcgctg

SEQ ID NO: 783667 - DNA, 17 bp, Homo sapiens
cggactcccgggccacg

SEQ ID NO: 783668 - DNA, 19 bp, Homo sapiens
cggactcccgggccacgcc

SEQ ID NO: 783669 - DNA, 21 bp, Homo sapiens
cggactctcccaggcctgcct

SEQ ID NO: 783670 - DNA, 14 bp, Homo sapiens
cggactctgcccct

SEQ ID NO: 783671 - DNA, 17 bp, Homo sapiens
cggactgaggtgcctgc

SEQ ID NO: 783672 - DNA, 13 bp, Homo sapiens
cggactgccaaat

SEQ ID NO: 783673 - DNA, 15 bp, Homo sapiens
cggactgcccccaga

SEQ ID NO: 783674 - DNA, 19 bp, Homo sapiens
cggactgcccccagaaagc

SEQ ID NO: 783675 - DNA, 14 bp, Homo sapiens
cggacttttctgca

SEQ ID NO: 783676 - DNA, 13 bp, Homo sapiens
cggagaaactgag

SEQ ID NO: 783677 - DNA, 16 bp, Homo sapiens
cggagaagagcgcagt

SEQ ID NO: 783678 - DNA, 16 bp, Homo sapiens
cggagagaaaaaagaa

SEQ ID NO: 783679 - DNA, 14 bp, Homo sapiens
cggagagcagcagc

SEQ ID NO: 783680 - DNA, 16 bp, Homo sapiens
cgccattgccaccagg

SEQ ID NO: 783681 - DNA, 19 bp, Homo sapiens
cgccattggttggaagcta

SEQ ID NO: 783682 - DNA, 15 bp, Homo sapiens
cgcccaacccttccc

SEQ ID NO: 783683 - DNA, 16 bp, Homo sapiens
cgcccaacccttcccc

SEQ ID NO: 783684 - DNA, 12 bp, Homo sapiens
cgcccaaggccc

SEQ ID NO: 783685 - DNA, 17 bp, Homo sapiens
cgcccacacggcccctt

SEQ ID NO: 783686 - DNA, 17 bp, Homo sapiens
cgcccacccagctggtc

SEQ ID NO: 783687 - DNA, 19 bp, Homo sapiens
cgcccacccagctggtcct

SEQ ID NO: 783688 - DNA, 19 bp, Homo sapiens
cgcccacccccacccccag

SEQ ID NO: 783689 - DNA, 22 bp, Homo sapiens
cgcccacccccagtctccaggg

SEQ ID NO: 783690 - DNA, 23 bp, Homo sapiens
cgcccacccccagtctccaggga

SEQ ID NO: 783691 - DNA, 22 bp, Homo sapiens
cgcccacccgagtacctccagt

SEQ ID NO: 783692 - DNA, 16 bp, Homo sapiens
cgcccactgtcctggg

SEQ ID NO: 783693 - DNA, 19 bp, Homo sapiens
cgcccactgtcctgggcgc

SEQ ID NO: 783694 - DNA, 14 bp, Homo sapiens
cgcccagagctggc

SEQ ID NO: 783695 - DNA, 16 bp, Homo sapiens
cgcccagagctggcct

SEQ ID NO: 783696 - DNA, 12 bp, Homo sapiens
cgcccagcctga

SEQ ID NO: 783697 - DNA, 15 bp, Homo sapiens
cgcccagctgcacct

SEQ ID NO: 783698 - DNA, 20 bp, Homo sapiens
cgcccagctgcacctgccag

SEQ ID NO: 783699 - DNA, 23 bp, Homo sapiens
cgcccagctgcacctgccagcct

SEQ ID NO: 783700 - DNA, 15 bp, Homo sapiens
cgcccaggagacatc

SEQ ID NO: 783701 - DNA, 11 bp, Homo sapiens
cgcccaggcct

SEQ ID NO: 783702 - DNA, 12 bp, Homo sapiens
cgcccaggcctg

SEQ ID NO: 783703 - DNA, 15 bp, Homo sapiens
cgcccaggcctgctg

SEQ ID NO: 783704 - DNA, 17 bp, Homo sapiens
cgcccaggcctgctggc

SEQ ID NO: 783705 - DNA, 23 bp, Homo sapiens
cgcccaggcctgggatgcagtga

SEQ ID NO: 783706 - DNA, 15 bp, Homo sapiens
cgcccaggctggagc

SEQ ID NO: 783707 - DNA, 11 bp, Homo sapiens
cgcccagggtc

SEQ ID NO: 783708 - DNA, 17 bp, Homo sapiens
cgcccattcgtctgtcc

SEQ ID NO: 783709 - DNA, 23 bp, Homo sapiens
cgcccattcgtctgtcccagagc

SEQ ID NO: 783710 - DNA, 18 bp, Homo sapiens
cgccccaactccaacctc

SEQ ID NO: 783711 - DNA, 12 bp, Homo sapiens
cgccccacctcc

SEQ ID NO: 783712 - DNA, 18 bp, Homo sapiens
cgccccagccctcagtca

SEQ ID NO: 783713 - DNA, 19 bp, Homo sapiens
cgccccagccctcagtcac

SEQ ID NO: 783714 - DNA, 12 bp, Homo sapiens
cgccccaggccc

SEQ ID NO: 783715 - DNA, 16 bp, Homo sapiens
cgccccatccctgctt

SEQ ID NO: 783716 - DNA, 12 bp, Homo sapiens
cgcccccagctt

SEQ ID NO: 783717 - DNA, 16 bp, Homo sapiens
cgcccccagcttctct

SEQ ID NO: 783718 - DNA, 18 bp, Homo sapiens
cgcccccagtccccaccc

SEQ ID NO: 783719 - DNA, 12 bp, Homo sapiens
cgcccccagtgt

SEQ ID NO: 783720 - DNA, 19 bp, Homo sapiens
cgccccccagagccagggc

SEQ ID NO: 783721 - DNA, 22 bp, Homo sapiens
cgccccccagagccagggctgt

SEQ ID NO: 783722 - DNA, 15 bp, Homo sapiens
cgcccccgagccctg

SEQ ID NO: 783723 - DNA, 14 bp, Homo sapiens
cgcccccgccccgc

SEQ ID NO: 783724 - DNA, 18 bp, Homo sapiens
cgcccccgccccgcgcgc

SEQ ID NO: 783725 - DNA, 23 bp, Homo sapiens
cgcccccgggtttggcgggccaa

SEQ ID NO: 783726 - DNA, 19 bp, Homo sapiens
cgccccctccgccctgcca

SEQ ID NO: 783727 - DNA, 20 bp, Homo sapiens
cgccccctccgccctgccac

SEQ ID NO: 783728 - DNA, 17 bp, Homo sapiens
cgccccgccccacattc

SEQ ID NO: 783729 - DNA, 23 bp, Homo sapiens
cgccccgctgtgtcctccctccc

SEQ ID NO: 783730 - DNA, 16 bp, Homo sapiens
cgccccgggctggccc

SEQ ID NO: 783731 - DNA, 21 bp, Homo sapiens
cgccccgggctggccctgtgc

SEQ ID NO: 783732 - DNA, 12 bp, Homo sapiens
cgcccctccaaa

SEQ ID NO: 783733 - DNA, 18 bp, Homo sapiens
cgcccctccaaacctcca

SEQ ID NO: 783734 - DNA, 19 bp, Homo sapiens
cgcccctccaaacctccag

SEQ ID NO: 783735 - DNA, 22 bp, Homo sapiens
cgcccctccaaacctccagcct

SEQ ID NO: 783736 - DNA, 15 bp, Homo sapiens
cgcccctccacccat

SEQ ID NO: 783737 - DNA, 15 bp, Homo sapiens
cgcccctccagtgtt

SEQ ID NO: 783738 - DNA, 15 bp, Homo sapiens
cgcccctcccaagcg

SEQ ID NO: 783739 - DNA, 16 bp, Homo sapiens
cgcccctcccctcagc

SEQ ID NO: 783740 - DNA, 17 bp, Homo sapiens
cgcccctcccctcagcc

SEQ ID NO: 783741 - DNA, 19 bp, Homo sapiens
cgcccctcccctcagcctg

SEQ ID NO: 783742 - DNA, 14 bp, Homo sapiens
cgcccctgccacct

SEQ ID NO: 783743 - DNA, 12 bp, Homo sapiens
cgcccctgcctg

SEQ ID NO: 783744 - DNA, 21 bp, Homo sapiens
cgcccctggggaaatagcctc

SEQ ID NO: 783745 - DNA, 19 bp, Homo sapiens
cgcccctgtggccctggcc

SEQ ID NO: 783746 - DNA, 21 bp, Homo sapiens
cgcccctgtggccctggccac

SEQ ID NO: 783747 - DNA, 15 bp, Homo sapiens
cgcccctgttttttg

SEQ ID NO: 783748 - DNA, 13 bp, Homo sapiens
cgccccttccccc

SEQ ID NO: 783749 - DNA, 19 bp, Homo sapiens
cgcccgactagcaggcatg

SEQ ID NO: 783750 - DNA, 14 bp, Homo sapiens
cgcccgcccactgt

SEQ ID NO: 783751 - DNA, 17 bp, Homo sapiens
ctaaattctactctaaa

SEQ ID NO: 783752 - DNA, 17 bp, Homo sapiens
ctaaattctatgttaaa

SEQ ID NO: 783753 - DNA, 12 bp, Homo sapiens
ctaaattgtata

SEQ ID NO: 783754 - DNA, 14 bp, Homo sapiens
ctaaattgtataca

SEQ ID NO: 783755 - DNA, 17 bp, Homo sapiens
ctaaattgtatacattt

SEQ ID NO: 783756 - DNA, 16 bp, Homo sapiens
ctaaattttaaagcca

SEQ ID NO: 783757 - DNA, 16 bp, Homo sapiens
ctaaattttctgaaac

SEQ ID NO: 783758 - DNA, 12 bp, Homo sapiens
ctaaattttctt

SEQ ID NO: 783759 - DNA, 21 bp, Homo sapiens
ctaacaaatgtaaaattatga

SEQ ID NO: 783760 - DNA, 20 bp, Homo sapiens
ctaacaacattgtagcctca

SEQ ID NO: 783761 - DNA, 18 bp, Homo sapiens
ctaacaagtgtatctcga

SEQ ID NO: 783762 - DNA, 16 bp, Homo sapiens
ctaacacagcatgtgt

SEQ ID NO: 783763 - DNA, 23 bp, Homo sapiens
ctaacactttagttatattcact

SEQ ID NO: 783764 - DNA, 18 bp, Homo sapiens
ctaacagaaattaattta

SEQ ID NO: 783765 - DNA, 15 bp, Homo sapiens
ctaacagtttgcctg

SEQ ID NO: 783766 - DNA, 17 bp, Homo sapiens
ctaacagtttgcctgct

SEQ ID NO: 783767 - DNA, 22 bp, Homo sapiens
ctaacatataatgttgttattt

SEQ ID NO: 783768 - DNA, 15 bp, Homo sapiens
ctaacatatgtatta

SEQ ID NO: 783769 - DNA, 16 bp, Homo sapiens
ctaacatatgtattaa

SEQ ID NO: 783770 - DNA, 14 bp, Homo sapiens
ctaacatcccactt

SEQ ID NO: 783771 - DNA, 15 bp, Homo sapiens
ctaacatcccactta

SEQ ID NO: 783772 - DNA, 11 bp, Homo sapiens
ctaacatcttt

SEQ ID NO: 783773 - DNA, 15 bp, Homo sapiens
ctaacatgttatcaa

SEQ ID NO: 783774 - DNA, 18 bp, Homo sapiens
ctaacattttaaataaaa

SEQ ID NO: 783775 - DNA, 21 bp, Homo sapiens
ctaacattttaaataaaagaa

SEQ ID NO: 783776 - DNA, 20 bp, Homo sapiens
ctaaccaaattctccctgga

SEQ ID NO: 783777 - DNA, 21 bp, Homo sapiens
ctaaccaagctgagtttccta

SEQ ID NO: 783778 - DNA, 16 bp, Homo sapiens
ctaaccagcagaaatg

SEQ ID NO: 783779 - DNA, 17 bp, Homo sapiens
ctaaccagcagaaatgc

SEQ ID NO: 783780 - DNA, 16 bp, Homo sapiens
ctaaccatccccaact

SEQ ID NO: 783781 - DNA, 21 bp, Homo sapiens
ctaaccatccccaactccatg

SEQ ID NO: 783782 - DNA, 19 bp, Homo sapiens
ctaacccccagcccacaga

SEQ ID NO: 783783 - DNA, 21 bp, Homo sapiens
ctaacccccagcccacagagc

SEQ ID NO: 783784 - DNA, 14 bp, Homo sapiens
ctaaccccttccag

SEQ ID NO: 783785 - DNA, 19 bp, Homo sapiens
ctaacccttatcaccagct

SEQ ID NO: 783786 - DNA, 21 bp, Homo sapiens
ctaacctatctatgaacaaca

SEQ ID NO: 783787 - DNA, 21 bp, Homo sapiens
ctaacctcgctcgatgactgt

SEQ ID NO: 783788 - DNA, 17 bp, Homo sapiens
ctaacctcgggcctgct

SEQ ID NO: 783789 - DNA, 18 bp, Homo sapiens
ctaacctctaaccctcat

SEQ ID NO: 783790 - DNA, 12 bp, Homo sapiens
ctaacctgtgac

SEQ ID NO: 783791 - DNA, 17 bp, Homo sapiens
ctaaccttgaatgctgc

SEQ ID NO: 783792 - DNA, 20 bp, Homo sapiens
ctaaccttgaatgctgccag

SEQ ID NO: 783793 - DNA, 16 bp, Homo sapiens
ctaaccttgcctggta

SEQ ID NO: 783794 - DNA, 21 bp, Homo sapiens
ctaacctttacatgaggactc

SEQ ID NO: 783795 - DNA, 22 bp, Homo sapiens
ctaacgataaaaggtaataaca

SEQ ID NO: 783796 - DNA, 19 bp, Homo sapiens
ctaacgtgtcagaatcctt

SEQ ID NO: 783797 - DNA, 17 bp, Homo sapiens
ctaacgttgagcccctg

SEQ ID NO: 783798 - DNA, 12 bp, Homo sapiens
ctaactaaactc

SEQ ID NO: 783799 - DNA, 19 bp, Homo sapiens
ctaactaaactctctttgg

SEQ ID NO: 783800 - DNA, 22 bp, Homo sapiens
ctaactagaattagtatgtctg

SEQ ID NO: 783801 - DNA, 18 bp, Homo sapiens
ctaactcaagataatcct

SEQ ID NO: 783802 - DNA, 21 bp, Homo sapiens
ctaactcaccagccccactgc

SEQ ID NO: 783803 - DNA, 15 bp, Homo sapiens
ctaactcactgccta

SEQ ID NO: 783804 - DNA, 17 bp, Homo sapiens
ctaactcactgcctagg

SEQ ID NO: 783805 - DNA, 20 bp, Homo sapiens
ctaactgctacaaatactct

SEQ ID NO: 783806 - DNA, 19 bp, Homo sapiens
ctaactgcttcatctcctt

SEQ ID NO: 783807 - DNA, 18 bp, Homo sapiens
ctaactgtaaatcatgtt

SEQ ID NO: 783808 - DNA, 12 bp, Homo sapiens
ctaactgtatat

SEQ ID NO: 783809 - DNA, 16 bp, Homo sapiens
ctaactgtatatttgt

SEQ ID NO: 783810 - DNA, 21 bp, Homo sapiens
ctaactgtggaatataaatag

SEQ ID NO: 783811 - DNA, 22 bp, Homo sapiens
ctaactgtggaatataaatagc

SEQ ID NO: 783812 - DNA, 14 bp, Homo sapiens
ctaacttcagtagg

SEQ ID NO: 783813 - DNA, 13 bp, Homo sapiens
ctaacttcataga

SEQ ID NO: 783814 - DNA, 17 bp, Homo sapiens
ctaacttcctgtgcctt

SEQ ID NO: 783815 - DNA, 23 bp, Homo sapiens
ctaacttcctgtgcctttcctat

SEQ ID NO: 783816 - DNA, 14 bp, Homo sapiens
ctaacttcctttat

SEQ ID NO: 783817 - DNA, 19 bp, Homo sapiens
ctaacttttcttaaggttt

SEQ ID NO: 783818 - DNA, 22 bp, Homo sapiens
ctaagaaaagatacgactttat

SEQ ID NO: 783819 - DNA, 23 bp, Homo sapiens
ctaagaaaagatacgactttatt

SEQ ID NO: 783820 - DNA, 14 bp, Homo sapiens
ctaagaaaagattt

SEQ ID NO: 783821 - DNA, 20 bp, Homo sapiens
ctaagaaaagattttaatca

SEQ ID NO: 783822 - DNA, 21 bp, Homo sapiens
ctaagaaaagattttaatcaa

SEQ ID NO: 783823 - DNA, 15 bp, Homo sapiens
ctaagaaaatgtagt

SEQ ID NO: 783824 - DNA, 19 bp, Homo sapiens
ctaagaaatatctgtgaaa

SEQ ID NO: 783825 - DNA, 23 bp, Homo sapiens
ctaagaaccaaaaaaaaaaaagg

SEQ ID NO: 783826 - DNA, 23 bp, Homo sapiens
ctaagaagaaaattgctgtgcct

SEQ ID NO: 783827 - DNA, 15 bp, Homo sapiens
ctaagaagacatttt

SEQ ID NO: 783828 - DNA, 18 bp, Homo sapiens
ctaagaagacattttgtt

SEQ ID NO: 783829 - DNA, 18 bp, Homo sapiens
ctaagaagttattttctt

SEQ ID NO: 783830 - DNA, 17 bp, Homo sapiens
ctaagaataacaagaag

SEQ ID NO: 783831 - DNA, 22 bp, Homo sapiens
ctaagaataacaagaagcccag

SEQ ID NO: 783832 - DNA, 22 bp, Homo sapiens
ctaagaattttgttttactttt

SEQ ID NO: 783833 - DNA, 23 bp, Homo sapiens
ctaagacacaaatgcatgaacaa

SEQ ID NO: 783834 - DNA, 23 bp, Homo sapiens
ctaagacatgtgaggaggaaaag

SEQ ID NO: 783835 - DNA, 21 bp, Homo sapiens
ctaagaccacgaaaaaaggct

SEQ ID NO: 783836 - DNA, 20 bp, Homo sapiens
ctaagactcccgccccgggc

SEQ ID NO: 783837 - DNA, 16 bp, Homo sapiens
ctaagactgccttcag

SEQ ID NO: 783838 - DNA, 15 bp, Homo sapiens
ctaagagaagtagaa

SEQ ID NO: 783839 - DNA, 22 bp, Homo sapiens
ctaagagaagttattttctaca

SEQ ID NO: 783840 - DNA, 21 bp, Homo sapiens
ctaagagaagttgtaaagtat

SEQ ID NO: 783841 - DNA, 17 bp, Homo sapiens
ctaagaggatacaaatt

SEQ ID NO: 783842 - DNA, 20 bp, Homo sapiens
ctaagagggcccaaagaatt

SEQ ID NO: 783843 - DNA, 18 bp, Homo sapiens
ctaagatacactgcactt

SEQ ID NO: 783844 - DNA, 20 bp, Homo sapiens
ctaagatgaaatgcactgta

SEQ ID NO: 783845 - DNA, 20 bp, Homo sapiens
ctaagatgaagctgagcttt

SEQ ID NO: 783846 - DNA, 20 bp, Homo sapiens
ctaagatgagatttgccagc

SEQ ID NO: 783847 - DNA, 21 bp, Homo sapiens
ctaagatgagatttgccagca

SEQ ID NO: 783848 - DNA, 23 bp, Homo sapiens
ctaagattcttttaaattagaaa

SEQ ID NO: 783849 - DNA, 12 bp, Homo sapiens
ctaagcacttct

SEQ ID NO: 783850 - DNA, 20 bp, Homo sapiens
ctaagcagaggaggggccgc

SEQ ID NO: 783851 - DNA, 14 bp, Homo sapiens
ctaagcagccagga

SEQ ID NO: 783852 - DNA, 21 bp, Homo sapiens
ctaagcagctggtcttttctc

SEQ ID NO: 783853 - DNA, 23 bp, Homo sapiens
ctaagcagttatggtgatgactt

SEQ ID NO: 783854 - DNA, 22 bp, Homo sapiens
ctaagcatatcgtaaagctgtt

SEQ ID NO: 783855 - DNA, 13 bp, Homo sapiens
ctaagccacagct

SEQ ID NO: 783856 - DNA, 13 bp, Homo sapiens
ctaagccagcctg

SEQ ID NO: 783857 - DNA, 18 bp, Homo sapiens
ctaagccagcctggtcca

SEQ ID NO: 783858 - DNA, 15 bp, Homo sapiens
ctaagccaggcctgg

SEQ ID NO: 783859 - DNA, 22 bp, Homo sapiens
ctaagccaggcctggctggagg

SEQ ID NO: 783860 - DNA, 18 bp, Homo sapiens
ctaagccagttttcattt

SEQ ID NO: 783861 - DNA, 14 bp, Homo sapiens
ctaagcccccgctg

SEQ ID NO: 783862 - DNA, 18 bp, Homo sapiens
ctaagcccccgctgtaat

SEQ ID NO: 783863 - DNA, 22 bp, Homo sapiens
ctaagcccccgctgtaatgaaa

SEQ ID NO: 783864 - DNA, 18 bp, Homo sapiens
ctaagccctcgaaccaag

SEQ ID NO: 783865 - DNA, 13 bp, Homo sapiens
ctaagcctggaag

SEQ ID NO: 783866 - DNA, 14 bp, Homo sapiens
ctaagcctggaagc

SEQ ID NO: 783867 - DNA, 15 bp, Homo sapiens
ctaagcctggaagcc

SEQ ID NO: 783868 - DNA, 17 bp, Homo sapiens
ctaagcctggaagccat

SEQ ID NO: 783869 - DNA, 14 bp, Homo sapiens
ctaagcctgtcccc

SEQ ID NO: 783870 - DNA, 14 bp, Homo sapiens
ctaagcctgttgct

SEQ ID NO: 783871 - DNA, 17 bp, Homo sapiens
ctaagcctttccataag

SEQ ID NO: 783872 - DNA, 18 bp, Homo sapiens
ctaagcgtgctgacatca

SEQ ID NO: 783873 - DNA, 15 bp, Homo sapiens
ctaagctaaccccct

SEQ ID NO: 783874 - DNA, 15 bp, Homo sapiens
ctaagctctttgaga

SEQ ID NO: 783875 - DNA, 23 bp, Homo sapiens
ctaagctgatattatttcttctc

SEQ ID NO: 783876 - DNA, 22 bp, Homo sapiens
ctaagctggagctcttggaaga

SEQ ID NO: 783877 - DNA, 14 bp, Homo sapiens
ctaagctgtttgcc

SEQ ID NO: 783878 - DNA, 20 bp, Homo sapiens
ctaagctttgccagctgctg

SEQ ID NO: 783879 - DNA, 15 bp, Homo sapiens
ctaaggaaccttcct

SEQ ID NO: 783880 - DNA, 18 bp, Homo sapiens
ctaaggacaaattagcat

SEQ ID NO: 783881 - DNA, 23 bp, Homo sapiens
ctaaggacaaattagcatgcaag

SEQ ID NO: 783882 - DNA, 11 bp, Homo sapiens
ctaaggacaca

SEQ ID NO: 783883 - DNA, 13 bp, Homo sapiens
ctaaggacacact

SEQ ID NO: 783884 - DNA, 14 bp, Homo sapiens
ctaaggacacacta

SEQ ID NO: 783885 - DNA, 16 bp, Homo sapiens
ctaaggacatttccca

SEQ ID NO: 783886 - DNA, 17 bp, Homo sapiens
ctaaggacatttcccag

SEQ ID NO: 783887 - DNA, 19 bp, Homo sapiens
ctaaggacatttcccaggg

SEQ ID NO: 783888 - DNA, 19 bp, Homo sapiens
ctaaggagcgctagtgcct

SEQ ID NO: 783889 - DNA, 20 bp, Homo sapiens
ctaaggagcgctagtgcctt

SEQ ID NO: 783890 - DNA, 17 bp, Homo sapiens
ctaaggaggggaaaaaa

SEQ ID NO: 783891 - DNA, 20 bp, Homo sapiens
ctaaggaggggaaaaaaatg

SEQ ID NO: 783892 - DNA, 21 bp, Homo sapiens
ctaaggaggggaaaaaaatgt

SEQ ID NO: 783893 - DNA, 18 bp, Homo sapiens
ctaaggataatgaaataa

SEQ ID NO: 783894 - DNA, 20 bp, Homo sapiens
ctaaggatagcaccgctttt

SEQ ID NO: 783895 - DNA, 12 bp, Homo sapiens
ctaaggatctct

SEQ ID NO: 783896 - DNA, 15 bp, Homo sapiens
ctaaggatctctcag

SEQ ID NO: 783897 - DNA, 18 bp, Homo sapiens
ctaaggatgtcacagggc

SEQ ID NO: 783898 - DNA, 14 bp, Homo sapiens
ctaaggctccccac

SEQ ID NO: 783899 - DNA, 16 bp, Homo sapiens
ctaaggctccccaccc

SEQ ID NO: 783900 - DNA, 15 bp, Homo sapiens
ctaaggctcctcctt

SEQ ID NO: 783901 - DNA, 23 bp, Homo sapiens
ctaaggctgctggcttcagggag

SEQ ID NO: 783902 - DNA, 22 bp, Homo sapiens
ctaaggctgcttcaaagattat

SEQ ID NO: 783903 - DNA, 22 bp, Homo sapiens
ctaagggaaagaattgaggaat

SEQ ID NO: 783904 - DNA, 23 bp, Homo sapiens
ctaagggagagtggtatttgcag

SEQ ID NO: 783905 - DNA, 12 bp, Homo sapiens
ctaagggcagcc

SEQ ID NO: 783906 - DNA, 13 bp, Homo sapiens
ctaagggcagccc

SEQ ID NO: 783907 - DNA, 19 bp, Homo sapiens
ctaaggggacctacagaca

SEQ ID NO: 783908 - DNA, 13 bp, Homo sapiens
ctaaggggcccgg

SEQ ID NO: 783909 - DNA, 22 bp, Homo sapiens
ctaaggggcccggccagccatg

SEQ ID NO: 783910 - DNA, 22 bp, Homo sapiens
ctaagggtagaaaactccaggg

SEQ ID NO: 783911 - DNA, 14 bp, Homo sapiens
ctaagggtgggtgc

SEQ ID NO: 783912 - DNA, 22 bp, Homo sapiens
ctaagggtgggtgctcagaata

SEQ ID NO: 783913 - DNA, 14 bp, Homo sapiens
ctaagggtgtcaag

SEQ ID NO: 783914 - DNA, 14 bp, Homo sapiens
ctaaggtctcatgc

SEQ ID NO: 783915 - DNA, 14 bp, Homo sapiens
ctaaggttctcata

SEQ ID NO: 783916 - DNA, 21 bp, Homo sapiens
ctaaggttgtctacgggggca

SEQ ID NO: 783917 - DNA, 18 bp, Homo sapiens
ctaaggtttccagtcaga

SEQ ID NO: 783918 - DNA, 19 bp, Homo sapiens
ctaaggttttgttgtgttc

SEQ ID NO: 783919 - DNA, 22 bp, Homo sapiens
ctaagtaaaaatatgtcatcat

SEQ ID NO: 783920 - DNA, 19 bp, Homo sapiens
ctaagtaaatacaattttt

SEQ ID NO: 783921 - DNA, 19 bp, Homo sapiens
ctaagtaagtttcttcctg

SEQ ID NO: 783922 - DNA, 17 bp, Homo sapiens
ctaagtaatttagaaga

SEQ ID NO: 783923 - DNA, 19 bp, Homo sapiens
ctaagtaatttagaagata

SEQ ID NO: 783924 - DNA, 11 bp, Homo sapiens
ctaagtacaag

SEQ ID NO: 783925 - DNA, 20 bp, Homo sapiens
ctaagtacacaataagcaaa

SEQ ID NO: 783926 - DNA, 16 bp, Homo sapiens
ctaagtatttaaatgt

SEQ ID NO: 783927 - DNA, 16 bp, Homo sapiens
ctaagtatttcccagc

SEQ ID NO: 783928 - DNA, 21 bp, Homo sapiens
ctaagtcacccagagcacagg

SEQ ID NO: 783929 - DNA, 15 bp, Homo sapiens
ctaagtcatgtatgt

SEQ ID NO: 783930 - DNA, 19 bp, Homo sapiens
ctaagtccagtgtttcttt

SEQ ID NO: 783931 - DNA, 16 bp, Homo sapiens
ctaagtcccttcctat

SEQ ID NO: 783932 - DNA, 23 bp, Homo sapiens
ctaagtcccttcctattctcctg

SEQ ID NO: 783933 - DNA, 18 bp, Homo sapiens
ctaagtctttactctgac

SEQ ID NO: 783934 - DNA, 16 bp, Homo sapiens
ctaagtctttccattg

SEQ ID NO: 783935 - DNA, 19 bp, Homo sapiens
ctaagtgatttccacaggt

SEQ ID NO: 783936 - DNA, 17 bp, Homo sapiens
ctaagtgctaagtgctt

SEQ ID NO: 783937 - DNA, 16 bp, Homo sapiens
ctaagtggattggctt

SEQ ID NO: 783938 - DNA, 21 bp, Homo sapiens
ctaagtggattggctttgtgc

SEQ ID NO: 783939 - DNA, 12 bp, Homo sapiens
ctaagtgggaga

SEQ ID NO: 783940 - DNA, 22 bp, Homo sapiens
ctaagtgtttactatgtgccag

SEQ ID NO: 783941 - DNA, 17 bp, Homo sapiens
ctaagttaatttaaagt

SEQ ID NO: 783942 - DNA, 21 bp, Homo sapiens
ctaagttaatttaaagttgtt

SEQ ID NO: 783943 - DNA, 23 bp, Homo sapiens
ctaagttagactcttcccctccc

SEQ ID NO: 783944 - DNA, 11 bp, Homo sapiens
ctaagttatta

SEQ ID NO: 783945 - DNA, 19 bp, Homo sapiens
ctaagttattacctctcca

SEQ ID NO: 783946 - DNA, 22 bp, Homo sapiens
ctaagttatttactcctcctgc

SEQ ID NO: 783947 - DNA, 18 bp, Homo sapiens
ctaagttccactgagctc

SEQ ID NO: 783948 - DNA, 20 bp, Homo sapiens
ctaagttccactgagctcca

SEQ ID NO: 783949 - DNA, 17 bp, Homo sapiens
ctaagttctaagttcat

SEQ ID NO: 783950 - DNA, 14 bp, Homo sapiens
ctaagttgctggga

SEQ ID NO: 783951 - DNA, 18 bp, Homo sapiens
ctaataaaaagcttttgt

SEQ ID NO: 783952 - DNA, 20 bp, Homo sapiens
ctaataaaaagcttttgtct

SEQ ID NO: 783953 - DNA, 10 bp, Homo sapiens
ctaataaaac

SEQ ID NO: 783954 - DNA, 19 bp, Homo sapiens
ctaataaaattcgctttct

SEQ ID NO: 783955 - DNA, 21 bp, Homo sapiens
ctaataaaattcgctttctaa

SEQ ID NO: 783956 - DNA, 13 bp, Homo sapiens
ctaataaatacat

SEQ ID NO: 783957 - DNA, 22 bp, Homo sapiens
ctaataagtttgtgttagaaaa

SEQ ID NO: 783958 - DNA, 12 bp, Homo sapiens
ctaataataaat

SEQ ID NO: 783959 - DNA, 16 bp, Homo sapiens
ctaatacaatggtcat

SEQ ID NO: 783960 - DNA, 20 bp, Homo sapiens
ctaatagaactcagttttaa

SEQ ID NO: 783961 - DNA, 21 bp, Homo sapiens
ctaatagaataaaggcagttt

SEQ ID NO: 783962 - DNA, 17 bp, Homo sapiens
ctaatagacaatttatt

SEQ ID NO: 783963 - DNA, 23 bp, Homo sapiens
ctaatagacaatttattatggca

SEQ ID NO: 783964 - DNA, 17 bp, Homo sapiens
ctaatagagagattagt

SEQ ID NO: 783965 - DNA, 17 bp, Homo sapiens
ctaatatacagggtagc

SEQ ID NO: 783966 - DNA, 12 bp, Homo sapiens
ctaatatacttt

SEQ ID NO: 783967 - DNA, 23 bp, Homo sapiens
ctaatatagtaggggttgaagaa

SEQ ID NO: 783968 - DNA, 17 bp, Homo sapiens
ctaatatatatgaataa

SEQ ID NO: 783969 - DNA, 13 bp, Homo sapiens
ctaatatatttaa

SEQ ID NO: 783970 - DNA, 12 bp, Homo sapiens
ctaatatatttt

SEQ ID NO: 783971 - DNA, 15 bp, Homo sapiens
ctaatatatttttat

SEQ ID NO: 783972 - DNA, 15 bp, Homo sapiens
ctaatatcaaatgca

SEQ ID NO: 783973 - DNA, 16 bp, Homo sapiens
ctaatattaaaaatat

SEQ ID NO: 783974 - DNA, 19 bp, Homo sapiens
ctaatcaaagccagggtct

SEQ ID NO: 783975 - DNA, 15 bp, Homo sapiens
ctaatcacagtgttg

SEQ ID NO: 783976 - DNA, 22 bp, Homo sapiens
ctaatcacagtgttgcatatga

SEQ ID NO: 783977 - DNA, 16 bp, Homo sapiens
ctaatcacatgtgctg

SEQ ID NO: 783978 - DNA, 23 bp, Homo sapiens
ctaatcacatgtgctgcaaatag

SEQ ID NO: 783979 - DNA, 17 bp, Homo sapiens
ctaatcagcattctcac

SEQ ID NO: 783980 - DNA, 20 bp, Homo sapiens
ctaatcagcattctcactcc

SEQ ID NO: 783981 - DNA, 21 bp, Homo sapiens
ctaatcagcattctcactcct

SEQ ID NO: 783982 - DNA, 20 bp, Homo sapiens
ctaatcaggctgaggtgtct

SEQ ID NO: 783983 - DNA, 21 bp, Homo sapiens
ctaatcatgagaaaaactgtt

SEQ ID NO: 783984 - DNA, 22 bp, Homo sapiens
ctaatcctatctggggagctcc

SEQ ID NO: 783985 - DNA, 22 bp, Homo sapiens
ctaatctatatgatatgcagcc

SEQ ID NO: 783986 - DNA, 20 bp, Homo sapiens
ctaatctatggtcgggagac

SEQ ID NO: 783987 - DNA, 17 bp, Homo sapiens
ctaatctattgggttca

SEQ ID NO: 783988 - DNA, 18 bp, Homo sapiens
ctaatctattgggttcat

SEQ ID NO: 783989 - DNA, 19 bp, Homo sapiens
ctaatctattgggttcatt

SEQ ID NO: 783990 - DNA, 22 bp, Homo sapiens
ctaatctattgggttcattatt

SEQ ID NO: 783991 - DNA, 11 bp, Homo sapiens
ctaatctgcct

SEQ ID NO: 783992 - DNA, 19 bp, Homo sapiens
ctaatctgcctggttttat

SEQ ID NO: 783993 - DNA, 17 bp, Homo sapiens
ctaatcttattcatttt

SEQ ID NO: 783994 - DNA, 21 bp, Homo sapiens
ctaatcttattcattttctct

SEQ ID NO: 783995 - DNA, 21 bp, Homo sapiens
ctaatcttgaatgtttgtgat

SEQ ID NO: 783996 - DNA, 20 bp, Homo sapiens
ctaatgaaaaacaaaaagct

SEQ ID NO: 783997 - DNA, 17 bp, Homo sapiens
ctacagaatagggtggc

SEQ ID NO: 783998 - DNA, 12 bp, Homo sapiens
ctacagaatttt

SEQ ID NO: 783999 - DNA, 18 bp, Homo sapiens
ctacagacagacatacat

SEQ ID NO: 784000 - DNA, 19 bp, Homo sapiens
ctacagacagacatacata

SEQ ID NO: 784001 - DNA, 21 bp, Homo sapiens
ctacagacttctccagaccca

SEQ ID NO: 784002 - DNA, 12 bp, Homo sapiens
ctacagagaaaa

SEQ ID NO: 784003 - DNA, 20 bp, Homo sapiens
ctacagagaaaatgaatttg

SEQ ID NO: 784004 - DNA, 13 bp, Homo sapiens
ctacagagctgtg

SEQ ID NO: 784005 - DNA, 14 bp, Homo sapiens
ctacagaggaggcc

SEQ ID NO: 784006 - DNA, 15 bp, Homo sapiens
ctacagaggaggcct

SEQ ID NO: 784007 - DNA, 17 bp, Homo sapiens
ctacagaggaggcctca

SEQ ID NO: 784008 - DNA, 20 bp, Homo sapiens
ctacagaggtctctgccggc

SEQ ID NO: 784009 - DNA, 23 bp, Homo sapiens
ctacagaggtctctgccggctct

SEQ ID NO: 784010 - DNA, 22 bp, Homo sapiens
ctacagcactactgggtgtcat

SEQ ID NO: 784011 - DNA, 15 bp, Homo sapiens
ctacagcctctttcc

SEQ ID NO: 784012 - DNA, 16 bp, Homo sapiens
ctacagcctctttcct

SEQ ID NO: 784013 - DNA, 19 bp, Homo sapiens
ctacagctcacctctgaag

SEQ ID NO: 784014 - DNA, 18 bp, Homo sapiens
ctacaggaagcaccccat

SEQ ID NO: 784015 - DNA, 21 bp, Homo sapiens
ctacaggagagggaagagtgc

SEQ ID NO: 784016 - DNA, 21 bp, Homo sapiens
ctacaggatggtgggcaggat

SEQ ID NO: 784017 - DNA, 22 bp, Homo sapiens
ctacagggcgagactctgtctc

SEQ ID NO: 784018 - DNA, 19 bp, Homo sapiens
ctacaggggttagcctgga

SEQ ID NO: 784019 - DNA, 22 bp, Homo sapiens
ctacaggtgcgcgccaccgtgc

SEQ ID NO: 784020 - DNA, 22 bp, Homo sapiens
ctacaggtgtttgactttcaaa

SEQ ID NO: 784021 - DNA, 22 bp, Homo sapiens
ctacagtaatgaaatgtttact

SEQ ID NO: 784022 - DNA, 18 bp, Homo sapiens
ctacagtcaagatagaaa

SEQ ID NO: 784023 - DNA, 19 bp, Homo sapiens
ctacagtgccaactcctca

SEQ ID NO: 784024 - DNA, 14 bp, Homo sapiens
ctacagtggtttta

SEQ ID NO: 784025 - DNA, 16 bp, Homo sapiens
ctacagtggttttata

SEQ ID NO: 784026 - DNA, 13 bp, Homo sapiens
ctacagtgtacag

SEQ ID NO: 784027 - DNA, 14 bp, Homo sapiens
ctacagtgtacagt

SEQ ID NO: 784028 - DNA, 19 bp, Homo sapiens
ctacagttgaaaaacagct

SEQ ID NO: 784029 - DNA, 17 bp, Homo sapiens
ctacagttttaactgtg

SEQ ID NO: 784030 - DNA, 20 bp, Homo sapiens
ctacagttttaactgtggat

SEQ ID NO: 784031 - DNA, 17 bp, Homo sapiens
ctacataaactgacttt

SEQ ID NO: 784032 - DNA, 23 bp, Homo sapiens
ctacatacgcaaaaacttccttt

SEQ ID NO: 784033 - DNA, 18 bp, Homo sapiens
ctacatatgctgatcttt

SEQ ID NO: 784034 - DNA, 15 bp, Homo sapiens
ctacatcccagcctg

SEQ ID NO: 784035 - DNA, 13 bp, Homo sapiens
ctacatctgcctc

SEQ ID NO: 784036 - DNA, 16 bp, Homo sapiens
ctacatcttctgcctt

SEQ ID NO: 784037 - DNA, 13 bp, Homo sapiens
ctacatgaaacag

SEQ ID NO: 784038 - DNA, 15 bp, Homo sapiens
ctacatgaaacagaa

SEQ ID NO: 784039 - DNA, 19 bp, Homo sapiens
ctacatgatgctaaaggct

SEQ ID NO: 784040 - DNA, 22 bp, Homo sapiens
ctacatgccccctcccttcaca

SEQ ID NO: 784041 - DNA, 21 bp, Homo sapiens
ctacatgctctttttctgtga

SEQ ID NO: 784042 - DNA, 21 bp, Homo sapiens
ctacatgtattgcacattgta

SEQ ID NO: 784043 - DNA, 17 bp, Homo sapiens
ctacattaatgtcctct

SEQ ID NO: 784044 - DNA, 22 bp, Homo sapiens
ctacattccctctcctgcccag

SEQ ID NO: 784045 - DNA, 18 bp, Homo sapiens
ctacattcctcagctgcc

SEQ ID NO: 784046 - DNA, 22 bp, Homo sapiens
ctacattcctcagctgccaagc

SEQ ID NO: 784047 - DNA, 20 bp, Homo sapiens
ctacattggaagcctgagca

SEQ ID NO: 784048 - DNA, 14 bp, Homo sapiens
ctacattttgcaac

SEQ ID NO: 784049 - DNA, 20 bp, Homo sapiens
ctacattttttaaaactgaa

SEQ ID NO: 784050 - DNA, 23 bp, Homo sapiens
ctacattttttaaaactgaatct

SEQ ID NO: 784051 - DNA, 12 bp, Homo sapiens
ctaccaaaatgg

SEQ ID NO: 784052 - DNA, 16 bp, Homo sapiens
ctaccaactttactgt

SEQ ID NO: 784053 - DNA, 17 bp, Homo sapiens
ctaccaccccttcctgt

SEQ ID NO: 784054 - DNA, 19 bp, Homo sapiens
ctaccaccttttccttata

SEQ ID NO: 784055 - DNA, 12 bp, Homo sapiens
ctaccagccagc

SEQ ID NO: 784056 - DNA, 13 bp, Homo sapiens
ctaccagccagcc

SEQ ID NO: 784057 - DNA, 16 bp, Homo sapiens
ctaccagccagcctca

SEQ ID NO: 784058 - DNA, 22 bp, Homo sapiens
ctaccagccagcctcagaaggc

SEQ ID NO: 784059 - DNA, 21 bp, Homo sapiens
ctaccagcgccaaatgttcat

SEQ ID NO: 784060 - DNA, 15 bp, Homo sapiens
ctaccagctcctcca

SEQ ID NO: 784061 - DNA, 21 bp, Homo sapiens
ctaccagctcctccagccctg

SEQ ID NO: 784062 - DNA, 15 bp, Homo sapiens
ctaccaggcaaattc

SEQ ID NO: 784063 - DNA, 19 bp, Homo sapiens
ctaccaggtgtgcctggaa

SEQ ID NO: 784064 - DNA, 14 bp, Homo sapiens
ctaccagttgccct

SEQ ID NO: 784065 - DNA, 16 bp, Homo sapiens
ctaccataagtgacac

SEQ ID NO: 784066 - DNA, 18 bp, Homo sapiens
ctaccatcccctgtagag

SEQ ID NO: 784067 - DNA, 18 bp, Homo sapiens
ctaccatctgatgtttca

SEQ ID NO: 784068 - DNA, 19 bp, Homo sapiens
ctaccatgaacagaaaaca

SEQ ID NO: 784069 - DNA, 13 bp, Homo sapiens
ctaccatgctgct

SEQ ID NO: 784070 - DNA, 14 bp, Homo sapiens
ctaccatgctgctt

SEQ ID NO: 784071 - DNA, 13 bp, Homo sapiens
ctaccattcagtg

SEQ ID NO: 784072 - DNA, 12 bp, Homo sapiens
ctaccatttcag

SEQ ID NO: 784073 - DNA, 20 bp, Homo sapiens
ctaccattttacatttctat

SEQ ID NO: 784074 - DNA, 16 bp, Homo sapiens
ctacccaaaccctagg

SEQ ID NO: 784075 - DNA, 12 bp, Homo sapiens
ctacccaaagga

SEQ ID NO: 784076 - DNA, 15 bp, Homo sapiens
ctacccaaccactca

SEQ ID NO: 784077 - DNA, 18 bp, Homo sapiens
ctacccaatgtctcccac

SEQ ID NO: 784078 - DNA, 23 bp, Homo sapiens
ctacccaccgatggagcccccag

SEQ ID NO: 784079 - DNA, 15 bp, Homo sapiens
ctacccactatcctt

SEQ ID NO: 784080 - DNA, 19 bp, Homo sapiens
ctacccactatccttcgtg

SEQ ID NO: 784081 - DNA, 14 bp, Homo sapiens
ctacccactgccag

SEQ ID NO: 784082 - DNA, 20 bp, Homo sapiens
ctacccagcgtggcccaggc

SEQ ID NO: 784083 - DNA, 18 bp, Homo sapiens
ctacccagcgtggcctcc

SEQ ID NO: 784084 - DNA, 14 bp, Homo sapiens
ctacccatatccct

SEQ ID NO: 784085 - DNA, 15 bp, Homo sapiens
ctacccatgagcctg

SEQ ID NO: 784086 - DNA, 16 bp, Homo sapiens
ctacccatgagcctgc

SEQ ID NO: 784087 - DNA, 17 bp, Homo sapiens
ctacccatgagcctgcc

SEQ ID NO: 784088 - DNA, 17 bp, Homo sapiens
ctaccccacaccaggcc

SEQ ID NO: 784089 - DNA, 21 bp, Homo sapiens
ctaccccacaccaggccgtcc

SEQ ID NO: 784090 - DNA, 13 bp, Homo sapiens
ctaccccaccacg

SEQ ID NO: 784091 - DNA, 14 bp, Homo sapiens
ctaccccaccacga

SEQ ID NO: 784092 - DNA, 17 bp, Homo sapiens
ctaccccagtcccaggg

SEQ ID NO: 784093 - DNA, 18 bp, Homo sapiens
ctaccccagtcccaggga

SEQ ID NO: 784094 - DNA, 13 bp, Homo sapiens
ctaccccccacct

SEQ ID NO: 784095 - DNA, 12 bp, Homo sapiens
ctaccccctcat

SEQ ID NO: 784096 - DNA, 21 bp, Homo sapiens
ctaccccctcatcccccagtt

SEQ ID NO: 784097 - DNA, 15 bp, Homo sapiens
ctaccccctcctctc

SEQ ID NO: 784098 - DNA, 21 bp, Homo sapiens
ctacccctcgactcagcacca

SEQ ID NO: 784099 - DNA, 20 bp, Homo sapiens
ctacccctgccctgctccta

SEQ ID NO: 784100 - DNA, 15 bp, Homo sapiens
ctacccctgctccca

SEQ ID NO: 784101 - DNA, 14 bp, Homo sapiens
ctacccctggctgt

SEQ ID NO: 784102 - DNA, 21 bp, Homo sapiens
ctaccccttggaaatgtctgc

SEQ ID NO: 784103 - DNA, 16 bp, Homo sapiens
ctaccccttgtgggca

SEQ ID NO: 784104 - DNA, 13 bp, Homo sapiens
ctacccctttctt

SEQ ID NO: 784105 - DNA, 16 bp, Homo sapiens
ctacccctttcttctc

SEQ ID NO: 784106 - DNA, 20 bp, Homo sapiens
ctacccgacataagtcgagg

SEQ ID NO: 784107 - DNA, 14 bp, Homo sapiens
ctacccgagcccag

SEQ ID NO: 784108 - DNA, 20 bp, Homo sapiens
ctacccgagcccagctacat

SEQ ID NO: 784109 - DNA, 23 bp, Homo sapiens
ctacccgcccgcgtccaaccccg

SEQ ID NO: 784110 - DNA, 15 bp, Homo sapiens
ctacccggcccagag

SEQ ID NO: 784111 - DNA, 15 bp, Homo sapiens
ctacccgtgcctggg

SEQ ID NO: 784112 - DNA, 17 bp, Homo sapiens
ctacccgtgcctgggcc

SEQ ID NO: 784113 - DNA, 23 bp, Homo sapiens
ctacccgtgcctgggcccctccc

SEQ ID NO: 784114 - DNA, 16 bp, Homo sapiens
ctactgatttttgtga

SEQ ID NO: 784115 - DNA, 21 bp, Homo sapiens
ctactgcactccagcctgggg

SEQ ID NO: 784116 - DNA, 13 bp, Homo sapiens
ctactgcactgag

SEQ ID NO: 784117 - DNA, 20 bp, Homo sapiens
ctactgcactttcccccttc

SEQ ID NO: 784118 - DNA, 13 bp, Homo sapiens
ctactgcagcacc

SEQ ID NO: 784119 - DNA, 22 bp, Homo sapiens
ctactgcagcacctccaggcct

SEQ ID NO: 784120 - DNA, 17 bp, Homo sapiens
ctactgccactgtgtgc

SEQ ID NO: 784121 - DNA, 12 bp, Homo sapiens
ctactgcccaca

SEQ ID NO: 784122 - DNA, 15 bp, Homo sapiens
ctactgcccacattt

SEQ ID NO: 784123 - DNA, 17 bp, Homo sapiens
ctactgcccctctccga

SEQ ID NO: 784124 - DNA, 19 bp, Homo sapiens
ctactgcccctctccgaaa

SEQ ID NO: 784125 - DNA, 11 bp, Homo sapiens
ctactgccttt

SEQ ID NO: 784126 - DNA, 15 bp, Homo sapiens
ctactgcctttagaa

SEQ ID NO: 784127 - DNA, 15 bp, Homo sapiens
ctactgctaaatcct

SEQ ID NO: 784128 - DNA, 20 bp, Homo sapiens
ctactgctaatgttgatcag

SEQ ID NO: 784129 - DNA, 15 bp, Homo sapiens
ctactgctcctgtgg

SEQ ID NO: 784130 - DNA, 16 bp, Homo sapiens
ctactgctcctgtggc

SEQ ID NO: 784131 - DNA, 21 bp, Homo sapiens
ctactggaaatgtagcactta

SEQ ID NO: 784132 - DNA, 14 bp, Homo sapiens
ctactggaatggtg

SEQ ID NO: 784133 - DNA, 21 bp, Homo sapiens
ctactggacttgaatggttaa

SEQ ID NO: 784134 - DNA, 14 bp, Homo sapiens
ctactggattctta

SEQ ID NO: 784135 - DNA, 11 bp, Homo sapiens
ctactggcagc

SEQ ID NO: 784136 - DNA, 14 bp, Homo sapiens
ctactggcagctcc

SEQ ID NO: 784137 - DNA, 15 bp, Homo sapiens
ctactggcagctcct

SEQ ID NO: 784138 - DNA, 15 bp, Homo sapiens
ctactggcattaatt

SEQ ID NO: 784139 - DNA, 19 bp, Homo sapiens
ctactggcattaattatta

SEQ ID NO: 784140 - DNA, 20 bp, Homo sapiens
ctactggcattaattattaa

SEQ ID NO: 784141 - DNA, 16 bp, Homo sapiens
ctactgggtgtcattt

SEQ ID NO: 784142 - DNA, 16 bp, Homo sapiens
ctactgtaattttata

SEQ ID NO: 784143 - DNA, 12 bp, Homo sapiens
ctactgtacttt

SEQ ID NO: 784144 - DNA, 17 bp, Homo sapiens
ctactgtcaaatgatgt

SEQ ID NO: 784145 - DNA, 21 bp, Homo sapiens
ctactgtcaaatgatgtgcaa

SEQ ID NO: 784146 - DNA, 20 bp, Homo sapiens
ctactgtctcactgaaacat

SEQ ID NO: 784147 - DNA, 17 bp, Homo sapiens
ctactgtctcctccctg

SEQ ID NO: 784148 - DNA, 12 bp, Homo sapiens
ctactgtgggga

SEQ ID NO: 784149 - DNA, 21 bp, Homo sapiens
ctactgtggggagagatggca

SEQ ID NO: 784150 - DNA, 15 bp, Homo sapiens
ctactgtgtgtgtga

SEQ ID NO: 784151 - DNA, 17 bp, Homo sapiens
ctactgtgtgtgtgaat

SEQ ID NO: 784152 - DNA, 13 bp, Homo sapiens
ctactgtgttcct

SEQ ID NO: 784153 - DNA, 19 bp, Homo sapiens
ctactgtgttcctggcaat

SEQ ID NO: 784154 - DNA, 14 bp, Homo sapiens
ctactgttcctttc

SEQ ID NO: 784155 - DNA, 18 bp, Homo sapiens
ctactgttcctttcagat

SEQ ID NO: 784156 - DNA, 13 bp, Homo sapiens
ctactgttgcaca

SEQ ID NO: 784157 - DNA, 16 bp, Homo sapiens
ctactgttgcacagcc

SEQ ID NO: 784158 - DNA, 17 bp, Homo sapiens
ctactgttgcacagcca

SEQ ID NO: 784159 - DNA, 23 bp, Homo sapiens
ctacttaaaatgattctctacca

SEQ ID NO: 784160 - DNA, 17 bp, Homo sapiens
ctacttaaatttgaatc

SEQ ID NO: 784161 - DNA, 19 bp, Homo sapiens
ctacttaaatttgaatctg

SEQ ID NO: 784162 - DNA, 16 bp, Homo sapiens
ctacttaatgcacagt

SEQ ID NO: 784163 - DNA, 19 bp, Homo sapiens
ctacttaatgtaattcagg

SEQ ID NO: 784164 - DNA, 15 bp, Homo sapiens
ctacttaattccttt

SEQ ID NO: 784165 - DNA, 14 bp, Homo sapiens
ctacttagggaaga

SEQ ID NO: 784166 - DNA, 15 bp, Homo sapiens
ctacttagggaagaa

SEQ ID NO: 784167 - DNA, 22 bp, Homo sapiens
ctacttagggaagaaaaagcaa

SEQ ID NO: 784168 - DNA, 14 bp, Homo sapiens
ctacttatcatttt

SEQ ID NO: 784169 - DNA, 20 bp, Homo sapiens
ctacttatcatttttgtata

SEQ ID NO: 784170 - DNA, 22 bp, Homo sapiens
ctacttcatagctccttggagc

SEQ ID NO: 784171 - DNA, 20 bp, Homo sapiens
ctacttccccttcctaattc

SEQ ID NO: 784172 - DNA, 17 bp, Homo sapiens
ctacttccccttcttgc

SEQ ID NO: 784173 - DNA, 13 bp, Homo sapiens
ctacttcctcctc

SEQ ID NO: 784174 - DNA, 20 bp, Homo sapiens
ctacttctggaagtcatctc

SEQ ID NO: 784175 - DNA, 18 bp, Homo sapiens
ctacttctgtaattgtgt

SEQ ID NO: 784176 - DNA, 23 bp, Homo sapiens
ctacttcttttttcaaaagaaag

SEQ ID NO: 784177 - DNA, 15 bp, Homo sapiens
ctacttgaagtggtt

SEQ ID NO: 784178 - DNA, 15 bp, Homo sapiens
ctacttgcctcattt

SEQ ID NO: 784179 - DNA, 23 bp, Homo sapiens
ctacttgggagcctgaggcagga

SEQ ID NO: 784180 - DNA, 13 bp, Homo sapiens
ctacttgggaggc

SEQ ID NO: 784181 - DNA, 15 bp, Homo sapiens
ctacttggtttgtgt

SEQ ID NO: 784182 - DNA, 17 bp, Homo sapiens
ctacttgtgactgaagg

SEQ ID NO: 784183 - DNA, 19 bp, Homo sapiens
ctactttataactaacatg

SEQ ID NO: 784184 - DNA, 22 bp, Homo sapiens
ctactttcatcttaaactaata

SEQ ID NO: 784185 - DNA, 19 bp, Homo sapiens
ctactttgaaaacaattca

SEQ ID NO: 784186 - DNA, 21 bp, Homo sapiens
ctactttgaaaacaattcagt

SEQ ID NO: 784187 - DNA, 21 bp, Homo sapiens
ctactttgactttttgcattt

SEQ ID NO: 784188 - DNA, 19 bp, Homo sapiens
ctactttgcttccgccact

SEQ ID NO: 784189 - DNA, 14 bp, Homo sapiens
ctactttgtccttt

SEQ ID NO: 784190 - DNA, 20 bp, Homo sapiens
ctactttgtcctttttgtta

SEQ ID NO: 784191 - DNA, 22 bp, Homo sapiens
ctactttgtcctttttgttatt

SEQ ID NO: 784192 - DNA, 13 bp, Homo sapiens
ctacttttctaaa

SEQ ID NO: 784193 - DNA, 14 bp, Homo sapiens
ctacttttctaaaa

SEQ ID NO: 784194 - DNA, 13 bp, Homo sapiens
ctacttttcttta

SEQ ID NO: 784195 - DNA, 22 bp, Homo sapiens
ctacttttctttattagctttc

SEQ ID NO: 784196 - DNA, 14 bp, Homo sapiens
ctactttttatact

SEQ ID NO: 784197 - DNA, 18 bp, Homo sapiens
ctactttttgtatttagt

SEQ ID NO: 784198 - DNA, 19 bp, Homo sapiens
ctactttttgtatttagta

SEQ ID NO: 784199 - DNA, 19 bp, Homo sapiens
ctacttttttatccacctc

SEQ ID NO: 784200 - DNA, 20 bp, Homo sapiens
ctacttttttatccacctcc

SEQ ID NO: 784201 - DNA, 12 bp, Homo sapiens
ctagaaaaataa

SEQ ID NO: 784202 - DNA, 17 bp, Homo sapiens
ctagaaaaataaaatgt

SEQ ID NO: 784203 - DNA, 14 bp, Homo sapiens
ctagaaacccaagc

SEQ ID NO: 784204 - DNA, 16 bp, Homo sapiens
ctagaaactctggctc

SEQ ID NO: 784205 - DNA, 14 bp, Homo sapiens
ctagaaagaaaaga

SEQ ID NO: 784206 - DNA, 16 bp, Homo sapiens
ctagaaagccatattc

SEQ ID NO: 784207 - DNA, 18 bp, Homo sapiens
ctagaaagccatattcca

SEQ ID NO: 784208 - DNA, 19 bp, Homo sapiens
ctagaaagccatattccag

SEQ ID NO: 784209 - DNA, 21 bp, Homo sapiens
ctagaaagccatattccagca

SEQ ID NO: 784210 - DNA, 20 bp, Homo sapiens
ctagaaagttagggggttct

SEQ ID NO: 784211 - DNA, 13 bp, Homo sapiens
ctagaaatatgat

SEQ ID NO: 784212 - DNA, 23 bp, Homo sapiens
ctagaaatgatccccagctgttt

SEQ ID NO: 784213 - DNA, 12 bp, Homo sapiens
ctagaaattttc

SEQ ID NO: 784214 - DNA, 14 bp, Homo sapiens
ctagaacacaggca

SEQ ID NO: 784215 - DNA, 20 bp, Homo sapiens
ctagaacatccctgggcaag

SEQ ID NO: 784216 - DNA, 20 bp, Homo sapiens
ctagaacatgcacatttata

SEQ ID NO: 784217 - DNA, 18 bp, Homo sapiens
ctagaactctccatctta

SEQ ID NO: 784218 - DNA, 13 bp, Homo sapiens
ctagaagaaaacc

SEQ ID NO: 784219 - DNA, 13 bp, Homo sapiens
ctagaagaaaagc

SEQ ID NO: 784220 - DNA, 16 bp, Homo sapiens
ctagaagaaccaaata

SEQ ID NO: 784221 - DNA, 21 bp, Homo sapiens
ctagaagaaccaaatacctca

SEQ ID NO: 784222 - DNA, 12 bp, Homo sapiens
ctagaagcacat

SEQ ID NO: 784223 - DNA, 23 bp, Homo sapiens
ctagttaccacattactctgcct

SEQ ID NO: 784224 - DNA, 15 bp, Homo sapiens
ctagttcaagaagat

SEQ ID NO: 784225 - DNA, 12 bp, Homo sapiens
ctagttctagat

SEQ ID NO: 784226 - DNA, 18 bp, Homo sapiens
ctagttctcaatcactgc

SEQ ID NO: 784227 - DNA, 17 bp, Homo sapiens
ctagttctgttgttttg

SEQ ID NO: 784228 - DNA, 15 bp, Homo sapiens
ctagttctttcctcc

SEQ ID NO: 784229 - DNA, 22 bp, Homo sapiens
ctagttctttcctccccctgca

SEQ ID NO: 784230 - DNA, 22 bp, Homo sapiens
ctagttctttgttcatagccca

SEQ ID NO: 784231 - DNA, 12 bp, Homo sapiens
ctagtttattct

SEQ ID NO: 784232 - DNA, 16 bp, Homo sapiens
ctagtttcagtaaata

SEQ ID NO: 784233 - DNA, 15 bp, Homo sapiens
ctagtttcctctcct

SEQ ID NO: 784234 - DNA, 20 bp, Homo sapiens
ctagtttgattaaattcttg

SEQ ID NO: 784235 - DNA, 16 bp, Homo sapiens
ctagtttgattattat

SEQ ID NO: 784236 - DNA, 13 bp, Homo sapiens
ctagttttacaga

SEQ ID NO: 784237 - DNA, 21 bp, Homo sapiens
ctagttttacagattgcctcc

SEQ ID NO: 784238 - DNA, 20 bp, Homo sapiens
ctagttttagttttctctta

SEQ ID NO: 784239 - DNA, 15 bp, Homo sapiens
ctagttttcagcctt

SEQ ID NO: 784240 - DNA, 19 bp, Homo sapiens
ctagttttcagccttggga

SEQ ID NO: 784241 - DNA, 16 bp, Homo sapiens
ctagttttctcctccc

SEQ ID NO: 784242 - DNA, 17 bp, Homo sapiens
ctagttttctcctccca

SEQ ID NO: 784243 - DNA, 15 bp, Homo sapiens
ctagtttttatagct

SEQ ID NO: 784244 - DNA, 18 bp, Homo sapiens
ctagttttttgcttctct

SEQ ID NO: 784245 - DNA, 20 bp, Homo sapiens
ctagttttttgcttctcttt

SEQ ID NO: 784246 - DNA, 18 bp, Homo sapiens
ctagttttttttgtaaac

SEQ ID NO: 784247 - DNA, 12 bp, Homo sapiens
ctataaaaaaga

SEQ ID NO: 784248 - DNA, 15 bp, Homo sapiens
ctataaaaaatatgt

SEQ ID NO: 784249 - DNA, 16 bp, Homo sapiens
ctataaaataaacttc

SEQ ID NO: 784250 - DNA, 12 bp, Homo sapiens
ctataaaatgcc

SEQ ID NO: 784251 - DNA, 15 bp, Homo sapiens
ctataaaattaaatg

SEQ ID NO: 784252 - DNA, 21 bp, Homo sapiens
ctataaaattaaatgccttgt

SEQ ID NO: 784253 - DNA, 13 bp, Homo sapiens
ctataaagagaag

SEQ ID NO: 784254 - DNA, 17 bp, Homo sapiens
ctataaagtaaagctaa

SEQ ID NO: 784255 - DNA, 14 bp, Homo sapiens
ctataaataaaaac

SEQ ID NO: 784256 - DNA, 18 bp, Homo sapiens
ctataaatggtgtttttt

SEQ ID NO: 784257 - DNA, 23 bp, Homo sapiens
ctataaatggtgtttttttaata

SEQ ID NO: 784258 - DNA, 14 bp, Homo sapiens
ctataaattaagaa

SEQ ID NO: 784259 - DNA, 23 bp, Homo sapiens
ctataaattcctctttgctttgc

SEQ ID NO: 784260 - DNA, 23 bp, Homo sapiens
ctataacagtgtctttctagcca

SEQ ID NO: 784261 - DNA, 14 bp, Homo sapiens
ctataacatgtctt

SEQ ID NO: 784262 - DNA, 14 bp, Homo sapiens
ctataaggtgcctc

SEQ ID NO: 784263 - DNA, 22 bp, Homo sapiens
ctataaggtgctctctttctgt

SEQ ID NO: 784264 - DNA, 20 bp, Homo sapiens
ctataagttgtaccaaaaca

SEQ ID NO: 784265 - DNA, 14 bp, Homo sapiens
ctataagttttaga

SEQ ID NO: 784266 - DNA, 20 bp, Homo sapiens
ctataataagttttgatata

SEQ ID NO: 784267 - DNA, 22 bp, Homo sapiens
ctataataagttttgatataat

SEQ ID NO: 784268 - DNA, 16 bp, Homo sapiens
ctataatatttccttt

SEQ ID NO: 784269 - DNA, 17 bp, Homo sapiens
ctataatatttcctttt

SEQ ID NO: 784270 - DNA, 15 bp, Homo sapiens
ctataatattttatc

SEQ ID NO: 784271 - DNA, 18 bp, Homo sapiens
ctataatcattagtttta

SEQ ID NO: 784272 - DNA, 21 bp, Homo sapiens
ctataatcattagttttagag

SEQ ID NO: 784273 - DNA, 15 bp, Homo sapiens
ctataatctgtcaaa

SEQ ID NO: 784274 - DNA, 21 bp, Homo sapiens
ctataatctgtcaaaacactg

SEQ ID NO: 784275 - DNA, 16 bp, Homo sapiens
ctataatcttatacaa

SEQ ID NO: 784276 - DNA, 20 bp, Homo sapiens
ctataatggaaacatttaca

SEQ ID NO: 784277 - DNA, 22 bp, Homo sapiens
ctataatgtgaaatgtaactgt

SEQ ID NO: 784278 - DNA, 22 bp, Homo sapiens
ctataattccctatcttttagt

SEQ ID NO: 784279 - DNA, 15 bp, Homo sapiens
ctataattttgcctt

SEQ ID NO: 784280 - DNA, 19 bp, Homo sapiens
ctataattttgcctttaac

SEQ ID NO: 784281 - DNA, 15 bp, Homo sapiens
ctatacaactggaca

SEQ ID NO: 784282 - DNA, 13 bp, Homo sapiens
ctatacacacaca

SEQ ID NO: 784283 - DNA, 21 bp, Homo sapiens
ctatacagaacagagggccag

SEQ ID NO: 784284 - DNA, 20 bp, Homo sapiens
ctatacaggacttagaagta

SEQ ID NO: 784285 - DNA, 16 bp, Homo sapiens
ctatacatctctcccc

SEQ ID NO: 784286 - DNA, 20 bp, Homo sapiens
ctataccatatgtctgcttc

SEQ ID NO: 784287 - DNA, 22 bp, Homo sapiens
ctataccatatgtctgcttctg

SEQ ID NO: 784288 - DNA, 13 bp, Homo sapiens
ctatacctgcctt

SEQ ID NO: 784289 - DNA, 18 bp, Homo sapiens
ctatacgtttctgtggag

SEQ ID NO: 784290 - DNA, 19 bp, Homo sapiens
ctatactgcatacttttta

SEQ ID NO: 784291 - DNA, 21 bp, Homo sapiens
ctatactgcatactttttaaa

SEQ ID NO: 784292 - DNA, 14 bp, Homo sapiens
ctatagagaggggg

SEQ ID NO: 784293 - DNA, 16 bp, Homo sapiens
ctatagagcctacctg

SEQ ID NO: 784294 - DNA, 15 bp, Homo sapiens
ctatagatgtctttt

SEQ ID NO: 784295 - DNA, 22 bp, Homo sapiens
ctatagatgtcttttcccattt

SEQ ID NO: 784296 - DNA, 14 bp, Homo sapiens
ctatagcactgagc

SEQ ID NO: 784297 - DNA, 13 bp, Homo sapiens
ctatagccaaaaa

SEQ ID NO: 784298 - DNA, 19 bp, Homo sapiens
ctatagccaaaaatagcta

SEQ ID NO: 784299 - DNA, 12 bp, Homo sapiens
ctatagcctggg

SEQ ID NO: 784300 - DNA, 17 bp, Homo sapiens
ctatagctaagtacaca

SEQ ID NO: 784301 - DNA, 14 bp, Homo sapiens
ctatagctcaggac

SEQ ID NO: 784302 - DNA, 16 bp, Homo sapiens
ctataggctggagaag

SEQ ID NO: 784303 - DNA, 17 bp, Homo sapiens
ctataggctggagaagc

SEQ ID NO: 784304 - DNA, 18 bp, Homo sapiens
ctataggctggagaagct

SEQ ID NO: 784305 - DNA, 14 bp, Homo sapiens
ctataggtccagaa

SEQ ID NO: 784306 - DNA, 12 bp, Homo sapiens
ctatagtatttg

SEQ ID NO: 784307 - DNA, 15 bp, Homo sapiens
ctatagtatttgatt

SEQ ID NO: 784308 - DNA, 18 bp, Homo sapiens
ctatagtggtgagatgga

SEQ ID NO: 784309 - DNA, 18 bp, Homo sapiens
ctatagtgtataccacct

SEQ ID NO: 784310 - DNA, 22 bp, Homo sapiens
ctatagtgtataccacctgtac

SEQ ID NO: 784311 - DNA, 18 bp, Homo sapiens
ctatagttactgtcctgt

SEQ ID NO: 784312 - DNA, 18 bp, Homo sapiens
ctatagtttcaccactcc

SEQ ID NO: 784313 - DNA, 19 bp, Homo sapiens
ctatagtttcaccactcct

SEQ ID NO: 784314 - DNA, 22 bp, Homo sapiens
ctatagtttcaccactcctctc

SEQ ID NO: 784315 - DNA, 21 bp, Homo sapiens
ctatataaaatgtattcaagc

SEQ ID NO: 784316 - DNA, 13 bp, Homo sapiens
ctatataaataag

SEQ ID NO: 784317 - DNA, 15 bp, Homo sapiens
ctatataaataagct

SEQ ID NO: 784318 - DNA, 14 bp, Homo sapiens
ctatataatttatt

SEQ ID NO: 784319 - DNA, 19 bp, Homo sapiens
ctatataccaaagcacatt

SEQ ID NO: 784320 - DNA, 19 bp, Homo sapiens
ctatatagctgatcagttt

SEQ ID NO: 784321 - DNA, 20 bp, Homo sapiens
ctatatagttccttgcctta

SEQ ID NO: 784322 - DNA, 15 bp, Homo sapiens
ctatatataaaacgg

SEQ ID NO: 784323 - DNA, 15 bp, Homo sapiens
ctatatataaatgac

SEQ ID NO: 784324 - DNA, 23 bp, Homo sapiens
ctatatataatttgagtgtatat

SEQ ID NO: 784325 - DNA, 13 bp, Homo sapiens
ctatatatgtgta

SEQ ID NO: 784326 - DNA, 19 bp, Homo sapiens
ctatatcagtagtgtacat

SEQ ID NO: 784327 - DNA, 21 bp, Homo sapiens
ctatatccagttcctgctctc

SEQ ID NO: 784328 - DNA, 20 bp, Homo sapiens
ctatatccatgtactgtagt

SEQ ID NO: 784329 - DNA, 21 bp, Homo sapiens
ctatatccatgtactgtagtt

SEQ ID NO: 784330 - DNA, 18 bp, Homo sapiens
ctatatcgagagtgtgtg

SEQ ID NO: 784331 - DNA, 18 bp, Homo sapiens
ctatatctgtttgtatat

SEQ ID NO: 784332 - DNA, 15 bp, Homo sapiens
ctatatgaaaaacaa

SEQ ID NO: 784333 - DNA, 15 bp, Homo sapiens
ctatatgaatttaaa

SEQ ID NO: 784334 - DNA, 16 bp, Homo sapiens
ctatatgcacccctgg

SEQ ID NO: 784335 - DNA, 21 bp, Homo sapiens
ctatatgcacccctggaacca

SEQ ID NO: 784336 - DNA, 16 bp, Homo sapiens
ctatatggaattgctt

SEQ ID NO: 784337 - DNA, 16 bp, Homo sapiens
ctatatggttctccaa

SEQ ID NO: 784338 - DNA, 16 bp, Homo sapiens
ctatatgtacagctct

SEQ ID NO: 784339 - DNA, 21 bp, Homo sapiens
ctatatgtacttgtcaaagaa

SEQ ID NO: 784340 - DNA, 16 bp, Homo sapiens
ctatatgtccatttaa

SEQ ID NO: 784341 - DNA, 19 bp, Homo sapiens
ctatattaaatgagggttt

SEQ ID NO: 784342 - DNA, 15 bp, Homo sapiens
ctatattagctgaaa

SEQ ID NO: 784343 - DNA, 12 bp, Homo sapiens
ctatattatgtc

SEQ ID NO: 784344 - DNA, 16 bp, Homo sapiens
ctatattatgtcttct

SEQ ID NO: 784345 - DNA, 14 bp, Homo sapiens
ctatattattatat

SEQ ID NO: 784346 - DNA, 15 bp, Homo sapiens
ctatattcctttttc

SEQ ID NO: 784347 - DNA, 18 bp, Homo sapiens
ctatattcctttttctat

SEQ ID NO: 784348 - DNA, 17 bp, Homo sapiens
ctagcactttgggaggc

SEQ ID NO: 784349 - DNA, 17 bp, Homo sapiens
ctagcagaaatctagaa

SEQ ID NO: 784350 - DNA, 12 bp, Homo sapiens
ctagcagacaga

SEQ ID NO: 784351 - DNA, 16 bp, Homo sapiens
ctagcagacagaaact

SEQ ID NO: 784352 - DNA, 21 bp, Homo sapiens
ctagcagacagaaactggatt

SEQ ID NO: 784353 - DNA, 19 bp, Homo sapiens
ctagcagagcaggggcagg

SEQ ID NO: 784354 - DNA, 21 bp, Homo sapiens
ctagcagagtgaggatgtgtt

SEQ ID NO: 784355 - DNA, 22 bp, Homo sapiens
ctagcagcaccgttctgtgcac

SEQ ID NO: 784356 - DNA, 12 bp, Homo sapiens
ctagcagcaggg

SEQ ID NO: 784357 - DNA, 14 bp, Homo sapiens
ctagcagcccttgt

SEQ ID NO: 784358 - DNA, 20 bp, Homo sapiens
ctagcagcccttgtgtgtgc

SEQ ID NO: 784359 - DNA, 14 bp, Homo sapiens
ctagcagctggcct

SEQ ID NO: 784360 - DNA, 22 bp, Homo sapiens
ctagcaggcaatgctgtacttt

SEQ ID NO: 784361 - DNA, 13 bp, Homo sapiens
ctagcaggcagga

SEQ ID NO: 784362 - DNA, 22 bp, Homo sapiens
ctagcaggcctaagacatgtga

SEQ ID NO: 784363 - DNA, 22 bp, Homo sapiens
ctagcagtaaatacttgcagtt

SEQ ID NO: 784364 - DNA, 23 bp, Homo sapiens
ctagcagtaaatacttgcagttg

SEQ ID NO: 784365 - DNA, 22 bp, Homo sapiens
ctagcagtgatgaaaatgaatc

SEQ ID NO: 784366 - DNA, 16 bp, Homo sapiens
ctagcatacgtacaca

SEQ ID NO: 784367 - DNA, 19 bp, Homo sapiens
ctagcatacgtacacattt

SEQ ID NO: 784368 - DNA, 12 bp, Homo sapiens
ctaccctgagct

SEQ ID NO: 784369 - DNA, 17 bp, Homo sapiens
ctaccctgagctgaggc

SEQ ID NO: 784370 - DNA, 13 bp, Homo sapiens
ctaccctgcctcc

SEQ ID NO: 784371 - DNA, 13 bp, Homo sapiens
ctaccctggactt

SEQ ID NO: 784372 - DNA, 19 bp, Homo sapiens
ctaccctgtctgtcccttt

SEQ ID NO: 784373 - DNA, 16 bp, Homo sapiens
ctaccctttttctcca

SEQ ID NO: 784374 - DNA, 18 bp, Homo sapiens
ctaccctttttctccagc

SEQ ID NO: 784375 - DNA, 17 bp, Homo sapiens
ctaccgagtctcttctc

SEQ ID NO: 784376 - DNA, 18 bp, Homo sapiens
ctaccgccctgggctgga

SEQ ID NO: 784377 - DNA, 21 bp, Homo sapiens
ctacctacatgctgaaaaata

SEQ ID NO: 784378 - DNA, 22 bp, Homo sapiens
ctacctacgtttgcaccgcctg

SEQ ID NO: 784379 - DNA, 22 bp, Homo sapiens
ctacctcaagttcttggaccag

SEQ ID NO: 784380 - DNA, 23 bp, Homo sapiens
ctacctcaagttcttggaccagt

SEQ ID NO: 784381 - DNA, 17 bp, Homo sapiens
ctacctcactggggtcc

SEQ ID NO: 784382 - DNA, 12 bp, Homo sapiens
ctacctcagcct

SEQ ID NO: 784383 - DNA, 14 bp, Homo sapiens
ctacctcagcctag

SEQ ID NO: 784384 - DNA, 13 bp, Homo sapiens
ctacctcagcctc

SEQ ID NO: 784385 - DNA, 14 bp, Homo sapiens
ctacctccaccctg

SEQ ID NO: 784386 - DNA, 11 bp, Homo sapiens
ctacctccaga

SEQ ID NO: 784387 - DNA, 15 bp, Homo sapiens
ctacctccctccctc

SEQ ID NO: 784388 - DNA, 17 bp, Homo sapiens
ctacctccctccctctc

SEQ ID NO: 784389 - DNA, 15 bp, Homo sapiens
ctacctccctcctca

SEQ ID NO: 784390 - DNA, 18 bp, Homo sapiens
ctacctccctcctcaggg

SEQ ID NO: 784391 - DNA, 16 bp, Homo sapiens
ctacctcccttgcctt

SEQ ID NO: 784392 - DNA, 17 bp, Homo sapiens
ctacctcttttgagact

SEQ ID NO: 784393 - DNA, 20 bp, Homo sapiens
ctacctgacactcccttggg

SEQ ID NO: 784394 - DNA, 16 bp, Homo sapiens
ctacctgagcattcag

SEQ ID NO: 784395 - DNA, 16 bp, Homo sapiens
ctacctgcagtgggaa

SEQ ID NO: 784396 - DNA, 16 bp, Homo sapiens
ctacctggggactcct

SEQ ID NO: 784397 - DNA, 19 bp, Homo sapiens
ctacctggggactcctcaa

SEQ ID NO: 784398 - DNA, 12 bp, Homo sapiens
ctacctgtgcct

SEQ ID NO: 784399 - DNA, 21 bp, Homo sapiens
ctacctgttcagtgtcccggg

SEQ ID NO: 784400 - DNA, 22 bp, Homo sapiens
ctacctgttcagtgtcccgggc

SEQ ID NO: 784401 - DNA, 23 bp, Homo sapiens
ctaccttgaatagaagttttcct

SEQ ID NO: 784402 - DNA, 20 bp, Homo sapiens
ctaccttgctagctagccag

SEQ ID NO: 784403 - DNA, 17 bp, Homo sapiens
ctaccttgcttttgctt

SEQ ID NO: 784404 - DNA, 21 bp, Homo sapiens
ctaccttggttcccccactga

SEQ ID NO: 784405 - DNA, 20 bp, Homo sapiens
ctacgaaaaataaaaaggaa

SEQ ID NO: 784406 - DNA, 22 bp, Homo sapiens
ctacgccaaagtgcagcccttc

SEQ ID NO: 784407 - DNA, 19 bp, Homo sapiens
ctacgcctcttctgtccct

SEQ ID NO: 784408 - DNA, 15 bp, Homo sapiens
ctacgctgacaatca

SEQ ID NO: 784409 - DNA, 16 bp, Homo sapiens
ctacgctgtccagaaa

SEQ ID NO: 784410 - DNA, 17 bp, Homo sapiens
ctacgtcatgtatttta

SEQ ID NO: 784411 - DNA, 19 bp, Homo sapiens
ctacgtcatgtattttatg

SEQ ID NO: 784412 - DNA, 15 bp, Homo sapiens
ctactaaaaatgcaa

SEQ ID NO: 784413 - DNA, 12 bp, Homo sapiens
ctactaaagtgc

SEQ ID NO: 784414 - DNA, 14 bp, Homo sapiens
ctactaaagtgcct

SEQ ID NO: 784415 - DNA, 14 bp, Homo sapiens
ctactaacaaatgt

SEQ ID NO: 784416 - DNA, 16 bp, Homo sapiens
ctactaacaaatgtaa

SEQ ID NO: 784417 - DNA, 18 bp, Homo sapiens
ctactaacaaatgtaaaa

SEQ ID NO: 784418 - DNA, 18 bp, Homo sapiens
ctactaatagaataaagg

SEQ ID NO: 784419 - DNA, 15 bp, Homo sapiens
ctactaattccacac

SEQ ID NO: 784420 - DNA, 16 bp, Homo sapiens
ctactaccacaaggaa

SEQ ID NO: 784421 - DNA, 20 bp, Homo sapiens
ctactacccattgttccctt

SEQ ID NO: 784422 - DNA, 15 bp, Homo sapiens
ctactacccgagccc

SEQ ID NO: 784423 - DNA, 16 bp, Homo sapiens
ctactacccgagccca

SEQ ID NO: 784424 - DNA, 17 bp, Homo sapiens
ctactacctgtaatgac

SEQ ID NO: 784425 - DNA, 15 bp, Homo sapiens
ctactactctgccaa

SEQ ID NO: 784426 - DNA, 16 bp, Homo sapiens
ctactactctgccaat

SEQ ID NO: 784427 - DNA, 20 bp, Homo sapiens
ctactagagatattcttatt

SEQ ID NO: 784428 - DNA, 17 bp, Homo sapiens
ctactagcaaaataaaa

SEQ ID NO: 784429 - DNA, 20 bp, Homo sapiens
ctactagcaaaataaaacat

SEQ ID NO: 784430 - DNA, 14 bp, Homo sapiens
ctactataaagaga

SEQ ID NO: 784431 - DNA, 18 bp, Homo sapiens
ctactatgccagatgcct

SEQ ID NO: 784432 - DNA, 16 bp, Homo sapiens
ctactatgcttcagga

SEQ ID NO: 784433 - DNA, 13 bp, Homo sapiens
ctactatgtgctg

SEQ ID NO: 784434 - DNA, 16 bp, Homo sapiens
ctactcaagaggctga

SEQ ID NO: 784435 - DNA, 20 bp, Homo sapiens
ctactcaagaggctgaggca

SEQ ID NO: 784436 - DNA, 17 bp, Homo sapiens
ctactcaagcgggtggc

SEQ ID NO: 784437 - DNA, 21 bp, Homo sapiens
ctactcaagcgggtggctctg

SEQ ID NO: 784438 - DNA, 16 bp, Homo sapiens
ctactcagaagcctga

SEQ ID NO: 784439 - DNA, 17 bp, Homo sapiens
ctactcagcagccctcc

SEQ ID NO: 784440 - DNA, 22 bp, Homo sapiens
ctactcagcagccctcctcacc

SEQ ID NO: 784441 - DNA, 15 bp, Homo sapiens
ctactcagcatttga

SEQ ID NO: 784442 - DNA, 13 bp, Homo sapiens
ctactcaggaggc

SEQ ID NO: 784443 - DNA, 20 bp, Homo sapiens
ctactcaggaggctgaggca

SEQ ID NO: 784444 - DNA, 23 bp, Homo sapiens
ctactcaggaggctgaggcagaa

SEQ ID NO: 784445 - DNA, 20 bp, Homo sapiens
ctactcatacttaagcaaaa

SEQ ID NO: 784446 - DNA, 12 bp, Homo sapiens
ctactccactgc

SEQ ID NO: 784447 - DNA, 20 bp, Homo sapiens
ctactccactgccctggcag

SEQ ID NO: 784448 - DNA, 14 bp, Homo sapiens
ctactcccctgggc

SEQ ID NO: 784449 - DNA, 11 bp, Homo sapiens
ctactccctct

SEQ ID NO: 784450 - DNA, 18 bp, Homo sapiens
ctactccctcttcactgt

SEQ ID NO: 784451 - DNA, 15 bp, Homo sapiens
ctactccctcttcca

SEQ ID NO: 784452 - DNA, 18 bp, Homo sapiens
ctactccctgcagatgcc

SEQ ID NO: 784453 - DNA, 15 bp, Homo sapiens
ctactcctacctcag

SEQ ID NO: 784454 - DNA, 16 bp, Homo sapiens
ctactcctacctcagc

SEQ ID NO: 784455 - DNA, 15 bp, Homo sapiens
ctactcctagaagaa

SEQ ID NO: 784456 - DNA, 15 bp, Homo sapiens
ctactcctctgcagt

SEQ ID NO: 784457 - DNA, 20 bp, Homo sapiens
ctactcctctgcagtgcctt

SEQ ID NO: 784458 - DNA, 14 bp, Homo sapiens
ctactcctgggtca

SEQ ID NO: 784459 - DNA, 13 bp, Homo sapiens
ctactcctgtgct

SEQ ID NO: 784460 - DNA, 14 bp, Homo sapiens
ctactcctgtgctc

SEQ ID NO: 784461 - DNA, 14 bp, Homo sapiens
ctactcctttggaa

SEQ ID NO: 784462 - DNA, 19 bp, Homo sapiens
ctactcgatagcctgaggt

SEQ ID NO: 784463 - DNA, 17 bp, Homo sapiens
ctactcgggaggctgag

SEQ ID NO: 784464 - DNA, 17 bp, Homo sapiens
ctactctaaagaaaaat

SEQ ID NO: 784465 - DNA, 21 bp, Homo sapiens
ctactctaaagaaaaatgcct

SEQ ID NO: 784466 - DNA, 22 bp, Homo sapiens
ctactctagttctgttgttttg

SEQ ID NO: 784467 - DNA, 22 bp, Homo sapiens
ctactctcaggatcaagaaagt

SEQ ID NO: 784468 - DNA, 20 bp, Homo sapiens
ctactctccccacgagggct

SEQ ID NO: 784469 - DNA, 17 bp, Homo sapiens
ctactctcttgccagca

SEQ ID NO: 784470 - DNA, 18 bp, Homo sapiens
ctactctcttgccagcat

SEQ ID NO: 784471 - DNA, 23 bp, Homo sapiens
ctactctcttgccagcattttca

SEQ ID NO: 784472 - DNA, 12 bp, Homo sapiens
ctactctgccaa

SEQ ID NO: 784473 - DNA, 21 bp, Homo sapiens
ctactctggaatgtttttccc

SEQ ID NO: 784474 - DNA, 14 bp, Homo sapiens
ctactctgtccagg

SEQ ID NO: 784475 - DNA, 16 bp, Homo sapiens
ctactctgttccttca

SEQ ID NO: 784476 - DNA, 22 bp, Homo sapiens
ctactctgttccttcacatcct

SEQ ID NO: 784477 - DNA, 17 bp, Homo sapiens
ctactcttacagagcct

SEQ ID NO: 784478 - DNA, 20 bp, Homo sapiens
ctactcttacagagccttga

SEQ ID NO: 784479 - DNA, 13 bp, Homo sapiens
ctactcttcctgt

SEQ ID NO: 784480 - DNA, 14 bp, Homo sapiens
ctactcttcctgtc

SEQ ID NO: 784481 - DNA, 16 bp, Homo sapiens
ctcaaagagattcgaa

SEQ ID NO: 784482 - DNA, 19 bp, Homo sapiens
ctcaaagagggggctctgc

SEQ ID NO: 784483 - DNA, 13 bp, Homo sapiens
ctcaaagatgcat

SEQ ID NO: 784484 - DNA, 15 bp, Homo sapiens
ctcaaagcaacccgc

SEQ ID NO: 784485 - DNA, 20 bp, Homo sapiens
ctcaaagcaacccgctggag

SEQ ID NO: 784486 - DNA, 15 bp, Homo sapiens
ctcaaagcacaatgt

SEQ ID NO: 784487 - DNA, 14 bp, Homo sapiens
ctcaaaggagaaaa

SEQ ID NO: 784488 - DNA, 15 bp, Homo sapiens
ctcaaaggagaaaaa

SEQ ID NO: 784489 - DNA, 23 bp, Homo sapiens
ctcaaaggagaaaaaaaaccttg

SEQ ID NO: 784490 - DNA, 18 bp, Homo sapiens
ctcaaaggagctttctca

SEQ ID NO: 784491 - DNA, 23 bp, Homo sapiens
ctcaaagtgactattcagttttc

SEQ ID NO: 784492 - DNA, 20 bp, Homo sapiens
ctcaaataggctattaaaaa

SEQ ID NO: 784493 - DNA, 20 bp, Homo sapiens
ctcaaataggtcatcatgaa

SEQ ID NO: 784494 - DNA, 22 bp, Homo sapiens
ctcaaatctattcagacaagca

SEQ ID NO: 784495 - DNA, 16 bp, Homo sapiens
ctcaaatgagtaacat

SEQ ID NO: 784496 - DNA, 22 bp, Homo sapiens
ctcaaatggtgtcatggctgaa

SEQ ID NO: 784497 - DNA, 13 bp, Homo sapiens
ctcaaattttttg

SEQ ID NO: 784498 - DNA, 19 bp, Homo sapiens
ctcaacaaagcacagtgtt

SEQ ID NO: 784499 - DNA, 17 bp, Homo sapiens
ctcaacaccctgcttct

SEQ ID NO: 784500 - DNA, 19 bp, Homo sapiens
ctcaacaccctgcttctcc

SEQ ID NO: 784501 - DNA, 21 bp, Homo sapiens
ctcaacacctctgcacaagct

SEQ ID NO: 784502 - DNA, 17 bp, Homo sapiens
ctcaacatgtgtttctg

SEQ ID NO: 784503 - DNA, 20 bp, Homo sapiens
ctcaacatgtgtttctgaca

SEQ ID NO: 784504 - DNA, 19 bp, Homo sapiens
ctcaacccccatttctatt

SEQ ID NO: 784505 - DNA, 22 bp, Homo sapiens
ctcaacccccatttctatttat

SEQ ID NO: 784506 - DNA, 14 bp, Homo sapiens
ctcaacccccctcc

SEQ ID NO: 784507 - DNA, 16 bp, Homo sapiens
ctcaacccccctccca

SEQ ID NO: 784508 - DNA, 17 bp, Homo sapiens
ctcaacccccctcccag

SEQ ID NO: 784509 - DNA, 18 bp, Homo sapiens
ctcaaccctccctcagcc

SEQ ID NO: 784510 - DNA, 21 bp, Homo sapiens
ctcaaccctccctcagcccct

SEQ ID NO: 784511 - DNA, 23 bp, Homo sapiens
ctcaacctaccaccccttcctgt

SEQ ID NO: 784512 - DNA, 13 bp, Homo sapiens
ctcaacctcacca

SEQ ID NO: 784513 - DNA, 14 bp, Homo sapiens
ctcaacctcctggg

SEQ ID NO: 784514 - DNA, 17 bp, Homo sapiens
ctcaacctcctgggttc

SEQ ID NO: 784515 - DNA, 21 bp, Homo sapiens
ctcaacctgtgatgaggggag

SEQ ID NO: 784516 - DNA, 23 bp, Homo sapiens
ctattccctaactctcgggacct

SEQ ID NO: 784517 - DNA, 13 bp, Homo sapiens
ctattcctgagag

SEQ ID NO: 784518 - DNA, 15 bp, Homo sapiens
ctattctagcctgca

SEQ ID NO: 784519 - DNA, 23 bp, Homo sapiens
ctattctagcctgcattgagctt

SEQ ID NO: 784520 - DNA, 14 bp, Homo sapiens
ctattctcctgcca

SEQ ID NO: 784521 - DNA, 13 bp, Homo sapiens
ctattctgagcct

SEQ ID NO: 784522 - DNA, 12 bp, Homo sapiens
ctattctgtcag

SEQ ID NO: 784523 - DNA, 21 bp, Homo sapiens
ctattcttggaccatgccaga

SEQ ID NO: 784524 - DNA, 22 bp, Homo sapiens
ctattcttggaccatgccagat

SEQ ID NO: 784525 - DNA, 18 bp, Homo sapiens
ctattcttggttcttatt

SEQ ID NO: 784526 - DNA, 15 bp, Homo sapiens
ctattgaactgtatt

SEQ ID NO: 784527 - DNA, 16 bp, Homo sapiens
ctattgacaagtcatt

SEQ ID NO: 784528 - DNA, 12 bp, Homo sapiens
ctattgacaata

SEQ ID NO: 784529 - DNA, 17 bp, Homo sapiens
ctattgacaataaaata

SEQ ID NO: 784530 - DNA, 14 bp, Homo sapiens
ctattgagccttgc

SEQ ID NO: 784531 - DNA, 17 bp, Homo sapiens
ctattgatgtacagtct

SEQ ID NO: 784532 - DNA, 20 bp, Homo sapiens
ctattgatgtacagtctgtc

SEQ ID NO: 784533 - DNA, 21 bp, Homo sapiens
ctattgatgtacagtctgtca

SEQ ID NO: 784534 - DNA, 22 bp, Homo sapiens
ctattgcaaaggttccaactgt

SEQ ID NO: 784535 - DNA, 19 bp, Homo sapiens
ctattgcagagactcattt

SEQ ID NO: 784536 - DNA, 15 bp, Homo sapiens
ctattgccaaccagt

SEQ ID NO: 784537 - DNA, 17 bp, Homo sapiens
ctattgcgctctcaaga

SEQ ID NO: 784538 - DNA, 14 bp, Homo sapiens
ctattgctgtctgg

SEQ ID NO: 784539 - DNA, 16 bp, Homo sapiens
ctattgctgtctggtg

SEQ ID NO: 784540 - DNA, 17 bp, Homo sapiens
ctattgctgtctggtga

SEQ ID NO: 784541 - DNA, 23 bp, Homo sapiens
ctattgctgtctggtgaggtggc

SEQ ID NO: 784542 - DNA, 14 bp, Homo sapiens
ctattgcttcacca

SEQ ID NO: 784543 - DNA, 21 bp, Homo sapiens
ctattggccaacaatcctttc

SEQ ID NO: 784544 - DNA, 23 bp, Homo sapiens
ctattggccaacaatcctttctg

SEQ ID NO: 784545 - DNA, 19 bp, Homo sapiens
ctattggtgcttgactctc

SEQ ID NO: 784546 - DNA, 13 bp, Homo sapiens
ctattgtaaatat

SEQ ID NO: 784547 - DNA, 18 bp, Homo sapiens
ctattgtaaggtctttgt

SEQ ID NO: 784548 - DNA, 19 bp, Homo sapiens
ctattgtaaggtctttgta

SEQ ID NO: 784549 - DNA, 17 bp, Homo sapiens
ctcaactcacctaatgt

SEQ ID NO: 784550 - DNA, 20 bp, Homo sapiens
ctcaactcgggggcgcctgg

SEQ ID NO: 784551 - DNA, 21 bp, Homo sapiens
ctcaactcgggggcgcctgga

SEQ ID NO: 784552 - DNA, 17 bp, Homo sapiens
ctcaactctacccctgc

SEQ ID NO: 784553 - DNA, 17 bp, Homo sapiens
ctcaactctgagcccat

SEQ ID NO: 784554 - DNA, 18 bp, Homo sapiens
ctcaactctgagcccata

SEQ ID NO: 784555 - DNA, 23 bp, Homo sapiens
ctcaactgaaggggtgcacccac

SEQ ID NO: 784556 - DNA, 13 bp, Homo sapiens
ctcaactgcctac

SEQ ID NO: 784557 - DNA, 22 bp, Homo sapiens
ctcaagaaagccctcattttta

SEQ ID NO: 784558 - DNA, 16 bp, Homo sapiens
ctcaagaaaggcccgg

SEQ ID NO: 784559 - DNA, 20 bp, Homo sapiens
ctcaagaagacatggagact

SEQ ID NO: 784560 - DNA, 21 bp, Homo sapiens
ctcaagaagacatggagactc

SEQ ID NO: 784561 - DNA, 15 bp, Homo sapiens
ctcaagaatctagaa

SEQ ID NO: 784562 - DNA, 15 bp, Homo sapiens
ctcaagacaaggctg

SEQ ID NO: 784563 - DNA, 16 bp, Homo sapiens
ctcaagaccagagacc

SEQ ID NO: 784564 - DNA, 21 bp, Homo sapiens
ctcaagactttagcttttcct

SEQ ID NO: 784565 - DNA, 22 bp, Homo sapiens
ctcaagactttgatccttggaa

SEQ ID NO: 784566 - DNA, 16 bp, Homo sapiens
ctcaagaggaatctgt

SEQ ID NO: 784567 - DNA, 18 bp, Homo sapiens
ctcaagaggaatctgttt

SEQ ID NO: 784568 - DNA, 20 bp, Homo sapiens
ctcaagaggaatctgtttct

SEQ ID NO: 784569 - DNA, 17 bp, Homo sapiens
ctcaagaggcagagttc

SEQ ID NO: 784570 - DNA, 19 bp, Homo sapiens
ctcaagagggcactggtgg

SEQ ID NO: 784571 - DNA, 16 bp, Homo sapiens
ctcaagattctacttg

SEQ ID NO: 784572 - DNA, 16 bp, Homo sapiens
ctcaagcaatcctcct

SEQ ID NO: 784573 - DNA, 23 bp, Homo sapiens
ctcaagcaatcctcctgcctcag

SEQ ID NO: 784574 - DNA, 22 bp, Homo sapiens
ctcaagcagcgaccgccccctc

SEQ ID NO: 784575 - DNA, 21 bp, Homo sapiens
ctcaagccagccccctccagc

SEQ ID NO: 784576 - DNA, 23 bp, Homo sapiens
ctcaagccagccccctccagctc

SEQ ID NO: 784577 - DNA, 17 bp, Homo sapiens
ctcaagcccgcggggac

SEQ ID NO: 784578 - DNA, 11 bp, Homo sapiens
ctcaagcctgt

SEQ ID NO: 784579 - DNA, 14 bp, Homo sapiens
ctcaagcctgtggg

SEQ ID NO: 784580 - DNA, 20 bp, Homo sapiens
ctcaagcctgtgggcagcat

SEQ ID NO: 784581 - DNA, 20 bp, Homo sapiens
ctcaagcgggtggctctggg

SEQ ID NO: 784582 - DNA, 18 bp, Homo sapiens
ctcaagctaagtaaaaat

SEQ ID NO: 784583 - DNA, 20 bp, Homo sapiens
ctcaagctagtgtttctagc

SEQ ID NO: 784584 - DNA, 15 bp, Homo sapiens
ctcaaggacaggagc

SEQ ID NO: 784585 - DNA, 20 bp, Homo sapiens
ctcaaggacttgaaagcatc

SEQ ID NO: 784586 - DNA, 16 bp, Homo sapiens
ctcaaggactttgcag

SEQ ID NO: 784587 - DNA, 14 bp, Homo sapiens
ctcaaggattgatt

SEQ ID NO: 784588 - DNA, 20 bp, Homo sapiens
ctcaaggccaccttggagga

SEQ ID NO: 784589 - DNA, 21 bp, Homo sapiens
ctcaaggccaccttggaggag

SEQ ID NO: 784590 - DNA, 14 bp, Homo sapiens
ctcaaggctgtgca

SEQ ID NO: 784591 - DNA, 16 bp, Homo sapiens
ctcaaggctgtgcagg

SEQ ID NO: 784592 - DNA, 15 bp, Homo sapiens
ctcaagggacaggga

SEQ ID NO: 784593 - DNA, 14 bp, Homo sapiens
ctcaaggggcaggg

SEQ ID NO: 784594 - DNA, 14 bp, Homo sapiens
ctcaaggggctgga

SEQ ID NO: 784595 - DNA, 15 bp, Homo sapiens
ctcaaggggctggaa

SEQ ID NO: 784596 - DNA, 14 bp, Homo sapiens
ctcaagggtggcag

SEQ ID NO: 784597 - DNA, 23 bp, Homo sapiens
ctcaagggtggcaggtcactgtc

SEQ ID NO: 784598 - DNA, 20 bp, Homo sapiens
ctcaaggtcatcaaacattt

SEQ ID NO: 784599 - DNA, 19 bp, Homo sapiens
ctcaagtagaaaagcagtc

SEQ ID NO: 784600 - DNA, 18 bp, Homo sapiens
ctcaagtcttccctgatc

SEQ ID NO: 784601 - DNA, 20 bp, Homo sapiens
ctcaagtgttaaattatttt

SEQ ID NO: 784602 - DNA, 14 bp, Homo sapiens
ctcaataaagtaca

SEQ ID NO: 784603 - DNA, 15 bp, Homo sapiens
ctcaataaattgcaa

SEQ ID NO: 784604 - DNA, 15 bp, Homo sapiens
ctcaatcaagaaaat

SEQ ID NO: 784605 - DNA, 23 bp, Homo sapiens
ctcaatcactgctcccccgtgtg

SEQ ID NO: 784606 - DNA, 20 bp, Homo sapiens
ctcaatcagtgcagtgatac

SEQ ID NO: 784607 - DNA, 15 bp, Homo sapiens
ctcaatccctgagga

SEQ ID NO: 784608 - DNA, 14 bp, Homo sapiens
ctcaatctaaggcc

SEQ ID NO: 784609 - DNA, 16 bp, Homo sapiens
ctcaatctccagggct

SEQ ID NO: 784610 - DNA, 19 bp, Homo sapiens
ctcaatctccagggctcca

SEQ ID NO: 784611 - DNA, 22 bp, Homo sapiens
ctcaatgaaaaatagtgtcttt

SEQ ID NO: 784612 - DNA, 16 bp, Homo sapiens
ctcaatgaagccagct

SEQ ID NO: 784613 - DNA, 12 bp, Homo sapiens
ctcaatgagctc

SEQ ID NO: 784614 - DNA, 17 bp, Homo sapiens
ctcaatgccctgccatt

SEQ ID NO: 784615 - DNA, 18 bp, Homo sapiens
ctcaatgcctggagacag

SEQ ID NO: 784616 - DNA, 20 bp, Homo sapiens
ctcaatggaggtttgcaaag

SEQ ID NO: 784617 - DNA, 22 bp, Homo sapiens
ctcaatggcctaaaactggcct

SEQ ID NO: 784618 - DNA, 14 bp, Homo sapiens
ctcaatggcctttt

SEQ ID NO: 784619 - DNA, 14 bp, Homo sapiens
ctcaatgtcttccc

SEQ ID NO: 784620 - DNA, 16 bp, Homo sapiens
ctcaatgtcttcccac

SEQ ID NO: 784621 - DNA, 18 bp, Homo sapiens
ctcaatgtgaccaggggt

SEQ ID NO: 784622 - DNA, 18 bp, Homo sapiens
ctcaatgtttgtaataat

SEQ ID NO: 784623 - DNA, 17 bp, Homo sapiens
ctcaattcaacaatgtg

SEQ ID NO: 784624 - DNA, 23 bp, Homo sapiens
ctcaattttatccctcacctgta

SEQ ID NO: 784625 - DNA, 23 bp, Homo sapiens
ctcaattttatgtattctttctg

SEQ ID NO: 784626 - DNA, 12 bp, Homo sapiens
ctcaatttttgg

SEQ ID NO: 784627 - DNA, 23 bp, Homo sapiens
ctcaatttttgtttttgagtact

SEQ ID NO: 784628 - DNA, 19 bp, Homo sapiens
ctcacaaaaaggcaaatat

SEQ ID NO: 784629 - DNA, 22 bp, Homo sapiens
ctcacaaaaaggcaaatattga

SEQ ID NO: 784630 - DNA, 17 bp, Homo sapiens
ctcacaaaatcacttta

SEQ ID NO: 784631 - DNA, 20 bp, Homo sapiens
ctcacaacctgaacctagga

SEQ ID NO: 784632 - DNA, 17 bp, Homo sapiens
ctcacaagaagaccaga

SEQ ID NO: 784633 - DNA, 19 bp, Homo sapiens
ctcacaagaagaccagact

SEQ ID NO: 784634 - DNA, 17 bp, Homo sapiens
ctcacaagcctcttctg

SEQ ID NO: 784635 - DNA, 14 bp, Homo sapiens
ctcacaatttaaaa

SEQ ID NO: 784636 - DNA, 13 bp, Homo sapiens
ctcacacacacag

SEQ ID NO: 784637 - DNA, 19 bp, Homo sapiens
ctcacacacacagctgggc

SEQ ID NO: 784638 - DNA, 20 bp, Homo sapiens
ctcacacacacagctgggca

SEQ ID NO: 784639 - DNA, 16 bp, Homo sapiens
ctcacacaccctgagg

SEQ ID NO: 784640 - DNA, 13 bp, Homo sapiens
ctcacacaggacc

SEQ ID NO: 784641 - DNA, 12 bp, Homo sapiens
ctcacacccacc

SEQ ID NO: 784642 - DNA, 13 bp, Homo sapiens
ctcacacccaccg

SEQ ID NO: 784643 - DNA, 22 bp, Homo sapiens
ctcacacccaccgtccgccctg

SEQ ID NO: 784644 - DNA, 12 bp, Homo sapiens
ctcacacccctg

SEQ ID NO: 784645 - DNA, 19 bp, Homo sapiens
ctcacacccctgtcccacc

SEQ ID NO: 784646 - DNA, 19 bp, Homo sapiens
ctcacaccgcgtctggtga

SEQ ID NO: 784647 - DNA, 21 bp, Homo sapiens
ctcacaccgcgtctggtgaca

SEQ ID NO: 784648 - DNA, 14 bp, Homo sapiens
ctcacacctgggcc

SEQ ID NO: 784649 - DNA, 18 bp, Homo sapiens
ctcacactcccctagggg

SEQ ID NO: 784650 - DNA, 14 bp, Homo sapiens
ctcacactcctggg

SEQ ID NO: 784651 - DNA, 12 bp, Homo sapiens
ctcacactctct

SEQ ID NO: 784652 - DNA, 15 bp, Homo sapiens
ctcacactctctgca

SEQ ID NO: 784653 - DNA, 21 bp, Homo sapiens
ctcacactctctgcagcccag

SEQ ID NO: 784654 - DNA, 13 bp, Homo sapiens
ctcacactgctgt

SEQ ID NO: 784655 - DNA, 15 bp, Homo sapiens
ctcacactgctgtcc

SEQ ID NO: 784656 - DNA, 22 bp, Homo sapiens
ctcacagacctggagcccctgg

SEQ ID NO: 784657 - DNA, 20 bp, Homo sapiens
ctcacagatgtgactgtata

SEQ ID NO: 784658 - DNA, 14 bp, Homo sapiens
ctcacagcagtgag

SEQ ID NO: 784659 - DNA, 12 bp, Homo sapiens
ctcacaggctga

SEQ ID NO: 784660 - DNA, 15 bp, Homo sapiens
ctcacagggatgctg

SEQ ID NO: 784661 - DNA, 12 bp, Homo sapiens
ctcacagggcag

SEQ ID NO: 784662 - DNA, 17 bp, Homo sapiens
ctcacagggcaggcctt

SEQ ID NO: 784663 - DNA, 19 bp, Homo sapiens
ctcacagggcaggccttgc

SEQ ID NO: 784664 - DNA, 13 bp, Homo sapiens
ctcacagttcctc

SEQ ID NO: 784665 - DNA, 19 bp, Homo sapiens
ctcacagttcctcgccctg

SEQ ID NO: 784666 - DNA, 20 bp, Homo sapiens
ctcacagttcctcgccctgg

SEQ ID NO: 784667 - DNA, 14 bp, Homo sapiens
ctcacatcctcctg

SEQ ID NO: 784668 - DNA, 15 bp, Homo sapiens
ctcacatcctcctgc

SEQ ID NO: 784669 - DNA, 19 bp, Homo sapiens
ctcacatcctcctgcccag

SEQ ID NO: 784670 - DNA, 20 bp, Homo sapiens
ctcacatcctcctgcccagc

SEQ ID NO: 784671 - DNA, 12 bp, Homo sapiens
ctcacatgggac

SEQ ID NO: 784672 - DNA, 16 bp, Homo sapiens
ctcacattacacacac

SEQ ID NO: 784673 - DNA, 12 bp, Homo sapiens
ctcacatttatg

SEQ ID NO: 784674 - DNA, 17 bp, Homo sapiens
ctcaccacaagctgagc

SEQ ID NO: 784675 - DNA, 19 bp, Homo sapiens
ctcaccacaagctgagcag

SEQ ID NO: 784676 - DNA, 12 bp, Homo sapiens
ctcaccaccccc

SEQ ID NO: 784677 - DNA, 17 bp, Homo sapiens
ctcaccactaccagcca

SEQ ID NO: 784678 - DNA, 19 bp, Homo sapiens
ctcaccactaccagccagc

SEQ ID NO: 784679 - DNA, 20 bp, Homo sapiens
ctcaccactaccagccagcc

SEQ ID NO: 784680 - DNA, 17 bp, Homo sapiens
ctcaccactgccccctg

SEQ ID NO: 784681 - DNA, 13 bp, Homo sapiens
ctcaccagcccca

SEQ ID NO: 784682 - DNA, 16 bp, Homo sapiens
ctcaccagccccactg

SEQ ID NO: 784683 - DNA, 17 bp, Homo sapiens
ctcaccagccccactgc

SEQ ID NO: 784684 - DNA, 23 bp, Homo sapiens
ctcaccagccccactgccagcag

SEQ ID NO: 784685 - DNA, 20 bp, Homo sapiens
ctcaccagccctagctgtcc

SEQ ID NO: 784686 - DNA, 17 bp, Homo sapiens
ctcaccagccctgcagc

SEQ ID NO: 784687 - DNA, 16 bp, Homo sapiens
ctcaccaggcccacga

SEQ ID NO: 784688 - DNA, 18 bp, Homo sapiens
ctcaccaggcccacgagg

SEQ ID NO: 784689 - DNA, 10 bp, Homo sapiens
ctcaccaggg

SEQ ID NO: 784690 - DNA, 22 bp, Homo sapiens
ctcaccagggtccgcaccagct

SEQ ID NO: 784691 - DNA, 15 bp, Homo sapiens
ctcaccagtggcctt

SEQ ID NO: 784692 - DNA, 19 bp, Homo sapiens
ctcaccagtggcctttcag

SEQ ID NO: 784693 - DNA, 24 bp, Homo sapiens
ctcaccagtgtcccctccactgtc

SEQ ID NO: 784694 - DNA, 16 bp, Homo sapiens
ctcacccaccagctcc

SEQ ID NO: 784695 - DNA, 20 bp, Homo sapiens
ctcacccaccagctccacac

SEQ ID NO: 784696 - DNA, 22 bp, Homo sapiens
ctcacccaccagctccacacat

SEQ ID NO: 784697 - DNA, 15 bp, Homo sapiens
ctcacccaccatgga

SEQ ID NO: 784698 - DNA, 16 bp, Homo sapiens
ctcacccactctggtg

SEQ ID NO: 784699 - DNA, 14 bp, Homo sapiens
ctcacccagatcag

SEQ ID NO: 784700 - DNA, 19 bp, Homo sapiens
ctcaccccaatccctgcca

SEQ ID NO: 784701 - DNA, 17 bp, Homo sapiens
ctcaccccacttcccat

SEQ ID NO: 784702 - DNA, 15 bp, Homo sapiens
ctcaccccagcctca

SEQ ID NO: 784703 - DNA, 19 bp, Homo sapiens
ctcacccccagctttgcta

SEQ ID NO: 784704 - DNA, 21 bp, Homo sapiens
ctcacccccgacggtgtggct

SEQ ID NO: 784705 - DNA, 15 bp, Homo sapiens
ctcaccccctcccac

SEQ ID NO: 784706 - DNA, 21 bp, Homo sapiens
ctcaccccctcccacccccag

SEQ ID NO: 784707 - DNA, 15 bp, Homo sapiens
ctcacccccttctcc

SEQ ID NO: 784708 - DNA, 16 bp, Homo sapiens
ctcacccccttctcca

SEQ ID NO: 784709 - DNA, 17 bp, Homo sapiens
ctcacccccttctccat

SEQ ID NO: 784710 - DNA, 20 bp, Homo sapiens
ctcacccccttctccatcca

SEQ ID NO: 784711 - DNA, 12 bp, Homo sapiens
ctcacccctggg

SEQ ID NO: 784712 - DNA, 14 bp, Homo sapiens
ctcacccctgggca

SEQ ID NO: 784713 - DNA, 17 bp, Homo sapiens
ctcacccctgggcaggc

SEQ ID NO: 784714 - DNA, 14 bp, Homo sapiens
ctcacccctgtagg

SEQ ID NO: 784715 - DNA, 19 bp, Homo sapiens
ctcaccctgagccccttcc

SEQ ID NO: 784716 - DNA, 20 bp, Homo sapiens
ctcaccctgagccccttcct

SEQ ID NO: 784717 - DNA, 15 bp, Homo sapiens
ctcaccctgcccgct

SEQ ID NO: 784718 - DNA, 19 bp, Homo sapiens
ctcaccctgcccgctccca

SEQ ID NO: 784719 - DNA, 14 bp, Homo sapiens
ctcaccctgcctta

SEQ ID NO: 784720 - DNA, 15 bp, Homo sapiens
ctcaccctgccttat

SEQ ID NO: 784721 - DNA, 13 bp, Homo sapiens
ctcaccctgggag

SEQ ID NO: 784722 - DNA, 15 bp, Homo sapiens
ctcaccctgggagcc

SEQ ID NO: 784723 - DNA, 13 bp, Homo sapiens
ctcaccctgtggg

SEQ ID NO: 784724 - DNA, 23 bp, Homo sapiens
ctcaccctgtgggaccgcctggc

SEQ ID NO: 784725 - DNA, 20 bp, Homo sapiens
ctcacccttcctggcccagg

SEQ ID NO: 784726 - DNA, 14 bp, Homo sapiens
ctcaccgctggccc

SEQ ID NO: 784727 - DNA, 16 bp, Homo sapiens
ctcaccgctggccctt

SEQ ID NO: 784728 - DNA, 13 bp, Homo sapiens
ctcacctagagcc

SEQ ID NO: 784729 - DNA, 15 bp, Homo sapiens
ctcacctagagccag

SEQ ID NO: 784730 - DNA, 18 bp, Homo sapiens
ctcacctagagccagacc

SEQ ID NO: 784731 - DNA, 15 bp, Homo sapiens
ctcacctagcctgat

SEQ ID NO: 784732 - DNA, 23 bp, Homo sapiens
ctcacctcatgcccaccccctgc

SEQ ID NO: 784733 - DNA, 18 bp, Homo sapiens
ctcacctctacccaaacc

SEQ ID NO: 784734 - DNA, 14 bp, Homo sapiens
ctcacctctgagga

SEQ ID NO: 784735 - DNA, 13 bp, Homo sapiens
ctcacctctgcct

SEQ ID NO: 784736 - DNA, 16 bp, Homo sapiens
ctcacctctgcctcaa

SEQ ID NO: 784737 - DNA, 18 bp, Homo sapiens
ctcacctctgcctcaatg

SEQ ID NO: 784738 - DNA, 15 bp, Homo sapiens
ctcacctctggactg

SEQ ID NO: 784739 - DNA, 20 bp, Homo sapiens
ctcacctctttgttcttcct

SEQ ID NO: 784740 - DNA, 20 bp, Homo sapiens
ctcacctgcactaacagagt

SEQ ID NO: 784741 - DNA, 16 bp, Homo sapiens
ctcacctgcagagaaa

SEQ ID NO: 784742 - DNA, 14 bp, Homo sapiens
ctcacctgcccctc

SEQ ID NO: 784743 - DNA, 17 bp, Homo sapiens
ctcacctgcccctctgt

SEQ ID NO: 784744 - DNA, 20 bp, Homo sapiens
ctcacctgggcacctgggga

SEQ ID NO: 784745 - DNA, 14 bp, Homo sapiens
ctcacctgggcctt

SEQ ID NO: 784746 - DNA, 13 bp, Homo sapiens
ctcacctggttga

SEQ ID NO: 784747 - DNA, 14 bp, Homo sapiens
ctcacctgtactct

SEQ ID NO: 784748 - DNA, 22 bp, Homo sapiens
ctcacctgtctaggtctcctca

SEQ ID NO: 784749 - DNA, 15 bp, Homo sapiens
ctcaccttcctgtgg

SEQ ID NO: 784750 - DNA, 14 bp, Homo sapiens
ctcacctttgtttt

SEQ ID NO: 784751 - DNA, 19 bp, Homo sapiens
ctcacgcctgtaatcccag

SEQ ID NO: 784752 - DNA, 21 bp, Homo sapiens
ctcacgcctgtaatcccagca

SEQ ID NO: 784753 - DNA, 23 bp, Homo sapiens
ctcacgcctgtaatcccagcagt

SEQ ID NO: 784754 - DNA, 14 bp, Homo sapiens
ctcacgccttggcc

SEQ ID NO: 784755 - DNA, 17 bp, Homo sapiens
ctcacgcgttctgggag

SEQ ID NO: 784756 - DNA, 18 bp, Homo sapiens
ctcacgctcccccgcagt

SEQ ID NO: 784757 - DNA, 14 bp, Homo sapiens
ctcagaattatttt

SEQ ID NO: 784758 - DNA, 20 bp, Homo sapiens
ctcagacatgttttccgtga

SEQ ID NO: 784759 - DNA, 21 bp, Homo sapiens
ctcagacccaacagcaaagga

SEQ ID NO: 784760 - DNA, 16 bp, Homo sapiens
ctcagacccccactct

SEQ ID NO: 784761 - DNA, 15 bp, Homo sapiens
ctcagaccctttctt

SEQ ID NO: 784762 - DNA, 22 bp, Homo sapiens
ctcagacgttgcctgagaagaa

SEQ ID NO: 784763 - DNA, 19 bp, Homo sapiens
ctcagactgggaacagggc

SEQ ID NO: 784764 - DNA, 21 bp, Homo sapiens
ctcagagaaaaatgctcccca

SEQ ID NO: 784765 - DNA, 23 bp, Homo sapiens
ctcagagaccagcactcagcctc

SEQ ID NO: 784766 - DNA, 22 bp, Homo sapiens
ctcagagaccagggctccagcc

SEQ ID NO: 784767 - DNA, 21 bp, Homo sapiens
ctcagagacctgaagtgtgca

SEQ ID NO: 784768 - DNA, 17 bp, Homo sapiens
ctcagagatgaaactat

SEQ ID NO: 784769 - DNA, 13 bp, Homo sapiens
ctcagagcagagc

SEQ ID NO: 784770 - DNA, 14 bp, Homo sapiens
ctcagagcagagca

SEQ ID NO: 784771 - DNA, 14 bp, Homo sapiens
ctcagagcagcaga

SEQ ID NO: 784772 - DNA, 15 bp, Homo sapiens
ctcagagcaggctca

SEQ ID NO: 784773 - DNA, 16 bp, Homo sapiens
ctcagagcaggggcca

SEQ ID NO: 784774 - DNA, 13 bp, Homo sapiens
ctcagagccaagt

SEQ ID NO: 784775 - DNA, 15 bp, Homo sapiens
ctcagagcccatggt

SEQ ID NO: 784776 - DNA, 14 bp, Homo sapiens
ctcagagccctgcc

SEQ ID NO: 784777 - DNA, 20 bp, Homo sapiens
ctcagagcctgacctgagag

SEQ ID NO: 784778 - DNA, 19 bp, Homo sapiens
ctcagagcgccaggaagcc

SEQ ID NO: 784779 - DNA, 15 bp, Homo sapiens
ctcagagcttgaaga

SEQ ID NO: 784780 - DNA, 18 bp, Homo sapiens
ctcagagctttaaaagta

SEQ ID NO: 784781 - DNA, 20 bp, Homo sapiens
ctcagagctttgtcacttgc

SEQ ID NO: 784782 - DNA, 22 bp, Homo sapiens
ctcagagctttgtcacttgcca

SEQ ID NO: 784783 - DNA, 13 bp, Homo sapiens
ctcagaggccccc

SEQ ID NO: 784784 - DNA, 17 bp, Homo sapiens
ctcagaggcccccagtg

SEQ ID NO: 784785 - DNA, 22 bp, Homo sapiens
ctcagaggcccccagtggggac

SEQ ID NO: 784786 - DNA, 23 bp, Homo sapiens
ctcagaggcccccagtggggaca

SEQ ID NO: 784787 - DNA, 22 bp, Homo sapiens
ctcagaggcctgctgccagtgc

SEQ ID NO: 784788 - DNA, 13 bp, Homo sapiens
ctcagagggggac

SEQ ID NO: 784789 - DNA, 17 bp, Homo sapiens
ctcagagggggactgct

SEQ ID NO: 784790 - DNA, 15 bp, Homo sapiens
ctcagagtaggtggg

SEQ ID NO: 784791 - DNA, 16 bp, Homo sapiens
ctcagagtccactgtg

SEQ ID NO: 784792 - DNA, 15 bp, Homo sapiens
ctcagagtccaggcc

SEQ ID NO: 784793 - DNA, 22 bp, Homo sapiens
ctcagagtgacagtcataaata

SEQ ID NO: 784794 - DNA, 14 bp, Homo sapiens
ctcagagtgaccct

SEQ ID NO: 784795 - DNA, 19 bp, Homo sapiens
ctcagagtgaccctcagct

SEQ ID NO: 784796 - DNA, 23 bp, Homo sapiens
ctcagagtgaccctcagctgtca

SEQ ID NO: 784797 - DNA, 13 bp, Homo sapiens
ctcagagtgcaag

SEQ ID NO: 784798 - DNA, 16 bp, Homo sapiens
ctcagagtggagttga

SEQ ID NO: 784799 - DNA, 17 bp, Homo sapiens
ctcagatacccagtgga

SEQ ID NO: 784800 - DNA, 18 bp, Homo sapiens
ctcagatagaatgacagt

SEQ ID NO: 784801 - DNA, 19 bp, Homo sapiens
ctcagatccccagctttct

SEQ ID NO: 784802 - DNA, 16 bp, Homo sapiens
ctcagatcttgacagt

SEQ ID NO: 784803 - DNA, 20 bp, Homo sapiens
ctcagatgatctctccacgg

SEQ ID NO: 784804 - DNA, 18 bp, Homo sapiens
ctcagatgcagtttggag

SEQ ID NO: 784805 - DNA, 22 bp, Homo sapiens
ctcagatgcgttcgcctctggc

SEQ ID NO: 784806 - DNA, 15 bp, Homo sapiens
ctcagatgggaattg

SEQ ID NO: 784807 - DNA, 20 bp, Homo sapiens
ctcagatgggaattgcacag

SEQ ID NO: 784808 - DNA, 17 bp, Homo sapiens
ctcagatggggcaccaa

SEQ ID NO: 784809 - DNA, 13 bp, Homo sapiens
ctcagatgttaaa

SEQ ID NO: 784810 - DNA, 14 bp, Homo sapiens
ctcagatgttaaaa

SEQ ID NO: 784811 - DNA, 16 bp, Homo sapiens
ctcagatgttaaaata

SEQ ID NO: 784812 - DNA, 19 bp, Homo sapiens
ctcagatgttaaaataaat

SEQ ID NO: 784813 - DNA, 17 bp, Homo sapiens
ctcagattatttttcct

SEQ ID NO: 784814 - DNA, 13 bp, Homo sapiens
ctcagattgctga

SEQ ID NO: 784815 - DNA, 22 bp, Homo sapiens
ctcagattgtaatatgtaaatg

SEQ ID NO: 784816 - DNA, 17 bp, Homo sapiens
ctcagatttctgaggaa

SEQ ID NO: 784817 - DNA, 21 bp, Homo sapiens
ctcagattttatattttctat

SEQ ID NO: 784818 - DNA, 21 bp, Homo sapiens
ctcagatttttctgaagggca

SEQ ID NO: 784819 - DNA, 21 bp, Homo sapiens
ctcagcaaaagatgcttctca

SEQ ID NO: 784820 - DNA, 21 bp, Homo sapiens
ctcagcaaagctacaggactg

SEQ ID NO: 784821 - DNA, 21 bp, Homo sapiens
ctcagcacattcgggaccaat

SEQ ID NO: 784822 - DNA, 22 bp, Homo sapiens
ctcagcacattcgggaccaata

SEQ ID NO: 784823 - DNA, 17 bp, Homo sapiens
ctcagcaccccttccat

SEQ ID NO: 784824 - DNA, 21 bp, Homo sapiens
ctcagcaccccttccatgtgg

SEQ ID NO: 784825 - DNA, 14 bp, Homo sapiens
ctcagcagaggcag

SEQ ID NO: 784826 - DNA, 14 bp, Homo sapiens
ctcagcagcagaga

SEQ ID NO: 784827 - DNA, 12 bp, Homo sapiens
ctcagcagccag

SEQ ID NO: 784828 - DNA, 14 bp, Homo sapiens
ctcagcagccagtc

SEQ ID NO: 784829 - DNA, 16 bp, Homo sapiens
ctcagcagccctcctc

SEQ ID NO: 784830 - DNA, 21 bp, Homo sapiens
ctcagcagccctcctcacccc

SEQ ID NO: 784831 - DNA, 14 bp, Homo sapiens
ctcagcagtgacca

SEQ ID NO: 784832 - DNA, 18 bp, Homo sapiens
ctcagcagttgacatcca

SEQ ID NO: 784833 - DNA, 17 bp, Homo sapiens
ctcagccaaatttcctg

SEQ ID NO: 784834 - DNA, 19 bp, Homo sapiens
ctcagccaaatttcctgtt

SEQ ID NO: 784835 - DNA, 23 bp, Homo sapiens
ctcagccaaatttcctgtttgaa

SEQ ID NO: 784836 - DNA, 15 bp, Homo sapiens
ctcagccacagcctg

SEQ ID NO: 784837 - DNA, 17 bp, Homo sapiens
ctcagccaccctgagtt

SEQ ID NO: 784838 - DNA, 18 bp, Homo sapiens
ctcagccaccctgagttg

SEQ ID NO: 784839 - DNA, 21 bp, Homo sapiens
ctcagccaccctgagttgctt

SEQ ID NO: 784840 - DNA, 12 bp, Homo sapiens
ctcagccagaga

SEQ ID NO: 784841 - DNA, 14 bp, Homo sapiens
ctcagccaggccct

SEQ ID NO: 784842 - DNA, 15 bp, Homo sapiens
ctcagccaggccctg

SEQ ID NO: 784843 - DNA, 21 bp, Homo sapiens
ctcagccatgaggagttgctg

SEQ ID NO: 784844 - DNA, 18 bp, Homo sapiens
ctcagccatttccccctc

SEQ ID NO: 784845 - DNA, 23 bp, Homo sapiens
ctcagccatttccccctcctcag

SEQ ID NO: 784846 - DNA, 21 bp, Homo sapiens
ctcagcccacatagtgatggt

SEQ ID NO: 784847 - DNA, 17 bp, Homo sapiens
ctcagcccacccccctc

SEQ ID NO: 784848 - DNA, 14 bp, Homo sapiens
ctcagcccaccctc

SEQ ID NO: 784849 - DNA, 15 bp, Homo sapiens
ctcagcccccaggat

SEQ ID NO: 784850 - DNA, 16 bp, Homo sapiens
ctcagcccccaggcca

SEQ ID NO: 784851 - DNA, 16 bp, Homo sapiens
ctcagcccctacccct

SEQ ID NO: 784852 - DNA, 17 bp, Homo sapiens
ctcagcccctacccctg

SEQ ID NO: 784853 - DNA, 21 bp, Homo sapiens
ctcagcccctacccctgccct

SEQ ID NO: 784854 - DNA, 13 bp, Homo sapiens
ctcagcccctctt

SEQ ID NO: 784855 - DNA, 16 bp, Homo sapiens
ctcagcccctcttgcc

SEQ ID NO: 784856 - DNA, 16 bp, Homo sapiens
ctcagcccgctgagtg

SEQ ID NO: 784857 - DNA, 11 bp, Homo sapiens
ctcagccctga

SEQ ID NO: 784858 - DNA, 18 bp, Homo sapiens
ctcagccctgactggtgc

SEQ ID NO: 784859 - DNA, 19 bp, Homo sapiens
ctcagccctgactggtgct

SEQ ID NO: 784860 - DNA, 14 bp, Homo sapiens
ctcagccctgaggt

SEQ ID NO: 784861 - DNA, 15 bp, Homo sapiens
ctcagccctgaggtg

SEQ ID NO: 784862 - DNA, 14 bp, Homo sapiens
ctcagccctggcct

SEQ ID NO: 784863 - DNA, 16 bp, Homo sapiens
ctcagccctggccttt

SEQ ID NO: 784864 - DNA, 20 bp, Homo sapiens
ctcagccctggcctttttct

SEQ ID NO: 784865 - DNA, 21 bp, Homo sapiens
ctcagccctgggccccaccac

SEQ ID NO: 784866 - DNA, 17 bp, Homo sapiens
ctcagccgagaaattgg

SEQ ID NO: 784867 - DNA, 22 bp, Homo sapiens
ctcagcctactccgctcactga

SEQ ID NO: 784868 - DNA, 22 bp, Homo sapiens
ctcagcctcatcctccccagga

SEQ ID NO: 784869 - DNA, 23 bp, Homo sapiens
ctcagcctcccaagtagctggga

SEQ ID NO: 784870 - DNA, 12 bp, Homo sapiens
ctcagcctcccc

SEQ ID NO: 784871 - DNA, 13 bp, Homo sapiens
ctcagcctcccct

SEQ ID NO: 784872 - DNA, 14 bp, Homo sapiens
ctcagcctcccctt

SEQ ID NO: 784873 - DNA, 15 bp, Homo sapiens
ctcagcctcccgagt

SEQ ID NO: 784874 - DNA, 23 bp, Homo sapiens
ctcagcctcccgagtagctggga

SEQ ID NO: 784875 - DNA, 20 bp, Homo sapiens
ctcagcctccggagtagctg

SEQ ID NO: 784876 - DNA, 13 bp, Homo sapiens
ctcagcctcctga

SEQ ID NO: 784877 - DNA, 14 bp, Homo sapiens
ctcagcctcctgag

SEQ ID NO: 784878 - DNA, 16 bp, Homo sapiens
ctcagcctcctgagcc

SEQ ID NO: 784879 - DNA, 16 bp, Homo sapiens
ctcagctgcctcactt

SEQ ID NO: 784880 - DNA, 18 bp, Homo sapiens
ctcagctgctcccacact

SEQ ID NO: 784881 - DNA, 17 bp, Homo sapiens
ctcagctggcagtgcaa

SEQ ID NO: 784882 - DNA, 21 bp, Homo sapiens
ctcagctgtcacctgctcaca

SEQ ID NO: 784883 - DNA, 18 bp, Homo sapiens
ctcagcttaattctcctt

SEQ ID NO: 784884 - DNA, 21 bp, Homo sapiens
ctcagcttaattctccttccc

SEQ ID NO: 784885 - DNA, 14 bp, Homo sapiens
ctcagcttatctct

SEQ ID NO: 784886 - DNA, 22 bp, Homo sapiens
ctcagcttcggggccggtgagg

SEQ ID NO: 784887 - DNA, 18 bp, Homo sapiens
ctcagcttgggcttcttc

SEQ ID NO: 784888 - DNA, 21 bp, Homo sapiens
ctcagcttgggcttcttcctc

SEQ ID NO: 784889 - DNA, 19 bp, Homo sapiens
ctcagctttccctgccaca

SEQ ID NO: 784890 - DNA, 16 bp, Homo sapiens
ctcagctttgagaagc

SEQ ID NO: 784891 - DNA, 21 bp, Homo sapiens
ctcagctttgagaagccttca

SEQ ID NO: 784892 - DNA, 14 bp, Homo sapiens
ctcagctttttccc

SEQ ID NO: 784893 - DNA, 20 bp, Homo sapiens
ctcaggaaaccacaaccttg

SEQ ID NO: 784894 - DNA, 16 bp, Homo sapiens
ctcaggaagagctatg

SEQ ID NO: 784895 - DNA, 16 bp, Homo sapiens
ctcaggaagtccagcc

SEQ ID NO: 784896 - DNA, 20 bp, Homo sapiens
ctcaggaccaaagctttcat

SEQ ID NO: 784897 - DNA, 22 bp, Homo sapiens
ctcaggaccaaagctttcatgt

SEQ ID NO: 784898 - DNA, 14 bp, Homo sapiens
ctcaggacccaggc

SEQ ID NO: 784899 - DNA, 17 bp, Homo sapiens
ctcaggacccaggccct

SEQ ID NO: 784900 - DNA, 19 bp, Homo sapiens
ctcaggacccaggccctcc

SEQ ID NO: 784901 - DNA, 23 bp, Homo sapiens
ctcaggacccaggccctccatgg

SEQ ID NO: 784902 - DNA, 15 bp, Homo sapiens
ctcaggaccctcagc

SEQ ID NO: 784903 - DNA, 16 bp, Homo sapiens
ctcaggacctgggacc

SEQ ID NO: 784904 - DNA, 15 bp, Homo sapiens
ctcaggactcctctc

SEQ ID NO: 784905 - DNA, 14 bp, Homo sapiens
ctcaggactgcgac

SEQ ID NO: 784906 - DNA, 16 bp, Homo sapiens
ctcaggagatggaggg

SEQ ID NO: 784907 - DNA, 18 bp, Homo sapiens
ctcaggagatggagggct

SEQ ID NO: 784908 - DNA, 21 bp, Homo sapiens
ctcaggagccgaagcccaggg

SEQ ID NO: 784909 - DNA, 14 bp, Homo sapiens
ctcaggaggaggct

SEQ ID NO: 784910 - DNA, 13 bp, Homo sapiens
ctcaggaggcaga

SEQ ID NO: 784911 - DNA, 16 bp, Homo sapiens
ctcaggaggcaggacc

SEQ ID NO: 784912 - DNA, 20 bp, Homo sapiens
ctcaggaggcgcccttggct

SEQ ID NO: 784913 - DNA, 15 bp, Homo sapiens
ctcaggaggctgagg

SEQ ID NO: 784914 - DNA, 23 bp, Homo sapiens
ctcaggaggctgaggcagaagaa

SEQ ID NO: 784915 - DNA, 19 bp, Homo sapiens
ctcaggaggctgaggcagg

SEQ ID NO: 784916 - DNA, 16 bp, Homo sapiens
ctcaggaggctgaggg

SEQ ID NO: 784917 - DNA, 22 bp, Homo sapiens
ctcaggagggtgacgcccagct

SEQ ID NO: 784918 - DNA, 22 bp, Homo sapiens
ctcaggatatccttatcagagc

SEQ ID NO: 784919 - DNA, 14 bp, Homo sapiens
ctcaggatccagtg

SEQ ID NO: 784920 - DNA, 20 bp, Homo sapiens
ctcaggattgctaggagctc

SEQ ID NO: 784921 - DNA, 19 bp, Homo sapiens
ctcaggatttaaaaactgg

SEQ ID NO: 784922 - DNA, 13 bp, Homo sapiens
ctcaggcaagccc

SEQ ID NO: 784923 - DNA, 21 bp, Homo sapiens
ctcaggcaagcccctcagccc

SEQ ID NO: 784924 - DNA, 16 bp, Homo sapiens
ctcaggcacacagcta

SEQ ID NO: 784925 - DNA, 18 bp, Homo sapiens
ctcaggcacacagctact

SEQ ID NO: 784926 - DNA, 22 bp, Homo sapiens
ctcaggcagacaagagctgctg

SEQ ID NO: 784927 - DNA, 23 bp, Homo sapiens
ctcaggcagacaagagctgctgt

SEQ ID NO: 784928 - DNA, 13 bp, Homo sapiens
ctcaggcagcacc

SEQ ID NO: 784929 - DNA, 14 bp, Homo sapiens
ctcaggcagcacca

SEQ ID NO: 784930 - DNA, 16 bp, Homo sapiens
ctcaggcagcaccaca

SEQ ID NO: 784931 - DNA, 20 bp, Homo sapiens
ctcaggcagcaccacactgg

SEQ ID NO: 784932 - DNA, 14 bp, Homo sapiens
ctcaggcagctcaa

SEQ ID NO: 784933 - DNA, 22 bp, Homo sapiens
ctcaggcataggcctgggtgct

SEQ ID NO: 784934 - DNA, 16 bp, Homo sapiens
ctcaggcatgcctgtg

SEQ ID NO: 784935 - DNA, 13 bp, Homo sapiens
ctcaggccacagt

SEQ ID NO: 784936 - DNA, 20 bp, Homo sapiens
ctcaggccacagtggggctg

SEQ ID NO: 784937 - DNA, 13 bp, Homo sapiens
ctcaggccacctg

SEQ ID NO: 784938 - DNA, 16 bp, Homo sapiens
ctcaggccacctgccc

SEQ ID NO: 784939 - DNA, 22 bp, Homo sapiens
ctcaggccacctgcccccttct

SEQ ID NO: 784940 - DNA, 16 bp, Homo sapiens
ctcaggccattcccca

SEQ ID NO: 784941 - DNA, 16 bp, Homo sapiens
ctcaggcctaggaggc

SEQ ID NO: 784942 - DNA, 11 bp, Homo sapiens
ctcaggcctcc

SEQ ID NO: 784943 - DNA, 20 bp, Homo sapiens
ctcaggcgatccacctgtct

SEQ ID NO: 784944 - DNA, 13 bp, Homo sapiens
ctcaggctcccca

SEQ ID NO: 784945 - DNA, 18 bp, Homo sapiens
ctcaggctgcagctggac

SEQ ID NO: 784946 - DNA, 24 bp, Homo sapiens
ctcaggctgctggggcctcagacg

SEQ ID NO: 784947 - DNA, 15 bp, Homo sapiens
ctcaggcttgaaatg

SEQ ID NO: 784948 - DNA, 17 bp, Homo sapiens
ctcaggcttgagggagg

SEQ ID NO: 784949 - DNA, 18 bp, Homo sapiens
ctcaggcttgagggaggg

SEQ ID NO: 784950 - DNA, 21 bp, Homo sapiens
ctcaggctttcactatttcct

SEQ ID NO: 784951 - DNA, 14 bp, Homo sapiens
ctcagggacagaga

SEQ ID NO: 784952 - DNA, 19 bp, Homo sapiens
ctcagggacagagacacct

SEQ ID NO: 784953 - DNA, 20 bp, Homo sapiens
ctcagggacagagacacctg

SEQ ID NO: 784954 - DNA, 14 bp, Homo sapiens
ctcagggagcctcc

SEQ ID NO: 784955 - DNA, 17 bp, Homo sapiens
ctcataaaccaatgtgg

SEQ ID NO: 784956 - DNA, 16 bp, Homo sapiens
ctcataaggtgctatc

SEQ ID NO: 784957 - DNA, 15 bp, Homo sapiens
ctcataccacactta

SEQ ID NO: 784958 - DNA, 16 bp, Homo sapiens
ctcatacctttaaagg

SEQ ID NO: 784959 - DNA, 18 bp, Homo sapiens
ctcatacctttaaaggaa

SEQ ID NO: 784960 - DNA, 23 bp, Homo sapiens
ctcatagaattttgagtattcca

SEQ ID NO: 784961 - DNA, 14 bp, Homo sapiens
ctcatagacactga

SEQ ID NO: 784962 - DNA, 18 bp, Homo sapiens
ctcatagaggtgagaaaa

SEQ ID NO: 784963 - DNA, 17 bp, Homo sapiens
ctcatagccctcagaca

SEQ ID NO: 784964 - DNA, 13 bp, Homo sapiens
ctcataggtccct

SEQ ID NO: 784965 - DNA, 20 bp, Homo sapiens
ctcataggtccctgacattt

SEQ ID NO: 784966 - DNA, 13 bp, Homo sapiens
ctcatatatttaa

SEQ ID NO: 784967 - DNA, 20 bp, Homo sapiens
ctcatatcccctatttaaca

SEQ ID NO: 784968 - DNA, 14 bp, Homo sapiens
ctcatatgccaccc

SEQ ID NO: 784969 - DNA, 15 bp, Homo sapiens
ctcatatttaaagac

SEQ ID NO: 784970 - DNA, 13 bp, Homo sapiens
ctcatattttgta

SEQ ID NO: 784971 - DNA, 16 bp, Homo sapiens
ctcatattttgtatat

SEQ ID NO: 784972 - DNA, 14 bp, Homo sapiens
ctcatcaactgaat

SEQ ID NO: 784973 - DNA, 14 bp, Homo sapiens
ctcatcaccatcgt

SEQ ID NO: 784974 - DNA, 20 bp, Homo sapiens
ctcatcaccccagaggcctt

SEQ ID NO: 784975 - DNA, 20 bp, Homo sapiens
ctcatcactggactgcatgg

SEQ ID NO: 784976 - DNA, 15 bp, Homo sapiens
ctcatcactggatga

SEQ ID NO: 784977 - DNA, 13 bp, Homo sapiens
ctcatcagagcag

SEQ ID NO: 784978 - DNA, 12 bp, Homo sapiens
ctcatcagtagt

SEQ ID NO: 784979 - DNA, 15 bp, Homo sapiens
ctcatcataaaataa

SEQ ID NO: 784980 - DNA, 14 bp, Homo sapiens
ctcatcatattcca

SEQ ID NO: 784981 - DNA, 13 bp, Homo sapiens
ctcatcatattgt

SEQ ID NO: 784982 - DNA, 14 bp, Homo sapiens
ctcatcatattttg

SEQ ID NO: 784983 - DNA, 13 bp, Homo sapiens
ctcatcatccacc

SEQ ID NO: 784984 - DNA, 14 bp, Homo sapiens
ctcatcatccaccc

SEQ ID NO: 784985 - DNA, 13 bp, Homo sapiens
ctcatcattctct

SEQ ID NO: 784986 - DNA, 19 bp, Homo sapiens
ctcatcattctctgtctca

SEQ ID NO: 784987 - DNA, 20 bp, Homo sapiens
ctcatcattctctgtctcat

SEQ ID NO: 784988 - DNA, 22 bp, Homo sapiens
ctcatcattctctgtctcatcc

SEQ ID NO: 784989 - DNA, 22 bp, Homo sapiens
ctcatcatttgcattgggcatt

SEQ ID NO: 784990 - DNA, 14 bp, Homo sapiens
ctcatcatttgtgg

SEQ ID NO: 784991 - DNA, 13 bp, Homo sapiens
ctcatcatttttt

SEQ ID NO: 784992 - DNA, 13 bp, Homo sapiens
ctcatccatttct

SEQ ID NO: 784993 - DNA, 13 bp, Homo sapiens
ctcatcccaacct

SEQ ID NO: 784994 - DNA, 10 bp, Homo sapiens
ctcatcccat

SEQ ID NO: 784995 - DNA, 13 bp, Homo sapiens
ctcatccccaggg

SEQ ID NO: 784996 - DNA, 13 bp, Homo sapiens
ctcatccccccac

SEQ ID NO: 784997 - DNA, 20 bp, Homo sapiens
ctcatcccccctgctgccca

SEQ ID NO: 784998 - DNA, 14 bp, Homo sapiens
ctcatccccctgtg

SEQ ID NO: 784999 - DNA, 17 bp, Homo sapiens
ctcatccctcggaagcc

SEQ ID NO: 785000 - DNA, 20 bp, Homo sapiens
ctcatccctggtcgtctatc

SEQ ID NO: 785001 - DNA, 14 bp, Homo sapiens
ctcatccgaggcag

SEQ ID NO: 785002 - DNA, 13 bp, Homo sapiens
ctcatcctccagt

SEQ ID NO: 785003 - DNA, 13 bp, Homo sapiens
ctcatcctgctct

SEQ ID NO: 785004 - DNA, 14 bp, Homo sapiens
ctcatcctgctctt

SEQ ID NO: 785005 - DNA, 12 bp, Homo sapiens
ctcatcctgctt

SEQ ID NO: 785006 - DNA, 14 bp, Homo sapiens
ctcatcctgcttct

SEQ ID NO: 785007 - DNA, 22 bp, Homo sapiens
ctcatcctgcttctcttttcct

SEQ ID NO: 785008 - DNA, 21 bp, Homo sapiens
ctcatcctggcacgccctact

SEQ ID NO: 785009 - DNA, 15 bp, Homo sapiens
ctccaaatgagatct

SEQ ID NO: 785010 - DNA, 15 bp, Homo sapiens
ctccaaatttaacca

SEQ ID NO: 785011 - DNA, 23 bp, Homo sapiens
ctccaaatttaaccataaatcaa

SEQ ID NO: 785012 - DNA, 14 bp, Homo sapiens
ctccaaatttttct

SEQ ID NO: 785013 - DNA, 15 bp, Homo sapiens
ctccaacaccaagca

SEQ ID NO: 785014 - DNA, 18 bp, Homo sapiens
ctccaacaccaagcacag

SEQ ID NO: 785015 - DNA, 22 bp, Homo sapiens
ctccaacccccgccacctcagg

SEQ ID NO: 785016 - DNA, 12 bp, Homo sapiens
ctccaaccctgc

SEQ ID NO: 785017 - DNA, 14 bp, Homo sapiens
ctccaacctggaca

SEQ ID NO: 785018 - DNA, 13 bp, Homo sapiens
ctccaacgcccct

SEQ ID NO: 785019 - DNA, 16 bp, Homo sapiens
ctccaacgcccctgtg

SEQ ID NO: 785020 - DNA, 19 bp, Homo sapiens
ctccaacgcccctgtggcc

SEQ ID NO: 785021 - DNA, 23 bp, Homo sapiens
ctccaactcctgacttcatgatc

SEQ ID NO: 785022 - DNA, 19 bp, Homo sapiens
ctccaactgcctaaggccc

SEQ ID NO: 785023 - DNA, 18 bp, Homo sapiens
ctccaactggattataaa

SEQ ID NO: 785024 - DNA, 22 bp, Homo sapiens
ctccaagaatggaagcctgaac

SEQ ID NO: 785025 - DNA, 23 bp, Homo sapiens
ctccaagaatggaagcctgaact

SEQ ID NO: 785026 - DNA, 15 bp, Homo sapiens
ctccaagatgccctc

SEQ ID NO: 785027 - DNA, 19 bp, Homo sapiens
ctccaagcacagagcctgg

SEQ ID NO: 785028 - DNA, 16 bp, Homo sapiens
ctccaagcagactcca

SEQ ID NO: 785029 - DNA, 13 bp, Homo sapiens
ctccaagcatcac

SEQ ID NO: 785030 - DNA, 14 bp, Homo sapiens
ctccaagcatttca

SEQ ID NO: 785031 - DNA, 16 bp, Homo sapiens
ctccaagcatttcatg

SEQ ID NO: 785032 - DNA, 18 bp, Homo sapiens
ctccaagccccatcttct

SEQ ID NO: 785033 - DNA, 18 bp, Homo sapiens
ctccaagccccctggcag

SEQ ID NO: 785034 - DNA, 19 bp, Homo sapiens
ctccaagcctgcctcccaa

SEQ ID NO: 785035 - DNA, 14 bp, Homo sapiens
ctccaagcggccct

SEQ ID NO: 785036 - DNA, 19 bp, Homo sapiens
ctccaagctccatctccac

SEQ ID NO: 785037 - DNA, 17 bp, Homo sapiens
ctccaaggaaagaacta

SEQ ID NO: 785038 - DNA, 20 bp, Homo sapiens
ctccaaggaggggctgtaaa

SEQ ID NO: 785039 - DNA, 17 bp, Homo sapiens
ctccaaggatcctctcc

SEQ ID NO: 785040 - DNA, 18 bp, Homo sapiens
ctccaaggatcctctcca

SEQ ID NO: 785041 - DNA, 22 bp, Homo sapiens
ctccaagggacaggtgggcctg

SEQ ID NO: 785042 - DNA, 21 bp, Homo sapiens
ctccaagggaccctttgcctt

SEQ ID NO: 785043 - DNA, 18 bp, Homo sapiens
ctccaagggcttctgcac

SEQ ID NO: 785044 - DNA, 19 bp, Homo sapiens
ctccaagggcttctgcacc

SEQ ID NO: 785045 - DNA, 23 bp, Homo sapiens
ctccaagggcttctgcaccctcc

SEQ ID NO: 785046 - DNA, 20 bp, Homo sapiens
ctccaagggtttcgactggt

SEQ ID NO: 785047 - DNA, 22 bp, Homo sapiens
ctccaagggtttcgactggtcc

SEQ ID NO: 785048 - DNA, 19 bp, Homo sapiens
ctccaaggtttataaagca

SEQ ID NO: 785049 - DNA, 21 bp, Homo sapiens
ctccaaggtttataaagcaga

SEQ ID NO: 785050 - DNA, 23 bp, Homo sapiens
ctccaaggtttataaagcagatt

SEQ ID NO: 785051 - DNA, 19 bp, Homo sapiens
ctccaagtctctctgtgaa

SEQ ID NO: 785052 - DNA, 16 bp, Homo sapiens
ctccaatatcagtgct

SEQ ID NO: 785053 - DNA, 22 bp, Homo sapiens
ctccaatcccaccaaccctcag

SEQ ID NO: 785054 - DNA, 14 bp, Homo sapiens
ctccaatgtcctga

SEQ ID NO: 785055 - DNA, 18 bp, Homo sapiens
ctccaatgtcctgaaaca

SEQ ID NO: 785056 - DNA, 17 bp, Homo sapiens
ctccaatgtctgctgag

SEQ ID NO: 785057 - DNA, 20 bp, Homo sapiens
ctccaatgtctgctgaggag

SEQ ID NO: 785058 - DNA, 18 bp, Homo sapiens
ctccaattctgaaatact

SEQ ID NO: 785059 - DNA, 20 bp, Homo sapiens
ctccaattctgaaatacttt

SEQ ID NO: 785060 - DNA, 15 bp, Homo sapiens
ctccaattttttaag

SEQ ID NO: 785061 - DNA, 15 bp, Homo sapiens
ctccacaacagcctg

SEQ ID NO: 785062 - DNA, 18 bp, Homo sapiens
ctccacaacagcctgggg

SEQ ID NO: 785063 - DNA, 19 bp, Homo sapiens
ctccacaacagcctggggt

SEQ ID NO: 785064 - DNA, 16 bp, Homo sapiens
ctccacacattccagc

SEQ ID NO: 785065 - DNA, 18 bp, Homo sapiens
ctccacacattccagcca

SEQ ID NO: 785066 - DNA, 17 bp, Homo sapiens
ctccacaccagtggcct

SEQ ID NO: 785067 - DNA, 13 bp, Homo sapiens
ctccacacctgaa

SEQ ID NO: 785068 - DNA, 13 bp, Homo sapiens
ctccacagagagg

SEQ ID NO: 785069 - DNA, 14 bp, Homo sapiens
ctccacagagagga

SEQ ID NO: 785070 - DNA, 23 bp, Homo sapiens
ctccacagatgtaattatgtttt

SEQ ID NO: 785071 - DNA, 16 bp, Homo sapiens
ctccacagcaacccca

SEQ ID NO: 785072 - DNA, 14 bp, Homo sapiens
ctccacagccgcag

SEQ ID NO: 785073 - DNA, 13 bp, Homo sapiens
ctccacagcgagg

SEQ ID NO: 785074 - DNA, 16 bp, Homo sapiens
ctccacagcgagggca

SEQ ID NO: 785075 - DNA, 22 bp, Homo sapiens
ctccacagcgagggcagctgct

SEQ ID NO: 785076 - DNA, 14 bp, Homo sapiens
ctccacagctgcag

SEQ ID NO: 785077 - DNA, 21 bp, Homo sapiens
ctccacagggcttgttttcca

SEQ ID NO: 785078 - DNA, 22 bp, Homo sapiens
ctccacagggcttgttttccaa

SEQ ID NO: 785079 - DNA, 16 bp, Homo sapiens
ctccacagtcccccac

SEQ ID NO: 785080 - DNA, 12 bp, Homo sapiens
ctccacagtgct

SEQ ID NO: 785081 - DNA, 14 bp, Homo sapiens
ctccacagtgctgc

SEQ ID NO: 785082 - DNA, 13 bp, Homo sapiens
ctccacagtgttg

SEQ ID NO: 785083 - DNA, 14 bp, Homo sapiens
ctccacagtgttgt

SEQ ID NO: 785084 - DNA, 21 bp, Homo sapiens
ctccacatcccagcagcccaa

SEQ ID NO: 785085 - DNA, 13 bp, Homo sapiens
ctccacatcctcc

SEQ ID NO: 785086 - DNA, 13 bp, Homo sapiens
ctccacatctgcc

SEQ ID NO: 785087 - DNA, 17 bp, Homo sapiens
ctccacatctgccttaa

SEQ ID NO: 785088 - DNA, 21 bp, Homo sapiens
ctccacatgctgcctggcaca

SEQ ID NO: 785089 - DNA, 12 bp, Homo sapiens
ctccaccaaccc

SEQ ID NO: 785090 - DNA, 13 bp, Homo sapiens
ctccaccaaccca

SEQ ID NO: 785091 - DNA, 20 bp, Homo sapiens
ctccaccaacccatcagaag

SEQ ID NO: 785092 - DNA, 20 bp, Homo sapiens
ctccaccaaccccgcggccc

SEQ ID NO: 785093 - DNA, 23 bp, Homo sapiens
ctccaccaaccccgcggcccaga

SEQ ID NO: 785094 - DNA, 13 bp, Homo sapiens
ctccaccacatcc

SEQ ID NO: 785095 - DNA, 18 bp, Homo sapiens
ctccaccacatctgccag

SEQ ID NO: 785096 - DNA, 12 bp, Homo sapiens
ctccaccaccac

SEQ ID NO: 785097 - DNA, 14 bp, Homo sapiens
ctccaccacccaaa

SEQ ID NO: 785098 - DNA, 16 bp, Homo sapiens
ctccaccacccaaaag

SEQ ID NO: 785099 - DNA, 13 bp, Homo sapiens
ctccaccagcccc

SEQ ID NO: 785100 - DNA, 17 bp, Homo sapiens
ctccaccagccctactc

SEQ ID NO: 785101 - DNA, 19 bp, Homo sapiens
ctccaccagccctactcct

SEQ ID NO: 785102 - DNA, 17 bp, Homo sapiens
ctccaccatccccaccc

SEQ ID NO: 785103 - DNA, 21 bp, Homo sapiens
ctccacccaaaccccttccca

SEQ ID NO: 785104 - DNA, 12 bp, Homo sapiens
ctccacccagcc

SEQ ID NO: 785105 - DNA, 13 bp, Homo sapiens
ctccacccagccc

SEQ ID NO: 785106 - DNA, 11 bp, Homo sapiens
ctccaccccag

SEQ ID NO: 785107 - DNA, 12 bp, Homo sapiens
ctccaccccagg

SEQ ID NO: 785108 - DNA, 22 bp, Homo sapiens
ctccaccccaggacgccactca

SEQ ID NO: 785109 - DNA, 19 bp, Homo sapiens
ctccacccccgccacggcc

SEQ ID NO: 785110 - DNA, 19 bp, Homo sapiens
ctccacccgtcctccctca

SEQ ID NO: 785111 - DNA, 21 bp, Homo sapiens
ctccacccgtcctccctcagc

SEQ ID NO: 785112 - DNA, 22 bp, Homo sapiens
ctccacccgtcctccctcagcc

SEQ ID NO: 785113 - DNA, 16 bp, Homo sapiens
ctccaccctccacctt

SEQ ID NO: 785114 - DNA, 15 bp, Homo sapiens
ctccaccctcctcta

SEQ ID NO: 785115 - DNA, 12 bp, Homo sapiens
ctccaccctgca

SEQ ID NO: 785116 - DNA, 13 bp, Homo sapiens
ctccaccctgcat

SEQ ID NO: 785117 - DNA, 18 bp, Homo sapiens
ctccaccctgtcccccag

SEQ ID NO: 785118 - DNA, 18 bp, Homo sapiens
ctccaccctgttagtttt

SEQ ID NO: 785119 - DNA, 16 bp, Homo sapiens
ctccaccgaccaactg

SEQ ID NO: 785120 - DNA, 21 bp, Homo sapiens
ctccaccgaccaactgcccta

SEQ ID NO: 785121 - DNA, 16 bp, Homo sapiens
ctccaccgctgcctaa

SEQ ID NO: 785122 - DNA, 11 bp, Homo sapiens
ctccacctcaa

SEQ ID NO: 785123 - DNA, 12 bp, Homo sapiens
ctccacctcagc

SEQ ID NO: 785124 - DNA, 18 bp, Homo sapiens
ctccacctcagccttgga

SEQ ID NO: 785125 - DNA, 13 bp, Homo sapiens
ctccacctctcac

SEQ ID NO: 785126 - DNA, 19 bp, Homo sapiens
ctccacctctcacgggccc

SEQ ID NO: 785127 - DNA, 15 bp, Homo sapiens
ctccacctctggtgg

SEQ ID NO: 785128 - DNA, 20 bp, Homo sapiens
ctccaccttgatgggtcaac

SEQ ID NO: 785129 - DNA, 14 bp, Homo sapiens
ctccacgcctcctg

SEQ ID NO: 785130 - DNA, 20 bp, Homo sapiens
ctccacgcctcctggccaga

SEQ ID NO: 785131 - DNA, 14 bp, Homo sapiens
ctccacgggcaggg

SEQ ID NO: 785132 - DNA, 22 bp, Homo sapiens
ctccacggtcagatttgctgtt

SEQ ID NO: 785133 - DNA, 18 bp, Homo sapiens
ctccacggtccgcggcct

SEQ ID NO: 785134 - DNA, 19 bp, Homo sapiens
ctccacggtgcgtggctgt

SEQ ID NO: 785135 - DNA, 15 bp, Homo sapiens
ctccacgtctttcct

SEQ ID NO: 785136 - DNA, 18 bp, Homo sapiens
ctccacgtctttcctgct

SEQ ID NO: 785137 - DNA, 19 bp, Homo sapiens
ctccacgtctttcctgcta

SEQ ID NO: 785138 - DNA, 17 bp, Homo sapiens
ctccactcaccacaagc

SEQ ID NO: 785139 - DNA, 22 bp, Homo sapiens
ctccactcaccacaagctgagc

SEQ ID NO: 785140 - DNA, 18 bp, Homo sapiens
ctccactcactccagccc

SEQ ID NO: 785141 - DNA, 19 bp, Homo sapiens
ctccactcactccagccca

SEQ ID NO: 785142 - DNA, 14 bp, Homo sapiens
ctccactcactgct

SEQ ID NO: 785143 - DNA, 14 bp, Homo sapiens
ctccactcaggtgc

SEQ ID NO: 785144 - DNA, 18 bp, Homo sapiens
ctccactcaggtgcacac

SEQ ID NO: 785145 - DNA, 17 bp, Homo sapiens
ctccactcccccacctg

SEQ ID NO: 785146 - DNA, 18 bp, Homo sapiens
ctccactcccccacctga

SEQ ID NO: 785147 - DNA, 22 bp, Homo sapiens
ctccactcctctcaactgcctc

SEQ ID NO: 785148 - DNA, 19 bp, Homo sapiens
ctccactcgacccagaatg

SEQ ID NO: 785149 - DNA, 16 bp, Homo sapiens
ctccactctagttcta

SEQ ID NO: 785150 - DNA, 20 bp, Homo sapiens
ctccactctccttcgtgtct

SEQ ID NO: 785151 - DNA, 22 bp, Homo sapiens
ctccactctgattcacctcttc

SEQ ID NO: 785152 - DNA, 15 bp, Homo sapiens
ctccactctgcttct

SEQ ID NO: 785153 - DNA, 21 bp, Homo sapiens
ctccactctgcttctctgact

SEQ ID NO: 785154 - DNA, 14 bp, Homo sapiens
ctccactgccttcg

SEQ ID NO: 785155 - DNA, 15 bp, Homo sapiens
ctccactgccttcga

SEQ ID NO: 785156 - DNA, 16 bp, Homo sapiens
ctccactgccttcgat

SEQ ID NO: 785157 - DNA, 13 bp, Homo sapiens
ctccactgctgga

SEQ ID NO: 785158 - DNA, 23 bp, Homo sapiens
ctccactggggaatgctcccagc

SEQ ID NO: 785159 - DNA, 17 bp, Homo sapiens
ctccactggtctgtctt

SEQ ID NO: 785160 - DNA, 9 bp, Homo sapiens
ctccactgt

SEQ ID NO: 785161 - DNA, 17 bp, Homo sapiens
ctccactgtgcctttgc

SEQ ID NO: 785162 - DNA, 17 bp, Homo sapiens
ctccacttctggtcccc

SEQ ID NO: 785163 - DNA, 19 bp, Homo sapiens
ctccacttctggtcccctg

SEQ ID NO: 785164 - DNA, 21 bp, Homo sapiens
ctccacttctggtcccctgtg

SEQ ID NO: 785165 - DNA, 15 bp, Homo sapiens
ctccactttttctta

SEQ ID NO: 785166 - DNA, 17 bp, Homo sapiens
ctccagaaacagctgct

SEQ ID NO: 785167 - DNA, 19 bp, Homo sapiens
ctccagaaacagctgcttc

SEQ ID NO: 785168 - DNA, 20 bp, Homo sapiens
ctccagaaacagctgcttct

SEQ ID NO: 785169 - DNA, 15 bp, Homo sapiens
ctccagaaacggcca

SEQ ID NO: 785170 - DNA, 14 bp, Homo sapiens
ctccagaagatagc

SEQ ID NO: 785171 - DNA, 21 bp, Homo sapiens
ctccagaagatgccagcttct

SEQ ID NO: 785172 - DNA, 23 bp, Homo sapiens
ctccagaagatgccagcttctct

SEQ ID NO: 785173 - DNA, 17 bp, Homo sapiens
ctccagaagcctctggc

SEQ ID NO: 785174 - DNA, 20 bp, Homo sapiens
ctccagaagcctctggctag

SEQ ID NO: 785175 - DNA, 14 bp, Homo sapiens
ctccagaatctgct

SEQ ID NO: 785176 - DNA, 19 bp, Homo sapiens
ctccagaatctgctgttgc

SEQ ID NO: 785177 - DNA, 22 bp, Homo sapiens
ctccagaatctgctgttgccat

SEQ ID NO: 785178 - DNA, 13 bp, Homo sapiens
ctccagaatgtaa

SEQ ID NO: 785179 - DNA, 20 bp, Homo sapiens
ctccagacccagaggccctg

SEQ ID NO: 785180 - DNA, 12 bp, Homo sapiens
ctccagaccccc

SEQ ID NO: 785181 - DNA, 16 bp, Homo sapiens
ctccagacccccaccc

SEQ ID NO: 785182 - DNA, 16 bp, Homo sapiens
ctccagacccccagca

SEQ ID NO: 785183 - DNA, 14 bp, Homo sapiens
ctccagacccctgg

SEQ ID NO: 785184 - DNA, 18 bp, Homo sapiens
ctccagacccctggcttt

SEQ ID NO: 785185 - DNA, 20 bp, Homo sapiens
ctccagacccctggcttttc

SEQ ID NO: 785186 - DNA, 21 bp, Homo sapiens
ctccagacccctggcttttca

SEQ ID NO: 785187 - DNA, 14 bp, Homo sapiens
ctccagaccctgcc

SEQ ID NO: 785188 - DNA, 16 bp, Homo sapiens
ctccagaccctgcctg

SEQ ID NO: 785189 - DNA, 18 bp, Homo sapiens
ctccagaccctgcctgag

SEQ ID NO: 785190 - DNA, 19 bp, Homo sapiens
ctccagaccctgcctgagc

SEQ ID NO: 785191 - DNA, 21 bp, Homo sapiens
ctccagaccctgcctgagccc

SEQ ID NO: 785192 - DNA, 16 bp, Homo sapiens
ctccagagaagccccg

SEQ ID NO: 785193 - DNA, 11 bp, Homo sapiens
ctccagagcca

SEQ ID NO: 785194 - DNA, 15 bp, Homo sapiens
ctccagagccagcct

SEQ ID NO: 785195 - DNA, 20 bp, Homo sapiens
ctccagagccagcctgggac

SEQ ID NO: 785196 - DNA, 21 bp, Homo sapiens
ctccagagccagcctgggact

SEQ ID NO: 785197 - DNA, 23 bp, Homo sapiens
ctccagagggacagggtggaccc

SEQ ID NO: 785198 - DNA, 20 bp, Homo sapiens
ctccagagggcactctgctt

SEQ ID NO: 785199 - DNA, 13 bp, Homo sapiens
ctccagaggtgga

SEQ ID NO: 785200 - DNA, 20 bp, Homo sapiens
ctccagagtctgagcccccg

SEQ ID NO: 785201 - DNA, 21 bp, Homo sapiens
ctccagatagagaaatagtga

SEQ ID NO: 785202 - DNA, 23 bp, Homo sapiens
ctccagatatgaacagggcccag

SEQ ID NO: 785203 - DNA, 19 bp, Homo sapiens
ctccagattctgatgcata

SEQ ID NO: 785204 - DNA, 16 bp, Homo sapiens
ctccagcaactgccct

SEQ ID NO: 785205 - DNA, 22 bp, Homo sapiens
ctccagcaactgcccttccagg

SEQ ID NO: 785206 - DNA, 23 bp, Homo sapiens
ctccagcaactgcccttccaggt

SEQ ID NO: 785207 - DNA, 15 bp, Homo sapiens
ctccagcaacttctt

SEQ ID NO: 785208 - DNA, 14 bp, Homo sapiens
ctccagcaccttct

SEQ ID NO: 785209 - DNA, 17 bp, Homo sapiens
ctccagcatccagcctg

SEQ ID NO: 785210 - DNA, 18 bp, Homo sapiens
ctccagcatccagcctgt

SEQ ID NO: 785211 - DNA, 20 bp, Homo sapiens
ctccagcatccagcctgtgt

SEQ ID NO: 785212 - DNA, 19 bp, Homo sapiens
ctccagccaacccctgtgg

SEQ ID NO: 785213 - DNA, 21 bp, Homo sapiens
ctccagccaacccctgtggag

SEQ ID NO: 785214 - DNA, 13 bp, Homo sapiens
ctccagccagcaa

SEQ ID NO: 785215 - DNA, 16 bp, Homo sapiens
ctccagccagcaatga

SEQ ID NO: 785216 - DNA, 12 bp, Homo sapiens
ctccagccagcg

SEQ ID NO: 785217 - DNA, 14 bp, Homo sapiens
ctccagccagcgcc

SEQ ID NO: 785218 - DNA, 19 bp, Homo sapiens
ctccagccagcgcctccct

SEQ ID NO: 785219 - DNA, 15 bp, Homo sapiens
ctccagccattgtaa

SEQ ID NO: 785220 - DNA, 11 bp, Homo sapiens
ctccagcccct

SEQ ID NO: 785221 - DNA, 20 bp, Homo sapiens
ctccagcccctcttggagaa

SEQ ID NO: 785222 - DNA, 19 bp, Homo sapiens
ctccagccccttctcagaa

SEQ ID NO: 785223 - DNA, 21 bp, Homo sapiens
ctccagccccttctcagaatc

SEQ ID NO: 785224 - DNA, 22 bp, Homo sapiens
ctccagccccttctcagaatct

SEQ ID NO: 785225 - DNA, 16 bp, Homo sapiens
ctccagcccgcagcac

SEQ ID NO: 785226 - DNA, 19 bp, Homo sapiens
ctccagcccgggagcctag

SEQ ID NO: 785227 - DNA, 22 bp, Homo sapiens
ctccagcccgggagcctaggac

SEQ ID NO: 785228 - DNA, 15 bp, Homo sapiens
ctccagcccttcaga

SEQ ID NO: 785229 - DNA, 19 bp, Homo sapiens
ctccagcccttcagacgag

SEQ ID NO: 785230 - DNA, 23 bp, Homo sapiens
ctccagcctccccaccccagtgg

SEQ ID NO: 785231 - DNA, 15 bp, Homo sapiens
ctccagcctccctgt

SEQ ID NO: 785232 - DNA, 17 bp, Homo sapiens
ctccagcctccctgtct

SEQ ID NO: 785233 - DNA, 18 bp, Homo sapiens
ctccagcctccctgtctc

SEQ ID NO: 785234 - DNA, 12 bp, Homo sapiens
ctccagcctctc

SEQ ID NO: 785235 - DNA, 19 bp, Homo sapiens
ctccagcctctcccggctg

SEQ ID NO: 785236 - DNA, 21 bp, Homo sapiens
ctccagcctctcccggctgcc

SEQ ID NO: 785237 - DNA, 11 bp, Homo sapiens
ctccagcctga

SEQ ID NO: 785238 - DNA, 12 bp, Homo sapiens
ctccagcctgaa

SEQ ID NO: 785239 - DNA, 14 bp, Homo sapiens
ctccagcctgagca

SEQ ID NO: 785240 - DNA, 19 bp, Homo sapiens
ctccagcctgcctggcagg

SEQ ID NO: 785241 - DNA, 21 bp, Homo sapiens
ctccagcctgggtgacagagc

SEQ ID NO: 785242 - DNA, 22 bp, Homo sapiens
ctccagcggccctgtcatccag

SEQ ID NO: 785243 - DNA, 10 bp, Homo sapiens
ctccagctca

SEQ ID NO: 785244 - DNA, 16 bp, Homo sapiens
ctccagctcagaaccc

SEQ ID NO: 785245 - DNA, 24 bp, Homo sapiens
ctccagctcagaacccagggctct

SEQ ID NO: 785246 - DNA, 21 bp, Homo sapiens
ctccagctctggcttcctgct

SEQ ID NO: 785247 - DNA, 13 bp, Homo sapiens
ctccagctgcccc

SEQ ID NO: 785248 - DNA, 16 bp, Homo sapiens
ctccagctgcctgggc

SEQ ID NO: 785249 - DNA, 17 bp, Homo sapiens
ctccagctgcctgggcc

SEQ ID NO: 785250 - DNA, 18 bp, Homo sapiens
ctccagctgcctgggccc

SEQ ID NO: 785251 - DNA, 15 bp, Homo sapiens
ctccagctgggctct

SEQ ID NO: 785252 - DNA, 21 bp, Homo sapiens
ctccagctgtactagtgccat

SEQ ID NO: 785253 - DNA, 15 bp, Homo sapiens
ctccagctgtcgtct

SEQ ID NO: 785254 - DNA, 13 bp, Homo sapiens
ctccagctgttca

SEQ ID NO: 785255 - DNA, 14 bp, Homo sapiens
ctccagcttcagct

SEQ ID NO: 785256 - DNA, 23 bp, Homo sapiens
ctccagctttaagggttgtgagc

SEQ ID NO: 785257 - DNA, 19 bp, Homo sapiens
ctccagcttttcctcaggg

SEQ ID NO: 785258 - DNA, 22 bp, Homo sapiens
ctccaggaaagagcagtcagag

SEQ ID NO: 785259 - DNA, 12 bp, Homo sapiens
ctccaggaacca

SEQ ID NO: 785260 - DNA, 15 bp, Homo sapiens
ctccaggaagaaaga

SEQ ID NO: 785261 - DNA, 17 bp, Homo sapiens
ctccaggaggggcctgg

SEQ ID NO: 785262 - DNA, 20 bp, Homo sapiens
ctccaggaggggcctgggca

SEQ ID NO: 785263 - DNA, 19 bp, Homo sapiens
ctccaggatttataaagca

SEQ ID NO: 785264 - DNA, 18 bp, Homo sapiens
ctccaggattttaatttc

SEQ ID NO: 785265 - DNA, 16 bp, Homo sapiens
ctccaggcacccttct

SEQ ID NO: 785266 - DNA, 20 bp, Homo sapiens
ctccaggcacccttctttcc

SEQ ID NO: 785267 - DNA, 22 bp, Homo sapiens
ctccaggcatttagccctcaca

SEQ ID NO: 785268 - DNA, 11 bp, Homo sapiens
ctccaggccca

SEQ ID NO: 785269 - DNA, 12 bp, Homo sapiens
ctccaggcccaa

SEQ ID NO: 785270 - DNA, 16 bp, Homo sapiens
ctccaggcccaaggct

SEQ ID NO: 785271 - DNA, 18 bp, Homo sapiens
ctccaggccctcctctcc

SEQ ID NO: 785272 - DNA, 20 bp, Homo sapiens
ctccaggccctcctctccca

SEQ ID NO: 785273 - DNA, 22 bp, Homo sapiens
ctccaggcctgcagcaggagtg

SEQ ID NO: 785274 - DNA, 14 bp, Homo sapiens
ctccaggcctgcct

SEQ ID NO: 785275 - DNA, 17 bp, Homo sapiens
ctccaggcctgcctccc

SEQ ID NO: 785276 - DNA, 22 bp, Homo sapiens
ctccaggcctgcctcccacttc

SEQ ID NO: 785277 - DNA, 14 bp, Homo sapiens
ctccaggcgccggc

SEQ ID NO: 785278 - DNA, 15 bp, Homo sapiens
ctccagggagcaaga

SEQ ID NO: 785279 - DNA, 18 bp, Homo sapiens
ctccagggagcaagacag

SEQ ID NO: 785280 - DNA, 19 bp, Homo sapiens
ctccagggagcaagacaga

SEQ ID NO: 785281 - DNA, 22 bp, Homo sapiens
ctccagggagcaagacagagac

SEQ ID NO: 785282 - DNA, 18 bp, Homo sapiens
ctccagggagtcccctcc

SEQ ID NO: 785283 - DNA, 22 bp, Homo sapiens
ctccagggatgattcaagccat

SEQ ID NO: 785284 - DNA, 23 bp, Homo sapiens
ctccagggccacgtgccaggccc

SEQ ID NO: 785285 - DNA, 17 bp, Homo sapiens
ctccagggcccccaccg

SEQ ID NO: 785286 - DNA, 14 bp, Homo sapiens
ctccaggggcacct

SEQ ID NO: 785287 - DNA, 21 bp, Homo sapiens
ctccaggggctgcttcctcct

SEQ ID NO: 785288 - DNA, 16 bp, Homo sapiens
ctccagggtcccctgc

SEQ ID NO: 785289 - DNA, 17 bp, Homo sapiens
ctccagggtcccctgcc

SEQ ID NO: 785290 - DNA, 20 bp, Homo sapiens
ctccagggtcccctgccacc

SEQ ID NO: 785291 - DNA, 21 bp, Homo sapiens
ctccagggtcccctgccaccg

SEQ ID NO: 785292 - DNA, 16 bp, Homo sapiens
ctccagggtcttgggc

SEQ ID NO: 785293 - DNA, 18 bp, Homo sapiens
ctccagggtcttgggcta

SEQ ID NO: 785294 - DNA, 23 bp, Homo sapiens
ctccagggtcttgggctactggc

SEQ ID NO: 785295 - DNA, 22 bp, Homo sapiens
ctccaggtcctctacttaatga

SEQ ID NO: 785296 - DNA, 14 bp, Homo sapiens
ctccaggtggctct

SEQ ID NO: 785297 - DNA, 18 bp, Homo sapiens
ctccaggttcaagtgatt

SEQ ID NO: 785298 - DNA, 16 bp, Homo sapiens
ctccagtaccttgctt

SEQ ID NO: 785299 - DNA, 16 bp, Homo sapiens
ctccagtagctcctgg

SEQ ID NO: 785300 - DNA, 14 bp, Homo sapiens
ctccagtcacactc

SEQ ID NO: 785301 - DNA, 15 bp, Homo sapiens
ctccagtcacactcc

SEQ ID NO: 785302 - DNA, 14 bp, Homo sapiens
ctccagtcatggta

SEQ ID NO: 785303 - DNA, 23 bp, Homo sapiens
ctccagtcatggtactaccccag

SEQ ID NO: 785304 - DNA, 18 bp, Homo sapiens
ctccagtcgttatttctg

SEQ ID NO: 785305 - DNA, 19 bp, Homo sapiens
ctccagtctgatctgtgaa

SEQ ID NO: 785306 - DNA, 14 bp, Homo sapiens
ctcccacccccagc

SEQ ID NO: 785307 - DNA, 19 bp, Homo sapiens
ctcccacccccatctctcc

SEQ ID NO: 785308 - DNA, 22 bp, Homo sapiens
ctcccacccccttctctgctcc

SEQ ID NO: 785309 - DNA, 16 bp, Homo sapiens
ctcccaccccggcctc

SEQ ID NO: 785310 - DNA, 18 bp, Homo sapiens
ctcccaccccggcctcca

SEQ ID NO: 785311 - DNA, 15 bp, Homo sapiens
ctcccacccggccac

SEQ ID NO: 785312 - DNA, 18 bp, Homo sapiens
ctcccacccggccacagc

SEQ ID NO: 785313 - DNA, 19 bp, Homo sapiens
ctcccacccggccacagct

SEQ ID NO: 785314 - DNA, 21 bp, Homo sapiens
ctcccacccggccacagctgc

SEQ ID NO: 785315 - DNA, 22 bp, Homo sapiens
ctcccacccggccacagctgct

SEQ ID NO: 785316 - DNA, 21 bp, Homo sapiens
ctcccaccctaagggcagccc

SEQ ID NO: 785317 - DNA, 20 bp, Homo sapiens
ctcccaccctgcgggccagg

SEQ ID NO: 785318 - DNA, 16 bp, Homo sapiens
ctcccaccgcccccac

SEQ ID NO: 785319 - DNA, 18 bp, Homo sapiens
ctcccacctagcagcacc

SEQ ID NO: 785320 - DNA, 14 bp, Homo sapiens
ctcccacctagtgc

SEQ ID NO: 785321 - DNA, 15 bp, Homo sapiens
ctcccacctagtgcc

SEQ ID NO: 785322 - DNA, 18 bp, Homo sapiens
ctcccacctagtgcccca

SEQ ID NO: 785323 - DNA, 19 bp, Homo sapiens
ctcccacctagtgccccag

SEQ ID NO: 785324 - DNA, 20 bp, Homo sapiens
ctcccacctagtgccccaga

SEQ ID NO: 785325 - DNA, 12 bp, Homo sapiens
ctcccacctccc

SEQ ID NO: 785326 - DNA, 13 bp, Homo sapiens
ctcccacctccct

SEQ ID NO: 785327 - DNA, 20 bp, Homo sapiens
ctcccacctgacacaccagg

SEQ ID NO: 785328 - DNA, 21 bp, Homo sapiens
ctcccacctgacacaccaggc

SEQ ID NO: 785329 - DNA, 21 bp, Homo sapiens
ctcccacgcctgtcctcctgg

SEQ ID NO: 785330 - DNA, 14 bp, Homo sapiens
ctcccacgtgggag

SEQ ID NO: 785331 - DNA, 21 bp, Homo sapiens
ctcccacgtgggagacaagaa

SEQ ID NO: 785332 - DNA, 14 bp, Homo sapiens
ctcccactcccatc

SEQ ID NO: 785333 - DNA, 17 bp, Homo sapiens
ctcccactcccatctcc

SEQ ID NO: 785334 - DNA, 18 bp, Homo sapiens
ctcccactcccatctcct

SEQ ID NO: 785335 - DNA, 13 bp, Homo sapiens
ctcccactgcagc

SEQ ID NO: 785336 - DNA, 11 bp, Homo sapiens
ctcccactggg

SEQ ID NO: 785337 - DNA, 12 bp, Homo sapiens
ctcccactggga

SEQ ID NO: 785338 - DNA, 13 bp, Homo sapiens
ctcccactgggac

SEQ ID NO: 785339 - DNA, 21 bp, Homo sapiens
ctcccactgggactcccagca

SEQ ID NO: 785340 - DNA, 23 bp, Homo sapiens
ctcccactggggtccagggagca

SEQ ID NO: 785341 - DNA, 13 bp, Homo sapiens
ctcccacttccca

SEQ ID NO: 785342 - DNA, 20 bp, Homo sapiens
ctcccacttcctcctacctg

SEQ ID NO: 785343 - DNA, 17 bp, Homo sapiens
ctcccactttgtctgta

SEQ ID NO: 785344 - DNA, 19 bp, Homo sapiens
ctcccactttgtctgtaca

SEQ ID NO: 785345 - DNA, 20 bp, Homo sapiens
ctcccactttgtctgtacat

SEQ ID NO: 785346 - DNA, 23 bp, Homo sapiens
ctcccactttgtctgtacatact

SEQ ID NO: 785347 - DNA, 22 bp, Homo sapiens
ctcccagaaaaactggctctga

SEQ ID NO: 785348 - DNA, 16 bp, Homo sapiens
ctcccagaaacatctc

SEQ ID NO: 785349 - DNA, 20 bp, Homo sapiens
ctcccagaaacatctctggc

SEQ ID NO: 785350 - DNA, 19 bp, Homo sapiens
ctcccagaactattctggg

SEQ ID NO: 785351 - DNA, 15 bp, Homo sapiens
ctcccagaatcccag

SEQ ID NO: 785352 - DNA, 13 bp, Homo sapiens
ctcccagacaggc

SEQ ID NO: 785353 - DNA, 19 bp, Homo sapiens
ctcccagaggagccaccag

SEQ ID NO: 785354 - DNA, 21 bp, Homo sapiens
ctcccagaggagccaccagtt

SEQ ID NO: 785355 - DNA, 23 bp, Homo sapiens
ctcccagaggagccaccagttct

SEQ ID NO: 785356 - DNA, 20 bp, Homo sapiens
ctcccagaggtccagcccat

SEQ ID NO: 785357 - DNA, 21 bp, Homo sapiens
ctcccagaggtccagcccatc

SEQ ID NO: 785358 - DNA, 17 bp, Homo sapiens
ctcccagagtgctggga

SEQ ID NO: 785359 - DNA, 22 bp, Homo sapiens
ctcccagagtgctgggattaca

SEQ ID NO: 785360 - DNA, 23 bp, Homo sapiens
ctcccagcaagacctcatctgtg

SEQ ID NO: 785361 - DNA, 19 bp, Homo sapiens
ctcccagcactgcctcctg

SEQ ID NO: 785362 - DNA, 18 bp, Homo sapiens
ctcccagccctatggatg

SEQ ID NO: 785363 - DNA, 20 bp, Homo sapiens
ctcccagcctgctgagagcc

SEQ ID NO: 785364 - DNA, 18 bp, Homo sapiens
ctcccagcggcctccggc

SEQ ID NO: 785365 - DNA, 19 bp, Homo sapiens
ctcccagctcctttctcct

SEQ ID NO: 785366 - DNA, 20 bp, Homo sapiens
ctcccagctcctttctcctg

SEQ ID NO: 785367 - DNA, 18 bp, Homo sapiens
ctcccagctctagacaac

SEQ ID NO: 785368 - DNA, 13 bp, Homo sapiens
ctcccagctgcac

SEQ ID NO: 785369 - DNA, 12 bp, Homo sapiens
ctcccagctgct

SEQ ID NO: 785370 - DNA, 14 bp, Homo sapiens
ctcccagctgtgct

SEQ ID NO: 785371 - DNA, 19 bp, Homo sapiens
ctcccagctgtgctgtgga

SEQ ID NO: 785372 - DNA, 19 bp, Homo sapiens
ctcccagcttgtaggagct

SEQ ID NO: 785373 - DNA, 11 bp, Homo sapiens
ctcccaggaac

SEQ ID NO: 785374 - DNA, 23 bp, Homo sapiens
ctcccaggaaccgaacatatcat

SEQ ID NO: 785375 - DNA, 15 bp, Homo sapiens
ctcccaggacaagca

SEQ ID NO: 785376 - DNA, 16 bp, Homo sapiens
ctcccaggacaagcac

SEQ ID NO: 785377 - DNA, 11 bp, Homo sapiens
ctcccaggcaa

SEQ ID NO: 785378 - DNA, 15 bp, Homo sapiens
ctcccaggccccctg

SEQ ID NO: 785379 - DNA, 12 bp, Homo sapiens
ctcccaggctct

SEQ ID NO: 785380 - DNA, 12 bp, Homo sapiens
ctcccaggctgc

SEQ ID NO: 785381 - DNA, 15 bp, Homo sapiens
ctcccaggctgctgg

SEQ ID NO: 785382 - DNA, 18 bp, Homo sapiens
ctcccaggctgctggagt

SEQ ID NO: 785383 - DNA, 15 bp, Homo sapiens
ctcccaggctggagt

SEQ ID NO: 785384 - DNA, 14 bp, Homo sapiens
ctcccagggagtga

SEQ ID NO: 785385 - DNA, 15 bp, Homo sapiens
ctcccagggagtgag

SEQ ID NO: 785386 - DNA, 15 bp, Homo sapiens
ctcctccaggcctgc

SEQ ID NO: 785387 - DNA, 11 bp, Homo sapiens
ctcctccaggg

SEQ ID NO: 785388 - DNA, 22 bp, Homo sapiens
ctcctccagtacgtcccgctgc

SEQ ID NO: 785389 - DNA, 16 bp, Homo sapiens
ctcctccatcacctga

SEQ ID NO: 785390 - DNA, 15 bp, Homo sapiens
ctcctccattttcct

SEQ ID NO: 785391 - DNA, 9 bp, Homo sapiens
ctcctccca

SEQ ID NO: 785392 - DNA, 20 bp, Homo sapiens
ctcctcccacccggctgcag

SEQ ID NO: 785393 - DNA, 17 bp, Homo sapiens
ctcctcccactgggact

SEQ ID NO: 785394 - DNA, 14 bp, Homo sapiens
ctcctcccacttct

SEQ ID NO: 785395 - DNA, 12 bp, Homo sapiens
ctcctcccagga

SEQ ID NO: 785396 - DNA, 13 bp, Homo sapiens
ctcctcccagggc

SEQ ID NO: 785397 - DNA, 14 bp, Homo sapiens
ctcctccccacctg

SEQ ID NO: 785398 - DNA, 19 bp, Homo sapiens
ctcctccccacctgtagct

SEQ ID NO: 785399 - DNA, 10 bp, Homo sapiens
ctcctccccc

SEQ ID NO: 785400 - DNA, 14 bp, Homo sapiens
ctcctcccccagtg

SEQ ID NO: 785401 - DNA, 23 bp, Homo sapiens
ctcctcccccggctgggcctcct

SEQ ID NO: 785402 - DNA, 11 bp, Homo sapiens
ctcctccccct

SEQ ID NO: 785403 - DNA, 16 bp, Homo sapiens
ctcctccccctgttct

SEQ ID NO: 785404 - DNA, 19 bp, Homo sapiens
ctcctccccctttggggta

SEQ ID NO: 785405 - DNA, 13 bp, Homo sapiens
ctcctccccgatc

SEQ ID NO: 785406 - DNA, 14 bp, Homo sapiens
ctcctcccctcctc

SEQ ID NO: 785407 - DNA, 15 bp, Homo sapiens
ctcctcccggtgccc

SEQ ID NO: 785408 - DNA, 10 bp, Homo sapiens
ctcctccctc

SEQ ID NO: 785409 - DNA, 18 bp, Homo sapiens
ctcctccctccaagcctg

SEQ ID NO: 785410 - DNA, 22 bp, Homo sapiens
ctcctccctccaagcctggcac

SEQ ID NO: 785411 - DNA, 14 bp, Homo sapiens
ctcctccctcccag

SEQ ID NO: 785412 - DNA, 15 bp, Homo sapiens
ctcctccctcccagc

SEQ ID NO: 785413 - DNA, 16 bp, Homo sapiens
ctcctccctcccagct

SEQ ID NO: 785414 - DNA, 21 bp, Homo sapiens
ctcctccctcccagctgcact

SEQ ID NO: 785415 - DNA, 23 bp, Homo sapiens
ctcctccctcccagctgcacttt

SEQ ID NO: 785416 - DNA, 14 bp, Homo sapiens
ctcctccctcctgc

SEQ ID NO: 785417 - DNA, 14 bp, Homo sapiens
ctcctccctgcatc

SEQ ID NO: 785418 - DNA, 18 bp, Homo sapiens
ctcctccctgcatctgac

SEQ ID NO: 785419 - DNA, 14 bp, Homo sapiens
ctcctccctgcccc

SEQ ID NO: 785420 - DNA, 16 bp, Homo sapiens
ctcctccctgcccccc

SEQ ID NO: 785421 - DNA, 20 bp, Homo sapiens
ctcctccctgccccccaagg

SEQ ID NO: 785422 - DNA, 20 bp, Homo sapiens
ctcctccctgctcctcatgg

SEQ ID NO: 785423 - DNA, 21 bp, Homo sapiens
ctcctccctggctgccctggc

SEQ ID NO: 785424 - DNA, 22 bp, Homo sapiens
ctcctccctggctgccctggcc

SEQ ID NO: 785425 - DNA, 13 bp, Homo sapiens
ctcctccctgggc

SEQ ID NO: 785426 - DNA, 15 bp, Homo sapiens
ctcctcccttccttt

SEQ ID NO: 785427 - DNA, 15 bp, Homo sapiens
ctcctccgcctgtgt

SEQ ID NO: 785428 - DNA, 16 bp, Homo sapiens
ctcctccgcctgtgtc

SEQ ID NO: 785429 - DNA, 17 bp, Homo sapiens
ctcctccgcctgtgtcc

SEQ ID NO: 785430 - DNA, 22 bp, Homo sapiens
ctcctccgcctgtgtccatctg

SEQ ID NO: 785431 - DNA, 12 bp, Homo sapiens
ctcctccgtctg

SEQ ID NO: 785432 - DNA, 15 bp, Homo sapiens
ctcctcctcccccag

SEQ ID NO: 785433 - DNA, 14 bp, Homo sapiens
ctcctcctcccctc

SEQ ID NO: 785434 - DNA, 15 bp, Homo sapiens
ctcctcctccctgca

SEQ ID NO: 785435 - DNA, 12 bp, Homo sapiens
ctcctcctcgga

SEQ ID NO: 785436 - DNA, 11 bp, Homo sapiens
ctcctcctctc

SEQ ID NO: 785437 - DNA, 14 bp, Homo sapiens
ctcctcctctttct

SEQ ID NO: 785438 - DNA, 12 bp, Homo sapiens
ctcctcctgccc

SEQ ID NO: 785439 - DNA, 16 bp, Homo sapiens
ctcctcctgccctgtc

SEQ ID NO: 785440 - DNA, 17 bp, Homo sapiens
ctcctcctgggggctgg

SEQ ID NO: 785441 - DNA, 13 bp, Homo sapiens
ctcctccttccca

SEQ ID NO: 785442 - DNA, 16 bp, Homo sapiens
ctcctccttcccaggg

SEQ ID NO: 785443 - DNA, 11 bp, Homo sapiens
ctcctcctttt

SEQ ID NO: 785444 - DNA, 15 bp, Homo sapiens
ctcctcctttttcca

SEQ ID NO: 785445 - DNA, 12 bp, Homo sapiens
ctcctcgagccc

SEQ ID NO: 785446 - DNA, 14 bp, Homo sapiens
ctcctcgagccctc

SEQ ID NO: 785447 - DNA, 19 bp, Homo sapiens
ctcctcgagccctccccca

SEQ ID NO: 785448 - DNA, 19 bp, Homo sapiens
ctcctcggagagcagcagc

SEQ ID NO: 785449 - DNA, 18 bp, Homo sapiens
ctcctcggccccctccat

SEQ ID NO: 785450 - DNA, 19 bp, Homo sapiens
ctcctcggccccctccatc

SEQ ID NO: 785451 - DNA, 14 bp, Homo sapiens
ctcctctacctctc

SEQ ID NO: 785452 - DNA, 17 bp, Homo sapiens
ctcctctagctgtgggg

SEQ ID NO: 785453 - DNA, 18 bp, Homo sapiens
ctcctctcaactgcctca

SEQ ID NO: 785454 - DNA, 23 bp, Homo sapiens
ctcctctcatcatttgcattggg

SEQ ID NO: 785455 - DNA, 13 bp, Homo sapiens
ctcctctccatgc

SEQ ID NO: 785456 - DNA, 18 bp, Homo sapiens
ctcctctccatgcacagt

SEQ ID NO: 785457 - DNA, 20 bp, Homo sapiens
ctcctctccattttagccca

SEQ ID NO: 785458 - DNA, 13 bp, Homo sapiens
ctcctctcccatc

SEQ ID NO: 785459 - DNA, 15 bp, Homo sapiens
ctcctctcccatccc

SEQ ID NO: 785460 - DNA, 23 bp, Homo sapiens
ctcctctcccatccccctgccct

SEQ ID NO: 785461 - DNA, 22 bp, Homo sapiens
ctcctctccttgggctcctggc

SEQ ID NO: 785462 - DNA, 16 bp, Homo sapiens
ctcctctcgcacaatg

SEQ ID NO: 785463 - DNA, 12 bp, Homo sapiens
ctcctctctgaa

SEQ ID NO: 785464 - DNA, 13 bp, Homo sapiens
ctcctctctgaag

SEQ ID NO: 785465 - DNA, 12 bp, Homo sapiens
ctcctctctgcc

SEQ ID NO: 785466 - DNA, 12 bp, Homo sapiens
ctcctctctgct

SEQ ID NO: 785467 - DNA, 19 bp, Homo sapiens
ctcctctgactcagggctc

SEQ ID NO: 785468 - DNA, 13 bp, Homo sapiens
ctcctctgagcca

SEQ ID NO: 785469 - DNA, 14 bp, Homo sapiens
ctcctctgaggaag

SEQ ID NO: 785470 - DNA, 12 bp, Homo sapiens
ctcctctgcact

SEQ ID NO: 785471 - DNA, 13 bp, Homo sapiens
ctcctctgcactc

SEQ ID NO: 785472 - DNA, 16 bp, Homo sapiens
ctcctctgcagtgcct

SEQ ID NO: 785473 - DNA, 15 bp, Homo sapiens
ctcctctgccacctc

SEQ ID NO: 785474 - DNA, 14 bp, Homo sapiens
ctcctctgccttgg

SEQ ID NO: 785475 - DNA, 16 bp, Homo sapiens
ctcctctgctgacctg

SEQ ID NO: 785476 - DNA, 17 bp, Homo sapiens
ctcctctggcaggcttc

SEQ ID NO: 785477 - DNA, 18 bp, Homo sapiens
ctcctctggcaggcttcc

SEQ ID NO: 785478 - DNA, 17 bp, Homo sapiens
ctcctctggctttccca

SEQ ID NO: 785479 - DNA, 22 bp, Homo sapiens
ctcctctggctttcccaggaga

SEQ ID NO: 785480 - DNA, 12 bp, Homo sapiens
ctcctctgggca

SEQ ID NO: 785481 - DNA, 13 bp, Homo sapiens
ctcctctgggcct

SEQ ID NO: 785482 - DNA, 15 bp, Homo sapiens
ctcctctgggcctgg

SEQ ID NO: 785483 - DNA, 18 bp, Homo sapiens
ctcctctgggcctggggt

SEQ ID NO: 785484 - DNA, 14 bp, Homo sapiens
ctcctctgtccagg

SEQ ID NO: 785485 - DNA, 22 bp, Homo sapiens
ctcctctgtgaccaatgtcttg

SEQ ID NO: 785486 - DNA, 20 bp, Homo sapiens
ctcctcttaaaaaataaaaa

SEQ ID NO: 785487 - DNA, 21 bp, Homo sapiens
ctcctcttaaaaaataaaaac

SEQ ID NO: 785488 - DNA, 23 bp, Homo sapiens
ctcctcttaaaaaataaaaactg

SEQ ID NO: 785489 - DNA, 21 bp, Homo sapiens
ctcctcttaccgtagcctccg

SEQ ID NO: 785490 - DNA, 20 bp, Homo sapiens
ctcctcttcccttagcctct

SEQ ID NO: 785491 - DNA, 23 bp, Homo sapiens
ctcctcttcccttagcctctccc

SEQ ID NO: 785492 - DNA, 22 bp, Homo sapiens
ctcctcttggtgggtgtggcca

SEQ ID NO: 785493 - DNA, 21 bp, Homo sapiens
ctcctcttgtaaataaagccc

SEQ ID NO: 785494 - DNA, 13 bp, Homo sapiens
ctcctctttctct

SEQ ID NO: 785495 - DNA, 21 bp, Homo sapiens
ctcctgaaacccaaagccctg

SEQ ID NO: 785496 - DNA, 20 bp, Homo sapiens
ctcctgaaatgccaagtgcc

SEQ ID NO: 785497 - DNA, 18 bp, Homo sapiens
ctcctgaaccgcacagct

SEQ ID NO: 785498 - DNA, 16 bp, Homo sapiens
ctcctgaagcctctgc

SEQ ID NO: 785499 - DNA, 23 bp, Homo sapiens
ctcctgaagggaaggcaaaggca

SEQ ID NO: 785500 - DNA, 21 bp, Homo sapiens
ctcctgaattcagttgctttg

SEQ ID NO: 785501 - DNA, 19 bp, Homo sapiens
ctcctgacagaaggtgcca

SEQ ID NO: 785502 - DNA, 20 bp, Homo sapiens
ctcctgggaaacctgccttt

SEQ ID NO: 785503 - DNA, 14 bp, Homo sapiens
ctcctgggaacaca

SEQ ID NO: 785504 - DNA, 22 bp, Homo sapiens
ctcctgggaacacatctggctg

SEQ ID NO: 785505 - DNA, 17 bp, Homo sapiens
ctcctgggacccttggc

SEQ ID NO: 785506 - DNA, 21 bp, Homo sapiens
ctcctgggcagccgttttcct

SEQ ID NO: 785507 - DNA, 12 bp, Homo sapiens
ctcctgggccct

SEQ ID NO: 785508 - DNA, 14 bp, Homo sapiens
ctcctgggccctct

SEQ ID NO: 785509 - DNA, 15 bp, Homo sapiens
ctcctgggccctctc

SEQ ID NO: 785510 - DNA, 17 bp, Homo sapiens
ctcctgggccctctctg

SEQ ID NO: 785511 - DNA, 14 bp, Homo sapiens
ctcctgggctcaag

SEQ ID NO: 785512 - DNA, 14 bp, Homo sapiens
ctcctgggctctga

SEQ ID NO: 785513 - DNA, 17 bp, Homo sapiens
ctcctgggctctgaaca

SEQ ID NO: 785514 - DNA, 20 bp, Homo sapiens
ctcctgggctctgaacacac

SEQ ID NO: 785515 - DNA, 17 bp, Homo sapiens
ctcctgggcttaaggcc

SEQ ID NO: 785516 - DNA, 23 bp, Homo sapiens
ctcctgggcttaaggcctaagga

SEQ ID NO: 785517 - DNA, 20 bp, Homo sapiens
ctcctggggagaaagagggg

SEQ ID NO: 785518 - DNA, 15 bp, Homo sapiens
ctcctggggagctcc

SEQ ID NO: 785519 - DNA, 17 bp, Homo sapiens
ctcctggggagctcctg

SEQ ID NO: 785520 - DNA, 20 bp, Homo sapiens
ctcctggggagctcctggga

SEQ ID NO: 785521 - DNA, 21 bp, Homo sapiens
ctcctggggagctcctgggac

SEQ ID NO: 785522 - DNA, 15 bp, Homo sapiens
ctcctggggcagaga

SEQ ID NO: 785523 - DNA, 23 bp, Homo sapiens
ctcctgggggctggctcccaggg

SEQ ID NO: 785524 - DNA, 18 bp, Homo sapiens
ctcctgggggtggcaggc

SEQ ID NO: 785525 - DNA, 19 bp, Homo sapiens
ctcctgggggtggcaggca

SEQ ID NO: 785526 - DNA, 21 bp, Homo sapiens
ctcctgggggtggcaggcaca

SEQ ID NO: 785527 - DNA, 23 bp, Homo sapiens
ctcctgggttttgtattctctga

SEQ ID NO: 785528 - DNA, 22 bp, Homo sapiens
ctcctggtcctggacacctccc

SEQ ID NO: 785529 - DNA, 24 bp, Homo sapiens
ctcctggtcctggacacctcccag

SEQ ID NO: 785530 - DNA, 15 bp, Homo sapiens
ctcctggtcttgaga

SEQ ID NO: 785531 - DNA, 21 bp, Homo sapiens
ctcctggtgcccacagcaggg

SEQ ID NO: 785532 - DNA, 20 bp, Homo sapiens
ctcctgtaacatactggcct

SEQ ID NO: 785533 - DNA, 17 bp, Homo sapiens
ctcctgtacctcagtgg

SEQ ID NO: 785534 - DNA, 18 bp, Homo sapiens
ctcctgtacctcagtgga

SEQ ID NO: 785535 - DNA, 21 bp, Homo sapiens
ctcctgtacctcagtggatct

SEQ ID NO: 785536 - DNA, 19 bp, Homo sapiens
ctcctgtacttgtcctcag

SEQ ID NO: 785537 - DNA, 21 bp, Homo sapiens
ctcctgtacttgtcctcagct

SEQ ID NO: 785538 - DNA, 22 bp, Homo sapiens
ctcctgtacttgtcctcagctt

SEQ ID NO: 785539 - DNA, 16 bp, Homo sapiens
ctcctgtcactcactg

SEQ ID NO: 785540 - DNA, 20 bp, Homo sapiens
ctcctgtcactcactgaggc

SEQ ID NO: 785541 - DNA, 23 bp, Homo sapiens
ctcctgtcactcactgaggccat

SEQ ID NO: 785542 - DNA, 14 bp, Homo sapiens
ctcctgtccaacct

SEQ ID NO: 785543 - DNA, 20 bp, Homo sapiens
ctcctgtccatcagccagga

SEQ ID NO: 785544 - DNA, 13 bp, Homo sapiens
ctcctgtcccgcc

SEQ ID NO: 785545 - DNA, 14 bp, Homo sapiens
ctcctgtccctgta

SEQ ID NO: 785546 - DNA, 16 bp, Homo sapiens
ctcctgtctgccagcc

SEQ ID NO: 785547 - DNA, 16 bp, Homo sapiens
ctcctgtgcatgggtg

SEQ ID NO: 785548 - DNA, 17 bp, Homo sapiens
ctcctgtgcatgggtga

SEQ ID NO: 785549 - DNA, 20 bp, Homo sapiens
ctcctgtgccccagctgcca

SEQ ID NO: 785550 - DNA, 22 bp, Homo sapiens
ctcctgtgccccagctgccagg

SEQ ID NO: 785551 - DNA, 23 bp, Homo sapiens
ctcctgtgccccagctgccaggc

SEQ ID NO: 785552 - DNA, 11 bp, Homo sapiens
ctcctgtgcta

SEQ ID NO: 785553 - DNA, 14 bp, Homo sapiens
ctcctgtgctctgg

SEQ ID NO: 785554 - DNA, 21 bp, Homo sapiens
ctcctgtgctctggaggctgc

SEQ ID NO: 785555 - DNA, 13 bp, Homo sapiens
ctcctgtgctggg

SEQ ID NO: 785556 - DNA, 22 bp, Homo sapiens
ctcctgtggaaggcagagaaat

SEQ ID NO: 785557 - DNA, 15 bp, Homo sapiens
ctcctgtggcaggag

SEQ ID NO: 785558 - DNA, 21 bp, Homo sapiens
ctcctgtggccccaccctggg

SEQ ID NO: 785559 - DNA, 22 bp, Homo sapiens
ctcctgtggccccaccctgggc

SEQ ID NO: 785560 - DNA, 16 bp, Homo sapiens
ctcctgtggggaaagg

SEQ ID NO: 785561 - DNA, 11 bp, Homo sapiens
ctcctgtgtaa

SEQ ID NO: 785562 - DNA, 10 bp, Homo sapiens
ctcctgtgtc

SEQ ID NO: 785563 - DNA, 11 bp, Homo sapiens
ctcctgtgtcg

SEQ ID NO: 785564 - DNA, 22 bp, Homo sapiens
ctcctgtgtcggtcagaacaac

SEQ ID NO: 785565 - DNA, 15 bp, Homo sapiens
ctcctgtgtgcttgt

SEQ ID NO: 785566 - DNA, 16 bp, Homo sapiens
ctcctgttttctccct

SEQ ID NO: 785567 - DNA, 20 bp, Homo sapiens
ctcctgttttctccctctca

SEQ ID NO: 785568 - DNA, 19 bp, Homo sapiens
ctcctgttttgcacagcca

SEQ ID NO: 785569 - DNA, 18 bp, Homo sapiens
ctccttaatttaattgct

SEQ ID NO: 785570 - DNA, 14 bp, Homo sapiens
ctccttacctctgg

SEQ ID NO: 785571 - DNA, 15 bp, Homo sapiens
ctccttacctctgga

SEQ ID NO: 785572 - DNA, 18 bp, Homo sapiens
ctccttacctctggaacc

SEQ ID NO: 785573 - DNA, 17 bp, Homo sapiens
ctccttactctgagccc

SEQ ID NO: 785574 - DNA, 19 bp, Homo sapiens
ctccttactctgagcccag

SEQ ID NO: 785575 - DNA, 20 bp, Homo sapiens
ctccttactctgagcccagg

SEQ ID NO: 785576 - DNA, 13 bp, Homo sapiens
ctccttagaaaaa

SEQ ID NO: 785577 - DNA, 19 bp, Homo sapiens
ctccttagacactttggaa

SEQ ID NO: 785578 - DNA, 21 bp, Homo sapiens
ctccttagagacatcaaaatc

SEQ ID NO: 785579 - DNA, 17 bp, Homo sapiens
ctccttagccctgtctg

SEQ ID NO: 785580 - DNA, 22 bp, Homo sapiens
ctccttagccctgtctgctagg

SEQ ID NO: 785581 - DNA, 16 bp, Homo sapiens
ctccttagtcttctca

SEQ ID NO: 785582 - DNA, 17 bp, Homo sapiens
ctccttagtcttctcat

SEQ ID NO: 785583 - DNA, 22 bp, Homo sapiens
ctccttatcaaaggacaccatt

SEQ ID NO: 785584 - DNA, 21 bp, Homo sapiens
ctccttcaaagaatgaaaggc

SEQ ID NO: 785585 - DNA, 23 bp, Homo sapiens
ctccttcaccctccgttgacagt

SEQ ID NO: 785586 - DNA, 13 bp, Homo sapiens
ctccttcactgtt

SEQ ID NO: 785587 - DNA, 17 bp, Homo sapiens
ctccttcactgttccct

SEQ ID NO: 785588 - DNA, 19 bp, Homo sapiens
ctccttcagacaccctcaa

SEQ ID NO: 785589 - DNA, 14 bp, Homo sapiens
ctccttcaggggag

SEQ ID NO: 785590 - DNA, 10 bp, Homo sapiens
ctccttccac

SEQ ID NO: 785591 - DNA, 15 bp, Homo sapiens
ctccttccacatgta

SEQ ID NO: 785592 - DNA, 13 bp, Homo sapiens
ctccttccattca

SEQ ID NO: 785593 - DNA, 14 bp, Homo sapiens
ctccttccattcag

SEQ ID NO: 785594 - DNA, 13 bp, Homo sapiens
ctccttcccacaa

SEQ ID NO: 785595 - DNA, 12 bp, Homo sapiens
ctccttcccaga

SEQ ID NO: 785596 - DNA, 22 bp, Homo sapiens
ctccttcccagataaggcaagc

SEQ ID NO: 785597 - DNA, 18 bp, Homo sapiens
ctccttcccagggaccag

SEQ ID NO: 785598 - DNA, 18 bp, Homo sapiens
ctccttccccccatctct

SEQ ID NO: 785599 - DNA, 19 bp, Homo sapiens
ctccttccccccatctctg

SEQ ID NO: 785600 - DNA, 14 bp, Homo sapiens
ctctccctgaccct

SEQ ID NO: 785601 - DNA, 20 bp, Homo sapiens
ctctccctgaccctgtatat

SEQ ID NO: 785602 - DNA, 13 bp, Homo sapiens
ctctccctgcact

SEQ ID NO: 785603 - DNA, 21 bp, Homo sapiens
ctctccctgcatcctgaggcc

SEQ ID NO: 785604 - DNA, 14 bp, Homo sapiens
ctctccctgtcaca

SEQ ID NO: 785605 - DNA, 19 bp, Homo sapiens
ctctccctgtcacacactg

SEQ ID NO: 785606 - DNA, 12 bp, Homo sapiens
ctctccctgttg

SEQ ID NO: 785607 - DNA, 15 bp, Homo sapiens
ctctcccttccctcc

SEQ ID NO: 785608 - DNA, 23 bp, Homo sapiens
ctctcccttcccttccctcaccc

SEQ ID NO: 785609 - DNA, 14 bp, Homo sapiens
ctctcccttgaggg

SEQ ID NO: 785610 - DNA, 18 bp, Homo sapiens
ctctccgacttcccctgg

SEQ ID NO: 785611 - DNA, 21 bp, Homo sapiens
ctctccgacttcccctgggca

SEQ ID NO: 785612 - DNA, 16 bp, Homo sapiens
ctctccggggccattt

SEQ ID NO: 785613 - DNA, 13 bp, Homo sapiens
ctctccgtgcagg

SEQ ID NO: 785614 - DNA, 19 bp, Homo sapiens
ctctcctactcggctctgc

SEQ ID NO: 785615 - DNA, 21 bp, Homo sapiens
ctctcctagagacagaagcag

SEQ ID NO: 785616 - DNA, 18 bp, Homo sapiens
ctctcctagcccctctct

SEQ ID NO: 785617 - DNA, 19 bp, Homo sapiens
ctctcctagcccctctctc

SEQ ID NO: 785618 - DNA, 11 bp, Homo sapiens
ctctcctccca

SEQ ID NO: 785619 - DNA, 13 bp, Homo sapiens
ctctcctcccagc

SEQ ID NO: 785620 - DNA, 14 bp, Homo sapiens
ctctcctcccagct

SEQ ID NO: 785621 - DNA, 11 bp, Homo sapiens
ctctcctcccc

SEQ ID NO: 785622 - DNA, 15 bp, Homo sapiens
ctctcctcctcagct

SEQ ID NO: 785623 - DNA, 14 bp, Homo sapiens
ctctcctcctcccc

SEQ ID NO: 785624 - DNA, 17 bp, Homo sapiens
ctctcctcctcccctcc

SEQ ID NO: 785625 - DNA, 21 bp, Homo sapiens
ctctcctcgagccctccccca

SEQ ID NO: 785626 - DNA, 20 bp, Homo sapiens
ctctcctcggccccctccat

SEQ ID NO: 785627 - DNA, 10 bp, Homo sapiens
ctctcctctc

SEQ ID NO: 785628 - DNA, 15 bp, Homo sapiens
ctctcctcttgccac

SEQ ID NO: 785629 - DNA, 13 bp, Homo sapiens
ctctcctgacccc

SEQ ID NO: 785630 - DNA, 16 bp, Homo sapiens
ctctcctgacccctgc

SEQ ID NO: 785631 - DNA, 15 bp, Homo sapiens
ctctcctgccctctg

SEQ ID NO: 785632 - DNA, 16 bp, Homo sapiens
ctctcctgccctctgc

SEQ ID NO: 785633 - DNA, 21 bp, Homo sapiens
ctctcctgccctctgctctgc

SEQ ID NO: 785634 - DNA, 14 bp, Homo sapiens
ctctcctgcctcag

SEQ ID NO: 785635 - DNA, 13 bp, Homo sapiens
ctctcctggccta

SEQ ID NO: 785636 - DNA, 21 bp, Homo sapiens
ctctcctggcctatccgctgc

SEQ ID NO: 785637 - DNA, 23 bp, Homo sapiens
ctctcctggcctatccgctgcca

SEQ ID NO: 785638 - DNA, 17 bp, Homo sapiens
ctctcctggctcggggt

SEQ ID NO: 785639 - DNA, 20 bp, Homo sapiens
ctctcctgggggtggcaggc

SEQ ID NO: 785640 - DNA, 23 bp, Homo sapiens
ctctcctgggggtggcaggcaca

SEQ ID NO: 785641 - DNA, 23 bp, Homo sapiens
ctcttccggagatgtagcaaaac

SEQ ID NO: 785642 - DNA, 19 bp, Homo sapiens
ctcttccgggagctggtga

SEQ ID NO: 785643 - DNA, 20 bp, Homo sapiens
ctcttccgtgacgtcactgg

SEQ ID NO: 785644 - DNA, 17 bp, Homo sapiens
ctcttccgtgcatccca

SEQ ID NO: 785645 - DNA, 12 bp, Homo sapiens
ctcttcctaccc

SEQ ID NO: 785646 - DNA, 20 bp, Homo sapiens
ctcttcctacccaaccactc

SEQ ID NO: 785647 - DNA, 22 bp, Homo sapiens
ctcttcctacccaaccactcaa

SEQ ID NO: 785648 - DNA, 17 bp, Homo sapiens
ctcttcctaccctgcct

SEQ ID NO: 785649 - DNA, 18 bp, Homo sapiens
ctcttcctcatcctgctt

SEQ ID NO: 785650 - DNA, 14 bp, Homo sapiens
ctcttcctcccctc

SEQ ID NO: 785651 - DNA, 20 bp, Homo sapiens
ctcttcctctaacatttttg

SEQ ID NO: 785652 - DNA, 16 bp, Homo sapiens
ctcttcctctgggcag

SEQ ID NO: 785653 - DNA, 13 bp, Homo sapiens
ctcttcctctggt

SEQ ID NO: 785654 - DNA, 14 bp, Homo sapiens
ctcttcctgcaagg

SEQ ID NO: 785655 - DNA, 12 bp, Homo sapiens
ctcttcctgccc

SEQ ID NO: 785656 - DNA, 17 bp, Homo sapiens
ctcttcctgcccctctt

SEQ ID NO: 785657 - DNA, 20 bp, Homo sapiens
ctcttcctgcccctctttct

SEQ ID NO: 785658 - DNA, 12 bp, Homo sapiens
ctcttcctgtcc

SEQ ID NO: 785659 - DNA, 13 bp, Homo sapiens
ctcttcctgtcct

SEQ ID NO: 785660 - DNA, 18 bp, Homo sapiens
ctcttcctgtctggcttc

SEQ ID NO: 785661 - DNA, 23 bp, Homo sapiens
ctcttccttgaagaactgcaggc

SEQ ID NO: 785662 - DNA, 16 bp, Homo sapiens
ctcttccttttatcag

SEQ ID NO: 785663 - DNA, 16 bp, Homo sapiens
ctcttcgaagccttgc

SEQ ID NO: 785664 - DNA, 14 bp, Homo sapiens
ctcttcggccctca

SEQ ID NO: 785665 - DNA, 15 bp, Homo sapiens
ctcttcggtttctga

SEQ ID NO: 785666 - DNA, 16 bp, Homo sapiens
ctcttcggtttctgag

SEQ ID NO: 785667 - DNA, 22 bp, Homo sapiens
ctcttctaggcccattgtcctc

SEQ ID NO: 785668 - DNA, 17 bp, Homo sapiens
ctcttctattttgtaaa

SEQ ID NO: 785669 - DNA, 19 bp, Homo sapiens
ctcttctcagctcttccat

SEQ ID NO: 785670 - DNA, 21 bp, Homo sapiens
ctcttctcagctcttccatga

SEQ ID NO: 785671 - DNA, 19 bp, Homo sapiens
ctcttctccactggatgga

SEQ ID NO: 785672 - DNA, 12 bp, Homo sapiens
ctcttctcccag

SEQ ID NO: 785673 - DNA, 14 bp, Homo sapiens
ctcttctcccagaa

SEQ ID NO: 785674 - DNA, 17 bp, Homo sapiens
ctcttctcccagaatcc

SEQ ID NO: 785675 - DNA, 13 bp, Homo sapiens
ctcttctcctttc

SEQ ID NO: 785676 - DNA, 15 bp, Homo sapiens
ctcttctctccagct

SEQ ID NO: 785677 - DNA, 17 bp, Homo sapiens
ctcttctcttgacagtc

SEQ ID NO: 785678 - DNA, 20 bp, Homo sapiens
ctcttctcttgacagtctga

SEQ ID NO: 785679 - DNA, 16 bp, Homo sapiens
ctcttctgacgtgcct

SEQ ID NO: 785680 - DNA, 17 bp, Homo sapiens
ctcttctgagcagaaat

SEQ ID NO: 785681 - DNA, 12 bp, Homo sapiens
ctcttctgagct

SEQ ID NO: 785682 - DNA, 15 bp, Homo sapiens
ctcttctgagctatt

SEQ ID NO: 785683 - DNA, 23 bp, Homo sapiens
ctcttctgagctatttcatctat

SEQ ID NO: 785684 - DNA, 16 bp, Homo sapiens
ctcttctgcatcttgg

SEQ ID NO: 785685 - DNA, 12 bp, Homo sapiens
ctcttctgctcc

SEQ ID NO: 785686 - DNA, 13 bp, Homo sapiens
ctcttctgctcca

SEQ ID NO: 785687 - DNA, 16 bp, Homo sapiens
ctgagaaagcccacct

SEQ ID NO: 785688 - DNA, 19 bp, Homo sapiens
ctgagaaagcccacctggg

SEQ ID NO: 785689 - DNA, 23 bp, Homo sapiens
ctgagaaagcccacctgggctgg

SEQ ID NO: 785690 - DNA, 17 bp, Homo sapiens
ctgagaaataggtatca

SEQ ID NO: 785691 - DNA, 20 bp, Homo sapiens
ctgagaactcgttcacctcc

SEQ ID NO: 785692 - DNA, 14 bp, Homo sapiens
ctgagaagaggagg

SEQ ID NO: 785693 - DNA, 18 bp, Homo sapiens
ctgagaagccccgacaca

SEQ ID NO: 785694 - DNA, 20 bp, Homo sapiens
ctgagaagccccgacacacg

SEQ ID NO: 785695 - DNA, 16 bp, Homo sapiens
ctgagaagctctgaag

SEQ ID NO: 785696 - DNA, 15 bp, Homo sapiens
ctgagaagctgctcc

SEQ ID NO: 785697 - DNA, 21 bp, Homo sapiens
ctgagaagctgctccaggcct

SEQ ID NO: 785698 - DNA, 23 bp, Homo sapiens
ctgagaaggtccttaatgatccg

SEQ ID NO: 785699 - DNA, 23 bp, Homo sapiens
ctgagaaggtttggtccagcctg

SEQ ID NO: 785700 - DNA, 18 bp, Homo sapiens
ctgagaagtcaaacattt

SEQ ID NO: 785701 - DNA, 15 bp, Homo sapiens
ctgagaataagaaag

SEQ ID NO: 785702 - DNA, 15 bp, Homo sapiens
ctgagaatctggggg

SEQ ID NO: 785703 - DNA, 18 bp, Homo sapiens
ctgagaatctgggggtga

SEQ ID NO: 785704 - DNA, 15 bp, Homo sapiens
ctgagaattccaagg

SEQ ID NO: 785705 - DNA, 14 bp, Homo sapiens
ctgagacactgaag

SEQ ID NO: 785706 - DNA, 14 bp, Homo sapiens
ctgagacagacaca

SEQ ID NO: 785707 - DNA, 20 bp, Homo sapiens
ctgagacagacacacagcct

SEQ ID NO: 785708 - DNA, 22 bp, Homo sapiens
ctgagacagcaccactgctgag

SEQ ID NO: 785709 - DNA, 24 bp, Homo sapiens
ctgagacagcaccactgctgagga

SEQ ID NO: 785710 - DNA, 15 bp, Homo sapiens
ctgagacaggagaat

SEQ ID NO: 785711 - DNA, 14 bp, Homo sapiens
ctgagacagggtgc

SEQ ID NO: 785712 - DNA, 21 bp, Homo sapiens
ctgagaccaaggctttctcta

SEQ ID NO: 785713 - DNA, 12 bp, Homo sapiens
ctgagaccacag

SEQ ID NO: 785714 - DNA, 14 bp, Homo sapiens
ctgagaccctactg

SEQ ID NO: 785715 - DNA, 15 bp, Homo sapiens
ctgagacccttttct

SEQ ID NO: 785716 - DNA, 19 bp, Homo sapiens
ctgagacccttttctcagg

SEQ ID NO: 785717 - DNA, 21 bp, Homo sapiens
ctgagacccttttctcaggac

SEQ ID NO: 785718 - DNA, 19 bp, Homo sapiens
ctgagacctgggatttgag

SEQ ID NO: 785719 - DNA, 20 bp, Homo sapiens
ctgagacctgggatttgaga

SEQ ID NO: 785720 - DNA, 21 bp, Homo sapiens
ctgagacctgggatttgagat

SEQ ID NO: 785721 - DNA, 12 bp, Homo sapiens
ctgagactccag

SEQ ID NO: 785722 - DNA, 20 bp, Homo sapiens
ctgagactccagaatctgct

SEQ ID NO: 785723 - DNA, 21 bp, Homo sapiens
ctgagactccagaatctgctg

SEQ ID NO: 785724 - DNA, 19 bp, Homo sapiens
ctgagactccggggagcgc

SEQ ID NO: 785725 - DNA, 17 bp, Homo sapiens
ctgagagaccctggcct

SEQ ID NO: 785726 - DNA, 13 bp, Homo sapiens
ctgagagactttt

SEQ ID NO: 785727 - DNA, 16 bp, Homo sapiens
ctgagagacttttaat

SEQ ID NO: 785728 - DNA, 21 bp, Homo sapiens
ctgagagccctgctgtgggag

SEQ ID NO: 785729 - DNA, 13 bp, Homo sapiens
ctgagagctgcct

SEQ ID NO: 785730 - DNA, 15 bp, Homo sapiens
ctgagaggaagcaag

SEQ ID NO: 785731 - DNA, 14 bp, Homo sapiens
ctgagaggcaggca

SEQ ID NO: 785732 - DNA, 15 bp, Homo sapiens
ctgagaggcaggcat

SEQ ID NO: 785733 - DNA, 16 bp, Homo sapiens
ctgagagggcaaggaa

SEQ ID NO: 785734 - DNA, 17 bp, Homo sapiens
ctgagagggctcgaggg

SEQ ID NO: 785735 - DNA, 17 bp, Homo sapiens
ctgagagtcagctctct

SEQ ID NO: 785736 - DNA, 18 bp, Homo sapiens
ctgagagtcagctctctg

SEQ ID NO: 785737 - DNA, 13 bp, Homo sapiens
ctgagagtcagga

SEQ ID NO: 785738 - DNA, 22 bp, Homo sapiens
ctgagagtggtgccctggaaca

SEQ ID NO: 785739 - DNA, 22 bp, Homo sapiens
ctgagagttggctcaggcagac

SEQ ID NO: 785740 - DNA, 14 bp, Homo sapiens
ctgagagtttcctc

SEQ ID NO: 785741 - DNA, 16 bp, Homo sapiens
ctgagagtttcctcag

SEQ ID NO: 785742 - DNA, 21 bp, Homo sapiens
ctgagagtttcctcagaaccc

SEQ ID NO: 785743 - DNA, 22 bp, Homo sapiens
ctgagagtttcctcagaaccca

SEQ ID NO: 785744 - DNA, 17 bp, Homo sapiens
ctgagatacttcccaaa

SEQ ID NO: 785745 - DNA, 15 bp, Homo sapiens
ctgagatcctggagt

SEQ ID NO: 785746 - DNA, 18 bp, Homo sapiens
ctgagatgcaaatgtcac

SEQ ID NO: 785747 - DNA, 15 bp, Homo sapiens
ctgagatgcaggtga

SEQ ID NO: 785748 - DNA, 11 bp, Homo sapiens
ctgagatgcta

SEQ ID NO: 785749 - DNA, 17 bp, Homo sapiens
ctgagatgctaatttat

SEQ ID NO: 785750 - DNA, 23 bp, Homo sapiens
ctgagatggaggtttccttttgg

SEQ ID NO: 785751 - DNA, 18 bp, Homo sapiens
ctgagatggagtgagctg

SEQ ID NO: 785752 - DNA, 23 bp, Homo sapiens
ctgagatgtcagatctcaagatc

SEQ ID NO: 785753 - DNA, 21 bp, Homo sapiens
ctgagattattccttcttcta

SEQ ID NO: 785754 - DNA, 18 bp, Homo sapiens
ctgagattcaatattgaa

SEQ ID NO: 785755 - DNA, 16 bp, Homo sapiens
ctgagattgtgtttgt

SEQ ID NO: 785756 - DNA, 15 bp, Homo sapiens
ctgagatttttgata

SEQ ID NO: 785757 - DNA, 22 bp, Homo sapiens
ctgagatttttgatatctcaat

SEQ ID NO: 785758 - DNA, 15 bp, Homo sapiens
ctgagcaaatgtggc

SEQ ID NO: 785759 - DNA, 17 bp, Homo sapiens
ctgagcaaatgtggctc

SEQ ID NO: 785760 - DNA, 20 bp, Homo sapiens
ctgagcaactcttgattatc

SEQ ID NO: 785761 - DNA, 18 bp, Homo sapiens
ctgagcaagaccctgtct

SEQ ID NO: 785762 - DNA, 20 bp, Homo sapiens
ctgagcaagaccctgtctct

SEQ ID NO: 785763 - DNA, 20 bp, Homo sapiens
ctgagcaagactctttcaaa

SEQ ID NO: 785764 - DNA, 14 bp, Homo sapiens
ctgagcaagagctg

SEQ ID NO: 785765 - DNA, 17 bp, Homo sapiens
ctgagcaagagctggca

SEQ ID NO: 785766 - DNA, 21 bp, Homo sapiens
ctgagcaatggtaactgcacc

SEQ ID NO: 785767 - DNA, 17 bp, Homo sapiens
ctgagcaatgtctgtgc

SEQ ID NO: 785768 - DNA, 15 bp, Homo sapiens
ctgagcacaggtgac

SEQ ID NO: 785769 - DNA, 16 bp, Homo sapiens
ctgagcacaggtgaca

SEQ ID NO: 785770 - DNA, 17 bp, Homo sapiens
ctgagcacaggtgacag

SEQ ID NO: 785771 - DNA, 14 bp, Homo sapiens
ctgagcacagtcag

SEQ ID NO: 785772 - DNA, 19 bp, Homo sapiens
ctgagcacatagtgtcctg

SEQ ID NO: 785773 - DNA, 20 bp, Homo sapiens
ctgagcacatagtgtcctgc

SEQ ID NO: 785774 - DNA, 16 bp, Homo sapiens
ctgagcaccccctcat

SEQ ID NO: 785775 - DNA, 18 bp, Homo sapiens
ctgagcaccccctcattc

SEQ ID NO: 785776 - DNA, 20 bp, Homo sapiens
ctgagcaccctctggattct

SEQ ID NO: 785777 - DNA, 17 bp, Homo sapiens
ctgagcaccgtgtcaag

SEQ ID NO: 785778 - DNA, 17 bp, Homo sapiens
ctgagcacctgcttcat

SEQ ID NO: 785779 - DNA, 23 bp, Homo sapiens
ctgagcacctgcttcatgctcag

SEQ ID NO: 785780 - DNA, 16 bp, Homo sapiens
ctgagcactgtttata

SEQ ID NO: 785781 - DNA, 12 bp, Homo sapiens
ctgagcacttag

SEQ ID NO: 785782 - DNA, 17 bp, Homo sapiens
ctgagcagaatactggt

SEQ ID NO: 785783 - DNA, 15 bp, Homo sapiens
ctgagcagcctctgg

SEQ ID NO: 785784 - DNA, 19 bp, Homo sapiens
ctgagcagcctctggacag

SEQ ID NO: 785785 - DNA, 19 bp, Homo sapiens
ctgagcaggacagccagca

SEQ ID NO: 785786 - DNA, 18 bp, Homo sapiens
ctgagcaggctgtggggt

SEQ ID NO: 785787 - DNA, 22 bp, Homo sapiens
ctgagcaggctgtggggtggag

SEQ ID NO: 785788 - DNA, 16 bp, Homo sapiens
ctgagcaggggcaggc

SEQ ID NO: 785789 - DNA, 18 bp, Homo sapiens
ctgagcagtttcattgtg

SEQ ID NO: 785790 - DNA, 15 bp, Homo sapiens
ctgagcattcaggca

SEQ ID NO: 785791 - DNA, 16 bp, Homo sapiens
ctgagcattcaggcag

SEQ ID NO: 785792 - DNA, 15 bp, Homo sapiens
ctgagccaaggaggc

SEQ ID NO: 785793 - DNA, 19 bp, Homo sapiens
ctgagccaaggaggcctgg

SEQ ID NO: 785794 - DNA, 22 bp, Homo sapiens
ctgagccaaggaggcctgggga

SEQ ID NO: 785795 - DNA, 13 bp, Homo sapiens
ctgagccacagtg

SEQ ID NO: 785796 - DNA, 17 bp, Homo sapiens
ctgagccactcgcagtc

SEQ ID NO: 785797 - DNA, 22 bp, Homo sapiens
ctgagccagcttagcaactgct

SEQ ID NO: 785798 - DNA, 22 bp, Homo sapiens
ctgagccagtgctttaatggca

SEQ ID NO: 785799 - DNA, 15 bp, Homo sapiens
ctgagcccaggagct

SEQ ID NO: 785800 - DNA, 23 bp, Homo sapiens
ctgagcccaggagctgagtcacc

SEQ ID NO: 785801 - DNA, 14 bp, Homo sapiens
ctgagcccaggccg

SEQ ID NO: 785802 - DNA, 23 bp, Homo sapiens
ctgagcccatgttctgcccccag

SEQ ID NO: 785803 - DNA, 15 bp, Homo sapiens
ctgagccccacctct

SEQ ID NO: 785804 - DNA, 23 bp, Homo sapiens
ctgagccccacctctccaagtct

SEQ ID NO: 785805 - DNA, 22 bp, Homo sapiens
ctgagccccagggtgcccagaa

SEQ ID NO: 785806 - DNA, 12 bp, Homo sapiens
ctgagcccccac

SEQ ID NO: 785807 - DNA, 15 bp, Homo sapiens
ctgagcccccaccgg

SEQ ID NO: 785808 - DNA, 16 bp, Homo sapiens
ctgagcccccaccgga

SEQ ID NO: 785809 - DNA, 19 bp, Homo sapiens
ctgagcccccaccggaact

SEQ ID NO: 785810 - DNA, 21 bp, Homo sapiens
ctgagccccgccctcttcctg

SEQ ID NO: 785811 - DNA, 24 bp, Homo sapiens
ctgcatacgttttggtgttgcttt

SEQ ID NO: 785812 - DNA, 20 bp, Homo sapiens
ctgcatactttgacaaggaa

SEQ ID NO: 785813 - DNA, 21 bp, Homo sapiens
ctgcatactttgacaaggaaa

SEQ ID NO: 785814 - DNA, 14 bp, Homo sapiens
ctgcatacttttta

SEQ ID NO: 785815 - DNA, 20 bp, Homo sapiens
ctgcatactttttaaatgta

SEQ ID NO: 785816 - DNA, 22 bp, Homo sapiens
ctgcataggagtttggaggaag

SEQ ID NO: 785817 - DNA, 21 bp, Homo sapiens
ctgcatagtattccattgtgt

SEQ ID NO: 785818 - DNA, 14 bp, Homo sapiens
ctgcatagtctgtt

SEQ ID NO: 785819 - DNA, 13 bp, Homo sapiens
ctgcatatttctg

SEQ ID NO: 785820 - DNA, 20 bp, Homo sapiens
ctgcatatttctgtatattt

SEQ ID NO: 785821 - DNA, 13 bp, Homo sapiens
ctgcatccagcct

SEQ ID NO: 785822 - DNA, 19 bp, Homo sapiens
ctgcatccatttgaacaca

SEQ ID NO: 785823 - DNA, 17 bp, Homo sapiens
ctgcatcccagcacctg

SEQ ID NO: 785824 - DNA, 19 bp, Homo sapiens
ctgcatcccattgctagca

SEQ ID NO: 785825 - DNA, 16 bp, Homo sapiens
ctgcatccccttggct

SEQ ID NO: 785826 - DNA, 21 bp, Homo sapiens
ctgcatccgtagttccctgaa

SEQ ID NO: 785827 - DNA, 15 bp, Homo sapiens
ctgcatcctgaggcc

SEQ ID NO: 785828 - DNA, 16 bp, Homo sapiens
ctgcatcctgaggcca

SEQ ID NO: 785829 - DNA, 22 bp, Homo sapiens
ctgcatcgtttcatcttccaac

SEQ ID NO: 785830 - DNA, 16 bp, Homo sapiens
ctgcatctgaccagca

SEQ ID NO: 785831 - DNA, 15 bp, Homo sapiens
ctgcatcttaacatg

SEQ ID NO: 785832 - DNA, 14 bp, Homo sapiens
ctgcatcttgggga

SEQ ID NO: 785833 - DNA, 18 bp, Homo sapiens
ctgcatcttggttatttc

SEQ ID NO: 785834 - DNA, 15 bp, Homo sapiens
ctgcatgaatatcat

SEQ ID NO: 785835 - DNA, 22 bp, Homo sapiens
ctgcatgacctaccaggacaga

SEQ ID NO: 785836 - DNA, 15 bp, Homo sapiens
ctgcatgatgtttgc

SEQ ID NO: 785837 - DNA, 12 bp, Homo sapiens
ctgcatgctctg

SEQ ID NO: 785838 - DNA, 14 bp, Homo sapiens
ctgcatgctctgga

SEQ ID NO: 785839 - DNA, 16 bp, Homo sapiens
ctgcatgctctggaag

SEQ ID NO: 785840 - DNA, 13 bp, Homo sapiens
ctgcatggaccta

SEQ ID NO: 785841 - DNA, 16 bp, Homo sapiens
ctgcatggacctaaca

SEQ ID NO: 785842 - DNA, 19 bp, Homo sapiens
ctgcatggacctaacattc

SEQ ID NO: 785843 - DNA, 16 bp, Homo sapiens
ctgcatggagcctgga

SEQ ID NO: 785844 - DNA, 12 bp, Homo sapiens
ctgcatggggag

SEQ ID NO: 785845 - DNA, 17 bp, Homo sapiens
ctgcatggggaggcagc

SEQ ID NO: 785846 - DNA, 22 bp, Homo sapiens
ctgcatggggaggcagcagagc

SEQ ID NO: 785847 - DNA, 19 bp, Homo sapiens
ctgcatgggggcaccgggc

SEQ ID NO: 785848 - DNA, 16 bp, Homo sapiens
ctgcatggtgtttatg

SEQ ID NO: 785849 - DNA, 21 bp, Homo sapiens
ctgcatgtactgtatattaca

SEQ ID NO: 785850 - DNA, 17 bp, Homo sapiens
ctgcatgtctactcagc

SEQ ID NO: 785851 - DNA, 12 bp, Homo sapiens
ctgcatgtgact

SEQ ID NO: 785852 - DNA, 20 bp, Homo sapiens
ctgcatgtgacttctcccct

SEQ ID NO: 785853 - DNA, 22 bp, Homo sapiens
ctgcatgtgacttctcccctgc

SEQ ID NO: 785854 - DNA, 16 bp, Homo sapiens
ctgcatgtggcttctc

SEQ ID NO: 785855 - DNA, 24 bp, Homo sapiens
ctgcatgtggcttctctgtctctg

SEQ ID NO: 785856 - DNA, 15 bp, Homo sapiens
ctgcatgtttgtgat

SEQ ID NO: 785857 - DNA, 13 bp, Homo sapiens
ctgcattagaaaa

SEQ ID NO: 785858 - DNA, 15 bp, Homo sapiens
ctgcattatctatgc

SEQ ID NO: 785859 - DNA, 20 bp, Homo sapiens
ctgcattcaggatcaaaccc

SEQ ID NO: 785860 - DNA, 16 bp, Homo sapiens
ctgcattcatttttat

SEQ ID NO: 785861 - DNA, 23 bp, Homo sapiens
ctgcattcatttttatagcaaca

SEQ ID NO: 785862 - DNA, 17 bp, Homo sapiens
ctgcattcccaggaaaa

SEQ ID NO: 785863 - DNA, 20 bp, Homo sapiens
ctgcattctctcccatcctg

SEQ ID NO: 785864 - DNA, 15 bp, Homo sapiens
ctgcattctgcacgc

SEQ ID NO: 785865 - DNA, 19 bp, Homo sapiens
ctgcattgagcatattttc

SEQ ID NO: 785866 - DNA, 17 bp, Homo sapiens
ctgcattgagcttgcat

SEQ ID NO: 785867 - DNA, 23 bp, Homo sapiens
ctgcattgagcttgcatgcttgc

SEQ ID NO: 785868 - DNA, 15 bp, Homo sapiens
ctgcattgttattgt

SEQ ID NO: 785869 - DNA, 16 bp, Homo sapiens
ctgcattgttttctag

SEQ ID NO: 785870 - DNA, 14 bp, Homo sapiens
ctgcatttaaaaga

SEQ ID NO: 785871 - DNA, 18 bp, Homo sapiens
ctgcatttaaaagataca

SEQ ID NO: 785872 - DNA, 20 bp, Homo sapiens
ctgcatttaaatttgatttc

SEQ ID NO: 785873 - DNA, 19 bp, Homo sapiens
ctgcatttcctcgcagcct

SEQ ID NO: 785874 - DNA, 18 bp, Homo sapiens
ctgcatttcggtggctag

SEQ ID NO: 785875 - DNA, 11 bp, Homo sapiens
ctgcatttctc

SEQ ID NO: 785876 - DNA, 15 bp, Homo sapiens
ctgcatttctcttct

SEQ ID NO: 785877 - DNA, 22 bp, Homo sapiens
ctgcattttaattttaaccaaa

SEQ ID NO: 785878 - DNA, 14 bp, Homo sapiens
ctgcattttacaca

SEQ ID NO: 785879 - DNA, 20 bp, Homo sapiens
ctgcattttattctggatgg

SEQ ID NO: 785880 - DNA, 15 bp, Homo sapiens
ctgcattttcctctt

SEQ ID NO: 785881 - DNA, 21 bp, Homo sapiens
ctgcattttcctcttgtcctg

SEQ ID NO: 785882 - DNA, 13 bp, Homo sapiens
ctgccaaaaccac

SEQ ID NO: 785883 - DNA, 16 bp, Homo sapiens
ctgccaaaaccacatg

SEQ ID NO: 785884 - DNA, 17 bp, Homo sapiens
ctgccaaaaccacatgg

SEQ ID NO: 785885 - DNA, 19 bp, Homo sapiens
ctgccaaaaccacatgggc

SEQ ID NO: 785886 - DNA, 22 bp, Homo sapiens
ctgccaaaaccacatgggctgg

SEQ ID NO: 785887 - DNA, 17 bp, Homo sapiens
ctgccaaagtgcctggg

SEQ ID NO: 785888 - DNA, 22 bp, Homo sapiens
ctgccaaataaatcatcctcat

SEQ ID NO: 785889 - DNA, 21 bp, Homo sapiens
ctgccaaccataccttccttc

SEQ ID NO: 785890 - DNA, 22 bp, Homo sapiens
ctgccaaccataccttccttcc

SEQ ID NO: 785891 - DNA, 23 bp, Homo sapiens
ctgccaaccataccttccttccc

SEQ ID NO: 785892 - DNA, 16 bp, Homo sapiens
ctgccaacctaaaact

SEQ ID NO: 785893 - DNA, 22 bp, Homo sapiens
ctgccaacctaaaactctttcg

SEQ ID NO: 785894 - DNA, 18 bp, Homo sapiens
ctgccaagactcctcagg

SEQ ID NO: 785895 - DNA, 19 bp, Homo sapiens
ctgccaagcactcgagacc

SEQ ID NO: 785896 - DNA, 13 bp, Homo sapiens
ctgccaagcccct

SEQ ID NO: 785897 - DNA, 15 bp, Homo sapiens
ctgccaaggccagag

SEQ ID NO: 785898 - DNA, 21 bp, Homo sapiens
ctgccaaggtggagggaagga

SEQ ID NO: 785899 - DNA, 15 bp, Homo sapiens
ctgccaatccttaaa

SEQ ID NO: 785900 - DNA, 23 bp, Homo sapiens
ctgccaatccttaaatatgtgaa

SEQ ID NO: 785901 - DNA, 20 bp, Homo sapiens
ctgccaatcggctacccctc

SEQ ID NO: 785902 - DNA, 21 bp, Homo sapiens
ctgccaatcggctacccctcg

SEQ ID NO: 785903 - DNA, 14 bp, Homo sapiens
ctgccaatgctcca

SEQ ID NO: 785904 - DNA, 17 bp, Homo sapiens
ctgccaatgctccagct

SEQ ID NO: 785905 - DNA, 24 bp, Homo sapiens
ctgccaatgctccagctgtcgtct

SEQ ID NO: 785906 - DNA, 13 bp, Homo sapiens
ctgccaatgtggg

SEQ ID NO: 785907 - DNA, 16 bp, Homo sapiens
ctgccacacccagggg

SEQ ID NO: 785908 - DNA, 23 bp, Homo sapiens
ctgccacactcagtcccccacca

SEQ ID NO: 785909 - DNA, 22 bp, Homo sapiens
ctgccacactgatggctcaaga

SEQ ID NO: 785910 - DNA, 22 bp, Homo sapiens
ctgccacacttcaggctcttct

SEQ ID NO: 785911 - DNA, 12 bp, Homo sapiens
ctgccacagcca

SEQ ID NO: 785912 - DNA, 14 bp, Homo sapiens
ctgccacagccaga

SEQ ID NO: 785913 - DNA, 16 bp, Homo sapiens
ctgccacagccagagg

SEQ ID NO: 785914 - DNA, 16 bp, Homo sapiens
ctgccacatggagccc

SEQ ID NO: 785915 - DNA, 22 bp, Homo sapiens
ctgccacattgatttttctata

SEQ ID NO: 785916 - DNA, 20 bp, Homo sapiens
ctgccaccacgtctgccagg

SEQ ID NO: 785917 - DNA, 22 bp, Homo sapiens
ctgccaccacgtctgccaggcc

SEQ ID NO: 785918 - DNA, 15 bp, Homo sapiens
ctgccaccaggccac

SEQ ID NO: 785919 - DNA, 15 bp, Homo sapiens
ctgccaccagggagc

SEQ ID NO: 785920 - DNA, 22 bp, Homo sapiens
ctgccaccagggagcttcctgg

SEQ ID NO: 785921 - DNA, 14 bp, Homo sapiens
ctgccaccatcctg

SEQ ID NO: 785922 - DNA, 12 bp, Homo sapiens
ctgccacccact

SEQ ID NO: 785923 - DNA, 14 bp, Homo sapiens
ctgccacccactca

SEQ ID NO: 785924 - DNA, 15 bp, Homo sapiens
ctgccacccactcag

SEQ ID NO: 785925 - DNA, 16 bp, Homo sapiens
ctgccacccactcagg

SEQ ID NO: 785926 - DNA, 17 bp, Homo sapiens
ctgccacccactcagga

SEQ ID NO: 785927 - DNA, 14 bp, Homo sapiens
ctgccacccccagg

SEQ ID NO: 785928 - DNA, 15 bp, Homo sapiens
ctgccacccccaggt

SEQ ID NO: 785929 - DNA, 17 bp, Homo sapiens
ctgccacccctcttctg

SEQ ID NO: 785930 - DNA, 20 bp, Homo sapiens
ctgccaccccttcctcccca

SEQ ID NO: 785931 - DNA, 15 bp, Homo sapiens
ctgccaccgactgcc

SEQ ID NO: 785932 - DNA, 20 bp, Homo sapiens
ctgccaccgactgcccagcc

SEQ ID NO: 785933 - DNA, 21 bp, Homo sapiens
ctgccaccgactgcccagcca

SEQ ID NO: 785934 - DNA, 23 bp, Homo sapiens
ctgccaccgactgcccagccact

SEQ ID NO: 785935 - DNA, 12 bp, Homo sapiens
ctgccacctccc

SEQ ID NO: 785936 - DNA, 22 bp, Homo sapiens
ctgccacgcaggccacccgggc

SEQ ID NO: 785937 - DNA, 15 bp, Homo sapiens
ctgccacgtcccgct

SEQ ID NO: 785938 - DNA, 16 bp, Homo sapiens
ctgccacgtcccgctg

SEQ ID NO: 785939 - DNA, 19 bp, Homo sapiens
ctgccacgtcccgctgcct

SEQ ID NO: 785940 - DNA, 20 bp, Homo sapiens
ctgccacgtcccgctgcctc

SEQ ID NO: 785941 - DNA, 22 bp, Homo sapiens
ctgccacgtcccgctgcctcct

SEQ ID NO: 785942 - DNA, 15 bp, Homo sapiens
ctgccactcaccctt

SEQ ID NO: 785943 - DNA, 16 bp, Homo sapiens
ctgccactctctggga

SEQ ID NO: 785944 - DNA, 18 bp, Homo sapiens
ctgccactctctgggact

SEQ ID NO: 785945 - DNA, 11 bp, Homo sapiens
ctgccactggg

SEQ ID NO: 785946 - DNA, 24 bp, Homo sapiens
ctgccactgggcacctgcgcacag

SEQ ID NO: 785947 - DNA, 13 bp, Homo sapiens
ctgccactgtgtg

SEQ ID NO: 785948 - DNA, 14 bp, Homo sapiens
ctgccactgtgtgc

SEQ ID NO: 785949 - DNA, 22 bp, Homo sapiens
ctgccactttcacgtggcctcc

SEQ ID NO: 785950 - DNA, 23 bp, Homo sapiens
ctgccactttggtacatggccag

SEQ ID NO: 785951 - DNA, 19 bp, Homo sapiens
ctgccagacactgagcttc

SEQ ID NO: 785952 - DNA, 15 bp, Homo sapiens
ctgccagacttaaaa

SEQ ID NO: 785953 - DNA, 13 bp, Homo sapiens
ctgccagagaagc

SEQ ID NO: 785954 - DNA, 11 bp, Homo sapiens
ctgccagagcc

SEQ ID NO: 785955 - DNA, 14 bp, Homo sapiens
ctgccagcacagag

SEQ ID NO: 785956 - DNA, 17 bp, Homo sapiens
ctgccagcagcagcagg

SEQ ID NO: 785957 - DNA, 19 bp, Homo sapiens
ctgccagccagcagccagc

SEQ ID NO: 785958 - DNA, 23 bp, Homo sapiens
ctgccagccagcagccagctctc

SEQ ID NO: 785959 - DNA, 15 bp, Homo sapiens
ctgccagcccactgc

SEQ ID NO: 785960 - DNA, 16 bp, Homo sapiens
ctgccagccgaccctc

SEQ ID NO: 785961 - DNA, 11 bp, Homo sapiens
ctgccagcctg

SEQ ID NO: 785962 - DNA, 14 bp, Homo sapiens
ctgccagcctgagc

SEQ ID NO: 785963 - DNA, 12 bp, Homo sapiens
ctgccagcctgg

SEQ ID NO: 785964 - DNA, 13 bp, Homo sapiens
ctgccagcctggc

SEQ ID NO: 785965 - DNA, 14 bp, Homo sapiens
ctgccagcctggct

SEQ ID NO: 785966 - DNA, 20 bp, Homo sapiens
ctgccagcctggcttctgga

SEQ ID NO: 785967 - DNA, 23 bp, Homo sapiens
ctgccagcctggcttctggagcc

SEQ ID NO: 785968 - DNA, 17 bp, Homo sapiens
ctgccagctctgtatca

SEQ ID NO: 785969 - DNA, 12 bp, Homo sapiens
ctgccagctgcc

SEQ ID NO: 785970 - DNA, 13 bp, Homo sapiens
ctgccagctgcct

SEQ ID NO: 785971 - DNA, 18 bp, Homo sapiens
ctgccaggaaacaaggga

SEQ ID NO: 785972 - DNA, 20 bp, Homo sapiens
ctgccaggaaacaagggaag

SEQ ID NO: 785973 - DNA, 16 bp, Homo sapiens
ctgccaggaccccagg

SEQ ID NO: 785974 - DNA, 21 bp, Homo sapiens
ctgccaggaccccaggtcagg

SEQ ID NO: 785975 - DNA, 13 bp, Homo sapiens
ctgccaggcacct

SEQ ID NO: 785976 - DNA, 14 bp, Homo sapiens
ctgccaggcacctg

SEQ ID NO: 785977 - DNA, 20 bp, Homo sapiens
ctgccaggcacctggcctgc

SEQ ID NO: 785978 - DNA, 17 bp, Homo sapiens
ctgccaggcaggggtgg

SEQ ID NO: 785979 - DNA, 20 bp, Homo sapiens
ctgccaggccagcctccgag

SEQ ID NO: 785980 - DNA, 20 bp, Homo sapiens
ctgccaggcccatctcaggt

SEQ ID NO: 785981 - DNA, 22 bp, Homo sapiens
ctgccaggcccatctcaggtgc

SEQ ID NO: 785982 - DNA, 23 bp, Homo sapiens
ctgccaggcccatctcaggtgcc

SEQ ID NO: 785983 - DNA, 18 bp, Homo sapiens
ctgccaggcggccctggg

SEQ ID NO: 785984 - DNA, 20 bp, Homo sapiens
ctgccaggcggccctgggga

SEQ ID NO: 785985 - DNA, 21 bp, Homo sapiens
ctgccaggcgttggtgccact

SEQ ID NO: 785986 - DNA, 17 bp, Homo sapiens
ctgccaggggcttccca

SEQ ID NO: 785987 - DNA, 22 bp, Homo sapiens
ctgccaggggtaacctggccac

SEQ ID NO: 785988 - DNA, 17 bp, Homo sapiens
ctgccagtcgggagagc

SEQ ID NO: 785989 - DNA, 16 bp, Homo sapiens
ctgccagtgacagaca

SEQ ID NO: 785990 - DNA, 16 bp, Homo sapiens
ctgccagtgcagccac

SEQ ID NO: 785991 - DNA, 18 bp, Homo sapiens
ctgccagtgcagccactg

SEQ ID NO: 785992 - DNA, 12 bp, Homo sapiens
ctgccagtgcct

SEQ ID NO: 785993 - DNA, 14 bp, Homo sapiens
ctgccagtgcctta

SEQ ID NO: 785994 - DNA, 16 bp, Homo sapiens
ctgccagtgctggtca

SEQ ID NO: 785995 - DNA, 13 bp, Homo sapiens
ctgccagttttgt

SEQ ID NO: 785996 - DNA, 15 bp, Homo sapiens
ctgccataattctaa

SEQ ID NO: 785997 - DNA, 14 bp, Homo sapiens
ctgccatattaaat

SEQ ID NO: 785998 - DNA, 17 bp, Homo sapiens
ctgccatcaccgctggg

SEQ ID NO: 785999 - DNA, 18 bp, Homo sapiens
ctgccatcaccgctgggt

SEQ ID NO: 786000 - DNA, 14 bp, Homo sapiens
ctgccatccccctc

SEQ ID NO: 786001 - DNA, 19 bp, Homo sapiens
ctgccatcggacaggagga

SEQ ID NO: 786002 - DNA, 17 bp, Homo sapiens
ctgccatctagccagcc

SEQ ID NO: 786003 - DNA, 19 bp, Homo sapiens
ctgccatcttagtttggat

SEQ ID NO: 786004 - DNA, 14 bp, Homo sapiens
ctgccatcttcagg

SEQ ID NO: 786005 - DNA, 18 bp, Homo sapiens
ctgccatcttcccagcag

SEQ ID NO: 786006 - DNA, 15 bp, Homo sapiens
ctgccatgacagagg

SEQ ID NO: 786007 - DNA, 20 bp, Homo sapiens
ctgccatgacagaggctgca

SEQ ID NO: 786008 - DNA, 18 bp, Homo sapiens
ctgccatgatagctgggg

SEQ ID NO: 786009 - DNA, 21 bp, Homo sapiens
ctgccatgatagctggggctt

SEQ ID NO: 786010 - DNA, 12 bp, Homo sapiens
ctgccatgatgt

SEQ ID NO: 786011 - DNA, 17 bp, Homo sapiens
ctgccatgatgtttaca

SEQ ID NO: 786012 - DNA, 14 bp, Homo sapiens
ctgccatgccactg

SEQ ID NO: 786013 - DNA, 19 bp, Homo sapiens
ctgccatgccactgccagg

SEQ ID NO: 786014 - DNA, 22 bp, Homo sapiens
ctgccatgccactgccaggcac

SEQ ID NO: 786015 - DNA, 14 bp, Homo sapiens
ctgccatgccagct

SEQ ID NO: 786016 - DNA, 17 bp, Homo sapiens
ctgccatgccagcttat

SEQ ID NO: 786017 - DNA, 14 bp, Homo sapiens
ctgccatgccagga

SEQ ID NO: 786018 - DNA, 16 bp, Homo sapiens
ctgccatgccaggaac

SEQ ID NO: 786019 - DNA, 17 bp, Homo sapiens
ctgccatgccaggaacc

SEQ ID NO: 786020 - DNA, 20 bp, Homo sapiens
ctgccatggaattccctcct

SEQ ID NO: 786021 - DNA, 19 bp, Homo sapiens
ctgccatgggtgcagaccc

SEQ ID NO: 786022 - DNA, 23 bp, Homo sapiens
ctgccatgtacctcccctgcctt

SEQ ID NO: 786023 - DNA, 22 bp, Homo sapiens
ctgccatgttgcccctttctct

SEQ ID NO: 786024 - DNA, 19 bp, Homo sapiens
ctgccattattttctgtca

SEQ ID NO: 786025 - DNA, 22 bp, Homo sapiens
ctgccattattttctgtcagat

SEQ ID NO: 786026 - DNA, 17 bp, Homo sapiens
ctgccattggcctcttg

SEQ ID NO: 786027 - DNA, 19 bp, Homo sapiens
ctgccattggcctcttgtc

SEQ ID NO: 786028 - DNA, 22 bp, Homo sapiens
ctgccattggcctcttgtccct

SEQ ID NO: 786029 - DNA, 13 bp, Homo sapiens
ctgccatttccct

SEQ ID NO: 786030 - DNA, 15 bp, Homo sapiens
ctgccatttcccttc

SEQ ID NO: 786031 - DNA, 21 bp, Homo sapiens
ctgccatttcccttctggaca

SEQ ID NO: 786032 - DNA, 19 bp, Homo sapiens
ctgccatttgcaccctccg

SEQ ID NO: 786033 - DNA, 22 bp, Homo sapiens
ctgccattttttaagagacagt

SEQ ID NO: 786034 - DNA, 20 bp, Homo sapiens
ctgcccaaacccttaactga

SEQ ID NO: 786035 - DNA, 15 bp, Homo sapiens
ctgcccaaactcccc

SEQ ID NO: 786036 - DNA, 18 bp, Homo sapiens
ctgcccaaactccccttc

SEQ ID NO: 786037 - DNA, 21 bp, Homo sapiens
ctgcccaaactccccttccct

SEQ ID NO: 786038 - DNA, 19 bp, Homo sapiens
ctgcccaacctgctctcct

SEQ ID NO: 786039 - DNA, 21 bp, Homo sapiens
ctgcccaagggcctcccacca

SEQ ID NO: 786040 - DNA, 22 bp, Homo sapiens
ctgcccaagggcctcccaccag

SEQ ID NO: 786041 - DNA, 18 bp, Homo sapiens
ctgcccaagtgaccaggg

SEQ ID NO: 786042 - DNA, 19 bp, Homo sapiens
ctgcccaagtgaccaggga

SEQ ID NO: 786043 - DNA, 22 bp, Homo sapiens
ctgcccaatgctttgggaggcc

SEQ ID NO: 786044 - DNA, 18 bp, Homo sapiens
ctgcccacatgggacctg

SEQ ID NO: 786045 - DNA, 14 bp, Homo sapiens
ctgcccaccaaagg

SEQ ID NO: 786046 - DNA, 21 bp, Homo sapiens
ctgcccaccaaaggtcaatgt

SEQ ID NO: 786047 - DNA, 14 bp, Homo sapiens
ctgcccacccccgg

SEQ ID NO: 786048 - DNA, 14 bp, Homo sapiens
ctgcccaccccctc

SEQ ID NO: 786049 - DNA, 16 bp, Homo sapiens
ctgcccaccctaccag

SEQ ID NO: 786050 - DNA, 20 bp, Homo sapiens
ctgcccaccctaccagctcc

SEQ ID NO: 786051 - DNA, 21 bp, Homo sapiens
ctgcccaccctaccagctcct

SEQ ID NO: 786052 - DNA, 15 bp, Homo sapiens
ctgcccacctccttc

SEQ ID NO: 786053 - DNA, 12 bp, Homo sapiens
ctgcccacctct

SEQ ID NO: 786054 - DNA, 14 bp, Homo sapiens
ctgcccacctctcc

SEQ ID NO: 786055 - DNA, 15 bp, Homo sapiens
ctgcccacctctccc

SEQ ID NO: 786056 - DNA, 14 bp, Homo sapiens
ctgcccacctctct

SEQ ID NO: 786057 - DNA, 15 bp, Homo sapiens
ctgcccacctggggt

SEQ ID NO: 786058 - DNA, 19 bp, Homo sapiens
ctgcccacctggggtctct

SEQ ID NO: 786059 - DNA, 18 bp, Homo sapiens
ctgcccacgatcccctcc

SEQ ID NO: 786060 - DNA, 19 bp, Homo sapiens
ctgcccacgcagacctgca

SEQ ID NO: 786061 - DNA, 20 bp, Homo sapiens
ctgcccacgcagaggacgca

SEQ ID NO: 786062 - DNA, 15 bp, Homo sapiens
ctgcccacgctcctg

SEQ ID NO: 786063 - DNA, 17 bp, Homo sapiens
ctgcccacgggaggaca

SEQ ID NO: 786064 - DNA, 18 bp, Homo sapiens
ctgcccacgggaggacaa

SEQ ID NO: 786065 - DNA, 23 bp, Homo sapiens
ctgcccactgtttctcttgagct

SEQ ID NO: 786066 - DNA, 23 bp, Homo sapiens
ctgcccacttagccgtccatggc

SEQ ID NO: 786067 - DNA, 17 bp, Homo sapiens
ctgcccagacaagattt

SEQ ID NO: 786068 - DNA, 14 bp, Homo sapiens
ctgcccagactgat

SEQ ID NO: 786069 - DNA, 21 bp, Homo sapiens
ctgcccagactgatgagcaca

SEQ ID NO: 786070 - DNA, 18 bp, Homo sapiens
ctgcccagagttgctggg

SEQ ID NO: 786071 - DNA, 12 bp, Homo sapiens
ctgcccagccac

SEQ ID NO: 786072 - DNA, 19 bp, Homo sapiens
ctgcccagccacccctcag

SEQ ID NO: 786073 - DNA, 14 bp, Homo sapiens
ctgcccagccactc

SEQ ID NO: 786074 - DNA, 19 bp, Homo sapiens
ctgcccagccactccaagc

SEQ ID NO: 786075 - DNA, 12 bp, Homo sapiens
ctgcccagcctc

SEQ ID NO: 786076 - DNA, 13 bp, Homo sapiens
ctgcccagcctca

SEQ ID NO: 786077 - DNA, 17 bp, Homo sapiens
ctgcccagcctccaagc

SEQ ID NO: 786078 - DNA, 19 bp, Homo sapiens
ctgcccagctccccaactc

SEQ ID NO: 786079 - DNA, 15 bp, Homo sapiens
ctgcccagctgctcc

SEQ ID NO: 786080 - DNA, 13 bp, Homo sapiens
ctgcccagcttgg

SEQ ID NO: 786081 - DNA, 13 bp, Homo sapiens
ctgcccaggagac

SEQ ID NO: 786082 - DNA, 19 bp, Homo sapiens
ctgcccaggagacagacca

SEQ ID NO: 786083 - DNA, 15 bp, Homo sapiens
ctgcccaggggtgcc

SEQ ID NO: 786084 - DNA, 17 bp, Homo sapiens
ctgcccaggggtgcccc

SEQ ID NO: 786085 - DNA, 20 bp, Homo sapiens
ctgcccaggggtgccccctc

SEQ ID NO: 786086 - DNA, 22 bp, Homo sapiens
ctgcccaggtggcctcctggcc

SEQ ID NO: 786087 - DNA, 20 bp, Homo sapiens
ctgcccagtgcaaaccactt

SEQ ID NO: 786088 - DNA, 22 bp, Homo sapiens
ctgcccagtgttgtttgtaaat

SEQ ID NO: 786089 - DNA, 18 bp, Homo sapiens
ctgcccatactgagcctg

SEQ ID NO: 786090 - DNA, 19 bp, Homo sapiens
ctgcccatactgagcctgc

SEQ ID NO: 786091 - DNA, 21 bp, Homo sapiens
ctgcccatccgtctgtctgtc

SEQ ID NO: 786092 - DNA, 16 bp, Homo sapiens
ctgcccatggacaggc

SEQ ID NO: 786093 - DNA, 20 bp, Homo sapiens
ctgcccatgtgtcccctcac

SEQ ID NO: 786094 - DNA, 16 bp, Homo sapiens
ctgctctcttcaggag

SEQ ID NO: 786095 - DNA, 19 bp, Homo sapiens
ctgctctcttcaggaggcc

SEQ ID NO: 786096 - DNA, 22 bp, Homo sapiens
ctgctctgaccttccagagccc

SEQ ID NO: 786097 - DNA, 22 bp, Homo sapiens
ctgctctgagaattgttgagat

SEQ ID NO: 786098 - DNA, 18 bp, Homo sapiens
ctgctctgccatcttcag

SEQ ID NO: 786099 - DNA, 12 bp, Homo sapiens
ctgctctgcccc

SEQ ID NO: 786100 - DNA, 14 bp, Homo sapiens
ctgctctgcccctt

SEQ ID NO: 786101 - DNA, 23 bp, Homo sapiens
ctgctctgccccttgggcatcca

SEQ ID NO: 786102 - DNA, 13 bp, Homo sapiens
ctgctctgcctgg

SEQ ID NO: 786103 - DNA, 15 bp, Homo sapiens
ctgctctgcctggag

SEQ ID NO: 786104 - DNA, 16 bp, Homo sapiens
ctgctctgcctggagt

SEQ ID NO: 786105 - DNA, 11 bp, Homo sapiens
ctgctctgctg

SEQ ID NO: 786106 - DNA, 12 bp, Homo sapiens
ctgctctggaca

SEQ ID NO: 786107 - DNA, 17 bp, Homo sapiens
ctgctctggttgtttct

SEQ ID NO: 786108 - DNA, 21 bp, Homo sapiens
ctgctctggttgtttctgttc

SEQ ID NO: 786109 - DNA, 22 bp, Homo sapiens
ctgctctggttgtttctgttcc

SEQ ID NO: 786110 - DNA, 19 bp, Homo sapiens
ctgctcttctgtgcccagg

SEQ ID NO: 786111 - DNA, 19 bp, Homo sapiens
ctgctcttgcagttgctct

SEQ ID NO: 786112 - DNA, 22 bp, Homo sapiens
ctgctcttgtttcactccacca

SEQ ID NO: 786113 - DNA, 19 bp, Homo sapiens
ctgctctttctctgccagt

SEQ ID NO: 786114 - DNA, 19 bp, Homo sapiens
ctgctgaaagtcctgcttt

SEQ ID NO: 786115 - DNA, 14 bp, Homo sapiens
ctgctgaacacagt

SEQ ID NO: 786116 - DNA, 19 bp, Homo sapiens
ctgctgaacacagtgtctg

SEQ ID NO: 786117 - DNA, 20 bp, Homo sapiens
ctgctgaacacagtgtctgt

SEQ ID NO: 786118 - DNA, 21 bp, Homo sapiens
ctgctgaagatgaatcaatgg

SEQ ID NO: 786119 - DNA, 21 bp, Homo sapiens
ctgctgaagatgcccctgctc

SEQ ID NO: 786120 - DNA, 17 bp, Homo sapiens
ctgctgaaggaataaat

SEQ ID NO: 786121 - DNA, 18 bp, Homo sapiens
ctgctgaaggacagaaca

SEQ ID NO: 786122 - DNA, 16 bp, Homo sapiens
ctgctgaaggctcatt

SEQ ID NO: 786123 - DNA, 16 bp, Homo sapiens
ctgctgaagttctgag

SEQ ID NO: 786124 - DNA, 17 bp, Homo sapiens
ctgctgacagacactaa

SEQ ID NO: 786125 - DNA, 20 bp, Homo sapiens
ctgctgacagacactaactt

SEQ ID NO: 786126 - DNA, 11 bp, Homo sapiens
ctgctgaccaa

SEQ ID NO: 786127 - DNA, 21 bp, Homo sapiens
ctgctgaccaattgtgctgcc

SEQ ID NO: 786128 - DNA, 22 bp, Homo sapiens
ctgctgaccaattgtgctgcca

SEQ ID NO: 786129 - DNA, 22 bp, Homo sapiens
ctgctgactgtttcattcactg

SEQ ID NO: 786130 - DNA, 15 bp, Homo sapiens
ctgctgagagaccca

SEQ ID NO: 786131 - DNA, 22 bp, Homo sapiens
ctgctgagatgaggaggggagc

SEQ ID NO: 786132 - DNA, 12 bp, Homo sapiens
ctgctgagccac

SEQ ID NO: 786133 - DNA, 16 bp, Homo sapiens
ctgctgagctgggccc

SEQ ID NO: 786134 - DNA, 17 bp, Homo sapiens
ctgctgagctgggccca

SEQ ID NO: 786135 - DNA, 19 bp, Homo sapiens
ctgctgagctgggcccagc

SEQ ID NO: 786136 - DNA, 17 bp, Homo sapiens
ctgctgaggagtctgag

SEQ ID NO: 786137 - DNA, 20 bp, Homo sapiens
ctgctgaggagtctgaggac

SEQ ID NO: 786138 - DNA, 21 bp, Homo sapiens
ctgctgaggagtctgaggact

SEQ ID NO: 786139 - DNA, 22 bp, Homo sapiens
ctgctgaggagtctgaggactg

SEQ ID NO: 786140 - DNA, 13 bp, Homo sapiens
ctgctgaggccca

SEQ ID NO: 786141 - DNA, 17 bp, Homo sapiens
ctgctgaggcccagtgc

SEQ ID NO: 786142 - DNA, 20 bp, Homo sapiens
ctgctgaggcccagtgcata

SEQ ID NO: 786143 - DNA, 22 bp, Homo sapiens
ctgctgaggcccagtgcatatg

SEQ ID NO: 786144 - DNA, 17 bp, Homo sapiens
ctgctgaggccttctct

SEQ ID NO: 786145 - DNA, 20 bp, Homo sapiens
ctgctgagtcagactgtcag

SEQ ID NO: 786146 - DNA, 19 bp, Homo sapiens
ctgctgagtcccaggctga

SEQ ID NO: 786147 - DNA, 17 bp, Homo sapiens
ctgctgatattttctct

SEQ ID NO: 786148 - DNA, 15 bp, Homo sapiens
ctgctgatgcgctgg

SEQ ID NO: 786149 - DNA, 18 bp, Homo sapiens
ctgctgattcttgtaaat

SEQ ID NO: 786150 - DNA, 23 bp, Homo sapiens
ctgctgcaccctgcgcctccaga

SEQ ID NO: 786151 - DNA, 16 bp, Homo sapiens
ctgctgcactaggact

SEQ ID NO: 786152 - DNA, 18 bp, Homo sapiens
ctgctgcactaggacttg

SEQ ID NO: 786153 - DNA, 13 bp, Homo sapiens
ctgctgcatactt

SEQ ID NO: 786154 - DNA, 16 bp, Homo sapiens
ctgctgccacagcaag

SEQ ID NO: 786155 - DNA, 22 bp, Homo sapiens
ctgctgccagaattaaagacct

SEQ ID NO: 786156 - DNA, 13 bp, Homo sapiens
ctgctgccagtgc

SEQ ID NO: 786157 - DNA, 15 bp, Homo sapiens
ctgctgcccagcctc

SEQ ID NO: 786158 - DNA, 22 bp, Homo sapiens
ctgctgcccagcctccaagctc

SEQ ID NO: 786159 - DNA, 18 bp, Homo sapiens
ctgctgcccccttcccca

SEQ ID NO: 786160 - DNA, 20 bp, Homo sapiens
ctgctgcccccttccccagc

SEQ ID NO: 786161 - DNA, 21 bp, Homo sapiens
ctgctgcccccttccccagcc

SEQ ID NO: 786162 - DNA, 22 bp, Homo sapiens
ctgctgcccggggtggggtgca

SEQ ID NO: 786163 - DNA, 12 bp, Homo sapiens
ctgctgccctcc

SEQ ID NO: 786164 - DNA, 21 bp, Homo sapiens
ctgctgccgcctcccagcctg

SEQ ID NO: 786165 - DNA, 12 bp, Homo sapiens
ctgctgcctctt

SEQ ID NO: 786166 - DNA, 20 bp, Homo sapiens
ctgctgcctctttccctagg

SEQ ID NO: 786167 - DNA, 11 bp, Homo sapiens
ctgctgcctgc

SEQ ID NO: 786168 - DNA, 15 bp, Homo sapiens
ctgctgcctgctgag

SEQ ID NO: 786169 - DNA, 16 bp, Homo sapiens
ctgctgcctgctgaga

SEQ ID NO: 786170 - DNA, 16 bp, Homo sapiens
ctgctgcctggccact

SEQ ID NO: 786171 - DNA, 19 bp, Homo sapiens
ctgctgcctggccactgct

SEQ ID NO: 786172 - DNA, 15 bp, Homo sapiens
ctgctgccttttctg

SEQ ID NO: 786173 - DNA, 19 bp, Homo sapiens
ctgctgccttttctggagt

SEQ ID NO: 786174 - DNA, 17 bp, Homo sapiens
ctgctgcgcccttacct

SEQ ID NO: 786175 - DNA, 16 bp, Homo sapiens
ctgctgcgtccccact

SEQ ID NO: 786176 - DNA, 18 bp, Homo sapiens
ctgctgcgtccccactcc

SEQ ID NO: 786177 - DNA, 16 bp, Homo sapiens
ctgctgctacaatgtc

SEQ ID NO: 786178 - DNA, 13 bp, Homo sapiens
ctgctgctaccag

SEQ ID NO: 786179 - DNA, 14 bp, Homo sapiens
ctgctgctaccagc

SEQ ID NO: 786180 - DNA, 13 bp, Homo sapiens
ctgctgctcccca

SEQ ID NO: 786181 - DNA, 15 bp, Homo sapiens
ctgctgctccccacc

SEQ ID NO: 786182 - DNA, 12 bp, Homo sapiens
ctgctgctctca

SEQ ID NO: 786183 - DNA, 14 bp, Homo sapiens
ctgctgctgcctgg

SEQ ID NO: 786184 - DNA, 17 bp, Homo sapiens
ctgctgctgcctggcca

SEQ ID NO: 786185 - DNA, 20 bp, Homo sapiens
ctgctgctgcgcccttacct

SEQ ID NO: 786186 - DNA, 23 bp, Homo sapiens
ctgctgctgtaactgctgagcca

SEQ ID NO: 786187 - DNA, 13 bp, Homo sapiens
ctgctgctgtgct

SEQ ID NO: 786188 - DNA, 11 bp, Homo sapiens
ctgctgcttct

SEQ ID NO: 786189 - DNA, 13 bp, Homo sapiens
ctgctgcttctgc

SEQ ID NO: 786190 - DNA, 14 bp, Homo sapiens
ctgctgcttctgct

SEQ ID NO: 786191 - DNA, 13 bp, Homo sapiens
ctgctgcttggga

SEQ ID NO: 786192 - DNA, 16 bp, Homo sapiens
ctgctggaagcccagc

SEQ ID NO: 786193 - DNA, 19 bp, Homo sapiens
ctgctggaaggggcagcag

SEQ ID NO: 786194 - DNA, 22 bp, Homo sapiens
ctgctggagaataaatttggga

SEQ ID NO: 786195 - DNA, 14 bp, Homo sapiens
ctgctggaggcctc

SEQ ID NO: 786196 - DNA, 15 bp, Homo sapiens
ctgctggaggcctca

SEQ ID NO: 786197 - DNA, 17 bp, Homo sapiens
ctgctggagtccagtgc

SEQ ID NO: 786198 - DNA, 14 bp, Homo sapiens
ctgctggagtgcag

SEQ ID NO: 786199 - DNA, 23 bp, Homo sapiens
ctgctggagttccggcctgggca

SEQ ID NO: 786200 - DNA, 23 bp, Homo sapiens
ctgctggatcacagctgctttct

SEQ ID NO: 786201 - DNA, 16 bp, Homo sapiens
ctgctggatgggactc

SEQ ID NO: 786202 - DNA, 14 bp, Homo sapiens
ctgctggcagggcc

SEQ ID NO: 786203 - DNA, 21 bp, Homo sapiens
ctgctggcagggccagggcaa

SEQ ID NO: 786204 - DNA, 22 bp, Homo sapiens
ctgctggcagggccagggcaat

SEQ ID NO: 786205 - DNA, 15 bp, Homo sapiens
ctgctggcatcaaga

SEQ ID NO: 786206 - DNA, 21 bp, Homo sapiens
ctgctggccatgaatctctgc

SEQ ID NO: 786207 - DNA, 15 bp, Homo sapiens
ctgctggcccagcca

SEQ ID NO: 786208 - DNA, 16 bp, Homo sapiens
ctgctggcccagccaa

SEQ ID NO: 786209 - DNA, 18 bp, Homo sapiens
ctgcttgcagccaggaga

SEQ ID NO: 786210 - DNA, 23 bp, Homo sapiens
ctgcttgccaaggcagaggcctg

SEQ ID NO: 786211 - DNA, 19 bp, Homo sapiens
ctgcttgcctagccccagg

SEQ ID NO: 786212 - DNA, 22 bp, Homo sapiens
ctgcttgcttttgcctctgccc

SEQ ID NO: 786213 - DNA, 17 bp, Homo sapiens
ctgcttggatgcgagct

SEQ ID NO: 786214 - DNA, 12 bp, Homo sapiens
ctgcttggccag

SEQ ID NO: 786215 - DNA, 20 bp, Homo sapiens
ctgcttggccagatgcgggg

SEQ ID NO: 786216 - DNA, 15 bp, Homo sapiens
ctgcttgtgatctca

SEQ ID NO: 786217 - DNA, 17 bp, Homo sapiens
ctgcttgtgatctcaca

SEQ ID NO: 786218 - DNA, 22 bp, Homo sapiens
ctgcttgtgcctcccttcccag

SEQ ID NO: 786219 - DNA, 21 bp, Homo sapiens
ctgctttaaagggcctgcctg

SEQ ID NO: 786220 - DNA, 15 bp, Homo sapiens
ctgctttcccctgtg

SEQ ID NO: 786221 - DNA, 16 bp, Homo sapiens
ctgctttcccctgtgg

SEQ ID NO: 786222 - DNA, 18 bp, Homo sapiens
ctgctttcccctgtgggg

SEQ ID NO: 786223 - DNA, 20 bp, Homo sapiens
ctgctttcccctgtggggat

SEQ ID NO: 786224 - DNA, 24 bp, Homo sapiens
ctgctttcctatctagcatttatt

SEQ ID NO: 786225 - DNA, 13 bp, Homo sapiens
ctgctttctgttc

SEQ ID NO: 786226 - DNA, 15 bp, Homo sapiens
ctgctttctgttcca

SEQ ID NO: 786227 - DNA, 21 bp, Homo sapiens
ctgctttgatttttgaagttg

SEQ ID NO: 786228 - DNA, 13 bp, Homo sapiens
ctgctttgcaaag

SEQ ID NO: 786229 - DNA, 15 bp, Homo sapiens
ctgctttgcaaagac

SEQ ID NO: 786230 - DNA, 18 bp, Homo sapiens
ctgctttgcgtgcccggg

SEQ ID NO: 786231 - DNA, 15 bp, Homo sapiens
ctgctttggcagtgc

SEQ ID NO: 786232 - DNA, 23 bp, Homo sapiens
ctggcccctccagaccctgcctg

SEQ ID NO: 786233 - DNA, 21 bp, Homo sapiens
ctggcccgccctcacctctga

SEQ ID NO: 786234 - DNA, 18 bp, Homo sapiens
ctggcccgtgacagactc

SEQ ID NO: 786235 - DNA, 14 bp, Homo sapiens
ctggccctatttag

SEQ ID NO: 786236 - DNA, 15 bp, Homo sapiens
ctggccctccctccc

SEQ ID NO: 786237 - DNA, 20 bp, Homo sapiens
ctggccctccctccctagcc

SEQ ID NO: 786238 - DNA, 19 bp, Homo sapiens
ctggccctgaggtgtgggg

SEQ ID NO: 786239 - DNA, 12 bp, Homo sapiens
ctggccctgcct

SEQ ID NO: 786240 - DNA, 17 bp, Homo sapiens
ctggccctgcttcctgc

SEQ ID NO: 786241 - DNA, 20 bp, Homo sapiens
ctggccctggggatcttccc

SEQ ID NO: 786242 - DNA, 20 bp, Homo sapiens
ctggccctggggtgtgtctc

SEQ ID NO: 786243 - DNA, 21 bp, Homo sapiens
ctggccctgtgcagaccttac

SEQ ID NO: 786244 - DNA, 14 bp, Homo sapiens
ctggcccttagaga

SEQ ID NO: 786245 - DNA, 14 bp, Homo sapiens
ctggcccttcagtc

SEQ ID NO: 786246 - DNA, 18 bp, Homo sapiens
ctggcccttcagtctgct

SEQ ID NO: 786247 - DNA, 21 bp, Homo sapiens
ctggcccttcagtctgctcca

SEQ ID NO: 786248 - DNA, 15 bp, Homo sapiens
ctggccgacccactg

SEQ ID NO: 786249 - DNA, 17 bp, Homo sapiens
ctggccgagtccaagct

SEQ ID NO: 786250 - DNA, 15 bp, Homo sapiens
ctggccgcagaggtg

SEQ ID NO: 786251 - DNA, 14 bp, Homo sapiens
ctggccgccccctg

SEQ ID NO: 786252 - DNA, 14 bp, Homo sapiens
ctggccgctgagcg

SEQ ID NO: 786253 - DNA, 15 bp, Homo sapiens
ctggccgctgagcgc

SEQ ID NO: 786254 - DNA, 17 bp, Homo sapiens
ctggccgctgagcgccc

SEQ ID NO: 786255 - DNA, 20 bp, Homo sapiens
ctggcctaatcactctgagt

SEQ ID NO: 786256 - DNA, 21 bp, Homo sapiens
ctggcctaggagatatctgag

SEQ ID NO: 786257 - DNA, 23 bp, Homo sapiens
ctggcctaggagatatctgaggg

SEQ ID NO: 786258 - DNA, 19 bp, Homo sapiens
ctggcctatccgctgccag

SEQ ID NO: 786259 - DNA, 20 bp, Homo sapiens
ctggcctcacgtgtctcaga

SEQ ID NO: 786260 - DNA, 15 bp, Homo sapiens
ctggcctcactggct

SEQ ID NO: 786261 - DNA, 20 bp, Homo sapiens
ctggcctcactggctggggc

SEQ ID NO: 786262 - DNA, 17 bp, Homo sapiens
ctggcctcagttcccag

SEQ ID NO: 786263 - DNA, 16 bp, Homo sapiens
ctggcctcccaaatga

SEQ ID NO: 786264 - DNA, 23 bp, Homo sapiens
ctggcctcccacccgatgctgct

SEQ ID NO: 786265 - DNA, 21 bp, Homo sapiens
ctggcctcccccaacacctgc

SEQ ID NO: 786266 - DNA, 21 bp, Homo sapiens
ctggcctcctaaggctcccca

SEQ ID NO: 786267 - DNA, 22 bp, Homo sapiens
ctggcctcctaaggctccccac

SEQ ID NO: 786268 - DNA, 15 bp, Homo sapiens
ctggcctccttcccc

SEQ ID NO: 786269 - DNA, 17 bp, Homo sapiens
ctggcctcgcctgcctt

SEQ ID NO: 786270 - DNA, 20 bp, Homo sapiens
ctggcctcgtgatctgccct

SEQ ID NO: 786271 - DNA, 14 bp, Homo sapiens
ctggcctctctagc

SEQ ID NO: 786272 - DNA, 16 bp, Homo sapiens
ctggcctctctgacat

SEQ ID NO: 786273 - DNA, 17 bp, Homo sapiens
ctggcctctgtgattac

SEQ ID NO: 786274 - DNA, 19 bp, Homo sapiens
ctggcctctgtgattacat

SEQ ID NO: 786275 - DNA, 22 bp, Homo sapiens
ctggcctctgtgattacataga

SEQ ID NO: 786276 - DNA, 23 bp, Homo sapiens
ctggcctctgtgattacatagat

SEQ ID NO: 786277 - DNA, 17 bp, Homo sapiens
ctggcctcttctgggct

SEQ ID NO: 786278 - DNA, 16 bp, Homo sapiens
ctggcctcttgatagt

SEQ ID NO: 786279 - DNA, 19 bp, Homo sapiens
ctggcctgagaggggaagc

SEQ ID NO: 786280 - DNA, 20 bp, Homo sapiens
ctggcctgagagtcagctct

SEQ ID NO: 786281 - DNA, 12 bp, Homo sapiens
ctggcctgagct

SEQ ID NO: 786282 - DNA, 21 bp, Homo sapiens
ctggcctgagctggggccaca

SEQ ID NO: 786283 - DNA, 12 bp, Homo sapiens
ctggcctgctgg

SEQ ID NO: 786284 - DNA, 17 bp, Homo sapiens
ctggcctgctgggaacc

SEQ ID NO: 786285 - DNA, 23 bp, Homo sapiens
ctggcctgctgggaaccccgcag

SEQ ID NO: 786286 - DNA, 15 bp, Homo sapiens
ctggcctgctgggct

SEQ ID NO: 786287 - DNA, 18 bp, Homo sapiens
ctggcctggaccattcct

SEQ ID NO: 786288 - DNA, 22 bp, Homo sapiens
ctggcctggactgttttctctc

SEQ ID NO: 786289 - DNA, 15 bp, Homo sapiens
ctggcctggatctcc

SEQ ID NO: 786290 - DNA, 21 bp, Homo sapiens
ctggcctggatctccccactc

SEQ ID NO: 786291 - DNA, 14 bp, Homo sapiens
ctggcctggctccc

SEQ ID NO: 786292 - DNA, 13 bp, Homo sapiens
ctggcctgggcca

SEQ ID NO: 786293 - DNA, 21 bp, Homo sapiens
ctggcctggggtccctctgaa

SEQ ID NO: 786294 - DNA, 21 bp, Homo sapiens
ctggcctgtctccctagggaa

SEQ ID NO: 786295 - DNA, 22 bp, Homo sapiens
ctggccttaaaaggggcccaag

SEQ ID NO: 786296 - DNA, 19 bp, Homo sapiens
ctggccttaaagagggaca

SEQ ID NO: 786297 - DNA, 12 bp, Homo sapiens
ctggccttcctc

SEQ ID NO: 786298 - DNA, 16 bp, Homo sapiens
ctggccttcctgccct

SEQ ID NO: 786299 - DNA, 13 bp, Homo sapiens
ctggccttctcct

SEQ ID NO: 786300 - DNA, 19 bp, Homo sapiens
ctggccttgaaaccacctt

SEQ ID NO: 786301 - DNA, 22 bp, Homo sapiens
ctggccttgcccgtcgtgtgct

SEQ ID NO: 786302 - DNA, 19 bp, Homo sapiens
ctggccttggtatgtgcca

SEQ ID NO: 786303 - DNA, 21 bp, Homo sapiens
ctggccttggtatgtgccagg

SEQ ID NO: 786304 - DNA, 15 bp, Homo sapiens
ctggccttgtacttg

SEQ ID NO: 786305 - DNA, 20 bp, Homo sapiens
ctggccttgtgtcactggct

SEQ ID NO: 786306 - DNA, 19 bp, Homo sapiens
ctggcctttgtaagtgcag

SEQ ID NO: 786307 - DNA, 14 bp, Homo sapiens
ctggcgacacactc

SEQ ID NO: 786308 - DNA, 14 bp, Homo sapiens
ctggcgacactcag

SEQ ID NO: 786309 - DNA, 22 bp, Homo sapiens
ctggcgacactcagggcagctg

SEQ ID NO: 786310 - DNA, 16 bp, Homo sapiens
ctggcgcccctgcctg

SEQ ID NO: 786311 - DNA, 21 bp, Homo sapiens
ctggcgcttggatctggggtg

SEQ ID NO: 786312 - DNA, 19 bp, Homo sapiens
ctggcggagatgggtcctg

SEQ ID NO: 786313 - DNA, 15 bp, Homo sapiens
ctggcggcgcagagg

SEQ ID NO: 786314 - DNA, 16 bp, Homo sapiens
ctggcggctactcagc

SEQ ID NO: 786315 - DNA, 18 bp, Homo sapiens
ctggcggctactcagcag

SEQ ID NO: 786316 - DNA, 23 bp, Homo sapiens
ctggcggctactcagcagccctc

SEQ ID NO: 786317 - DNA, 18 bp, Homo sapiens
ctggcggggaaccctggg

SEQ ID NO: 786318 - DNA, 20 bp, Homo sapiens
ctggcgggggtgggccgtgg

SEQ ID NO: 786319 - DNA, 22 bp, Homo sapiens
ctggcggggttggcccttgtct

SEQ ID NO: 786320 - DNA, 22 bp, Homo sapiens
ctggcgtctgtcttcaagggct

SEQ ID NO: 786321 - DNA, 23 bp, Homo sapiens
ctggcgtctgtcttcaagggctt

SEQ ID NO: 786322 - DNA, 22 bp, Homo sapiens
ctggcgtgaacccaggaggcgg

SEQ ID NO: 786323 - DNA, 22 bp, Homo sapiens
ctggcgtgctcagacccaacag

SEQ ID NO: 786324 - DNA, 19 bp, Homo sapiens
ctggcgttcacctccctgc

SEQ ID NO: 786325 - DNA, 16 bp, Homo sapiens
ctggcgttctcaagaa

SEQ ID NO: 786326 - DNA, 16 bp, Homo sapiens
ctggctaacacggtga

SEQ ID NO: 786327 - DNA, 21 bp, Homo sapiens
gcactggagccacaggcaggg

SEQ ID NO: 786328 - DNA, 22 bp, Homo sapiens
gcactggagctgggaggtctcg

SEQ ID NO: 786329 - DNA, 16 bp, Homo sapiens
gcactggagtgcaggg

SEQ ID NO: 786330 - DNA, 19 bp, Homo sapiens
gcactggcattgtccctgt

SEQ ID NO: 786331 - DNA, 16 bp, Homo sapiens
ggaaaactattgagcc

SEQ ID NO: 786332 - DNA, 21 bp, Homo sapiens
ggaaaacttttgttttttggg

SEQ ID NO: 786333 - DNA, 22 bp, Homo sapiens
ggaaaacttttgttttttgggg

SEQ ID NO: 786334 - DNA, 17 bp, Homo sapiens
ggaaaagaaagaagtta

SEQ ID NO: 786335 - DNA, 23 bp, Homo sapiens
ggaaaagaagaaactttgcctca

SEQ ID NO: 786336 - DNA, 18 bp, Homo sapiens
ggaaaagaatacagaaag

SEQ ID NO: 786337 - DNA, 22 bp, Homo sapiens
ggaaaagaatccctgcagcctg

SEQ ID NO: 786338 - DNA, 19 bp, Homo sapiens
ggaaaagactcctcctggg

SEQ ID NO: 786339 - DNA, 22 bp, Homo sapiens
ggaaaagagcgcatcaggcctg

SEQ ID NO: 786340 - DNA, 22 bp, Homo sapiens
ggaaaagcaagaaacagtttct

SEQ ID NO: 786341 - DNA, 18 bp, Homo sapiens
ggaaaagcagctctcccc

SEQ ID NO: 786342 - DNA, 20 bp, Homo sapiens
ggaaaagggtcttgggaaat

SEQ ID NO: 786343 - DNA, 21 bp, Homo sapiens
ggaaaagggtcttgggaaata

SEQ ID NO: 786344 - DNA, 17 bp, Homo sapiens
ggaaaaggtccttgcct

SEQ ID NO: 786345 - DNA, 21 bp, Homo sapiens
ggaaaaggtccttgcctcctg

SEQ ID NO: 786346 - DNA, 15 bp, Homo sapiens
ggaaaaggttgaata

SEQ ID NO: 786347 - DNA, 20 bp, Homo sapiens
ggaaaaggttgaataatata

SEQ ID NO: 786348 - DNA, 14 bp, Homo sapiens
ggaaaagttaaact

SEQ ID NO: 786349 - DNA, 15 bp, Homo sapiens
ggaaaatatttcctg

SEQ ID NO: 786350 - DNA, 15 bp, Homo sapiens
ggaaaatcagcctgc

SEQ ID NO: 786351 - DNA, 22 bp, Homo sapiens
ggaaaatctatatttgtcttcc

SEQ ID NO: 786352 - DNA, 21 bp, Homo sapiens
ggaaaatgagtatttggtcca

SEQ ID NO: 786353 - DNA, 20 bp, Homo sapiens
ggaaaatgcagcagggatgc

SEQ ID NO: 786354 - DNA, 16 bp, Homo sapiens
ggaaaatggccatgca

SEQ ID NO: 786355 - DNA, 19 bp, Homo sapiens
ggaaaatgtatccagagga

SEQ ID NO: 786356 - DNA, 12 bp, Homo sapiens
ggaaaattattt

SEQ ID NO: 786357 - DNA, 13 bp, Homo sapiens
ggaaaattgaaag

SEQ ID NO: 786358 - DNA, 16 bp, Homo sapiens
ggaaaattgaaagtat

SEQ ID NO: 786359 - DNA, 15 bp, Homo sapiens
ggaaaattttctcct

SEQ ID NO: 786360 - DNA, 13 bp, Homo sapiens
ggaaacaaatgtg

SEQ ID NO: 786361 - DNA, 20 bp, Homo sapiens
ggaaacaagtgaccccaggg

SEQ ID NO: 786362 - DNA, 17 bp, Homo sapiens
ggaaacaccattataaa

SEQ ID NO: 786363 - DNA, 11 bp, Homo sapiens
ggaaacagcat

SEQ ID NO: 786364 - DNA, 12 bp, Homo sapiens
ggaaacagcatg

SEQ ID NO: 786365 - DNA, 16 bp, Homo sapiens
ggaaacagcatgaata

SEQ ID NO: 786366 - DNA, 13 bp, Homo sapiens
ggaaacagcttta

SEQ ID NO: 786367 - DNA, 17 bp, Homo sapiens
ggaaaccaagtggtcag

SEQ ID NO: 786368 - DNA, 19 bp, Homo sapiens
ggaaaccaagtggtcagga

SEQ ID NO: 786369 - DNA, 17 bp, Homo sapiens
ggaaaccacaaccttgc

SEQ ID NO: 786370 - DNA, 19 bp, Homo sapiens
ggaaaccacaaccttgcag

SEQ ID NO: 786371 - DNA, 22 bp, Homo sapiens
ggaaaccgagtagaaaatgtga

SEQ ID NO: 786372 - DNA, 13 bp, Homo sapiens
ggaaacctgccct

SEQ ID NO: 786373 - DNA, 14 bp, Homo sapiens
ggaaacctgccctg

SEQ ID NO: 786374 - DNA, 15 bp, Homo sapiens
ggaaaccttggagag

SEQ ID NO: 786375 - DNA, 14 bp, Homo sapiens
ggaaacgcacttac

SEQ ID NO: 786376 - DNA, 23 bp, Homo sapiens
ggaaacggtatcctccctgccca

SEQ ID NO: 786377 - DNA, 22 bp, Homo sapiens
ggaaacgtatgtgtgcaggagc

SEQ ID NO: 786378 - DNA, 17 bp, Homo sapiens
ggaaactaccaggtgtg

SEQ ID NO: 786379 - DNA, 19 bp, Homo sapiens
ggaaactatgtgtttttct

SEQ ID NO: 786380 - DNA, 18 bp, Homo sapiens
ggaaactcacactcccct

SEQ ID NO: 786381 - DNA, 21 bp, Homo sapiens
ggaaactcacctgctggcccc

SEQ ID NO: 786382 - DNA, 21 bp, Homo sapiens
ggaaactccacatctgcctta

SEQ ID NO: 786383 - DNA, 12 bp, Homo sapiens
ggaaactttatt

SEQ ID NO: 786384 - DNA, 23 bp, Homo sapiens
ggaaagataataaattgatttgt

SEQ ID NO: 786385 - DNA, 19 bp, Homo sapiens
ggaaagatgttaagcattt

SEQ ID NO: 786386 - DNA, 13 bp, Homo sapiens
ggaaagcagaact

SEQ ID NO: 786387 - DNA, 15 bp, Homo sapiens
ggaaagcagaactga

SEQ ID NO: 786388 - DNA, 21 bp, Homo sapiens
ggaaagcagagcctcctggga

SEQ ID NO: 786389 - DNA, 19 bp, Homo sapiens
ggaaagcaggtggcatctc

SEQ ID NO: 786390 - DNA, 21 bp, Homo sapiens
ggaaagcaggtggcatctcta

SEQ ID NO: 786391 - DNA, 19 bp, Homo sapiens
ggaaagccacacggagagg

SEQ ID NO: 786392 - DNA, 20 bp, Homo sapiens
ggaaagccattgaccaccca

SEQ ID NO: 786393 - DNA, 16 bp, Homo sapiens
ggaaagccctccccct

SEQ ID NO: 786394 - DNA, 13 bp, Homo sapiens
ggaaagcctctgc

SEQ ID NO: 786395 - DNA, 19 bp, Homo sapiens
ggaaagcgcctccaaccct

SEQ ID NO: 786396 - DNA, 23 bp, Homo sapiens
ggaaagctcagctactgattttt

SEQ ID NO: 786397 - DNA, 13 bp, Homo sapiens
ggaaaggacccac

SEQ ID NO: 786398 - DNA, 15 bp, Homo sapiens
ggaaaggacccaccc

SEQ ID NO: 786399 - DNA, 21 bp, Homo sapiens
ggaaaggagtagaaaaagcag

SEQ ID NO: 786400 - DNA, 19 bp, Homo sapiens
ggaaaggctcagtctcagg

SEQ ID NO: 786401 - DNA, 15 bp, Homo sapiens
ggaaaggctctgaaa

SEQ ID NO: 786402 - DNA, 15 bp, Homo sapiens
ggaaagggcctggcc

SEQ ID NO: 786403 - DNA, 15 bp, Homo sapiens
ggaaaggggcgagca

SEQ ID NO: 786404 - DNA, 18 bp, Homo sapiens
ggaaaggggggagctggg

SEQ ID NO: 786405 - DNA, 18 bp, Homo sapiens
ggaaagtcagaatcagaa

SEQ ID NO: 786406 - DNA, 19 bp, Homo sapiens
ggaaagtgaatttgaatga

SEQ ID NO: 786407 - DNA, 21 bp, Homo sapiens
ggaaagtgcgttctcccagca

SEQ ID NO: 786408 - DNA, 23 bp, Homo sapiens
ggaaagtggccaagaagcagtgg

SEQ ID NO: 786409 - DNA, 18 bp, Homo sapiens
ggaaataaaacctttcaa

SEQ ID NO: 786410 - DNA, 22 bp, Homo sapiens
ggaaataaaacctttcaaattt

SEQ ID NO: 786411 - DNA, 14 bp, Homo sapiens
ggaaataacagaga

SEQ ID NO: 786412 - DNA, 18 bp, Homo sapiens
ggaaataacagagagaat

SEQ ID NO: 786413 - DNA, 17 bp, Homo sapiens
ggaaataatttgaatgt

SEQ ID NO: 786414 - DNA, 13 bp, Homo sapiens
ggaaatagaaaga

SEQ ID NO: 786415 - DNA, 15 bp, Homo sapiens
ggaaatagcatgaca

SEQ ID NO: 786416 - DNA, 20 bp, Homo sapiens
ggaaatagggcaagaattct

SEQ ID NO: 786417 - DNA, 14 bp, Homo sapiens
ggaaatatatatgt

SEQ ID NO: 786418 - DNA, 16 bp, Homo sapiens
ggaaatatcagttact

SEQ ID NO: 786419 - DNA, 14 bp, Homo sapiens
ggaaatatgaatgc

SEQ ID NO: 786420 - DNA, 20 bp, Homo sapiens
ggaaatccattgtttaaaga

SEQ ID NO: 786421 - DNA, 20 bp, Homo sapiens
ggaaatcctagtttcctctc

SEQ ID NO: 786422 - DNA, 22 bp, Homo sapiens
ggaaatcctagtttcctctcct

SEQ ID NO: 786423 - DNA, 18 bp, Homo sapiens
ggaaatctcaccccatcc

SEQ ID NO: 786424 - DNA, 22 bp, Homo sapiens
ggaaatcttttacatttttcct

SEQ ID NO: 786425 - DNA, 15 bp, Homo sapiens
ggaaatgaaagaaag

SEQ ID NO: 786426 - DNA, 20 bp, Homo sapiens
ggaaatgaacattggggatt

SEQ ID NO: 786427 - DNA, 15 bp, Homo sapiens
ggaaatgaagcaggg

SEQ ID NO: 786428 - DNA, 23 bp, Homo sapiens
ggaaatgagtggccagcgccagg

SEQ ID NO: 786429 - DNA, 22 bp, Homo sapiens
ggaaatgctattgttgtgggct

SEQ ID NO: 786430 - DNA, 22 bp, Homo sapiens
ggaaatggggaaagcagaactg

SEQ ID NO: 786431 - DNA, 15 bp, Homo sapiens
ggaaatgtaatactg

SEQ ID NO: 786432 - DNA, 18 bp, Homo sapiens
ggaaatgtcacagaagca

SEQ ID NO: 786433 - DNA, 14 bp, Homo sapiens
ggaaatgtcctgca

SEQ ID NO: 786434 - DNA, 14 bp, Homo sapiens
ggaaattaagaaga

SEQ ID NO: 786435 - DNA, 14 bp, Homo sapiens
ggaaattagtcttt

SEQ ID NO: 786436 - DNA, 23 bp, Homo sapiens
ggaaattttacaagggcataaag

SEQ ID NO: 786437 - DNA, 15 bp, Homo sapiens
ggaacaaacagggct

SEQ ID NO: 786438 - DNA, 15 bp, Homo sapiens
ggaacaaattatttt

SEQ ID NO: 786439 - DNA, 19 bp, Homo sapiens
ggaacaacttgtagcagct

SEQ ID NO: 786440 - DNA, 18 bp, Homo sapiens
ggaacaatagaataatct

SEQ ID NO: 786441 - DNA, 21 bp, Homo sapiens
ggaacaattgaagtaaacttt

SEQ ID NO: 786442 - DNA, 14 bp, Homo sapiens
ggaacacggccaca

SEQ ID NO: 786443 - DNA, 14 bp, Homo sapiens
ggaacactggaaca

SEQ ID NO: 786444 - DNA, 22 bp, Homo sapiens
ggaacactggtgggcagctgag

SEQ ID NO: 786445 - DNA, 23 bp, Homo sapiens
ggaacactggtgggcagctgagg

SEQ ID NO: 786446 - DNA, 12 bp, Homo sapiens
ggaacagaagga

SEQ ID NO: 786447 - DNA, 12 bp, Homo sapiens
ggaacagaatgt

SEQ ID NO: 786448 - DNA, 18 bp, Homo sapiens
ggaacagacaacagaagt

SEQ ID NO: 786449 - DNA, 20 bp, Homo sapiens
ggaacagacaacagaagtca

SEQ ID NO: 786450 - DNA, 16 bp, Homo sapiens
ggaacagacaggagaa

SEQ ID NO: 786451 - DNA, 17 bp, Homo sapiens
ggaacagacctgaggct

SEQ ID NO: 786452 - DNA, 20 bp, Homo sapiens
ggaacagcgggagacctgtg

SEQ ID NO: 786453 - DNA, 22 bp, Homo sapiens
ggaacaggccccacgccctctc

SEQ ID NO: 786454 - DNA, 16 bp, Homo sapiens
ggaacagtggctgggt

SEQ ID NO: 786455 - DNA, 17 bp, Homo sapiens
gctgggagtccttacct

SEQ ID NO: 786456 - DNA, 19 bp, Homo sapiens
gctgggagtccttacctcg

SEQ ID NO: 786457 - DNA, 18 bp, Homo sapiens
gctgggataactggccag

SEQ ID NO: 786458 - DNA, 17 bp, Homo sapiens
gctgggatgacaggtgt

SEQ ID NO: 786459 - DNA, 18 bp, Homo sapiens
gctgggatgacaggtgtg

SEQ ID NO: 786460 - DNA, 19 bp, Homo sapiens
gctgggatgacaggtgtga

SEQ ID NO: 786461 - DNA, 19 bp, Homo sapiens
gctgggatgtgtgctttcc

SEQ ID NO: 786462 - DNA, 17 bp, Homo sapiens
gctgggattacaggcat

SEQ ID NO: 786463 - DNA, 16 bp, Homo sapiens
gctgggattgtgggca

SEQ ID NO: 786464 - DNA, 24 bp, Homo sapiens
gctgggatttcttcgctgctctag

SEQ ID NO: 786465 - DNA, 14 bp, Homo sapiens
gctgggcaccgtgt

SEQ ID NO: 786466 - DNA, 22 bp, Homo sapiens
gctgggcaccgtgtcctcctct

SEQ ID NO: 786467 - DNA, 23 bp, Homo sapiens
gctgggcaccgtgtcctcctctg

SEQ ID NO: 786468 - DNA, 12 bp, Homo sapiens
gctgggcacctg

SEQ ID NO: 786469 - DNA, 15 bp, Homo sapiens
gctgggcacctgact

SEQ ID NO: 786470 - DNA, 14 bp, Homo sapiens
gctgggcactgctc

SEQ ID NO: 786471 - DNA, 16 bp, Homo sapiens
gctgggcactgctcca

SEQ ID NO: 786472 - DNA, 17 bp, Homo sapiens
gctgggcactgctccaa

SEQ ID NO: 786473 - DNA, 20 bp, Homo sapiens
gctgggcactgctccaaggg

SEQ ID NO: 786474 - DNA, 12 bp, Homo sapiens
gctgggcagccc

SEQ ID NO: 786475 - DNA, 13 bp, Homo sapiens
gctgggcagcccg

SEQ ID NO: 786476 - DNA, 17 bp, Homo sapiens
gctgggcagccttgggg

SEQ ID NO: 786477 - DNA, 14 bp, Homo sapiens
gctgggcaggttgg

SEQ ID NO: 786478 - DNA, 13 bp, Homo sapiens
gctgggcatactt

SEQ ID NO: 786479 - DNA, 21 bp, Homo sapiens
gctgggcatcccagcttgccc

SEQ ID NO: 786480 - DNA, 12 bp, Homo sapiens
gctgggccaggg

SEQ ID NO: 786481 - DNA, 13 bp, Homo sapiens
gctgggccaggga

SEQ ID NO: 786482 - DNA, 20 bp, Homo sapiens
gctgggccatgtccaaagag

SEQ ID NO: 786483 - DNA, 23 bp, Homo sapiens
gctgggcccaaaggcccagggag

SEQ ID NO: 786484 - DNA, 19 bp, Homo sapiens
gctgggcccacccagggag

SEQ ID NO: 786485 - DNA, 13 bp, Homo sapiens
gctgggcccagcc

SEQ ID NO: 786486 - DNA, 16 bp, Homo sapiens
gctgggccccatgctc

SEQ ID NO: 786487 - DNA, 22 bp, Homo sapiens
gctgggccccatgctctgcccc

SEQ ID NO: 786488 - DNA, 15 bp, Homo sapiens
gctgggcccctgcac

SEQ ID NO: 786489 - DNA, 17 bp, Homo sapiens
gctgggcccctgcacag

SEQ ID NO: 786490 - DNA, 13 bp, Homo sapiens
gctgggcccctgg

SEQ ID NO: 786491 - DNA, 15 bp, Homo sapiens
gctgggcccctggga

SEQ ID NO: 786492 - DNA, 17 bp, Homo sapiens
gctgggcccctgggatg

SEQ ID NO: 786493 - DNA, 17 bp, Homo sapiens
gctgggcccctggggac

SEQ ID NO: 786494 - DNA, 18 bp, Homo sapiens
gctgggcccctggggaca

SEQ ID NO: 786495 - DNA, 19 bp, Homo sapiens
gctgggcccctggggacag

SEQ ID NO: 786496 - DNA, 19 bp, Homo sapiens
gctgggccgcaagggcctg

SEQ ID NO: 786497 - DNA, 21 bp, Homo sapiens
gctgggccgcaagggcctgga

SEQ ID NO: 786498 - DNA, 21 bp, Homo sapiens
gctgggcctgtgcactgggca

SEQ ID NO: 786499 - DNA, 18 bp, Homo sapiens
gctgggcgtgtgtgacac

SEQ ID NO: 786500 - DNA, 14 bp, Homo sapiens
gctgggctctccac

SEQ ID NO: 786501 - DNA, 15 bp, Homo sapiens
gctgggctctccacc

SEQ ID NO: 786502 - DNA, 21 bp, Homo sapiens
gctgggctctgccaccctacc

SEQ ID NO: 786503 - DNA, 15 bp, Homo sapiens
gctgggctctgcctt

SEQ ID NO: 786504 - DNA, 20 bp, Homo sapiens
gctgggctgagcccctaccc

SEQ ID NO: 786505 - DNA, 22 bp, Homo sapiens
gctgggctgagcccctacccca

SEQ ID NO: 786506 - DNA, 18 bp, Homo sapiens
gctgggctgagcccctgg

SEQ ID NO: 786507 - DNA, 12 bp, Homo sapiens
gctgggctgggc

SEQ ID NO: 786508 - DNA, 15 bp, Homo sapiens
gctgggctgggctga

SEQ ID NO: 786509 - DNA, 19 bp, Homo sapiens
gctgggctgggctgagccc

SEQ ID NO: 786510 - DNA, 18 bp, Homo sapiens
gctgggcttggcctggag

SEQ ID NO: 786511 - DNA, 22 bp, Homo sapiens
gctggggaagaggactgtgtga

SEQ ID NO: 786512 - DNA, 20 bp, Homo sapiens
gctggggaagggttttcttt

SEQ ID NO: 786513 - DNA, 20 bp, Homo sapiens
gctggggaagtacgtcccag

SEQ ID NO: 786514 - DNA, 17 bp, Homo sapiens
gctggggacccacccag

SEQ ID NO: 786515 - DNA, 14 bp, Homo sapiens
gctggggactcagg

SEQ ID NO: 786516 - DNA, 17 bp, Homo sapiens
gctggggactcagggac

SEQ ID NO: 786517 - DNA, 16 bp, Homo sapiens
gctggggactctggca

SEQ ID NO: 786518 - DNA, 18 bp, Homo sapiens
gctggggactctggcaca

SEQ ID NO: 786519 - DNA, 13 bp, Homo sapiens
gctggggactggg

SEQ ID NO: 786520 - DNA, 14 bp, Homo sapiens
gctggggagatggg

SEQ ID NO: 786521 - DNA, 18 bp, Homo sapiens
gctggggagatgggggct

SEQ ID NO: 786522 - DNA, 14 bp, Homo sapiens
gctggggaggagga

SEQ ID NO: 786523 - DNA, 16 bp, Homo sapiens
gctggggaggaggaga

SEQ ID NO: 786524 - DNA, 14 bp, Homo sapiens
gctggggaggtgct

SEQ ID NO: 786525 - DNA, 18 bp, Homo sapiens
gctggggaggtgctgggg

SEQ ID NO: 786526 - DNA, 18 bp, Homo sapiens
gctggggaggtgggaggc

SEQ ID NO: 786527 - DNA, 14 bp, Homo sapiens
gctggggagtccct

SEQ ID NO: 786528 - DNA, 22 bp, Homo sapiens
gctggggatccccgcctggcca

SEQ ID NO: 786529 - DNA, 10 bp, Homo sapiens
gctggggcag

SEQ ID NO: 786530 - DNA, 19 bp, Homo sapiens
gctggggcagaggggcagc

SEQ ID NO: 786531 - DNA, 20 bp, Homo sapiens
gctggggcagaggggcagcc

SEQ ID NO: 786532 - DNA, 15 bp, Homo sapiens
gctggggcaggggcc

SEQ ID NO: 786533 - DNA, 19 bp, Homo sapiens
gctggggcaggggcctggg

SEQ ID NO: 786534 - DNA, 20 bp, Homo sapiens
gctggggcaggggcctgggc

SEQ ID NO: 786535 - DNA, 13 bp, Homo sapiens
gctggggccagag

SEQ ID NO: 786536 - DNA, 19 bp, Homo sapiens
gctggggccagaggctggg

SEQ ID NO: 786537 - DNA, 15 bp, Homo sapiens
gctggggccccatct

SEQ ID NO: 786538 - DNA, 18 bp, Homo sapiens
gctggggccggggctgag

SEQ ID NO: 786539 - DNA, 15 bp, Homo sapiens
gctggggcctcagac

SEQ ID NO: 786540 - DNA, 18 bp, Homo sapiens
gctggggcgtggggaggg

SEQ ID NO: 786541 - DNA, 19 bp, Homo sapiens
gctggggcgtggggagggc

SEQ ID NO: 786542 - DNA, 23 bp, Homo sapiens
gctggggctaggggaagggcttt

SEQ ID NO: 786543 - DNA, 15 bp, Homo sapiens
gctggggctgccagc

SEQ ID NO: 786544 - DNA, 18 bp, Homo sapiens
gctggggctgccagcctg

SEQ ID NO: 786545 - DNA, 15 bp, Homo sapiens
gctgggggaagggtg

SEQ ID NO: 786546 - DNA, 14 bp, Homo sapiens
gctgggggcaactg

SEQ ID NO: 786547 - DNA, 14 bp, Homo sapiens
gctgggggcacagc

SEQ ID NO: 786548 - DNA, 19 bp, Homo sapiens
gctgggggccagggctgga

SEQ ID NO: 786549 - DNA, 16 bp, Homo sapiens
gctgggggtagcctgg

SEQ ID NO: 786550 - DNA, 17 bp, Homo sapiens
gctgggggtagcctgga

SEQ ID NO: 786551 - DNA, 18 bp, Homo sapiens
gctgggggtgggccaggc

SEQ ID NO: 786552 - DNA, 12 bp, Homo sapiens
gctggggtccag

SEQ ID NO: 786553 - DNA, 14 bp, Homo sapiens
gctggggtccaggg

SEQ ID NO: 786554 - DNA, 21 bp, Homo sapiens
gctggggtctgggcagtgcca

SEQ ID NO: 786555 - DNA, 16 bp, Homo sapiens
gctggggtgagagagg

SEQ ID NO: 786556 - DNA, 14 bp, Homo sapiens
gctggggtgcactg

SEQ ID NO: 786557 - DNA, 22 bp, Homo sapiens
gctgggtaatgtgaaggcccaa

SEQ ID NO: 786558 - DNA, 21 bp, Homo sapiens
gctgggtcaaaagagccctgg

SEQ ID NO: 786559 - DNA, 16 bp, Homo sapiens
gctgggtcaggcaggg

SEQ ID NO: 786560 - DNA, 18 bp, Homo sapiens
gctgggtgccctctcagg

SEQ ID NO: 786561 - DNA, 12 bp, Homo sapiens
gctgggtgcctg

SEQ ID NO: 786562 - DNA, 13 bp, Homo sapiens
gctgggtgcctgc

SEQ ID NO: 786563 - DNA, 22 bp, Homo sapiens
gctgggtggcaccagcagcctg

SEQ ID NO: 786564 - DNA, 20 bp, Homo sapiens
gctgggtgggcccagaactg

SEQ ID NO: 786565 - DNA, 21 bp, Homo sapiens
gctgggtggttttttccccct

SEQ ID NO: 786566 - DNA, 18 bp, Homo sapiens
gctggtaacagtggctgc

SEQ ID NO: 786567 - DNA, 16 bp, Homo sapiens
gctggtaacagttcat

SEQ ID NO: 786568 - DNA, 20 bp, Homo sapiens
gctggtagaaaaaggggcct

SEQ ID NO: 786569 - DNA, 18 bp, Homo sapiens
gctggtagagacccccag

SEQ ID NO: 786570 - DNA, 19 bp, Homo sapiens
gctggtagagacccccagg

SEQ ID NO: 786571 - DNA, 16 bp, Homo sapiens
gctggtagcagcaggc

SEQ ID NO: 786572 - DNA, 14 bp, Homo sapiens
gcttatttttctga

SEQ ID NO: 786573 - DNA, 22 bp, Homo sapiens
gcttattttttaaaatatttga

SEQ ID NO: 786574 - DNA, 22 bp, Homo sapiens
gcttcaaattcaaggccttcca

SEQ ID NO: 786575 - DNA, 19 bp, Homo sapiens
gcttcaagttgtaaaaatg

SEQ ID NO: 786576 - DNA, 15 bp, Homo sapiens
gcttcacagccacac

SEQ ID NO: 786577 - DNA, 17 bp, Homo sapiens
gcttcacagtagagcca

SEQ ID NO: 786578 - DNA, 21 bp, Homo sapiens
gcttcacagtagagccagctt

SEQ ID NO: 786579 - DNA, 21 bp, Homo sapiens
gcttcaccagtctgtctactg

SEQ ID NO: 786580 - DNA, 16 bp, Homo sapiens
gcttcacccctgcact

SEQ ID NO: 786581 - DNA, 20 bp, Homo sapiens
gcttcacccctgcacttcag

SEQ ID NO: 786582 - DNA, 22 bp, Homo sapiens
gcttcaccctgaatggttccat

SEQ ID NO: 786583 - DNA, 16 bp, Homo sapiens
gcttcactcatgcaaa

SEQ ID NO: 786584 - DNA, 23 bp, Homo sapiens
gcttcactcttattgtccttcta

SEQ ID NO: 786585 - DNA, 17 bp, Homo sapiens
gcttcagcccccaccag

SEQ ID NO: 786586 - DNA, 16 bp, Homo sapiens
gcttcagccctggccc

SEQ ID NO: 786587 - DNA, 15 bp, Homo sapiens
gcttcagcctgaggc

SEQ ID NO: 786588 - DNA, 20 bp, Homo sapiens
gcttcagcctgaggctgaga

SEQ ID NO: 786589 - DNA, 20 bp, Homo sapiens
gcttcagggtatcccagacc

SEQ ID NO: 786590 - DNA, 14 bp, Homo sapiens
gcttcatgccagct

SEQ ID NO: 786591 - DNA, 13 bp, Homo sapiens
gcttcattctgga

SEQ ID NO: 786592 - DNA, 15 bp, Homo sapiens
gcttcattctggaaa

SEQ ID NO: 786593 - DNA, 11 bp, Homo sapiens
gcttcattgta

SEQ ID NO: 786594 - DNA, 14 bp, Homo sapiens
gcttcattttggag

SEQ ID NO: 786595 - DNA, 13 bp, Homo sapiens
gcttccaaagcct

SEQ ID NO: 786596 - DNA, 15 bp, Homo sapiens
gcttccaaatattgt

SEQ ID NO: 786597 - DNA, 21 bp, Homo sapiens
gcttccaaatgtgtcagaata

SEQ ID NO: 786598 - DNA, 14 bp, Homo sapiens
gcttccacctcatg

SEQ ID NO: 786599 - DNA, 20 bp, Homo sapiens
gcttccagaaggcagcaaag

SEQ ID NO: 786600 - DNA, 22 bp, Homo sapiens
gcttccagagagtcctctggat

SEQ ID NO: 786601 - DNA, 19 bp, Homo sapiens
gcttccaggaaactccaca

SEQ ID NO: 786602 - DNA, 11 bp, Homo sapiens
gcttccaggct

SEQ ID NO: 786603 - DNA, 13 bp, Homo sapiens
gcttccaggctct

SEQ ID NO: 786604 - DNA, 14 bp, Homo sapiens
gcttccatgattct

SEQ ID NO: 786605 - DNA, 19 bp, Homo sapiens
gcttccatgattctattta

SEQ ID NO: 786606 - DNA, 17 bp, Homo sapiens
gcttccatttgacaaag

SEQ ID NO: 786607 - DNA, 20 bp, Homo sapiens
gcttccatttgtgtgtgtgc

SEQ ID NO: 786608 - DNA, 16 bp, Homo sapiens
gcttcccagaggagca

SEQ ID NO: 786609 - DNA, 13 bp, Homo sapiens
gcttcccatccta

SEQ ID NO: 786610 - DNA, 21 bp, Homo sapiens
gcttcccccacccctccacgt

SEQ ID NO: 786611 - DNA, 18 bp, Homo sapiens
gcttcccctccctaccct

SEQ ID NO: 786612 - DNA, 17 bp, Homo sapiens
gcttcccgctcagccct

SEQ ID NO: 786613 - DNA, 15 bp, Homo sapiens
gcttccctaaactgc

SEQ ID NO: 786614 - DNA, 17 bp, Homo sapiens
gcttccctaaactgcag

SEQ ID NO: 786615 - DNA, 18 bp, Homo sapiens
gcttccctaaactgcagc

SEQ ID NO: 786616 - DNA, 22 bp, Homo sapiens
gcttccctaaactgcagcctct

SEQ ID NO: 786617 - DNA, 12 bp, Homo sapiens
gcttccctctgc

SEQ ID NO: 786618 - DNA, 15 bp, Homo sapiens
gcttccctctgcctg

SEQ ID NO: 786619 - DNA, 17 bp, Homo sapiens
gcttccctgaaagactg

SEQ ID NO: 786620 - DNA, 13 bp, Homo sapiens
gcttccctggcat

SEQ ID NO: 786621 - DNA, 14 bp, Homo sapiens
gcttccgagacacc

SEQ ID NO: 786622 - DNA, 16 bp, Homo sapiens
gcttcctcacacccct

SEQ ID NO: 786623 - DNA, 20 bp, Homo sapiens
gcttcctcacacccctgtcc

SEQ ID NO: 786624 - DNA, 22 bp, Homo sapiens
gcttcctcacacccctgtccca

SEQ ID NO: 786625 - DNA, 22 bp, Homo sapiens
gcttcctcagtaacatttctgt

SEQ ID NO: 786626 - DNA, 20 bp, Homo sapiens
gcttcctcccaacaagcagc

SEQ ID NO: 786627 - DNA, 19 bp, Homo sapiens
gcttcctccgtccacccag

SEQ ID NO: 786628 - DNA, 23 bp, Homo sapiens
gcttcctccgtccacccaggctg

SEQ ID NO: 786629 - DNA, 15 bp, Homo sapiens
gcttcctcctcaggc

SEQ ID NO: 786630 - DNA, 23 bp, Homo sapiens
gcttcctctagaagccaagggaa

SEQ ID NO: 786631 - DNA, 14 bp, Homo sapiens
gcttcctcttcttg

SEQ ID NO: 786632 - DNA, 13 bp, Homo sapiens
gcttcctgccctt

SEQ ID NO: 786633 - DNA, 18 bp, Homo sapiens
gcttcctgcccttccctc

SEQ ID NO: 786634 - DNA, 20 bp, Homo sapiens
gcttcctgcgtcctcctcac

SEQ ID NO: 786635 - DNA, 13 bp, Homo sapiens
gcttcctgctgta

SEQ ID NO: 786636 - DNA, 14 bp, Homo sapiens
gcttcctgcttgcc

SEQ ID NO: 786637 - DNA, 21 bp, Homo sapiens
gcttcctgcttgccaaggcag

SEQ ID NO: 786638 - DNA, 15 bp, Homo sapiens
gcttcctggctctgg

SEQ ID NO: 786639 - DNA, 16 bp, Homo sapiens
gcttcctgggtcctgt

SEQ ID NO: 786640 - DNA, 13 bp, Homo sapiens
gcttcctgtccac

SEQ ID NO: 786641 - DNA, 14 bp, Homo sapiens
gcttcctgtgccct

SEQ ID NO: 786642 - DNA, 16 bp, Homo sapiens
gcttcctgtgccctca

SEQ ID NO: 786643 - DNA, 22 bp, Homo sapiens
gcttcctgtgctaagtctttcc

SEQ ID NO: 786644 - DNA, 17 bp, Homo sapiens
gcttccttcagtttgta

SEQ ID NO: 786645 - DNA, 18 bp, Homo sapiens
gcttcctttctctcctgg

SEQ ID NO: 786646 - DNA, 18 bp, Homo sapiens
gcttcgaactccaggctt

SEQ ID NO: 786647 - DNA, 17 bp, Homo sapiens
gcttcgactactgctcc

SEQ ID NO: 786648 - DNA, 19 bp, Homo sapiens
gcttcgactactgctcctg

SEQ ID NO: 786649 - DNA, 17 bp, Homo sapiens
gcttcgaggacaggaaa

SEQ ID NO: 786650 - DNA, 20 bp, Homo sapiens
gcttcgaggacaggaaaggc

SEQ ID NO: 786651 - DNA, 20 bp, Homo sapiens
gcttcggagggccgcagggc

SEQ ID NO: 786652 - DNA, 23 bp, Homo sapiens
gcttcggagggccgcagggccca

SEQ ID NO: 786653 - DNA, 22 bp, Homo sapiens
gcttcggccacaggcaggtcac

SEQ ID NO: 786654 - DNA, 17 bp, Homo sapiens
gcttcggccgcgccacc

SEQ ID NO: 786655 - DNA, 18 bp, Homo sapiens
gcttcgggcccttcccac

SEQ ID NO: 786656 - DNA, 23 bp, Homo sapiens
gcttcggtgtgcagatcatccgt

SEQ ID NO: 786657 - DNA, 14 bp, Homo sapiens
gcttcgtttatttt

SEQ ID NO: 786658 - DNA, 17 bp, Homo sapiens
gcttctaaatgcccagt

SEQ ID NO: 786659 - DNA, 20 bp, Homo sapiens
gcttctaagtaaatacaatt

SEQ ID NO: 786660 - DNA, 15 bp, Homo sapiens
gcttctactttcatc

SEQ ID NO: 786661 - DNA, 21 bp, Homo sapiens
gcttctagaaactctggctca

SEQ ID NO: 786662 - DNA, 23 bp, Homo sapiens
gcttctagagatgtgcctgtggg

SEQ ID NO: 786663 - DNA, 20 bp, Homo sapiens
gcttctaggagtcaactggc

SEQ ID NO: 786664 - DNA, 23 bp, Homo sapiens
gcttctaggagtcaactggctgg

SEQ ID NO: 786665 - DNA, 18 bp, Homo sapiens
gcttctagtttgcaactt

SEQ ID NO: 786666 - DNA, 12 bp, Homo sapiens
gcttctatccca

SEQ ID NO: 786667 - DNA, 23 bp, Homo sapiens
gcttctattacctattaggtgga

SEQ ID NO: 786668 - DNA, 22 bp, Homo sapiens
gcttctccaatgctctggagtg

SEQ ID NO: 786669 - DNA, 12 bp, Homo sapiens
gcttctcccatt

SEQ ID NO: 786670 - DNA, 15 bp, Homo sapiens
gcttctcccatttcc

SEQ ID NO: 786671 - DNA, 19 bp, Homo sapiens
gcttctcccatttcctgat

SEQ ID NO: 786672 - DNA, 22 bp, Homo sapiens
gcttgtaactccaccaacccat

SEQ ID NO: 786673 - DNA, 18 bp, Homo sapiens
gcttgtaatcaagccttt

SEQ ID NO: 786674 - DNA, 14 bp, Homo sapiens
gcttgtacataatg

SEQ ID NO: 786675 - DNA, 22 bp, Homo sapiens
gcttgtaccacttttgcaaata

SEQ ID NO: 786676 - DNA, 19 bp, Homo sapiens
gcttgtactaagccaggag

SEQ ID NO: 786677 - DNA, 19 bp, Homo sapiens
gcttgtagaactcactctg

SEQ ID NO: 786678 - DNA, 22 bp, Homo sapiens
gcttgtagaagtaggaggaaac

SEQ ID NO: 786679 - DNA, 18 bp, Homo sapiens
gcttgtagaatttttaaa

SEQ ID NO: 786680 - DNA, 14 bp, Homo sapiens
gcttgtaggagctg

SEQ ID NO: 786681 - DNA, 18 bp, Homo sapiens
gcttgtattgtaaatgtg

SEQ ID NO: 786682 - DNA, 13 bp, Homo sapiens
gcttgtcagagct

SEQ ID NO: 786683 - DNA, 14 bp, Homo sapiens
gcttgtcagagctg

SEQ ID NO: 786684 - DNA, 16 bp, Homo sapiens
gcttgtcagagctggg

SEQ ID NO: 786685 - DNA, 18 bp, Homo sapiens
gcttgtcagagctgggag

SEQ ID NO: 786686 - DNA, 15 bp, Homo sapiens
gcttgtcattccaga

SEQ ID NO: 786687 - DNA, 16 bp, Homo sapiens
gcttgtcctcatctct

SEQ ID NO: 786688 - DNA, 15 bp, Homo sapiens
gcttgtcctgctctc

SEQ ID NO: 786689 - DNA, 18 bp, Homo sapiens
gcttgtcctgggcctgcc

SEQ ID NO: 786690 - DNA, 14 bp, Homo sapiens
gcttgtcctgtgct

SEQ ID NO: 786691 - DNA, 20 bp, Homo sapiens
gcttgtgatttccatttctg

SEQ ID NO: 786692 - DNA, 21 bp, Homo sapiens
gcttgtgatttccatttctga

SEQ ID NO: 786693 - DNA, 23 bp, Homo sapiens
gcttgtgatttccatttctgatg

SEQ ID NO: 786694 - DNA, 14 bp, Homo sapiens
gcttgtgctcggga

SEQ ID NO: 786695 - DNA, 16 bp, Homo sapiens
gcttgttagagagaaa

SEQ ID NO: 786696 - DNA, 14 bp, Homo sapiens
gcttgttggatttt

SEQ ID NO: 786697 - DNA, 23 bp, Homo sapiens
gcttgttgggattcctgacccag

SEQ ID NO: 786698 - DNA, 9 bp, Homo sapiens
gcttgtttc

SEQ ID NO: 786699 - DNA, 20 bp, Homo sapiens
gcttgtttgatttcaacatg

SEQ ID NO: 786700 - DNA, 12 bp, Homo sapiens
gcttgttttcca

SEQ ID NO: 786701 - DNA, 20 bp, Homo sapiens
gctttaaaaagggaagaaac

SEQ ID NO: 786702 - DNA, 22 bp, Homo sapiens
gctttaaaaagggaagaaactg

SEQ ID NO: 786703 - DNA, 19 bp, Homo sapiens
gctttaaaagtatctttaa

SEQ ID NO: 786704 - DNA, 18 bp, Homo sapiens
gctttaaaagtcattatt

SEQ ID NO: 786705 - DNA, 21 bp, Homo sapiens
gctttaaaagtcattattcct

SEQ ID NO: 786706 - DNA, 15 bp, Homo sapiens
gctttaaaatatatc

SEQ ID NO: 786707 - DNA, 17 bp, Homo sapiens
gctttaaacaaattcat

SEQ ID NO: 786708 - DNA, 20 bp, Homo sapiens
gctttaaactaccctccaga

SEQ ID NO: 786709 - DNA, 22 bp, Homo sapiens
gctttaaactaccctccagagt

SEQ ID NO: 786710 - DNA, 15 bp, Homo sapiens
gctttaaataaatta

SEQ ID NO: 786711 - DNA, 16 bp, Homo sapiens
gctttaaataaattaa

SEQ ID NO: 786712 - DNA, 14 bp, Homo sapiens
gctttaatatgagc

SEQ ID NO: 786713 - DNA, 20 bp, Homo sapiens
gctttaatatgagcttcaat

SEQ ID NO: 786714 - DNA, 22 bp, Homo sapiens
gctttaatatgagcttcaatat

SEQ ID NO: 786715 - DNA, 23 bp, Homo sapiens
gctttaatatgagcttcaatata

SEQ ID NO: 786716 - DNA, 23 bp, Homo sapiens
gctttaattaattaagtatctgg

SEQ ID NO: 786717 - DNA, 15 bp, Homo sapiens
gctttaattgtataa

SEQ ID NO: 786718 - DNA, 16 bp, Homo sapiens
gctttaattgtataag

SEQ ID NO: 786719 - DNA, 13 bp, Homo sapiens
gctttacatattc

SEQ ID NO: 786720 - DNA, 20 bp, Homo sapiens
gctttacatgctgtgctctt

SEQ ID NO: 786721 - DNA, 20 bp, Homo sapiens
gctttaccttttcagggctg

SEQ ID NO: 786722 - DNA, 22 bp, Homo sapiens
gctttaccttttcagggctggc

SEQ ID NO: 786723 - DNA, 16 bp, Homo sapiens
gctttactgtttgtta

SEQ ID NO: 786724 - DNA, 16 bp, Homo sapiens
gctttagaccctgggt

SEQ ID NO: 786725 - DNA, 13 bp, Homo sapiens
gctttaggggtgg

SEQ ID NO: 786726 - DNA, 18 bp, Homo sapiens
gctttatatatggacatg

SEQ ID NO: 786727 - DNA, 16 bp, Homo sapiens
gctttatcttttcata

SEQ ID NO: 786728 - DNA, 12 bp, Homo sapiens
gctttatgttca

SEQ ID NO: 786729 - DNA, 22 bp, Homo sapiens
gctttattcttcagatacaaac

SEQ ID NO: 786730 - DNA, 19 bp, Homo sapiens
gctttattgaattagaaaa

SEQ ID NO: 786731 - DNA, 21 bp, Homo sapiens
gctttatttgttttttttgtt

SEQ ID NO: 786732 - DNA, 23 bp, Homo sapiens
gctttattttttaagtatttata

SEQ ID NO: 786733 - DNA, 22 bp, Homo sapiens
gctttcaaaataaggatgactt

SEQ ID NO: 786734 - DNA, 14 bp, Homo sapiens
gctttcaaatgtac

SEQ ID NO: 786735 - DNA, 11 bp, Homo sapiens
gctttcaagtg

SEQ ID NO: 786736 - DNA, 15 bp, Homo sapiens
gctttcaattgtatt

SEQ ID NO: 786737 - DNA, 22 bp, Homo sapiens
gctttcactaggaaaatcatgt

SEQ ID NO: 786738 - DNA, 20 bp, Homo sapiens
gctttcagagccagcctggc

SEQ ID NO: 786739 - DNA, 21 bp, Homo sapiens
gctttcaggctacctttttct

SEQ ID NO: 786740 - DNA, 13 bp, Homo sapiens
gctttcatcctgt

SEQ ID NO: 786741 - DNA, 14 bp, Homo sapiens
gctttcatcctgtg

SEQ ID NO: 786742 - DNA, 16 bp, Homo sapiens
gctttcatcctgtgtc

SEQ ID NO: 786743 - DNA, 22 bp, Homo sapiens
gctttcatcctgtgtcccctga

SEQ ID NO: 786744 - DNA, 19 bp, Homo sapiens
gctttcatgaccactgggc

SEQ ID NO: 786745 - DNA, 12 bp, Homo sapiens
gctttcatgatt

SEQ ID NO: 786746 - DNA, 20 bp, Homo sapiens
gctttcatgtaaactgtgca

SEQ ID NO: 786747 - DNA, 21 bp, Homo sapiens
gctttcatgtaaactgtgcac

SEQ ID NO: 786748 - DNA, 21 bp, Homo sapiens
gctttccccgggggaggaagg

SEQ ID NO: 786749 - DNA, 12 bp, Homo sapiens
gctttcccctgt

SEQ ID NO: 786750 - DNA, 14 bp, Homo sapiens
gctttccctgagga

SEQ ID NO: 786751 - DNA, 15 bp, Homo sapiens
gctttccctgcctct

SEQ ID NO: 786752 - DNA, 17 bp, Homo sapiens
gctttcccttccagttc

SEQ ID NO: 786753 - DNA, 23 bp, Homo sapiens
gctttccgtttttttctttcctg

SEQ ID NO: 786754 - DNA, 15 bp, Homo sapiens
gctttcctaaatcag

SEQ ID NO: 786755 - DNA, 12 bp, Homo sapiens
gctttcctgaat

SEQ ID NO: 786756 - DNA, 15 bp, Homo sapiens
gctttttatttctgc

SEQ ID NO: 786757 - DNA, 23 bp, Homo sapiens
gctttttccttttcatctgttgt

SEQ ID NO: 786758 - DNA, 13 bp, Homo sapiens
gctttttcttctc

SEQ ID NO: 786759 - DNA, 16 bp, Homo sapiens
gctttttgttcagaat

SEQ ID NO: 786760 - DNA, 17 bp, Homo sapiens
gctttttgttcagaatt

SEQ ID NO: 786761 - DNA, 23 bp, Homo sapiens
gcttttttaaccaaggaggggcc

SEQ ID NO: 786762 - DNA, 15 bp, Homo sapiens
gcttttttattttaa

SEQ ID NO: 786763 - DNA, 23 bp, Homo sapiens
gcttttttcacattgatcatttt

SEQ ID NO: 786764 - DNA, 20 bp, Homo sapiens
gcttttttccaaaacaaaaa

SEQ ID NO: 786765 - DNA, 15 bp, Homo sapiens
gcttttttccttttg

SEQ ID NO: 786766 - DNA, 21 bp, Homo sapiens
gctttttttgtgtgtatttgc

SEQ ID NO: 786767 - DNA, 22 bp, Homo sapiens
gctttttttgtgtgtatttgct

SEQ ID NO: 786768 - DNA, 15 bp, Homo sapiens
gcttttttttccttc

SEQ ID NO: 786769 - DNA, 17 bp, Homo sapiens
gcttttttttttccagc

SEQ ID NO: 786770 - DNA, 20 bp, Homo sapiens
ggaaaaaaaaaaagaaaaaa

SEQ ID NO: 786771 - DNA, 15 bp, Homo sapiens
ggaaaaaaaagaaaa

SEQ ID NO: 786772 - DNA, 16 bp, Homo sapiens
ggaaaaaaaatatata

SEQ ID NO: 786773 - DNA, 13 bp, Homo sapiens
ggaaaaaagaaag

SEQ ID NO: 786774 - DNA, 16 bp, Homo sapiens
ggaaaaaagaaagaaa

SEQ ID NO: 786775 - DNA, 15 bp, Homo sapiens
ggaaaaaagttttga

SEQ ID NO: 786776 - DNA, 13 bp, Homo sapiens
ggaaaaaattgta

SEQ ID NO: 786777 - DNA, 13 bp, Homo sapiens
ggaaaaacacaag

SEQ ID NO: 786778 - DNA, 17 bp, Homo sapiens
ggaaaaaccgagatagg

SEQ ID NO: 786779 - DNA, 17 bp, Homo sapiens
ggaaaaactttggaacc

SEQ ID NO: 786780 - DNA, 19 bp, Homo sapiens
ggaaaaactttggaaccag

SEQ ID NO: 786781 - DNA, 14 bp, Homo sapiens
ggaaaaataatcaa

SEQ ID NO: 786782 - DNA, 20 bp, Homo sapiens
ggaaaaataatcaagatttt

SEQ ID NO: 786783 - DNA, 13 bp, Homo sapiens
ggaaaaatagcct

SEQ ID NO: 786784 - DNA, 15 bp, Homo sapiens
ggaaaaatccagaaa

SEQ ID NO: 786785 - DNA, 15 bp, Homo sapiens
ggaaaaatgagtaat

SEQ ID NO: 786786 - DNA, 17 bp, Homo sapiens
ggaaaaatgccactccc

SEQ ID NO: 786787 - DNA, 18 bp, Homo sapiens
ggaaaaatgccactccct

SEQ ID NO: 786788 - DNA, 19 bp, Homo sapiens
ggaaaaatgccatcaaatg

SEQ ID NO: 786789 - DNA, 15 bp, Homo sapiens
ggaaaaatggttgat

SEQ ID NO: 786790 - DNA, 17 bp, Homo sapiens
ggaaaaatggttgatgg

SEQ ID NO: 786791 - DNA, 21 bp, Homo sapiens
ggaaaaatggttgatggaaaa

SEQ ID NO: 786792 - DNA, 20 bp, Homo sapiens
ggaaaacaaatcactgtatt

SEQ ID NO: 786793 - DNA, 19 bp, Homo sapiens
ggaaaacacagcctccctg

SEQ ID NO: 786794 - DNA, 15 bp, Homo sapiens
ggaaaacagaacact

SEQ ID NO: 786795 - DNA, 13 bp, Homo sapiens
ggaaaacagctat

SEQ ID NO: 786796 - DNA, 21 bp, Homo sapiens
ggaaaaccaagccgtggcttc

SEQ ID NO: 786797 - DNA, 13 bp, Homo sapiens
ggaaaacctgggg

SEQ ID NO: 786798 - DNA, 15 bp, Homo sapiens
ggaaaacctggggga

SEQ ID NO: 786799 - DNA, 21 bp, Homo sapiens
ggaaaacgggcagtctgctct

SEQ ID NO: 786800 - DNA, 18 bp, Homo sapiens
ggaacagtgtttcccata

SEQ ID NO: 786801 - DNA, 23 bp, Homo sapiens
ggaacagtgtttcccataatttt

SEQ ID NO: 786802 - DNA, 16 bp, Homo sapiens
ggaacatacagacaca

SEQ ID NO: 786803 - DNA, 14 bp, Homo sapiens
ggaacatgccccct

SEQ ID NO: 786804 - DNA, 16 bp, Homo sapiens
ggaacatggctagcct

SEQ ID NO: 786805 - DNA, 17 bp, Homo sapiens
ggaacattatttttaga

SEQ ID NO: 786806 - DNA, 21 bp, Homo sapiens
ggaacattccagtggaccctg

SEQ ID NO: 786807 - DNA, 19 bp, Homo sapiens
ggaaccacaatgtttcttc

SEQ ID NO: 786808 - DNA, 22 bp, Homo sapiens
ggaaccacatataacacttaac

SEQ ID NO: 786809 - DNA, 11 bp, Homo sapiens
ggaaccagact

SEQ ID NO: 786810 - DNA, 13 bp, Homo sapiens
ggaaccagagcca

SEQ ID NO: 786811 - DNA, 19 bp, Homo sapiens
ggaaccagggaggagagga

SEQ ID NO: 786812 - DNA, 12 bp, Homo sapiens
ggaaccagggcc

SEQ ID NO: 786813 - DNA, 15 bp, Homo sapiens
ggaacccaagaaagg

SEQ ID NO: 786814 - DNA, 15 bp, Homo sapiens
ggaaccccccaggcc

SEQ ID NO: 786815 - DNA, 17 bp, Homo sapiens
ggaaccccccaggccct

SEQ ID NO: 786816 - DNA, 16 bp, Homo sapiens
ggaaccccgcagcccg

SEQ ID NO: 786817 - DNA, 17 bp, Homo sapiens
ggaaccccgcagcccgt

SEQ ID NO: 786818 - DNA, 18 bp, Homo sapiens
ggaaccccgcagcccgtg

SEQ ID NO: 786819 - DNA, 23 bp, Homo sapiens
ggaaccctcaggccaccctccac

SEQ ID NO: 786820 - DNA, 14 bp, Homo sapiens
ggaaccctgtccct

SEQ ID NO: 786821 - DNA, 21 bp, Homo sapiens
ggaaccgctcacctagagcca

SEQ ID NO: 786822 - DNA, 15 bp, Homo sapiens
ggaacctcccagagg

SEQ ID NO: 786823 - DNA, 16 bp, Homo sapiens
ggaacctcccagaggt

SEQ ID NO: 786824 - DNA, 14 bp, Homo sapiens
ggaacctctgtctc

SEQ ID NO: 786825 - DNA, 15 bp, Homo sapiens
ggaacctgcaaaaaa

SEQ ID NO: 786826 - DNA, 16 bp, Homo sapiens
ggaacctgcaaaaaat

SEQ ID NO: 786827 - DNA, 22 bp, Homo sapiens
ggaacctgtcctaaggaacctt

SEQ ID NO: 786828 - DNA, 12 bp, Homo sapiens
ggaaccttccct

SEQ ID NO: 786829 - DNA, 16 bp, Homo sapiens
ggaaccttccctccaa

SEQ ID NO: 786830 - DNA, 19 bp, Homo sapiens
ggaaccttccttcctgctt

SEQ ID NO: 786831 - DNA, 17 bp, Homo sapiens
ggaaccttgctgtcctg

SEQ ID NO: 786832 - DNA, 14 bp, Homo sapiens
ggaacgagcactgg

SEQ ID NO: 786833 - DNA, 19 bp, Homo sapiens
ggaacgagcactggccaga

SEQ ID NO: 786834 - DNA, 15 bp, Homo sapiens
ggaacgatgtgtctg

SEQ ID NO: 786835 - DNA, 13 bp, Homo sapiens
ggaacgcagcctc

SEQ ID NO: 786836 - DNA, 17 bp, Homo sapiens
ggaacgcagcctccagt

SEQ ID NO: 786837 - DNA, 19 bp, Homo sapiens
ggaacgctctcctcgagcc

SEQ ID NO: 786838 - DNA, 22 bp, Homo sapiens
ggaacggatgctccgaggactg

SEQ ID NO: 786839 - DNA, 20 bp, Homo sapiens
ggaacggccctgcaggagca

SEQ ID NO: 786840 - DNA, 22 bp, Homo sapiens
ggaacggccctgcaggagcagg

SEQ ID NO: 786841 - DNA, 15 bp, Homo sapiens
ggaacgggcagccac

SEQ ID NO: 786842 - DNA, 16 bp, Homo sapiens
ggaacgggcagccaca

SEQ ID NO: 786843 - DNA, 24 bp, Homo sapiens
ggaacgggcatgggcctctctggg

SEQ ID NO: 786844 - DNA, 16 bp, Homo sapiens
ggaacgtgtgtccagg

SEQ ID NO: 786845 - DNA, 21 bp, Homo sapiens
ggaacgtgtgtccaggctctg

SEQ ID NO: 786846 - DNA, 22 bp, Homo sapiens
ggaactagaaagaaggacccag

SEQ ID NO: 786847 - DNA, 23 bp, Homo sapiens
ggaactaggctcttatgtgtgcc

SEQ ID NO: 786848 - DNA, 18 bp, Homo sapiens
ggaactgaatcaggaaac

SEQ ID NO: 786849 - DNA, 20 bp, Homo sapiens
ggaactgaccccctcccctg

SEQ ID NO: 786850 - DNA, 20 bp, Homo sapiens
ggaactgacgctggagatgc

SEQ ID NO: 786851 - DNA, 19 bp, Homo sapiens
ggaactgcctgggccatgc

SEQ ID NO: 786852 - DNA, 15 bp, Homo sapiens
ggaactgcttgccca

SEQ ID NO: 786853 - DNA, 20 bp, Homo sapiens
ggaactgcttgcccagggtg

SEQ ID NO: 786854 - DNA, 18 bp, Homo sapiens
ggaactggagtctgtctc

SEQ ID NO: 786855 - DNA, 23 bp, Homo sapiens
ggaactggctgtgaagacccagg

SEQ ID NO: 786856 - DNA, 17 bp, Homo sapiens
ggaactgtagggccagg

SEQ ID NO: 786857 - DNA, 17 bp, Homo sapiens
ggaactgtccagagagc

SEQ ID NO: 786858 - DNA, 20 bp, Homo sapiens
ggaactgtgcaaagggctgc

SEQ ID NO: 786859 - DNA, 15 bp, Homo sapiens
ggaactgtgtattta

SEQ ID NO: 786860 - DNA, 20 bp, Homo sapiens
ggaactgtgtatttatttaa

SEQ ID NO: 786861 - DNA, 22 bp, Homo sapiens
ggaactgtgtatttatttaaaa

SEQ ID NO: 786862 - DNA, 19 bp, Homo sapiens
ggaacttgcgagtccaagg

SEQ ID NO: 786863 - DNA, 23 bp, Homo sapiens
ggaacttgcgagtccaaggccag

SEQ ID NO: 786864 - DNA, 14 bp, Homo sapiens
ggaacttgctgctg

SEQ ID NO: 786865 - DNA, 17 bp, Homo sapiens
ggaagaaattcaggtac

SEQ ID NO: 786866 - DNA, 18 bp, Homo sapiens
ggaagaaattcaggtaca

SEQ ID NO: 786867 - DNA, 18 bp, Homo sapiens
ggaagaaattcctgtagc

SEQ ID NO: 786868 - DNA, 19 bp, Homo sapiens
ggaagaaattcctgtagca

SEQ ID NO: 786869 - DNA, 13 bp, Homo sapiens
ggaagaacataga

SEQ ID NO: 786870 - DNA, 14 bp, Homo sapiens
ggaagaaggaggaa

SEQ ID NO: 786871 - DNA, 13 bp, Homo sapiens
ggaagaagggaga

SEQ ID NO: 786872 - DNA, 19 bp, Homo sapiens
ggaagaagttttttacttt

SEQ ID NO: 786873 - DNA, 21 bp, Homo sapiens
ggaagaatttaatggactgtg

SEQ ID NO: 786874 - DNA, 19 bp, Homo sapiens
ggaagacacttcagatctg

SEQ ID NO: 786875 - DNA, 15 bp, Homo sapiens
ggaagacataaaact

SEQ ID NO: 786876 - DNA, 16 bp, Homo sapiens
ggaagaccagaattcc

SEQ ID NO: 786877 - DNA, 15 bp, Homo sapiens
ggaagacgcctgagc

SEQ ID NO: 786878 - DNA, 13 bp, Homo sapiens
ggaagactgctcc

SEQ ID NO: 786879 - DNA, 15 bp, Homo sapiens
ggaagagaaaaaata

SEQ ID NO: 786880 - DNA, 13 bp, Homo sapiens
ggaagagaagaca

SEQ ID NO: 786881 - DNA, 14 bp, Homo sapiens
ggaagagaagacaa

SEQ ID NO: 786882 - DNA, 20 bp, Homo sapiens
ggaagagaagagggcccagc

SEQ ID NO: 786883 - DNA, 20 bp, Homo sapiens
ggaagagacaaagtgggtgt

SEQ ID NO: 786884 - DNA, 16 bp, Homo sapiens
ggaagagacagcccag

SEQ ID NO: 786885 - DNA, 21 bp, Homo sapiens
ggaagagacatgagaaaggga

SEQ ID NO: 786886 - DNA, 11 bp, Homo sapiens
ggaagagagag

SEQ ID NO: 786887 - DNA, 12 bp, Homo sapiens
ggaagagaggca

SEQ ID NO: 786888 - DNA, 18 bp, Homo sapiens
ggaagagaggcacctgct

SEQ ID NO: 786889 - DNA, 13 bp, Homo sapiens
ggaagagcagcct

SEQ ID NO: 786890 - DNA, 14 bp, Homo sapiens
ggaagagcagcctg

SEQ ID NO: 786891 - DNA, 15 bp, Homo sapiens
ggaagagcaggcaca

SEQ ID NO: 786892 - DNA, 13 bp, Homo sapiens
ggaagagccacct

SEQ ID NO: 786893 - DNA, 19 bp, Homo sapiens
ggaagagccacctgcaaga

SEQ ID NO: 786894 - DNA, 18 bp, Homo sapiens
ggaagagccacctggcag

SEQ ID NO: 786895 - DNA, 13 bp, Homo sapiens
ggaagagccttgc

SEQ ID NO: 786896 - DNA, 11 bp, Homo sapiens
ggaagaggccc

SEQ ID NO: 786897 - DNA, 13 bp, Homo sapiens
ggaagaggcctgt

SEQ ID NO: 786898 - DNA, 23 bp, Homo sapiens
ggaagaggcctgtttggcctctc

SEQ ID NO: 786899 - DNA, 17 bp, Homo sapiens
ggaagagggagaccaaa

SEQ ID NO: 786900 - DNA, 20 bp, Homo sapiens
ggaagagggcagtacctggg

SEQ ID NO: 786901 - DNA, 19 bp, Homo sapiens
ggaagagggctgagctgag

SEQ ID NO: 786902 - DNA, 13 bp, Homo sapiens
ggaagaggggctg

SEQ ID NO: 786903 - DNA, 17 bp, Homo sapiens
ggaagaggggctggggc

SEQ ID NO: 786904 - DNA, 14 bp, Homo sapiens
ggaagatatacatg

SEQ ID NO: 786905 - DNA, 14 bp, Homo sapiens
ggaagatcccccag

SEQ ID NO: 786906 - DNA, 17 bp, Homo sapiens
ggaagatggtccgtgcc

SEQ ID NO: 786907 - DNA, 14 bp, Homo sapiens
ggaagatgtttaca

SEQ ID NO: 786908 - DNA, 21 bp, Homo sapiens
ggaagatttaccttttctgtt

SEQ ID NO: 786909 - DNA, 20 bp, Homo sapiens
ggaagattttatgcacagcc

SEQ ID NO: 786910 - DNA, 21 bp, Homo sapiens
ggaagattttatgcacagcct

SEQ ID NO: 786911 - DNA, 16 bp, Homo sapiens
ggaagcaaagacaaaa

SEQ ID NO: 786912 - DNA, 19 bp, Homo sapiens
ggaagcaaagacaaaagaa

SEQ ID NO: 786913 - DNA, 18 bp, Homo sapiens
ggaagcaagacgtaaaga

SEQ ID NO: 786914 - DNA, 22 bp, Homo sapiens
ggaagcagatacatatgagtgt

SEQ ID NO: 786915 - DNA, 16 bp, Homo sapiens
ggaagcaggacctaga

SEQ ID NO: 786916 - DNA, 20 bp, Homo sapiens
ggaagcagttggggccctct

SEQ ID NO: 786917 - DNA, 21 bp, Homo sapiens
ggaagcatgtaggagaatcca

SEQ ID NO: 786918 - DNA, 20 bp, Homo sapiens
ggaagcattcagagagcagc

SEQ ID NO: 786919 - DNA, 15 bp, Homo sapiens
ggaagcattgaattc

SEQ ID NO: 786920 - DNA, 22 bp, Homo sapiens
ggaagcattgtaaaataattct

SEQ ID NO: 786921 - DNA, 22 bp, Homo sapiens
ggaagccaaaatgtaggcttag

SEQ ID NO: 786922 - DNA, 14 bp, Homo sapiens
ggaagccaaagagt

SEQ ID NO: 786923 - DNA, 13 bp, Homo sapiens
ggaagccaaagtt

SEQ ID NO: 786924 - DNA, 18 bp, Homo sapiens
ggaagccagagccccaag

SEQ ID NO: 786925 - DNA, 12 bp, Homo sapiens
ggacagctgctt

SEQ ID NO: 786926 - DNA, 16 bp, Homo sapiens
ggacagcttcctcaca

SEQ ID NO: 786927 - DNA, 19 bp, Homo sapiens
ggacagcttgagccgggcc

SEQ ID NO: 786928 - DNA, 14 bp, Homo sapiens
ggacaggaagctgg

SEQ ID NO: 786929 - DNA, 18 bp, Homo sapiens
ggacaggaagctggcaga

SEQ ID NO: 786930 - DNA, 15 bp, Homo sapiens
ggacaggagaagaga

SEQ ID NO: 786931 - DNA, 17 bp, Homo sapiens
ggacaggagaagagagg

SEQ ID NO: 786932 - DNA, 11 bp, Homo sapiens
ggacaggagcc

SEQ ID NO: 786933 - DNA, 13 bp, Homo sapiens
ggacaggagcctg

SEQ ID NO: 786934 - DNA, 16 bp, Homo sapiens
ggacaggaggaggaga

SEQ ID NO: 786935 - DNA, 13 bp, Homo sapiens
ggacaggatctat

SEQ ID NO: 786936 - DNA, 22 bp, Homo sapiens
ggacaggcccggcgcggtggct

SEQ ID NO: 786937 - DNA, 23 bp, Homo sapiens
ggacaggcctcacctctacccaa

SEQ ID NO: 786938 - DNA, 20 bp, Homo sapiens
ggacaggctctagagagagg

SEQ ID NO: 786939 - DNA, 23 bp, Homo sapiens
ggacaggctgaagagagggacag

SEQ ID NO: 786940 - DNA, 20 bp, Homo sapiens
ggacaggctggaatgaggga

SEQ ID NO: 786941 - DNA, 22 bp, Homo sapiens
ggacaggctggaatgagggagg

SEQ ID NO: 786942 - DNA, 15 bp, Homo sapiens
ggacaggctggctcc

SEQ ID NO: 786943 - DNA, 23 bp, Homo sapiens
ggacaggctggctccagatgcag

SEQ ID NO: 786944 - DNA, 13 bp, Homo sapiens
ggacagggcaggc

SEQ ID NO: 786945 - DNA, 15 bp, Homo sapiens
ggacagggccagggt

SEQ ID NO: 786946 - DNA, 16 bp, Homo sapiens
ggacaggtgggcctgg

SEQ ID NO: 786947 - DNA, 23 bp, Homo sapiens
ggacaggtggggcctcagcctgg

SEQ ID NO: 786948 - DNA, 18 bp, Homo sapiens
ggacagtatcccacatcc

SEQ ID NO: 786949 - DNA, 15 bp, Homo sapiens
ggacagtcctgggag

SEQ ID NO: 786950 - DNA, 17 bp, Homo sapiens
ggacagtgataggccca

SEQ ID NO: 786951 - DNA, 19 bp, Homo sapiens
ggacagtgcttcagcctga

SEQ ID NO: 786952 - DNA, 22 bp, Homo sapiens
ggacagtgcttcagcctgaggc

SEQ ID NO: 786953 - DNA, 23 bp, Homo sapiens
ggacagtgcttcagcctgaggct

SEQ ID NO: 786954 - DNA, 23 bp, Homo sapiens
ggacagtttaccagttgcctttt

SEQ ID NO: 786955 - DNA, 19 bp, Homo sapiens
ggacataatggggtcctgg

SEQ ID NO: 786956 - DNA, 20 bp, Homo sapiens
ggacatagagagggagaaga

SEQ ID NO: 786957 - DNA, 22 bp, Homo sapiens
ggacatagagagggagaagaag

SEQ ID NO: 786958 - DNA, 20 bp, Homo sapiens
ggacatccccccgccaaaag

SEQ ID NO: 786959 - DNA, 18 bp, Homo sapiens
ggacatgagtctgtagga

SEQ ID NO: 786960 - DNA, 22 bp, Homo sapiens
ggacatgatggggaaggagtac

SEQ ID NO: 786961 - DNA, 17 bp, Homo sapiens
ggacatgctcacctcta

SEQ ID NO: 786962 - DNA, 15 bp, Homo sapiens
ggacatggcacaggc

SEQ ID NO: 786963 - DNA, 22 bp, Homo sapiens
ggacatggggcaagccagggcc

SEQ ID NO: 786964 - DNA, 23 bp, Homo sapiens
ggacatggggcaagccagggccc

SEQ ID NO: 786965 - DNA, 21 bp, Homo sapiens
ggacatgtttttgttttcttt

SEQ ID NO: 786966 - DNA, 16 bp, Homo sapiens
ggacattcactgctga

SEQ ID NO: 786967 - DNA, 15 bp, Homo sapiens
ggacattttttcagt

SEQ ID NO: 786968 - DNA, 15 bp, Homo sapiens
ggaccaaagggggag

SEQ ID NO: 786969 - DNA, 20 bp, Homo sapiens
ggaccaaattgcttctagga

SEQ ID NO: 786970 - DNA, 16 bp, Homo sapiens
ggaccaaccctgggga

SEQ ID NO: 786971 - DNA, 22 bp, Homo sapiens
ggaccaaccctgtttcctgagt

SEQ ID NO: 786972 - DNA, 16 bp, Homo sapiens
ggaccaacctgctctg

SEQ ID NO: 786973 - DNA, 19 bp, Homo sapiens
ggaccaacctgctctgtcc

SEQ ID NO: 786974 - DNA, 16 bp, Homo sapiens
ggaccaactggcttct

SEQ ID NO: 786975 - DNA, 18 bp, Homo sapiens
ggaccaagcgaccaagga

SEQ ID NO: 786976 - DNA, 15 bp, Homo sapiens
ggaccaaggacccct

SEQ ID NO: 786977 - DNA, 22 bp, Homo sapiens
ggaccaaggcaaggcaggtgcc

SEQ ID NO: 786978 - DNA, 14 bp, Homo sapiens
ggactccggaggac

SEQ ID NO: 786979 - DNA, 19 bp, Homo sapiens
ggactccggggccccactg

SEQ ID NO: 786980 - DNA, 15 bp, Homo sapiens
ggactcctcccacaa

SEQ ID NO: 786981 - DNA, 12 bp, Homo sapiens
ggactcctctgt

SEQ ID NO: 786982 - DNA, 12 bp, Homo sapiens
ggactcctcttg

SEQ ID NO: 786983 - DNA, 18 bp, Homo sapiens
ggactcctggcagggcca

SEQ ID NO: 786984 - DNA, 22 bp, Homo sapiens
ggactcggagactatggcctcg

SEQ ID NO: 786985 - DNA, 18 bp, Homo sapiens
ggactcggccactgtgtc

SEQ ID NO: 786986 - DNA, 17 bp, Homo sapiens
ggactctaagctggagc

SEQ ID NO: 786987 - DNA, 18 bp, Homo sapiens
ggactctagtccttggct

SEQ ID NO: 786988 - DNA, 11 bp, Homo sapiens
ggactctcagg

SEQ ID NO: 786989 - DNA, 17 bp, Homo sapiens
ggactctcagtctctga

SEQ ID NO: 786990 - DNA, 21 bp, Homo sapiens
ggactctcccaggcctgcctg

SEQ ID NO: 786991 - DNA, 14 bp, Homo sapiens
ggactctcctcctc

SEQ ID NO: 786992 - DNA, 18 bp, Homo sapiens
ggactctcctcctcccct

SEQ ID NO: 786993 - DNA, 19 bp, Homo sapiens
ggactctgagcgggaggca

SEQ ID NO: 786994 - DNA, 12 bp, Homo sapiens
ggactctgcccc

SEQ ID NO: 786995 - DNA, 18 bp, Homo sapiens
ggactctgcccctggacc

SEQ ID NO: 786996 - DNA, 11 bp, Homo sapiens
ggactctgcct

SEQ ID NO: 786997 - DNA, 21 bp, Homo sapiens
ggactctgcgggaggctgggg

SEQ ID NO: 786998 - DNA, 23 bp, Homo sapiens
ggactctgcgggaggctggggcc

SEQ ID NO: 786999 - DNA, 17 bp, Homo sapiens
ggactctggcacagtga

SEQ ID NO: 787000 - DNA, 16 bp, Homo sapiens
ggactcttgctctttc

SEQ ID NO: 787001 - DNA, 18 bp, Homo sapiens
ggactcttgctctttcta

SEQ ID NO: 787002 - DNA, 13 bp, Homo sapiens
ggactgacagcat

SEQ ID NO: 787003 - DNA, 20 bp, Homo sapiens
ggactgagccaaggaggcct

SEQ ID NO: 787004 - DNA, 22 bp, Homo sapiens
ggactgagccaaggaggcctgg

SEQ ID NO: 787005 - DNA, 12 bp, Homo sapiens
ggactgagccag

SEQ ID NO: 787006 - DNA, 11 bp, Homo sapiens
ggactgagccc

SEQ ID NO: 787007 - DNA, 15 bp, Homo sapiens
ggactgagccctctc

SEQ ID NO: 787008 - DNA, 16 bp, Homo sapiens
ggactgagctggggga

SEQ ID NO: 787009 - DNA, 17 bp, Homo sapiens
ggactgaggtgcctgct

SEQ ID NO: 787010 - DNA, 20 bp, Homo sapiens
ggactgcagtcggcatgcca

SEQ ID NO: 787011 - DNA, 12 bp, Homo sapiens
ggactgcagtgt

SEQ ID NO: 787012 - DNA, 22 bp, Homo sapiens
ggactgcatggggaggcagcag

SEQ ID NO: 787013 - DNA, 16 bp, Homo sapiens
ggactgccaggctgtt

SEQ ID NO: 787014 - DNA, 17 bp, Homo sapiens
ggactgccaggctgttt

SEQ ID NO: 787015 - DNA, 15 bp, Homo sapiens
ggactgcccccagaa

SEQ ID NO: 787016 - DNA, 17 bp, Homo sapiens
ggactgcccccagaaag

SEQ ID NO: 787017 - DNA, 15 bp, Homo sapiens
ggactgcggaggaag

SEQ ID NO: 787018 - DNA, 19 bp, Homo sapiens
ggactgctaaataaaattt

SEQ ID NO: 787019 - DNA, 16 bp, Homo sapiens
ggactgctgctgcctg

SEQ ID NO: 787020 - DNA, 17 bp, Homo sapiens
ggactgctgctgcctgg

SEQ ID NO: 787021 - DNA, 14 bp, Homo sapiens
ggactggaaccagg

SEQ ID NO: 787022 - DNA, 15 bp, Homo sapiens
ggactggaaccaggg

SEQ ID NO: 787023 - DNA, 23 bp, Homo sapiens
ggactggaggtgggcatgccacc

SEQ ID NO: 787024 - DNA, 17 bp, Homo sapiens
ggactggagtccctgtg

SEQ ID NO: 787025 - DNA, 21 bp, Homo sapiens
ggactggccatttttctgggg

SEQ ID NO: 787026 - DNA, 22 bp, Homo sapiens
ggactggcgagtccagagagga

SEQ ID NO: 787027 - DNA, 20 bp, Homo sapiens
ggactggctagagtcctcac

SEQ ID NO: 787028 - DNA, 21 bp, Homo sapiens
ggactgggaccgtgcgagctg

SEQ ID NO: 787029 - DNA, 15 bp, Homo sapiens
ggactgggggccaga

SEQ ID NO: 787030 - DNA, 20 bp, Homo sapiens
ggactgggttgcgtcctgac

SEQ ID NO: 787031 - DNA, 13 bp, Homo sapiens
ggactgggtttgg

SEQ ID NO: 787032 - DNA, 14 bp, Homo sapiens
ggactggtgggggt

SEQ ID NO: 787033 - DNA, 21 bp, Homo sapiens
ggactggtgggggttctggca

SEQ ID NO: 787034 - DNA, 12 bp, Homo sapiens
ggactgtaaaca

SEQ ID NO: 787035 - DNA, 22 bp, Homo sapiens
ggactgtagaaggtgagaggcg

SEQ ID NO: 787036 - DNA, 20 bp, Homo sapiens
ggactgtcacactggtgctg

SEQ ID NO: 787037 - DNA, 19 bp, Homo sapiens
ggactgtcctcccacagac

SEQ ID NO: 787038 - DNA, 21 bp, Homo sapiens
ggactgtcctcccacagacct

SEQ ID NO: 787039 - DNA, 21 bp, Homo sapiens
ggactgtcctgaggagccctg

SEQ ID NO: 787040 - DNA, 14 bp, Homo sapiens
ggagaatgcagccc

SEQ ID NO: 787041 - DNA, 17 bp, Homo sapiens
ggagaatggggttcctg

SEQ ID NO: 787042 - DNA, 22 bp, Homo sapiens
ggagaattgctggaacccagga

SEQ ID NO: 787043 - DNA, 15 bp, Homo sapiens
ggagacaaagcagga

SEQ ID NO: 787044 - DNA, 12 bp, Homo sapiens
ggagacagcagc

SEQ ID NO: 787045 - DNA, 14 bp, Homo sapiens
ggagacagcatcag

SEQ ID NO: 787046 - DNA, 17 bp, Homo sapiens
ggagacagcatcagggt

SEQ ID NO: 787047 - DNA, 17 bp, Homo sapiens
ggagacagcttctctgc

SEQ ID NO: 787048 - DNA, 12 bp, Homo sapiens
ggagacagggtt

SEQ ID NO: 787049 - DNA, 18 bp, Homo sapiens
ggagacagtgatctccat

SEQ ID NO: 787050 - DNA, 12 bp, Homo sapiens
ggagacatatat

SEQ ID NO: 787051 - DNA, 16 bp, Homo sapiens
ggagacatggaccagc

SEQ ID NO: 787052 - DNA, 14 bp, Homo sapiens
ggagacatgtgaca

SEQ ID NO: 787053 - DNA, 17 bp, Homo sapiens
ggagacattgctctatg

SEQ ID NO: 787054 - DNA, 21 bp, Homo sapiens
ggagaccacactgcacacagt

SEQ ID NO: 787055 - DNA, 20 bp, Homo sapiens
ggagacccccaggcagaggg

SEQ ID NO: 787056 - DNA, 22 bp, Homo sapiens
ggagaccccttgttgcactgcc

SEQ ID NO: 787057 - DNA, 12 bp, Homo sapiens
ggagaccctgcc

SEQ ID NO: 787058 - DNA, 20 bp, Homo sapiens
ggagaccctgccacagccag

SEQ ID NO: 787059 - DNA, 23 bp, Homo sapiens
ggagaccctgccacagccagagg

SEQ ID NO: 787060 - DNA, 21 bp, Homo sapiens
ggagaccgcttcacccctgca

SEQ ID NO: 787061 - DNA, 13 bp, Homo sapiens
ggagacctgtgct

SEQ ID NO: 787062 - DNA, 15 bp, Homo sapiens
ggagacctgtgctag

SEQ ID NO: 787063 - DNA, 23 bp, Homo sapiens
ggagacctgttggcctgtgggcc

SEQ ID NO: 787064 - DNA, 23 bp, Homo sapiens
ggagacgtggaacctctgtctca

SEQ ID NO: 787065 - DNA, 14 bp, Homo sapiens
ggagactagattgc

SEQ ID NO: 787066 - DNA, 16 bp, Homo sapiens
ggagactatggcctcg

SEQ ID NO: 787067 - DNA, 16 bp, Homo sapiens
ggagactcacctctgc

SEQ ID NO: 787068 - DNA, 21 bp, Homo sapiens
ggagactcacctctgcctcaa

SEQ ID NO: 787069 - DNA, 17 bp, Homo sapiens
ggagactccaaggagct

SEQ ID NO: 787070 - DNA, 12 bp, Homo sapiens
ggagactcctgc

SEQ ID NO: 787071 - DNA, 17 bp, Homo sapiens
ggagactcctgccctgt

SEQ ID NO: 787072 - DNA, 16 bp, Homo sapiens
ggagactgtctcaaga

SEQ ID NO: 787073 - DNA, 12 bp, Homo sapiens
ggagactgtggt

SEQ ID NO: 787074 - DNA, 16 bp, Homo sapiens
ggagacttggggccag

SEQ ID NO: 787075 - DNA, 13 bp, Homo sapiens
ggagagaaaaaag

SEQ ID NO: 787076 - DNA, 16 bp, Homo sapiens
ggagagaaaatatatg

SEQ ID NO: 787077 - DNA, 15 bp, Homo sapiens
ggagagacaggcagc

SEQ ID NO: 787078 - DNA, 11 bp, Homo sapiens
ggagagacctc

SEQ ID NO: 787079 - DNA, 20 bp, Homo sapiens
ggagagacggtgttgggagc

SEQ ID NO: 787080 - DNA, 15 bp, Homo sapiens
ggagagactgaaagc

SEQ ID NO: 787081 - DNA, 19 bp, Homo sapiens
ggagagactgagcagccgc

SEQ ID NO: 787082 - DNA, 20 bp, Homo sapiens
ggagagagaggctgcctcag

SEQ ID NO: 787083 - DNA, 13 bp, Homo sapiens
ggagagagccagg

SEQ ID NO: 787084 - DNA, 15 bp, Homo sapiens
ggagagagccaggat

SEQ ID NO: 787085 - DNA, 15 bp, Homo sapiens
ggagagagtcccaga

SEQ ID NO: 787086 - DNA, 22 bp, Homo sapiens
ggagagatccctgcagaaccca

SEQ ID NO: 787087 - DNA, 20 bp, Homo sapiens
ggagagatgacccctacccc

SEQ ID NO: 787088 - DNA, 14 bp, Homo sapiens
ggagagcaaaggcc

SEQ ID NO: 787089 - DNA, 18 bp, Homo sapiens
ggagagcaaaggcccatg

SEQ ID NO: 787090 - DNA, 19 bp, Homo sapiens
ggagagcaaaggcccatgc

SEQ ID NO: 787091 - DNA, 13 bp, Homo sapiens
ggagagcactgcc

SEQ ID NO: 787092 - DNA, 14 bp, Homo sapiens
ggagagcactgcct

SEQ ID NO: 787093 - DNA, 10 bp, Homo sapiens
ggagagcagc

SEQ ID NO: 787094 - DNA, 13 bp, Homo sapiens
ggagagcagcagc

SEQ ID NO: 787095 - DNA, 14 bp, Homo sapiens
ggagagcagctggc

SEQ ID NO: 787096 - DNA, 14 bp, Homo sapiens
ggagagcaggctgg

SEQ ID NO: 787097 - DNA, 16 bp, Homo sapiens
ggagagcaggctggca

SEQ ID NO: 787098 - DNA, 13 bp, Homo sapiens
ggagagccaacct

SEQ ID NO: 787099 - DNA, 12 bp, Homo sapiens
ggagagccactg

SEQ ID NO: 787100 - DNA, 18 bp, Homo sapiens
ggagagccactgggcccc

SEQ ID NO: 787101 - DNA, 19 bp, Homo sapiens
ggagagccactgggcccct

SEQ ID NO: 787102 - DNA, 21 bp, Homo sapiens
ggagagccagccctccctgtc

SEQ ID NO: 787103 - DNA, 23 bp, Homo sapiens
ggagagccagccctccctgtcct

SEQ ID NO: 787104 - DNA, 14 bp, Homo sapiens
ggagagccagctct

SEQ ID NO: 787105 - DNA, 19 bp, Homo sapiens
ggagagccagctctctcta

SEQ ID NO: 787106 - DNA, 21 bp, Homo sapiens
ggagagcccccaccagcagca

SEQ ID NO: 787107 - DNA, 13 bp, Homo sapiens
ggagagccctgga

SEQ ID NO: 787108 - DNA, 12 bp, Homo sapiens
ggagagcctggc

SEQ ID NO: 787109 - DNA, 17 bp, Homo sapiens
ggagcttgggcagtgcc

SEQ ID NO: 787110 - DNA, 22 bp, Homo sapiens
ggagcttgggcagtgccccagg

SEQ ID NO: 787111 - DNA, 15 bp, Homo sapiens
ggagctttggaatat

SEQ ID NO: 787112 - DNA, 23 bp, Homo sapiens
ggagctttgttttgggggtcagg

SEQ ID NO: 787113 - DNA, 21 bp, Homo sapiens
ggagcttttttccttaatcca

SEQ ID NO: 787114 - DNA, 13 bp, Homo sapiens
ggaggaaaaaaga

SEQ ID NO: 787115 - DNA, 17 bp, Homo sapiens
ggaggaaaacacagcct

SEQ ID NO: 787116 - DNA, 20 bp, Homo sapiens
ggaggaaaacacagcctccc

SEQ ID NO: 787117 - DNA, 20 bp, Homo sapiens
ggaggaaaaccaagccgtgg

SEQ ID NO: 787118 - DNA, 15 bp, Homo sapiens
ggaggaaagggagga

SEQ ID NO: 787119 - DNA, 15 bp, Homo sapiens
ggaggaaagggcctg

SEQ ID NO: 787120 - DNA, 19 bp, Homo sapiens
ggaggaaataactaagaga

SEQ ID NO: 787121 - DNA, 18 bp, Homo sapiens
ggaggaacactgcactct

SEQ ID NO: 787122 - DNA, 21 bp, Homo sapiens
ggaggaaccacaatgtttctt

SEQ ID NO: 787123 - DNA, 18 bp, Homo sapiens
ggaggaacgggcagccac

SEQ ID NO: 787124 - DNA, 15 bp, Homo sapiens
ggaggaagagccacc

SEQ ID NO: 787125 - DNA, 23 bp, Homo sapiens
ggaggaagagccacctgcaagat

SEQ ID NO: 787126 - DNA, 19 bp, Homo sapiens
ggaggaagcaggttgaggg

SEQ ID NO: 787127 - DNA, 18 bp, Homo sapiens
ggaggaaggaggacccag

SEQ ID NO: 787128 - DNA, 13 bp, Homo sapiens
ggaggaaggcaag

SEQ ID NO: 787129 - DNA, 14 bp, Homo sapiens
ggaggaaggcaaga

SEQ ID NO: 787130 - DNA, 10 bp, Homo sapiens
ggaggaaggg

SEQ ID NO: 787131 - DNA, 15 bp, Homo sapiens
ggaggaaggtgctga

SEQ ID NO: 787132 - DNA, 18 bp, Homo sapiens
ggaggaaggtgctgagct

SEQ ID NO: 787133 - DNA, 19 bp, Homo sapiens
ggaggaatcgaggaaccag

SEQ ID NO: 787134 - DNA, 20 bp, Homo sapiens
ggaggaatcgaggaaccaga

SEQ ID NO: 787135 - DNA, 21 bp, Homo sapiens
ggaggaatcgaggaaccagag

SEQ ID NO: 787136 - DNA, 12 bp, Homo sapiens
ggaggaatgaca

SEQ ID NO: 787137 - DNA, 15 bp, Homo sapiens
ggaggaatgctcccc

SEQ ID NO: 787138 - DNA, 19 bp, Homo sapiens
ggaggacagacggccggcc

SEQ ID NO: 787139 - DNA, 14 bp, Homo sapiens
ggaggacaggcagg

SEQ ID NO: 787140 - DNA, 16 bp, Homo sapiens
ggaggaccagggccct

SEQ ID NO: 787141 - DNA, 20 bp, Homo sapiens
ggaggaccagggccctgggc

SEQ ID NO: 787142 - DNA, 15 bp, Homo sapiens
ggaggacccctgcct

SEQ ID NO: 787143 - DNA, 12 bp, Homo sapiens
ggaggacctggg

SEQ ID NO: 787144 - DNA, 12 bp, Homo sapiens
ggaggaccttat

SEQ ID NO: 787145 - DNA, 13 bp, Homo sapiens
ggagatgggaagg

SEQ ID NO: 787146 - DNA, 18 bp, Homo sapiens
ggagatgggccttttgga

SEQ ID NO: 787147 - DNA, 16 bp, Homo sapiens
ggagatgttgagggga

SEQ ID NO: 787148 - DNA, 12 bp, Homo sapiens
ggagattctggg

SEQ ID NO: 787149 - DNA, 17 bp, Homo sapiens
ggagattggacggcctg

SEQ ID NO: 787150 - DNA, 21 bp, Homo sapiens
ggagatttttcatacttttct

SEQ ID NO: 787151 - DNA, 20 bp, Homo sapiens
ggagcaaaatcgatgcagtg

SEQ ID NO: 787152 - DNA, 17 bp, Homo sapiens
ggagcaaagttaaaagc

SEQ ID NO: 787153 - DNA, 16 bp, Homo sapiens
ggagcaaatgtttctg

SEQ ID NO: 787154 - DNA, 15 bp, Homo sapiens
ggagcaagacagaga

SEQ ID NO: 787155 - DNA, 13 bp, Homo sapiens
ggagcaaggttta

SEQ ID NO: 787156 - DNA, 14 bp, Homo sapiens
ggagcaatcacagg

SEQ ID NO: 787157 - DNA, 16 bp, Homo sapiens
ggagcaatctgaccct

SEQ ID NO: 787158 - DNA, 13 bp, Homo sapiens
ggagcacagccct

SEQ ID NO: 787159 - DNA, 14 bp, Homo sapiens
ggagcacagccctg

SEQ ID NO: 787160 - DNA, 17 bp, Homo sapiens
ggagcacagccctggga

SEQ ID NO: 787161 - DNA, 13 bp, Homo sapiens
ggagcacaggcag

SEQ ID NO: 787162 - DNA, 14 bp, Homo sapiens
ggagcacaggcagc

SEQ ID NO: 787163 - DNA, 15 bp, Homo sapiens
ggagcacaggcagct

SEQ ID NO: 787164 - DNA, 18 bp, Homo sapiens
ggagcacaggtcccacct

SEQ ID NO: 787165 - DNA, 23 bp, Homo sapiens
ggagcacatgttactgcttcatt

SEQ ID NO: 787166 - DNA, 16 bp, Homo sapiens
ggagcacccagagcac

SEQ ID NO: 787167 - DNA, 21 bp, Homo sapiens
ggagcacctggaccccctgcc

SEQ ID NO: 787168 - DNA, 14 bp, Homo sapiens
ggagcacctgggcc

SEQ ID NO: 787169 - DNA, 21 bp, Homo sapiens
ggagcacctgggccccactgg

SEQ ID NO: 787170 - DNA, 22 bp, Homo sapiens
ggagcacctgggccccactgga

SEQ ID NO: 787171 - DNA, 14 bp, Homo sapiens
ggagcacgtggaga

SEQ ID NO: 787172 - DNA, 14 bp, Homo sapiens
ggagcactgttcac

SEQ ID NO: 787173 - DNA, 18 bp, Homo sapiens
ggagcacttgcgtcctgc

SEQ ID NO: 787174 - DNA, 23 bp, Homo sapiens
ggagcagaaaacccttgggccag

SEQ ID NO: 787175 - DNA, 15 bp, Homo sapiens
ggagcagaaagtgcc

SEQ ID NO: 787176 - DNA, 20 bp, Homo sapiens
ggagcagacaggaggaatca

SEQ ID NO: 787177 - DNA, 15 bp, Homo sapiens
ggagcagaccacccc

SEQ ID NO: 787178 - DNA, 13 bp, Homo sapiens
ggagcagcagcgc

SEQ ID NO: 787179 - DNA, 16 bp, Homo sapiens
ggagcagcaggaaggc

SEQ ID NO: 787180 - DNA, 14 bp, Homo sapiens
ggagcagccagagc

SEQ ID NO: 787181 - DNA, 16 bp, Homo sapiens
ggagcagccagagctg

SEQ ID NO: 787182 - DNA, 18 bp, Homo sapiens
ggagcagccagagctgtg

SEQ ID NO: 787183 - DNA, 21 bp, Homo sapiens
ggagcagccagagctgtgcct

SEQ ID NO: 787184 - DNA, 12 bp, Homo sapiens
ggagcagccagg

SEQ ID NO: 787185 - DNA, 14 bp, Homo sapiens
ggagcagccaggac

SEQ ID NO: 787186 - DNA, 15 bp, Homo sapiens
ggagcagccaggacc

SEQ ID NO: 787187 - DNA, 19 bp, Homo sapiens
ggagcagccaggacccgcc

SEQ ID NO: 787188 - DNA, 20 bp, Homo sapiens
ggagcagcctcgaggctggt

SEQ ID NO: 787189 - DNA, 21 bp, Homo sapiens
ggagcagcctcgaggctggtg

SEQ ID NO: 787190 - DNA, 21 bp, Homo sapiens
ggagcagcggattgctctgga

SEQ ID NO: 787191 - DNA, 22 bp, Homo sapiens
ggagcagctattttaagccatc

SEQ ID NO: 787192 - DNA, 18 bp, Homo sapiens
ggagcagcttccttctgg

SEQ ID NO: 787193 - DNA, 20 bp, Homo sapiens
ggagcagcttccttctggga

SEQ ID NO: 787194 - DNA, 21 bp, Homo sapiens
ggagcagcttccttctgggac

SEQ ID NO: 787195 - DNA, 22 bp, Homo sapiens
ggagcagcttccttctgggact

SEQ ID NO: 787196 - DNA, 15 bp, Homo sapiens
ggagcagcttcttgg

SEQ ID NO: 787197 - DNA, 17 bp, Homo sapiens
ggagcagcttcttgggc

SEQ ID NO: 787198 - DNA, 18 bp, Homo sapiens
ggagcaggaggccaataa

SEQ ID NO: 787199 - DNA, 21 bp, Homo sapiens
ggagcaggaggccaataaaaa

SEQ ID NO: 787200 - DNA, 17 bp, Homo sapiens
ggagcagggaaggcctg

SEQ ID NO: 787201 - DNA, 21 bp, Homo sapiens
ggagcagggaaggcctgactt

SEQ ID NO: 787202 - DNA, 13 bp, Homo sapiens
ggagcagggcggc

SEQ ID NO: 787203 - DNA, 18 bp, Homo sapiens
ggagcagtatcatgaagc

SEQ ID NO: 787204 - DNA, 17 bp, Homo sapiens
ggagcagtctcctgccc

SEQ ID NO: 787205 - DNA, 12 bp, Homo sapiens
ggagcagtgtct

SEQ ID NO: 787206 - DNA, 17 bp, Homo sapiens
ggagcagtgtcttccat

SEQ ID NO: 787207 - DNA, 18 bp, Homo sapiens
ggagcagttttcccctgg

SEQ ID NO: 787208 - DNA, 16 bp, Homo sapiens
ggagcatcaagccact

SEQ ID NO: 787209 - DNA, 13 bp, Homo sapiens
ggagcatcccgga

SEQ ID NO: 787210 - DNA, 16 bp, Homo sapiens
ggagcatctgactcac

SEQ ID NO: 787211 - DNA, 21 bp, Homo sapiens
ggagcatctgtttacctggca

SEQ ID NO: 787212 - DNA, 14 bp, Homo sapiens
ggagcatgggcctg

SEQ ID NO: 787213 - DNA, 16 bp, Homo sapiens
ggagcatgggcctggc

SEQ ID NO: 787214 - DNA, 15 bp, Homo sapiens
ggagcattaagccca

SEQ ID NO: 787215 - DNA, 20 bp, Homo sapiens
ggagcatttaatggcagcta

SEQ ID NO: 787216 - DNA, 17 bp, Homo sapiens
ggagccaagtccagatt

SEQ ID NO: 787217 - DNA, 22 bp, Homo sapiens
ggagccaatccactccttcctt

SEQ ID NO: 787218 - DNA, 16 bp, Homo sapiens
ggagccaatggagact

SEQ ID NO: 787219 - DNA, 19 bp, Homo sapiens
ggagggaaggggatggagg

SEQ ID NO: 787220 - DNA, 17 bp, Homo sapiens
ggagggaattgaggtct

SEQ ID NO: 787221 - DNA, 15 bp, Homo sapiens
ggagggacagggcag

SEQ ID NO: 787222 - DNA, 17 bp, Homo sapiens
ggagggaccgcgcaggc

SEQ ID NO: 787223 - DNA, 24 bp, Homo sapiens
ggagggactgtcacactggtgctg

SEQ ID NO: 787224 - DNA, 12 bp, Homo sapiens
ggagggacttgg

SEQ ID NO: 787225 - DNA, 23 bp, Homo sapiens
ggagggacttttaatcagtgaag

SEQ ID NO: 787226 - DNA, 12 bp, Homo sapiens
ggagggagaggt

SEQ ID NO: 787227 - DNA, 13 bp, Homo sapiens
ggagggaggcgct

SEQ ID NO: 787228 - DNA, 20 bp, Homo sapiens
ggagggatgaagggcgagtg

SEQ ID NO: 787229 - DNA, 22 bp, Homo sapiens
ggagggatgcccccaggcagcc

SEQ ID NO: 787230 - DNA, 17 bp, Homo sapiens
ggagggattctggttcc

SEQ ID NO: 787231 - DNA, 22 bp, Homo sapiens
ggagggattctggttccagggt

SEQ ID NO: 787232 - DNA, 20 bp, Homo sapiens
ggagggattggccgcttggc

SEQ ID NO: 787233 - DNA, 23 bp, Homo sapiens
ggagggcaagggccatgctgaag

SEQ ID NO: 787234 - DNA, 22 bp, Homo sapiens
ggagggcacattaactccctcc

SEQ ID NO: 787235 - DNA, 17 bp, Homo sapiens
ggagggcactggagctg

SEQ ID NO: 787236 - DNA, 16 bp, Homo sapiens
ggagggcacttcaggt

SEQ ID NO: 787237 - DNA, 15 bp, Homo sapiens
ggagggcagcagggc

SEQ ID NO: 787238 - DNA, 14 bp, Homo sapiens
ggagggcagctggc

SEQ ID NO: 787239 - DNA, 18 bp, Homo sapiens
ggagggcaggcttgggga

SEQ ID NO: 787240 - DNA, 12 bp, Homo sapiens
ggagggcatggg

SEQ ID NO: 787241 - DNA, 23 bp, Homo sapiens
ggagggccacatgggaggctcac

SEQ ID NO: 787242 - DNA, 18 bp, Homo sapiens
ggagggccagggaggcag

SEQ ID NO: 787243 - DNA, 19 bp, Homo sapiens
ggagggcccctgcgtgggg

SEQ ID NO: 787244 - DNA, 15 bp, Homo sapiens
ggagggccgcagggc

SEQ ID NO: 787245 - DNA, 18 bp, Homo sapiens
ggagggccggcggctctg

SEQ ID NO: 787246 - DNA, 17 bp, Homo sapiens
ggagggctcctggggca

SEQ ID NO: 787247 - DNA, 20 bp, Homo sapiens
ggagggctcctggggcagag

SEQ ID NO: 787248 - DNA, 19 bp, Homo sapiens
ggagggcttggcccagcgc

SEQ ID NO: 787249 - DNA, 15 bp, Homo sapiens
ggaggggaagctggg

SEQ ID NO: 787250 - DNA, 17 bp, Homo sapiens
ggaggggaagctgggcc

SEQ ID NO: 787251 - DNA, 22 bp, Homo sapiens
ggaggggacagaggccctgcca

SEQ ID NO: 787252 - DNA, 20 bp, Homo sapiens
ggaggggagcgtctgggaac

SEQ ID NO: 787253 - DNA, 13 bp, Homo sapiens
ggaggggaggggg

SEQ ID NO: 787254 - DNA, 12 bp, Homo sapiens
ggaggggcagag

SEQ ID NO: 787255 - DNA, 15 bp, Homo sapiens
ggaggggcagagcca

SEQ ID NO: 787256 - DNA, 14 bp, Homo sapiens
ggaggggccctcag

SEQ ID NO: 787257 - DNA, 18 bp, Homo sapiens
ggaggggccggctggcct

SEQ ID NO: 787258 - DNA, 21 bp, Homo sapiens
ggaggggcctaggcctcagcc

SEQ ID NO: 787259 - DNA, 13 bp, Homo sapiens
ggaggggcctggc

SEQ ID NO: 787260 - DNA, 21 bp, Homo sapiens
ggaggggcctggcagccgtgc

SEQ ID NO: 787261 - DNA, 12 bp, Homo sapiens
ggaggggcgctg

SEQ ID NO: 787262 - DNA, 19 bp, Homo sapiens
ggaggggcgctggcccagc

SEQ ID NO: 787263 - DNA, 17 bp, Homo sapiens
ggaggggcggcaggagg

SEQ ID NO: 787264 - DNA, 14 bp, Homo sapiens
ggagggggaagcaa

SEQ ID NO: 787265 - DNA, 18 bp, Homo sapiens
ggagggggaatgtagtga

SEQ ID NO: 787266 - DNA, 12 bp, Homo sapiens
ggagggggacct

SEQ ID NO: 787267 - DNA, 15 bp, Homo sapiens
ggagggggagggggt

SEQ ID NO: 787268 - DNA, 18 bp, Homo sapiens
ggagggggcgctcaggac

SEQ ID NO: 787269 - DNA, 14 bp, Homo sapiens
ggagggggcggcag

SEQ ID NO: 787270 - DNA, 18 bp, Homo sapiens
ggagggggcttgaagcca

SEQ ID NO: 787271 - DNA, 12 bp, Homo sapiens
ggaggggggagc

SEQ ID NO: 787272 - DNA, 18 bp, Homo sapiens
ggagggggttggggtggt

SEQ ID NO: 787273 - DNA, 20 bp, Homo sapiens
ggaggggtttgggagtcagg

SEQ ID NO: 787274 - DNA, 20 bp, Homo sapiens
ggagggtctgggggcagctg

SEQ ID NO: 787275 - DNA, 17 bp, Homo sapiens
ggagggtcttgagggga

SEQ ID NO: 787276 - DNA, 22 bp, Homo sapiens
ggagggtcttgaggggaagctg

SEQ ID NO: 787277 - DNA, 15 bp, Homo sapiens
ggagggtgcagccct

SEQ ID NO: 787278 - DNA, 17 bp, Homo sapiens
ggagggttcccctggcc

SEQ ID NO: 787279 - DNA, 20 bp, Homo sapiens
ggagggttccgccactccag

SEQ ID NO: 787280 - DNA, 21 bp, Homo sapiens
ggaggtagagaggggactggg

SEQ ID NO: 787281 - DNA, 20 bp, Homo sapiens
ggaggtagaggttgtggtga

SEQ ID NO: 787282 - DNA, 19 bp, Homo sapiens
ggaggtcacattcaggaag

SEQ ID NO: 787283 - DNA, 20 bp, Homo sapiens
ggaggtcacattcaggaaga

SEQ ID NO: 787284 - DNA, 15 bp, Homo sapiens
ggaggtcactccacc

SEQ ID NO: 787285 - DNA, 20 bp, Homo sapiens
ggaggtccccggttgctggt

SEQ ID NO: 787286 - DNA, 23 bp, Homo sapiens
ggaggtccccggttgctggtcag

SEQ ID NO: 787287 - DNA, 20 bp, Homo sapiens
ggaggtccttaggcctctga

SEQ ID NO: 787288 - DNA, 14 bp, Homo sapiens
ggaggtcgaggcag

SEQ ID NO: 787289 - DNA, 15 bp, Homo sapiens
ggaggtcgaggcagg

SEQ ID NO: 787290 - DNA, 21 bp, Homo sapiens
ggaggtgagatcacagcctcc

SEQ ID NO: 787291 - DNA, 20 bp, Homo sapiens
ggaggtgcgtgttcagcaga

SEQ ID NO: 787292 - DNA, 22 bp, Homo sapiens
ggaggtgcgtgttcagcagaac

SEQ ID NO: 787293 - DNA, 17 bp, Homo sapiens
ggaggtggaagaaggga

SEQ ID NO: 787294 - DNA, 19 bp, Homo sapiens
ggaggtggagattgcagtg

SEQ ID NO: 787295 - DNA, 17 bp, Homo sapiens
ggaggtggcagccctgt

SEQ ID NO: 787296 - DNA, 16 bp, Homo sapiens
ggaggtgggaggccag

SEQ ID NO: 787297 - DNA, 18 bp, Homo sapiens
ggaggtgggaggccaggc

SEQ ID NO: 787298 - DNA, 21 bp, Homo sapiens
ggaggtgggcaaagggaagta

SEQ ID NO: 787299 - DNA, 20 bp, Homo sapiens
ggaggtgggcatgccaccct

SEQ ID NO: 787300 - DNA, 13 bp, Homo sapiens
ggaggtgggggct

SEQ ID NO: 787301 - DNA, 19 bp, Homo sapiens
ggaggttctcagagccaag

SEQ ID NO: 787302 - DNA, 20 bp, Homo sapiens
ggaggttctcagagccaagt

SEQ ID NO: 787303 - DNA, 18 bp, Homo sapiens
ggaggttctgggcctctg

SEQ ID NO: 787304 - DNA, 19 bp, Homo sapiens
ggaggttgagtgagccggg

SEQ ID NO: 787305 - DNA, 18 bp, Homo sapiens
ggaggttggttccttggg

SEQ ID NO: 787306 - DNA, 22 bp, Homo sapiens
ggaggttggttccttggggggc

SEQ ID NO: 787307 - DNA, 14 bp, Homo sapiens
ggaggttgtggatg

SEQ ID NO: 787308 - DNA, 14 bp, Homo sapiens
ggagtaacagggca

SEQ ID NO: 787309 - DNA, 14 bp, Homo sapiens
ggagtaagtgtaca

SEQ ID NO: 787310 - DNA, 17 bp, Homo sapiens
ggagtaagtgtacaatt

SEQ ID NO: 787311 - DNA, 19 bp, Homo sapiens
ggagtaataggaccagagc

SEQ ID NO: 787312 - DNA, 20 bp, Homo sapiens
ggagtaataggaccagagcg

SEQ ID NO: 787313 - DNA, 12 bp, Homo sapiens
ggagtagaatac

SEQ ID NO: 787314 - DNA, 13 bp, Homo sapiens
ggagtagccaagc

SEQ ID NO: 787315 - DNA, 15 bp, Homo sapiens
ggagtatgcaaaagt

SEQ ID NO: 787316 - DNA, 14 bp, Homo sapiens
ggagtcaactggct

SEQ ID NO: 787317 - DNA, 13 bp, Homo sapiens
ggagtcacacagt

SEQ ID NO: 787318 - DNA, 21 bp, Homo sapiens
ggagtcacacagtgttggagg

SEQ ID NO: 787319 - DNA, 16 bp, Homo sapiens
ggagtcagagccctgg

SEQ ID NO: 787320 - DNA, 19 bp, Homo sapiens
ggagtcagagccctggctg

SEQ ID NO: 787321 - DNA, 23 bp, Homo sapiens
ggagtcaggcctgggcaggaccc

SEQ ID NO: 787322 - DNA, 13 bp, Homo sapiens
ggagtcaggggct

SEQ ID NO: 787323 - DNA, 19 bp, Homo sapiens
ggagtcaggggctctgtgt

SEQ ID NO: 787324 - DNA, 19 bp, Homo sapiens
gctaggagagactgaaagc

SEQ ID NO: 787325 - DNA, 18 bp, Homo sapiens
gctaggatgttgctcaga

SEQ ID NO: 787326 - DNA, 15 bp, Homo sapiens
gctaggattacaggc

SEQ ID NO: 787327 - DNA, 18 bp, Homo sapiens
gctaggcgagtgccagga

SEQ ID NO: 787328 - DNA, 20 bp, Homo sapiens
gctaggcgagtgccaggact

SEQ ID NO: 787329 - DNA, 21 bp, Homo sapiens
gctaggcgagtgccaggactc

SEQ ID NO: 787330 - DNA, 22 bp, Homo sapiens
gctaggctcgccttccctcctg

SEQ ID NO: 787331 - DNA, 16 bp, Homo sapiens
gctagggagagggaag

SEQ ID NO: 787332 - DNA, 14 bp, Homo sapiens
gctagggctgctgc

SEQ ID NO: 787333 - DNA, 15 bp, Homo sapiens
gctagggctgctgct

SEQ ID NO: 787334 - DNA, 17 bp, Homo sapiens
gctagggctgctgcttc

SEQ ID NO: 787335 - DNA, 21 bp, Homo sapiens
gctagtaccctatagagaggg

SEQ ID NO: 787336 - DNA, 16 bp, Homo sapiens
gctagtagcaatgtgc

SEQ ID NO: 787337 - DNA, 19 bp, Homo sapiens
gctagtagcaatgtgcctt

SEQ ID NO: 787338 - DNA, 21 bp, Homo sapiens
gctagtatcttcaaactttca

SEQ ID NO: 787339 - DNA, 18 bp, Homo sapiens
gctagtcaagctcctcct

SEQ ID NO: 787340 - DNA, 21 bp, Homo sapiens
gctagtcaagctcctcctccc

SEQ ID NO: 787341 - DNA, 14 bp, Homo sapiens
gctagtcagagaga

SEQ ID NO: 787342 - DNA, 18 bp, Homo sapiens
gctagtcagagagagtgt

SEQ ID NO: 787343 - DNA, 23 bp, Homo sapiens
gctagtcagtaaagatatttgaa

SEQ ID NO: 787344 - DNA, 17 bp, Homo sapiens
gctagtcttttgctttt

SEQ ID NO: 787345 - DNA, 18 bp, Homo sapiens
gctagtgcatttcaagga

SEQ ID NO: 787346 - DNA, 13 bp, Homo sapiens
gctagtgccttta

SEQ ID NO: 787347 - DNA, 23 bp, Homo sapiens
gctagtgggccctctctctgggc

SEQ ID NO: 787348 - DNA, 17 bp, Homo sapiens
gctagtggggtgaacag

SEQ ID NO: 787349 - DNA, 20 bp, Homo sapiens
gctagtggggtgaacagctg

SEQ ID NO: 787350 - DNA, 21 bp, Homo sapiens
gctagtggggtgaacagctgg

SEQ ID NO: 787351 - DNA, 20 bp, Homo sapiens
gctagtgtgagtggcagcca

SEQ ID NO: 787352 - DNA, 22 bp, Homo sapiens
gctagtgtttctagctaaataa

SEQ ID NO: 787353 - DNA, 16 bp, Homo sapiens
gctagttctgctgccc

SEQ ID NO: 787354 - DNA, 21 bp, Homo sapiens
gctagttttacagattgcctc

SEQ ID NO: 787355 - DNA, 11 bp, Homo sapiens
gctataatcat

SEQ ID NO: 787356 - DNA, 20 bp, Homo sapiens
gctataatcattagttttag

SEQ ID NO: 787357 - DNA, 21 bp, Homo sapiens
gctatactgcatactttttaa

SEQ ID NO: 787358 - DNA, 19 bp, Homo sapiens
gctataggctggagaagct

SEQ ID NO: 787359 - DNA, 13 bp, Homo sapiens
gctatagtatttg

SEQ ID NO: 787360 - DNA, 19 bp, Homo sapiens
gctatagtgtataccacct

SEQ ID NO: 787361 - DNA, 15 bp, Homo sapiens
gctatataattgtga

SEQ ID NO: 787362 - DNA, 19 bp, Homo sapiens
gctatatccagttcctgct

SEQ ID NO: 787363 - DNA, 14 bp, Homo sapiens
gctatatccatgta

SEQ ID NO: 787364 - DNA, 15 bp, Homo sapiens
gctatatccatgtac

SEQ ID NO: 787365 - DNA, 17 bp, Homo sapiens
gctatatccatgtactg

SEQ ID NO: 787366 - DNA, 19 bp, Homo sapiens
gctatatccatgtactgta

SEQ ID NO: 787367 - DNA, 20 bp, Homo sapiens
gctatatcctgatgctggat

SEQ ID NO: 787368 - DNA, 19 bp, Homo sapiens
gctatattcctttttctat

SEQ ID NO: 787369 - DNA, 20 bp, Homo sapiens
gctatattcctttttctatg

SEQ ID NO: 787370 - DNA, 22 bp, Homo sapiens
gctatcaatcaccgtctgtgtt

SEQ ID NO: 787371 - DNA, 13 bp, Homo sapiens
gctatcacacagt

SEQ ID NO: 787372 - DNA, 17 bp, Homo sapiens
gctatcagcaatactca

SEQ ID NO: 787373 - DNA, 18 bp, Homo sapiens
gctatcagcaatactcat

SEQ ID NO: 787374 - DNA, 13 bp, Homo sapiens
gctatcctgctga

SEQ ID NO: 787375 - DNA, 17 bp, Homo sapiens
gctatcctgctgaaagt

SEQ ID NO: 787376 - DNA, 15 bp, Homo sapiens
gctatcgccctcctt

SEQ ID NO: 787377 - DNA, 22 bp, Homo sapiens
gctatcgccctcctttccctta

SEQ ID NO: 787378 - DNA, 14 bp, Homo sapiens
gctatctaaagttt

SEQ ID NO: 787379 - DNA, 20 bp, Homo sapiens
gctatctctgtgtgcacaaa

SEQ ID NO: 787380 - DNA, 22 bp, Homo sapiens
gctatctgcactctaaactgca

SEQ ID NO: 787381 - DNA, 21 bp, Homo sapiens
gctatctggaggccttccagc

SEQ ID NO: 787382 - DNA, 16 bp, Homo sapiens
gctatctgtcatctct

SEQ ID NO: 787383 - DNA, 21 bp, Homo sapiens
gctatctgtcatctctctggg

SEQ ID NO: 787384 - DNA, 13 bp, Homo sapiens
gctatcttcatgt

SEQ ID NO: 787385 - DNA, 13 bp, Homo sapiens
gctatgaacagaa

SEQ ID NO: 787386 - DNA, 15 bp, Homo sapiens
gctatgacagctggc

SEQ ID NO: 787387 - DNA, 14 bp, Homo sapiens
gctatgagttttct

SEQ ID NO: 787388 - DNA, 20 bp, Homo sapiens
gctatgatttttttttccaa

SEQ ID NO: 787389 - DNA, 19 bp, Homo sapiens
gctatggcaggataagaaa

SEQ ID NO: 787390 - DNA, 16 bp, Homo sapiens
gctatggtgagatgca

SEQ ID NO: 787391 - DNA, 22 bp, Homo sapiens
gctatggtgagatgcagctgga

SEQ ID NO: 787392 - DNA, 15 bp, Homo sapiens
gctatggttgccacc

SEQ ID NO: 787393 - DNA, 18 bp, Homo sapiens
gctatggttgccacccca

SEQ ID NO: 787394 - DNA, 14 bp, Homo sapiens
gctatgtaagggtc

SEQ ID NO: 787395 - DNA, 16 bp, Homo sapiens
gctatgttactatttt

SEQ ID NO: 787396 - DNA, 17 bp, Homo sapiens
gctatgttactattttc

SEQ ID NO: 787397 - DNA, 19 bp, Homo sapiens
gctatgttctgtcttccca

SEQ ID NO: 787398 - DNA, 18 bp, Homo sapiens
gctatgtttttaatgtat

SEQ ID NO: 787399 - DNA, 15 bp, Homo sapiens
gctattaaaaaagtc

SEQ ID NO: 787400 - DNA, 12 bp, Homo sapiens
gctattaatatt

SEQ ID NO: 787401 - DNA, 18 bp, Homo sapiens
gctattagcggctcctcg

SEQ ID NO: 787402 - DNA, 21 bp, Homo sapiens
gctattattttcactgtagaa

SEQ ID NO: 787403 - DNA, 14 bp, Homo sapiens
gctattcacctcag

SEQ ID NO: 787404 - DNA, 16 bp, Homo sapiens
gctattcacctcagta

SEQ ID NO: 787405 - DNA, 20 bp, Homo sapiens
gctattcacctcagtagaaa

SEQ ID NO: 787406 - DNA, 16 bp, Homo sapiens
gctattgacaagtcat

SEQ ID NO: 787407 - DNA, 13 bp, Homo sapiens
gctattgctgtct

SEQ ID NO: 787408 - DNA, 14 bp, Homo sapiens
gctattgctgtctg

SEQ ID NO: 787409 - DNA, 19 bp, Homo sapiens
gctattggaggatcagttt

SEQ ID NO: 787410 - DNA, 22 bp, Homo sapiens
gctatttatccctttcctggtt

SEQ ID NO: 787411 - DNA, 19 bp, Homo sapiens
gctcagcctggtgggcctc

SEQ ID NO: 787412 - DNA, 15 bp, Homo sapiens
gctcagccttgcaca

SEQ ID NO: 787413 - DNA, 20 bp, Homo sapiens
gctcagctactgatttttgt

SEQ ID NO: 787414 - DNA, 17 bp, Homo sapiens
gctcagctctgggccat

SEQ ID NO: 787415 - DNA, 16 bp, Homo sapiens
gctcagcttcttccta

SEQ ID NO: 787416 - DNA, 11 bp, Homo sapiens
gctcaggaaaa

SEQ ID NO: 787417 - DNA, 12 bp, Homo sapiens
gctcaggaccca

SEQ ID NO: 787418 - DNA, 16 bp, Homo sapiens
gctcaggacccaggcc

SEQ ID NO: 787419 - DNA, 15 bp, Homo sapiens
gctcaggaggcgccc

SEQ ID NO: 787420 - DNA, 13 bp, Homo sapiens
gctcaggaggctt

SEQ ID NO: 787421 - DNA, 22 bp, Homo sapiens
gctcaggagggtgacgcccagc

SEQ ID NO: 787422 - DNA, 12 bp, Homo sapiens
gctcaggcaagc

SEQ ID NO: 787423 - DNA, 16 bp, Homo sapiens
gctcaggcaagcccct

SEQ ID NO: 787424 - DNA, 18 bp, Homo sapiens
gctcaggcaagcccctca

SEQ ID NO: 787425 - DNA, 23 bp, Homo sapiens
gctcaggcaagcccctcagccct

SEQ ID NO: 787426 - DNA, 22 bp, Homo sapiens
gctcaggcagacaagagctgct

SEQ ID NO: 787427 - DNA, 14 bp, Homo sapiens
gctcaggcagctcg

SEQ ID NO: 787428 - DNA, 20 bp, Homo sapiens
gctcaggcctataaccccag

SEQ ID NO: 787429 - DNA, 22 bp, Homo sapiens
gctcaggcctccctagcacctc

SEQ ID NO: 787430 - DNA, 22 bp, Homo sapiens
gctcaggcgatccacctgtctc

SEQ ID NO: 787431 - DNA, 24 bp, Homo sapiens
gctcaggcgatccacctgtctcag

SEQ ID NO: 787432 - DNA, 22 bp, Homo sapiens
gctcaggctgcagctggacaga

SEQ ID NO: 787433 - DNA, 18 bp, Homo sapiens
gctcaggggacactggcc

SEQ ID NO: 787434 - DNA, 22 bp, Homo sapiens
gctcagggtgctagaggattag

SEQ ID NO: 787435 - DNA, 14 bp, Homo sapiens
gctcaggtgcctta

SEQ ID NO: 787436 - DNA, 14 bp, Homo sapiens
gctcagtctccctt

SEQ ID NO: 787437 - DNA, 16 bp, Homo sapiens
gctcagtctccctttc

SEQ ID NO: 787438 - DNA, 19 bp, Homo sapiens
gctcagtctccctttccct

SEQ ID NO: 787439 - DNA, 14 bp, Homo sapiens
gctcagtctgttca

SEQ ID NO: 787440 - DNA, 16 bp, Homo sapiens
gctcagtctgttcact

SEQ ID NO: 787441 - DNA, 14 bp, Homo sapiens
gctcagtgccacct

SEQ ID NO: 787442 - DNA, 12 bp, Homo sapiens
gctcagtgcccg

SEQ ID NO: 787443 - DNA, 16 bp, Homo sapiens
gctcagtgtccagctt

SEQ ID NO: 787444 - DNA, 16 bp, Homo sapiens
gctcatacaaaataaa

SEQ ID NO: 787445 - DNA, 22 bp, Homo sapiens
gctcatagaattttgagtattc

SEQ ID NO: 787446 - DNA, 23 bp, Homo sapiens
gctcatagaggtgagaaaactca

SEQ ID NO: 787447 - DNA, 18 bp, Homo sapiens
gctcatattttgtatata

SEQ ID NO: 787448 - DNA, 20 bp, Homo sapiens
gctcatcattctctgtctca

SEQ ID NO: 787449 - DNA, 18 bp, Homo sapiens
gctcatcccccctgctgc

SEQ ID NO: 787450 - DNA, 20 bp, Homo sapiens
gctcatcctgtagggcaccc

SEQ ID NO: 787451 - DNA, 23 bp, Homo sapiens
gctcatcctgtagggcacccaaa

SEQ ID NO: 787452 - DNA, 15 bp, Homo sapiens
gctcatctccaagga

SEQ ID NO: 787453 - DNA, 13 bp, Homo sapiens
gctcatctgctgg

SEQ ID NO: 787454 - DNA, 23 bp, Homo sapiens
gctcatctgctggtccgtgggac

SEQ ID NO: 787455 - DNA, 18 bp, Homo sapiens
gctcatggcgtaatgggc

SEQ ID NO: 787456 - DNA, 21 bp, Homo sapiens
gctcatggcgtaatgggcctg

SEQ ID NO: 787457 - DNA, 22 bp, Homo sapiens
gctcatggcgtaatgggcctgc

SEQ ID NO: 787458 - DNA, 23 bp, Homo sapiens
gctcatggcgtaatgggcctgcc

SEQ ID NO: 787459 - DNA, 20 bp, Homo sapiens
gctcatggctgtgtccactg

SEQ ID NO: 787460 - DNA, 13 bp, Homo sapiens
gctcatgggtggc

SEQ ID NO: 787461 - DNA, 22 bp, Homo sapiens
gctcatgtaggtgagcctgggc

SEQ ID NO: 787462 - DNA, 23 bp, Homo sapiens
gctcatgtaggtgagcctgggca

SEQ ID NO: 787463 - DNA, 14 bp, Homo sapiens
gctcattaaacttt

SEQ ID NO: 787464 - DNA, 17 bp, Homo sapiens
gctcattaaactttttt

SEQ ID NO: 787465 - DNA, 20 bp, Homo sapiens
gctcattacagttctttcct

SEQ ID NO: 787466 - DNA, 11 bp, Homo sapiens
gctcatttaag

SEQ ID NO: 787467 - DNA, 23 bp, Homo sapiens
gctcattttgacaaagtgcctca

SEQ ID NO: 787468 - DNA, 14 bp, Homo sapiens
gctccaagaggctg

SEQ ID NO: 787469 - DNA, 19 bp, Homo sapiens
gctccaagatgttctcctg

SEQ ID NO: 787470 - DNA, 16 bp, Homo sapiens
gctccaagccccatct

SEQ ID NO: 787471 - DNA, 19 bp, Homo sapiens
gctccaagccccatcttct

SEQ ID NO: 787472 - DNA, 16 bp, Homo sapiens
gctccaagggacaggt

SEQ ID NO: 787473 - DNA, 20 bp, Homo sapiens
gctccaagggacaggtgggc

SEQ ID NO: 787474 - DNA, 16 bp, Homo sapiens
gctccaatttccccac

SEQ ID NO: 787475 - DNA, 18 bp, Homo sapiens
gctccacacattccagcc

SEQ ID NO: 787476 - DNA, 12 bp, Homo sapiens
gctccaccacat

SEQ ID NO: 787477 - DNA, 13 bp, Homo sapiens
gctccaccagcag

SEQ ID NO: 787478 - DNA, 14 bp, Homo sapiens
gctccaccagcagc

SEQ ID NO: 787479 - DNA, 16 bp, Homo sapiens
gctccacccttggcct

SEQ ID NO: 787480 - DNA, 17 bp, Homo sapiens
gctccacccttggcctg

SEQ ID NO: 787481 - DNA, 14 bp, Homo sapiens
gctccacctctggt

SEQ ID NO: 787482 - DNA, 20 bp, Homo sapiens
gctccacctctggtggctcc

SEQ ID NO: 787483 - DNA, 20 bp, Homo sapiens
gctccacggtgcgtggctgt

SEQ ID NO: 787484 - DNA, 23 bp, Homo sapiens
gctccacggtgcgtggctgtggc

SEQ ID NO: 787485 - DNA, 17 bp, Homo sapiens
gctccactctgcttctc

SEQ ID NO: 787486 - DNA, 21 bp, Homo sapiens
gctccactctgcttctctgac

SEQ ID NO: 787487 - DNA, 21 bp, Homo sapiens
gctccagaagatgccagcttc

SEQ ID NO: 787488 - DNA, 21 bp, Homo sapiens
gctccagacatacaaacataa

SEQ ID NO: 787489 - DNA, 17 bp, Homo sapiens
gctccagacccccagca

SEQ ID NO: 787490 - DNA, 22 bp, Homo sapiens
gctccagactcacttgccattg

SEQ ID NO: 787491 - DNA, 14 bp, Homo sapiens
gctccagaggacct

SEQ ID NO: 787492 - DNA, 12 bp, Homo sapiens
gctccagagggc

SEQ ID NO: 787493 - DNA, 20 bp, Homo sapiens
gctccagagggcactctgct

SEQ ID NO: 787494 - DNA, 22 bp, Homo sapiens
gctccagatgcagggcagtcat

SEQ ID NO: 787495 - DNA, 20 bp, Homo sapiens
gctccagattctgatgcata

SEQ ID NO: 787496 - DNA, 21 bp, Homo sapiens
gctccagcaactgcccttcca

SEQ ID NO: 787497 - DNA, 20 bp, Homo sapiens
gctccagcaccttctttctg

SEQ ID NO: 787498 - DNA, 21 bp, Homo sapiens
gctccagcaccttctttctgg

SEQ ID NO: 787499 - DNA, 21 bp, Homo sapiens
gctccagcaggaaggacccca

SEQ ID NO: 787500 - DNA, 13 bp, Homo sapiens
gctccagcatcca

SEQ ID NO: 787501 - DNA, 14 bp, Homo sapiens
gctccagcatccag

SEQ ID NO: 787502 - DNA, 18 bp, Homo sapiens
gctccagcatccagcctg

SEQ ID NO: 787503 - DNA, 16 bp, Homo sapiens
gctccagccaacccct

SEQ ID NO: 787504 - DNA, 12 bp, Homo sapiens
gctccagcccct

SEQ ID NO: 787505 - DNA, 13 bp, Homo sapiens
gctccagcccctt

SEQ ID NO: 787506 - DNA, 20 bp, Homo sapiens
gctccagcccctttgcctct

SEQ ID NO: 787507 - DNA, 13 bp, Homo sapiens
gctccagctgccc

SEQ ID NO: 787508 - DNA, 20 bp, Homo sapiens
gctccagctgttcagctggt

SEQ ID NO: 787509 - DNA, 11 bp, Homo sapiens
gctccaggaca

SEQ ID NO: 787510 - DNA, 15 bp, Homo sapiens
gctccaggcacccag

SEQ ID NO: 787511 - DNA, 19 bp, Homo sapiens
gctccaggcctgcagcagg

SEQ ID NO: 787512 - DNA, 20 bp, Homo sapiens
gctccagggaatccaagcct

SEQ ID NO: 787513 - DNA, 22 bp, Homo sapiens
gctccagggaatccaagcctcc

SEQ ID NO: 787514 - DNA, 19 bp, Homo sapiens
gctccagggatgattcaag

SEQ ID NO: 787515 - DNA, 16 bp, Homo sapiens
gctccagggcagcctc

SEQ ID NO: 787516 - DNA, 23 bp, Homo sapiens
gctccagggcagcctccaccttg

SEQ ID NO: 787517 - DNA, 22 bp, Homo sapiens
gctccagggtcttgggctactg

SEQ ID NO: 787518 - DNA, 23 bp, Homo sapiens
gctccagggtcttgggctactgg

SEQ ID NO: 787519 - DNA, 15 bp, Homo sapiens
gctccaggtggctct

SEQ ID NO: 787520 - DNA, 13 bp, Homo sapiens
gctccagtgccgc

SEQ ID NO: 787521 - DNA, 19 bp, Homo sapiens
gctccagtgccgctcctgc

SEQ ID NO: 787522 - DNA, 17 bp, Homo sapiens
gctccagtgggcagggg

SEQ ID NO: 787523 - DNA, 14 bp, Homo sapiens
gctccagtttgcat

SEQ ID NO: 787524 - DNA, 16 bp, Homo sapiens
gctccagtttgcattt

SEQ ID NO: 787525 - DNA, 17 bp, Homo sapiens
gctccatcgcgccagcg

SEQ ID NO: 787526 - DNA, 18 bp, Homo sapiens
gctccatgactggctgtc

SEQ ID NO: 787527 - DNA, 20 bp, Homo sapiens
gctccatgcctctggaggcc

SEQ ID NO: 787528 - DNA, 13 bp, Homo sapiens
gctccatgtgcat

SEQ ID NO: 787529 - DNA, 20 bp, Homo sapiens
gctccatgtgccccctctac

SEQ ID NO: 787530 - DNA, 19 bp, Homo sapiens
gctcctcacccctgtaggg

SEQ ID NO: 787531 - DNA, 15 bp, Homo sapiens
gctcctcacctgtct

SEQ ID NO: 787532 - DNA, 14 bp, Homo sapiens
gctcctcactggag

SEQ ID NO: 787533 - DNA, 11 bp, Homo sapiens
gctcctcagag

SEQ ID NO: 787534 - DNA, 16 bp, Homo sapiens
gctcctcagcggctcc

SEQ ID NO: 787535 - DNA, 13 bp, Homo sapiens
gctcctcatggga

SEQ ID NO: 787536 - DNA, 12 bp, Homo sapiens
gctcctccagcc

SEQ ID NO: 787537 - DNA, 13 bp, Homo sapiens
gctcctccagccc

SEQ ID NO: 787538 - DNA, 20 bp, Homo sapiens
gctcctccagggtgtgtgct

SEQ ID NO: 787539 - DNA, 16 bp, Homo sapiens
gctcctcccagatggc

SEQ ID NO: 787540 - DNA, 13 bp, Homo sapiens
gctcctcccagct

SEQ ID NO: 787541 - DNA, 19 bp, Homo sapiens
gctcctcccggtgcccaag

SEQ ID NO: 787542 - DNA, 16 bp, Homo sapiens
gctcctccctgccccc

SEQ ID NO: 787543 - DNA, 17 bp, Homo sapiens
gctcctccctgcccccc

SEQ ID NO: 787544 - DNA, 16 bp, Homo sapiens
gctcctccctggctgc

SEQ ID NO: 787545 - DNA, 20 bp, Homo sapiens
gctcctccctggctgccctg

SEQ ID NO: 787546 - DNA, 15 bp, Homo sapiens
gctcctccctgtgcc

SEQ ID NO: 787547 - DNA, 23 bp, Homo sapiens
gctcctccctgtgcccccagcct

SEQ ID NO: 787548 - DNA, 16 bp, Homo sapiens
gctcctcctcacccac

SEQ ID NO: 787549 - DNA, 18 bp, Homo sapiens
gctcctcctccctgcatc

SEQ ID NO: 787550 - DNA, 13 bp, Homo sapiens
gctcctcctctca

SEQ ID NO: 787551 - DNA, 14 bp, Homo sapiens
gctcctcctgccct

SEQ ID NO: 787552 - DNA, 18 bp, Homo sapiens
gctcctcctgccctgtcc

SEQ ID NO: 787553 - DNA, 13 bp, Homo sapiens
gctcctccttccc

SEQ ID NO: 787554 - DNA, 19 bp, Homo sapiens
gctcctccttcccagggac

SEQ ID NO: 787555 - DNA, 19 bp, Homo sapiens
gctcctccttgcccagact

SEQ ID NO: 787556 - DNA, 14 bp, Homo sapiens
gctcctctaggggc

SEQ ID NO: 787557 - DNA, 17 bp, Homo sapiens
gctcctctaggggcagc

SEQ ID NO: 787558 - DNA, 20 bp, Homo sapiens
gctcctctaggggcagcctc

SEQ ID NO: 787559 - DNA, 13 bp, Homo sapiens
gctcctctccagg

SEQ ID NO: 787560 - DNA, 16 bp, Homo sapiens
gctcctctccaggcac

SEQ ID NO: 787561 - DNA, 17 bp, Homo sapiens
gctcctctccagtctga

SEQ ID NO: 787562 - DNA, 16 bp, Homo sapiens
gctcctctgccttgga

SEQ ID NO: 787563 - DNA, 17 bp, Homo sapiens
gctcctctgccttggac

SEQ ID NO: 787564 - DNA, 20 bp, Homo sapiens
gctcctctgccttggacacc

SEQ ID NO: 787565 - DNA, 20 bp, Homo sapiens
gctcctcttaccgtagcctc

SEQ ID NO: 787566 - DNA, 22 bp, Homo sapiens
gctcctcttaccgtagcctccg

SEQ ID NO: 787567 - DNA, 17 bp, Homo sapiens
gctcctcttgattcctg

SEQ ID NO: 787568 - DNA, 22 bp, Homo sapiens
gctcctgaggggcatctgcccc

SEQ ID NO: 787569 - DNA, 15 bp, Homo sapiens
gctcctgagtagctg

SEQ ID NO: 787570 - DNA, 17 bp, Homo sapiens
gctcctgagtagctggg

SEQ ID NO: 787571 - DNA, 19 bp, Homo sapiens
gctcctgagtagctgggcc

SEQ ID NO: 787572 - DNA, 20 bp, Homo sapiens
gctcctgagtagctgggcct

SEQ ID NO: 787573 - DNA, 20 bp, Homo sapiens
gctcctgcacttacttgctt

SEQ ID NO: 787574 - DNA, 11 bp, Homo sapiens
gctcctgcagc

SEQ ID NO: 787575 - DNA, 15 bp, Homo sapiens
gctcctgcagcatgg

SEQ ID NO: 787576 - DNA, 21 bp, Homo sapiens
gctcctgcagcatggtccctg

SEQ ID NO: 787577 - DNA, 16 bp, Homo sapiens
gctcctgccaaccaca

SEQ ID NO: 787578 - DNA, 12 bp, Homo sapiens
gctcctgccagg

SEQ ID NO: 787579 - DNA, 13 bp, Homo sapiens
gctcctgcttccc

SEQ ID NO: 787580 - DNA, 17 bp, Homo sapiens
gctcctgcttcccctcc

SEQ ID NO: 787581 - DNA, 17 bp, Homo sapiens
gctcctgcttttctgtc

SEQ ID NO: 787582 - DNA, 19 bp, Homo sapiens
gctcctgcttttctgtcct

SEQ ID NO: 787583 - DNA, 22 bp, Homo sapiens
gctcctggaaccaatcccgtga

SEQ ID NO: 787584 - DNA, 18 bp, Homo sapiens
gctcctggagcctttgaa

SEQ ID NO: 787585 - DNA, 22 bp, Homo sapiens
gctgagcaggacagccagcagc

SEQ ID NO: 787586 - DNA, 16 bp, Homo sapiens
gctgagccactcgcag

SEQ ID NO: 787587 - DNA, 20 bp, Homo sapiens
gctgagcccctaccccacac

SEQ ID NO: 787588 - DNA, 22 bp, Homo sapiens
gctgagcccctggtcttctcta

SEQ ID NO: 787589 - DNA, 15 bp, Homo sapiens
gctgagcccctgtct

SEQ ID NO: 787590 - DNA, 22 bp, Homo sapiens
gctgagcccctgtctagagagg

SEQ ID NO: 787591 - DNA, 13 bp, Homo sapiens
gctgagccctggc

SEQ ID NO: 787592 - DNA, 17 bp, Homo sapiens
gctgagcctcacagcag

SEQ ID NO: 787593 - DNA, 19 bp, Homo sapiens
gctgagcctcacagcagtg

SEQ ID NO: 787594 - DNA, 22 bp, Homo sapiens
gctgagcctcacagcagtgaga

SEQ ID NO: 787595 - DNA, 16 bp, Homo sapiens
gctgagcctcagtctc

SEQ ID NO: 787596 - DNA, 14 bp, Homo sapiens
gctgagcctctcac

SEQ ID NO: 787597 - DNA, 14 bp, Homo sapiens
gctgagcctggctg

SEQ ID NO: 787598 - DNA, 14 bp, Homo sapiens
gctgagcgccagga

SEQ ID NO: 787599 - DNA, 20 bp, Homo sapiens
gctgagcgcccccgagccct

SEQ ID NO: 787600 - DNA, 17 bp, Homo sapiens
gctgagctagcctccag

SEQ ID NO: 787601 - DNA, 14 bp, Homo sapiens
gctgagctgagctt

SEQ ID NO: 787602 - DNA, 14 bp, Homo sapiens
gctgagctgggccc

SEQ ID NO: 787603 - DNA, 18 bp, Homo sapiens
gctgagctgggcccagcc

SEQ ID NO: 787604 - DNA, 12 bp, Homo sapiens
gctgaggagcag

SEQ ID NO: 787605 - DNA, 15 bp, Homo sapiens
gctgaggagcagcca

SEQ ID NO: 787606 - DNA, 16 bp, Homo sapiens
gctgaggagcagccag

SEQ ID NO: 787607 - DNA, 19 bp, Homo sapiens
gctgaggaggggcctgggc

SEQ ID NO: 787608 - DNA, 17 bp, Homo sapiens
gctgaggagtctgagga

SEQ ID NO: 787609 - DNA, 21 bp, Homo sapiens
gctgaggagtctgaggactgt

SEQ ID NO: 787610 - DNA, 24 bp, Homo sapiens
gctgaggagtctgaggactgtcct

SEQ ID NO: 787611 - DNA, 18 bp, Homo sapiens
gctgaggatttcaagcct

SEQ ID NO: 787612 - DNA, 20 bp, Homo sapiens
gctgaggatttcaagcctgc

SEQ ID NO: 787613 - DNA, 16 bp, Homo sapiens
gctgaggcagaagaat

SEQ ID NO: 787614 - DNA, 13 bp, Homo sapiens
gctgaggcaggag

SEQ ID NO: 787615 - DNA, 15 bp, Homo sapiens
gctgaggcaggagga

SEQ ID NO: 787616 - DNA, 15 bp, Homo sapiens
gctgaggccagagtc

SEQ ID NO: 787617 - DNA, 19 bp, Homo sapiens
gctgaggccagagtcacct

SEQ ID NO: 787618 - DNA, 22 bp, Homo sapiens
gctgaggccggatgcggtggct

SEQ ID NO: 787619 - DNA, 12 bp, Homo sapiens
gctgaggcctcg

SEQ ID NO: 787620 - DNA, 14 bp, Homo sapiens
gctgaggccttctc

SEQ ID NO: 787621 - DNA, 20 bp, Homo sapiens
gctgaggccttctcttgagg

SEQ ID NO: 787622 - DNA, 15 bp, Homo sapiens
gctgagggagggagc

SEQ ID NO: 787623 - DNA, 18 bp, Homo sapiens
gctgagggagggagccat

SEQ ID NO: 787624 - DNA, 16 bp, Homo sapiens
gctgagggatgactta

SEQ ID NO: 787625 - DNA, 19 bp, Homo sapiens
gctgagggccaatacccta

SEQ ID NO: 787626 - DNA, 14 bp, Homo sapiens
gctgagggccctgt

SEQ ID NO: 787627 - DNA, 12 bp, Homo sapiens
gctgagggcctg

SEQ ID NO: 787628 - DNA, 14 bp, Homo sapiens
gctgagggcctgct

SEQ ID NO: 787629 - DNA, 17 bp, Homo sapiens
gctgagggcctgctgga

SEQ ID NO: 787630 - DNA, 22 bp, Homo sapiens
gctgaggggaggatcactggag

SEQ ID NO: 787631 - DNA, 23 bp, Homo sapiens
gctgaggggcaacgaagaaaaaa

SEQ ID NO: 787632 - DNA, 13 bp, Homo sapiens
gctgaggggcagg

SEQ ID NO: 787633 - DNA, 17 bp, Homo sapiens
gctgaggggcctgcgcc

SEQ ID NO: 787634 - DNA, 23 bp, Homo sapiens
gctgaggggggccgtgcccaggg

SEQ ID NO: 787635 - DNA, 18 bp, Homo sapiens
gctgagggtgagtgggtg

SEQ ID NO: 787636 - DNA, 17 bp, Homo sapiens
gctgaggtctcttgagg

SEQ ID NO: 787637 - DNA, 11 bp, Homo sapiens
gctgaggtggg

SEQ ID NO: 787638 - DNA, 16 bp, Homo sapiens
gctgaggttagagaga

SEQ ID NO: 787639 - DNA, 17 bp, Homo sapiens
gctgaggttcctctgcc

SEQ ID NO: 787640 - DNA, 19 bp, Homo sapiens
gctgaggttcctctgcctg

SEQ ID NO: 787641 - DNA, 23 bp, Homo sapiens
gctgaggttcctctgcctgcccc

SEQ ID NO: 787642 - DNA, 15 bp, Homo sapiens
gctgagtcacctcct

SEQ ID NO: 787643 - DNA, 18 bp, Homo sapiens
gctgagtcacctcctcca

SEQ ID NO: 787644 - DNA, 23 bp, Homo sapiens
gctgagtcatctgttagggcctt

SEQ ID NO: 787645 - DNA, 22 bp, Homo sapiens
gctgagtcatgatctccctgcc

SEQ ID NO: 787646 - DNA, 23 bp, Homo sapiens
gctgagtcatgatctccctgccg

SEQ ID NO: 787647 - DNA, 20 bp, Homo sapiens
gctgagtgaccgggggctgc

SEQ ID NO: 787648 - DNA, 21 bp, Homo sapiens
gctgagtgactgtaggcaggg

SEQ ID NO: 787649 - DNA, 14 bp, Homo sapiens
gctgagtgcagcca

SEQ ID NO: 787650 - DNA, 15 bp, Homo sapiens
gctgagtgcagccaa

SEQ ID NO: 787651 - DNA, 22 bp, Homo sapiens
gctgagtgcagccaaaggggag

SEQ ID NO: 787652 - DNA, 12 bp, Homo sapiens
gctgagtgctgg

SEQ ID NO: 787653 - DNA, 19 bp, Homo sapiens
gctgagtggaatgcaggga

SEQ ID NO: 787654 - DNA, 19 bp, Homo sapiens
gctgagtggcaggggacag

SEQ ID NO: 787655 - DNA, 18 bp, Homo sapiens
gctgagtggccagccagt

SEQ ID NO: 787656 - DNA, 19 bp, Homo sapiens
gctgagtggccagccagtg

SEQ ID NO: 787657 - DNA, 23 bp, Homo sapiens
gctgagtgggggatcacagcctc

SEQ ID NO: 787658 - DNA, 23 bp, Homo sapiens
gctgagttacttgtctgaggcct

SEQ ID NO: 787659 - DNA, 15 bp, Homo sapiens
gctgagtttcctatg

SEQ ID NO: 787660 - DNA, 17 bp, Homo sapiens
gctgataattgtgtatt

SEQ ID NO: 787661 - DNA, 18 bp, Homo sapiens
gctgatatgcaagtaaga

SEQ ID NO: 787662 - DNA, 20 bp, Homo sapiens
gctgatattatggcaagtga

SEQ ID NO: 787663 - DNA, 16 bp, Homo sapiens
gctgatattatttctt

SEQ ID NO: 787664 - DNA, 18 bp, Homo sapiens
gctgatccagagcacaga

SEQ ID NO: 787665 - DNA, 24 bp, Homo sapiens
gctgatccataggactaccgcagg

SEQ ID NO: 787666 - DNA, 20 bp, Homo sapiens
gctgatccggctgctcctcc

SEQ ID NO: 787667 - DNA, 16 bp, Homo sapiens
gctgatcgtagaaaat

SEQ ID NO: 787668 - DNA, 19 bp, Homo sapiens
gctgatcgtagaaaatttg

SEQ ID NO: 787669 - DNA, 22 bp, Homo sapiens
gctgatctgcggatctcagctt

SEQ ID NO: 787670 - DNA, 23 bp, Homo sapiens
gctgatgaaactcctgattttgt

SEQ ID NO: 787671 - DNA, 14 bp, Homo sapiens
gctgatgaggctgg

SEQ ID NO: 787672 - DNA, 14 bp, Homo sapiens
gctgatgatccaga

SEQ ID NO: 787673 - DNA, 22 bp, Homo sapiens
gctgatgatgtctcttgtagaa

SEQ ID NO: 787674 - DNA, 16 bp, Homo sapiens
gctgatgcgctgggat

SEQ ID NO: 787675 - DNA, 18 bp, Homo sapiens
gctgatgctcctccgggt

SEQ ID NO: 787676 - DNA, 22 bp, Homo sapiens
gctgatgctcctccgggtctgc

SEQ ID NO: 787677 - DNA, 16 bp, Homo sapiens
gctgatgcttgaagta

SEQ ID NO: 787678 - DNA, 15 bp, Homo sapiens
gctgatggaggaaaa

SEQ ID NO: 787679 - DNA, 16 bp, Homo sapiens
gctgatggaggaaaaa

SEQ ID NO: 787680 - DNA, 13 bp, Homo sapiens
gctgatggcagct

SEQ ID NO: 787681 - DNA, 14 bp, Homo sapiens
gctgatggcagctg

SEQ ID NO: 787682 - DNA, 13 bp, Homo sapiens
gctgatggcctgg

SEQ ID NO: 787683 - DNA, 21 bp, Homo sapiens
gctgatggcctggctgcctgg

SEQ ID NO: 787684 - DNA, 17 bp, Homo sapiens
gctgatgtcaatttctg

SEQ ID NO: 787685 - DNA, 14 bp, Homo sapiens
gctgatgtggactg

SEQ ID NO: 787686 - DNA, 17 bp, Homo sapiens
gctgatgtggactgtct

SEQ ID NO: 787687 - DNA, 20 bp, Homo sapiens
gctgatgttggaagagaaag

SEQ ID NO: 787688 - DNA, 14 bp, Homo sapiens
gctgattactgtca

SEQ ID NO: 787689 - DNA, 20 bp, Homo sapiens
gctgattactgtcaataaac

SEQ ID NO: 787690 - DNA, 21 bp, Homo sapiens
gctgattactgtcaataaaca

SEQ ID NO: 787691 - DNA, 21 bp, Homo sapiens
gctgattcaaaccaaagctgc

SEQ ID NO: 787692 - DNA, 24 bp, Homo sapiens
gctgattcaaaccaaagctgcctg

SEQ ID NO: 787693 - DNA, 17 bp, Homo sapiens
gctgattcctcgtgtcc

SEQ ID NO: 787694 - DNA, 14 bp, Homo sapiens
gctgattcttgtaa

SEQ ID NO: 787695 - DNA, 13 bp, Homo sapiens
gctgatttcactt

SEQ ID NO: 787696 - DNA, 17 bp, Homo sapiens
gctgatttccaggcccc

SEQ ID NO: 787697 - DNA, 21 bp, Homo sapiens
gctgatttccaggcccctgag

SEQ ID NO: 787698 - DNA, 14 bp, Homo sapiens
gctgatttctagtg

SEQ ID NO: 787699 - DNA, 20 bp, Homo sapiens
gctgatttctagtgtatact

SEQ ID NO: 787700 - DNA, 18 bp, Homo sapiens
gctgatttggagtgagcc

SEQ ID NO: 787701 - DNA, 22 bp, Homo sapiens
gctgcaaaggagaagcacagct

SEQ ID NO: 787702 - DNA, 12 bp, Homo sapiens
gctgcaaggtac

SEQ ID NO: 787703 - DNA, 19 bp, Homo sapiens
gctgcaaggtggcctctgc

SEQ ID NO: 787704 - DNA, 20 bp, Homo sapiens
gctgcaaggtggcctctgcc

SEQ ID NO: 787705 - DNA, 12 bp, Homo sapiens
gctgcaaggttt

SEQ ID NO: 787706 - DNA, 15 bp, Homo sapiens
gctgcaatgcctaga

SEQ ID NO: 787707 - DNA, 16 bp, Homo sapiens
gctgcaattccctgga

SEQ ID NO: 787708 - DNA, 17 bp, Homo sapiens
gctgcacaaaagcagat

SEQ ID NO: 787709 - DNA, 13 bp, Homo sapiens
ggcagcttgcccc

SEQ ID NO: 787710 - DNA, 14 bp, Homo sapiens
ggcagctttttctg

SEQ ID NO: 787711 - DNA, 19 bp, Homo sapiens
ggcagctttttctgtggag

SEQ ID NO: 787712 - DNA, 15 bp, Homo sapiens
ggcaggaaggagagc

SEQ ID NO: 787713 - DNA, 16 bp, Homo sapiens
ggcaggaaggagagcc

SEQ ID NO: 787714 - DNA, 16 bp, Homo sapiens
ggcaggaagggaagcg

SEQ ID NO: 787715 - DNA, 22 bp, Homo sapiens
ggcaggacacatcccggcctct

SEQ ID NO: 787716 - DNA, 14 bp, Homo sapiens
ggcaggactcctgg

SEQ ID NO: 787717 - DNA, 17 bp, Homo sapiens
ggcaggactcctggcag

SEQ ID NO: 787718 - DNA, 23 bp, Homo sapiens
ggcaggactcctggcagggccac

SEQ ID NO: 787719 - DNA, 21 bp, Homo sapiens
ggcaggaggctttgggtggct

SEQ ID NO: 787720 - DNA, 14 bp, Homo sapiens
ggcaggagtgccag

SEQ ID NO: 787721 - DNA, 15 bp, Homo sapiens
ggcaggagtgccagg

SEQ ID NO: 787722 - DNA, 16 bp, Homo sapiens
ggcaggagtgccagga

SEQ ID NO: 787723 - DNA, 22 bp, Homo sapiens
ggcaggagtgccaggaccagcc

SEQ ID NO: 787724 - DNA, 19 bp, Homo sapiens
ggcaggatctcaagccagc

SEQ ID NO: 787725 - DNA, 20 bp, Homo sapiens
ggcaggatctcaagccagcc

SEQ ID NO: 787726 - DNA, 21 bp, Homo sapiens
ggcaggatctcaagccagccc

SEQ ID NO: 787727 - DNA, 15 bp, Homo sapiens
ggcaggatgaccctg

SEQ ID NO: 787728 - DNA, 14 bp, Homo sapiens
ggcaggatggcctt

SEQ ID NO: 787729 - DNA, 16 bp, Homo sapiens
ggcaggatggcctttc

SEQ ID NO: 787730 - DNA, 17 bp, Homo sapiens
ggcaggatggcctttcc

SEQ ID NO: 787731 - DNA, 18 bp, Homo sapiens
ggcaggcacacagcagcc

SEQ ID NO: 787732 - DNA, 19 bp, Homo sapiens
ggcaggcacacagcagccc

SEQ ID NO: 787733 - DNA, 16 bp, Homo sapiens
ggcaggcactgtggcc

SEQ ID NO: 787734 - DNA, 17 bp, Homo sapiens
ggcaggcagggctgcag

SEQ ID NO: 787735 - DNA, 14 bp, Homo sapiens
ggcaggcaggtgtt

SEQ ID NO: 787736 - DNA, 20 bp, Homo sapiens
ggcaggcattcctgaaggga

SEQ ID NO: 787737 - DNA, 22 bp, Homo sapiens
ggcaggcattcctgaagggaac

SEQ ID NO: 787738 - DNA, 13 bp, Homo sapiens
ggcaggcattgag

SEQ ID NO: 787739 - DNA, 23 bp, Homo sapiens
ggcaggccagcttcgtgctggag

SEQ ID NO: 787740 - DNA, 12 bp, Homo sapiens
ggcaggcctccg

SEQ ID NO: 787741 - DNA, 11 bp, Homo sapiens
ggcaggcctga

SEQ ID NO: 787742 - DNA, 12 bp, Homo sapiens
ggcaggcctgac

SEQ ID NO: 787743 - DNA, 15 bp, Homo sapiens
ggcaggcctgagaat

SEQ ID NO: 787744 - DNA, 17 bp, Homo sapiens
ggcaggcctgagaatga

SEQ ID NO: 787745 - DNA, 12 bp, Homo sapiens
ggcaggcctggg

SEQ ID NO: 787746 - DNA, 16 bp, Homo sapiens
ggcaggcgcagaggtc

SEQ ID NO: 787747 - DNA, 17 bp, Homo sapiens
ggcaggcgggcccatga

SEQ ID NO: 787748 - DNA, 15 bp, Homo sapiens
ggcaggcgtgtggca

SEQ ID NO: 787749 - DNA, 22 bp, Homo sapiens
ggcaggctcactgccaggccag

SEQ ID NO: 787750 - DNA, 15 bp, Homo sapiens
ggcaggctctctcct

SEQ ID NO: 787751 - DNA, 10 bp, Homo sapiens
ggcaggctgg

SEQ ID NO: 787752 - DNA, 13 bp, Homo sapiens
ggcaggctgggcc

SEQ ID NO: 787753 - DNA, 16 bp, Homo sapiens
ggcaggctgggccatg

SEQ ID NO: 787754 - DNA, 16 bp, Homo sapiens
ggcaggctgggtgacc

SEQ ID NO: 787755 - DNA, 18 bp, Homo sapiens
ggcagggaaaggctctga

SEQ ID NO: 787756 - DNA, 20 bp, Homo sapiens
ggcagggaagaggggtgcag

SEQ ID NO: 787757 - DNA, 23 bp, Homo sapiens
ggcagggaaggggaggcagccgg

SEQ ID NO: 787758 - DNA, 16 bp, Homo sapiens
ggcagggaatgcctgg

SEQ ID NO: 787759 - DNA, 23 bp, Homo sapiens
ggcagggaatgcctggagggtaa

SEQ ID NO: 787760 - DNA, 21 bp, Homo sapiens
ggcagggacttgcctccactc

SEQ ID NO: 787761 - DNA, 14 bp, Homo sapiens
ggcagggagagcgc

SEQ ID NO: 787762 - DNA, 13 bp, Homo sapiens
ggcagggagggga

SEQ ID NO: 787763 - DNA, 15 bp, Homo sapiens
ggcagggaggggctg

SEQ ID NO: 787764 - DNA, 16 bp, Homo sapiens
ggcagggaggggctgg

SEQ ID NO: 787765 - DNA, 22 bp, Homo sapiens
ggcagggaggggctggggcagg

SEQ ID NO: 787766 - DNA, 13 bp, Homo sapiens
ggcagggcagagg

SEQ ID NO: 787767 - DNA, 19 bp, Homo sapiens
ggcagggccacctgcagga

SEQ ID NO: 787768 - DNA, 22 bp, Homo sapiens
ggcagggccacctgcaggaccc

SEQ ID NO: 787769 - DNA, 11 bp, Homo sapiens
ggcagggccag

SEQ ID NO: 787770 - DNA, 12 bp, Homo sapiens
ggcagggccagg

SEQ ID NO: 787771 - DNA, 16 bp, Homo sapiens
ggcagggccagggcaa

SEQ ID NO: 787772 - DNA, 18 bp, Homo sapiens
ggcagggccagggcaatg

SEQ ID NO: 787773 - DNA, 16 bp, Homo sapiens
ggcagggccccaggca

SEQ ID NO: 787774 - DNA, 15 bp, Homo sapiens
ggcagggcctcatct

SEQ ID NO: 787775 - DNA, 16 bp, Homo sapiens
ggcagggccttgccca

SEQ ID NO: 787776 - DNA, 19 bp, Homo sapiens
ggcagggccttgcccagag

SEQ ID NO: 787777 - DNA, 20 bp, Homo sapiens
ggcagggccttgcccagaga

SEQ ID NO: 787778 - DNA, 14 bp, Homo sapiens
ggcagggctcacac

SEQ ID NO: 787779 - DNA, 16 bp, Homo sapiens
ggcagggctcacactc

SEQ ID NO: 787780 - DNA, 15 bp, Homo sapiens
ggcagggctctcccg

SEQ ID NO: 787781 - DNA, 14 bp, Homo sapiens
ggcagggctctgat

SEQ ID NO: 787782 - DNA, 17 bp, Homo sapiens
ggcagggctgcagaggg

SEQ ID NO: 787783 - DNA, 21 bp, Homo sapiens
ggcaggggaattttctctcca

SEQ ID NO: 787784 - DNA, 20 bp, Homo sapiens
ggcaggggacaagggaggca

SEQ ID NO: 787785 - DNA, 14 bp, Homo sapiens
ggcaggggacagga

SEQ ID NO: 787786 - DNA, 23 bp, Homo sapiens
ggcaggggagacaggagcctagc

SEQ ID NO: 787787 - DNA, 14 bp, Homo sapiens
ggcaggggagccag

SEQ ID NO: 787788 - DNA, 17 bp, Homo sapiens
ggcaggggcctgggccg

SEQ ID NO: 787789 - DNA, 15 bp, Homo sapiens
ggcaggggccttgtc

SEQ ID NO: 787790 - DNA, 12 bp, Homo sapiens
ggcaggggcgga

SEQ ID NO: 787791 - DNA, 17 bp, Homo sapiens
ggcaggggctgctgcct

SEQ ID NO: 787792 - DNA, 13 bp, Homo sapiens
ggcagggggccct

SEQ ID NO: 787793 - DNA, 15 bp, Homo sapiens
ggcagggggccctgc

SEQ ID NO: 787794 - DNA, 15 bp, Homo sapiens
ggcaggggtgagagc

SEQ ID NO: 787795 - DNA, 22 bp, Homo sapiens
ggcaggggtgagagcacccact

SEQ ID NO: 787796 - DNA, 14 bp, Homo sapiens
ggcaggggtggggg

SEQ ID NO: 787797 - DNA, 17 bp, Homo sapiens
ggcagggtcaggagagg

SEQ ID NO: 787798 - DNA, 15 bp, Homo sapiens
ggcagggtctgggct

SEQ ID NO: 787799 - DNA, 23 bp, Homo sapiens
ggcagggtgggatggaggagaag

SEQ ID NO: 787800 - DNA, 20 bp, Homo sapiens
ggcagggtggggagggagcc

SEQ ID NO: 787801 - DNA, 17 bp, Homo sapiens
ggcaggtaaactcctgt

SEQ ID NO: 787802 - DNA, 24 bp, Homo sapiens
ggcaggtagatcgcttgagcccag

SEQ ID NO: 787803 - DNA, 17 bp, Homo sapiens
ggcaggtcacagaaagg

SEQ ID NO: 787804 - DNA, 16 bp, Homo sapiens
ggcaggtcactgtcac

SEQ ID NO: 787805 - DNA, 17 bp, Homo sapiens
ggcaggtcactgtcact

SEQ ID NO: 787806 - DNA, 19 bp, Homo sapiens
ggcaggtcctgcccatgtg

SEQ ID NO: 787807 - DNA, 22 bp, Homo sapiens
ggcaggtctgcaagggcccaga

SEQ ID NO: 787808 - DNA, 16 bp, Homo sapiens
ggcaggtgaccttctg

SEQ ID NO: 787809 - DNA, 18 bp, Homo sapiens
ggcaggtgcctccaggtg

SEQ ID NO: 787810 - DNA, 20 bp, Homo sapiens
ggcaggtggccgcccctgag

SEQ ID NO: 787811 - DNA, 15 bp, Homo sapiens
ggcaggtgggagctg

SEQ ID NO: 787812 - DNA, 16 bp, Homo sapiens
ggcaggtgggagctga

SEQ ID NO: 787813 - DNA, 18 bp, Homo sapiens
ggcaggtgggctgcctgc

SEQ ID NO: 787814 - DNA, 19 bp, Homo sapiens
ggcaggtgggggtgggctg

SEQ ID NO: 787815 - DNA, 14 bp, Homo sapiens
ggcaggtggtggca

SEQ ID NO: 787816 - DNA, 16 bp, Homo sapiens
ggcaggttggatggga

SEQ ID NO: 787817 - DNA, 20 bp, Homo sapiens
ggcaggttggatgggagtgg

SEQ ID NO: 787818 - DNA, 15 bp, Homo sapiens
ggcaggttggtgggg

SEQ ID NO: 787819 - DNA, 19 bp, Homo sapiens
ggcagtcaccacccagccc

SEQ ID NO: 787820 - DNA, 11 bp, Homo sapiens
ggcagtccaga

SEQ ID NO: 787821 - DNA, 11 bp, Homo sapiens
ggcagtccctt

SEQ ID NO: 787822 - DNA, 16 bp, Homo sapiens
ggcagtccgtgggacg

SEQ ID NO: 787823 - DNA, 17 bp, Homo sapiens
ggcagtccttactcccc

SEQ ID NO: 787824 - DNA, 14 bp, Homo sapiens
ggcagtcgggggct

SEQ ID NO: 787825 - DNA, 15 bp, Homo sapiens
ggcagtctgaaccct

SEQ ID NO: 787826 - DNA, 21 bp, Homo sapiens
ggcagtctgaacccttgtgct

SEQ ID NO: 787827 - DNA, 17 bp, Homo sapiens
ggcagtctgctctgctg

SEQ ID NO: 787828 - DNA, 13 bp, Homo sapiens
ggcagtcttgcaa

SEQ ID NO: 787829 - DNA, 23 bp, Homo sapiens
ggcagtgactcgacaaaggccac

SEQ ID NO: 787830 - DNA, 14 bp, Homo sapiens
ggcagtgactggca

SEQ ID NO: 787831 - DNA, 15 bp, Homo sapiens
ggcagtgactggcag

SEQ ID NO: 787832 - DNA, 19 bp, Homo sapiens
ggcagtgagtgccatgctt

SEQ ID NO: 787833 - DNA, 17 bp, Homo sapiens
ggcagtgattctgtttg

SEQ ID NO: 787834 - DNA, 17 bp, Homo sapiens
ggcagtgcaatgcttgt

SEQ ID NO: 787835 - DNA, 12 bp, Homo sapiens
ggcagtgcatgc

SEQ ID NO: 787836 - DNA, 13 bp, Homo sapiens
ggcagtgcatgca

SEQ ID NO: 787837 - DNA, 14 bp, Homo sapiens
ggcagtgccacagc

SEQ ID NO: 787838 - DNA, 17 bp, Homo sapiens
ggcagtgccacagcctg

SEQ ID NO: 787839 - DNA, 21 bp, Homo sapiens
ggcagtgccacagcctgctgg

SEQ ID NO: 787840 - DNA, 19 bp, Homo sapiens
ggcagtgcccatgtgtaca

SEQ ID NO: 787841 - DNA, 16 bp, Homo sapiens
ggcagtgccccaggga

SEQ ID NO: 787842 - DNA, 21 bp, Homo sapiens
ggcagtgccccagggagtcca

SEQ ID NO: 787843 - DNA, 14 bp, Homo sapiens
ggcagtgccctttg

SEQ ID NO: 787844 - DNA, 17 bp, Homo sapiens
ggcagtgcctgctctgc

SEQ ID NO: 787845 - DNA, 22 bp, Homo sapiens
ggcagtgctgatccggctgctc

SEQ ID NO: 787846 - DNA, 23 bp, Homo sapiens
ggcagtgctgatccggctgctcc

SEQ ID NO: 787847 - DNA, 16 bp, Homo sapiens
ggcagtggccaagcct

SEQ ID NO: 787848 - DNA, 18 bp, Homo sapiens
ggcagtggccaagcctgc

SEQ ID NO: 787849 - DNA, 19 bp, Homo sapiens
ggcagtggccaagcctgct

SEQ ID NO: 787850 - DNA, 22 bp, Homo sapiens
ggcagtggccaagcctgctgtg

SEQ ID NO: 787851 - DNA, 23 bp, Homo sapiens
ggcagtggccaagcctgctgtgt

SEQ ID NO: 787852 - DNA, 12 bp, Homo sapiens
ggcagtggccac

SEQ ID NO: 787853 - DNA, 20 bp, Homo sapiens
ggcagtggtggttttctgtt

SEQ ID NO: 787854 - DNA, 15 bp, Homo sapiens
ggcagttaggtgctg

SEQ ID NO: 787855 - DNA, 15 bp, Homo sapiens
ggcagttctcccagg

SEQ ID NO: 787856 - DNA, 19 bp, Homo sapiens
ggcagttctcccagggagt

SEQ ID NO: 787857 - DNA, 14 bp, Homo sapiens
ggcagttggccaga

SEQ ID NO: 787858 - DNA, 18 bp, Homo sapiens
ggcagtttaaagcacaat

SEQ ID NO: 787859 - DNA, 16 bp, Homo sapiens
ggcagttttagcagca

SEQ ID NO: 787860 - DNA, 17 bp, Homo sapiens
ggcatacacacagcagt

SEQ ID NO: 787861 - DNA, 14 bp, Homo sapiens
ggcataggcctggg

SEQ ID NO: 787862 - DNA, 15 bp, Homo sapiens
ggcataggcctgggt

SEQ ID NO: 787863 - DNA, 20 bp, Homo sapiens
ggcataggtctctttgcttt

SEQ ID NO: 787864 - DNA, 23 bp, Homo sapiens
ggcatatcttctatatctgaaga

SEQ ID NO: 787865 - DNA, 17 bp, Homo sapiens
ggcatatgtttccccat

SEQ ID NO: 787866 - DNA, 17 bp, Homo sapiens
ggcatcacagggcagag

SEQ ID NO: 787867 - DNA, 23 bp, Homo sapiens
ggcatcacagggcagagccggga

SEQ ID NO: 787868 - DNA, 12 bp, Homo sapiens
ggcatcaggcac

SEQ ID NO: 787869 - DNA, 19 bp, Homo sapiens
ggcatcaggcactggtggc

SEQ ID NO: 787870 - DNA, 14 bp, Homo sapiens
ggcatcaggtctgg

SEQ ID NO: 787871 - DNA, 15 bp, Homo sapiens
ggcatccacccagtg

SEQ ID NO: 787872 - DNA, 16 bp, Homo sapiens
ggcatccacccagtgc

SEQ ID NO: 787873 - DNA, 17 bp, Homo sapiens
ggcatccacccagtgct

SEQ ID NO: 787874 - DNA, 14 bp, Homo sapiens
ggcatcccagcttg

SEQ ID NO: 787875 - DNA, 19 bp, Homo sapiens
ggcatcccagcttgccccc

SEQ ID NO: 787876 - DNA, 22 bp, Homo sapiens
ggcatccctttttcataaatta

SEQ ID NO: 787877 - DNA, 23 bp, Homo sapiens
ggcatccttgcctgtctaaagcc

SEQ ID NO: 787878 - DNA, 18 bp, Homo sapiens
ggcatcgcaccattctga

SEQ ID NO: 787879 - DNA, 21 bp, Homo sapiens
ggcatcgcaccattctgactc

SEQ ID NO: 787880 - DNA, 19 bp, Homo sapiens
ggcatcgcatccgtcctgg

SEQ ID NO: 787881 - DNA, 20 bp, Homo sapiens
ggcatcgcatccgtcctggg

SEQ ID NO: 787882 - DNA, 21 bp, Homo sapiens
ggcatcgcatccgtcctgggc

SEQ ID NO: 787883 - DNA, 22 bp, Homo sapiens
ggcatcgcatccgtcctgggcg

SEQ ID NO: 787884 - DNA, 18 bp, Homo sapiens
ggcatcggcagctgaacc

SEQ ID NO: 787885 - DNA, 14 bp, Homo sapiens
ggcatctcctgtgc

SEQ ID NO: 787886 - DNA, 14 bp, Homo sapiens
ggcatctctgtccc

SEQ ID NO: 787887 - DNA, 15 bp, Homo sapiens
ggcatctctgtccca

SEQ ID NO: 787888 - DNA, 21 bp, Homo sapiens
ggcatctctgtcccattccct

SEQ ID NO: 787889 - DNA, 14 bp, Homo sapiens
ggcatctcttcccc

SEQ ID NO: 787890 - DNA, 18 bp, Homo sapiens
ggcatctcttccccagag

SEQ ID NO: 787891 - DNA, 20 bp, Homo sapiens
ggcatctcttccccagagag

SEQ ID NO: 787892 - DNA, 16 bp, Homo sapiens
ggcatctgacacaaaa

SEQ ID NO: 787893 - DNA, 17 bp, Homo sapiens
ggcatctgacacaaaaa

SEQ ID NO: 787894 - DNA, 22 bp, Homo sapiens
ggcatctgcaccctcgatgaag

SEQ ID NO: 787895 - DNA, 18 bp, Homo sapiens
ggcatctgcccctccccc

SEQ ID NO: 787896 - DNA, 20 bp, Homo sapiens
ggcatctgtctgtctgtggg

SEQ ID NO: 787897 - DNA, 17 bp, Homo sapiens
ggcatcttgctggctac

SEQ ID NO: 787898 - DNA, 22 bp, Homo sapiens
ggcatctttgccttgggctgct

SEQ ID NO: 787899 - DNA, 11 bp, Homo sapiens
ggcatcttttg

SEQ ID NO: 787900 - DNA, 14 bp, Homo sapiens
ggcatcttttggag

SEQ ID NO: 787901 - DNA, 14 bp, Homo sapiens
ggcatcttttgtat

SEQ ID NO: 787902 - DNA, 16 bp, Homo sapiens
ggcatcttttgtatta

SEQ ID NO: 787903 - DNA, 19 bp, Homo sapiens
ggcatgaaccctcttgcca

SEQ ID NO: 787904 - DNA, 18 bp, Homo sapiens
ggcatgaatcgggctaag

SEQ ID NO: 787905 - DNA, 21 bp, Homo sapiens
ggcatgacactctagtgactt

SEQ ID NO: 787906 - DNA, 14 bp, Homo sapiens
ggcatgagccactg

SEQ ID NO: 787907 - DNA, 14 bp, Homo sapiens
ggcatgagggatca

SEQ ID NO: 787908 - DNA, 19 bp, Homo sapiens
ggcatgagggatcacaggg

SEQ ID NO: 787909 - DNA, 20 bp, Homo sapiens
ggcatgatcatagctcactg

SEQ ID NO: 787910 - DNA, 12 bp, Homo sapiens
ggcatgatttat

SEQ ID NO: 787911 - DNA, 21 bp, Homo sapiens
ggcatgatttatatatggcat

SEQ ID NO: 787912 - DNA, 17 bp, Homo sapiens
ggcatgcacacggctgg

SEQ ID NO: 787913 - DNA, 18 bp, Homo sapiens
ggcatgcagctgcctggg

SEQ ID NO: 787914 - DNA, 16 bp, Homo sapiens
ggcatgccaccctcac

SEQ ID NO: 787915 - DNA, 17 bp, Homo sapiens
ggcatgccaccctcaca

SEQ ID NO: 787916 - DNA, 13 bp, Homo sapiens
ggcatgccaggac

SEQ ID NO: 787917 - DNA, 23 bp, Homo sapiens
ggcatgccaggacccgccagccc

SEQ ID NO: 787918 - DNA, 16 bp, Homo sapiens
ggcatgcctgtgtgac

SEQ ID NO: 787919 - DNA, 12 bp, Homo sapiens
ggcatgctgaat

SEQ ID NO: 787920 - DNA, 13 bp, Homo sapiens
ggcatgctggggc

SEQ ID NO: 787921 - DNA, 14 bp, Homo sapiens
ggcatggacttctg

SEQ ID NO: 787922 - DNA, 22 bp, Homo sapiens
ggcatggattaatagagttgga

SEQ ID NO: 787923 - DNA, 23 bp, Homo sapiens
ggcatggcaaatcaggggccaga

SEQ ID NO: 787924 - DNA, 20 bp, Homo sapiens
ggcatggcaattctggaagc

SEQ ID NO: 787925 - DNA, 17 bp, Homo sapiens
ggcatggctcagagctt

SEQ ID NO: 787926 - DNA, 12 bp, Homo sapiens
ggcatgggcctc

SEQ ID NO: 787927 - DNA, 17 bp, Homo sapiens
ggcatgggcctctctgg

SEQ ID NO: 787928 - DNA, 18 bp, Homo sapiens
ggcatgggcgcaggccca

SEQ ID NO: 787929 - DNA, 16 bp, Homo sapiens
ggcatggggcatgtcc

SEQ ID NO: 787930 - DNA, 23 bp, Homo sapiens
ggcatgggtccagggcctgacac

SEQ ID NO: 787931 - DNA, 19 bp, Homo sapiens
ggcatgggttggcagggtg

SEQ ID NO: 787932 - DNA, 19 bp, Homo sapiens
ggcatggtacggagatgtt

SEQ ID NO: 787933 - DNA, 19 bp, Homo sapiens
ggcatggtggcgcaagcct

SEQ ID NO: 787934 - DNA, 21 bp, Homo sapiens
ggcatggtggcgcaagcctgt

SEQ ID NO: 787935 - DNA, 19 bp, Homo sapiens
ggcatgtattatcacatca

SEQ ID NO: 787936 - DNA, 20 bp, Homo sapiens
ggcatgtattatcacatcaa

SEQ ID NO: 787937 - DNA, 16 bp, Homo sapiens
ggcatgtcccacccac

SEQ ID NO: 787938 - DNA, 23 bp, Homo sapiens
ggcatgtcctttccatctgtcca

SEQ ID NO: 787939 - DNA, 21 bp, Homo sapiens
ggccccgggctctggccaccc

SEQ ID NO: 787940 - DNA, 13 bp, Homo sapiens
ggccccggggctg

SEQ ID NO: 787941 - DNA, 13 bp, Homo sapiens
ggcccctcacatc

SEQ ID NO: 787942 - DNA, 17 bp, Homo sapiens
ggcccctcacatcctct

SEQ ID NO: 787943 - DNA, 20 bp, Homo sapiens
ggcccctcacatcctctcca

SEQ ID NO: 787944 - DNA, 19 bp, Homo sapiens
ggcccctcaccctctgtcc

SEQ ID NO: 787945 - DNA, 21 bp, Homo sapiens
ggcccctcaccctctgtcccc

SEQ ID NO: 787946 - DNA, 22 bp, Homo sapiens
ggcccctcaccctgccttatct

SEQ ID NO: 787947 - DNA, 19 bp, Homo sapiens
ggcccctcacctgggcctt

SEQ ID NO: 787948 - DNA, 21 bp, Homo sapiens
ggcccctcagagccctgccct

SEQ ID NO: 787949 - DNA, 13 bp, Homo sapiens
ggcccctccacgc

SEQ ID NO: 787950 - DNA, 23 bp, Homo sapiens
ggcccctccacgcctcctggcca

SEQ ID NO: 787951 - DNA, 16 bp, Homo sapiens
ggcccctccccctgag

SEQ ID NO: 787952 - DNA, 19 bp, Homo sapiens
ggcccctcccctcagagcc

SEQ ID NO: 787953 - DNA, 14 bp, Homo sapiens
ggcccctccttgca

SEQ ID NO: 787954 - DNA, 15 bp, Homo sapiens
ggcccctctgcccag

SEQ ID NO: 787955 - DNA, 16 bp, Homo sapiens
ggcccctctgtggagc

SEQ ID NO: 787956 - DNA, 18 bp, Homo sapiens
ggcccctgagcccagaga

SEQ ID NO: 787957 - DNA, 13 bp, Homo sapiens
ggcccctgaggac

SEQ ID NO: 787958 - DNA, 19 bp, Homo sapiens
ggcccctgaggactggaga

SEQ ID NO: 787959 - DNA, 18 bp, Homo sapiens
ggcccctgctgtctctct

SEQ ID NO: 787960 - DNA, 19 bp, Homo sapiens
ggcccctgctgtctctctg

SEQ ID NO: 787961 - DNA, 21 bp, Homo sapiens
ggcccctggcagcacagccca

SEQ ID NO: 787962 - DNA, 13 bp, Homo sapiens
ggcccctggcccc

SEQ ID NO: 787963 - DNA, 22 bp, Homo sapiens
ggcccctgggcttggcctgctg

SEQ ID NO: 787964 - DNA, 20 bp, Homo sapiens
ggcccctggggacagagcca

SEQ ID NO: 787965 - DNA, 23 bp, Homo sapiens
ggcccctggggacagagccaccc

SEQ ID NO: 787966 - DNA, 19 bp, Homo sapiens
ggcccctgtccccagtccc

SEQ ID NO: 787967 - DNA, 18 bp, Homo sapiens
ggcccctgtggggaacag

SEQ ID NO: 787968 - DNA, 21 bp, Homo sapiens
ggccccttcacttctgaccac

SEQ ID NO: 787969 - DNA, 15 bp, Homo sapiens
ggccccttcccagcc

SEQ ID NO: 787970 - DNA, 18 bp, Homo sapiens
ggcccgacaggtgggcct

SEQ ID NO: 787971 - DNA, 18 bp, Homo sapiens
ggcccgcagcctggcatc

SEQ ID NO: 787972 - DNA, 21 bp, Homo sapiens
ggcccgcagcctggcatctgt

SEQ ID NO: 787973 - DNA, 19 bp, Homo sapiens
ggcccgccctcacctctga

SEQ ID NO: 787974 - DNA, 12 bp, Homo sapiens
ggcccgcctgcc

SEQ ID NO: 787975 - DNA, 17 bp, Homo sapiens
ggcccgctgcagcctct

SEQ ID NO: 787976 - DNA, 12 bp, Homo sapiens
ggcccgctgcct

SEQ ID NO: 787977 - DNA, 16 bp, Homo sapiens
ggcccgctgcctcttg

SEQ ID NO: 787978 - DNA, 22 bp, Homo sapiens
ggcccgctgcgtgccatcactc

SEQ ID NO: 787979 - DNA, 14 bp, Homo sapiens
ggcccggagcagca

SEQ ID NO: 787980 - DNA, 17 bp, Homo sapiens
ggcccggagcagcagga

SEQ ID NO: 787981 - DNA, 21 bp, Homo sapiens
ggcccggagtaatcaggcagc

SEQ ID NO: 787982 - DNA, 15 bp, Homo sapiens
ggcccggccacaccc

SEQ ID NO: 787983 - DNA, 13 bp, Homo sapiens
ggcccggcccctc

SEQ ID NO: 787984 - DNA, 14 bp, Homo sapiens
ggcccggcccctca

SEQ ID NO: 787985 - DNA, 15 bp, Homo sapiens
ggcccgggcaggcca

SEQ ID NO: 787986 - DNA, 12 bp, Homo sapiens
ggcccgggcccc

SEQ ID NO: 787987 - DNA, 15 bp, Homo sapiens
ggcccgggccgaccc

SEQ ID NO: 787988 - DNA, 22 bp, Homo sapiens
ggcccgggccgaccctgcggcc

SEQ ID NO: 787989 - DNA, 17 bp, Homo sapiens
ggcccgtggacacccca

SEQ ID NO: 787990 - DNA, 18 bp, Homo sapiens
ggccctacaatgctcatg

SEQ ID NO: 787991 - DNA, 15 bp, Homo sapiens
ggccctagctttacg

SEQ ID NO: 787992 - DNA, 12 bp, Homo sapiens
ggccctcagcat

SEQ ID NO: 787993 - DNA, 11 bp, Homo sapiens
ggccctcaggc

SEQ ID NO: 787994 - DNA, 21 bp, Homo sapiens
ggccctcatctatgaggaaag

SEQ ID NO: 787995 - DNA, 22 bp, Homo sapiens
ggccctccagtgggctgatgct

SEQ ID NO: 787996 - DNA, 12 bp, Homo sapiens
ggccctcccagc

SEQ ID NO: 787997 - DNA, 13 bp, Homo sapiens
ggccctccccaca

SEQ ID NO: 787998 - DNA, 14 bp, Homo sapiens
ggcccagcatgcag

SEQ ID NO: 787999 - DNA, 15 bp, Homo sapiens
ggcccagcattgctg

SEQ ID NO: 788000 - DNA, 20 bp, Homo sapiens
ggcccagcattgctggttct

SEQ ID NO: 788001 - DNA, 16 bp, Homo sapiens
ggcccagcccagagcc

SEQ ID NO: 788002 - DNA, 14 bp, Homo sapiens
ggcccagcccctag

SEQ ID NO: 788003 - DNA, 13 bp, Homo sapiens
ggcccagcccctc

SEQ ID NO: 788004 - DNA, 13 bp, Homo sapiens
ggcccagccctcc

SEQ ID NO: 788005 - DNA, 12 bp, Homo sapiens
ggcccagccggc

SEQ ID NO: 788006 - DNA, 16 bp, Homo sapiens
ggcccagccggcctct

SEQ ID NO: 788007 - DNA, 17 bp, Homo sapiens
ggcccagccggcctctc

SEQ ID NO: 788008 - DNA, 19 bp, Homo sapiens
ggcccagccggcctctctg

SEQ ID NO: 788009 - DNA, 16 bp, Homo sapiens
ggcccagcctgtcctg

SEQ ID NO: 788010 - DNA, 23 bp, Homo sapiens
ggcccagcggcccctcccacaca

SEQ ID NO: 788011 - DNA, 16 bp, Homo sapiens
ggcccagcggtccctg

SEQ ID NO: 788012 - DNA, 18 bp, Homo sapiens
ggcccagctgctcccctg

SEQ ID NO: 788013 - DNA, 15 bp, Homo sapiens
ggcccagctgggctc

SEQ ID NO: 788014 - DNA, 17 bp, Homo sapiens
ggcccagctgggctctg

SEQ ID NO: 788015 - DNA, 18 bp, Homo sapiens
ggcccagctgtagccatg

SEQ ID NO: 788016 - DNA, 20 bp, Homo sapiens
ggcccagctgtagccatggc

SEQ ID NO: 788017 - DNA, 21 bp, Homo sapiens
ggcccagctgtagccatggct

SEQ ID NO: 788018 - DNA, 15 bp, Homo sapiens
ggcccaggaccagct

SEQ ID NO: 788019 - DNA, 16 bp, Homo sapiens
ggcccaggaccagctg

SEQ ID NO: 788020 - DNA, 14 bp, Homo sapiens
ggcccaggagctct

SEQ ID NO: 788021 - DNA, 14 bp, Homo sapiens
ggcccaggaggacc

SEQ ID NO: 788022 - DNA, 19 bp, Homo sapiens
ggcccaggcaccaccagga

SEQ ID NO: 788023 - DNA, 20 bp, Homo sapiens
ggcccaggcaccaccaggag

SEQ ID NO: 788024 - DNA, 23 bp, Homo sapiens
ggcccaggcaccaccaggagcag

SEQ ID NO: 788025 - DNA, 13 bp, Homo sapiens
ggcccaggcaggt

SEQ ID NO: 788026 - DNA, 10 bp, Homo sapiens
ggcccaggcc

SEQ ID NO: 788027 - DNA, 13 bp, Homo sapiens
ggcccaggccagc

SEQ ID NO: 788028 - DNA, 16 bp, Homo sapiens
ggcccaggccagcccc

SEQ ID NO: 788029 - DNA, 16 bp, Homo sapiens
ggcccaggccttgctg

SEQ ID NO: 788030 - DNA, 15 bp, Homo sapiens
ggcccagggaggcag

SEQ ID NO: 788031 - DNA, 18 bp, Homo sapiens
ggcccagggaggcagcgt

SEQ ID NO: 788032 - DNA, 19 bp, Homo sapiens
ggcccaggtaacatgttta

SEQ ID NO: 788033 - DNA, 16 bp, Homo sapiens
ggcccagtgccactgc

SEQ ID NO: 788034 - DNA, 18 bp, Homo sapiens
ggcccagtgccagctcca

SEQ ID NO: 788035 - DNA, 21 bp, Homo sapiens
ggcccataatagttagccctc

SEQ ID NO: 788036 - DNA, 23 bp, Homo sapiens
ggcccataatagttagccctcag

SEQ ID NO: 788037 - DNA, 20 bp, Homo sapiens
ggcccatagccttggggttg

SEQ ID NO: 788038 - DNA, 13 bp, Homo sapiens
ggcccatctcagc

SEQ ID NO: 788039 - DNA, 15 bp, Homo sapiens
ggcccatctcagcct

SEQ ID NO: 788040 - DNA, 18 bp, Homo sapiens
ggcccatctcagcctcct

SEQ ID NO: 788041 - DNA, 21 bp, Homo sapiens
ggcccatctcaggtgccactc

SEQ ID NO: 788042 - DNA, 14 bp, Homo sapiens
ggcccatctccctg

SEQ ID NO: 788043 - DNA, 18 bp, Homo sapiens
ggcccatctccctgcttt

SEQ ID NO: 788044 - DNA, 18 bp, Homo sapiens
ggcccatgcccccttcgc

SEQ ID NO: 788045 - DNA, 17 bp, Homo sapiens
ggcccatggccttgggc

SEQ ID NO: 788046 - DNA, 20 bp, Homo sapiens
ggcccatggccttgggctct

SEQ ID NO: 788047 - DNA, 16 bp, Homo sapiens
ggccccaaaaccacag

SEQ ID NO: 788048 - DNA, 21 bp, Homo sapiens
ggccccaaaaccacagccctg

SEQ ID NO: 788049 - DNA, 20 bp, Homo sapiens
ggccccaacaagcaccccgc

SEQ ID NO: 788050 - DNA, 20 bp, Homo sapiens
ggccccaatcttgcccactg

SEQ ID NO: 788051 - DNA, 22 bp, Homo sapiens
ggccccacaggagttgtgagcc

SEQ ID NO: 788052 - DNA, 19 bp, Homo sapiens
ggccccacccaccctctgg

SEQ ID NO: 788053 - DNA, 22 bp, Homo sapiens
ggccttttgacggccttcttgg

SEQ ID NO: 788054 - DNA, 22 bp, Homo sapiens
ggccttttgctacgtgcctccc

SEQ ID NO: 788055 - DNA, 12 bp, Homo sapiens
ggccttttggat

SEQ ID NO: 788056 - DNA, 13 bp, Homo sapiens
ggcgaatctcaaa

SEQ ID NO: 788057 - DNA, 17 bp, Homo sapiens
ggcgaatctcaaaatta

SEQ ID NO: 788058 - DNA, 22 bp, Homo sapiens
ggcgacactcagggcagctgcc

SEQ ID NO: 788059 - DNA, 18 bp, Homo sapiens
ggcgacagttttccttct

SEQ ID NO: 788060 - DNA, 18 bp, Homo sapiens
ggcgagcctgactctgtt

SEQ ID NO: 788061 - DNA, 19 bp, Homo sapiens
ggcgagcctgactctgttg

SEQ ID NO: 788062 - DNA, 17 bp, Homo sapiens
ggcgagctttctctccg

SEQ ID NO: 788063 - DNA, 20 bp, Homo sapiens
ggcgaggccggagagctggt

SEQ ID NO: 788064 - DNA, 15 bp, Homo sapiens
ggcgagtgccaggac

SEQ ID NO: 788065 - DNA, 22 bp, Homo sapiens
ggcgagtggtttcggaaaaaaa

SEQ ID NO: 788066 - DNA, 19 bp, Homo sapiens
ggcgataaaactaaatata

SEQ ID NO: 788067 - DNA, 17 bp, Homo sapiens
ggcgatccacctgtctc

SEQ ID NO: 788068 - DNA, 20 bp, Homo sapiens
ggcgatccccgcttcccctt

SEQ ID NO: 788069 - DNA, 21 bp, Homo sapiens
ggcgatcgcggcggagctggc

SEQ ID NO: 788070 - DNA, 14 bp, Homo sapiens
ggcgatgccacgct

SEQ ID NO: 788071 - DNA, 17 bp, Homo sapiens
ggcgcaaaggtgcctca

SEQ ID NO: 788072 - DNA, 13 bp, Homo sapiens
ggcgcagagggaa

SEQ ID NO: 788073 - DNA, 16 bp, Homo sapiens
ggcgcaggtgggctgg

SEQ ID NO: 788074 - DNA, 20 bp, Homo sapiens
ggcgcatgagtatctgtggg

SEQ ID NO: 788075 - DNA, 21 bp, Homo sapiens
ggcgcatgagtatctgtggga

SEQ ID NO: 788076 - DNA, 13 bp, Homo sapiens
ggcgcatgtctgc

SEQ ID NO: 788077 - DNA, 15 bp, Homo sapiens
ggcgcatgtctgcac

SEQ ID NO: 788078 - DNA, 21 bp, Homo sapiens
ggcgcatgtctgcacctccgc

SEQ ID NO: 788079 - DNA, 13 bp, Homo sapiens
ggcgccaccacca

SEQ ID NO: 788080 - DNA, 16 bp, Homo sapiens
ggcgccaccagctctg

SEQ ID NO: 788081 - DNA, 17 bp, Homo sapiens
ggcgccaccagctctgc

SEQ ID NO: 788082 - DNA, 12 bp, Homo sapiens
ggcgccaggaca

SEQ ID NO: 788083 - DNA, 16 bp, Homo sapiens
ggcgccaggacagcag

SEQ ID NO: 788084 - DNA, 21 bp, Homo sapiens
ggcgccaggacagcagcactc

SEQ ID NO: 788085 - DNA, 12 bp, Homo sapiens
ggcgcccagggt

SEQ ID NO: 788086 - DNA, 18 bp, Homo sapiens
ggcgcccccccctcccca

SEQ ID NO: 788087 - DNA, 14 bp, Homo sapiens
ggcgcccccgcccc

SEQ ID NO: 788088 - DNA, 15 bp, Homo sapiens
ggcgcccctgccacc

SEQ ID NO: 788089 - DNA, 16 bp, Homo sapiens
ggcgccctctctgctc

SEQ ID NO: 788090 - DNA, 18 bp, Homo sapiens
ggcgcccttggcttctgt

SEQ ID NO: 788091 - DNA, 20 bp, Homo sapiens
ggcgccgcaaaccacactgg

SEQ ID NO: 788092 - DNA, 21 bp, Homo sapiens
ggcgccgtctccaggggctgc

SEQ ID NO: 788093 - DNA, 19 bp, Homo sapiens
ggcgccgtgctgggcagcc

SEQ ID NO: 788094 - DNA, 15 bp, Homo sapiens
ggcgcctgccctgcc

SEQ ID NO: 788095 - DNA, 18 bp, Homo sapiens
ggcgcctgccctgcccaa

SEQ ID NO: 788096 - DNA, 23 bp, Homo sapiens
ggcgcctgccctgcccaagtgac

SEQ ID NO: 788097 - DNA, 17 bp, Homo sapiens
ggcgcctggagggatgc

SEQ ID NO: 788098 - DNA, 22 bp, Homo sapiens
ggcgcctggagggatgccccca

SEQ ID NO: 788099 - DNA, 18 bp, Homo sapiens
ggcgcctgtagtcccagc

SEQ ID NO: 788100 - DNA, 17 bp, Homo sapiens
ggcgccttttcagccct

SEQ ID NO: 788101 - DNA, 23 bp, Homo sapiens
ggcgcgatctcggctcagcctcc

SEQ ID NO: 788102 - DNA, 16 bp, Homo sapiens
ggcgcgggaggcacca

SEQ ID NO: 788103 - DNA, 18 bp, Homo sapiens
ggcgcgggaggcaccagc

SEQ ID NO: 788104 - DNA, 15 bp, Homo sapiens
ggcgcgggcagccac

SEQ ID NO: 788105 - DNA, 14 bp, Homo sapiens
ggcgcgtctgcccc

SEQ ID NO: 788106 - DNA, 19 bp, Homo sapiens
ggcgctcaggacccaggcc

SEQ ID NO: 788107 - DNA, 15 bp, Homo sapiens
ggcgctcgctcaggt

SEQ ID NO: 788108 - DNA, 18 bp, Homo sapiens
ggcgctgccacctgcccc

SEQ ID NO: 788109 - DNA, 22 bp, Homo sapiens
ggcgtgtatctggtatatgtaa

SEQ ID NO: 788110 - DNA, 14 bp, Homo sapiens
ggcgtgtgaagaac

SEQ ID NO: 788111 - DNA, 21 bp, Homo sapiens
ggcgtttttctcgtccccctc

SEQ ID NO: 788112 - DNA, 22 bp, Homo sapiens
ggctaaaaaagctgaatcagac

SEQ ID NO: 788113 - DNA, 18 bp, Homo sapiens
ggctaaaggggagaaact

SEQ ID NO: 788114 - DNA, 12 bp, Homo sapiens
ggctaaatgaag

SEQ ID NO: 788115 - DNA, 19 bp, Homo sapiens
ggctaacctggacctggaa

SEQ ID NO: 788116 - DNA, 20 bp, Homo sapiens
ggctaacctggacctggaac

SEQ ID NO: 788117 - DNA, 17 bp, Homo sapiens
ggctaactatatttgct

SEQ ID NO: 788118 - DNA, 16 bp, Homo sapiens
ggctaactgatgaatt

SEQ ID NO: 788119 - DNA, 14 bp, Homo sapiens
ggctaactggaagc

SEQ ID NO: 788120 - DNA, 22 bp, Homo sapiens
ggctaacttattccgagaatgc

SEQ ID NO: 788121 - DNA, 15 bp, Homo sapiens
ggctaagatgagatt

SEQ ID NO: 788122 - DNA, 22 bp, Homo sapiens
ggctaagatgagatttgccagc

SEQ ID NO: 788123 - DNA, 16 bp, Homo sapiens
ggctaaggtccctggg

SEQ ID NO: 788124 - DNA, 16 bp, Homo sapiens
ggctaagtcaagatca

SEQ ID NO: 788125 - DNA, 22 bp, Homo sapiens
ggctaataaactgtattaaatc

SEQ ID NO: 788126 - DNA, 18 bp, Homo sapiens
ggctaattagaaatcaac

SEQ ID NO: 788127 - DNA, 19 bp, Homo sapiens
ggctaattcccagagtgtg

SEQ ID NO: 788128 - DNA, 13 bp, Homo sapiens
ggctaatttaaca

SEQ ID NO: 788129 - DNA, 13 bp, Homo sapiens
ggctaatttttgt

SEQ ID NO: 788130 - DNA, 19 bp, Homo sapiens
ggctaattttttatccttt

SEQ ID NO: 788131 - DNA, 19 bp, Homo sapiens
ggctacagtaaccaaaaca

SEQ ID NO: 788132 - DNA, 13 bp, Homo sapiens
ggctacatcccag

SEQ ID NO: 788133 - DNA, 22 bp, Homo sapiens
ggctacatcccagcctgtggtt

SEQ ID NO: 788134 - DNA, 20 bp, Homo sapiens
ggctacccctcgactcagca

SEQ ID NO: 788135 - DNA, 21 bp, Homo sapiens
ggctacccctcgactcagcac

SEQ ID NO: 788136 - DNA, 19 bp, Homo sapiens
ggctaccctgagctgaggc

SEQ ID NO: 788137 - DNA, 21 bp, Homo sapiens
ggctacgctgacaatcagtta

SEQ ID NO: 788138 - DNA, 21 bp, Homo sapiens
ggctactcagcagccctcctc

SEQ ID NO: 788139 - DNA, 19 bp, Homo sapiens
ggctactctcctcggcccc

SEQ ID NO: 788140 - DNA, 15 bp, Homo sapiens
ggctactgcagcttt

SEQ ID NO: 788141 - DNA, 18 bp, Homo sapiens
ggctactgcagctttaca

SEQ ID NO: 788142 - DNA, 21 bp, Homo sapiens
ggctactgccactgtgtgcct

SEQ ID NO: 788143 - DNA, 15 bp, Homo sapiens
ggctactggcagctc

SEQ ID NO: 788144 - DNA, 16 bp, Homo sapiens
ggctactggcagctcc

SEQ ID NO: 788145 - DNA, 23 bp, Homo sapiens
ggctactggcagctcctctcctt

SEQ ID NO: 788146 - DNA, 16 bp, Homo sapiens
ggctagaggccagccc

SEQ ID NO: 788147 - DNA, 14 bp, Homo sapiens
ggctagagtcctca

SEQ ID NO: 788148 - DNA, 18 bp, Homo sapiens
ggctagagtcctcactcc

SEQ ID NO: 788149 - DNA, 13 bp, Homo sapiens
ggctagccctgag

SEQ ID NO: 788150 - DNA, 14 bp, Homo sapiens
ggctagggggagcc

SEQ ID NO: 788151 - DNA, 17 bp, Homo sapiens
ggctagtcaagctcctc

SEQ ID NO: 788152 - DNA, 24 bp, Homo sapiens
ggctagtgtgagtggcagccatgc

SEQ ID NO: 788153 - DNA, 18 bp, Homo sapiens
ggctatagatgtcttttc

SEQ ID NO: 788154 - DNA, 19 bp, Homo sapiens
ggctatagatgtcttttcc

SEQ ID NO: 788155 - DNA, 20 bp, Homo sapiens
ggctatagctacaggaagca

SEQ ID NO: 788156 - DNA, 20 bp, Homo sapiens
ggctatctatacctgccttt

SEQ ID NO: 788157 - DNA, 21 bp, Homo sapiens
ggctatgaaaatgagccctgg

SEQ ID NO: 788158 - DNA, 14 bp, Homo sapiens
ggctatgcatttga

SEQ ID NO: 788159 - DNA, 21 bp, Homo sapiens
ggctatggatctgatttttaa

SEQ ID NO: 788160 - DNA, 19 bp, Homo sapiens
ggctatggttgccacccca

SEQ ID NO: 788161 - DNA, 18 bp, Homo sapiens
ggctattttctaaagact

SEQ ID NO: 788162 - DNA, 20 bp, Homo sapiens
ggctcaagaataaaatatga

SEQ ID NO: 788163 - DNA, 19 bp, Homo sapiens
ggctcaagcgattctcctg

SEQ ID NO: 788164 - DNA, 23 bp, Homo sapiens
ggctcaagctatccttgcacctc

SEQ ID NO: 788165 - DNA, 12 bp, Homo sapiens
ggctcacactcc

SEQ ID NO: 788166 - DNA, 19 bp, Homo sapiens
ggctcacagggcaggcctt

SEQ ID NO: 788167 - DNA, 14 bp, Homo sapiens
ggctcaccagctgg

SEQ ID NO: 788168 - DNA, 15 bp, Homo sapiens
ggctcaccagctggg

SEQ ID NO: 788169 - DNA, 17 bp, Homo sapiens
ggctcacccccttctcc

SEQ ID NO: 788170 - DNA, 12 bp, Homo sapiens
ggctcacgcctg

SEQ ID NO: 788171 - DNA, 19 bp, Homo sapiens
ggctcacggggcctccaac

SEQ ID NO: 788172 - DNA, 23 bp, Homo sapiens
ggctgggtcaaaagagccctggc

SEQ ID NO: 788173 - DNA, 18 bp, Homo sapiens
ggctgggtcagggccaga

SEQ ID NO: 788174 - DNA, 19 bp, Homo sapiens
ggctgggtggcaccagcag

SEQ ID NO: 788175 - DNA, 14 bp, Homo sapiens
ggctgggtggcccc

SEQ ID NO: 788176 - DNA, 17 bp, Homo sapiens
ggctgggtgggcccaga

SEQ ID NO: 788177 - DNA, 19 bp, Homo sapiens
ggctgggtgggcccagaac

SEQ ID NO: 788178 - DNA, 19 bp, Homo sapiens
ggctggtaacagttcatgt

SEQ ID NO: 788179 - DNA, 13 bp, Homo sapiens
ggctggtagcagc

SEQ ID NO: 788180 - DNA, 17 bp, Homo sapiens
ggctggtagcagcaggc

SEQ ID NO: 788181 - DNA, 18 bp, Homo sapiens
ggctggtagcagcaggct

SEQ ID NO: 788182 - DNA, 18 bp, Homo sapiens
ggctggtatctcagaaag

SEQ ID NO: 788183 - DNA, 15 bp, Homo sapiens
ggctggtcactctgc

SEQ ID NO: 788184 - DNA, 23 bp, Homo sapiens
ggctggtctcgaactcctggcct

SEQ ID NO: 788185 - DNA, 23 bp, Homo sapiens
ggctggtctgaaacccttgagct

SEQ ID NO: 788186 - DNA, 15 bp, Homo sapiens
ggctggtctgatgga

SEQ ID NO: 788187 - DNA, 21 bp, Homo sapiens
ggctggtctggagtcccaccc

SEQ ID NO: 788188 - DNA, 24 bp, Homo sapiens
ggctggtgacgttcagcctttgtc

SEQ ID NO: 788189 - DNA, 17 bp, Homo sapiens
ggctggtgagaccccgc

SEQ ID NO: 788190 - DNA, 21 bp, Homo sapiens
ggctggtgagaccccgcactg

SEQ ID NO: 788191 - DNA, 10 bp, Homo sapiens
ggctggtgcc

SEQ ID NO: 788192 - DNA, 15 bp, Homo sapiens
ggctggtgccagcct

SEQ ID NO: 788193 - DNA, 16 bp, Homo sapiens
ggctggtgccccacag

SEQ ID NO: 788194 - DNA, 21 bp, Homo sapiens
ggctggtgccccacagctacc

SEQ ID NO: 788195 - DNA, 13 bp, Homo sapiens
ggctggtggccca

SEQ ID NO: 788196 - DNA, 14 bp, Homo sapiens
ggctggtggccttg

SEQ ID NO: 788197 - DNA, 12 bp, Homo sapiens
ggctggtgtccc

SEQ ID NO: 788198 - DNA, 18 bp, Homo sapiens
ggctggtgtccccttccc

SEQ ID NO: 788199 - DNA, 21 bp, Homo sapiens
ggctggttttgtaagatgctg

SEQ ID NO: 788200 - DNA, 22 bp, Homo sapiens
ggctggttttgtaagatgctgg

SEQ ID NO: 788201 - DNA, 17 bp, Homo sapiens
ggctgtaacctgctgga

SEQ ID NO: 788202 - DNA, 17 bp, Homo sapiens
ggctgtacctgttcctc

SEQ ID NO: 788203 - DNA, 14 bp, Homo sapiens
ggctgtcatctgtg

SEQ ID NO: 788204 - DNA, 14 bp, Homo sapiens
ggctgtccagcctt

SEQ ID NO: 788205 - DNA, 21 bp, Homo sapiens
ggctgtccccctcctcccagg

SEQ ID NO: 788206 - DNA, 19 bp, Homo sapiens
ggctgtccctcatggagac

SEQ ID NO: 788207 - DNA, 18 bp, Homo sapiens
ggctgtcctccttcctgg

SEQ ID NO: 788208 - DNA, 12 bp, Homo sapiens
ggctgtctagaa

SEQ ID NO: 788209 - DNA, 14 bp, Homo sapiens
ggctgtctgaggct

SEQ ID NO: 788210 - DNA, 13 bp, Homo sapiens
ggctgtctgcctg

SEQ ID NO: 788211 - DNA, 14 bp, Homo sapiens
ggctgtctgtcacc

SEQ ID NO: 788212 - DNA, 19 bp, Homo sapiens
ggctgtctgtctgcagtgc

SEQ ID NO: 788213 - DNA, 21 bp, Homo sapiens
ggctgtctgtgccatggcccc

SEQ ID NO: 788214 - DNA, 20 bp, Homo sapiens
ggctgtgaagacccaggaga

SEQ ID NO: 788215 - DNA, 21 bp, Homo sapiens
ggctgtgactctgggcaggga

SEQ ID NO: 788216 - DNA, 14 bp, Homo sapiens
ggctgtgcccagca

SEQ ID NO: 788217 - DNA, 17 bp, Homo sapiens
ggctgtgcccagcaggc

SEQ ID NO: 788218 - DNA, 19 bp, Homo sapiens
ggctgtgcccagcaggccc

SEQ ID NO: 788219 - DNA, 20 bp, Homo sapiens
ggctgtgcccagcaggccca

SEQ ID NO: 788220 - DNA, 22 bp, Homo sapiens
ggctgtgcccagcaggcccagc

SEQ ID NO: 788221 - DNA, 14 bp, Homo sapiens
ggctgtgcccctga

SEQ ID NO: 788222 - DNA, 15 bp, Homo sapiens
ggctgtgcccctgat

SEQ ID NO: 788223 - DNA, 16 bp, Homo sapiens
ggctgtgcctctgcct

SEQ ID NO: 788224 - DNA, 21 bp, Homo sapiens
ggctgtgcctgcttctgtgta

SEQ ID NO: 788225 - DNA, 19 bp, Homo sapiens
ggctgtgcgctgacaacca

SEQ ID NO: 788226 - DNA, 13 bp, Homo sapiens
ggctgtgctcaga

SEQ ID NO: 788227 - DNA, 17 bp, Homo sapiens
ggctgtgcttgaaggcc

SEQ ID NO: 788228 - DNA, 20 bp, Homo sapiens
ggctgtgcttgaaggccctg

SEQ ID NO: 788229 - DNA, 23 bp, Homo sapiens
ggctgtgcttgaaggccctgctg

SEQ ID NO: 788230 - DNA, 21 bp, Homo sapiens
ggctgtggaggcctgatgctg

SEQ ID NO: 788231 - DNA, 17 bp, Homo sapiens
ggctgtggatagcccat

SEQ ID NO: 788232 - DNA, 20 bp, Homo sapiens
ggctgtggccctgcccttgg

SEQ ID NO: 788233 - DNA, 21 bp, Homo sapiens
ggctgtggccgtctcctccct

SEQ ID NO: 788234 - DNA, 14 bp, Homo sapiens
ggctgtgggcaagc

SEQ ID NO: 788235 - DNA, 22 bp, Homo sapiens
ggctgtgggcctcaaggacttg

SEQ ID NO: 788236 - DNA, 15 bp, Homo sapiens
ggctgtggggtctgg

SEQ ID NO: 788237 - DNA, 18 bp, Homo sapiens
ggctgtggggtgggctgg

SEQ ID NO: 788238 - DNA, 22 bp, Homo sapiens
ggctgtgtaagatttgttttta

SEQ ID NO: 788239 - DNA, 20 bp, Homo sapiens
ggctgtgtcctaaatgcaaa

SEQ ID NO: 788240 - DNA, 20 bp, Homo sapiens
ggctgtgtcctaaggcccat

SEQ ID NO: 788241 - DNA, 15 bp, Homo sapiens
ggctgtgtctaaact

SEQ ID NO: 788242 - DNA, 13 bp, Homo sapiens
ggctgtgtggcca

SEQ ID NO: 788243 - DNA, 17 bp, Homo sapiens
ggctgtgtggccaacca

SEQ ID NO: 788244 - DNA, 21 bp, Homo sapiens
ggctgtgtggccaaccaggac

SEQ ID NO: 788245 - DNA, 18 bp, Homo sapiens
ggctgttcatgctccaag

SEQ ID NO: 788246 - DNA, 20 bp, Homo sapiens
ggctgttctcgaactcctga

SEQ ID NO: 788247 - DNA, 18 bp, Homo sapiens
ggctgttctgtggttcct

SEQ ID NO: 788248 - DNA, 19 bp, Homo sapiens
ggctgttggaggaccccga

SEQ ID NO: 788249 - DNA, 23 bp, Homo sapiens
ggctgttggcactcacagacctg

SEQ ID NO: 788250 - DNA, 12 bp, Homo sapiens
ggctgtttactg

SEQ ID NO: 788251 - DNA, 21 bp, Homo sapiens
ggctgtttactgcttttcatt

SEQ ID NO: 788252 - DNA, 18 bp, Homo sapiens
ggctgtttcgtgtagtgg

SEQ ID NO: 788253 - DNA, 20 bp, Homo sapiens
ggctgtttcttgtctgttat

SEQ ID NO: 788254 - DNA, 14 bp, Homo sapiens
ggctgtttgaggat

SEQ ID NO: 788255 - DNA, 23 bp, Homo sapiens
ggcttaaacccatattgtaaaac

SEQ ID NO: 788256 - DNA, 22 bp, Homo sapiens
ggcttaaagtgaaggaaataaa

SEQ ID NO: 788257 - DNA, 21 bp, Homo sapiens
ggcttaagtgagcagaacagg

SEQ ID NO: 788258 - DNA, 17 bp, Homo sapiens
ggcttacacgtggagga

SEQ ID NO: 788259 - DNA, 22 bp, Homo sapiens
ggcttagacaccacctggagtg

SEQ ID NO: 788260 - DNA, 14 bp, Homo sapiens
ggcttagagagagg

SEQ ID NO: 788261 - DNA, 17 bp, Homo sapiens
ggcttagtatttctcag

SEQ ID NO: 788262 - DNA, 19 bp, Homo sapiens
ggcttataaacacattgaa

SEQ ID NO: 788263 - DNA, 14 bp, Homo sapiens
gggaaagagggagc

SEQ ID NO: 788264 - DNA, 18 bp, Homo sapiens
gggaaagcgggcagcccc

SEQ ID NO: 788265 - DNA, 15 bp, Homo sapiens
gggaaaggatatttt

SEQ ID NO: 788266 - DNA, 17 bp, Homo sapiens
gggaaaggatggagtgt

SEQ ID NO: 788267 - DNA, 19 bp, Homo sapiens
gggaaaggatggagtgttt

SEQ ID NO: 788268 - DNA, 16 bp, Homo sapiens
gggaaagggaggaaga

SEQ ID NO: 788269 - DNA, 20 bp, Homo sapiens
gggaaaggggttggggtgac

SEQ ID NO: 788270 - DNA, 17 bp, Homo sapiens
gggaaatactactcctg

SEQ ID NO: 788271 - DNA, 23 bp, Homo sapiens
gggaaatatatacaaaaagaaaa

SEQ ID NO: 788272 - DNA, 13 bp, Homo sapiens
gggaaatttttca

SEQ ID NO: 788273 - DNA, 22 bp, Homo sapiens
gggaacaaatcacacctctggg

SEQ ID NO: 788274 - DNA, 23 bp, Homo sapiens
gggaacaaatcacacctctgggc

SEQ ID NO: 788275 - DNA, 15 bp, Homo sapiens
gggaggggacagagg

SEQ ID NO: 788276 - DNA, 12 bp, Homo sapiens
gggaggggaggc

SEQ ID NO: 788277 - DNA, 14 bp, Homo sapiens
gggaggggcaggct

SEQ ID NO: 788278 - DNA, 16 bp, Homo sapiens
gggaggggccctcagg

SEQ ID NO: 788279 - DNA, 16 bp, Homo sapiens
gggaggggcctaggga

SEQ ID NO: 788280 - DNA, 16 bp, Homo sapiens
gggaggggcgctggcc

SEQ ID NO: 788281 - DNA, 17 bp, Homo sapiens
gggagggggaagcaaag

SEQ ID NO: 788282 - DNA, 13 bp, Homo sapiens
gggagggggaggg

SEQ ID NO: 788283 - DNA, 14 bp, Homo sapiens
gggaggggggaggg

SEQ ID NO: 788284 - DNA, 20 bp, Homo sapiens
gggagggggtacctcatgag

SEQ ID NO: 788285 - DNA, 21 bp, Homo sapiens
gggagggggtgagaggcagga

SEQ ID NO: 788286 - DNA, 21 bp, Homo sapiens
gggagggggttacaaactgca

SEQ ID NO: 788287 - DNA, 19 bp, Homo sapiens
gggagggtcttttaccctg

SEQ ID NO: 788288 - DNA, 23 bp, Homo sapiens
gggagggtcttttaccctgtgtc

SEQ ID NO: 788289 - DNA, 19 bp, Homo sapiens
gggagggtgacccacagct

SEQ ID NO: 788290 - DNA, 13 bp, Homo sapiens
gggaggtaggctg

SEQ ID NO: 788291 - DNA, 13 bp, Homo sapiens
gggaggtccaagc

SEQ ID NO: 788292 - DNA, 18 bp, Homo sapiens
gggaggtcgaggcaggag

SEQ ID NO: 788293 - DNA, 20 bp, Homo sapiens
gggaggtgctgggggagccc

SEQ ID NO: 788294 - DNA, 19 bp, Homo sapiens
gggaggttggttccttggg

SEQ ID NO: 788295 - DNA, 18 bp, Homo sapiens
gggagtaataggaccaga

SEQ ID NO: 788296 - DNA, 12 bp, Homo sapiens
gggagtcagagc

SEQ ID NO: 788297 - DNA, 21 bp, Homo sapiens
gggagtcagagccctggctgg

SEQ ID NO: 788298 - DNA, 16 bp, Homo sapiens
gggagtccaggcacag

SEQ ID NO: 788299 - DNA, 19 bp, Homo sapiens
gggagtccaggcacaggat

SEQ ID NO: 788300 - DNA, 20 bp, Homo sapiens
gggagtccagggtttctctg

SEQ ID NO: 788301 - DNA, 16 bp, Homo sapiens
gggagtcccctccccg

SEQ ID NO: 788302 - DNA, 20 bp, Homo sapiens
gggagtccctacctgcttca

SEQ ID NO: 788303 - DNA, 14 bp, Homo sapiens
gggagtccttacct

SEQ ID NO: 788304 - DNA, 20 bp, Homo sapiens
gggagtccttacctcgggga

SEQ ID NO: 788305 - DNA, 15 bp, Homo sapiens
gggagtctcaggagg

SEQ ID NO: 788306 - DNA, 19 bp, Homo sapiens
gggagtctcaggaggaggc

SEQ ID NO: 788307 - DNA, 21 bp, Homo sapiens
gggagtctcaggaggaggctg

SEQ ID NO: 788308 - DNA, 14 bp, Homo sapiens
gggagtctccctcc

SEQ ID NO: 788309 - DNA, 20 bp, Homo sapiens
gggagtctccctccgactcc

SEQ ID NO: 788310 - DNA, 15 bp, Homo sapiens
gggagtcttgggtgg

SEQ ID NO: 788311 - DNA, 20 bp, Homo sapiens
gggagtgaaacagagaaaga

SEQ ID NO: 788312 - DNA, 23 bp, Homo sapiens
gggagtgactcaagaagtgaaga

SEQ ID NO: 788313 - DNA, 17 bp, Homo sapiens
gggagtgagcagctact

SEQ ID NO: 788314 - DNA, 16 bp, Homo sapiens
gggagtgaggggctgt

SEQ ID NO: 788315 - DNA, 17 bp, Homo sapiens
gggagtgaggggctgtg

SEQ ID NO: 788316 - DNA, 23 bp, Homo sapiens
gggagtgaggggttacctccctc

SEQ ID NO: 788317 - DNA, 17 bp, Homo sapiens
gggagtggcacttctgc

SEQ ID NO: 788318 - DNA, 21 bp, Homo sapiens
gggagtggcacttctgccttg

SEQ ID NO: 788319 - DNA, 20 bp, Homo sapiens
gggagtgggacagagtctgg

SEQ ID NO: 788320 - DNA, 14 bp, Homo sapiens
gggagtgggcacct

SEQ ID NO: 788321 - DNA, 16 bp, Homo sapiens
gggcaagccagggccc

SEQ ID NO: 788322 - DNA, 23 bp, Homo sapiens
gggcaagccagggcccagagccc

SEQ ID NO: 788323 - DNA, 20 bp, Homo sapiens
gggcaagggttaaggcctga

SEQ ID NO: 788324 - DNA, 15 bp, Homo sapiens
gggcaagtagcagga

SEQ ID NO: 788325 - DNA, 19 bp, Homo sapiens
gggcaagtcgagagggctg

SEQ ID NO: 788326 - DNA, 17 bp, Homo sapiens
gggcaagtgagagggga

SEQ ID NO: 788327 - DNA, 19 bp, Homo sapiens
gggcaagtgagaggggagg

SEQ ID NO: 788328 - DNA, 19 bp, Homo sapiens
gggcaagtggatggcccag

SEQ ID NO: 788329 - DNA, 22 bp, Homo sapiens
gggcaagtggatggcccagcag

SEQ ID NO: 788330 - DNA, 17 bp, Homo sapiens
gggcaagtggatgggaa

SEQ ID NO: 788331 - DNA, 12 bp, Homo sapiens
gggcaatgccat

SEQ ID NO: 788332 - DNA, 16 bp, Homo sapiens
gggcaatgccatcagc

SEQ ID NO: 788333 - DNA, 21 bp, Homo sapiens
gggcaatgccatcagcccctg

SEQ ID NO: 788334 - DNA, 15 bp, Homo sapiens
gggcacaccactgcc

SEQ ID NO: 788335 - DNA, 19 bp, Homo sapiens
gggcacacgcctcccactg

SEQ ID NO: 788336 - DNA, 13 bp, Homo sapiens
gggcacagctgtc

SEQ ID NO: 788337 - DNA, 16 bp, Homo sapiens
gggcacagggtctcta

SEQ ID NO: 788338 - DNA, 18 bp, Homo sapiens
gggcacagtccagaccca

SEQ ID NO: 788339 - DNA, 16 bp, Homo sapiens
gggcacagtccaggaa

SEQ ID NO: 788340 - DNA, 17 bp, Homo sapiens
gggcacagtgctgcccc

SEQ ID NO: 788341 - DNA, 19 bp, Homo sapiens
gggcacagtggactcagca

SEQ ID NO: 788342 - DNA, 17 bp, Homo sapiens
gggcacagtggtgaccc

SEQ ID NO: 788343 - DNA, 19 bp, Homo sapiens
gggcacattaactccctcc

SEQ ID NO: 788344 - DNA, 20 bp, Homo sapiens
gggcacattaactccctcca

SEQ ID NO: 788345 - DNA, 17 bp, Homo sapiens
gggcaccacaaaatata

SEQ ID NO: 788346 - DNA, 18 bp, Homo sapiens
gggcaccaggggtttctc

SEQ ID NO: 788347 - DNA, 20 bp, Homo sapiens
gggcaccaggggtttctcgc

SEQ ID NO: 788348 - DNA, 19 bp, Homo sapiens
gggcacctatagtcccagc

SEQ ID NO: 788349 - DNA, 22 bp, Homo sapiens
gggcacctatgagatggccatg

SEQ ID NO: 788350 - DNA, 16 bp, Homo sapiens
gggcacggggacctgg

SEQ ID NO: 788351 - DNA, 23 bp, Homo sapiens
gggcactccgcgccgatgccacc

SEQ ID NO: 788352 - DNA, 19 bp, Homo sapiens
gggcactgctccaagggac

SEQ ID NO: 788353 - DNA, 14 bp, Homo sapiens
gggcactggcactg

SEQ ID NO: 788354 - DNA, 15 bp, Homo sapiens
gggcactggcccagg

SEQ ID NO: 788355 - DNA, 22 bp, Homo sapiens
gggcactgggcgtctgactccc

SEQ ID NO: 788356 - DNA, 19 bp, Homo sapiens
gggcacttaatttgtaaac

SEQ ID NO: 788357 - DNA, 15 bp, Homo sapiens
gggcacttcaggtcc

SEQ ID NO: 788358 - DNA, 23 bp, Homo sapiens
gggcactttttaattcaccaaag

SEQ ID NO: 788359 - DNA, 22 bp, Homo sapiens
gggcagaacagccgctcctgtc

SEQ ID NO: 788360 - DNA, 21 bp, Homo sapiens
gggcagaagactagaggccag

SEQ ID NO: 788361 - DNA, 20 bp, Homo sapiens
gggcagaccctgagcagaat

SEQ ID NO: 788362 - DNA, 14 bp, Homo sapiens
gggcagagcaggaa

SEQ ID NO: 788363 - DNA, 17 bp, Homo sapiens
gggcagagccatgggcc

SEQ ID NO: 788364 - DNA, 17 bp, Homo sapiens
gggcagagctggctctg

SEQ ID NO: 788365 - DNA, 21 bp, Homo sapiens
gggcagaggaatgtagggcct

SEQ ID NO: 788366 - DNA, 15 bp, Homo sapiens
gggcagagggcagag

SEQ ID NO: 788367 - DNA, 13 bp, Homo sapiens
gggcagagggctg

SEQ ID NO: 788368 - DNA, 16 bp, Homo sapiens
gggcagagggctggag

SEQ ID NO: 788369 - DNA, 13 bp, Homo sapiens
gggcagaggggca

SEQ ID NO: 788370 - DNA, 15 bp, Homo sapiens
gggcagaggggcagc

SEQ ID NO: 788371 - DNA, 15 bp, Homo sapiens
gggcagatcttttct

SEQ ID NO: 788372 - DNA, 15 bp, Homo sapiens
gggcagcaaggctgc

SEQ ID NO: 788373 - DNA, 19 bp, Homo sapiens
gggcagcaaggctgctgcc

SEQ ID NO: 788374 - DNA, 15 bp, Homo sapiens
gggcagcacctctgc

SEQ ID NO: 788375 - DNA, 11 bp, Homo sapiens
gggcagcactc

SEQ ID NO: 788376 - DNA, 14 bp, Homo sapiens
gggcagcactcccc

SEQ ID NO: 788377 - DNA, 19 bp, Homo sapiens
gggcagcactgggaagctg

SEQ ID NO: 788378 - DNA, 16 bp, Homo sapiens
gggcagcagcatccca

SEQ ID NO: 788379 - DNA, 21 bp, Homo sapiens
gggcagcagcatcccagcctt

SEQ ID NO: 788380 - DNA, 22 bp, Homo sapiens
gggcagcagcatcccagccttg

SEQ ID NO: 788381 - DNA, 13 bp, Homo sapiens
gggcagccacagg

SEQ ID NO: 788382 - DNA, 19 bp, Homo sapiens
gggcagccacaggactgag

SEQ ID NO: 788383 - DNA, 22 bp, Homo sapiens
gggcagccacaggactgagccc

SEQ ID NO: 788384 - DNA, 22 bp, Homo sapiens
gggcagccacccaagcctgctg

SEQ ID NO: 788385 - DNA, 12 bp, Homo sapiens
gggcagccagga

SEQ ID NO: 788386 - DNA, 13 bp, Homo sapiens
gggcagccaggct

SEQ ID NO: 788387 - DNA, 18 bp, Homo sapiens
gggcagccgctaggagag

SEQ ID NO: 788388 - DNA, 11 bp, Homo sapiens
gggcagcctgc

SEQ ID NO: 788389 - DNA, 23 bp, Homo sapiens
gggcagccttgggggggctgcct

SEQ ID NO: 788390 - DNA, 16 bp, Homo sapiens
gggcagcgccaggctg

SEQ ID NO: 788391 - DNA, 14 bp, Homo sapiens
gggcagctgaggac

SEQ ID NO: 788392 - DNA, 12 bp, Homo sapiens
gggcagctggcc

SEQ ID NO: 788393 - DNA, 20 bp, Homo sapiens
gggcagctggcccccagccc

SEQ ID NO: 788394 - DNA, 22 bp, Homo sapiens
gggcagctggcccccagccctg

SEQ ID NO: 788395 - DNA, 13 bp, Homo sapiens
gggcagctgggcc

SEQ ID NO: 788396 - DNA, 14 bp, Homo sapiens
gggcagctgggccc

SEQ ID NO: 788397 - DNA, 19 bp, Homo sapiens
gggcaggaaggagagcctg

SEQ ID NO: 788398 - DNA, 18 bp, Homo sapiens
gggcaggagggccctacc

SEQ ID NO: 788399 - DNA, 14 bp, Homo sapiens
gggcaggagtgcca

SEQ ID NO: 788400 - DNA, 15 bp, Homo sapiens
gggcaggagtgccag

SEQ ID NO: 788401 - DNA, 18 bp, Homo sapiens
gggcaggagtgccaggac

SEQ ID NO: 788402 - DNA, 21 bp, Homo sapiens
gggcaggagtgccaggaccag

SEQ ID NO: 788403 - DNA, 22 bp, Homo sapiens
gggcaggagtgccaggaccagc

SEQ ID NO: 788404 - DNA, 19 bp, Homo sapiens
gggcaggatctcaagccag

SEQ ID NO: 788405 - DNA, 20 bp, Homo sapiens
gggcaggatctcaagccagc

SEQ ID NO: 788406 - DNA, 16 bp, Homo sapiens
gggcaggcaagccctt

SEQ ID NO: 788407 - DNA, 13 bp, Homo sapiens
gggcaggcagaga

SEQ ID NO: 788408 - DNA, 12 bp, Homo sapiens
gggcaggcaggg

SEQ ID NO: 788409 - DNA, 11 bp, Homo sapiens
gggcaggcctg

SEQ ID NO: 788410 - DNA, 12 bp, Homo sapiens
gggcaggcggtc

SEQ ID NO: 788411 - DNA, 14 bp, Homo sapiens
gggcaggctgaggt

SEQ ID NO: 788412 - DNA, 13 bp, Homo sapiens
gggcaggctgggc

SEQ ID NO: 788413 - DNA, 14 bp, Homo sapiens
gggcaggcttgggg

SEQ ID NO: 788414 - DNA, 16 bp, Homo sapiens
gggcaggcttggggaa

SEQ ID NO: 788415 - DNA, 23 bp, Homo sapiens
gggcagggacccggggtctcctg

SEQ ID NO: 788416 - DNA, 22 bp, Homo sapiens
gggcagggagagcgcctcttcc

SEQ ID NO: 788417 - DNA, 23 bp, Homo sapiens
gggcagggagagcgcctcttcct

SEQ ID NO: 788418 - DNA, 14 bp, Homo sapiens
gggcagggagtgat

SEQ ID NO: 788419 - DNA, 19 bp, Homo sapiens
gggcagggatgatggcaga

SEQ ID NO: 788420 - DNA, 16 bp, Homo sapiens
gggcagggcccacgtg

SEQ ID NO: 788421 - DNA, 22 bp, Homo sapiens
gggcaggggagccagggtagag

SEQ ID NO: 788422 - DNA, 13 bp, Homo sapiens
gggcaggggcctg

SEQ ID NO: 788423 - DNA, 15 bp, Homo sapiens
gggcaggggcctggg

SEQ ID NO: 788424 - DNA, 16 bp, Homo sapiens
gggcaggggcctgggc

SEQ ID NO: 788425 - DNA, 11 bp, Homo sapiens
gggcagggtga

SEQ ID NO: 788426 - DNA, 14 bp, Homo sapiens
gggcagggtgaccc

SEQ ID NO: 788427 - DNA, 16 bp, Homo sapiens
gggcagggtgagaagc

SEQ ID NO: 788428 - DNA, 16 bp, Homo sapiens
gggcaggtcctgccca

SEQ ID NO: 788429 - DNA, 17 bp, Homo sapiens
gggcaggtcctgcccat

SEQ ID NO: 788430 - DNA, 19 bp, Homo sapiens
gggcaggtggccgcccctg

SEQ ID NO: 788431 - DNA, 16 bp, Homo sapiens
gggcaggtggtggagg

SEQ ID NO: 788432 - DNA, 17 bp, Homo sapiens
gggcaggtgtttctttc

SEQ ID NO: 788433 - DNA, 20 bp, Homo sapiens
gggcaggtgtttctttcctg

SEQ ID NO: 788434 - DNA, 17 bp, Homo sapiens
gggcaggttcctggggc

SEQ ID NO: 788435 - DNA, 16 bp, Homo sapiens
gggcagtcaccaccca

SEQ ID NO: 788436 - DNA, 19 bp, Homo sapiens
gggcagtcaccacccagcc

SEQ ID NO: 788437 - DNA, 20 bp, Homo sapiens
gggcagtcaccacccagccc

SEQ ID NO: 788438 - DNA, 14 bp, Homo sapiens
gggccagaggcagc

SEQ ID NO: 788439 - DNA, 14 bp, Homo sapiens
gggccagaggctgg

SEQ ID NO: 788440 - DNA, 15 bp, Homo sapiens
gggccagaggctggg

SEQ ID NO: 788441 - DNA, 14 bp, Homo sapiens
gggccagcagaggg

SEQ ID NO: 788442 - DNA, 13 bp, Homo sapiens
gggccagcaggct

SEQ ID NO: 788443 - DNA, 18 bp, Homo sapiens
gggccagcaggctcctgg

SEQ ID NO: 788444 - DNA, 20 bp, Homo sapiens
gggccagcaggctcctggct

SEQ ID NO: 788445 - DNA, 13 bp, Homo sapiens
gggccagccaggc

SEQ ID NO: 788446 - DNA, 16 bp, Homo sapiens
gggccagccaggcggg

SEQ ID NO: 788447 - DNA, 18 bp, Homo sapiens
gggccagccaggcgggct

SEQ ID NO: 788448 - DNA, 22 bp, Homo sapiens
gggccagccccacccccagcca

SEQ ID NO: 788449 - DNA, 17 bp, Homo sapiens
gggccagcccctcccac

SEQ ID NO: 788450 - DNA, 12 bp, Homo sapiens
gggccagctggg

SEQ ID NO: 788451 - DNA, 15 bp, Homo sapiens
gggccagctggggag

SEQ ID NO: 788452 - DNA, 17 bp, Homo sapiens
gggccagctggggagat

SEQ ID NO: 788453 - DNA, 17 bp, Homo sapiens
gggccaggacaggcccg

SEQ ID NO: 788454 - DNA, 14 bp, Homo sapiens
gggccaggaccatg

SEQ ID NO: 788455 - DNA, 11 bp, Homo sapiens
gggccaggcag

SEQ ID NO: 788456 - DNA, 21 bp, Homo sapiens
gggccaggcagaatggctgca

SEQ ID NO: 788457 - DNA, 14 bp, Homo sapiens
gggccaggcaggcg

SEQ ID NO: 788458 - DNA, 20 bp, Homo sapiens
gggccaggcaggtgcctgga

SEQ ID NO: 788459 - DNA, 23 bp, Homo sapiens
gggccaggcaggtgcctggacat

SEQ ID NO: 788460 - DNA, 11 bp, Homo sapiens
gggccaggcct

SEQ ID NO: 788461 - DNA, 13 bp, Homo sapiens
gggccagggaggc

SEQ ID NO: 788462 - DNA, 17 bp, Homo sapiens
gggccagggaggcagag

SEQ ID NO: 788463 - DNA, 16 bp, Homo sapiens
gggccagggccctgca

SEQ ID NO: 788464 - DNA, 12 bp, Homo sapiens
gggccagggctg

SEQ ID NO: 788465 - DNA, 16 bp, Homo sapiens
gggccagggctgcccc

SEQ ID NO: 788466 - DNA, 21 bp, Homo sapiens
gggccagggctggatggacag

SEQ ID NO: 788467 - DNA, 17 bp, Homo sapiens
gggccagggtgggaaga

SEQ ID NO: 788468 - DNA, 18 bp, Homo sapiens
gggccagggtgggaagag

SEQ ID NO: 788469 - DNA, 17 bp, Homo sapiens
gggccaggtgcagacct

SEQ ID NO: 788470 - DNA, 19 bp, Homo sapiens
gggccagtcctgcctggcc

SEQ ID NO: 788471 - DNA, 21 bp, Homo sapiens
gggccagtcctgcctggccag

SEQ ID NO: 788472 - DNA, 15 bp, Homo sapiens
gggccagtctgggct

SEQ ID NO: 788473 - DNA, 22 bp, Homo sapiens
gggccagtgagggctgggccca

SEQ ID NO: 788474 - DNA, 17 bp, Homo sapiens
gggccagtggggcctgt

SEQ ID NO: 788475 - DNA, 20 bp, Homo sapiens
gggccagtggggcctgtgga

SEQ ID NO: 788476 - DNA, 15 bp, Homo sapiens
gggccatcctgcccc

SEQ ID NO: 788477 - DNA, 17 bp, Homo sapiens
gggccatgccccacccc

SEQ ID NO: 788478 - DNA, 21 bp, Homo sapiens
gggccatgccccacccccctc

SEQ ID NO: 788479 - DNA, 22 bp, Homo sapiens
gggccatgccccacccccctcc

SEQ ID NO: 788480 - DNA, 22 bp, Homo sapiens
gggccatggctttcatcctgtg

SEQ ID NO: 788481 - DNA, 14 bp, Homo sapiens
gggccatgtccaaa

SEQ ID NO: 788482 - DNA, 23 bp, Homo sapiens
gggccatgtccaaagaggctgcc

SEQ ID NO: 788483 - DNA, 12 bp, Homo sapiens
gggccattaccc

SEQ ID NO: 788484 - DNA, 15 bp, Homo sapiens
gggccattaccccat

SEQ ID NO: 788485 - DNA, 16 bp, Homo sapiens
gggccattaccccata

SEQ ID NO: 788486 - DNA, 18 bp, Homo sapiens
gggccattctccacagca

SEQ ID NO: 788487 - DNA, 13 bp, Homo sapiens
gggccgtgcccag

SEQ ID NO: 788488 - DNA, 17 bp, Homo sapiens
gggccgtgcccaggggc

SEQ ID NO: 788489 - DNA, 17 bp, Homo sapiens
gggccgtggcacagctg

SEQ ID NO: 788490 - DNA, 23 bp, Homo sapiens
gggcctagatccacacacagagg

SEQ ID NO: 788491 - DNA, 20 bp, Homo sapiens
gggcctagcgatctctcctg

SEQ ID NO: 788492 - DNA, 16 bp, Homo sapiens
gggcctcaaggacttg

SEQ ID NO: 788493 - DNA, 15 bp, Homo sapiens
gggcctcagggtcct

SEQ ID NO: 788494 - DNA, 14 bp, Homo sapiens
gggcctccagaact

SEQ ID NO: 788495 - DNA, 17 bp, Homo sapiens
gggcctccagaagctgc

SEQ ID NO: 788496 - DNA, 21 bp, Homo sapiens
gggcctccagaagctgctcct

SEQ ID NO: 788497 - DNA, 11 bp, Homo sapiens
gggcctccagg

SEQ ID NO: 788498 - DNA, 17 bp, Homo sapiens
gggcctccatgccccag

SEQ ID NO: 788499 - DNA, 16 bp, Homo sapiens
gggcctcccaccagag

SEQ ID NO: 788500 - DNA, 17 bp, Homo sapiens
gggcctcccctgggcag

SEQ ID NO: 788501 - DNA, 22 bp, Homo sapiens
gggcctcccctgggcagggttc

SEQ ID NO: 788502 - DNA, 13 bp, Homo sapiens
gggcctccctccg

SEQ ID NO: 788503 - DNA, 15 bp, Homo sapiens
gggcctccctgttca

SEQ ID NO: 788504 - DNA, 20 bp, Homo sapiens
gggcctccgcttatcctgct

SEQ ID NO: 788505 - DNA, 22 bp, Homo sapiens
gggcctccgcttatcctgctag

SEQ ID NO: 788506 - DNA, 21 bp, Homo sapiens
gggcctcctcagcctctgcaa

SEQ ID NO: 788507 - DNA, 22 bp, Homo sapiens
gggcctccttcccatgcctgtc

SEQ ID NO: 788508 - DNA, 15 bp, Homo sapiens
gggcctccttcttcc

SEQ ID NO: 788509 - DNA, 18 bp, Homo sapiens
gggcctccttcttccact

SEQ ID NO: 788510 - DNA, 15 bp, Homo sapiens
gggcctctcctgccc

SEQ ID NO: 788511 - DNA, 16 bp, Homo sapiens
gggcctctcctgccct

SEQ ID NO: 788512 - DNA, 12 bp, Homo sapiens
gggcctctctcc

SEQ ID NO: 788513 - DNA, 21 bp, Homo sapiens
gggcctctctcctgcctgccc

SEQ ID NO: 788514 - DNA, 13 bp, Homo sapiens
gggcctctctggg

SEQ ID NO: 788515 - DNA, 15 bp, Homo sapiens
gggcctctctggggg

SEQ ID NO: 788516 - DNA, 22 bp, Homo sapiens
gggcctctctgggggaggcagg

SEQ ID NO: 788517 - DNA, 20 bp, Homo sapiens
gggcctctttttgcccttta

SEQ ID NO: 788518 - DNA, 18 bp, Homo sapiens
gggcctgactgttgcccc

SEQ ID NO: 788519 - DNA, 20 bp, Homo sapiens
gggcctgactgttgcccccc

SEQ ID NO: 788520 - DNA, 14 bp, Homo sapiens
gggcctgagagaat

SEQ ID NO: 788521 - DNA, 20 bp, Homo sapiens
gggcctgagtggaggattat

SEQ ID NO: 788522 - DNA, 18 bp, Homo sapiens
gggcctgcatggagaagg

SEQ ID NO: 788523 - DNA, 16 bp, Homo sapiens
gggcctgcccagacaa

SEQ ID NO: 788524 - DNA, 14 bp, Homo sapiens
gggcctgccgggct

SEQ ID NO: 788525 - DNA, 21 bp, Homo sapiens
gggcctgccgggctgagggcc

SEQ ID NO: 788526 - DNA, 16 bp, Homo sapiens
gggcctgcctgcctcc

SEQ ID NO: 788527 - DNA, 20 bp, Homo sapiens
gggcctgcctgcctccaccc

SEQ ID NO: 788528 - DNA, 21 bp, Homo sapiens
gggcctgcctgcctccacccg

SEQ ID NO: 788529 - DNA, 23 bp, Homo sapiens
gggcctgcctgcctccacccgtc

SEQ ID NO: 788530 - DNA, 21 bp, Homo sapiens
gggcctgcctggtctctagag

SEQ ID NO: 788531 - DNA, 19 bp, Homo sapiens
gggcctgcgcccagagctg

SEQ ID NO: 788532 - DNA, 21 bp, Homo sapiens
gggcctgcggaggcggtggca

SEQ ID NO: 788533 - DNA, 20 bp, Homo sapiens
gggcctgctagtctgtcagg

SEQ ID NO: 788534 - DNA, 17 bp, Homo sapiens
gggcctgctgcgtcaga

SEQ ID NO: 788535 - DNA, 16 bp, Homo sapiens
gggcctgctggagttc

SEQ ID NO: 788536 - DNA, 14 bp, Homo sapiens
gggcctggacctgc

SEQ ID NO: 788537 - DNA, 21 bp, Homo sapiens
gggcctggagccctgggcgga

SEQ ID NO: 788538 - DNA, 21 bp, Homo sapiens
gggcctggattcatttcctgc

SEQ ID NO: 788539 - DNA, 22 bp, Homo sapiens
gggcctggcagccgtgccttca

SEQ ID NO: 788540 - DNA, 12 bp, Homo sapiens
gggcctggccag

SEQ ID NO: 788541 - DNA, 19 bp, Homo sapiens
gggcctggccagtcctggt

SEQ ID NO: 788542 - DNA, 13 bp, Homo sapiens
gggcctggcctga

SEQ ID NO: 788543 - DNA, 14 bp, Homo sapiens
gggcctggcctgag

SEQ ID NO: 788544 - DNA, 16 bp, Homo sapiens
gggcctggcctgagct

SEQ ID NO: 788545 - DNA, 22 bp, Homo sapiens
gggcctggcctgagctggggcc

SEQ ID NO: 788546 - DNA, 12 bp, Homo sapiens
gggcctgggagg

SEQ ID NO: 788547 - DNA, 12 bp, Homo sapiens
gggcctgggcct

SEQ ID NO: 788548 - DNA, 14 bp, Homo sapiens
gggcctggggcctg

SEQ ID NO: 788549 - DNA, 16 bp, Homo sapiens
gggcctggggcctgag

SEQ ID NO: 788550 - DNA, 18 bp, Homo sapiens
gggcctggtcgttttcaa

SEQ ID NO: 788551 - DNA, 14 bp, Homo sapiens
gggcctgtgcactg

SEQ ID NO: 788552 - DNA, 14 bp, Homo sapiens
gggcctgtgcagca

SEQ ID NO: 788553 - DNA, 16 bp, Homo sapiens
gggcctgtgcagcagc

SEQ ID NO: 788554 - DNA, 17 bp, Homo sapiens
gggcctgtgcagcagcc

SEQ ID NO: 788555 - DNA, 20 bp, Homo sapiens
gggcctgtgcagcagcccag

SEQ ID NO: 788556 - DNA, 16 bp, Homo sapiens
gggcctgtggaatgag

SEQ ID NO: 788557 - DNA, 22 bp, Homo sapiens
gggcctgtgtgtgggtggggtt

SEQ ID NO: 788558 - DNA, 17 bp, Homo sapiens
gggccttagggcactgg

SEQ ID NO: 788559 - DNA, 17 bp, Homo sapiens
gggccttagtgggccag

SEQ ID NO: 788560 - DNA, 18 bp, Homo sapiens
gggccttagtgggccagg

SEQ ID NO: 788561 - DNA, 23 bp, Homo sapiens
gggccttatcgggctccagccat

SEQ ID NO: 788562 - DNA, 15 bp, Homo sapiens
gggccttgcccagag

SEQ ID NO: 788563 - DNA, 22 bp, Homo sapiens
gggccttgcccagagatgcctc

SEQ ID NO: 788564 - DNA, 14 bp, Homo sapiens
gggccttgcggaag

SEQ ID NO: 788565 - DNA, 16 bp, Homo sapiens
gggccttgctctgagc

SEQ ID NO: 788566 - DNA, 23 bp, Homo sapiens
gggccttggatcgctaagctggc

SEQ ID NO: 788567 - DNA, 22 bp, Homo sapiens
gggccttggcctcccctgctga

SEQ ID NO: 788568 - DNA, 15 bp, Homo sapiens
gggccttggctgggc

SEQ ID NO: 788569 - DNA, 23 bp, Homo sapiens
ggggaatggaagttctgaattaa

SEQ ID NO: 788570 - DNA, 14 bp, Homo sapiens
ggggacaccagagc

SEQ ID NO: 788571 - DNA, 18 bp, Homo sapiens
ggggacagaggccctgcc

SEQ ID NO: 788572 - DNA, 23 bp, Homo sapiens
ggggacagcttcctcacacccct

SEQ ID NO: 788573 - DNA, 14 bp, Homo sapiens
ggggacagggaggg

SEQ ID NO: 788574 - DNA, 16 bp, Homo sapiens
ggggacccagctcctc

SEQ ID NO: 788575 - DNA, 13 bp, Homo sapiens
ggggacccaggct

SEQ ID NO: 788576 - DNA, 20 bp, Homo sapiens
ggggaccctccagaggtgga

SEQ ID NO: 788577 - DNA, 22 bp, Homo sapiens
ggggacctgtcccccactctct

SEQ ID NO: 788578 - DNA, 23 bp, Homo sapiens
ggggaccttggcgctctcagctt

SEQ ID NO: 788579 - DNA, 18 bp, Homo sapiens
ggggacgcctgccctgcc

SEQ ID NO: 788580 - DNA, 21 bp, Homo sapiens
ggggacgcttttgagtgggcc

SEQ ID NO: 788581 - DNA, 23 bp, Homo sapiens
ggggacgcttttgagtgggccct

SEQ ID NO: 788582 - DNA, 13 bp, Homo sapiens
ggggactcctcaa

SEQ ID NO: 788583 - DNA, 20 bp, Homo sapiens
ggggactcctcaaaccactt

SEQ ID NO: 788584 - DNA, 14 bp, Homo sapiens
ggggactctgccgc

SEQ ID NO: 788585 - DNA, 22 bp, Homo sapiens
ggggactctgggctatggacac

SEQ ID NO: 788586 - DNA, 12 bp, Homo sapiens
ggggactgggga

SEQ ID NO: 788587 - DNA, 14 bp, Homo sapiens
ggggactgtctttc

SEQ ID NO: 788588 - DNA, 22 bp, Homo sapiens
ggggacttccgctccctggata

SEQ ID NO: 788589 - DNA, 15 bp, Homo sapiens
ggggagaaaattaaa

SEQ ID NO: 788590 - DNA, 11 bp, Homo sapiens
ggggagaaagg

SEQ ID NO: 788591 - DNA, 13 bp, Homo sapiens
ggggagaagagcc

SEQ ID NO: 788592 - DNA, 20 bp, Homo sapiens
ggggagaagagccctggaca

SEQ ID NO: 788593 - DNA, 21 bp, Homo sapiens
ggggagacttggggccagcgc

SEQ ID NO: 788594 - DNA, 11 bp, Homo sapiens
ggggagagaag

SEQ ID NO: 788595 - DNA, 18 bp, Homo sapiens
ggggagagacaggcagcc

SEQ ID NO: 788596 - DNA, 21 bp, Homo sapiens
ggggagagacaggcagcccag

SEQ ID NO: 788597 - DNA, 23 bp, Homo sapiens
ggggagattctgggtttgcccag

SEQ ID NO: 788598 - DNA, 21 bp, Homo sapiens
ggggagcaaatcatctgcatt

SEQ ID NO: 788599 - DNA, 19 bp, Homo sapiens
ggggagcacttgcgtcctg

SEQ ID NO: 788600 - DNA, 15 bp, Homo sapiens
ggggagcagagagag

SEQ ID NO: 788601 - DNA, 20 bp, Homo sapiens
ggggagcagcggctctggtc

SEQ ID NO: 788602 - DNA, 22 bp, Homo sapiens
ggggagcaggaggccaataaaa

SEQ ID NO: 788603 - DNA, 14 bp, Homo sapiens
ggggagccctcagg

SEQ ID NO: 788604 - DNA, 21 bp, Homo sapiens
ggggagccctcaggctcccca

SEQ ID NO: 788605 - DNA, 12 bp, Homo sapiens
ggggagctcctg

SEQ ID NO: 788606 - DNA, 18 bp, Homo sapiens
ggggagctgcagagcagc

SEQ ID NO: 788607 - DNA, 16 bp, Homo sapiens
ggggagcttgggactc

SEQ ID NO: 788608 - DNA, 13 bp, Homo sapiens
ggggaggaccagg

SEQ ID NO: 788609 - DNA, 15 bp, Homo sapiens
ggggaggcagcagag

SEQ ID NO: 788610 - DNA, 11 bp, Homo sapiens
ggggaggccct

SEQ ID NO: 788611 - DNA, 16 bp, Homo sapiens
ggggaggccctgcctg

SEQ ID NO: 788612 - DNA, 12 bp, Homo sapiens
ggggagggcagg

SEQ ID NO: 788613 - DNA, 15 bp, Homo sapiens
ggggagggctcctgg

SEQ ID NO: 788614 - DNA, 13 bp, Homo sapiens
ggggaggggccct

SEQ ID NO: 788615 - DNA, 16 bp, Homo sapiens
ggggaggggccctcag

SEQ ID NO: 788616 - DNA, 15 bp, Homo sapiens
ggggaggggcctagg

SEQ ID NO: 788617 - DNA, 16 bp, Homo sapiens
ggggaggggcgctggc

SEQ ID NO: 788618 - DNA, 15 bp, Homo sapiens
ggggagggggaagca

SEQ ID NO: 788619 - DNA, 22 bp, Homo sapiens
ggggagggtcttttaccctgtg

SEQ ID NO: 788620 - DNA, 23 bp, Homo sapiens
ggggagggtcttttaccctgtgt

SEQ ID NO: 788621 - DNA, 14 bp, Homo sapiens
ggggagtgaaacag

SEQ ID NO: 788622 - DNA, 19 bp, Homo sapiens
ggggagtgggacagagtct

SEQ ID NO: 788623 - DNA, 20 bp, Homo sapiens
ggggagtgggacagagtctg

SEQ ID NO: 788624 - DNA, 18 bp, Homo sapiens
ggggagttgttatgccat

SEQ ID NO: 788625 - DNA, 15 bp, Homo sapiens
ggggatccagtgaga

SEQ ID NO: 788626 - DNA, 13 bp, Homo sapiens
ggggatccccgcc

SEQ ID NO: 788627 - DNA, 21 bp, Homo sapiens
ggggatccccgcctggccagg

SEQ ID NO: 788628 - DNA, 22 bp, Homo sapiens
ggggatccccgcctggccagga

SEQ ID NO: 788629 - DNA, 20 bp, Homo sapiens
ggggatggacacccccagct

SEQ ID NO: 788630 - DNA, 17 bp, Homo sapiens
ggggatggaggccagag

SEQ ID NO: 788631 - DNA, 20 bp, Homo sapiens
ggggatggaggccagagtct

SEQ ID NO: 788632 - DNA, 14 bp, Homo sapiens
ggggatgggtgggg

SEQ ID NO: 788633 - DNA, 17 bp, Homo sapiens
ggggatgggtggggagg

SEQ ID NO: 788634 - DNA, 14 bp, Homo sapiens
ggggatgtgggagg

SEQ ID NO: 788635 - DNA, 18 bp, Homo sapiens
ggggatgtgggagggagc

SEQ ID NO: 788636 - DNA, 12 bp, Homo sapiens
ggggcaagacag

SEQ ID NO: 788637 - DNA, 14 bp, Homo sapiens
ggggcaagccaggg

SEQ ID NO: 788638 - DNA, 18 bp, Homo sapiens
ggggcaagccagggccca

SEQ ID NO: 788639 - DNA, 20 bp, Homo sapiens
ggggcaagccagggcccaga

SEQ ID NO: 788640 - DNA, 21 bp, Homo sapiens
ggggcaagccagggcccagag

SEQ ID NO: 788641 - DNA, 22 bp, Homo sapiens
ggggcaagccagggcccagagc

SEQ ID NO: 788642 - DNA, 23 bp, Homo sapiens
ggggcaagccagggcccagagcc

SEQ ID NO: 788643 - DNA, 15 bp, Homo sapiens
ggggcaaggtctcct

SEQ ID NO: 788644 - DNA, 21 bp, Homo sapiens
ggggcaatagggttaaatggt

SEQ ID NO: 788645 - DNA, 18 bp, Homo sapiens
ggggcacaccactgccct

SEQ ID NO: 788646 - DNA, 19 bp, Homo sapiens
ggggcacaccactgccctg

SEQ ID NO: 788647 - DNA, 22 bp, Homo sapiens
ggggcacaccactgccctgcct

SEQ ID NO: 788648 - DNA, 13 bp, Homo sapiens
ggggcacagctgt

SEQ ID NO: 788649 - DNA, 17 bp, Homo sapiens
ggggcacagtccaggaa

SEQ ID NO: 788650 - DNA, 20 bp, Homo sapiens
ggggcaccttccgacatccc

SEQ ID NO: 788651 - DNA, 15 bp, Homo sapiens
ggggcagagaataaa

SEQ ID NO: 788652 - DNA, 15 bp, Homo sapiens
ggggcagagaggaag

SEQ ID NO: 788653 - DNA, 13 bp, Homo sapiens
ggggcagagccag

SEQ ID NO: 788654 - DNA, 18 bp, Homo sapiens
ggggcagagggcagaggc

SEQ ID NO: 788655 - DNA, 22 bp, Homo sapiens
ggggcagagggcagaggctgga

SEQ ID NO: 788656 - DNA, 15 bp, Homo sapiens
ggggcagccctgagt

SEQ ID NO: 788657 - DNA, 15 bp, Homo sapiens
ggggcagcccttgct

SEQ ID NO: 788658 - DNA, 19 bp, Homo sapiens
ggggcagctgccagagaag

SEQ ID NO: 788659 - DNA, 21 bp, Homo sapiens
ggggcaggaaagccacatctt

SEQ ID NO: 788660 - DNA, 19 bp, Homo sapiens
ggggcaggagtgccaggac

SEQ ID NO: 788661 - DNA, 21 bp, Homo sapiens
ggggcaggagtgccaggacca

SEQ ID NO: 788662 - DNA, 11 bp, Homo sapiens
ggggcaggcct

SEQ ID NO: 788663 - DNA, 12 bp, Homo sapiens
ggggcaggcctg

SEQ ID NO: 788664 - DNA, 16 bp, Homo sapiens
ggggcaggcctgggac

SEQ ID NO: 788665 - DNA, 13 bp, Homo sapiens
ggggcaggcgcag

SEQ ID NO: 788666 - DNA, 22 bp, Homo sapiens
ggggcaggctctctcctctctc

SEQ ID NO: 788667 - DNA, 21 bp, Homo sapiens
ggggcagggaaggggaggcag

SEQ ID NO: 788668 - DNA, 17 bp, Homo sapiens
ggggcagggacttgcct

SEQ ID NO: 788669 - DNA, 13 bp, Homo sapiens
ggggcagggaggc

SEQ ID NO: 788670 - DNA, 14 bp, Homo sapiens
ggggcaggggcctg

SEQ ID NO: 788671 - DNA, 22 bp, Homo sapiens
ggggcagtatgtgatggactgg

SEQ ID NO: 788672 - DNA, 14 bp, Homo sapiens
ggggcatctgtctg

SEQ ID NO: 788673 - DNA, 23 bp, Homo sapiens
ggggcatctgtctgtctgtgggc

SEQ ID NO: 788674 - DNA, 17 bp, Homo sapiens
ggggcatggttccttcc

SEQ ID NO: 788675 - DNA, 21 bp, Homo sapiens
ggggcatggttccttccctgg

SEQ ID NO: 788676 - DNA, 23 bp, Homo sapiens
ggggcatgtattggcctggaggt

SEQ ID NO: 788677 - DNA, 19 bp, Homo sapiens
ggggccaaagaaggcaggg

SEQ ID NO: 788678 - DNA, 20 bp, Homo sapiens
ggggccaaagaaggcaggga

SEQ ID NO: 788679 - DNA, 16 bp, Homo sapiens
ggggccacccaaatgt

SEQ ID NO: 788680 - DNA, 19 bp, Homo sapiens
ggggccaccccgtgcccct

SEQ ID NO: 788681 - DNA, 15 bp, Homo sapiens
ggggccacctgcctg

SEQ ID NO: 788682 - DNA, 16 bp, Homo sapiens
ggggccacctgcctgc

SEQ ID NO: 788683 - DNA, 21 bp, Homo sapiens
ggggccagagagcaggggagc

SEQ ID NO: 788684 - DNA, 23 bp, Homo sapiens
ggggccagaggaactgtccagag

SEQ ID NO: 788685 - DNA, 14 bp, Homo sapiens
ggggccagcagagg

SEQ ID NO: 788686 - DNA, 22 bp, Homo sapiens
ggggccagcgcttctggtctgg

SEQ ID NO: 788687 - DNA, 12 bp, Homo sapiens
ggggccagctgg

SEQ ID NO: 788688 - DNA, 10 bp, Homo sapiens
ggggccagga

SEQ ID NO: 788689 - DNA, 12 bp, Homo sapiens
ggggccaggacc

SEQ ID NO: 788690 - DNA, 11 bp, Homo sapiens
ggggccagggc

SEQ ID NO: 788691 - DNA, 12 bp, Homo sapiens
ggggccagggca

SEQ ID NO: 788692 - DNA, 21 bp, Homo sapiens
ggggccaggggcaggcagggc

SEQ ID NO: 788693 - DNA, 18 bp, Homo sapiens
ggggccagtgagggctgg

SEQ ID NO: 788694 - DNA, 20 bp, Homo sapiens
ggggccatgagctccagacc

SEQ ID NO: 788695 - DNA, 19 bp, Homo sapiens
ggggccatgcctcctcagg

SEQ ID NO: 788696 - DNA, 23 bp, Homo sapiens
ggggcccaagtggggtgctctgg

SEQ ID NO: 788697 - DNA, 17 bp, Homo sapiens
ggggcccaccctctgcc

SEQ ID NO: 788698 - DNA, 23 bp, Homo sapiens
ggggcccaccctctgcccaggga

SEQ ID NO: 788699 - DNA, 14 bp, Homo sapiens
ggggcccagcccct

SEQ ID NO: 788700 - DNA, 23 bp, Homo sapiens
ggggccccacctcggcacacact

SEQ ID NO: 788701 - DNA, 17 bp, Homo sapiens
ggggccccagatctgcc

SEQ ID NO: 788702 - DNA, 22 bp, Homo sapiens
ggggccccagcgtctgcagggt

SEQ ID NO: 788703 - DNA, 19 bp, Homo sapiens
ggggccccgccagggctgg

SEQ ID NO: 788704 - DNA, 16 bp, Homo sapiens
ggggccccggggctgg

SEQ ID NO: 788705 - DNA, 18 bp, Homo sapiens
ggggccccggggctggca

SEQ ID NO: 788706 - DNA, 15 bp, Homo sapiens
ggggcccctggccca

SEQ ID NO: 788707 - DNA, 22 bp, Homo sapiens
ggggcccctttttactcccctt

SEQ ID NO: 788708 - DNA, 16 bp, Homo sapiens
ggggcccgacaggtgg

SEQ ID NO: 788709 - DNA, 23 bp, Homo sapiens
ggggcccgcctggcagaactgag

SEQ ID NO: 788710 - DNA, 12 bp, Homo sapiens
ggggccctcagg

SEQ ID NO: 788711 - DNA, 20 bp, Homo sapiens
ggggccctcttgccagcctc

SEQ ID NO: 788712 - DNA, 21 bp, Homo sapiens
ggggccctcttgccagcctcc

SEQ ID NO: 788713 - DNA, 13 bp, Homo sapiens
ggggccctgagcc

SEQ ID NO: 788714 - DNA, 21 bp, Homo sapiens
ggggccctggtccttccaggc

SEQ ID NO: 788715 - DNA, 14 bp, Homo sapiens
ggggccctgtacag

SEQ ID NO: 788716 - DNA, 12 bp, Homo sapiens
ggggcccttggc

SEQ ID NO: 788717 - DNA, 21 bp, Homo sapiens
ggggcccttggggcctggctt

SEQ ID NO: 788718 - DNA, 19 bp, Homo sapiens
ggggccgcctgccctgcct

SEQ ID NO: 788719 - DNA, 16 bp, Homo sapiens
ggggccggccagtggc

SEQ ID NO: 788720 - DNA, 16 bp, Homo sapiens
ggggccgggcaggtcc

SEQ ID NO: 788721 - DNA, 22 bp, Homo sapiens
ggggccggggggaggggacaga

SEQ ID NO: 788722 - DNA, 17 bp, Homo sapiens
ggggcctagggagccgc

SEQ ID NO: 788723 - DNA, 22 bp, Homo sapiens
ggggcctcaatctaaggccttc

SEQ ID NO: 788724 - DNA, 15 bp, Homo sapiens
ggggcctccagaagc

SEQ ID NO: 788725 - DNA, 17 bp, Homo sapiens
ggggcctccagaagctg

SEQ ID NO: 788726 - DNA, 14 bp, Homo sapiens
ggggcctcctcagc

SEQ ID NO: 788727 - DNA, 14 bp, Homo sapiens
ggggcctgactgct

SEQ ID NO: 788728 - DNA, 12 bp, Homo sapiens
ggggcctgccct

SEQ ID NO: 788729 - DNA, 19 bp, Homo sapiens
ggggcctgcgcccagagct

SEQ ID NO: 788730 - DNA, 21 bp, Homo sapiens
ggggcctgcgcccagagctgg

SEQ ID NO: 788731 - DNA, 14 bp, Homo sapiens
ggggcctggacctg

SEQ ID NO: 788732 - DNA, 13 bp, Homo sapiens
ggggcctggcttg

SEQ ID NO: 788733 - DNA, 14 bp, Homo sapiens
ggggcctggcttgc

SEQ ID NO: 788734 - DNA, 21 bp, Homo sapiens
ggggcctggcttgctccaggg

SEQ ID NO: 788735 - DNA, 13 bp, Homo sapiens
ggggcctgggaca

SEQ ID NO: 788736 - DNA, 13 bp, Homo sapiens
ggggcctgtggtg

SEQ ID NO: 788737 - DNA, 20 bp, Homo sapiens
ggggccttagggcactgggc

SEQ ID NO: 788738 - DNA, 20 bp, Homo sapiens
ggggccttgcggaagccata

SEQ ID NO: 788739 - DNA, 14 bp, Homo sapiens
ggggccttgctctg

SEQ ID NO: 788740 - DNA, 15 bp, Homo sapiens
ggggccttgctctga

SEQ ID NO: 788741 - DNA, 21 bp, Homo sapiens
ggggcgatcgcggcggagctg

SEQ ID NO: 788742 - DNA, 22 bp, Homo sapiens
ggggcgccgcaaaccacactgg

SEQ ID NO: 788743 - DNA, 13 bp, Homo sapiens
ggggcgcctggag

SEQ ID NO: 788744 - DNA, 24 bp, Homo sapiens
ggggcgctcaggacccaggccctc

SEQ ID NO: 788745 - DNA, 13 bp, Homo sapiens
ggggcgctggccc

SEQ ID NO: 788746 - DNA, 15 bp, Homo sapiens
ggggcgctggcccag

SEQ ID NO: 788747 - DNA, 17 bp, Homo sapiens
ggggcgctggcccagcc

SEQ ID NO: 788748 - DNA, 18 bp, Homo sapiens
ggggcgctggcccagccg

SEQ ID NO: 788749 - DNA, 16 bp, Homo sapiens
ggggcgctgtcctgcg

SEQ ID NO: 788750 - DNA, 13 bp, Homo sapiens
ggggcgggctcag

SEQ ID NO: 788751 - DNA, 14 bp, Homo sapiens
ggggcgggctcaga

SEQ ID NO: 788752 - DNA, 13 bp, Homo sapiens
ggggcggggactg

SEQ ID NO: 788753 - DNA, 15 bp, Homo sapiens
ggggcgggtgacgcc

SEQ ID NO: 788754 - DNA, 20 bp, Homo sapiens
ggggcgtctgttcccccttc

SEQ ID NO: 788755 - DNA, 16 bp, Homo sapiens
ggggcgtggctggcct

SEQ ID NO: 788756 - DNA, 22 bp, Homo sapiens
ggggctaaggtttccagtcaga

SEQ ID NO: 788757 - DNA, 12 bp, Homo sapiens
ggggctcctgga

SEQ ID NO: 788758 - DNA, 13 bp, Homo sapiens
ggggctcctgggt

SEQ ID NO: 788759 - DNA, 16 bp, Homo sapiens
ggggctcctgggttgg

SEQ ID NO: 788760 - DNA, 21 bp, Homo sapiens
ggggctcctgggttggaggga

SEQ ID NO: 788761 - DNA, 21 bp, Homo sapiens
ggggctcctttctccagccag

SEQ ID NO: 788762 - DNA, 22 bp, Homo sapiens
ggggctcctttctccagccagc

SEQ ID NO: 788763 - DNA, 16 bp, Homo sapiens
ggggctctcagctcag

SEQ ID NO: 788764 - DNA, 12 bp, Homo sapiens
ggggctctgccc

SEQ ID NO: 788765 - DNA, 16 bp, Homo sapiens
ggggctcttctgagca

SEQ ID NO: 788766 - DNA, 14 bp, Homo sapiens
ggggctgaggggca

SEQ ID NO: 788767 - DNA, 15 bp, Homo sapiens
ggggctgcacctcct

SEQ ID NO: 788768 - DNA, 22 bp, Homo sapiens
ggggctgcaggcaggcggctcc

SEQ ID NO: 788769 - DNA, 14 bp, Homo sapiens
ggggctgccagcct

SEQ ID NO: 788770 - DNA, 13 bp, Homo sapiens
ggggctgctccag

SEQ ID NO: 788771 - DNA, 12 bp, Homo sapiens
ggggctgctccc

SEQ ID NO: 788772 - DNA, 15 bp, Homo sapiens
ggggctgctcctcca

SEQ ID NO: 788773 - DNA, 10 bp, Homo sapiens
ggggctgctg

SEQ ID NO: 788774 - DNA, 11 bp, Homo sapiens
ggggctgctgg

SEQ ID NO: 788775 - DNA, 15 bp, Homo sapiens
ggggctgctggggca

SEQ ID NO: 788776 - DNA, 11 bp, Homo sapiens
ggggctgctgt

SEQ ID NO: 788777 - DNA, 20 bp, Homo sapiens
ggggctgctgtgtggacggc

SEQ ID NO: 788778 - DNA, 19 bp, Homo sapiens
ggggctgcttcctcctgga

SEQ ID NO: 788779 - DNA, 12 bp, Homo sapiens
ggggctggccta

SEQ ID NO: 788780 - DNA, 19 bp, Homo sapiens
ggggctggccttcctgccc

SEQ ID NO: 788781 - DNA, 12 bp, Homo sapiens
ggggctggctcc

SEQ ID NO: 788782 - DNA, 15 bp, Homo sapiens
ggggctggctcccag

SEQ ID NO: 788783 - DNA, 17 bp, Homo sapiens
ggggctggctcccaggg

SEQ ID NO: 788784 - DNA, 14 bp, Homo sapiens
ggggctggggaggg

SEQ ID NO: 788785 - DNA, 12 bp, Homo sapiens
ggggctggggca

SEQ ID NO: 788786 - DNA, 17 bp, Homo sapiens
ggggctggggcaggctc

SEQ ID NO: 788787 - DNA, 12 bp, Homo sapiens
ggggctggggga

SEQ ID NO: 788788 - DNA, 20 bp, Homo sapiens
ggggctgtcctccttcctgg

SEQ ID NO: 788789 - DNA, 13 bp, Homo sapiens
ggggctgtggccc

SEQ ID NO: 788790 - DNA, 15 bp, Homo sapiens
ggggctgtggccctg

SEQ ID NO: 788791 - DNA, 22 bp, Homo sapiens
ggggctgtggccgtctcctccc

SEQ ID NO: 788792 - DNA, 21 bp, Homo sapiens
ggggcttcaccagtctgtcta

SEQ ID NO: 788793 - DNA, 22 bp, Homo sapiens
ggggcttcttcctcacactgct

SEQ ID NO: 788794 - DNA, 15 bp, Homo sapiens
ggggctttctggaga

SEQ ID NO: 788795 - DNA, 12 bp, Homo sapiens
ggggctttgggc

SEQ ID NO: 788796 - DNA, 18 bp, Homo sapiens
ggggctttgggcccaaga

SEQ ID NO: 788797 - DNA, 22 bp, Homo sapiens
ggggctttgggcccaagaactg

SEQ ID NO: 788798 - DNA, 23 bp, Homo sapiens
ggggctttgggcccaagaactgc

SEQ ID NO: 788799 - DNA, 20 bp, Homo sapiens
gggggaaaaaaaagaaaaaa

SEQ ID NO: 788800 - DNA, 23 bp, Homo sapiens
gggggaagattttatgcacagcc

SEQ ID NO: 788801 - DNA, 17 bp, Homo sapiens
gggggaatgcacctccc

SEQ ID NO: 788802 - DNA, 16 bp, Homo sapiens
gggggacaacccccca

SEQ ID NO: 788803 - DNA, 15 bp, Homo sapiens
gggggacagagaagg

SEQ ID NO: 788804 - DNA, 14 bp, Homo sapiens
gggggacctgtccc

SEQ ID NO: 788805 - DNA, 21 bp, Homo sapiens
gggggactctgagcgggaggc

SEQ ID NO: 788806 - DNA, 19 bp, Homo sapiens
gggggactgctgctgcctg

SEQ ID NO: 788807 - DNA, 20 bp, Homo sapiens
gggggactgggagtcagagc

SEQ ID NO: 788808 - DNA, 17 bp, Homo sapiens
gggggagcagagagagc

SEQ ID NO: 788809 - DNA, 19 bp, Homo sapiens
gggggaggagtcaggggct

SEQ ID NO: 788810 - DNA, 12 bp, Homo sapiens
gggggagggaag

SEQ ID NO: 788811 - DNA, 12 bp, Homo sapiens
gggggagggagg

SEQ ID NO: 788812 - DNA, 14 bp, Homo sapiens
gggggagggggagg

SEQ ID NO: 788813 - DNA, 13 bp, Homo sapiens
gggggagtgggcg

SEQ ID NO: 788814 - DNA, 21 bp, Homo sapiens
gggggatgccactcctccctc

SEQ ID NO: 788815 - DNA, 20 bp, Homo sapiens
gggggcaagaagtagcagtg

SEQ ID NO: 788816 - DNA, 22 bp, Homo sapiens
gggggcacttggaggacctggc

SEQ ID NO: 788817 - DNA, 20 bp, Homo sapiens
gggggcatctcttccccaga

SEQ ID NO: 788818 - DNA, 22 bp, Homo sapiens
gggggcatctgagtccagctcc

SEQ ID NO: 788819 - DNA, 22 bp, Homo sapiens
gggctacagaatagggtggcag

SEQ ID NO: 788820 - DNA, 16 bp, Homo sapiens
gggctaccctgagctg

SEQ ID NO: 788821 - DNA, 19 bp, Homo sapiens
gggctaccctgagctgagg

SEQ ID NO: 788822 - DNA, 22 bp, Homo sapiens
gggctaccctgagctgaggcag

SEQ ID NO: 788823 - DNA, 20 bp, Homo sapiens
gggctactgccactgtgtgc

SEQ ID NO: 788824 - DNA, 13 bp, Homo sapiens
gggctactggcag

SEQ ID NO: 788825 - DNA, 15 bp, Homo sapiens
gggctagccctgagc

SEQ ID NO: 788826 - DNA, 22 bp, Homo sapiens
gggctagtgtgagtggcagcca

SEQ ID NO: 788827 - DNA, 15 bp, Homo sapiens
gggctatggacacag

SEQ ID NO: 788828 - DNA, 13 bp, Homo sapiens
gggctatttctct

SEQ ID NO: 788829 - DNA, 22 bp, Homo sapiens
gggctatttctctccccactga

SEQ ID NO: 788830 - DNA, 13 bp, Homo sapiens
gggctcaaagccc

SEQ ID NO: 788831 - DNA, 19 bp, Homo sapiens
gggctcaagcaatcctcct

SEQ ID NO: 788832 - DNA, 19 bp, Homo sapiens
gggctcacactcctgggct

SEQ ID NO: 788833 - DNA, 15 bp, Homo sapiens
gggctcacagggcag

SEQ ID NO: 788834 - DNA, 17 bp, Homo sapiens
gggctcacggggcctcc

SEQ ID NO: 788835 - DNA, 20 bp, Homo sapiens
gggctcactgtgctggggca

SEQ ID NO: 788836 - DNA, 21 bp, Homo sapiens
gggctcagagctttgtcactt

SEQ ID NO: 788837 - DNA, 22 bp, Homo sapiens
gggctcagagctttgtcacttg

SEQ ID NO: 788838 - DNA, 23 bp, Homo sapiens
gggctcagagctttgtcacttgc

SEQ ID NO: 788839 - DNA, 20 bp, Homo sapiens
gggctcagagtgaccctcag

SEQ ID NO: 788840 - DNA, 11 bp, Homo sapiens
gggctcagcct

SEQ ID NO: 788841 - DNA, 12 bp, Homo sapiens
gggctcagcctg

SEQ ID NO: 788842 - DNA, 13 bp, Homo sapiens
gggctcaggaaaa

SEQ ID NO: 788843 - DNA, 15 bp, Homo sapiens
gggctcagggctgga

SEQ ID NO: 788844 - DNA, 23 bp, Homo sapiens
gggctccagcaccttctttctgg

SEQ ID NO: 788845 - DNA, 16 bp, Homo sapiens
gggctccagcatccag

SEQ ID NO: 788846 - DNA, 20 bp, Homo sapiens
gggctccagcatccagcctg

SEQ ID NO: 788847 - DNA, 19 bp, Homo sapiens
gggctccatgcctctggag

SEQ ID NO: 788848 - DNA, 22 bp, Homo sapiens
gggctcccaggggtctccctgg

SEQ ID NO: 788849 - DNA, 22 bp, Homo sapiens
gggctccctaaactttggcctt

SEQ ID NO: 788850 - DNA, 11 bp, Homo sapiens
gggctccctcc

SEQ ID NO: 788851 - DNA, 13 bp, Homo sapiens
gggctccctcctc

SEQ ID NO: 788852 - DNA, 14 bp, Homo sapiens
gggctccctcctct

SEQ ID NO: 788853 - DNA, 20 bp, Homo sapiens
gggctccctcctctggcagg

SEQ ID NO: 788854 - DNA, 22 bp, Homo sapiens
gggctccctcctctggcaggct

SEQ ID NO: 788855 - DNA, 21 bp, Homo sapiens
gggctccctcctggagcatcc

SEQ ID NO: 788856 - DNA, 15 bp, Homo sapiens
gggctccctctctgg

SEQ ID NO: 788857 - DNA, 20 bp, Homo sapiens
gggctccggaggggacccag

SEQ ID NO: 788858 - DNA, 22 bp, Homo sapiens
gggctcctccagggtggcagca

SEQ ID NO: 788859 - DNA, 11 bp, Homo sapiens
gggctcctgca

SEQ ID NO: 788860 - DNA, 14 bp, Homo sapiens
gggctcctggaacc

SEQ ID NO: 788861 - DNA, 15 bp, Homo sapiens
gggctcctggctgcc

SEQ ID NO: 788862 - DNA, 16 bp, Homo sapiens
gggctcctggctgcca

SEQ ID NO: 788863 - DNA, 20 bp, Homo sapiens
gggctcctggggcagagaag

SEQ ID NO: 788864 - DNA, 21 bp, Homo sapiens
gggctcctgggggtggggagg

SEQ ID NO: 788865 - DNA, 14 bp, Homo sapiens
gggctccttcccct

SEQ ID NO: 788866 - DNA, 21 bp, Homo sapiens
gggctcctttctccagccagc

SEQ ID NO: 788867 - DNA, 21 bp, Homo sapiens
gggctcgccgtgtctcagcct

SEQ ID NO: 788868 - DNA, 16 bp, Homo sapiens
gggctcggggaggcag

SEQ ID NO: 788869 - DNA, 13 bp, Homo sapiens
gggctctacctct

SEQ ID NO: 788870 - DNA, 22 bp, Homo sapiens
gggctctatgcctgcactggga

SEQ ID NO: 788871 - DNA, 23 bp, Homo sapiens
gggctctcatgttttcaactgcc

SEQ ID NO: 788872 - DNA, 13 bp, Homo sapiens
gggctctccaaag

SEQ ID NO: 788873 - DNA, 21 bp, Homo sapiens
gggctctccacctcagccttg

SEQ ID NO: 788874 - DNA, 19 bp, Homo sapiens
gggctctctgctgtacata

SEQ ID NO: 788875 - DNA, 12 bp, Homo sapiens
gggctctgcccc

SEQ ID NO: 788876 - DNA, 21 bp, Homo sapiens
gggctctgccccagctctggc

SEQ ID NO: 788877 - DNA, 20 bp, Homo sapiens
gggctctgccccaggcccta

SEQ ID NO: 788878 - DNA, 21 bp, Homo sapiens
gggctctggacctcaggaggg

SEQ ID NO: 788879 - DNA, 23 bp, Homo sapiens
gggctctggacctcaggagggca

SEQ ID NO: 788880 - DNA, 14 bp, Homo sapiens
gggctctggccacc

SEQ ID NO: 788881 - DNA, 16 bp, Homo sapiens
gggctctggccaccct

SEQ ID NO: 788882 - DNA, 16 bp, Homo sapiens
gggctctgtgcagtca

SEQ ID NO: 788883 - DNA, 11 bp, Homo sapiens
gggctcttccc

SEQ ID NO: 788884 - DNA, 23 bp, Homo sapiens
gggctcttcccctagacctcccc

SEQ ID NO: 788885 - DNA, 18 bp, Homo sapiens
gggctgaacatgcctgcc

SEQ ID NO: 788886 - DNA, 15 bp, Homo sapiens
gggctgaatgtatgt

SEQ ID NO: 788887 - DNA, 15 bp, Homo sapiens
gggctgacacctacc

SEQ ID NO: 788888 - DNA, 22 bp, Homo sapiens
gggctgacacctaccatgctgc

SEQ ID NO: 788889 - DNA, 23 bp, Homo sapiens
gggctgacacctaccatgctgct

SEQ ID NO: 788890 - DNA, 21 bp, Homo sapiens
gggctgacccagcatctccca

SEQ ID NO: 788891 - DNA, 14 bp, Homo sapiens
gggctgagccccta

SEQ ID NO: 788892 - DNA, 17 bp, Homo sapiens
gggctgagcccctggtc

SEQ ID NO: 788893 - DNA, 15 bp, Homo sapiens
gggctgagccctggc

SEQ ID NO: 788894 - DNA, 16 bp, Homo sapiens
gggctgagccctggca

SEQ ID NO: 788895 - DNA, 19 bp, Homo sapiens
gggctgagcgtggaagggg

SEQ ID NO: 788896 - DNA, 23 bp, Homo sapiens
gggctgagcgtggaagggggagg

SEQ ID NO: 788897 - DNA, 15 bp, Homo sapiens
gggctgagctagcct

SEQ ID NO: 788898 - DNA, 13 bp, Homo sapiens
gggctgagctggg

SEQ ID NO: 788899 - DNA, 11 bp, Homo sapiens
gggctgaggaa

SEQ ID NO: 788900 - DNA, 19 bp, Homo sapiens
gggctgaggagcagccagg

SEQ ID NO: 788901 - DNA, 22 bp, Homo sapiens
gggctgaggagcagccaggacc

SEQ ID NO: 788902 - DNA, 14 bp, Homo sapiens
gggctgaggccaga

SEQ ID NO: 788903 - DNA, 17 bp, Homo sapiens
gggctgagggcctgctg

SEQ ID NO: 788904 - DNA, 17 bp, Homo sapiens
gggctgagtgacacaag

SEQ ID NO: 788905 - DNA, 20 bp, Homo sapiens
gggtctccctctcctgccta

SEQ ID NO: 788906 - DNA, 18 bp, Homo sapiens
gggtctccctggctccct

SEQ ID NO: 788907 - DNA, 12 bp, Homo sapiens
gggtctcctccc

SEQ ID NO: 788908 - DNA, 21 bp, Homo sapiens
gggtctcctcccagcggcctc

SEQ ID NO: 788909 - DNA, 13 bp, Homo sapiens
gggtctccttggc

SEQ ID NO: 788910 - DNA, 15 bp, Homo sapiens
gggtctctagtgctg

SEQ ID NO: 788911 - DNA, 20 bp, Homo sapiens
gggtctctagtgctgtgaaa

SEQ ID NO: 788912 - DNA, 21 bp, Homo sapiens
gggtctctcatttttttaatt

SEQ ID NO: 788913 - DNA, 22 bp, Homo sapiens
gggtctctctccctacctccct

SEQ ID NO: 788914 - DNA, 14 bp, Homo sapiens
gggtctctggggac

SEQ ID NO: 788915 - DNA, 15 bp, Homo sapiens
gggtctgagactgaa

SEQ ID NO: 788916 - DNA, 11 bp, Homo sapiens
gggtctgccct

SEQ ID NO: 788917 - DNA, 19 bp, Homo sapiens
gggtctgctctttctctgc

SEQ ID NO: 788918 - DNA, 19 bp, Homo sapiens
gggtctggatgggaggaga

SEQ ID NO: 788919 - DNA, 23 bp, Homo sapiens
gggtctggatgggaggagagcca

SEQ ID NO: 788920 - DNA, 22 bp, Homo sapiens
gggtctgggagggggtgagagg

SEQ ID NO: 788921 - DNA, 23 bp, Homo sapiens
gggtctgggcagcacctctggtc

SEQ ID NO: 788922 - DNA, 14 bp, Homo sapiens
gggtctgggcagtg

SEQ ID NO: 788923 - DNA, 23 bp, Homo sapiens
gggtctgggcggcgggcggctgg

SEQ ID NO: 788924 - DNA, 15 bp, Homo sapiens
gggtctgggcgtcca

SEQ ID NO: 788925 - DNA, 17 bp, Homo sapiens
gggtctgggggcagctg

SEQ ID NO: 788926 - DNA, 19 bp, Homo sapiens
gggtctgggggcagctgtc

SEQ ID NO: 788927 - DNA, 16 bp, Homo sapiens
gggtctgtctgctttg

SEQ ID NO: 788928 - DNA, 14 bp, Homo sapiens
gggtctgtgactgg

SEQ ID NO: 788929 - DNA, 18 bp, Homo sapiens
gggtctgtgactggatct

SEQ ID NO: 788930 - DNA, 19 bp, Homo sapiens
gggtctgtgactggatctt

SEQ ID NO: 788931 - DNA, 22 bp, Homo sapiens
gggtctgtgctgtgcctgctag

SEQ ID NO: 788932 - DNA, 19 bp, Homo sapiens
gggtcttgaggggaagctg

SEQ ID NO: 788933 - DNA, 18 bp, Homo sapiens
gggtcttgctctgtcccc

SEQ ID NO: 788934 - DNA, 20 bp, Homo sapiens
gggtcttgctctgtccccca

SEQ ID NO: 788935 - DNA, 21 bp, Homo sapiens
gggtcttgctctgtcccccag

SEQ ID NO: 788936 - DNA, 22 bp, Homo sapiens
gggtctttgtggtagcttatct

SEQ ID NO: 788937 - DNA, 17 bp, Homo sapiens
gggtcttttaccctgtg

SEQ ID NO: 788938 - DNA, 21 bp, Homo sapiens
gggtcttttaccctgtgtcag

SEQ ID NO: 788939 - DNA, 21 bp, Homo sapiens
gggtctttttctcttctgttc

SEQ ID NO: 788940 - DNA, 13 bp, Homo sapiens
gggtgacagtcat

SEQ ID NO: 788941 - DNA, 18 bp, Homo sapiens
gggtgacagtcatcatca

SEQ ID NO: 788942 - DNA, 22 bp, Homo sapiens
gggtgacagtcatcatcagggc

SEQ ID NO: 788943 - DNA, 18 bp, Homo sapiens
gggtgacccacagctctg

SEQ ID NO: 788944 - DNA, 14 bp, Homo sapiens
gggtgacgcctgag

SEQ ID NO: 788945 - DNA, 13 bp, Homo sapiens
gggtgacggccct

SEQ ID NO: 788946 - DNA, 13 bp, Homo sapiens
gggtgactggaag

SEQ ID NO: 788947 - DNA, 19 bp, Homo sapiens
gggtgacttccctggtcac

SEQ ID NO: 788948 - DNA, 12 bp, Homo sapiens
gggtgaggagga

SEQ ID NO: 788949 - DNA, 19 bp, Homo sapiens
gggtgataaggggccttgc

SEQ ID NO: 788950 - DNA, 22 bp, Homo sapiens
gggtgatgcttttgctgctgct

SEQ ID NO: 788951 - DNA, 16 bp, Homo sapiens
gggtgatttcagagag

SEQ ID NO: 788952 - DNA, 23 bp, Homo sapiens
gggtgattttatgatcagtgttg

SEQ ID NO: 788953 - DNA, 16 bp, Homo sapiens
gggtgcagaggctgtg

SEQ ID NO: 788954 - DNA, 13 bp, Homo sapiens
gggtgcagcccaa

SEQ ID NO: 788955 - DNA, 16 bp, Homo sapiens
gggtgcagctgggtgg

SEQ ID NO: 788956 - DNA, 15 bp, Homo sapiens
gggtgcatcctcctc

SEQ ID NO: 788957 - DNA, 21 bp, Homo sapiens
gggtgcatcctcctcagcccc

SEQ ID NO: 788958 - DNA, 24 bp, Homo sapiens
gggtgcatcctcctcagcccccag

SEQ ID NO: 788959 - DNA, 21 bp, Homo sapiens
gggtgcatttgagagaagcca

SEQ ID NO: 788960 - DNA, 21 bp, Homo sapiens
gggtgcccatttgtgatcagc

SEQ ID NO: 788961 - DNA, 12 bp, Homo sapiens
gggtgccccctc

SEQ ID NO: 788962 - DNA, 23 bp, Homo sapiens
gggtgccctctgctcaggcctcc

SEQ ID NO: 788963 - DNA, 17 bp, Homo sapiens
gggtgccctggctcctt

SEQ ID NO: 788964 - DNA, 22 bp, Homo sapiens
gggtgcctcagagcaggctcag

SEQ ID NO: 788965 - DNA, 17 bp, Homo sapiens
gggtgcctgcagcgcct

SEQ ID NO: 788966 - DNA, 22 bp, Homo sapiens
cttgctctgtcccccaggctgg

SEQ ID NO: 788967 - DNA, 17 bp, Homo sapiens
cttgctctgtctcccag

SEQ ID NO: 788968 - DNA, 20 bp, Homo sapiens
cttgctcttagattgggcca

SEQ ID NO: 788969 - DNA, 19 bp, Homo sapiens
cttgctcttcagtgggaga

SEQ ID NO: 788970 - DNA, 18 bp, Homo sapiens
cttgctgaatttcaggca

SEQ ID NO: 788971 - DNA, 14 bp, Homo sapiens
cttgctgaccccag

SEQ ID NO: 788972 - DNA, 22 bp, Homo sapiens
cttgctgaccccaggtcagccc

SEQ ID NO: 788973 - DNA, 16 bp, Homo sapiens
cttgctgaggggcagg

SEQ ID NO: 788974 - DNA, 21 bp, Homo sapiens
cttgctgatgctcctccgggt

SEQ ID NO: 788975 - DNA, 21 bp, Homo sapiens
cttgctgatggctgctagatt

SEQ ID NO: 788976 - DNA, 16 bp, Homo sapiens
cttgctgatggcttga

SEQ ID NO: 788977 - DNA, 18 bp, Homo sapiens
cttgctgatggcttgaca

SEQ ID NO: 788978 - DNA, 20 bp, Homo sapiens
cttgctgatggcttgacatg

SEQ ID NO: 788979 - DNA, 23 bp, Homo sapiens
cttgctgatggcttgacatgtgc

SEQ ID NO: 788980 - DNA, 20 bp, Homo sapiens
cttgctgcaagcacagccct

SEQ ID NO: 788981 - DNA, 23 bp, Homo sapiens
cttgctgcactcttgcacatgga

SEQ ID NO: 788982 - DNA, 19 bp, Homo sapiens
cttgctgccatgatgtata

SEQ ID NO: 788983 - DNA, 13 bp, Homo sapiens
cttgctgccctgc

SEQ ID NO: 788984 - DNA, 20 bp, Homo sapiens
cttgctgccctgccccaagt

SEQ ID NO: 788985 - DNA, 12 bp, Homo sapiens
cttgctgctgtc

SEQ ID NO: 788986 - DNA, 16 bp, Homo sapiens
cttgctgctgtgcctg

SEQ ID NO: 788987 - DNA, 12 bp, Homo sapiens
cttgctgcttta

SEQ ID NO: 788988 - DNA, 22 bp, Homo sapiens
cttgctggacggggactgggga

SEQ ID NO: 788989 - DNA, 16 bp, Homo sapiens
cttgctggattaatgt

SEQ ID NO: 788990 - DNA, 14 bp, Homo sapiens
cttgctggccccag

SEQ ID NO: 788991 - DNA, 15 bp, Homo sapiens
cttgctggccccagc

SEQ ID NO: 788992 - DNA, 16 bp, Homo sapiens
cttgctggccccagcc

SEQ ID NO: 788993 - DNA, 15 bp, Homo sapiens
cttgctggctctgag

SEQ ID NO: 788994 - DNA, 17 bp, Homo sapiens
cttgctggctctgagaa

SEQ ID NO: 788995 - DNA, 18 bp, Homo sapiens
cttgctggctctgagaat

SEQ ID NO: 788996 - DNA, 19 bp, Homo sapiens
cttgctggctctgagaatc

SEQ ID NO: 788997 - DNA, 13 bp, Homo sapiens
cttgctggggtcc

SEQ ID NO: 788998 - DNA, 18 bp, Homo sapiens
cttgctggggtccagggc

SEQ ID NO: 788999 - DNA, 21 bp, Homo sapiens
cttgctggggtccagggctgt

SEQ ID NO: 789000 - DNA, 14 bp, Homo sapiens
cttgctgtccaggc

SEQ ID NO: 789001 - DNA, 16 bp, Homo sapiens
cttgctgtccaggcag

SEQ ID NO: 789002 - DNA, 15 bp, Homo sapiens
cttgctgtcctaggc

SEQ ID NO: 789003 - DNA, 17 bp, Homo sapiens
cttgctgtcctaggcca

SEQ ID NO: 789004 - DNA, 14 bp, Homo sapiens
cttgctgtctctgc

SEQ ID NO: 789005 - DNA, 15 bp, Homo sapiens
cttgctgtctctgct

SEQ ID NO: 789006 - DNA, 15 bp, Homo sapiens
cttgctgtgaattaa

SEQ ID NO: 789007 - DNA, 19 bp, Homo sapiens
cttgctgtggggctacagg

SEQ ID NO: 789008 - DNA, 12 bp, Homo sapiens
cttgctgtgtga

SEQ ID NO: 789009 - DNA, 16 bp, Homo sapiens
cttgctgttcttgaag

SEQ ID NO: 789010 - DNA, 21 bp, Homo sapiens
cttgctgttcttgaagctggg

SEQ ID NO: 789011 - DNA, 20 bp, Homo sapiens
cttgctgtttactcccttct

SEQ ID NO: 789012 - DNA, 17 bp, Homo sapiens
cttgcttaaatttctta

SEQ ID NO: 789013 - DNA, 15 bp, Homo sapiens
cttgcttagcctgtg

SEQ ID NO: 789014 - DNA, 16 bp, Homo sapiens
cttgcttagcctgtgc

SEQ ID NO: 789015 - DNA, 17 bp, Homo sapiens
cttgcttagcctgtgct

SEQ ID NO: 789016 - DNA, 23 bp, Homo sapiens
cttgcttagtatggttctcagat

SEQ ID NO: 789017 - DNA, 15 bp, Homo sapiens
cttgcttatttgaca

SEQ ID NO: 789018 - DNA, 13 bp, Homo sapiens
cttgcttcagtgg

SEQ ID NO: 789019 - DNA, 14 bp, Homo sapiens
cttgcttcagtgga

SEQ ID NO: 789020 - DNA, 13 bp, Homo sapiens
cttgcttccctaa

SEQ ID NO: 789021 - DNA, 17 bp, Homo sapiens
cttgcttccctaatcta

SEQ ID NO: 789022 - DNA, 12 bp, Homo sapiens
cttgcttctccc

SEQ ID NO: 789023 - DNA, 19 bp, Homo sapiens
cttgcttctcccatttcct

SEQ ID NO: 789024 - DNA, 17 bp, Homo sapiens
cttgcttctcttctttc

SEQ ID NO: 789025 - DNA, 21 bp, Homo sapiens
cttgcttctcttctttccatt

SEQ ID NO: 789026 - DNA, 14 bp, Homo sapiens
cttgcttcttactg

SEQ ID NO: 789027 - DNA, 15 bp, Homo sapiens
cttgcttcttactga

SEQ ID NO: 789028 - DNA, 14 bp, Homo sapiens
cttgcttctttcta

SEQ ID NO: 789029 - DNA, 15 bp, Homo sapiens
cttgcttctttctag

SEQ ID NO: 789030 - DNA, 13 bp, Homo sapiens
cttgcttgctttt

SEQ ID NO: 789031 - DNA, 15 bp, Homo sapiens
cttgcttggaagcca

SEQ ID NO: 789032 - DNA, 17 bp, Homo sapiens
cttgcttggaagccagg

SEQ ID NO: 789033 - DNA, 18 bp, Homo sapiens
cttgcttggggaacttgt

SEQ ID NO: 789034 - DNA, 21 bp, Homo sapiens
cttgcttgttgggattcctga

SEQ ID NO: 789035 - DNA, 17 bp, Homo sapiens
cttgctttaccttttca

SEQ ID NO: 789036 - DNA, 13 bp, Homo sapiens
cttgctttcaatt

SEQ ID NO: 789037 - DNA, 13 bp, Homo sapiens
cttgctttcacat

SEQ ID NO: 789038 - DNA, 16 bp, Homo sapiens
cttgctttcctgggcc

SEQ ID NO: 789039 - DNA, 17 bp, Homo sapiens
cttgctttcctgggcct

SEQ ID NO: 789040 - DNA, 19 bp, Homo sapiens
cttgctttcctgggccttt

SEQ ID NO: 789041 - DNA, 11 bp, Homo sapiens
cttgctttcta

SEQ ID NO: 789042 - DNA, 17 bp, Homo sapiens
cttgctttcttctttcc

SEQ ID NO: 789043 - DNA, 13 bp, Homo sapiens
cttgctttcttta

SEQ ID NO: 789044 - DNA, 22 bp, Homo sapiens
cttgctttcttttttaaaatca

SEQ ID NO: 789045 - DNA, 21 bp, Homo sapiens
cttgctttgatttacagcaag

SEQ ID NO: 789046 - DNA, 12 bp, Homo sapiens
cttgctttgggc

SEQ ID NO: 789047 - DNA, 15 bp, Homo sapiens
cttgctttgggcttt

SEQ ID NO: 789048 - DNA, 21 bp, Homo sapiens
cttgctttgggctttgcaggc

SEQ ID NO: 789049 - DNA, 21 bp, Homo sapiens
cttgctttggggggtgtgctg

SEQ ID NO: 789050 - DNA, 18 bp, Homo sapiens
cttgctttgtctggcctc

SEQ ID NO: 789051 - DNA, 19 bp, Homo sapiens
cttgctttgtctggcctca

SEQ ID NO: 789052 - DNA, 21 bp, Homo sapiens
cttgctttgtctggcctcacg

SEQ ID NO: 789053 - DNA, 15 bp, Homo sapiens
cttgcttttccctct

SEQ ID NO: 789054 - DNA, 16 bp, Homo sapiens
cttgcttttccctctt

SEQ ID NO: 789055 - DNA, 20 bp, Homo sapiens
cttgcttttccctcttttct

SEQ ID NO: 789056 - DNA, 22 bp, Homo sapiens
cttgcttttccctcttttctta

SEQ ID NO: 789057 - DNA, 17 bp, Homo sapiens
cttgcttttctgtattt

SEQ ID NO: 789058 - DNA, 14 bp, Homo sapiens
cttgcttttctttt

SEQ ID NO: 789059 - DNA, 23 bp, Homo sapiens
cttgctttttgcccgttgaccag

SEQ ID NO: 789060 - DNA, 20 bp, Homo sapiens
cttgcttttttgaaagatgc

SEQ ID NO: 789061 - DNA, 15 bp, Homo sapiens
cttggaaacctgccc

SEQ ID NO: 789062 - DNA, 17 bp, Homo sapiens
cttggaaacctgccctg

SEQ ID NO: 789063 - DNA, 20 bp, Homo sapiens
cttggaaacctgccctgcct

SEQ ID NO: 789064 - DNA, 21 bp, Homo sapiens
cttggaaagaaacaaccgttg

SEQ ID NO: 789065 - DNA, 23 bp, Homo sapiens
cttggaaagcatcacctcaggcc

SEQ ID NO: 789066 - DNA, 17 bp, Homo sapiens
cttggaaatagaaagaa

SEQ ID NO: 789067 - DNA, 21 bp, Homo sapiens
cttggaaatagaaagaagcca

SEQ ID NO: 789068 - DNA, 17 bp, Homo sapiens
cttggaaatcaggtaga

SEQ ID NO: 789069 - DNA, 16 bp, Homo sapiens
cttggaaccagcccca

SEQ ID NO: 789070 - DNA, 16 bp, Homo sapiens
cttggaagaggaggag

SEQ ID NO: 789071 - DNA, 19 bp, Homo sapiens
cttggaagattctatttaa

SEQ ID NO: 789072 - DNA, 16 bp, Homo sapiens
cttggaagctgtttgg

SEQ ID NO: 789073 - DNA, 19 bp, Homo sapiens
cttggaagctgtttggaaa

SEQ ID NO: 789074 - DNA, 20 bp, Homo sapiens
cttggaagctgtttggaaaa

SEQ ID NO: 789075 - DNA, 12 bp, Homo sapiens
cttggaagggcg

SEQ ID NO: 789076 - DNA, 21 bp, Homo sapiens
cttggaagggcgttctaggta

SEQ ID NO: 789077 - DNA, 22 bp, Homo sapiens
cttggaagggcgttctaggtag

SEQ ID NO: 789078 - DNA, 21 bp, Homo sapiens
cttggaagtttcatatattgt

SEQ ID NO: 789079 - DNA, 20 bp, Homo sapiens
cttggaatttgtaacctcag

SEQ ID NO: 789080 - DNA, 15 bp, Homo sapiens
cttggacaacagctc

SEQ ID NO: 789081 - DNA, 13 bp, Homo sapiens
cttggacacttgg

SEQ ID NO: 789082 - DNA, 16 bp, Homo sapiens
cttggacatcctcctc

SEQ ID NO: 789083 - DNA, 21 bp, Homo sapiens
cttggacatcctcctcccacc

SEQ ID NO: 789084 - DNA, 22 bp, Homo sapiens
cttggacatcctcctcccaccc

SEQ ID NO: 789085 - DNA, 17 bp, Homo sapiens
cttggacatctctctgg

SEQ ID NO: 789086 - DNA, 18 bp, Homo sapiens
cttggacatctctctggc

SEQ ID NO: 789087 - DNA, 23 bp, Homo sapiens
cttggacatctctctggcttctg

SEQ ID NO: 789088 - DNA, 16 bp, Homo sapiens
cttggaccactcctgt

SEQ ID NO: 789089 - DNA, 14 bp, Homo sapiens
cttggaccctggtg

SEQ ID NO: 789090 - DNA, 15 bp, Homo sapiens
cttggacccttggaa

SEQ ID NO: 789091 - DNA, 14 bp, Homo sapiens
cttggacctccagg

SEQ ID NO: 789092 - DNA, 16 bp, Homo sapiens
cttggacctccagggg

SEQ ID NO: 789093 - DNA, 24 bp, Homo sapiens
cttggacctccaggggctcctggg

SEQ ID NO: 789094 - DNA, 12 bp, Homo sapiens
cttggacctctg

SEQ ID NO: 789095 - DNA, 14 bp, Homo sapiens
cttggacctctgct

SEQ ID NO: 789096 - DNA, 15 bp, Homo sapiens
cttggacctctgctc

SEQ ID NO: 789097 - DNA, 16 bp, Homo sapiens
cttggacctctgctct

SEQ ID NO: 789098 - DNA, 22 bp, Homo sapiens
cttggactattataatttaatg

SEQ ID NO: 789099 - DNA, 13 bp, Homo sapiens
cttggactcctcc

SEQ ID NO: 789100 - DNA, 14 bp, Homo sapiens
cttggactcctccc

SEQ ID NO: 789101 - DNA, 16 bp, Homo sapiens
cttggactcctcccac

SEQ ID NO: 789102 - DNA, 16 bp, Homo sapiens
cttggagaactcggtt

SEQ ID NO: 789103 - DNA, 19 bp, Homo sapiens
cttggagaagtctcagcta

SEQ ID NO: 789104 - DNA, 14 bp, Homo sapiens
cttggagactcctg

SEQ ID NO: 789105 - DNA, 20 bp, Homo sapiens
cttggagactcctggtctgt

SEQ ID NO: 789106 - DNA, 21 bp, Homo sapiens
cttggagagagaggctgcctc

SEQ ID NO: 789107 - DNA, 14 bp, Homo sapiens
cttggagagcaaag

SEQ ID NO: 789108 - DNA, 16 bp, Homo sapiens
cttggagagcaaaggc

SEQ ID NO: 789109 - DNA, 22 bp, Homo sapiens
cttggagagcaaaggcccatgc

SEQ ID NO: 789110 - DNA, 13 bp, Homo sapiens
cttggagagcagc

SEQ ID NO: 789111 - DNA, 22 bp, Homo sapiens
cttggagagcagctggctctcc

SEQ ID NO: 789112 - DNA, 21 bp, Homo sapiens
cttggagaggagagtggcagg

SEQ ID NO: 789113 - DNA, 14 bp, Homo sapiens
cttggagatggcag

SEQ ID NO: 789114 - DNA, 15 bp, Homo sapiens
cttggagcccgtgca

SEQ ID NO: 789115 - DNA, 22 bp, Homo sapiens
cttggagcctctttttccttct

SEQ ID NO: 789116 - DNA, 17 bp, Homo sapiens
cttggagcgtggactgg

SEQ ID NO: 789117 - DNA, 12 bp, Homo sapiens
cttggagctgag

SEQ ID NO: 789118 - DNA, 15 bp, Homo sapiens
cttggagctgagcct

SEQ ID NO: 789119 - DNA, 21 bp, Homo sapiens
cttggagctgagcctctcacc

SEQ ID NO: 789120 - DNA, 22 bp, Homo sapiens
cttggagctgccgtgcctgtgt

SEQ ID NO: 789121 - DNA, 17 bp, Homo sapiens
cttggagctttggaata

SEQ ID NO: 789122 - DNA, 23 bp, Homo sapiens
cttggaggaagtatgagtgctga

SEQ ID NO: 789123 - DNA, 21 bp, Homo sapiens
cttggagggagaggtggcagg

SEQ ID NO: 789124 - DNA, 23 bp, Homo sapiens
cttggagggagaggtggcaggaa

SEQ ID NO: 789125 - DNA, 15 bp, Homo sapiens
cttggagggtctggg

SEQ ID NO: 789126 - DNA, 16 bp, Homo sapiens
cttggagggtctgggg

SEQ ID NO: 789127 - DNA, 18 bp, Homo sapiens
cttggagggtctgggggc

SEQ ID NO: 789128 - DNA, 21 bp, Homo sapiens
cttggagggtctgggggcagc

SEQ ID NO: 789129 - DNA, 16 bp, Homo sapiens
cttggagtagacaaaa

SEQ ID NO: 789130 - DNA, 22 bp, Homo sapiens
cttggagtattggggtctgacc

SEQ ID NO: 789131 - DNA, 14 bp, Homo sapiens
cttggagtggccaa

SEQ ID NO: 789132 - DNA, 22 bp, Homo sapiens
cttggagtttttcattgtcgct

SEQ ID NO: 789133 - DNA, 18 bp, Homo sapiens
cttggataatgctgttgc

SEQ ID NO: 789134 - DNA, 22 bp, Homo sapiens
cttggataatgctgttgcctca

SEQ ID NO: 789135 - DNA, 16 bp, Homo sapiens
cttggatcctgggctg

SEQ ID NO: 789136 - DNA, 17 bp, Homo sapiens
cttggatcctgggctgg

SEQ ID NO: 789137 - DNA, 14 bp, Homo sapiens
cttggatgcagtgc

SEQ ID NO: 789138 - DNA, 18 bp, Homo sapiens
cttggatgtacctgcccc

SEQ ID NO: 789139 - DNA, 18 bp, Homo sapiens
cttggcaaattttaaaac

SEQ ID NO: 789140 - DNA, 20 bp, Homo sapiens
cttggcaacagaagcagttg

SEQ ID NO: 789141 - DNA, 14 bp, Homo sapiens
cttggcacccccat

SEQ ID NO: 789142 - DNA, 17 bp, Homo sapiens
cttggcacccccatgct

SEQ ID NO: 789143 - DNA, 12 bp, Homo sapiens
cttggcacttaa

SEQ ID NO: 789144 - DNA, 21 bp, Homo sapiens
cttggcacttaagtgcacttt

SEQ ID NO: 789145 - DNA, 18 bp, Homo sapiens
cttggcagccgagctcgt

SEQ ID NO: 789146 - DNA, 15 bp, Homo sapiens
cttggcagctgaact

SEQ ID NO: 789147 - DNA, 23 bp, Homo sapiens
cttggcagcttaacattgacttc

SEQ ID NO: 789148 - DNA, 13 bp, Homo sapiens
cttggcagctttt

SEQ ID NO: 789149 - DNA, 15 bp, Homo sapiens
cttggcagctttttc

SEQ ID NO: 789150 - DNA, 18 bp, Homo sapiens
cttggcagctttttctgt

SEQ ID NO: 789151 - DNA, 20 bp, Homo sapiens
cttggcagctttttctgtgg

SEQ ID NO: 789152 - DNA, 18 bp, Homo sapiens
cttggcatcacagggcag

SEQ ID NO: 789153 - DNA, 22 bp, Homo sapiens
cttggcatcacagggcagagcc

SEQ ID NO: 789154 - DNA, 16 bp, Homo sapiens
cttggcatctgtgtgc

SEQ ID NO: 789155 - DNA, 17 bp, Homo sapiens
cttggcatctgtgtgcg

SEQ ID NO: 789156 - DNA, 20 bp, Homo sapiens
cttggcatgggcgcaggccc

SEQ ID NO: 789157 - DNA, 22 bp, Homo sapiens
cttggcatgggcgcaggcccag

SEQ ID NO: 789158 - DNA, 19 bp, Homo sapiens
cttggcatttctatacttt

SEQ ID NO: 789159 - DNA, 14 bp, Homo sapiens
cttggccacagact

SEQ ID NO: 789160 - DNA, 16 bp, Homo sapiens
cttggcccaggagctc

SEQ ID NO: 789161 - DNA, 17 bp, Homo sapiens
cttggcccaggagctct

SEQ ID NO: 789162 - DNA, 19 bp, Homo sapiens
cttggcccaggagctctgc

SEQ ID NO: 789163 - DNA, 24 bp, Homo sapiens
cttggcccaggagctctgcgccag

SEQ ID NO: 789164 - DNA, 16 bp, Homo sapiens
cttggccccagacgca

SEQ ID NO: 789165 - DNA, 21 bp, Homo sapiens
cttggcccctccctcccggct

SEQ ID NO: 789166 - DNA, 14 bp, Homo sapiens
cttggccctctcct

SEQ ID NO: 789167 - DNA, 15 bp, Homo sapiens
cttggccctttcctt

SEQ ID NO: 789168 - DNA, 21 bp, Homo sapiens
cttggccggctgtgctcagag

SEQ ID NO: 789169 - DNA, 16 bp, Homo sapiens
cttggcctcccaaagt

SEQ ID NO: 789170 - DNA, 15 bp, Homo sapiens
cttggcctgctgtga

SEQ ID NO: 789171 - DNA, 17 bp, Homo sapiens
cttggcctgtctcatcc

SEQ ID NO: 789172 - DNA, 10 bp, Homo sapiens
cttggccttg

SEQ ID NO: 789173 - DNA, 13 bp, Homo sapiens
cttggccttggca

SEQ ID NO: 789174 - DNA, 17 bp, Homo sapiens
cttggccttgggccggt

SEQ ID NO: 789175 - DNA, 21 bp, Homo sapiens
cttggcgtggagccagggagc

SEQ ID NO: 789176 - DNA, 24 bp, Homo sapiens
cttggctcactgcaacttctgcct

SEQ ID NO: 789177 - DNA, 16 bp, Homo sapiens
cttggctcagacatgt

SEQ ID NO: 789178 - DNA, 19 bp, Homo sapiens
cttggctcgaatctctgtg

SEQ ID NO: 789179 - DNA, 21 bp, Homo sapiens
cttggctcgaatctctgtgcc

SEQ ID NO: 789180 - DNA, 22 bp, Homo sapiens
cttggctcgaatctctgtgcct

SEQ ID NO: 789181 - DNA, 23 bp, Homo sapiens
cttggctcgatgctgtgggggac

SEQ ID NO: 789182 - DNA, 16 bp, Homo sapiens
cttggctcgttctctt

SEQ ID NO: 789183 - DNA, 16 bp, Homo sapiens
cttggctcttggcttc

SEQ ID NO: 789184 - DNA, 17 bp, Homo sapiens
cttggctcttggcttcc

SEQ ID NO: 789185 - DNA, 19 bp, Homo sapiens
cttggctcttggcttccag

SEQ ID NO: 789186 - DNA, 17 bp, Homo sapiens
cttggctgactggggct

SEQ ID NO: 789187 - DNA, 21 bp, Homo sapiens
cttggctgcagccatcccgct

SEQ ID NO: 789188 - DNA, 15 bp, Homo sapiens
cttggctgcaggcaa

SEQ ID NO: 789189 - DNA, 13 bp, Homo sapiens
cttggctgctcac

SEQ ID NO: 789190 - DNA, 13 bp, Homo sapiens
cttggctggaatt

SEQ ID NO: 789191 - DNA, 13 bp, Homo sapiens
cttggctgggcct

SEQ ID NO: 789192 - DNA, 13 bp, Homo sapiens
cttggctggggag

SEQ ID NO: 789193 - DNA, 16 bp, Homo sapiens
cttggctggggaggac

SEQ ID NO: 789194 - DNA, 19 bp, Homo sapiens
cttggctggggaggaccag

SEQ ID NO: 789195 - DNA, 18 bp, Homo sapiens
cttggctgtccttcccct

SEQ ID NO: 789196 - DNA, 19 bp, Homo sapiens
cttggctgtccttcccctt

SEQ ID NO: 789197 - DNA, 19 bp, Homo sapiens
cttggcttacctgacctct

SEQ ID NO: 789198 - DNA, 24 bp, Homo sapiens
cttggcttacctgacctcttgctg

SEQ ID NO: 789199 - DNA, 15 bp, Homo sapiens
cttggcttcagactc

SEQ ID NO: 789200 - DNA, 20 bp, Homo sapiens
cttggcttcaggggagtccc

SEQ ID NO: 789201 - DNA, 19 bp, Homo sapiens
cttggcttccagaaggcag

SEQ ID NO: 789202 - DNA, 21 bp, Homo sapiens
cttggcttccagaaggcagca

SEQ ID NO: 789203 - DNA, 23 bp, Homo sapiens
cttggcttcctccgtccacccag

SEQ ID NO: 789204 - DNA, 18 bp, Homo sapiens
cttggcttctcagcccct

SEQ ID NO: 789205 - DNA, 19 bp, Homo sapiens
cttggcttctcagcccctt

SEQ ID NO: 789206 - DNA, 17 bp, Homo sapiens
cttggcttcttaaaaac

SEQ ID NO: 789207 - DNA, 17 bp, Homo sapiens
cttggcttgcctggtgg

SEQ ID NO: 789208 - DNA, 20 bp, Homo sapiens
cttggcttggaagattctat

SEQ ID NO: 789209 - DNA, 11 bp, Homo sapiens
cttgggaaata

SEQ ID NO: 789210 - DNA, 12 bp, Homo sapiens
cttgggaaatat

SEQ ID NO: 789211 - DNA, 19 bp, Homo sapiens
cttgggaaatatgaatgcc

SEQ ID NO: 789212 - DNA, 18 bp, Homo sapiens
cttgggaaatttttaatg

SEQ ID NO: 789213 - DNA, 16 bp, Homo sapiens
cttgggaactccactc

SEQ ID NO: 789214 - DNA, 22 bp, Homo sapiens
cttgggaagctgaggcgggaga

SEQ ID NO: 789215 - DNA, 22 bp, Homo sapiens
cttgtgcttggtggggctcgtg

SEQ ID NO: 789216 - DNA, 23 bp, Homo sapiens
cttgtgctttgctcttgtcccac

SEQ ID NO: 789217 - DNA, 18 bp, Homo sapiens
cttgtggaattgggagct

SEQ ID NO: 789218 - DNA, 16 bp, Homo sapiens
cttgtggactggctgt

SEQ ID NO: 789219 - DNA, 17 bp, Homo sapiens
cttgtggactggctgtg

SEQ ID NO: 789220 - DNA, 16 bp, Homo sapiens
cttgtggataagggag

SEQ ID NO: 789221 - DNA, 20 bp, Homo sapiens
cttgtggccccttttacttt

SEQ ID NO: 789222 - DNA, 23 bp, Homo sapiens
cttgtggccttttttataactaa

SEQ ID NO: 789223 - DNA, 18 bp, Homo sapiens
cttgtgggagacagcagc

SEQ ID NO: 789224 - DNA, 19 bp, Homo sapiens
cttgtgggagacagcagcc

SEQ ID NO: 789225 - DNA, 20 bp, Homo sapiens
cttgtgggagacagcagcct

SEQ ID NO: 789226 - DNA, 22 bp, Homo sapiens
cttgtgggcaaaggcagggcca

SEQ ID NO: 789227 - DNA, 15 bp, Homo sapiens
cttgtgggctggtgc

SEQ ID NO: 789228 - DNA, 16 bp, Homo sapiens
cttgtgggtccatgct

SEQ ID NO: 789229 - DNA, 18 bp, Homo sapiens
cttgtggttctctttttg

SEQ ID NO: 789230 - DNA, 13 bp, Homo sapiens
cttgtgtagattt

SEQ ID NO: 789231 - DNA, 17 bp, Homo sapiens
cttgtgtagatttgaaa

SEQ ID NO: 789232 - DNA, 12 bp, Homo sapiens
cttgtgtatatg

SEQ ID NO: 789233 - DNA, 14 bp, Homo sapiens
cttgtgtcagagct

SEQ ID NO: 789234 - DNA, 19 bp, Homo sapiens
cttgtgtcctgtcctttct

SEQ ID NO: 789235 - DNA, 15 bp, Homo sapiens
cttgtgtctctgtgc

SEQ ID NO: 789236 - DNA, 23 bp, Homo sapiens
cttgtgtctttggaggtgctgct

SEQ ID NO: 789237 - DNA, 20 bp, Homo sapiens
cttgtgtgtgccctgggcca

SEQ ID NO: 789238 - DNA, 20 bp, Homo sapiens
cttgtgtgtgggctgtgagt

SEQ ID NO: 789239 - DNA, 21 bp, Homo sapiens
cttgtgtgtgggctgtgagtg

SEQ ID NO: 789240 - DNA, 19 bp, Homo sapiens
cttgtgtgttttgagagta

SEQ ID NO: 789241 - DNA, 17 bp, Homo sapiens
cttgtgtttgcttaaac

SEQ ID NO: 789242 - DNA, 14 bp, Homo sapiens
cttgtgttttgtcc

SEQ ID NO: 789243 - DNA, 17 bp, Homo sapiens
cttgttaatgctttctg

SEQ ID NO: 789244 - DNA, 20 bp, Homo sapiens
cttgttaatgtcattgctaa

SEQ ID NO: 789245 - DNA, 21 bp, Homo sapiens
cttgttacaaattttttaatt

SEQ ID NO: 789246 - DNA, 13 bp, Homo sapiens
cttgttactgctg

SEQ ID NO: 789247 - DNA, 17 bp, Homo sapiens
cttgttacttctgaggt

SEQ ID NO: 789248 - DNA, 13 bp, Homo sapiens
cttgttagaaaac

SEQ ID NO: 789249 - DNA, 14 bp, Homo sapiens
cttgttagaatctg

SEQ ID NO: 789250 - DNA, 14 bp, Homo sapiens
cttgttagagagaa

SEQ ID NO: 789251 - DNA, 18 bp, Homo sapiens
cttgttattaatgtttct

SEQ ID NO: 789252 - DNA, 14 bp, Homo sapiens
cttgttattgtgaa

SEQ ID NO: 789253 - DNA, 17 bp, Homo sapiens
cttgttattgtgaatga

SEQ ID NO: 789254 - DNA, 16 bp, Homo sapiens
cttgttcatcatccag

SEQ ID NO: 789255 - DNA, 22 bp, Homo sapiens
cttgttcatcatccagatgtgg

SEQ ID NO: 789256 - DNA, 17 bp, Homo sapiens
cttgttcatggagagct

SEQ ID NO: 789257 - DNA, 13 bp, Homo sapiens
cttgttcatttgg

SEQ ID NO: 789258 - DNA, 13 bp, Homo sapiens
cttgttccagctc

SEQ ID NO: 789259 - DNA, 20 bp, Homo sapiens
cttgttctatttttcaatca

SEQ ID NO: 789260 - DNA, 14 bp, Homo sapiens
cttgttctgttcct

SEQ ID NO: 789261 - DNA, 19 bp, Homo sapiens
cttgttcttggttcctgtt

SEQ ID NO: 789262 - DNA, 14 bp, Homo sapiens
ctttcaaatttcac

SEQ ID NO: 789263 - DNA, 23 bp, Homo sapiens
ctttcaagcagtcgtgcctgtgt

SEQ ID NO: 789264 - DNA, 20 bp, Homo sapiens
ctttcaagtctgactctcca

SEQ ID NO: 789265 - DNA, 22 bp, Homo sapiens
ctttcaataaatgtatcatttt

SEQ ID NO: 789266 - DNA, 16 bp, Homo sapiens
ctttcacaaaaaagaa

SEQ ID NO: 789267 - DNA, 14 bp, Homo sapiens
ctttcacaaccttc

SEQ ID NO: 789268 - DNA, 16 bp, Homo sapiens
ctttcacaaccttctg

SEQ ID NO: 789269 - DNA, 21 bp, Homo sapiens
ctttcacaagcaacagactct

SEQ ID NO: 789270 - DNA, 13 bp, Homo sapiens
ctttcacagctcc

SEQ ID NO: 789271 - DNA, 18 bp, Homo sapiens
ctttcacagctcctccca

SEQ ID NO: 789272 - DNA, 23 bp, Homo sapiens
ctttcaccacatggccttgcctc

SEQ ID NO: 789273 - DNA, 17 bp, Homo sapiens
ctttcaccctcatgaaa

SEQ ID NO: 789274 - DNA, 18 bp, Homo sapiens
ctttcactggaatgaaga

SEQ ID NO: 789275 - DNA, 15 bp, Homo sapiens
ctttcacttcttcct

SEQ ID NO: 789276 - DNA, 16 bp, Homo sapiens
ctttcacttcttccta

SEQ ID NO: 789277 - DNA, 19 bp, Homo sapiens
ctttcagagccagcctggc

SEQ ID NO: 789278 - DNA, 22 bp, Homo sapiens
ctttcagagccagcctggctct

SEQ ID NO: 789279 - DNA, 14 bp, Homo sapiens
ctttcagagccagt

SEQ ID NO: 789280 - DNA, 18 bp, Homo sapiens
ctttcagagccagtgaag

SEQ ID NO: 789281 - DNA, 18 bp, Homo sapiens
ctttcagagcccccagcc

SEQ ID NO: 789282 - DNA, 22 bp, Homo sapiens
ctttcagatgtcttctgcctgt

SEQ ID NO: 789283 - DNA, 22 bp, Homo sapiens
ctttcagctcatttaatcccag

SEQ ID NO: 789284 - DNA, 19 bp, Homo sapiens
ctttcagctgtgtctgaca

SEQ ID NO: 789285 - DNA, 20 bp, Homo sapiens
ctttcagggaatttcaggaa

SEQ ID NO: 789286 - DNA, 21 bp, Homo sapiens
ctttcaggggggttgtgaggc

SEQ ID NO: 789287 - DNA, 17 bp, Homo sapiens
ctttcaggtccaggcca

SEQ ID NO: 789288 - DNA, 21 bp, Homo sapiens
ctttcagtacttttttaaata

SEQ ID NO: 789289 - DNA, 17 bp, Homo sapiens
ctttcagtgcagtttct

SEQ ID NO: 789290 - DNA, 22 bp, Homo sapiens
ctttcagtgcagtttcttttca

SEQ ID NO: 789291 - DNA, 18 bp, Homo sapiens
ctttcataccacttgaat

SEQ ID NO: 789292 - DNA, 19 bp, Homo sapiens
ctttcatagagaggcctgc

SEQ ID NO: 789293 - DNA, 23 bp, Homo sapiens
ctttcatatagttagctaataaa

SEQ ID NO: 789294 - DNA, 17 bp, Homo sapiens
ctttcatccactagtgc

SEQ ID NO: 789295 - DNA, 21 bp, Homo sapiens
ctttcatctctctacctccac

SEQ ID NO: 789296 - DNA, 16 bp, Homo sapiens
ctttcatcttaaacta

SEQ ID NO: 789297 - DNA, 19 bp, Homo sapiens
ctttcatgaccactgggcc

SEQ ID NO: 789298 - DNA, 21 bp, Homo sapiens
ctttcatgaccactgggcctg

SEQ ID NO: 789299 - DNA, 19 bp, Homo sapiens
ctttcatgtaaactgtgca

SEQ ID NO: 789300 - DNA, 21 bp, Homo sapiens
ctttcatgtaaactgtgcacc

SEQ ID NO: 789301 - DNA, 17 bp, Homo sapiens
ctttcatgtcttgtcat

SEQ ID NO: 789302 - DNA, 20 bp, Homo sapiens
ctttcattaggcaaagtaca

SEQ ID NO: 789303 - DNA, 17 bp, Homo sapiens
ctttcattcggtgtgaa

SEQ ID NO: 789304 - DNA, 19 bp, Homo sapiens
ctttcattcggtgtgaact

SEQ ID NO: 789305 - DNA, 15 bp, Homo sapiens
ctttcattcttctca

SEQ ID NO: 789306 - DNA, 15 bp, Homo sapiens
ctttcattgctaaga

SEQ ID NO: 789307 - DNA, 22 bp, Homo sapiens
ctttcattttaaactcctgaaa

SEQ ID NO: 789308 - DNA, 10 bp, Homo sapiens
ctttccaaat

SEQ ID NO: 789309 - DNA, 18 bp, Homo sapiens
ctttccaaatgcccagct

SEQ ID NO: 789310 - DNA, 22 bp, Homo sapiens
ctttccaaatgcccagcttaaa

SEQ ID NO: 789311 - DNA, 13 bp, Homo sapiens
ctttccaaattat

SEQ ID NO: 789312 - DNA, 15 bp, Homo sapiens
ctttccaaattattt

SEQ ID NO: 789313 - DNA, 14 bp, Homo sapiens
ctttccaagcttgg

SEQ ID NO: 789314 - DNA, 15 bp, Homo sapiens
ctttccaatagaaag

SEQ ID NO: 789315 - DNA, 22 bp, Homo sapiens
ctttccaatagaaagaaactaa

SEQ ID NO: 789316 - DNA, 18 bp, Homo sapiens
ctttccacatttgtcaca

SEQ ID NO: 789317 - DNA, 19 bp, Homo sapiens
ctttccacatttgtcacag

SEQ ID NO: 789318 - DNA, 23 bp, Homo sapiens
ctttccaccacagccagcacctg

SEQ ID NO: 789319 - DNA, 14 bp, Homo sapiens
ctttccaccccctc

SEQ ID NO: 789320 - DNA, 17 bp, Homo sapiens
ctttccaccctattccc

SEQ ID NO: 789321 - DNA, 15 bp, Homo sapiens
ctttccactctggat

SEQ ID NO: 789322 - DNA, 20 bp, Homo sapiens
ctttccacttcttcctttct

SEQ ID NO: 789323 - DNA, 21 bp, Homo sapiens
ctttccactttgttggccctt

SEQ ID NO: 789324 - DNA, 23 bp, Homo sapiens
ctttccactttgttggcccttcc

SEQ ID NO: 789325 - DNA, 13 bp, Homo sapiens
ctttccagacaga

SEQ ID NO: 789326 - DNA, 15 bp, Homo sapiens
ctttccagagaactg

SEQ ID NO: 789327 - DNA, 18 bp, Homo sapiens
ctttccagcctcctgctg

SEQ ID NO: 789328 - DNA, 16 bp, Homo sapiens
ctttccagcttagaat

SEQ ID NO: 789329 - DNA, 19 bp, Homo sapiens
ctttccaggagacatatat

SEQ ID NO: 789330 - DNA, 21 bp, Homo sapiens
ctttccaggagacatatatag

SEQ ID NO: 789331 - DNA, 19 bp, Homo sapiens
ctttccaggcaccctcagg

SEQ ID NO: 789332 - DNA, 21 bp, Homo sapiens
ctttccaggcttccctgactt

SEQ ID NO: 789333 - DNA, 16 bp, Homo sapiens
ctttccagggttattt

SEQ ID NO: 789334 - DNA, 22 bp, Homo sapiens
ctttccatgggagccagctgct

SEQ ID NO: 789335 - DNA, 24 bp, Homo sapiens
ctttccatgggagccagctgcttt

SEQ ID NO: 789336 - DNA, 15 bp, Homo sapiens
ctttccatgggcccg

SEQ ID NO: 789337 - DNA, 15 bp, Homo sapiens
ctttccattcttctt

SEQ ID NO: 789338 - DNA, 18 bp, Homo sapiens
ctttccattggatctcat

SEQ ID NO: 789339 - DNA, 14 bp, Homo sapiens
ctttcccaaatgta

SEQ ID NO: 789340 - DNA, 16 bp, Homo sapiens
ctttcccaccattcct

SEQ ID NO: 789341 - DNA, 21 bp, Homo sapiens
ctttcccaccattcctgcctt

SEQ ID NO: 789342 - DNA, 22 bp, Homo sapiens
ctttcccaccctccacctctca

SEQ ID NO: 789343 - DNA, 13 bp, Homo sapiens
ctttcccaggaga

SEQ ID NO: 789344 - DNA, 15 bp, Homo sapiens
ctttcccagtctgtc

SEQ ID NO: 789345 - DNA, 23 bp, Homo sapiens
ctttccccaattacagggtgact

SEQ ID NO: 789346 - DNA, 15 bp, Homo sapiens
ctttccccagaggct

SEQ ID NO: 789347 - DNA, 15 bp, Homo sapiens
ctttcccccctcaca

SEQ ID NO: 789348 - DNA, 14 bp, Homo sapiens
ctttcccccttccc

SEQ ID NO: 789349 - DNA, 16 bp, Homo sapiens
ctttcccctcagagct

SEQ ID NO: 789350 - DNA, 14 bp, Homo sapiens
ctttcccctgtggg

SEQ ID NO: 789351 - DNA, 17 bp, Homo sapiens
ctttcccctgtggggat

SEQ ID NO: 789352 - DNA, 14 bp, Homo sapiens
ctttccctagaaag

SEQ ID NO: 789353 - DNA, 18 bp, Homo sapiens
ctttccctcaccccctcc

SEQ ID NO: 789354 - DNA, 19 bp, Homo sapiens
cttttaattgtttcagaat

SEQ ID NO: 789355 - DNA, 20 bp, Homo sapiens
cttttacagaatgcattaaa

SEQ ID NO: 789356 - DNA, 22 bp, Homo sapiens
cttttacagaatgcattaaaaa

SEQ ID NO: 789357 - DNA, 13 bp, Homo sapiens
cttttacatactg

SEQ ID NO: 789358 - DNA, 14 bp, Homo sapiens
cttttacatactgc

SEQ ID NO: 789359 - DNA, 17 bp, Homo sapiens
cttttacatactgctgt

SEQ ID NO: 789360 - DNA, 19 bp, Homo sapiens
cttttaccactatttaagt

SEQ ID NO: 789361 - DNA, 15 bp, Homo sapiens
cttttaccactccca

SEQ ID NO: 789362 - DNA, 16 bp, Homo sapiens
cttttaccactcccag

SEQ ID NO: 789363 - DNA, 14 bp, Homo sapiens
cttttaccctgtgt

SEQ ID NO: 789364 - DNA, 21 bp, Homo sapiens
cttttaccctgtgtcagagcc

SEQ ID NO: 789365 - DNA, 23 bp, Homo sapiens
cttttaccgttggggcccttaac

SEQ ID NO: 789366 - DNA, 14 bp, Homo sapiens
cttttactctgcct

SEQ ID NO: 789367 - DNA, 21 bp, Homo sapiens
cttttactctgtgtaaagact

SEQ ID NO: 789368 - DNA, 18 bp, Homo sapiens
cttttactggttgcatgg

SEQ ID NO: 789369 - DNA, 21 bp, Homo sapiens
cttttactggttgcatggaaa

SEQ ID NO: 789370 - DNA, 18 bp, Homo sapiens
cttttactttaaagtagt

SEQ ID NO: 789371 - DNA, 14 bp, Homo sapiens
cttttactttttta

SEQ ID NO: 789372 - DNA, 23 bp, Homo sapiens
cttttagaaatactgcaagaaaa

SEQ ID NO: 789373 - DNA, 13 bp, Homo sapiens
cttttagcctagt

SEQ ID NO: 789374 - DNA, 20 bp, Homo sapiens
cttttaggaaaatcactttg

SEQ ID NO: 789375 - DNA, 14 bp, Homo sapiens
cttttataaacttt

SEQ ID NO: 789376 - DNA, 15 bp, Homo sapiens
cttttataaacttta

SEQ ID NO: 789377 - DNA, 12 bp, Homo sapiens
cttttataaata

SEQ ID NO: 789378 - DNA, 14 bp, Homo sapiens
cttttataaattaa

SEQ ID NO: 789379 - DNA, 16 bp, Homo sapiens
cttttataaggaaact

SEQ ID NO: 789380 - DNA, 17 bp, Homo sapiens
cttttataatgattcat

SEQ ID NO: 789381 - DNA, 18 bp, Homo sapiens
cttttataatgattcata

SEQ ID NO: 789382 - DNA, 19 bp, Homo sapiens
cttttataatgattcataa

SEQ ID NO: 789383 - DNA, 21 bp, Homo sapiens
cttttataattctcattaaaa

SEQ ID NO: 789384 - DNA, 11 bp, Homo sapiens
cttttatacca

SEQ ID NO: 789385 - DNA, 22 bp, Homo sapiens
cttttatacctttcctttttgg

SEQ ID NO: 789386 - DNA, 15 bp, Homo sapiens
cttttatactgacac

SEQ ID NO: 789387 - DNA, 12 bp, Homo sapiens
cttttatagcta

SEQ ID NO: 789388 - DNA, 21 bp, Homo sapiens
cttttataggatttatttaaa

SEQ ID NO: 789389 - DNA, 19 bp, Homo sapiens
cttttataggtgagaaaaa

SEQ ID NO: 789390 - DNA, 15 bp, Homo sapiens
cttttatatggccca

SEQ ID NO: 789391 - DNA, 13 bp, Homo sapiens
cttttatattcta

SEQ ID NO: 789392 - DNA, 15 bp, Homo sapiens
cttttatattctaat

SEQ ID NO: 789393 - DNA, 14 bp, Homo sapiens
cttttatatttgta

SEQ ID NO: 789394 - DNA, 22 bp, Homo sapiens
cttttatcccaaagttgttgta

SEQ ID NO: 789395 - DNA, 16 bp, Homo sapiens
cttttatctgcagaac

SEQ ID NO: 789396 - DNA, 18 bp, Homo sapiens
cttttctggaatgtaatc

SEQ ID NO: 789397 - DNA, 13 bp, Homo sapiens
cttttctggaatt

SEQ ID NO: 789398 - DNA, 13 bp, Homo sapiens
cttttctggagtt

SEQ ID NO: 789399 - DNA, 16 bp, Homo sapiens
cttttctggtccctct

SEQ ID NO: 789400 - DNA, 19 bp, Homo sapiens
cttttctggtccctcttct

SEQ ID NO: 789401 - DNA, 17 bp, Homo sapiens
cttttctggttccaaac

SEQ ID NO: 789402 - DNA, 21 bp, Homo sapiens
cttttctggttccaaaccagt

SEQ ID NO: 789403 - DNA, 15 bp, Homo sapiens
cttttctgtaattca

SEQ ID NO: 789404 - DNA, 14 bp, Homo sapiens
cttttctgtcacca

SEQ ID NO: 789405 - DNA, 15 bp, Homo sapiens
cttttctgtcaccaa

SEQ ID NO: 789406 - DNA, 18 bp, Homo sapiens
cttttctgtcaccaaatt

SEQ ID NO: 789407 - DNA, 15 bp, Homo sapiens
cttttctgtcctggg

SEQ ID NO: 789408 - DNA, 17 bp, Homo sapiens
cttttctgtctctgcct

SEQ ID NO: 789409 - DNA, 17 bp, Homo sapiens
cttttctgtggctggct

SEQ ID NO: 789410 - DNA, 17 bp, Homo sapiens
cttttcttatttttgta

SEQ ID NO: 789411 - DNA, 17 bp, Homo sapiens
cttttcttggttctttt

SEQ ID NO: 789412 - DNA, 16 bp, Homo sapiens
cttttcttgtatctgg

SEQ ID NO: 789413 - DNA, 14 bp, Homo sapiens
cttttctttaactt

SEQ ID NO: 789414 - DNA, 15 bp, Homo sapiens
cttttctttaacttt

SEQ ID NO: 789415 - DNA, 20 bp, Homo sapiens
cttttctttattagctttct

SEQ ID NO: 789416 - DNA, 13 bp, Homo sapiens
cttttcttttctt

SEQ ID NO: 789417 - DNA, 18 bp, Homo sapiens
cttttctttttttcttta

SEQ ID NO: 789418 - DNA, 17 bp, Homo sapiens
cttttgaaaagaccaag

SEQ ID NO: 789419 - DNA, 19 bp, Homo sapiens
cttttgaaaagaccaagac

SEQ ID NO: 789420 - DNA, 22 bp, Homo sapiens
cttttgaaaagaccaagacttt

SEQ ID NO: 789421 - DNA, 14 bp, Homo sapiens
cttttgaaaagctt

SEQ ID NO: 789422 - DNA, 14 bp, Homo sapiens
cttttgaaagtaga

SEQ ID NO: 789423 - DNA, 18 bp, Homo sapiens
cttttgaaagtagagcta

SEQ ID NO: 789424 - DNA, 21 bp, Homo sapiens
cttttgaacgcccccccccac

SEQ ID NO: 789425 - DNA, 22 bp, Homo sapiens
cttttgaactgttagatgctga

SEQ ID NO: 789426 - DNA, 12 bp, Homo sapiens
cttttgaacttg

SEQ ID NO: 789427 - DNA, 20 bp, Homo sapiens
cttttgaagtagtttgtata

SEQ ID NO: 789428 - DNA, 22 bp, Homo sapiens
cttttgaagtagtttgtataac

SEQ ID NO: 789429 - DNA, 13 bp, Homo sapiens
cttttgaatattc

SEQ ID NO: 789430 - DNA, 20 bp, Homo sapiens
cttttgacaatcaaagaaaa

SEQ ID NO: 789431 - DNA, 18 bp, Homo sapiens
cttttgacactgctctaa

SEQ ID NO: 789432 - DNA, 23 bp, Homo sapiens
cttttgacacttttaaaaaacaa

SEQ ID NO: 789433 - DNA, 20 bp, Homo sapiens
cttttgacggccttcttggt

SEQ ID NO: 789434 - DNA, 12 bp, Homo sapiens
cttttgaggctt

SEQ ID NO: 789435 - DNA, 16 bp, Homo sapiens
cttttgagtgggccct

SEQ ID NO: 789436 - DNA, 21 bp, Homo sapiens
cttttgagtgggccctgcccg

SEQ ID NO: 789437 - DNA, 20 bp, Homo sapiens
cttttgagtgtgtgtgtgca

SEQ ID NO: 789438 - DNA, 23 bp, Homo sapiens
cttttgagtgtgtgtgtgcatgt

SEQ ID NO: 789439 - DNA, 15 bp, Homo sapiens
cttttgatatgcata

SEQ ID NO: 789440 - DNA, 18 bp, Homo sapiens
cttttgatcacattgttt

SEQ ID NO: 789441 - DNA, 14 bp, Homo sapiens
cttttgatctctgc

SEQ ID NO: 789442 - DNA, 22 bp, Homo sapiens
cttttgatgatgtctacagaaa

SEQ ID NO: 789443 - DNA, 18 bp, Homo sapiens
cttttgatggggagaaag

SEQ ID NO: 789444 - DNA, 14 bp, Homo sapiens
cttttgatgtgaaa

SEQ ID NO: 789445 - DNA, 23 bp, Homo sapiens
cttttgatgttcagagtggctca

SEQ ID NO: 789446 - DNA, 14 bp, Homo sapiens
cttttgcacccctc

SEQ ID NO: 789447 - DNA, 15 bp, Homo sapiens
cttttgcacccctcc

SEQ ID NO: 789448 - DNA, 17 bp, Homo sapiens
cttttgcacccctccca

SEQ ID NO: 789449 - DNA, 19 bp, Homo sapiens
cttttgcacccctcccatt

SEQ ID NO: 789450 - DNA, 22 bp, Homo sapiens
cttttgcacctgctctcttgta

SEQ ID NO: 789451 - DNA, 18 bp, Homo sapiens
cttttgcagaagagggtg

SEQ ID NO: 789452 - DNA, 12 bp, Homo sapiens
cttttgcatttc

SEQ ID NO: 789453 - DNA, 19 bp, Homo sapiens
cttttgccagtattatgca

SEQ ID NO: 789454 - DNA, 17 bp, Homo sapiens
cttttgcccacctcttc

SEQ ID NO: 789455 - DNA, 16 bp, Homo sapiens
cttttgccccagaaag

SEQ ID NO: 789456 - DNA, 16 bp, Homo sapiens
cttttgccgttattaa

SEQ ID NO: 789457 - DNA, 16 bp, Homo sapiens
cttttgcctgtaagaa

SEQ ID NO: 789458 - DNA, 19 bp, Homo sapiens
cttttgcgcttatttggaa

SEQ ID NO: 789459 - DNA, 21 bp, Homo sapiens
cttttgcgcttatttggaaat

SEQ ID NO: 789460 - DNA, 23 bp, Homo sapiens
cttttgcgcttatttggaaattt

SEQ ID NO: 789461 - DNA, 23 bp, Homo sapiens
cttttgcggttcaggaaaattga

SEQ ID NO: 789462 - DNA, 12 bp, Homo sapiens
cttttgctgctg

SEQ ID NO: 789463 - DNA, 13 bp, Homo sapiens
cttttgctgctgc

SEQ ID NO: 789464 - DNA, 14 bp, Homo sapiens
cttttgctgtcttt

SEQ ID NO: 789465 - DNA, 16 bp, Homo sapiens
cttttgctgtttatac

SEQ ID NO: 789466 - DNA, 19 bp, Homo sapiens
cttttgctgtttatacttg

SEQ ID NO: 789467 - DNA, 23 bp, Homo sapiens
cttttgctgtttggatgtttcca

SEQ ID NO: 789468 - DNA, 17 bp, Homo sapiens
cttttgcttgatccaga

SEQ ID NO: 789469 - DNA, 14 bp, Homo sapiens
cttttggaacattt

SEQ ID NO: 789470 - DNA, 16 bp, Homo sapiens
cttttggaacatttct

SEQ ID NO: 789471 - DNA, 12 bp, Homo sapiens
cttttggaatca

SEQ ID NO: 789472 - DNA, 23 bp, Homo sapiens
cttttggcaatgactcaaagtct

SEQ ID NO: 789473 - DNA, 13 bp, Homo sapiens
cttttggccttgt

SEQ ID NO: 789474 - DNA, 19 bp, Homo sapiens
cttttgggcctccttccca

SEQ ID NO: 789475 - DNA, 12 bp, Homo sapiens
cttttgggcctt

SEQ ID NO: 789476 - DNA, 18 bp, Homo sapiens
cttttgggctcaaagccc

SEQ ID NO: 789477 - DNA, 14 bp, Homo sapiens
cttttggtctccct

SEQ ID NO: 789478 - DNA, 20 bp, Homo sapiens
cttttggtcttcagcctccc

SEQ ID NO: 789479 - DNA, 22 bp, Homo sapiens
cttttggtcttcagcctccctc

SEQ ID NO: 789480 - DNA, 17 bp, Homo sapiens
cttttggtgtgttggac

SEQ ID NO: 789481 - DNA, 18 bp, Homo sapiens
cttttggtgtgttggaca

SEQ ID NO: 789482 - DNA, 20 bp, Homo sapiens
cttttggtgtgttggacaga

SEQ ID NO: 789483 - DNA, 21 bp, Homo sapiens
cttttggttatgaatactttg

SEQ ID NO: 789484 - DNA, 22 bp, Homo sapiens
cttttggtttcaccttccctcg

SEQ ID NO: 789485 - DNA, 11 bp, Homo sapiens
cttttgtaaat

SEQ ID NO: 789486 - DNA, 12 bp, Homo sapiens
cttttgtaaata

SEQ ID NO: 789487 - DNA, 13 bp, Homo sapiens
cttttgtaaatat

SEQ ID NO: 789488 - DNA, 14 bp, Homo sapiens
cttttgtaaatatt

SEQ ID NO: 789489 - DNA, 10 bp, Homo sapiens
cttttgtaag

SEQ ID NO: 789490 - DNA, 20 bp, Homo sapiens
cttttgtaagacaaaggttt

SEQ ID NO: 789491 - DNA, 14 bp, Homo sapiens
cttttgtaatttga

SEQ ID NO: 789492 - DNA, 17 bp, Homo sapiens
cttttgtactgaatttt

SEQ ID NO: 789493 - DNA, 23 bp, Homo sapiens
cttttgtactgaatttttttgta

SEQ ID NO: 789494 - DNA, 21 bp, Homo sapiens
cttttgtaggctgttcccttt

SEQ ID NO: 789495 - DNA, 23 bp, Homo sapiens
cttttgtaggctgttccctttgc

SEQ ID NO: 789496 - DNA, 20 bp, Homo sapiens
cttttgtatcttcctttctt

SEQ ID NO: 789497 - DNA, 17 bp, Homo sapiens
cttttgtatgtaaatgt

SEQ ID NO: 789498 - DNA, 21 bp, Homo sapiens
cttttgtatgtaaatgtgcat

SEQ ID NO: 789499 - DNA, 12 bp, Homo sapiens
cttttgtattaa

SEQ ID NO: 789500 - DNA, 17 bp, Homo sapiens
cttttgtattaagaaag

SEQ ID NO: 789501 - DNA, 17 bp, Homo sapiens
cttttgtccaatgtggt

SEQ ID NO: 789502 - DNA, 18 bp, Homo sapiens
cttttgtccccagggccc

SEQ ID NO: 789503 - DNA, 11 bp, Homo sapiens
cttttgtctac

SEQ ID NO: 789504 - DNA, 21 bp, Homo sapiens
cttttgtgatggagtgctgtt

SEQ ID NO: 789505 - DNA, 14 bp, Homo sapiens
cttttgtgcattat

SEQ ID NO: 789506 - DNA, 18 bp, Homo sapiens
cttttgtgcattatctag

SEQ ID NO: 789507 - DNA, 20 bp, Homo sapiens
cttttgtgggtttctctgtg

SEQ ID NO: 789508 - DNA, 16 bp, Homo sapiens
cttttgtgtaatgaaa

SEQ ID NO: 789509 - DNA, 17 bp, Homo sapiens
cttttgtgtaatgaaaa

SEQ ID NO: 789510 - DNA, 19 bp, Homo sapiens
cttttgtgtcctgctctgt

SEQ ID NO: 789511 - DNA, 23 bp, Homo sapiens
cttttgtgtcctgctctgtttgg

SEQ ID NO: 789512 - DNA, 17 bp, Homo sapiens
cttttgtgtgaattgac

SEQ ID NO: 789513 - DNA, 15 bp, Homo sapiens
cttttgttaaataat

SEQ ID NO: 789514 - DNA, 22 bp, Homo sapiens
cttttgttcagggctgtgatcg

SEQ ID NO: 789515 - DNA, 15 bp, Homo sapiens
cttttgttctcttct

SEQ ID NO: 789516 - DNA, 12 bp, Homo sapiens
cttttgttctga

SEQ ID NO: 789517 - DNA, 20 bp, Homo sapiens
cttttgttgcccaggctgga

SEQ ID NO: 789518 - DNA, 22 bp, Homo sapiens
cttttgttgtactttatatctt

SEQ ID NO: 789519 - DNA, 21 bp, Homo sapiens
cttttgtttaaatataaatgt

SEQ ID NO: 789520 - DNA, 22 bp, Homo sapiens
cttttgtttcccttgctttgtt

SEQ ID NO: 789521 - DNA, 21 bp, Homo sapiens
gaaccttaacctctctaagcc

SEQ ID NO: 789522 - DNA, 20 bp, Homo sapiens
gaaccttaatgacaacactt

SEQ ID NO: 789523 - DNA, 15 bp, Homo sapiens
gaaccttccttcctg

SEQ ID NO: 789524 - DNA, 13 bp, Homo sapiens
gaaccttctccct

SEQ ID NO: 789525 - DNA, 15 bp, Homo sapiens
gaaccttctcccttc

SEQ ID NO: 789526 - DNA, 17 bp, Homo sapiens
gaaccttgaggggctag

SEQ ID NO: 789527 - DNA, 13 bp, Homo sapiens
gaaccttgctgtc

SEQ ID NO: 789528 - DNA, 14 bp, Homo sapiens
gaaccttgctgtcc

SEQ ID NO: 789529 - DNA, 16 bp, Homo sapiens
gaaccttgctgtcctg

SEQ ID NO: 789530 - DNA, 15 bp, Homo sapiens
gaacgactgtatatt

SEQ ID NO: 789531 - DNA, 17 bp, Homo sapiens
gaacgagcactggccag

SEQ ID NO: 789532 - DNA, 22 bp, Homo sapiens
gaacgagcactggccagagagg

SEQ ID NO: 789533 - DNA, 18 bp, Homo sapiens
gaacgatttagaaagaag

SEQ ID NO: 789534 - DNA, 15 bp, Homo sapiens
gaacgcaccccactg

SEQ ID NO: 789535 - DNA, 20 bp, Homo sapiens
gaacgcaccccactgggaga

SEQ ID NO: 789536 - DNA, 16 bp, Homo sapiens
gaacgccagtctccca

SEQ ID NO: 789537 - DNA, 21 bp, Homo sapiens
gaacgccagtctcccaggccc

SEQ ID NO: 789538 - DNA, 19 bp, Homo sapiens
gaacgcccccccccacccc

SEQ ID NO: 789539 - DNA, 14 bp, Homo sapiens
gaacgctctcctcg

SEQ ID NO: 789540 - DNA, 21 bp, Homo sapiens
gaacgctcttagctttctcag

SEQ ID NO: 789541 - DNA, 19 bp, Homo sapiens
gaacggaacgttggacttt

SEQ ID NO: 789542 - DNA, 13 bp, Homo sapiens
gaacggccctgca

SEQ ID NO: 789543 - DNA, 17 bp, Homo sapiens
gaacgggcagccacagg

SEQ ID NO: 789544 - DNA, 18 bp, Homo sapiens
gaacgggcagccacagga

SEQ ID NO: 789545 - DNA, 21 bp, Homo sapiens
gaacgggcatgggcctctctg

SEQ ID NO: 789546 - DNA, 22 bp, Homo sapiens
gaacgggcatgggcctctctgg

SEQ ID NO: 789547 - DNA, 15 bp, Homo sapiens
gaacggtaaatttct

SEQ ID NO: 789548 - DNA, 14 bp, Homo sapiens
gaacgtatttctcc

SEQ ID NO: 789549 - DNA, 14 bp, Homo sapiens
gaacgtgactgccc

SEQ ID NO: 789550 - DNA, 15 bp, Homo sapiens
gaacgttgccacacc

SEQ ID NO: 789551 - DNA, 21 bp, Homo sapiens
gaacgtttctggcctgggttt

SEQ ID NO: 789552 - DNA, 15 bp, Homo sapiens
gaacgttttcttctt

SEQ ID NO: 789553 - DNA, 15 bp, Homo sapiens
gaacgtttttcctgt

SEQ ID NO: 789554 - DNA, 13 bp, Homo sapiens
gaactaaactagt

SEQ ID NO: 789555 - DNA, 19 bp, Homo sapiens
gaactaaactagtttttcc

SEQ ID NO: 789556 - DNA, 22 bp, Homo sapiens
gaactaaactagtttttcctat

SEQ ID NO: 789557 - DNA, 23 bp, Homo sapiens
gaactaaactagtttttcctatc

SEQ ID NO: 789558 - DNA, 19 bp, Homo sapiens
gaactaacttactgtccac

SEQ ID NO: 789559 - DNA, 19 bp, Homo sapiens
gaactaccttggttccccc

SEQ ID NO: 789560 - DNA, 20 bp, Homo sapiens
gaactaccttggttccccca

SEQ ID NO: 789561 - DNA, 13 bp, Homo sapiens
gaactactgtact

SEQ ID NO: 789562 - DNA, 21 bp, Homo sapiens
gaactactgtactttgccatt

SEQ ID NO: 789563 - DNA, 23 bp, Homo sapiens
gaactagaggtgttacagaggac

SEQ ID NO: 789564 - DNA, 15 bp, Homo sapiens
gaactaggctgagca

SEQ ID NO: 789565 - DNA, 16 bp, Homo sapiens
gaactagggaagctca

SEQ ID NO: 789566 - DNA, 15 bp, Homo sapiens
gaactatagtaactt

SEQ ID NO: 789567 - DNA, 19 bp, Homo sapiens
gaactatatcagtagtgta

SEQ ID NO: 789568 - DNA, 16 bp, Homo sapiens
gaactatgaaaagtgg

SEQ ID NO: 789569 - DNA, 17 bp, Homo sapiens
gaactatgactggagta

SEQ ID NO: 789570 - DNA, 20 bp, Homo sapiens
gaactatgtcgatgcacagt

SEQ ID NO: 789571 - DNA, 18 bp, Homo sapiens
gaactattccccagcagg

SEQ ID NO: 789572 - DNA, 19 bp, Homo sapiens
gaactattttcaaagactt

SEQ ID NO: 789573 - DNA, 16 bp, Homo sapiens
gaactcaccctgggag

SEQ ID NO: 789574 - DNA, 21 bp, Homo sapiens
gaactcaccctgggagccagt

SEQ ID NO: 789575 - DNA, 22 bp, Homo sapiens
gaactcaccctgggagccagtc

SEQ ID NO: 789576 - DNA, 14 bp, Homo sapiens
gaactcactggggc

SEQ ID NO: 789577 - DNA, 13 bp, Homo sapiens
gaactcagaagag

SEQ ID NO: 789578 - DNA, 15 bp, Homo sapiens
gaactcagaagagaa

SEQ ID NO: 789579 - DNA, 15 bp, Homo sapiens
gaactcattaacaac

SEQ ID NO: 789580 - DNA, 12 bp, Homo sapiens
gaactccacccc

SEQ ID NO: 789581 - DNA, 23 bp, Homo sapiens
gaactccaccgaccaactgccct

SEQ ID NO: 789582 - DNA, 18 bp, Homo sapiens
gaactccactctccttcg

SEQ ID NO: 789583 - DNA, 16 bp, Homo sapiens
gaactccaggatggaa

SEQ ID NO: 789584 - DNA, 23 bp, Homo sapiens
gaactccaggctttctggagttc

SEQ ID NO: 789585 - DNA, 14 bp, Homo sapiens
gaactccatacagc

SEQ ID NO: 789586 - DNA, 11 bp, Homo sapiens
gaactccattt

SEQ ID NO: 789587 - DNA, 18 bp, Homo sapiens
gaactcctgccaggcaca

SEQ ID NO: 789588 - DNA, 22 bp, Homo sapiens
gaagaacacagcatgtgccaag

SEQ ID NO: 789589 - DNA, 20 bp, Homo sapiens
gaagaacagctgttcctgtg

SEQ ID NO: 789590 - DNA, 13 bp, Homo sapiens
gaagaacatagaa

SEQ ID NO: 789591 - DNA, 17 bp, Homo sapiens
gaagaacatccaaggag

SEQ ID NO: 789592 - DNA, 20 bp, Homo sapiens
gaagaacatccaaggagaaa

SEQ ID NO: 789593 - DNA, 19 bp, Homo sapiens
gaagaacatgattttacaa

SEQ ID NO: 789594 - DNA, 18 bp, Homo sapiens
gaagaaccaaatacctca

SEQ ID NO: 789595 - DNA, 13 bp, Homo sapiens
gaagaaccagccc

SEQ ID NO: 789596 - DNA, 14 bp, Homo sapiens
gaagaactgcaggc

SEQ ID NO: 789597 - DNA, 17 bp, Homo sapiens
gaagaagaaatctttct

SEQ ID NO: 789598 - DNA, 19 bp, Homo sapiens
gaagaagagaagctgctga

SEQ ID NO: 789599 - DNA, 14 bp, Homo sapiens
gaagaagagatgca

SEQ ID NO: 789600 - DNA, 14 bp, Homo sapiens
gaagaagcagagag

SEQ ID NO: 789601 - DNA, 14 bp, Homo sapiens
gaagaagctctctc

SEQ ID NO: 789602 - DNA, 13 bp, Homo sapiens
gaagaaggcagtg

SEQ ID NO: 789603 - DNA, 15 bp, Homo sapiens
gaagaagggagaaga

SEQ ID NO: 789604 - DNA, 16 bp, Homo sapiens
gaagaagggagaagaa

SEQ ID NO: 789605 - DNA, 19 bp, Homo sapiens
gaagaagggagaagaaagg

SEQ ID NO: 789606 - DNA, 12 bp, Homo sapiens
gaagaagtggga

SEQ ID NO: 789607 - DNA, 16 bp, Homo sapiens
gaagaagtgggagcag

SEQ ID NO: 789608 - DNA, 19 bp, Homo sapiens
gaagaagtttcatcatttt

SEQ ID NO: 789609 - DNA, 12 bp, Homo sapiens
gaagaagttttt

SEQ ID NO: 789610 - DNA, 14 bp, Homo sapiens
gaagaatattgtat

SEQ ID NO: 789611 - DNA, 15 bp, Homo sapiens
gaagaatcacgattt

SEQ ID NO: 789612 - DNA, 21 bp, Homo sapiens
gaagaatctcatctcagtgaa

SEQ ID NO: 789613 - DNA, 20 bp, Homo sapiens
gaagaatgcacaagaatgga

SEQ ID NO: 789614 - DNA, 19 bp, Homo sapiens
gaagaatgctgttctgatt

SEQ ID NO: 789615 - DNA, 24 bp, Homo sapiens
gaagaatgcttaatcagatagata

SEQ ID NO: 789616 - DNA, 22 bp, Homo sapiens
gaagaatgttaagacttgacag

SEQ ID NO: 789617 - DNA, 19 bp, Homo sapiens
gaagaatgttagagtaatg

SEQ ID NO: 789618 - DNA, 14 bp, Homo sapiens
gaagaatgtttctg

SEQ ID NO: 789619 - DNA, 14 bp, Homo sapiens
gaagaattatgtaa

SEQ ID NO: 789620 - DNA, 21 bp, Homo sapiens
gaagaattattcagtgaattt

SEQ ID NO: 789621 - DNA, 23 bp, Homo sapiens
gaagaattattcagtgaatttgt

SEQ ID NO: 789622 - DNA, 19 bp, Homo sapiens
gaagaattgaacccaggag

SEQ ID NO: 789623 - DNA, 22 bp, Homo sapiens
gaagaattgtcttgcaagttaa

SEQ ID NO: 789624 - DNA, 17 bp, Homo sapiens
gaagaatttaatggact

SEQ ID NO: 789625 - DNA, 15 bp, Homo sapiens
gaagaatttattaca

SEQ ID NO: 789626 - DNA, 13 bp, Homo sapiens
gaagaatttgaag

SEQ ID NO: 789627 - DNA, 13 bp, Homo sapiens
gaagaattttatt

SEQ ID NO: 789628 - DNA, 19 bp, Homo sapiens
gaagaattttatttttctg

SEQ ID NO: 789629 - DNA, 20 bp, Homo sapiens
gaagaattttatttttctgt

SEQ ID NO: 789630 - DNA, 22 bp, Homo sapiens
gaagaattttatttttctgtgg

SEQ ID NO: 789631 - DNA, 12 bp, Homo sapiens
gaagaattttga

SEQ ID NO: 789632 - DNA, 15 bp, Homo sapiens
gaagacaaaaagaca

SEQ ID NO: 789633 - DNA, 19 bp, Homo sapiens
gaagacaaagtcccagaat

SEQ ID NO: 789634 - DNA, 16 bp, Homo sapiens
gaagacaatgacttac

SEQ ID NO: 789635 - DNA, 22 bp, Homo sapiens
gaagacaatgacttactgtaca

SEQ ID NO: 789636 - DNA, 19 bp, Homo sapiens
gaagacaatttgatacata

SEQ ID NO: 789637 - DNA, 20 bp, Homo sapiens
gaagacaatttgatacataa

SEQ ID NO: 789638 - DNA, 12 bp, Homo sapiens
gaagacacagaa

SEQ ID NO: 789639 - DNA, 14 bp, Homo sapiens
gaagacacttcaga

SEQ ID NO: 789640 - DNA, 19 bp, Homo sapiens
gaagacataaaactttaaa

SEQ ID NO: 789641 - DNA, 21 bp, Homo sapiens
gaagacatggagactcctgcc

SEQ ID NO: 789642 - DNA, 14 bp, Homo sapiens
gaagacattctggt

SEQ ID NO: 789643 - DNA, 14 bp, Homo sapiens
gaagacattttgtt

SEQ ID NO: 789644 - DNA, 20 bp, Homo sapiens
gaagacattttttgctataa

SEQ ID NO: 789645 - DNA, 14 bp, Homo sapiens
gaagaccaaaatta

SEQ ID NO: 789646 - DNA, 23 bp, Homo sapiens
gaagaccaaaattactaataaat

SEQ ID NO: 789647 - DNA, 18 bp, Homo sapiens
gaagaccaaaggaaggaa

SEQ ID NO: 789648 - DNA, 21 bp, Homo sapiens
gaagaccacatccacacacgc

SEQ ID NO: 789649 - DNA, 22 bp, Homo sapiens
gaagaccacatccacacacgca

SEQ ID NO: 789650 - DNA, 19 bp, Homo sapiens
gaagaccagaattcccttg

SEQ ID NO: 789651 - DNA, 18 bp, Homo sapiens
gaagaccagactgtggag

SEQ ID NO: 789652 - DNA, 13 bp, Homo sapiens
gaagaccatgcct

SEQ ID NO: 789653 - DNA, 22 bp, Homo sapiens
gaagaccatgtggagacttcat

SEQ ID NO: 789654 - DNA, 22 bp, Homo sapiens
gaagaccattctgtgaccaaaa

SEQ ID NO: 789655 - DNA, 16 bp, Homo sapiens
gaagaccccacccaag

SEQ ID NO: 789656 - DNA, 19 bp, Homo sapiens
gaagacccctgactcatca

SEQ ID NO: 789657 - DNA, 17 bp, Homo sapiens
gaagaccctcttgccca

SEQ ID NO: 789658 - DNA, 17 bp, Homo sapiens
gaagacctagctatgtt

SEQ ID NO: 789659 - DNA, 17 bp, Homo sapiens
gaagacctgagaatgta

SEQ ID NO: 789660 - DNA, 16 bp, Homo sapiens
gaagacggaaaacaat

SEQ ID NO: 789661 - DNA, 18 bp, Homo sapiens
gaagacgtggactcctct

SEQ ID NO: 789662 - DNA, 14 bp, Homo sapiens
gaagacgttttctt

SEQ ID NO: 789663 - DNA, 16 bp, Homo sapiens
gaagacgttttcttta

SEQ ID NO: 789664 - DNA, 16 bp, Homo sapiens
gaagactagaggccag

SEQ ID NO: 789665 - DNA, 23 bp, Homo sapiens
gaagactagaggccagggcagca

SEQ ID NO: 789666 - DNA, 13 bp, Homo sapiens
gaagactgcacag

SEQ ID NO: 789667 - DNA, 16 bp, Homo sapiens
gaagactgctcccggc

SEQ ID NO: 789668 - DNA, 12 bp, Homo sapiens
gaagactgtggc

SEQ ID NO: 789669 - DNA, 13 bp, Homo sapiens
gaagactgtggct

SEQ ID NO: 789670 - DNA, 13 bp, Homo sapiens
gaagacttcaaaa

SEQ ID NO: 789671 - DNA, 14 bp, Homo sapiens
gaagacttcttggg

SEQ ID NO: 789672 - DNA, 19 bp, Homo sapiens
gaagactttaattatatat

SEQ ID NO: 789673 - DNA, 12 bp, Homo sapiens
gaagagaaacca

SEQ ID NO: 789674 - DNA, 19 bp, Homo sapiens
gaagagaaatacagctggc

SEQ ID NO: 789675 - DNA, 16 bp, Homo sapiens
gaagagaagctgctga

SEQ ID NO: 789676 - DNA, 17 bp, Homo sapiens
gaagagaagctgctgac

SEQ ID NO: 789677 - DNA, 18 bp, Homo sapiens
gaagagacaaagtgggtg

SEQ ID NO: 789678 - DNA, 20 bp, Homo sapiens
gaagagacaaagtgggtgtg

SEQ ID NO: 789679 - DNA, 16 bp, Homo sapiens
gaagagactgggaaga

SEQ ID NO: 789680 - DNA, 14 bp, Homo sapiens
gaagagagagaccc

SEQ ID NO: 789681 - DNA, 14 bp, Homo sapiens
gaagagagagccat

SEQ ID NO: 789682 - DNA, 19 bp, Homo sapiens
gaagagaggcacctgctgg

SEQ ID NO: 789683 - DNA, 23 bp, Homo sapiens
gaagagaggcacctgctggaaac

SEQ ID NO: 789684 - DNA, 14 bp, Homo sapiens
gaagagaggggaag

SEQ ID NO: 789685 - DNA, 19 bp, Homo sapiens
gaagagaggggaagaattt

SEQ ID NO: 789686 - DNA, 22 bp, Homo sapiens
gaagagatgacaaaccataact

SEQ ID NO: 789687 - DNA, 16 bp, Homo sapiens
gaagagatgcactata

SEQ ID NO: 789688 - DNA, 14 bp, Homo sapiens
gaagagcagagctg

SEQ ID NO: 789689 - DNA, 15 bp, Homo sapiens
gaagagcaggcacat

SEQ ID NO: 789690 - DNA, 18 bp, Homo sapiens
gaagagccacctgcaaga

SEQ ID NO: 789691 - DNA, 20 bp, Homo sapiens
gaagagccacctgcaagatg

SEQ ID NO: 789692 - DNA, 17 bp, Homo sapiens
gaagagcccgcagggcc

SEQ ID NO: 789693 - DNA, 20 bp, Homo sapiens
gaagagcccgccgtctgcag

SEQ ID NO: 789694 - DNA, 21 bp, Homo sapiens
gaagagcccgccgtctgcagg

SEQ ID NO: 789695 - DNA, 21 bp, Homo sapiens
gaagagcgcagtgttttgcaa

SEQ ID NO: 789696 - DNA, 20 bp, Homo sapiens
gaagagctcccctccacagc

SEQ ID NO: 789697 - DNA, 14 bp, Homo sapiens
gaagagcttgcttt

SEQ ID NO: 789698 - DNA, 20 bp, Homo sapiens
gaagagcttgctttgattta

SEQ ID NO: 789699 - DNA, 22 bp, Homo sapiens
gaagagcttgtgtcctgtcctt

SEQ ID NO: 789700 - DNA, 14 bp, Homo sapiens
gaagaggaacagtg

SEQ ID NO: 789701 - DNA, 18 bp, Homo sapiens
gaagaggaagaaattcag

SEQ ID NO: 789702 - DNA, 13 bp, Homo sapiens
gaaggaagggcag

SEQ ID NO: 789703 - DNA, 23 bp, Homo sapiens
gaaggaatagccagagaggagca

SEQ ID NO: 789704 - DNA, 23 bp, Homo sapiens
gaaggaatcaaattttgccagag

SEQ ID NO: 789705 - DNA, 16 bp, Homo sapiens
gaaggaatttgattgc

SEQ ID NO: 789706 - DNA, 23 bp, Homo sapiens
gaaggaatttgattgctttgctg

SEQ ID NO: 789707 - DNA, 13 bp, Homo sapiens
gaaggacacagtg

SEQ ID NO: 789708 - DNA, 18 bp, Homo sapiens
gaaggacacttcctgcct

SEQ ID NO: 789709 - DNA, 20 bp, Homo sapiens
gaaggaccacattttatatt

SEQ ID NO: 789710 - DNA, 22 bp, Homo sapiens
gaaggaccacattttatattta

SEQ ID NO: 789711 - DNA, 16 bp, Homo sapiens
gaaggacccctcacca

SEQ ID NO: 789712 - DNA, 17 bp, Homo sapiens
gaaggacccctcaccac

SEQ ID NO: 789713 - DNA, 20 bp, Homo sapiens
gaaggactaatagaaaagta

SEQ ID NO: 789714 - DNA, 12 bp, Homo sapiens
gaaggacttgac

SEQ ID NO: 789715 - DNA, 13 bp, Homo sapiens
gaaggagagcctg

SEQ ID NO: 789716 - DNA, 19 bp, Homo sapiens
gaaggagcccagccagaaa

SEQ ID NO: 789717 - DNA, 22 bp, Homo sapiens
gaaggagcccagccagaaagca

SEQ ID NO: 789718 - DNA, 22 bp, Homo sapiens
gaaggaggaatgctggactgga

SEQ ID NO: 789719 - DNA, 15 bp, Homo sapiens
gaaggaggacccagg

SEQ ID NO: 789720 - DNA, 17 bp, Homo sapiens
gaaggaggacccaggac

SEQ ID NO: 789721 - DNA, 10 bp, Homo sapiens
gaaggaggag

SEQ ID NO: 789722 - DNA, 11 bp, Homo sapiens
gaaggaggaga

SEQ ID NO: 789723 - DNA, 17 bp, Homo sapiens
gaaggaggcagactgat

SEQ ID NO: 789724 - DNA, 20 bp, Homo sapiens
gaaggaggccaaccagcccg

SEQ ID NO: 789725 - DNA, 16 bp, Homo sapiens
gaaggagggcagagcc

SEQ ID NO: 789726 - DNA, 20 bp, Homo sapiens
gaaggagggcagagccatgg

SEQ ID NO: 789727 - DNA, 21 bp, Homo sapiens
gaaggagggcagagccatggg

SEQ ID NO: 789728 - DNA, 22 bp, Homo sapiens
gaaggaggggagagacaggcag

SEQ ID NO: 789729 - DNA, 23 bp, Homo sapiens
gaaggaggggagagacaggcagc

SEQ ID NO: 789730 - DNA, 19 bp, Homo sapiens
gaaggaggggagcctttgg

SEQ ID NO: 789731 - DNA, 18 bp, Homo sapiens
gaaggagtacaaaacaat

SEQ ID NO: 789732 - DNA, 21 bp, Homo sapiens
gaaggatacaaaagcatgtga

SEQ ID NO: 789733 - DNA, 15 bp, Homo sapiens
gaaggatgtacattt

SEQ ID NO: 789734 - DNA, 17 bp, Homo sapiens
gaaggattatggaaaaa

SEQ ID NO: 789735 - DNA, 16 bp, Homo sapiens
gaaggattgcatcctg

SEQ ID NO: 789736 - DNA, 20 bp, Homo sapiens
gaaggattgcatcctgctgg

SEQ ID NO: 789737 - DNA, 13 bp, Homo sapiens
gaaggcaaaggca

SEQ ID NO: 789738 - DNA, 21 bp, Homo sapiens
gaaggcaaaggcagaggaatt

SEQ ID NO: 789739 - DNA, 18 bp, Homo sapiens
gaaggcaaatataagctg

SEQ ID NO: 789740 - DNA, 15 bp, Homo sapiens
gaaggcagacagcag

SEQ ID NO: 789741 - DNA, 20 bp, Homo sapiens
gaaggcagacagcaggcagc

SEQ ID NO: 789742 - DNA, 18 bp, Homo sapiens
gaaggcagagaaatctaa

SEQ ID NO: 789743 - DNA, 15 bp, Homo sapiens
gaaggcagaggctgg

SEQ ID NO: 789744 - DNA, 16 bp, Homo sapiens
gaaggcagaggctggc

SEQ ID NO: 789745 - DNA, 14 bp, Homo sapiens
gaaggcagggcaga

SEQ ID NO: 789746 - DNA, 22 bp, Homo sapiens
gaaggcagggggaaggtggggt

SEQ ID NO: 789747 - DNA, 21 bp, Homo sapiens
gaaggcagtagttttcaaaac

SEQ ID NO: 789748 - DNA, 16 bp, Homo sapiens
gaaggcagtctgaacc

SEQ ID NO: 789749 - DNA, 17 bp, Homo sapiens
gaaggcatcagtcccta

SEQ ID NO: 789750 - DNA, 15 bp, Homo sapiens
gaaggcatgagaaag

SEQ ID NO: 789751 - DNA, 18 bp, Homo sapiens
gaaggcatgcctggacaa

SEQ ID NO: 789752 - DNA, 19 bp, Homo sapiens
gaaggccaaaatcaagagt

SEQ ID NO: 789753 - DNA, 23 bp, Homo sapiens
gaaggccattgggtttggggcca

SEQ ID NO: 789754 - DNA, 18 bp, Homo sapiens
gaaggccctgctgagtca

SEQ ID NO: 789755 - DNA, 13 bp, Homo sapiens
gaaggcctgactt

SEQ ID NO: 789756 - DNA, 13 bp, Homo sapiens
gaaggcgaggaga

SEQ ID NO: 789757 - DNA, 18 bp, Homo sapiens
gaaggcgctgggtgcctg

SEQ ID NO: 789758 - DNA, 22 bp, Homo sapiens
gaaggcgctgggtgcctgcagc

SEQ ID NO: 789759 - DNA, 17 bp, Homo sapiens
gaaggctactggcatta

SEQ ID NO: 789760 - DNA, 17 bp, Homo sapiens
gaaggctccggggtgac

SEQ ID NO: 789761 - DNA, 22 bp, Homo sapiens
gaaggctgaactcttcagaaca

SEQ ID NO: 789762 - DNA, 13 bp, Homo sapiens
gaaggctgccaac

SEQ ID NO: 789763 - DNA, 13 bp, Homo sapiens
gaaggctggctga

SEQ ID NO: 789764 - DNA, 22 bp, Homo sapiens
gaaggcttctctccacagtgtt

SEQ ID NO: 789765 - DNA, 15 bp, Homo sapiens
gaaggcttgggattt

SEQ ID NO: 789766 - DNA, 20 bp, Homo sapiens
gaaggcttgggatttgctgt

SEQ ID NO: 789767 - DNA, 21 bp, Homo sapiens
gaaggcttgggatttgctgtg

SEQ ID NO: 789768 - DNA, 15 bp, Homo sapiens
gaagggaagagacag

SEQ ID NO: 789769 - DNA, 19 bp, Homo sapiens
gaagggaatcctcctccag

SEQ ID NO: 789770 - DNA, 17 bp, Homo sapiens
gaagggaccttgaaggg

SEQ ID NO: 789771 - DNA, 18 bp, Homo sapiens
gaagggaccttgaagggt

SEQ ID NO: 789772 - DNA, 21 bp, Homo sapiens
gaagggactaggagcactgta

SEQ ID NO: 789773 - DNA, 16 bp, Homo sapiens
gaagggagagccagct

SEQ ID NO: 789774 - DNA, 18 bp, Homo sapiens
gaagggaggaaggccttt

SEQ ID NO: 789775 - DNA, 15 bp, Homo sapiens
gaagggaggggaagg

SEQ ID NO: 789776 - DNA, 13 bp, Homo sapiens
gaagggaggtggc

SEQ ID NO: 789777 - DNA, 18 bp, Homo sapiens
gaagggagtgaggggctg

SEQ ID NO: 789778 - DNA, 15 bp, Homo sapiens
gaagggatgggggaa

SEQ ID NO: 789779 - DNA, 13 bp, Homo sapiens
gaagggcaagaaa

SEQ ID NO: 789780 - DNA, 13 bp, Homo sapiens
gaagggcaagttt

SEQ ID NO: 789781 - DNA, 18 bp, Homo sapiens
gaagggcatcatgcatct

SEQ ID NO: 789782 - DNA, 13 bp, Homo sapiens
gaagggccaccct

SEQ ID NO: 789783 - DNA, 19 bp, Homo sapiens
gaagggccagtcctgcctg

SEQ ID NO: 789784 - DNA, 13 bp, Homo sapiens
gaagggctgcatg

SEQ ID NO: 789785 - DNA, 19 bp, Homo sapiens
gaaggggaagcactcgtgt

SEQ ID NO: 789786 - DNA, 12 bp, Homo sapiens
gaaggggagctt

SEQ ID NO: 789787 - DNA, 23 bp, Homo sapiens
gaaggggagggtgttcagaggca

SEQ ID NO: 789788 - DNA, 16 bp, Homo sapiens
gaaggggatggaggcc

SEQ ID NO: 789789 - DNA, 17 bp, Homo sapiens
gaaggggcagccctgag

SEQ ID NO: 789790 - DNA, 17 bp, Homo sapiens
gaaggggccagaggctc

SEQ ID NO: 789791 - DNA, 19 bp, Homo sapiens
gaaggggccccggggctgg

SEQ ID NO: 789792 - DNA, 22 bp, Homo sapiens
gaaggggcctcaccgagtgggg

SEQ ID NO: 789793 - DNA, 23 bp, Homo sapiens
gaaggggcggggttagagccaag

SEQ ID NO: 789794 - DNA, 18 bp, Homo sapiens
gaaggggctgcttgcttt

SEQ ID NO: 789795 - DNA, 18 bp, Homo sapiens
gaagggggagtgaaacag

SEQ ID NO: 789796 - DNA, 22 bp, Homo sapiens
gaagggggattggagggaagac

SEQ ID NO: 789797 - DNA, 20 bp, Homo sapiens
gaagggggccatgaggcctc

SEQ ID NO: 789798 - DNA, 19 bp, Homo sapiens
gaagggggctctgccccag

SEQ ID NO: 789799 - DNA, 18 bp, Homo sapiens
gaaggggggttgcagtgg

SEQ ID NO: 789800 - DNA, 17 bp, Homo sapiens
gaagggggtccacccag

SEQ ID NO: 789801 - DNA, 18 bp, Homo sapiens
gaagggggtccacccagc

SEQ ID NO: 789802 - DNA, 15 bp, Homo sapiens
gaagggggtctctgt

SEQ ID NO: 789803 - DNA, 18 bp, Homo sapiens
gaagggggtctctgttaa

SEQ ID NO: 789804 - DNA, 13 bp, Homo sapiens
gaagggggtgaca

SEQ ID NO: 789805 - DNA, 19 bp, Homo sapiens
gaagggggtgacagtcctc

SEQ ID NO: 789806 - DNA, 16 bp, Homo sapiens
gaagggggtgtgcgtg

SEQ ID NO: 789807 - DNA, 15 bp, Homo sapiens
gaagggggttgtggc

SEQ ID NO: 789808 - DNA, 14 bp, Homo sapiens
gaaggggtcctgca

SEQ ID NO: 789809 - DNA, 16 bp, Homo sapiens
gaaggggtcctgcagg

SEQ ID NO: 789810 - DNA, 15 bp, Homo sapiens
gaagggtcctgccgg

SEQ ID NO: 789811 - DNA, 16 bp, Homo sapiens
gaagggtcctgccggt

SEQ ID NO: 789812 - DNA, 22 bp, Homo sapiens
gaagggtgggaagggataattt

SEQ ID NO: 789813 - DNA, 12 bp, Homo sapiens
gaagggtgggga

SEQ ID NO: 789814 - DNA, 22 bp, Homo sapiens
gaagggtggtctgagcaccccc

SEQ ID NO: 789815 - DNA, 22 bp, Homo sapiens
gaagggttctgccctgcctgag

SEQ ID NO: 789816 - DNA, 23 bp, Homo sapiens
gaagggttctgccctgcctgagg

SEQ ID NO: 789817 - DNA, 23 bp, Homo sapiens
gaagttgacttatagtacatgat

SEQ ID NO: 789818 - DNA, 20 bp, Homo sapiens
gaagttgcattcctttgtct

SEQ ID NO: 789819 - DNA, 17 bp, Homo sapiens
gaagttggcacatttca

SEQ ID NO: 789820 - DNA, 14 bp, Homo sapiens
gaagttggccacct

SEQ ID NO: 789821 - DNA, 15 bp, Homo sapiens
gaagttggccacctt

SEQ ID NO: 789822 - DNA, 21 bp, Homo sapiens
gaagttgttactaactaaact

SEQ ID NO: 789823 - DNA, 17 bp, Homo sapiens
gaagtttattctcattt

SEQ ID NO: 789824 - DNA, 21 bp, Homo sapiens
gaagtttatttgagaaaatat

SEQ ID NO: 789825 - DNA, 22 bp, Homo sapiens
gaagtttatttgagaaaatata

SEQ ID NO: 789826 - DNA, 21 bp, Homo sapiens
gaagtttcaagttttaaagtt

SEQ ID NO: 789827 - DNA, 14 bp, Homo sapiens
gaagtttcacatga

SEQ ID NO: 789828 - DNA, 13 bp, Homo sapiens
gaagtttcattta

SEQ ID NO: 789829 - DNA, 19 bp, Homo sapiens
gaagtttccagaaaagaag

SEQ ID NO: 789830 - DNA, 20 bp, Homo sapiens
gaagtttgagatcagcctgg

SEQ ID NO: 789831 - DNA, 14 bp, Homo sapiens
gaagtttgtgtctt

SEQ ID NO: 789832 - DNA, 21 bp, Homo sapiens
gaagtttgtgttctgtttgtt

SEQ ID NO: 789833 - DNA, 17 bp, Homo sapiens
gaagttttacagcaagg

SEQ ID NO: 789834 - DNA, 18 bp, Homo sapiens
gaagttttggagagggaa

SEQ ID NO: 789835 - DNA, 15 bp, Homo sapiens
gaataaaaaagattc

SEQ ID NO: 789836 - DNA, 21 bp, Homo sapiens
gaataaaaaagattctactaa

SEQ ID NO: 789837 - DNA, 15 bp, Homo sapiens
gaataaaaaccctgt

SEQ ID NO: 789838 - DNA, 19 bp, Homo sapiens
gaataaaaaggttggcctt

SEQ ID NO: 789839 - DNA, 23 bp, Homo sapiens
gaataaacattaattttgtgcat

SEQ ID NO: 789840 - DNA, 16 bp, Homo sapiens
gaataaactagattac

SEQ ID NO: 789841 - DNA, 19 bp, Homo sapiens
gaataaactagattacatt

SEQ ID NO: 789842 - DNA, 18 bp, Homo sapiens
gaataaactcaaaactct

SEQ ID NO: 789843 - DNA, 22 bp, Homo sapiens
gaataaactgaatattttggaa

SEQ ID NO: 789844 - DNA, 17 bp, Homo sapiens
gaataaagttcctgtca

SEQ ID NO: 789845 - DNA, 13 bp, Homo sapiens
gaataaagttctg

SEQ ID NO: 789846 - DNA, 20 bp, Homo sapiens
gaataaagttctgttttctg

SEQ ID NO: 789847 - DNA, 12 bp, Homo sapiens
gaataaatgaag

SEQ ID NO: 789848 - DNA, 12 bp, Homo sapiens
gaataaatgtgt

SEQ ID NO: 789849 - DNA, 17 bp, Homo sapiens
gaataaattatggcatt

SEQ ID NO: 789850 - DNA, 20 bp, Homo sapiens
gaataaattcccaacttctc

SEQ ID NO: 789851 - DNA, 18 bp, Homo sapiens
gaataaattttcaaatcc

SEQ ID NO: 789852 - DNA, 14 bp, Homo sapiens
gaataacatttaaa

SEQ ID NO: 789853 - DNA, 22 bp, Homo sapiens
gaataaccacttaaaaaatgtc

SEQ ID NO: 789854 - DNA, 21 bp, Homo sapiens
gaataactatctcacttccag

SEQ ID NO: 789855 - DNA, 21 bp, Homo sapiens
gaataagccattctgactcat

SEQ ID NO: 789856 - DNA, 13 bp, Homo sapiens
gaataagctttct

SEQ ID NO: 789857 - DNA, 19 bp, Homo sapiens
gaataaggtacaagaagca

SEQ ID NO: 789858 - DNA, 16 bp, Homo sapiens
gaataagtgtctttct

SEQ ID NO: 789859 - DNA, 13 bp, Homo sapiens
gaataagttattg

SEQ ID NO: 789860 - DNA, 16 bp, Homo sapiens
gaataagttattgcag

SEQ ID NO: 789861 - DNA, 14 bp, Homo sapiens
gaataataaaatca

SEQ ID NO: 789862 - DNA, 11 bp, Homo sapiens
gaataataaat

SEQ ID NO: 789863 - DNA, 21 bp, Homo sapiens
gaataataaatacacaatgaa

SEQ ID NO: 789864 - DNA, 20 bp, Homo sapiens
gaataatatcaaataaaata

SEQ ID NO: 789865 - DNA, 19 bp, Homo sapiens
gaataatatgctgccaaat

SEQ ID NO: 789866 - DNA, 13 bp, Homo sapiens
gaataatctatta

SEQ ID NO: 789867 - DNA, 18 bp, Homo sapiens
gaataatgaaaataaaac

SEQ ID NO: 789868 - DNA, 16 bp, Homo sapiens
gaataatggaaacatt

SEQ ID NO: 789869 - DNA, 20 bp, Homo sapiens
gaataatggaaacattacag

SEQ ID NO: 789870 - DNA, 20 bp, Homo sapiens
gaataatgtgggaagaaaca

SEQ ID NO: 789871 - DNA, 13 bp, Homo sapiens
gaataattattta

SEQ ID NO: 789872 - DNA, 21 bp, Homo sapiens
gaataattgctttttcacagt

SEQ ID NO: 789873 - DNA, 13 bp, Homo sapiens
gaataatttatta

SEQ ID NO: 789874 - DNA, 17 bp, Homo sapiens
gaataatttattattaa

SEQ ID NO: 789875 - DNA, 14 bp, Homo sapiens
gaataatttcccaa

SEQ ID NO: 789876 - DNA, 23 bp, Homo sapiens
gaataatttcccaattaggaagt

SEQ ID NO: 789877 - DNA, 23 bp, Homo sapiens
gaataatttgtaaatgattttaa

SEQ ID NO: 789878 - DNA, 16 bp, Homo sapiens
gaataattttggaata

SEQ ID NO: 789879 - DNA, 12 bp, Homo sapiens
gaatacacagta

SEQ ID NO: 789880 - DNA, 14 bp, Homo sapiens
gaatacagaaagat

SEQ ID NO: 789881 - DNA, 21 bp, Homo sapiens
gaatacagaggcaactgcatt

SEQ ID NO: 789882 - DNA, 20 bp, Homo sapiens
gaatacagtgttattttctt

SEQ ID NO: 789883 - DNA, 14 bp, Homo sapiens
gaatacattttatt

SEQ ID NO: 789884 - DNA, 18 bp, Homo sapiens
gaatacattttattctgt

SEQ ID NO: 789885 - DNA, 16 bp, Homo sapiens
gaataccactctgtaa

SEQ ID NO: 789886 - DNA, 18 bp, Homo sapiens
gaatacgcagaactacca

SEQ ID NO: 789887 - DNA, 21 bp, Homo sapiens
gaatacgctaagcctggaagc

SEQ ID NO: 789888 - DNA, 20 bp, Homo sapiens
gaatactatccatgtaataa

SEQ ID NO: 789889 - DNA, 16 bp, Homo sapiens
gaatactcacattttg

SEQ ID NO: 789890 - DNA, 13 bp, Homo sapiens
gaatactcttgaa

SEQ ID NO: 789891 - DNA, 16 bp, Homo sapiens
gaatactcttgaaagg

SEQ ID NO: 789892 - DNA, 12 bp, Homo sapiens
gaatacttattt

SEQ ID NO: 789893 - DNA, 13 bp, Homo sapiens
gaatacttatttt

SEQ ID NO: 789894 - DNA, 19 bp, Homo sapiens
gaatacttttgccctttga

SEQ ID NO: 789895 - DNA, 14 bp, Homo sapiens
gaatactttttaca

SEQ ID NO: 789896 - DNA, 17 bp, Homo sapiens
gaatagaagctaaggtt

SEQ ID NO: 789897 - DNA, 19 bp, Homo sapiens
gaatagacatcaaactcaa

SEQ ID NO: 789898 - DNA, 13 bp, Homo sapiens
gaatagagcctcg

SEQ ID NO: 789899 - DNA, 15 bp, Homo sapiens
gaatagagctgccac

SEQ ID NO: 789900 - DNA, 15 bp, Homo sapiens
gaatagaggaagaaa

SEQ ID NO: 789901 - DNA, 16 bp, Homo sapiens
gaatagatatgaaagc

SEQ ID NO: 789902 - DNA, 19 bp, Homo sapiens
gaatagatatgaaagctga

SEQ ID NO: 789903 - DNA, 20 bp, Homo sapiens
gaatagatcagtatttcact

SEQ ID NO: 789904 - DNA, 15 bp, Homo sapiens
gaatagatgctgact

SEQ ID NO: 789905 - DNA, 15 bp, Homo sapiens
gaatagatgtcttca

SEQ ID NO: 789906 - DNA, 15 bp, Homo sapiens
gaatagatgtgatca

SEQ ID NO: 789907 - DNA, 18 bp, Homo sapiens
gaatagattttctctgga

SEQ ID NO: 789908 - DNA, 19 bp, Homo sapiens
gaatagattttctctggaa

SEQ ID NO: 789909 - DNA, 20 bp, Homo sapiens
gaatagattttctctggaaa

SEQ ID NO: 789910 - DNA, 21 bp, Homo sapiens
gaatagcaaaattcctgtgtt

SEQ ID NO: 789911 - DNA, 19 bp, Homo sapiens
gaatagcaaggtgctcaca

SEQ ID NO: 789912 - DNA, 23 bp, Homo sapiens
gaatagccacatttggaatactt

SEQ ID NO: 789913 - DNA, 15 bp, Homo sapiens
gaatagccagagagg

SEQ ID NO: 789914 - DNA, 12 bp, Homo sapiens
gaatagcctggc

SEQ ID NO: 789915 - DNA, 13 bp, Homo sapiens
gaatagcctggcc

SEQ ID NO: 789916 - DNA, 18 bp, Homo sapiens
gaatagctgttttgtgta

SEQ ID NO: 789917 - DNA, 21 bp, Homo sapiens
gaatagctgttttgtgtatat

SEQ ID NO: 789918 - DNA, 19 bp, Homo sapiens
gaatagctttaaaagggaa

SEQ ID NO: 789919 - DNA, 22 bp, Homo sapiens
gaatagggaagtaaaaaaacaa

SEQ ID NO: 789920 - DNA, 23 bp, Homo sapiens
gaatagtctagatggctcctctc

SEQ ID NO: 789921 - DNA, 20 bp, Homo sapiens
gaatagtgcctaaagtgctg

SEQ ID NO: 789922 - DNA, 18 bp, Homo sapiens
gaatagtggacatggtca

SEQ ID NO: 789923 - DNA, 13 bp, Homo sapiens
gaatataaaaaat

SEQ ID NO: 789924 - DNA, 17 bp, Homo sapiens
gaatataaatgtgtgta

SEQ ID NO: 789925 - DNA, 17 bp, Homo sapiens
gaatataacatgtaaaa

SEQ ID NO: 789926 - DNA, 13 bp, Homo sapiens
gaatataagaaaa

SEQ ID NO: 789927 - DNA, 16 bp, Homo sapiens
gaatataatactgtat

SEQ ID NO: 789928 - DNA, 19 bp, Homo sapiens
gaatataatatatttgtgt

SEQ ID NO: 789929 - DNA, 12 bp, Homo sapiens
gaatataatgga

SEQ ID NO: 789930 - DNA, 12 bp, Homo sapiens
gaatataattat

SEQ ID NO: 789931 - DNA, 21 bp, Homo sapiens
gaatataggcacattaccatt

SEQ ID NO: 789932 - DNA, 14 bp, Homo sapiens
gaatataggtctct

SEQ ID NO: 789933 - DNA, 22 bp, Homo sapiens
gaatatagttctgtgtagagaa

SEQ ID NO: 789934 - DNA, 23 bp, Homo sapiens
gaatatagttctgtgtagagaat

SEQ ID NO: 789935 - DNA, 21 bp, Homo sapiens
gaatatatagtgtatagaagc

SEQ ID NO: 789936 - DNA, 20 bp, Homo sapiens
gaatatatctctatttgaga

SEQ ID NO: 789937 - DNA, 22 bp, Homo sapiens
gaatgaaaatgcagtcctgagg

SEQ ID NO: 789938 - DNA, 17 bp, Homo sapiens
gaatgaaattcctcctt

SEQ ID NO: 789939 - DNA, 16 bp, Homo sapiens
gaatgaaattgctgaa

SEQ ID NO: 789940 - DNA, 19 bp, Homo sapiens
gaatgaaccctcctccttt

SEQ ID NO: 789941 - DNA, 20 bp, Homo sapiens
gaatgaaccctcctcctttt

SEQ ID NO: 789942 - DNA, 16 bp, Homo sapiens
gaatgaactgtggaat

SEQ ID NO: 789943 - DNA, 17 bp, Homo sapiens
gaatgaactgtggaatt

SEQ ID NO: 789944 - DNA, 15 bp, Homo sapiens
gaatgaatttatctt

SEQ ID NO: 789945 - DNA, 16 bp, Homo sapiens
gaatgaatttatcttt

SEQ ID NO: 789946 - DNA, 20 bp, Homo sapiens
gaatgaatttatctttacca

SEQ ID NO: 789947 - DNA, 20 bp, Homo sapiens
gaatgacggtaagtgttctc

SEQ ID NO: 789948 - DNA, 13 bp, Homo sapiens
gaatgacttactt

SEQ ID NO: 789949 - DNA, 17 bp, Homo sapiens
gaatgagagcgacacag

SEQ ID NO: 789950 - DNA, 19 bp, Homo sapiens
gaatgagagcgacacagac

SEQ ID NO: 789951 - DNA, 20 bp, Homo sapiens
gaatgagagcgacacagacg

SEQ ID NO: 789952 - DNA, 14 bp, Homo sapiens
gaatgagagtgtga

SEQ ID NO: 789953 - DNA, 17 bp, Homo sapiens
gaatgagagttccttct

SEQ ID NO: 789954 - DNA, 14 bp, Homo sapiens
gaatgagcccagag

SEQ ID NO: 789955 - DNA, 16 bp, Homo sapiens
gaatgaggtcccaggc

SEQ ID NO: 789956 - DNA, 22 bp, Homo sapiens
gaatgaggtcccaggcagagaa

SEQ ID NO: 789957 - DNA, 14 bp, Homo sapiens
gaatgaggtgggag

SEQ ID NO: 789958 - DNA, 18 bp, Homo sapiens
gaatgagtcaatcagcct

SEQ ID NO: 789959 - DNA, 19 bp, Homo sapiens
gaatgagtcaatcagcctt

SEQ ID NO: 789960 - DNA, 12 bp, Homo sapiens
gaatgatagaac

SEQ ID NO: 789961 - DNA, 21 bp, Homo sapiens
gaatgatagtaataggataca

SEQ ID NO: 789962 - DNA, 22 bp, Homo sapiens
gaatgatatctttgacctcaat

SEQ ID NO: 789963 - DNA, 22 bp, Homo sapiens
gaatgatcttgtgtaaggtttt

SEQ ID NO: 789964 - DNA, 13 bp, Homo sapiens
gaatgatgaagct

SEQ ID NO: 789965 - DNA, 21 bp, Homo sapiens
gaatgatggtttccagcttca

SEQ ID NO: 789966 - DNA, 13 bp, Homo sapiens
gaatgattaatca

SEQ ID NO: 789967 - DNA, 15 bp, Homo sapiens
gaatgattcagtgtt

SEQ ID NO: 789968 - DNA, 20 bp, Homo sapiens
gaatgattcatgttatattt

SEQ ID NO: 789969 - DNA, 23 bp, Homo sapiens
gaatgattctaatttttaagcaa

SEQ ID NO: 789970 - DNA, 16 bp, Homo sapiens
gaatgatttccaaaga

SEQ ID NO: 789971 - DNA, 16 bp, Homo sapiens
gaatgatttttcttta

SEQ ID NO: 789972 - DNA, 18 bp, Homo sapiens
gaatgatttttctttaca

SEQ ID NO: 789973 - DNA, 14 bp, Homo sapiens
gaatgcaatccttc

SEQ ID NO: 789974 - DNA, 18 bp, Homo sapiens
gaatgcacaagaatggat

SEQ ID NO: 789975 - DNA, 20 bp, Homo sapiens
gaatgcacaagaatggatca

SEQ ID NO: 789976 - DNA, 21 bp, Homo sapiens
gaatgcacaagaatggatcac

SEQ ID NO: 789977 - DNA, 18 bp, Homo sapiens
gaatgcagaggtctccaa

SEQ ID NO: 789978 - DNA, 22 bp, Homo sapiens
gaatgcagattcctgggcctgt

SEQ ID NO: 789979 - DNA, 16 bp, Homo sapiens
gaatgcagcaggaagg

SEQ ID NO: 789980 - DNA, 13 bp, Homo sapiens
gaatgcagcccac

SEQ ID NO: 789981 - DNA, 13 bp, Homo sapiens
gaatgcattcaaa

SEQ ID NO: 789982 - DNA, 15 bp, Homo sapiens
gaatgcattccctga

SEQ ID NO: 789983 - DNA, 16 bp, Homo sapiens
gaatgccatttctcac

SEQ ID NO: 789984 - DNA, 17 bp, Homo sapiens
gaatgcccacaggcaaa

SEQ ID NO: 789985 - DNA, 22 bp, Homo sapiens
gaatgcctcaatgtgaccaggg

SEQ ID NO: 789986 - DNA, 18 bp, Homo sapiens
gaatgcctcctgtgggga

SEQ ID NO: 789987 - DNA, 15 bp, Homo sapiens
gaatgcctgtgccaa

SEQ ID NO: 789988 - DNA, 22 bp, Homo sapiens
gaatgccttggaaatagaaaga

SEQ ID NO: 789989 - DNA, 12 bp, Homo sapiens
gaatgctcaggg

SEQ ID NO: 789990 - DNA, 16 bp, Homo sapiens
gaatgctcccagctgt

SEQ ID NO: 789991 - DNA, 19 bp, Homo sapiens
gaatgctcccagctgtgct

SEQ ID NO: 789992 - DNA, 19 bp, Homo sapiens
gaatgctcccccatcctcc

SEQ ID NO: 789993 - DNA, 23 bp, Homo sapiens
gaatgctcccccatcctcccctt

SEQ ID NO: 789994 - DNA, 19 bp, Homo sapiens
gaatgctgaactccttgtt

SEQ ID NO: 789995 - DNA, 16 bp, Homo sapiens
gaatgctgaggcctcg

SEQ ID NO: 789996 - DNA, 12 bp, Homo sapiens
gaatgctgccag

SEQ ID NO: 789997 - DNA, 15 bp, Homo sapiens
gaatgctgccagtgt

SEQ ID NO: 789998 - DNA, 13 bp, Homo sapiens
gaatgctgcccgg

SEQ ID NO: 789999 - DNA, 23 bp, Homo sapiens
gaatgctggactggaggcccctg

SEQ ID NO: 790000 - DNA, 14 bp, Homo sapiens
gaatgctgggactc

SEQ ID NO: 790001 - DNA, 17 bp, Homo sapiens
gaatgctgggactcagc

SEQ ID NO: 790002 - DNA, 19 bp, Homo sapiens
gaatgctgggactcagcct

SEQ ID NO: 790003 - DNA, 11 bp, Homo sapiens
gaatgctgggc

SEQ ID NO: 790004 - DNA, 20 bp, Homo sapiens
gaatgctgggtatgctctgt

SEQ ID NO: 790005 - DNA, 23 bp, Homo sapiens
gaatgctgggtatgctctgtgac

SEQ ID NO: 790006 - DNA, 17 bp, Homo sapiens
gaatgctggttttccta

SEQ ID NO: 790007 - DNA, 22 bp, Homo sapiens
gaatgctggttttcctaaatgc

SEQ ID NO: 790008 - DNA, 20 bp, Homo sapiens
gaatgctgtacatctatttt

SEQ ID NO: 790009 - DNA, 20 bp, Homo sapiens
gaatggaactactgtacttt

SEQ ID NO: 790010 - DNA, 11 bp, Homo sapiens
gaatggaataa

SEQ ID NO: 790011 - DNA, 21 bp, Homo sapiens
gaatggaatcgatttcctccc

SEQ ID NO: 790012 - DNA, 16 bp, Homo sapiens
gaatggactaagatga

SEQ ID NO: 790013 - DNA, 13 bp, Homo sapiens
gaatggagacaga

SEQ ID NO: 790014 - DNA, 17 bp, Homo sapiens
gaatggaggatattcta

SEQ ID NO: 790015 - DNA, 13 bp, Homo sapiens
gaatggaggcaga

SEQ ID NO: 790016 - DNA, 19 bp, Homo sapiens
gaatggatcacaagatgga

SEQ ID NO: 790017 - DNA, 15 bp, Homo sapiens
gaatggctgggtcag

SEQ ID NO: 790018 - DNA, 14 bp, Homo sapiens
gaatgggagacctg

SEQ ID NO: 790019 - DNA, 14 bp, Homo sapiens
gaatgggggtcaga

SEQ ID NO: 790020 - DNA, 15 bp, Homo sapiens
gaatggggttcctgc

SEQ ID NO: 790021 - DNA, 13 bp, Homo sapiens
gaatggtccaggg

SEQ ID NO: 790022 - DNA, 13 bp, Homo sapiens
gaatggtggtgga

SEQ ID NO: 790023 - DNA, 17 bp, Homo sapiens
gaatggttaataaaact

SEQ ID NO: 790024 - DNA, 18 bp, Homo sapiens
gaatggttaataaaactg

SEQ ID NO: 790025 - DNA, 22 bp, Homo sapiens
gaatggttccatgcctgagggt

SEQ ID NO: 790026 - DNA, 22 bp, Homo sapiens
gaatgtaaaagaacttactgat

SEQ ID NO: 790027 - DNA, 15 bp, Homo sapiens
gaatgtaaagcttgt

SEQ ID NO: 790028 - DNA, 18 bp, Homo sapiens
gaatgtaagaaaacaaaa

SEQ ID NO: 790029 - DNA, 23 bp, Homo sapiens
gaatgtaagaaaacaaaatctaa

SEQ ID NO: 790030 - DNA, 17 bp, Homo sapiens
gaatatctgtaatggta

SEQ ID NO: 790031 - DNA, 20 bp, Homo sapiens
gaatatgatccctaatgtgt

SEQ ID NO: 790032 - DNA, 15 bp, Homo sapiens
gaatatggaacatat

SEQ ID NO: 790033 - DNA, 15 bp, Homo sapiens
gaatatgtttccttg

SEQ ID NO: 790034 - DNA, 13 bp, Homo sapiens
gaatattaaaaaa

SEQ ID NO: 790035 - DNA, 19 bp, Homo sapiens
gaatattcaaaattccaaa

SEQ ID NO: 790036 - DNA, 15 bp, Homo sapiens
gaatattcaggactt

SEQ ID NO: 790037 - DNA, 18 bp, Homo sapiens
gaatattcccaagcccat

SEQ ID NO: 790038 - DNA, 24 bp, Homo sapiens
gaatattcctggacttacaaaatg

SEQ ID NO: 790039 - DNA, 21 bp, Homo sapiens
gaatattgcaaaatacatgaa

SEQ ID NO: 790040 - DNA, 19 bp, Homo sapiens
gaatattgccattatgctt

SEQ ID NO: 790041 - DNA, 23 bp, Homo sapiens
gaatattgtattgttagatgttt

SEQ ID NO: 790042 - DNA, 15 bp, Homo sapiens
gaatattgtgattct

SEQ ID NO: 790043 - DNA, 17 bp, Homo sapiens
gaatattgtgattctgt

SEQ ID NO: 790044 - DNA, 19 bp, Homo sapiens
gaatatttataggccaggg

SEQ ID NO: 790045 - DNA, 20 bp, Homo sapiens
gaatatttatatttcactat

SEQ ID NO: 790046 - DNA, 19 bp, Homo sapiens
gaatatttattacctctga

SEQ ID NO: 790047 - DNA, 19 bp, Homo sapiens
gaatatttccatatggatt

SEQ ID NO: 790048 - DNA, 21 bp, Homo sapiens
gaatattttcattaaaagcta

SEQ ID NO: 790049 - DNA, 22 bp, Homo sapiens
gaatattttggaaactgctaaa

SEQ ID NO: 790050 - DNA, 14 bp, Homo sapiens
gaatcaaacatttt

SEQ ID NO: 790051 - DNA, 16 bp, Homo sapiens
gaatcaaagacatgga

SEQ ID NO: 790052 - DNA, 17 bp, Homo sapiens
gaatcaaatctgtgctc

SEQ ID NO: 790053 - DNA, 20 bp, Homo sapiens
gaatcaagatgtcagactgg

SEQ ID NO: 790054 - DNA, 21 bp, Homo sapiens
gaatcaagatgtcagactggc

SEQ ID NO: 790055 - DNA, 16 bp, Homo sapiens
gaatcaagcacactgt

SEQ ID NO: 790056 - DNA, 22 bp, Homo sapiens
gaatcaagctagaaggccacat

SEQ ID NO: 790057 - DNA, 18 bp, Homo sapiens
gaatcaaggtaagctcag

SEQ ID NO: 790058 - DNA, 14 bp, Homo sapiens
gaatcaatcctggg

SEQ ID NO: 790059 - DNA, 23 bp, Homo sapiens
gaatcagaacagatgctgagcca

SEQ ID NO: 790060 - DNA, 22 bp, Homo sapiens
gaatcagaagatagtcttggaa

SEQ ID NO: 790061 - DNA, 16 bp, Homo sapiens
gaatcagaatcatgga

SEQ ID NO: 790062 - DNA, 18 bp, Homo sapiens
gaatcagaatcatggaga

SEQ ID NO: 790063 - DNA, 23 bp, Homo sapiens
gaatcagaccctaccccaccacg

SEQ ID NO: 790064 - DNA, 18 bp, Homo sapiens
gaatcagctggacatact

SEQ ID NO: 790065 - DNA, 13 bp, Homo sapiens
gaatcaggagagg

SEQ ID NO: 790066 - DNA, 15 bp, Homo sapiens
gaatcaggtttccaa

SEQ ID NO: 790067 - DNA, 23 bp, Homo sapiens
gaatcagtatttccttccactgt

SEQ ID NO: 790068 - DNA, 20 bp, Homo sapiens
gaatcagtcctagaatgttt

SEQ ID NO: 790069 - DNA, 16 bp, Homo sapiens
gaatcagtgttaaatt

SEQ ID NO: 790070 - DNA, 19 bp, Homo sapiens
gaatcatgagcctgctgga

SEQ ID NO: 790071 - DNA, 20 bp, Homo sapiens
gaatcatgtcaggcctgtgt

SEQ ID NO: 790072 - DNA, 19 bp, Homo sapiens
gaatcatgtgaacccggga

SEQ ID NO: 790073 - DNA, 14 bp, Homo sapiens
gaatcattgcttat

SEQ ID NO: 790074 - DNA, 22 bp, Homo sapiens
gaatcatttctatttctcctcc

SEQ ID NO: 790075 - DNA, 23 bp, Homo sapiens
gaatcatttgttcaaagctgttg

SEQ ID NO: 790076 - DNA, 12 bp, Homo sapiens
gaatccaaactt

SEQ ID NO: 790077 - DNA, 18 bp, Homo sapiens
gaatccaaatctgtcctc

SEQ ID NO: 790078 - DNA, 12 bp, Homo sapiens
gaatccaagatt

SEQ ID NO: 790079 - DNA, 15 bp, Homo sapiens
gaatccaagctccct

SEQ ID NO: 790080 - DNA, 16 bp, Homo sapiens
gaatccaagctccctg

SEQ ID NO: 790081 - DNA, 17 bp, Homo sapiens
gaatccaagctccctgc

SEQ ID NO: 790082 - DNA, 17 bp, Homo sapiens
gaatccaagtgaacact

SEQ ID NO: 790083 - DNA, 20 bp, Homo sapiens
gaatccaatactgcccaagg

SEQ ID NO: 790084 - DNA, 15 bp, Homo sapiens
gaatccacccatcct

SEQ ID NO: 790085 - DNA, 24 bp, Homo sapiens
gaatccacccatcctaccaatgca

SEQ ID NO: 790086 - DNA, 16 bp, Homo sapiens
gaatccataaatgtgt

SEQ ID NO: 790087 - DNA, 19 bp, Homo sapiens
gaatccataaatgtgttcc

SEQ ID NO: 790088 - DNA, 15 bp, Homo sapiens
gaatccatcctgcaa

SEQ ID NO: 790089 - DNA, 15 bp, Homo sapiens
gaatccattggagaa

SEQ ID NO: 790090 - DNA, 17 bp, Homo sapiens
gaatccattggagaagc

SEQ ID NO: 790091 - DNA, 17 bp, Homo sapiens
gaatcccaaatttgatt

SEQ ID NO: 790092 - DNA, 15 bp, Homo sapiens
gaatcccaagaccca

SEQ ID NO: 790093 - DNA, 17 bp, Homo sapiens
gaatcccagaggtggga

SEQ ID NO: 790094 - DNA, 18 bp, Homo sapiens
gaatccctgcagcctggt

SEQ ID NO: 790095 - DNA, 13 bp, Homo sapiens
gaatccctgggag

SEQ ID NO: 790096 - DNA, 19 bp, Homo sapiens
gaatccctgggagcgcctg

SEQ ID NO: 790097 - DNA, 17 bp, Homo sapiens
gaatccctgttcattgt

SEQ ID NO: 790098 - DNA, 19 bp, Homo sapiens
gaatcccttaacagttgta

SEQ ID NO: 790099 - DNA, 22 bp, Homo sapiens
gaatccctttgcacctgagacc

SEQ ID NO: 790100 - DNA, 14 bp, Homo sapiens
gaatcctcagagag

SEQ ID NO: 790101 - DNA, 12 bp, Homo sapiens
gaatcctgcctc

SEQ ID NO: 790102 - DNA, 13 bp, Homo sapiens
gaatcctgcctct

SEQ ID NO: 790103 - DNA, 14 bp, Homo sapiens
gaatcctggcagcc

SEQ ID NO: 790104 - DNA, 16 bp, Homo sapiens
gaatcctggcagccca

SEQ ID NO: 790105 - DNA, 14 bp, Homo sapiens
gaatcgaagtgttt

SEQ ID NO: 790106 - DNA, 22 bp, Homo sapiens
gaatcgatgggggatgcttcat

SEQ ID NO: 790107 - DNA, 16 bp, Homo sapiens
gaatcgcagctgtggg

SEQ ID NO: 790108 - DNA, 13 bp, Homo sapiens
gaatctaaacgtg

SEQ ID NO: 790109 - DNA, 21 bp, Homo sapiens
gaatctaaacgtggtcacctt

SEQ ID NO: 790110 - DNA, 20 bp, Homo sapiens
gaatctaagctgtttgccaa

SEQ ID NO: 790111 - DNA, 22 bp, Homo sapiens
gaatctaaggataatgaaataa

SEQ ID NO: 790112 - DNA, 16 bp, Homo sapiens
gaatctacccaaagga

SEQ ID NO: 790113 - DNA, 17 bp, Homo sapiens
gaatctacccaaaggat

SEQ ID NO: 790114 - DNA, 22 bp, Homo sapiens
gaatctacccccagatccaagc

SEQ ID NO: 790115 - DNA, 15 bp, Homo sapiens
gaatctactaattcc

SEQ ID NO: 790116 - DNA, 13 bp, Homo sapiens
gaatctatattta

SEQ ID NO: 790117 - DNA, 20 bp, Homo sapiens
gaatctatggctttaaataa

SEQ ID NO: 790118 - DNA, 16 bp, Homo sapiens
gaatctattagatttt

SEQ ID NO: 790119 - DNA, 13 bp, Homo sapiens
gaatctatttaag

SEQ ID NO: 790120 - DNA, 18 bp, Homo sapiens
gaatctcataattggaat

SEQ ID NO: 790121 - DNA, 20 bp, Homo sapiens
gaatctctctactcagatga

SEQ ID NO: 790122 - DNA, 15 bp, Homo sapiens
gaatctctgcctctc

SEQ ID NO: 790123 - DNA, 13 bp, Homo sapiens
gaatctctgtgcc

SEQ ID NO: 790124 - DNA, 14 bp, Homo sapiens
gaatctctgtgcct

SEQ ID NO: 790125 - DNA, 12 bp, Homo sapiens
gaatctcttcac

SEQ ID NO: 790126 - DNA, 21 bp, Homo sapiens
gaatctcttcatgcttgacat

SEQ ID NO: 790127 - DNA, 12 bp, Homo sapiens
gaatctgcaggg

SEQ ID NO: 790128 - DNA, 20 bp, Homo sapiens
gaatctgccttccagcccag

SEQ ID NO: 790129 - DNA, 12 bp, Homo sapiens
gacaaacccttc

SEQ ID NO: 790130 - DNA, 13 bp, Homo sapiens
gacaaacctagct

SEQ ID NO: 790131 - DNA, 20 bp, Homo sapiens
gacaaacctagcttttaaaa

SEQ ID NO: 790132 - DNA, 17 bp, Homo sapiens
gacaaagactcctctgg

SEQ ID NO: 790133 - DNA, 18 bp, Homo sapiens
gacaaagactcctctggg

SEQ ID NO: 790134 - DNA, 20 bp, Homo sapiens
gacaaagccagaggagaaga

SEQ ID NO: 790135 - DNA, 17 bp, Homo sapiens
gacaaaggacatttgtt

SEQ ID NO: 790136 - DNA, 15 bp, Homo sapiens
gacaaaggatgaaga

SEQ ID NO: 790137 - DNA, 12 bp, Homo sapiens
gacaaaggcctg

SEQ ID NO: 790138 - DNA, 23 bp, Homo sapiens
gacaaagtcaataaaagagctgt

SEQ ID NO: 790139 - DNA, 22 bp, Homo sapiens
gacaaagtcatcccctctcagg

SEQ ID NO: 790140 - DNA, 12 bp, Homo sapiens
gacaaagtgcct

SEQ ID NO: 790141 - DNA, 14 bp, Homo sapiens
gacaaagtgggtgt

SEQ ID NO: 790142 - DNA, 12 bp, Homo sapiens
gacaaagtgttg

SEQ ID NO: 790143 - DNA, 22 bp, Homo sapiens
gacaaataaatgattatattca

SEQ ID NO: 790144 - DNA, 17 bp, Homo sapiens
gacaaatagaaaatggt

SEQ ID NO: 790145 - DNA, 23 bp, Homo sapiens
gacaaataggagtgagtgtatgt

SEQ ID NO: 790146 - DNA, 13 bp, Homo sapiens
gacaaatcaacag

SEQ ID NO: 790147 - DNA, 16 bp, Homo sapiens
gacaaatcacatattt

SEQ ID NO: 790148 - DNA, 15 bp, Homo sapiens
gacaaatcctttctg

SEQ ID NO: 790149 - DNA, 21 bp, Homo sapiens
gacaaatcctttctgcccccc

SEQ ID NO: 790150 - DNA, 18 bp, Homo sapiens
gacaaatctcagaacctt

SEQ ID NO: 790151 - DNA, 17 bp, Homo sapiens
gacaaatctttaagaat

SEQ ID NO: 790152 - DNA, 18 bp, Homo sapiens
gacaaattagcatgcaag

SEQ ID NO: 790153 - DNA, 21 bp, Homo sapiens
gacaaattagcatgcaagctt

SEQ ID NO: 790154 - DNA, 13 bp, Homo sapiens
gacaaattatatt

SEQ ID NO: 790155 - DNA, 15 bp, Homo sapiens
gacaaattatatttg

SEQ ID NO: 790156 - DNA, 11 bp, Homo sapiens
gacaacactga

SEQ ID NO: 790157 - DNA, 17 bp, Homo sapiens
gacaacagaaaaacaat

SEQ ID NO: 790158 - DNA, 23 bp, Homo sapiens
gacaacagaaaaacaatcttatt

SEQ ID NO: 790159 - DNA, 22 bp, Homo sapiens
gacaacagaagtcatgaagccc

SEQ ID NO: 790160 - DNA, 12 bp, Homo sapiens
gacaacagttct

SEQ ID NO: 790161 - DNA, 14 bp, Homo sapiens
gacaacagttctga

SEQ ID NO: 790162 - DNA, 17 bp, Homo sapiens
gacaacatcccacagtg

SEQ ID NO: 790163 - DNA, 18 bp, Homo sapiens
gacaacatcccacagtgg

SEQ ID NO: 790164 - DNA, 14 bp, Homo sapiens
gacaacatgtttaa

SEQ ID NO: 790165 - DNA, 22 bp, Homo sapiens
gacaacatttctatagccaaaa

SEQ ID NO: 790166 - DNA, 14 bp, Homo sapiens
gacaaccaaaacat

SEQ ID NO: 790167 - DNA, 19 bp, Homo sapiens
gacaaccaccgctccccag

SEQ ID NO: 790168 - DNA, 19 bp, Homo sapiens
gacaaccactggtctgtag

SEQ ID NO: 790169 - DNA, 19 bp, Homo sapiens
gacaaccattaaagtcaga

SEQ ID NO: 790170 - DNA, 15 bp, Homo sapiens
gacaacccaggcagt

SEQ ID NO: 790171 - DNA, 13 bp, Homo sapiens
gacaaccccccaa

SEQ ID NO: 790172 - DNA, 14 bp, Homo sapiens
gacaaccctggcct

SEQ ID NO: 790173 - DNA, 21 bp, Homo sapiens
gacaaccgatgctccagccaa

SEQ ID NO: 790174 - DNA, 13 bp, Homo sapiens
gacaaccttgtcc

SEQ ID NO: 790175 - DNA, 22 bp, Homo sapiens
gacacttgccttcttcacccag

SEQ ID NO: 790176 - DNA, 20 bp, Homo sapiens
gacactttgaaatgtgtttc

SEQ ID NO: 790177 - DNA, 23 bp, Homo sapiens
gacacttttcaaaagaagacatc

SEQ ID NO: 790178 - DNA, 23 bp, Homo sapiens
gacactttttgtattttttcctt

SEQ ID NO: 790179 - DNA, 19 bp, Homo sapiens
gacacttttttgagtggat

SEQ ID NO: 790180 - DNA, 19 bp, Homo sapiens
gacagaaaagtgcctgagc

SEQ ID NO: 790181 - DNA, 16 bp, Homo sapiens
gacagaaaccaagcca

SEQ ID NO: 790182 - DNA, 13 bp, Homo sapiens
gacagaagcaggc

SEQ ID NO: 790183 - DNA, 17 bp, Homo sapiens
gacagaagcaggctgga

SEQ ID NO: 790184 - DNA, 14 bp, Homo sapiens
gacagaaggtgcca

SEQ ID NO: 790185 - DNA, 23 bp, Homo sapiens
gacagaaggtgccactttaccca

SEQ ID NO: 790186 - DNA, 23 bp, Homo sapiens
gacagacaacactgggaaacaga

SEQ ID NO: 790187 - DNA, 15 bp, Homo sapiens
gacagacacacacac

SEQ ID NO: 790188 - DNA, 14 bp, Homo sapiens
gacagacacctccc

SEQ ID NO: 790189 - DNA, 21 bp, Homo sapiens
gacagacacctccccctaccc

SEQ ID NO: 790190 - DNA, 23 bp, Homo sapiens
gacagacacctccccctacccat

SEQ ID NO: 790191 - DNA, 14 bp, Homo sapiens
gacagacaggctct

SEQ ID NO: 790192 - DNA, 15 bp, Homo sapiens
gacagacaggctctt

SEQ ID NO: 790193 - DNA, 18 bp, Homo sapiens
gacagaccacatctttat

SEQ ID NO: 790194 - DNA, 23 bp, Homo sapiens
gacagactcacaacctgaaccta

SEQ ID NO: 790195 - DNA, 23 bp, Homo sapiens
gacagactcctgaggacagctgt

SEQ ID NO: 790196 - DNA, 22 bp, Homo sapiens
gacagactttggacagtggcct

SEQ ID NO: 790197 - DNA, 12 bp, Homo sapiens
gacagagaaggg

SEQ ID NO: 790198 - DNA, 13 bp, Homo sapiens
gacagagactcag

SEQ ID NO: 790199 - DNA, 17 bp, Homo sapiens
gacagagcaaagcgccc

SEQ ID NO: 790200 - DNA, 22 bp, Homo sapiens
gacagaggaaagggctggctcc

SEQ ID NO: 790201 - DNA, 18 bp, Homo sapiens
gacagaggagcttttctg

SEQ ID NO: 790202 - DNA, 15 bp, Homo sapiens
gacagaggccaagga

SEQ ID NO: 790203 - DNA, 14 bp, Homo sapiens
gacagaggccctgc

SEQ ID NO: 790204 - DNA, 15 bp, Homo sapiens
gacagaggccctgcc

SEQ ID NO: 790205 - DNA, 18 bp, Homo sapiens
gacagaggccctgccacg

SEQ ID NO: 790206 - DNA, 21 bp, Homo sapiens
gacagaggccctgccacgtcc

SEQ ID NO: 790207 - DNA, 22 bp, Homo sapiens
gacagaggctgcacccctgggc

SEQ ID NO: 790208 - DNA, 15 bp, Homo sapiens
gacagaggggactct

SEQ ID NO: 790209 - DNA, 16 bp, Homo sapiens
gacagaggggactctg

SEQ ID NO: 790210 - DNA, 17 bp, Homo sapiens
gacagaggggactctgg

SEQ ID NO: 790211 - DNA, 16 bp, Homo sapiens
gacagagtatgaacac

SEQ ID NO: 790212 - DNA, 23 bp, Homo sapiens
gacagatacgtagttgtgctttt

SEQ ID NO: 790213 - DNA, 18 bp, Homo sapiens
gacagatagacagtgctg

SEQ ID NO: 790214 - DNA, 23 bp, Homo sapiens
gacagatagacagtgctgccctg

SEQ ID NO: 790215 - DNA, 14 bp, Homo sapiens
gacagatcaagctg

SEQ ID NO: 790216 - DNA, 16 bp, Homo sapiens
gacagatcaagctgtg

SEQ ID NO: 790217 - DNA, 14 bp, Homo sapiens
gacagatcactcct

SEQ ID NO: 790218 - DNA, 18 bp, Homo sapiens
gacagatcactcctggag

SEQ ID NO: 790219 - DNA, 22 bp, Homo sapiens
gacagatcataggaagtggctg

SEQ ID NO: 790220 - DNA, 15 bp, Homo sapiens
gacagatgcaagtta

SEQ ID NO: 790221 - DNA, 16 bp, Homo sapiens
gacagatggacgcagg

SEQ ID NO: 790222 - DNA, 19 bp, Homo sapiens
gacagatggacgcaggccc

SEQ ID NO: 790223 - DNA, 20 bp, Homo sapiens
gacagatggacgcaggccct

SEQ ID NO: 790224 - DNA, 21 bp, Homo sapiens
gacagatggacgcaggccctg

SEQ ID NO: 790225 - DNA, 16 bp, Homo sapiens
gacagatggcccaagg

SEQ ID NO: 790226 - DNA, 22 bp, Homo sapiens
gacagatggcccaagggatggc

SEQ ID NO: 790227 - DNA, 14 bp, Homo sapiens
gacagattaatatt

SEQ ID NO: 790228 - DNA, 16 bp, Homo sapiens
gacagcaaaaccattg

SEQ ID NO: 790229 - DNA, 19 bp, Homo sapiens
gacagcaaaaccattgctt

SEQ ID NO: 790230 - DNA, 20 bp, Homo sapiens
gacagcaaaaccattgcttc

SEQ ID NO: 790231 - DNA, 12 bp, Homo sapiens
gacagcaccact

SEQ ID NO: 790232 - DNA, 13 bp, Homo sapiens
gacagcaccactg

SEQ ID NO: 790233 - DNA, 14 bp, Homo sapiens
gacagcaccactgc

SEQ ID NO: 790234 - DNA, 17 bp, Homo sapiens
gacagcaccactgctga

SEQ ID NO: 790235 - DNA, 24 bp, Homo sapiens
gacagcagcactcccgctgcacac

SEQ ID NO: 790236 - DNA, 17 bp, Homo sapiens
gacagcagcctgtatgt

SEQ ID NO: 790237 - DNA, 18 bp, Homo sapiens
gacagcagcctgtatgtg

SEQ ID NO: 790238 - DNA, 14 bp, Homo sapiens
gacatggggcaagc

SEQ ID NO: 790239 - DNA, 15 bp, Homo sapiens
gacatggggcaagcc

SEQ ID NO: 790240 - DNA, 19 bp, Homo sapiens
gacatggggcaagccaggg

SEQ ID NO: 790241 - DNA, 22 bp, Homo sapiens
gacatgggtattttataatgtt

SEQ ID NO: 790242 - DNA, 17 bp, Homo sapiens
gacatggtgcctgagag

SEQ ID NO: 790243 - DNA, 19 bp, Homo sapiens
gacatggtgcctgagaggc

SEQ ID NO: 790244 - DNA, 20 bp, Homo sapiens
gacatggtgcctgagaggca

SEQ ID NO: 790245 - DNA, 15 bp, Homo sapiens
gacatggtgccttag

SEQ ID NO: 790246 - DNA, 21 bp, Homo sapiens
gacatggttgggggaatgcac

SEQ ID NO: 790247 - DNA, 22 bp, Homo sapiens
gacatggttgggggaatgcacc

SEQ ID NO: 790248 - DNA, 18 bp, Homo sapiens
gacatgtaccccctttcc

SEQ ID NO: 790249 - DNA, 22 bp, Homo sapiens
gacatgtgaagctatttgatat

SEQ ID NO: 790250 - DNA, 18 bp, Homo sapiens
gacatgtgaggaggaaaa

SEQ ID NO: 790251 - DNA, 21 bp, Homo sapiens
gacatgtgcaattgtgaggga

SEQ ID NO: 790252 - DNA, 19 bp, Homo sapiens
gacatgtggaaagtgaatt

SEQ ID NO: 790253 - DNA, 21 bp, Homo sapiens
gacatgtggaggggcagcctg

SEQ ID NO: 790254 - DNA, 24 bp, Homo sapiens
gacatgtggaggggcagcctgtgc

SEQ ID NO: 790255 - DNA, 14 bp, Homo sapiens
gacatgtggtggga

SEQ ID NO: 790256 - DNA, 18 bp, Homo sapiens
gacatgttatatattttt

SEQ ID NO: 790257 - DNA, 14 bp, Homo sapiens
gacatgtttcaaga

SEQ ID NO: 790258 - DNA, 13 bp, Homo sapiens
gacattaaataat

SEQ ID NO: 790259 - DNA, 17 bp, Homo sapiens
gaattcggtgtgcacca

SEQ ID NO: 790260 - DNA, 18 bp, Homo sapiens
gaattcggtgtgctgcca

SEQ ID NO: 790261 - DNA, 17 bp, Homo sapiens
gaattcgtgttatgaat

SEQ ID NO: 790262 - DNA, 12 bp, Homo sapiens
gaattctactgg

SEQ ID NO: 790263 - DNA, 15 bp, Homo sapiens
gaattctactggaaa

SEQ ID NO: 790264 - DNA, 23 bp, Homo sapiens
gaattctaggcatcccaggggac

SEQ ID NO: 790265 - DNA, 19 bp, Homo sapiens
gaattctatttttgtcctt

SEQ ID NO: 790266 - DNA, 14 bp, Homo sapiens
gaattctgaagttt

SEQ ID NO: 790267 - DNA, 23 bp, Homo sapiens
gaattctgccttggttctggcca

SEQ ID NO: 790268 - DNA, 18 bp, Homo sapiens
gaattcttacatgttttc

SEQ ID NO: 790269 - DNA, 20 bp, Homo sapiens
gaattcttcctctccttccc

SEQ ID NO: 790270 - DNA, 23 bp, Homo sapiens
gaattcttcctctccttcccaca

SEQ ID NO: 790271 - DNA, 16 bp, Homo sapiens
gaattcttttggggaa

SEQ ID NO: 790272 - DNA, 21 bp, Homo sapiens
gaattgaaataaggagggaca

SEQ ID NO: 790273 - DNA, 18 bp, Homo sapiens
gaattgaacccaggaggt

SEQ ID NO: 790274 - DNA, 14 bp, Homo sapiens
gaattgaactctct

SEQ ID NO: 790275 - DNA, 16 bp, Homo sapiens
gaattgactgcagttg

SEQ ID NO: 790276 - DNA, 18 bp, Homo sapiens
gaattgacttcgactgtg

SEQ ID NO: 790277 - DNA, 19 bp, Homo sapiens
gaattgagaataagaattt

SEQ ID NO: 790278 - DNA, 16 bp, Homo sapiens
gaattgagctgcagaa

SEQ ID NO: 790279 - DNA, 20 bp, Homo sapiens
gaattgatcattttcccccc

SEQ ID NO: 790280 - DNA, 17 bp, Homo sapiens
gaattgatttgcattga

SEQ ID NO: 790281 - DNA, 18 bp, Homo sapiens
gaattgccagtcttttgt

SEQ ID NO: 790282 - DNA, 15 bp, Homo sapiens
gaattggcataattt

SEQ ID NO: 790283 - DNA, 21 bp, Homo sapiens
gaattggcataatttgtctta

SEQ ID NO: 790284 - DNA, 16 bp, Homo sapiens
gaattgggagcttggg

SEQ ID NO: 790285 - DNA, 17 bp, Homo sapiens
gaattggggagggagaa

SEQ ID NO: 790286 - DNA, 14 bp, Homo sapiens
gaattgggtttctg

SEQ ID NO: 790287 - DNA, 20 bp, Homo sapiens
gaattggtcttaatgttgaa

SEQ ID NO: 790288 - DNA, 15 bp, Homo sapiens
gaattggtgattctg

SEQ ID NO: 790289 - DNA, 14 bp, Homo sapiens
gaattggtgtatat

SEQ ID NO: 790290 - DNA, 16 bp, Homo sapiens
gaattgtaactgttct

SEQ ID NO: 790291 - DNA, 17 bp, Homo sapiens
gaattgtacctatttct

SEQ ID NO: 790292 - DNA, 18 bp, Homo sapiens
gaattgtacctatttctg

SEQ ID NO: 790293 - DNA, 19 bp, Homo sapiens
gaattgtacctatttctga

SEQ ID NO: 790294 - DNA, 16 bp, Homo sapiens
gaattgtctctgggct

SEQ ID NO: 790295 - DNA, 22 bp, Homo sapiens
gactatgcagaggcctggggga

SEQ ID NO: 790296 - DNA, 14 bp, Homo sapiens
gactattcagtttt

SEQ ID NO: 790297 - DNA, 14 bp, Homo sapiens
gactcaaaacctgg

SEQ ID NO: 790298 - DNA, 18 bp, Homo sapiens
gactcaagaagtgaagaa

SEQ ID NO: 790299 - DNA, 23 bp, Homo sapiens
gactcaagaggaatctgtttctc

SEQ ID NO: 790300 - DNA, 16 bp, Homo sapiens
gactcaaggggctgga

SEQ ID NO: 790301 - DNA, 18 bp, Homo sapiens
gactcaagtacccattct

SEQ ID NO: 790302 - DNA, 21 bp, Homo sapiens
gactcaagtacccattctgtt

SEQ ID NO: 790303 - DNA, 14 bp, Homo sapiens
gactcacaggaagg

SEQ ID NO: 790304 - DNA, 13 bp, Homo sapiens
gactcaccctcca

SEQ ID NO: 790305 - DNA, 12 bp, Homo sapiens
gactcacctctg

SEQ ID NO: 790306 - DNA, 15 bp, Homo sapiens
gactcacctctgcct

SEQ ID NO: 790307 - DNA, 17 bp, Homo sapiens
gactcacctctgcctca

SEQ ID NO: 790308 - DNA, 23 bp, Homo sapiens
gactcacttacatcttctgtgaa

SEQ ID NO: 790309 - DNA, 21 bp, Homo sapiens
gactcacttgccattgccagg

SEQ ID NO: 790310 - DNA, 16 bp, Homo sapiens
gactcagactccattt

SEQ ID NO: 790311 - DNA, 18 bp, Homo sapiens
gactcagatgaggacaga

SEQ ID NO: 790312 - DNA, 10 bp, Homo sapiens
gactcagcac

SEQ ID NO: 790313 - DNA, 23 bp, Homo sapiens
gactcagcaccacattgcctcat

SEQ ID NO: 790314 - DNA, 14 bp, Homo sapiens
gactcagcagaggc

SEQ ID NO: 790315 - DNA, 22 bp, Homo sapiens
gactcagcagaggcagtggcca

SEQ ID NO: 790316 - DNA, 12 bp, Homo sapiens
gactcagcagtg

SEQ ID NO: 790317 - DNA, 15 bp, Homo sapiens
gactcagccctgagg

SEQ ID NO: 790318 - DNA, 12 bp, Homo sapiens
gactcagccttc

SEQ ID NO: 790319 - DNA, 22 bp, Homo sapiens
gactcagctctgacattctgat

SEQ ID NO: 790320 - DNA, 23 bp, Homo sapiens
gactcagctctgacattctgatt

SEQ ID NO: 790321 - DNA, 18 bp, Homo sapiens
gactcaggagtctgccac

SEQ ID NO: 790322 - DNA, 20 bp, Homo sapiens
gactcaggagtctgccactt

SEQ ID NO: 790323 - DNA, 15 bp, Homo sapiens
gactcaggatccagt

SEQ ID NO: 790324 - DNA, 23 bp, Homo sapiens
gactcaggatttaaaaactggaa

SEQ ID NO: 790325 - DNA, 18 bp, Homo sapiens
gactcagggaccggtgct

SEQ ID NO: 790326 - DNA, 20 bp, Homo sapiens
gactcagggaccggtgctgc

SEQ ID NO: 790327 - DNA, 12 bp, Homo sapiens
gactcagggcag

SEQ ID NO: 790328 - DNA, 17 bp, Homo sapiens
gactcagggcagcgcca

SEQ ID NO: 790329 - DNA, 18 bp, Homo sapiens
gactcagggcagcgccag

SEQ ID NO: 790330 - DNA, 14 bp, Homo sapiens
gactcagggcccca

SEQ ID NO: 790331 - DNA, 17 bp, Homo sapiens
gactcagggctcctggg

SEQ ID NO: 790332 - DNA, 19 bp, Homo sapiens
gactcagggctcctgggtt

SEQ ID NO: 790333 - DNA, 21 bp, Homo sapiens
gactcaggtctgtaactgccc

SEQ ID NO: 790334 - DNA, 16 bp, Homo sapiens
gactcaggtgggccct

SEQ ID NO: 790335 - DNA, 17 bp, Homo sapiens
gactcaggttccagaac

SEQ ID NO: 790336 - DNA, 21 bp, Homo sapiens
gactcaggttgtagtaaagaa

SEQ ID NO: 790337 - DNA, 12 bp, Homo sapiens
gactcagtgttc

SEQ ID NO: 790338 - DNA, 14 bp, Homo sapiens
gactcatcatttgt

SEQ ID NO: 790339 - DNA, 13 bp, Homo sapiens
gactcatccccac

SEQ ID NO: 790340 - DNA, 12 bp, Homo sapiens
gactcatggcag

SEQ ID NO: 790341 - DNA, 14 bp, Homo sapiens
gactcatggcagct

SEQ ID NO: 790342 - DNA, 19 bp, Homo sapiens
gactcatggtgtgttacac

SEQ ID NO: 790343 - DNA, 22 bp, Homo sapiens
gactcattgtagaaaggaagcc

SEQ ID NO: 790344 - DNA, 19 bp, Homo sapiens
gactccagagtctgagccc

SEQ ID NO: 790345 - DNA, 10 bp, Homo sapiens
gactccagcc

SEQ ID NO: 790346 - DNA, 16 bp, Homo sapiens
gactccagccagcgcc

SEQ ID NO: 790347 - DNA, 19 bp, Homo sapiens
gactccagccagcgcctcc

SEQ ID NO: 790348 - DNA, 23 bp, Homo sapiens
gactccagccagcgcctccctcc

SEQ ID NO: 790349 - DNA, 14 bp, Homo sapiens
gactccagcccctg

SEQ ID NO: 790350 - DNA, 21 bp, Homo sapiens
gactccaggcagcagacacat

SEQ ID NO: 790351 - DNA, 21 bp, Homo sapiens
gactccatctctcatcctcca

SEQ ID NO: 790352 - DNA, 15 bp, Homo sapiens
gactccatggctaag

SEQ ID NO: 790353 - DNA, 23 bp, Homo sapiens
gactccattggggtgagaggtga

SEQ ID NO: 790354 - DNA, 13 bp, Homo sapiens
gactcccagcaga

SEQ ID NO: 790355 - DNA, 16 bp, Homo sapiens
gactcccagcagagcc

SEQ ID NO: 790356 - DNA, 21 bp, Homo sapiens
gactcccagcagagcccacca

SEQ ID NO: 790357 - DNA, 22 bp, Homo sapiens
gactcccagcagagcccaccag

SEQ ID NO: 790358 - DNA, 15 bp, Homo sapiens
gactccccaggccag

SEQ ID NO: 790359 - DNA, 16 bp, Homo sapiens
gactccccaggccagg

SEQ ID NO: 790360 - DNA, 23 bp, Homo sapiens
gactcccccaaccaaggaaggag

SEQ ID NO: 790361 - DNA, 24 bp, Homo sapiens
gactccctcctcacctctggactg

SEQ ID NO: 790362 - DNA, 17 bp, Homo sapiens
gactccctgagtctgga

SEQ ID NO: 790363 - DNA, 21 bp, Homo sapiens
gactccctgagtctggacctc

SEQ ID NO: 790364 - DNA, 12 bp, Homo sapiens
gactccctggga

SEQ ID NO: 790365 - DNA, 13 bp, Homo sapiens
gactccctgtggg

SEQ ID NO: 790366 - DNA, 14 bp, Homo sapiens
gactccctgtgggg

SEQ ID NO: 790367 - DNA, 23 bp, Homo sapiens
gactccctgtgggggtggccatc

SEQ ID NO: 790368 - DNA, 18 bp, Homo sapiens
gactccggaggactgagc

SEQ ID NO: 790369 - DNA, 19 bp, Homo sapiens
gactccggaggactgagcc

SEQ ID NO: 790370 - DNA, 20 bp, Homo sapiens
gactccggaggactgagccc

SEQ ID NO: 790371 - DNA, 21 bp, Homo sapiens
gactccggaggactgagcccc

SEQ ID NO: 790372 - DNA, 23 bp, Homo sapiens
gactccggaggactgagccccca

SEQ ID NO: 790373 - DNA, 12 bp, Homo sapiens
gactccggcctg

SEQ ID NO: 790374 - DNA, 17 bp, Homo sapiens
gactccgttggccactc

SEQ ID NO: 790375 - DNA, 20 bp, Homo sapiens
gactcctcaaaccacttgcc

SEQ ID NO: 790376 - DNA, 14 bp, Homo sapiens
gactcctcccacaa

SEQ ID NO: 790377 - DNA, 16 bp, Homo sapiens
gactcctcctgggggc

SEQ ID NO: 790378 - DNA, 17 bp, Homo sapiens
gactcctcctgggggct

SEQ ID NO: 790379 - DNA, 19 bp, Homo sapiens
gactcctcctgggggctgg

SEQ ID NO: 790380 - DNA, 20 bp, Homo sapiens
gactcctgaggacagctgtc

SEQ ID NO: 790381 - DNA, 17 bp, Homo sapiens
gactcctggtctgtgaa

SEQ ID NO: 790382 - DNA, 14 bp, Homo sapiens
gactcctgtggaga

SEQ ID NO: 790383 - DNA, 22 bp, Homo sapiens
gactcctgtggagatgacttgg

SEQ ID NO: 790384 - DNA, 16 bp, Homo sapiens
gactccttctccccaa

SEQ ID NO: 790385 - DNA, 15 bp, Homo sapiens
gactcctttcctctg

SEQ ID NO: 790386 - DNA, 14 bp, Homo sapiens
gactcggccactgt

SEQ ID NO: 790387 - DNA, 22 bp, Homo sapiens
gactcggccactgtgtctctgt

SEQ ID NO: 790388 - DNA, 16 bp, Homo sapiens
gactcgggagctgcac

SEQ ID NO: 790389 - DNA, 15 bp, Homo sapiens
gactcgggggctggt

SEQ ID NO: 790390 - DNA, 16 bp, Homo sapiens
gactctaagctggagc

SEQ ID NO: 790391 - DNA, 14 bp, Homo sapiens
gactctaggttata

SEQ ID NO: 790392 - DNA, 16 bp, Homo sapiens
gactctaggttataca

SEQ ID NO: 790393 - DNA, 22 bp, Homo sapiens
gactctaggttatacaataacc

SEQ ID NO: 790394 - DNA, 15 bp, Homo sapiens
gactctagtccttgg

SEQ ID NO: 790395 - DNA, 12 bp, Homo sapiens
gactctcaggga

SEQ ID NO: 790396 - DNA, 18 bp, Homo sapiens
gactctcagtctctgagc

SEQ ID NO: 790397 - DNA, 20 bp, Homo sapiens
gactctcctcctcccctcct

SEQ ID NO: 790398 - DNA, 16 bp, Homo sapiens
gactctctgagctggg

SEQ ID NO: 790399 - DNA, 20 bp, Homo sapiens
gactctctgagctggggagg

SEQ ID NO: 790400 - DNA, 13 bp, Homo sapiens
gactctctgtgac

SEQ ID NO: 790401 - DNA, 14 bp, Homo sapiens
gactctctgtgacc

SEQ ID NO: 790402 - DNA, 20 bp, Homo sapiens
gactctgagaaaatgcgaga

SEQ ID NO: 790403 - DNA, 22 bp, Homo sapiens
gactctgagccaagggagggaa

SEQ ID NO: 790404 - DNA, 17 bp, Homo sapiens
gactctgagcgggaggc

SEQ ID NO: 790405 - DNA, 19 bp, Homo sapiens
gactctgagcgggaggcag

SEQ ID NO: 790406 - DNA, 20 bp, Homo sapiens
gactctgatcccatattctt

SEQ ID NO: 790407 - DNA, 22 bp, Homo sapiens
gactctgatggaatgtgccacc

SEQ ID NO: 790408 - DNA, 19 bp, Homo sapiens
gactctgcatcccagcacc

SEQ ID NO: 790409 - DNA, 20 bp, Homo sapiens
gactctgcatcccagcacct

SEQ ID NO: 790410 - DNA, 14 bp, Homo sapiens
gactggcaggtgca

SEQ ID NO: 790411 - DNA, 19 bp, Homo sapiens
gactggccatttttctggg

SEQ ID NO: 790412 - DNA, 17 bp, Homo sapiens
gactggctagagtcctc

SEQ ID NO: 790413 - DNA, 20 bp, Homo sapiens
gactggctagagtcctcact

SEQ ID NO: 790414 - DNA, 22 bp, Homo sapiens
gactggctcatgcctcagcccg

SEQ ID NO: 790415 - DNA, 10 bp, Homo sapiens
gactggcttt

SEQ ID NO: 790416 - DNA, 21 bp, Homo sapiens
gactggcttttattaatgcac

SEQ ID NO: 790417 - DNA, 22 bp, Homo sapiens
gactggcttttattaatgcact

SEQ ID NO: 790418 - DNA, 23 bp, Homo sapiens
gactggcttttattaatgcactt

SEQ ID NO: 790419 - DNA, 20 bp, Homo sapiens
gactgggaagataggctctg

SEQ ID NO: 790420 - DNA, 14 bp, Homo sapiens
gactgggaccgtgc

SEQ ID NO: 790421 - DNA, 22 bp, Homo sapiens
gactgggaccgtgcgagctgcc

SEQ ID NO: 790422 - DNA, 17 bp, Homo sapiens
gactgggagccacttct

SEQ ID NO: 790423 - DNA, 23 bp, Homo sapiens
gactgggagccgcagcagctccc

SEQ ID NO: 790424 - DNA, 20 bp, Homo sapiens
gactgggatgggaacactgg

SEQ ID NO: 790425 - DNA, 14 bp, Homo sapiens
gactgggcccaggc

SEQ ID NO: 790426 - DNA, 18 bp, Homo sapiens
gactgggcccaggcaggt

SEQ ID NO: 790427 - DNA, 20 bp, Homo sapiens
gactgggcccaggcaggtct

SEQ ID NO: 790428 - DNA, 17 bp, Homo sapiens
gactgggcctcccttgg

SEQ ID NO: 790429 - DNA, 12 bp, Homo sapiens
gactgggctctg

SEQ ID NO: 790430 - DNA, 17 bp, Homo sapiens
gactgggctctggctct

SEQ ID NO: 790431 - DNA, 14 bp, Homo sapiens
gactgggctgaggg

SEQ ID NO: 790432 - DNA, 16 bp, Homo sapiens
gactgggctgagggag

SEQ ID NO: 790433 - DNA, 15 bp, Homo sapiens
gactggggagcacag

SEQ ID NO: 790434 - DNA, 16 bp, Homo sapiens
gactggggagggctgc

SEQ ID NO: 790435 - DNA, 17 bp, Homo sapiens
gactggggagggctgca

SEQ ID NO: 790436 - DNA, 18 bp, Homo sapiens
gactgggtaatttataaa

SEQ ID NO: 790437 - DNA, 17 bp, Homo sapiens
gactgggtaggaaagag

SEQ ID NO: 790438 - DNA, 21 bp, Homo sapiens
gactgggtttggaccccagct

SEQ ID NO: 790439 - DNA, 22 bp, Homo sapiens
gactgggtttggaccccagctg

SEQ ID NO: 790440 - DNA, 15 bp, Homo sapiens
gactggtccagctct

SEQ ID NO: 790441 - DNA, 19 bp, Homo sapiens
gactggtccagctctgaca

SEQ ID NO: 790442 - DNA, 15 bp, Homo sapiens
gactggtcctgtgtg

SEQ ID NO: 790443 - DNA, 19 bp, Homo sapiens
gactggtggcaggggcttc

SEQ ID NO: 790444 - DNA, 19 bp, Homo sapiens
gactggtgtcataaacttt

SEQ ID NO: 790445 - DNA, 17 bp, Homo sapiens
gactggttagtgatgca

SEQ ID NO: 790446 - DNA, 15 bp, Homo sapiens
gactggttgtcagaa

SEQ ID NO: 790447 - DNA, 17 bp, Homo sapiens
gactggtttgtttgctt

SEQ ID NO: 790448 - DNA, 14 bp, Homo sapiens
gactggttttctgc

SEQ ID NO: 790449 - DNA, 15 bp, Homo sapiens
gactggttttctgcc

SEQ ID NO: 790450 - DNA, 20 bp, Homo sapiens
gactgtaactttttttcagt

SEQ ID NO: 790451 - DNA, 21 bp, Homo sapiens
gactgtaactttttttcagtt

SEQ ID NO: 790452 - DNA, 14 bp, Homo sapiens
gactgtaagatgtt

SEQ ID NO: 790453 - DNA, 17 bp, Homo sapiens
gactgtaagatgttgtt

SEQ ID NO: 790454 - DNA, 16 bp, Homo sapiens
gactgtaatgtgtact

SEQ ID NO: 790455 - DNA, 14 bp, Homo sapiens
gactgtacagagac

SEQ ID NO: 790456 - DNA, 17 bp, Homo sapiens
gactgtactcctcccag

SEQ ID NO: 790457 - DNA, 18 bp, Homo sapiens
gactgtactcctcccagg

SEQ ID NO: 790458 - DNA, 23 bp, Homo sapiens
gactgtactcctcccaggcgccc

SEQ ID NO: 790459 - DNA, 21 bp, Homo sapiens
gactgtagaaggtgagaggcg

SEQ ID NO: 790460 - DNA, 22 bp, Homo sapiens
gactgtagagatttttatgtgt

SEQ ID NO: 790461 - DNA, 23 bp, Homo sapiens
gacgcctgatggtgctgctcagg

SEQ ID NO: 790462 - DNA, 18 bp, Homo sapiens
gacgcctgccctgcccag

SEQ ID NO: 790463 - DNA, 12 bp, Homo sapiens
gacgcctggggg

SEQ ID NO: 790464 - DNA, 17 bp, Homo sapiens
gacgccttccaggtcag

SEQ ID NO: 790465 - DNA, 22 bp, Homo sapiens
gacgccttccaggtcaggatgc

SEQ ID NO: 790466 - DNA, 19 bp, Homo sapiens
gacgccttcctctctggat

SEQ ID NO: 790467 - DNA, 15 bp, Homo sapiens
gacgcgtctcctgtt

SEQ ID NO: 790468 - DNA, 14 bp, Homo sapiens
gacgctggagatgc

SEQ ID NO: 790469 - DNA, 16 bp, Homo sapiens
gacgctggagatgcaa

SEQ ID NO: 790470 - DNA, 18 bp, Homo sapiens
gacgcttgtgacagtgcc

SEQ ID NO: 790471 - DNA, 13 bp, Homo sapiens
gacgctttgtctg

SEQ ID NO: 790472 - DNA, 19 bp, Homo sapiens
gacgcttttgagtgggccc

SEQ ID NO: 790473 - DNA, 13 bp, Homo sapiens
gacggaaaacaat

SEQ ID NO: 790474 - DNA, 18 bp, Homo sapiens
gacggaaatgaaattgtc

SEQ ID NO: 790475 - DNA, 21 bp, Homo sapiens
gacggaggtccccggttgctg

SEQ ID NO: 790476 - DNA, 22 bp, Homo sapiens
gacggaggtccccggttgctgg

SEQ ID NO: 790477 - DNA, 15 bp, Homo sapiens
gacggagtgggggga

SEQ ID NO: 790478 - DNA, 11 bp, Homo sapiens
gacggatggca

SEQ ID NO: 790479 - DNA, 16 bp, Homo sapiens
gacggcaggctcactg

SEQ ID NO: 790480 - DNA, 20 bp, Homo sapiens
gacggcaggctcactgccag

SEQ ID NO: 790481 - DNA, 11 bp, Homo sapiens
gacggcctcca

SEQ ID NO: 790482 - DNA, 22 bp, Homo sapiens
gagaacaaagctgttaaactgt

SEQ ID NO: 790483 - DNA, 16 bp, Homo sapiens
gagaacaagtcacagc

SEQ ID NO: 790484 - DNA, 17 bp, Homo sapiens
gagaacaagtcacagct

SEQ ID NO: 790485 - DNA, 22 bp, Homo sapiens
gagaacacctccagcttttctt

SEQ ID NO: 790486 - DNA, 22 bp, Homo sapiens
gagaacagtttcatcaggacca

SEQ ID NO: 790487 - DNA, 23 bp, Homo sapiens
gagaacatgcaaaatcaggaaag

SEQ ID NO: 790488 - DNA, 18 bp, Homo sapiens
gagaaccaaatctggaag

SEQ ID NO: 790489 - DNA, 16 bp, Homo sapiens
gagaaccaccactgcc

SEQ ID NO: 790490 - DNA, 21 bp, Homo sapiens
gagaaccagtctcctcactct

SEQ ID NO: 790491 - DNA, 20 bp, Homo sapiens
gagaaccgagcaaagatcaa

SEQ ID NO: 790492 - DNA, 23 bp, Homo sapiens
gagaaccgagcaaagatcaaaat

SEQ ID NO: 790493 - DNA, 18 bp, Homo sapiens
gagaacctaagtttcagt

SEQ ID NO: 790494 - DNA, 18 bp, Homo sapiens
gagaacgccagtctccca

SEQ ID NO: 790495 - DNA, 22 bp, Homo sapiens
gagaacgccagtctcccaggcc

SEQ ID NO: 790496 - DNA, 17 bp, Homo sapiens
gagaactaaagctggag

SEQ ID NO: 790497 - DNA, 20 bp, Homo sapiens
gagaactcgcgctcagtaaa

SEQ ID NO: 790498 - DNA, 21 bp, Homo sapiens
gagaactcgttcacctccaag

SEQ ID NO: 790499 - DNA, 22 bp, Homo sapiens
gagaactctctccctggtctct

SEQ ID NO: 790500 - DNA, 14 bp, Homo sapiens
gagaactctggctt

SEQ ID NO: 790501 - DNA, 16 bp, Homo sapiens
gagaactgactttctc

SEQ ID NO: 790502 - DNA, 23 bp, Homo sapiens
gagaactgcatatgtttcgctga

SEQ ID NO: 790503 - DNA, 17 bp, Homo sapiens
gagaactgcttctaaga

SEQ ID NO: 790504 - DNA, 18 bp, Homo sapiens
gagaagaacaagaaatgg

SEQ ID NO: 790505 - DNA, 14 bp, Homo sapiens
gagaagagccctgg

SEQ ID NO: 790506 - DNA, 21 bp, Homo sapiens
gagaagagcttgcacagccaa

SEQ ID NO: 790507 - DNA, 12 bp, Homo sapiens
gagaagatggcc

SEQ ID NO: 790508 - DNA, 18 bp, Homo sapiens
gagaagatggccatgccc

SEQ ID NO: 790509 - DNA, 13 bp, Homo sapiens
gagaagcatgaaa

SEQ ID NO: 790510 - DNA, 12 bp, Homo sapiens
gagaagccaagc

SEQ ID NO: 790511 - DNA, 20 bp, Homo sapiens
gagaagccacgctgtcctct

SEQ ID NO: 790512 - DNA, 18 bp, Homo sapiens
gagaagccccgcacgggc

SEQ ID NO: 790513 - DNA, 16 bp, Homo sapiens
gagaagcccgtgtgag

SEQ ID NO: 790514 - DNA, 14 bp, Homo sapiens
gagaagccttcagc

SEQ ID NO: 790515 - DNA, 18 bp, Homo sapiens
gagaagccttcagctcca

SEQ ID NO: 790516 - DNA, 16 bp, Homo sapiens
gagaagcggatttcca

SEQ ID NO: 790517 - DNA, 15 bp, Homo sapiens
gagaagcgtttttaa

SEQ ID NO: 790518 - DNA, 19 bp, Homo sapiens
gagaagctagatgcccctg

SEQ ID NO: 790519 - DNA, 17 bp, Homo sapiens
gagaagctcccaggaac

SEQ ID NO: 790520 - DNA, 14 bp, Homo sapiens
gagaagctgaggcc

SEQ ID NO: 790521 - DNA, 23 bp, Homo sapiens
gagacagatacctccaaccctgc

SEQ ID NO: 790522 - DNA, 15 bp, Homo sapiens
gagacagatcactcc

SEQ ID NO: 790523 - DNA, 11 bp, Homo sapiens
gagacagcagc

SEQ ID NO: 790524 - DNA, 21 bp, Homo sapiens
gagacagctgatacttcattt

SEQ ID NO: 790525 - DNA, 16 bp, Homo sapiens
gagacagcttctctgc

SEQ ID NO: 790526 - DNA, 20 bp, Homo sapiens
gagacaggaaaatcctctgg

SEQ ID NO: 790527 - DNA, 21 bp, Homo sapiens
gagacaggaaaatcctctggc

SEQ ID NO: 790528 - DNA, 12 bp, Homo sapiens
gagacaggaagg

SEQ ID NO: 790529 - DNA, 13 bp, Homo sapiens
gagacaggacaga

SEQ ID NO: 790530 - DNA, 23 bp, Homo sapiens
gagacaggacagaatgtgttctt

SEQ ID NO: 790531 - DNA, 16 bp, Homo sapiens
gagacaggacctgact

SEQ ID NO: 790532 - DNA, 16 bp, Homo sapiens
gagacaggagcctagc

SEQ ID NO: 790533 - DNA, 15 bp, Homo sapiens
gagacagggtctcac

SEQ ID NO: 790534 - DNA, 19 bp, Homo sapiens
gagacagggtttcaccatg

SEQ ID NO: 790535 - DNA, 18 bp, Homo sapiens
gagacaggtcagtagtca

SEQ ID NO: 790536 - DNA, 15 bp, Homo sapiens
gagacagtctcactc

SEQ ID NO: 790537 - DNA, 13 bp, Homo sapiens
gagacagtgaatt

SEQ ID NO: 790538 - DNA, 17 bp, Homo sapiens
gagacagtgatctccat

SEQ ID NO: 790539 - DNA, 15 bp, Homo sapiens
gagacagtgggaaat

SEQ ID NO: 790540 - DNA, 15 bp, Homo sapiens
gagacagttgcccga

SEQ ID NO: 790541 - DNA, 13 bp, Homo sapiens
gagacatatatag

SEQ ID NO: 790542 - DNA, 21 bp, Homo sapiens
gagacatctgcacccctgagt

SEQ ID NO: 790543 - DNA, 15 bp, Homo sapiens
gagacatgaatacta

SEQ ID NO: 790544 - DNA, 15 bp, Homo sapiens
gagacatggaagaga

SEQ ID NO: 790545 - DNA, 13 bp, Homo sapiens
gagacatggacca

SEQ ID NO: 790546 - DNA, 13 bp, Homo sapiens
gagacatgtacct

SEQ ID NO: 790547 - DNA, 14 bp, Homo sapiens
gagacatgtgacat

SEQ ID NO: 790548 - DNA, 22 bp, Homo sapiens
gagacattaactcattagactg

SEQ ID NO: 790549 - DNA, 23 bp, Homo sapiens
gagaccaaatgtcggggttgggg

SEQ ID NO: 790550 - DNA, 17 bp, Homo sapiens
gagaccaacctgaccaa

SEQ ID NO: 790551 - DNA, 19 bp, Homo sapiens
gagaccaacctgggcaaca

SEQ ID NO: 790552 - DNA, 14 bp, Homo sapiens
gagagaaagagaac

SEQ ID NO: 790553 - DNA, 21 bp, Homo sapiens
gagagaacaacaggcaggggc

SEQ ID NO: 790554 - DNA, 23 bp, Homo sapiens
gagagaacaacaggcaggggccc

SEQ ID NO: 790555 - DNA, 13 bp, Homo sapiens
gagagaagaaagt

SEQ ID NO: 790556 - DNA, 16 bp, Homo sapiens
gagagaagccacgctg

SEQ ID NO: 790557 - DNA, 13 bp, Homo sapiens
gagagaagctgat

SEQ ID NO: 790558 - DNA, 15 bp, Homo sapiens
gagagaatagagctg

SEQ ID NO: 790559 - DNA, 16 bp, Homo sapiens
gagagaattggctcaa

SEQ ID NO: 790560 - DNA, 17 bp, Homo sapiens
gagagaccacacatttt

SEQ ID NO: 790561 - DNA, 14 bp, Homo sapiens
gagagacccaagga

SEQ ID NO: 790562 - DNA, 15 bp, Homo sapiens
gagagacccaaggag

SEQ ID NO: 790563 - DNA, 19 bp, Homo sapiens
gagagacccaaggaggaaa

SEQ ID NO: 790564 - DNA, 20 bp, Homo sapiens
gagagacccaaggaggaaaa

SEQ ID NO: 790565 - DNA, 15 bp, Homo sapiens
gagagaccctcactg

SEQ ID NO: 790566 - DNA, 23 bp, Homo sapiens
gagagaccctcactgctggggag

SEQ ID NO: 790567 - DNA, 22 bp, Homo sapiens
gagaggttgaggaaaagactgt

SEQ ID NO: 790568 - DNA, 16 bp, Homo sapiens
gagagtacagtgagcc

SEQ ID NO: 790569 - DNA, 11 bp, Homo sapiens
gagagtaccat

SEQ ID NO: 790570 - DNA, 14 bp, Homo sapiens
gagagtaccatgct

SEQ ID NO: 790571 - DNA, 18 bp, Homo sapiens
gagagtagccgagagcct

SEQ ID NO: 790572 - DNA, 21 bp, Homo sapiens
gagagtagccgagagcctgct

SEQ ID NO: 790573 - DNA, 22 bp, Homo sapiens
gagagtagccgagagcctgctc

SEQ ID NO: 790574 - DNA, 22 bp, Homo sapiens
gagagtatttttatacaaacct

SEQ ID NO: 790575 - DNA, 14 bp, Homo sapiens
gagagtcaaagctg

SEQ ID NO: 790576 - DNA, 13 bp, Homo sapiens
gagagtcaggagt

SEQ ID NO: 790577 - DNA, 15 bp, Homo sapiens
gagagtcccagagca

SEQ ID NO: 790578 - DNA, 13 bp, Homo sapiens
gagagtgcactgc

SEQ ID NO: 790579 - DNA, 15 bp, Homo sapiens
gagagtggcaggtgg

SEQ ID NO: 790580 - DNA, 22 bp, Homo sapiens
gagagtggcaggtgggctgcct

SEQ ID NO: 790581 - DNA, 11 bp, Homo sapiens
gagagtgtgac

SEQ ID NO: 790582 - DNA, 12 bp, Homo sapiens
gagagtgtgcaa

SEQ ID NO: 790583 - DNA, 23 bp, Homo sapiens
gagagtgtgcaactggccagcca

SEQ ID NO: 790584 - DNA, 16 bp, Homo sapiens
gagagtgtgtgggcag

SEQ ID NO: 790585 - DNA, 20 bp, Homo sapiens
gagagttcaagcctgtggga

SEQ ID NO: 790586 - DNA, 18 bp, Homo sapiens
gagagttctttgctgccc

SEQ ID NO: 790587 - DNA, 11 bp, Homo sapiens
gagagtttcct

SEQ ID NO: 790588 - DNA, 14 bp, Homo sapiens
gagagtttcctcag

SEQ ID NO: 790589 - DNA, 22 bp, Homo sapiens
gagataaaacagaatcttctgg

SEQ ID NO: 790590 - DNA, 17 bp, Homo sapiens
gagataaaagcaattct

SEQ ID NO: 790591 - DNA, 23 bp, Homo sapiens
gagataaaaggtggagtttctct

SEQ ID NO: 790592 - DNA, 15 bp, Homo sapiens
gagatactattttca

SEQ ID NO: 790593 - DNA, 18 bp, Homo sapiens
gagatacttatgcaagat

SEQ ID NO: 790594 - DNA, 16 bp, Homo sapiens
gagatacttgatgcca

SEQ ID NO: 790595 - DNA, 23 bp, Homo sapiens
gagatacttgatgccaaaatgac

SEQ ID NO: 790596 - DNA, 16 bp, Homo sapiens
gagatagcattgtgaa

SEQ ID NO: 790597 - DNA, 12 bp, Homo sapiens
gagatagctggg

SEQ ID NO: 790598 - DNA, 14 bp, Homo sapiens
gagataggggaggg

SEQ ID NO: 790599 - DNA, 15 bp, Homo sapiens
gagataggggagggg

SEQ ID NO: 790600 - DNA, 15 bp, Homo sapiens
gagatagttttcatc

SEQ ID NO: 790601 - DNA, 19 bp, Homo sapiens
gagatattataagggagag

SEQ ID NO: 790602 - DNA, 11 bp, Homo sapiens
gagatatttac

SEQ ID NO: 790603 - DNA, 13 bp, Homo sapiens
gagatcaaagatg

SEQ ID NO: 790604 - DNA, 16 bp, Homo sapiens
gagatcacagcctcca

SEQ ID NO: 790605 - DNA, 20 bp, Homo sapiens
gagatcacagcctccagggc

SEQ ID NO: 790606 - DNA, 15 bp, Homo sapiens
gagatcacccactcc

SEQ ID NO: 790607 - DNA, 13 bp, Homo sapiens
gagatcagcctgg

SEQ ID NO: 790608 - DNA, 22 bp, Homo sapiens
gagatccttcacaggcagtgca

SEQ ID NO: 790609 - DNA, 20 bp, Homo sapiens
gagatcgcgccactgcactc

SEQ ID NO: 790610 - DNA, 17 bp, Homo sapiens
gagatcgggaagcagaa

SEQ ID NO: 790611 - DNA, 21 bp, Homo sapiens
gagatcgtgccgttactctcc

SEQ ID NO: 790612 - DNA, 21 bp, Homo sapiens
gagatcgtgctactgcactcc

SEQ ID NO: 790613 - DNA, 21 bp, Homo sapiens
gagatctaagcctttccataa

SEQ ID NO: 790614 - DNA, 23 bp, Homo sapiens
gagatctaaggatgtcacagggc

SEQ ID NO: 790615 - DNA, 18 bp, Homo sapiens
gagatctgtataaataag

SEQ ID NO: 790616 - DNA, 12 bp, Homo sapiens
gagatcttcctt

SEQ ID NO: 790617 - DNA, 23 bp, Homo sapiens
gagatcttccttccgctctgagg

SEQ ID NO: 790618 - DNA, 18 bp, Homo sapiens
gagatctttctttccaaa

SEQ ID NO: 790619 - DNA, 21 bp, Homo sapiens
gagatctttctttccaaaaca

SEQ ID NO: 790620 - DNA, 16 bp, Homo sapiens
gagatgaattaaattt

SEQ ID NO: 790621 - DNA, 14 bp, Homo sapiens
gagatgaccaggga

SEQ ID NO: 790622 - DNA, 22 bp, Homo sapiens
gagatgagaaatgatgaaaagg

SEQ ID NO: 790623 - DNA, 14 bp, Homo sapiens
gagatgaggagggg

SEQ ID NO: 790624 - DNA, 16 bp, Homo sapiens
gagatgagttgcagtt

SEQ ID NO: 790625 - DNA, 17 bp, Homo sapiens
gagatgagttgcagttt

SEQ ID NO: 790626 - DNA, 14 bp, Homo sapiens
gagatgcagaggta

SEQ ID NO: 790627 - DNA, 19 bp, Homo sapiens
gagatgcctccaccgctgc

SEQ ID NO: 790628 - DNA, 23 bp, Homo sapiens
gagatgcctccaccgctgcctaa

SEQ ID NO: 790629 - DNA, 21 bp, Homo sapiens
gagatgcgttgttacaggaag

SEQ ID NO: 790630 - DNA, 23 bp, Homo sapiens
gagatggaacccttttggccccc

SEQ ID NO: 790631 - DNA, 22 bp, Homo sapiens
gagatggacccctcccttgctc

SEQ ID NO: 790632 - DNA, 15 bp, Homo sapiens
gagatggagggcttg

SEQ ID NO: 790633 - DNA, 18 bp, Homo sapiens
gagatggagtttctctct

SEQ ID NO: 790634 - DNA, 12 bp, Homo sapiens
gagatggcagca

SEQ ID NO: 790635 - DNA, 13 bp, Homo sapiens
gagatgggggctt

SEQ ID NO: 790636 - DNA, 15 bp, Homo sapiens
gagatggtcagtgtg

SEQ ID NO: 790637 - DNA, 13 bp, Homo sapiens
gagatggtgaggc

SEQ ID NO: 790638 - DNA, 17 bp, Homo sapiens
gagatgtaaaaggtatt

SEQ ID NO: 790639 - DNA, 15 bp, Homo sapiens
gagatgtagcaaaac

SEQ ID NO: 790640 - DNA, 16 bp, Homo sapiens
gagatgtatgaaggct

SEQ ID NO: 790641 - DNA, 16 bp, Homo sapiens
gagatgtcttggaaca

SEQ ID NO: 790642 - DNA, 13 bp, Homo sapiens
gagatgtgagtcc

SEQ ID NO: 790643 - DNA, 16 bp, Homo sapiens
gagatgtgagtcctgt

SEQ ID NO: 790644 - DNA, 14 bp, Homo sapiens
gagatgtttttaaa

SEQ ID NO: 790645 - DNA, 17 bp, Homo sapiens
gagatgtttttaaaagt

SEQ ID NO: 790646 - DNA, 18 bp, Homo sapiens
gagatgtttttaaaagtt

SEQ ID NO: 790647 - DNA, 23 bp, Homo sapiens
gagattagtaaatatgtgaagaa

SEQ ID NO: 790648 - DNA, 13 bp, Homo sapiens
gagattattcctt

SEQ ID NO: 790649 - DNA, 14 bp, Homo sapiens
gagattcaatattg

SEQ ID NO: 790650 - DNA, 21 bp, Homo sapiens
gagattcattttctagataca

SEQ ID NO: 790651 - DNA, 14 bp, Homo sapiens
gagattctgggttt

SEQ ID NO: 790652 - DNA, 18 bp, Homo sapiens
gagattctgggtttgccc

SEQ ID NO: 790653 - DNA, 23 bp, Homo sapiens
gagattcttctaggggtagctgg

SEQ ID NO: 790654 - DNA, 22 bp, Homo sapiens
gagattgaatttcactgtcttt

SEQ ID NO: 790655 - DNA, 17 bp, Homo sapiens
gagattggacggcctga

SEQ ID NO: 790656 - DNA, 18 bp, Homo sapiens
gagattggatttgctgtg

SEQ ID NO: 790657 - DNA, 16 bp, Homo sapiens
gagattggcatggctt

SEQ ID NO: 790658 - DNA, 15 bp, Homo sapiens
gagattggccagtga

SEQ ID NO: 790659 - DNA, 19 bp, Homo sapiens
gagattggccagtgagaag

SEQ ID NO: 790660 - DNA, 20 bp, Homo sapiens
gagattggccagtgagaagc

SEQ ID NO: 790661 - DNA, 16 bp, Homo sapiens
gagattgggagaaatc

SEQ ID NO: 790662 - DNA, 21 bp, Homo sapiens
gagattgtgccacttcactcc

SEQ ID NO: 790663 - DNA, 12 bp, Homo sapiens
gagatttcttag

SEQ ID NO: 790664 - DNA, 22 bp, Homo sapiens
gagatttgccagcacaggggcc

SEQ ID NO: 790665 - DNA, 12 bp, Homo sapiens
gagatttgtcta

SEQ ID NO: 790666 - DNA, 18 bp, Homo sapiens
gagatttttaagaacttc

SEQ ID NO: 790667 - DNA, 19 bp, Homo sapiens
gagatttttgatatctcaa

SEQ ID NO: 790668 - DNA, 19 bp, Homo sapiens
gagatttttttgtgtatgt

SEQ ID NO: 790669 - DNA, 22 bp, Homo sapiens
gagcaaaagcctcagaaaggga

SEQ ID NO: 790670 - DNA, 14 bp, Homo sapiens
gagcaaaaggcagc

SEQ ID NO: 790671 - DNA, 16 bp, Homo sapiens
gagcaaaaggcagctc

SEQ ID NO: 790672 - DNA, 15 bp, Homo sapiens
gagcaaactctgctg

SEQ ID NO: 790673 - DNA, 19 bp, Homo sapiens
gagcaaagaaggagctgag

SEQ ID NO: 790674 - DNA, 22 bp, Homo sapiens
gagcaaagatcaaaataaaaag

SEQ ID NO: 790675 - DNA, 13 bp, Homo sapiens
gagcaaagcgccc

SEQ ID NO: 790676 - DNA, 18 bp, Homo sapiens
gagcaaaggcccatgccc

SEQ ID NO: 790677 - DNA, 17 bp, Homo sapiens
gagcaaagtagatcatg

SEQ ID NO: 790678 - DNA, 14 bp, Homo sapiens
gagcaaatgtttct

SEQ ID NO: 790679 - DNA, 16 bp, Homo sapiens
gagcaaatgtttctgc

SEQ ID NO: 790680 - DNA, 14 bp, Homo sapiens
gagcaacccctgta

SEQ ID NO: 790681 - DNA, 16 bp, Homo sapiens
gagcaactctccactc

SEQ ID NO: 790682 - DNA, 15 bp, Homo sapiens
gagcaagaagaaaat

SEQ ID NO: 790683 - DNA, 14 bp, Homo sapiens
gagcaagactctgt

SEQ ID NO: 790684 - DNA, 13 bp, Homo sapiens
gagcaagagctgg

SEQ ID NO: 790685 - DNA, 16 bp, Homo sapiens
gagcaaggccttctct

SEQ ID NO: 790686 - DNA, 20 bp, Homo sapiens
gagcaagggttccctcaaga

SEQ ID NO: 790687 - DNA, 14 bp, Homo sapiens
gagcaataaagtgg

SEQ ID NO: 790688 - DNA, 15 bp, Homo sapiens
gagcaatgtctgtgc

SEQ ID NO: 790689 - DNA, 14 bp, Homo sapiens
gagcacaaggcctt

SEQ ID NO: 790690 - DNA, 17 bp, Homo sapiens
gagcacacttatttatg

SEQ ID NO: 790691 - DNA, 22 bp, Homo sapiens
gagcacacttatttatgaattg

SEQ ID NO: 790692 - DNA, 23 bp, Homo sapiens
gagcacacttatttatgaattgt

SEQ ID NO: 790693 - DNA, 13 bp, Homo sapiens
gagcacagagccc

SEQ ID NO: 790694 - DNA, 14 bp, Homo sapiens
gagcacaggcagct

SEQ ID NO: 790695 - DNA, 13 bp, Homo sapiens
gagcacaggtccc

SEQ ID NO: 790696 - DNA, 16 bp, Homo sapiens
gagcacagtcaggggc

SEQ ID NO: 790697 - DNA, 17 bp, Homo sapiens
gagcacagtcaggggct

SEQ ID NO: 790698 - DNA, 22 bp, Homo sapiens
gagcacagtcaggggctgggca

SEQ ID NO: 790699 - DNA, 23 bp, Homo sapiens
gagcacatagagctttttaatag

SEQ ID NO: 790700 - DNA, 18 bp, Homo sapiens
gagcacatctctctgccc

SEQ ID NO: 790701 - DNA, 19 bp, Homo sapiens
gagcacatctctctgccct

SEQ ID NO: 790702 - DNA, 16 bp, Homo sapiens
gagcacccattccaaa

SEQ ID NO: 790703 - DNA, 17 bp, Homo sapiens
gagcaccccctcattcc

SEQ ID NO: 790704 - DNA, 16 bp, Homo sapiens
gagcaccccctgctcc

SEQ ID NO: 790705 - DNA, 16 bp, Homo sapiens
gagcacccctctctgc

SEQ ID NO: 790706 - DNA, 22 bp, Homo sapiens
gagcaccgtgtcaagctgctct

SEQ ID NO: 790707 - DNA, 22 bp, Homo sapiens
gagcacctcacctcccgaagcc

SEQ ID NO: 790708 - DNA, 16 bp, Homo sapiens
gagcacctctatacag

SEQ ID NO: 790709 - DNA, 20 bp, Homo sapiens
gagcacctgaaccccatggg

SEQ ID NO: 790710 - DNA, 22 bp, Homo sapiens
gagcacctggaccccctgcccg

SEQ ID NO: 790711 - DNA, 22 bp, Homo sapiens
gagcacctgggccccactggac

SEQ ID NO: 790712 - DNA, 17 bp, Homo sapiens
gagcaccttcctcactt

SEQ ID NO: 790713 - DNA, 19 bp, Homo sapiens
gagcaccttcctcacttcc

SEQ ID NO: 790714 - DNA, 20 bp, Homo sapiens
gagcaccttcctcacttcca

SEQ ID NO: 790715 - DNA, 13 bp, Homo sapiens
gagcacgcctgcc

SEQ ID NO: 790716 - DNA, 17 bp, Homo sapiens
gagcacgcctgccatct

SEQ ID NO: 790717 - DNA, 22 bp, Homo sapiens
gagcacgcctgccatcttctcc

SEQ ID NO: 790718 - DNA, 19 bp, Homo sapiens
gagcacgtggagatagtgc

SEQ ID NO: 790719 - DNA, 21 bp, Homo sapiens
gagcactctaattagagaact

SEQ ID NO: 790720 - DNA, 21 bp, Homo sapiens
gagcactctcaccccaagcgg

SEQ ID NO: 790721 - DNA, 21 bp, Homo sapiens
gagcactctgagtttaccatt

SEQ ID NO: 790722 - DNA, 19 bp, Homo sapiens
gagcactgcgcgctatccc

SEQ ID NO: 790723 - DNA, 14 bp, Homo sapiens
gagcactggagtgc

SEQ ID NO: 790724 - DNA, 12 bp, Homo sapiens
gagcactggcca

SEQ ID NO: 790725 - DNA, 14 bp, Homo sapiens
gagcactggccaga

SEQ ID NO: 790726 - DNA, 15 bp, Homo sapiens
gagcactggccagag

SEQ ID NO: 790727 - DNA, 17 bp, Homo sapiens
gagcactggccagagag

SEQ ID NO: 790728 - DNA, 23 bp, Homo sapiens
gagcactggccagagagggccca

SEQ ID NO: 790729 - DNA, 13 bp, Homo sapiens
gagcactgggttg

SEQ ID NO: 790730 - DNA, 12 bp, Homo sapiens
gagcactgttca

SEQ ID NO: 790731 - DNA, 18 bp, Homo sapiens
gagcacttaagagaatat

SEQ ID NO: 790732 - DNA, 20 bp, Homo sapiens
gagcacttgcgtcctgcaga

SEQ ID NO: 790733 - DNA, 22 bp, Homo sapiens
gagcagaaaacccttgggccag

SEQ ID NO: 790734 - DNA, 23 bp, Homo sapiens
gagcagaacggagccccaggcct

SEQ ID NO: 790735 - DNA, 16 bp, Homo sapiens
gagcagagaattctct

SEQ ID NO: 790736 - DNA, 24 bp, Homo sapiens
gagcagagacatgactcagcctgt

SEQ ID NO: 790737 - DNA, 12 bp, Homo sapiens
gagcagagagag

SEQ ID NO: 790738 - DNA, 17 bp, Homo sapiens
gagcagagagagccaga

SEQ ID NO: 790739 - DNA, 15 bp, Homo sapiens
gagcagagcaggcaa

SEQ ID NO: 790740 - DNA, 11 bp, Homo sapiens
gagcagagcct

SEQ ID NO: 790741 - DNA, 17 bp, Homo sapiens
gagcagagggaggaaga

SEQ ID NO: 790742 - DNA, 14 bp, Homo sapiens
gagcagaggtctcc

SEQ ID NO: 790743 - DNA, 20 bp, Homo sapiens
gagcagagtctgggcctctg

SEQ ID NO: 790744 - DNA, 21 bp, Homo sapiens
gagcagcagcacctttctctg

SEQ ID NO: 790745 - DNA, 15 bp, Homo sapiens
gagcagcagcttggg

SEQ ID NO: 790746 - DNA, 17 bp, Homo sapiens
gagcagccaaggccgcc

SEQ ID NO: 790747 - DNA, 21 bp, Homo sapiens
gagcagccaaggccgccagcg

SEQ ID NO: 790748 - DNA, 22 bp, Homo sapiens
gagcagccaaggccgccagcgt

SEQ ID NO: 790749 - DNA, 14 bp, Homo sapiens
gagcagccagagct

SEQ ID NO: 790750 - DNA, 12 bp, Homo sapiens
gagcagccagga

SEQ ID NO: 790751 - DNA, 19 bp, Homo sapiens
gagcagcctcgaggctggt

SEQ ID NO: 790752 - DNA, 14 bp, Homo sapiens
gagcagcctcgtgg

SEQ ID NO: 790753 - DNA, 15 bp, Homo sapiens
gagcagcctcgtgga

SEQ ID NO: 790754 - DNA, 16 bp, Homo sapiens
gagcagcctcgtggag

SEQ ID NO: 790755 - DNA, 14 bp, Homo sapiens
gagcagcctctgga

SEQ ID NO: 790756 - DNA, 13 bp, Homo sapiens
gagcagcctgtgg

SEQ ID NO: 790757 - DNA, 15 bp, Homo sapiens
gagcagcctgtggca

SEQ ID NO: 790758 - DNA, 16 bp, Homo sapiens
gagcagcctgtggcat

SEQ ID NO: 790759 - DNA, 18 bp, Homo sapiens
gagcagcctgtggcatct

SEQ ID NO: 790760 - DNA, 21 bp, Homo sapiens
gagcagcgcccaggcctgctg

SEQ ID NO: 790761 - DNA, 18 bp, Homo sapiens
gagcagcggtttggggag

SEQ ID NO: 790762 - DNA, 12 bp, Homo sapiens
gagcagctccct

SEQ ID NO: 790763 - DNA, 20 bp, Homo sapiens
gagcagctccctttctcagg

SEQ ID NO: 790764 - DNA, 11 bp, Homo sapiens
gagcagctggc

SEQ ID NO: 790765 - DNA, 16 bp, Homo sapiens
gagcagctggctctcc

SEQ ID NO: 790766 - DNA, 17 bp, Homo sapiens
gagcagctggctctcca

SEQ ID NO: 790767 - DNA, 19 bp, Homo sapiens
gagcagctggctctccacc

SEQ ID NO: 790768 - DNA, 23 bp, Homo sapiens
gagcagctggggtaggctgtctg

SEQ ID NO: 790769 - DNA, 16 bp, Homo sapiens
gagcagcttccttctg

SEQ ID NO: 790770 - DNA, 19 bp, Homo sapiens
gagcagcttccttctggga

SEQ ID NO: 790771 - DNA, 18 bp, Homo sapiens
gagcagcttcggtgtgca

SEQ ID NO: 790772 - DNA, 17 bp, Homo sapiens
gagcagctttaaactca

SEQ ID NO: 790773 - DNA, 18 bp, Homo sapiens
gagcagctttaaactcag

SEQ ID NO: 790774 - DNA, 23 bp, Homo sapiens
gagcagctttaaactcagggaca

SEQ ID NO: 790775 - DNA, 16 bp, Homo sapiens
gagcaggaagcattca

SEQ ID NO: 790776 - DNA, 13 bp, Homo sapiens
gagcaggacctcc

SEQ ID NO: 790777 - DNA, 15 bp, Homo sapiens
gagcaggactccagg

SEQ ID NO: 790778 - DNA, 13 bp, Homo sapiens
gagcaggagcccc

SEQ ID NO: 790779 - DNA, 12 bp, Homo sapiens
gagcaggaggcc

SEQ ID NO: 790780 - DNA, 15 bp, Homo sapiens
gagcaggaggccaat

SEQ ID NO: 790781 - DNA, 23 bp, Homo sapiens
gagcaggaggccaataaaaagtt

SEQ ID NO: 790782 - DNA, 20 bp, Homo sapiens
gagcaggaggggggctgggt

SEQ ID NO: 790783 - DNA, 15 bp, Homo sapiens
gagcaggcacatgga

SEQ ID NO: 790784 - DNA, 21 bp, Homo sapiens
gagcaggcacgggtggtcccc

SEQ ID NO: 790785 - DNA, 22 bp, Homo sapiens
gagcaggcacgggtggtccccg

SEQ ID NO: 790786 - DNA, 12 bp, Homo sapiens
gagcaggcaggg

SEQ ID NO: 790787 - DNA, 13 bp, Homo sapiens
gagcaggcagggg

SEQ ID NO: 790788 - DNA, 22 bp, Homo sapiens
gagcaggcggtgggcacccacc

SEQ ID NO: 790789 - DNA, 15 bp, Homo sapiens
gagcaggctcagact

SEQ ID NO: 790790 - DNA, 16 bp, Homo sapiens
gagcaggctcagactc

SEQ ID NO: 790791 - DNA, 18 bp, Homo sapiens
gagcaggctcagactctg

SEQ ID NO: 790792 - DNA, 22 bp, Homo sapiens
gagcaggctggcagctctccag

SEQ ID NO: 790793 - DNA, 13 bp, Homo sapiens
gagcagggaaggc

SEQ ID NO: 790794 - DNA, 14 bp, Homo sapiens
gagcagggaaggcc

SEQ ID NO: 790795 - DNA, 16 bp, Homo sapiens
gagcagggaaggcctg

SEQ ID NO: 790796 - DNA, 14 bp, Homo sapiens
gagcagggcggctg

SEQ ID NO: 790797 - DNA, 16 bp, Homo sapiens
gagcagggcggctgcc

SEQ ID NO: 790798 - DNA, 17 bp, Homo sapiens
gagcagggcggctgccg

SEQ ID NO: 790799 - DNA, 18 bp, Homo sapiens
gagcagggcggctgccga

SEQ ID NO: 790800 - DNA, 21 bp, Homo sapiens
gagcagggcggctgccgactc

SEQ ID NO: 790801 - DNA, 16 bp, Homo sapiens
gagcaggggagcttgg

SEQ ID NO: 790802 - DNA, 16 bp, Homo sapiens
gagcaggggcagggtg

SEQ ID NO: 790803 - DNA, 17 bp, Homo sapiens
gagcagggtggggtctg

SEQ ID NO: 790804 - DNA, 18 bp, Homo sapiens
gagcagggtggggtctgg

SEQ ID NO: 790805 - DNA, 22 bp, Homo sapiens
gagcagggtggggtctgggagg

SEQ ID NO: 790806 - DNA, 23 bp, Homo sapiens
gagcagggtggggtctgggaggg

SEQ ID NO: 790807 - DNA, 15 bp, Homo sapiens
gagcagtcagagtcc

SEQ ID NO: 790808 - DNA, 16 bp, Homo sapiens
gagcagtcagagtcca

SEQ ID NO: 790809 - DNA, 21 bp, Homo sapiens
gagcagtgaatgattcagtgt

SEQ ID NO: 790810 - DNA, 21 bp, Homo sapiens
gagcagtgggagggtaccagc

SEQ ID NO: 790811 - DNA, 11 bp, Homo sapiens
gagcagtgtct

SEQ ID NO: 790812 - DNA, 22 bp, Homo sapiens
gatatattaaaaatataaaact

SEQ ID NO: 790813 - DNA, 19 bp, Homo sapiens
gatatatttaaaaatattt

SEQ ID NO: 790814 - DNA, 23 bp, Homo sapiens
gatatatttcacttttgttctgc

SEQ ID NO: 790815 - DNA, 23 bp, Homo sapiens
gatatattttacaattttttatc

SEQ ID NO: 790816 - DNA, 13 bp, Homo sapiens
gatatcagaattt

SEQ ID NO: 790817 - DNA, 16 bp, Homo sapiens
gatatcatgcaaattt

SEQ ID NO: 790818 - DNA, 22 bp, Homo sapiens
gatatcattttaaaaactttat

SEQ ID NO: 790819 - DNA, 15 bp, Homo sapiens
gatatccatcttttt

SEQ ID NO: 790820 - DNA, 14 bp, Homo sapiens
gatatcctctcccc

SEQ ID NO: 790821 - DNA, 23 bp, Homo sapiens
gatatcgacttgtttttgcacat

SEQ ID NO: 790822 - DNA, 16 bp, Homo sapiens
gatatcgtgaaatcct

SEQ ID NO: 790823 - DNA, 20 bp, Homo sapiens
gatatcgtgaaatcctcagc

SEQ ID NO: 790824 - DNA, 17 bp, Homo sapiens
gatatctagacaatttc

SEQ ID NO: 790825 - DNA, 16 bp, Homo sapiens
gatatctcaatctgca

SEQ ID NO: 790826 - DNA, 23 bp, Homo sapiens
gatatctgagggaggaggccacc

SEQ ID NO: 790827 - DNA, 13 bp, Homo sapiens
gatatctgcatgt

SEQ ID NO: 790828 - DNA, 16 bp, Homo sapiens
gatatgaccaaaattt

SEQ ID NO: 790829 - DNA, 19 bp, Homo sapiens
gatatgacccacactgcca

SEQ ID NO: 790830 - DNA, 20 bp, Homo sapiens
gatatgcaccaggtctcaag

SEQ ID NO: 790831 - DNA, 14 bp, Homo sapiens
gatatgcttactaa

SEQ ID NO: 790832 - DNA, 15 bp, Homo sapiens
gatatggcattgcac

SEQ ID NO: 790833 - DNA, 20 bp, Homo sapiens
gatatggctgcccaggagac

SEQ ID NO: 790834 - DNA, 16 bp, Homo sapiens
gatatgggtcctctgg

SEQ ID NO: 790835 - DNA, 17 bp, Homo sapiens
gatatgtatgggtaggg

SEQ ID NO: 790836 - DNA, 20 bp, Homo sapiens
gatatgtatgttgtgaatta

SEQ ID NO: 790837 - DNA, 13 bp, Homo sapiens
gatatgtggtgta

SEQ ID NO: 790838 - DNA, 22 bp, Homo sapiens
gatatgttaaatgtatagctgg

SEQ ID NO: 790839 - DNA, 17 bp, Homo sapiens
gatatgttgttaaacac

SEQ ID NO: 790840 - DNA, 15 bp, Homo sapiens
gatatgtttttattt

SEQ ID NO: 790841 - DNA, 13 bp, Homo sapiens
gatattaaaattt

SEQ ID NO: 790842 - DNA, 19 bp, Homo sapiens
gatattaaaatttggtgct

SEQ ID NO: 790843 - DNA, 18 bp, Homo sapiens
gatattaagaatcttaga

SEQ ID NO: 790844 - DNA, 15 bp, Homo sapiens
gatattatagaaaat

SEQ ID NO: 790845 - DNA, 16 bp, Homo sapiens
gatattatagaaaatt

SEQ ID NO: 790846 - DNA, 24 bp, Homo sapiens
gatattatctacctgttctgtagc

SEQ ID NO: 790847 - DNA, 16 bp, Homo sapiens
gatattcaataaagca

SEQ ID NO: 790848 - DNA, 20 bp, Homo sapiens
gatattccccccacttaaga

SEQ ID NO: 790849 - DNA, 20 bp, Homo sapiens
gatattctactgtacttttt

SEQ ID NO: 790850 - DNA, 24 bp, Homo sapiens
gatattctttaaacaaatatgaaa

SEQ ID NO: 790851 - DNA, 15 bp, Homo sapiens
gatattgaaggaatt

SEQ ID NO: 790852 - DNA, 18 bp, Homo sapiens
gatattgaggccaagaat

SEQ ID NO: 790853 - DNA, 20 bp, Homo sapiens
gatattgaggccaagaatat

SEQ ID NO: 790854 - DNA, 14 bp, Homo sapiens
gatattgatattga

SEQ ID NO: 790855 - DNA, 24 bp, Homo sapiens
gatattgatgataacacttaaaat

SEQ ID NO: 790856 - DNA, 16 bp, Homo sapiens
gatattggttcttccc

SEQ ID NO: 790857 - DNA, 18 bp, Homo sapiens
gatattgtacataaaaga

SEQ ID NO: 790858 - DNA, 16 bp, Homo sapiens
gatattgtgaagtaca

SEQ ID NO: 790859 - DNA, 17 bp, Homo sapiens
gatattgttataaataa

SEQ ID NO: 790860 - DNA, 13 bp, Homo sapiens
gatattgtttaaa

SEQ ID NO: 790861 - DNA, 17 bp, Homo sapiens
gatattgtttaaaattc

SEQ ID NO: 790862 - DNA, 21 bp, Homo sapiens
gatattgtttaaaattcagtt

SEQ ID NO: 790863 - DNA, 18 bp, Homo sapiens
gatattgtttgctgttgg

SEQ ID NO: 790864 - DNA, 16 bp, Homo sapiens
gatattgttttctgta

SEQ ID NO: 790865 - DNA, 17 bp, Homo sapiens
gatattgttttctgtaa

SEQ ID NO: 790866 - DNA, 20 bp, Homo sapiens
gatattgttttctgtaaata

SEQ ID NO: 790867 - DNA, 22 bp, Homo sapiens
gatattgttttctgtaaataac

SEQ ID NO: 790868 - DNA, 15 bp, Homo sapiens
gatatttaagaaaat

SEQ ID NO: 790869 - DNA, 20 bp, Homo sapiens
gatatttaagaaaatacaat

SEQ ID NO: 790870 - DNA, 19 bp, Homo sapiens
gatatttaggtttttggct

SEQ ID NO: 790871 - DNA, 13 bp, Homo sapiens
gatatttatatat

SEQ ID NO: 790872 - DNA, 19 bp, Homo sapiens
gatatttatggggggagaa

SEQ ID NO: 790873 - DNA, 15 bp, Homo sapiens
gatatttctagctta

SEQ ID NO: 790874 - DNA, 13 bp, Homo sapiens
gatatttctcagc

SEQ ID NO: 790875 - DNA, 18 bp, Homo sapiens
gatattttcaaattgtat

SEQ ID NO: 790876 - DNA, 19 bp, Homo sapiens
gatattttcaaattgtatc

SEQ ID NO: 790877 - DNA, 21 bp, Homo sapiens
gatattttcaacgcagccctg

SEQ ID NO: 790878 - DNA, 22 bp, Homo sapiens
gatattttcaacgcagccctgc

SEQ ID NO: 790879 - DNA, 23 bp, Homo sapiens
gatattttccctttttaaaaaat

SEQ ID NO: 790880 - DNA, 21 bp, Homo sapiens
gatattttctgtgcctgaata

SEQ ID NO: 790881 - DNA, 16 bp, Homo sapiens
gatattttgctttgtg

SEQ ID NO: 790882 - DNA, 23 bp, Homo sapiens
gatattttggggggcagagaata

SEQ ID NO: 790883 - DNA, 22 bp, Homo sapiens
gatatttttaaagatctgtaag

SEQ ID NO: 790884 - DNA, 18 bp, Homo sapiens
gatatttttccatttatt

SEQ ID NO: 790885 - DNA, 21 bp, Homo sapiens
gatattttttcagaaatatgt

SEQ ID NO: 790886 - DNA, 23 bp, Homo sapiens
gatcaaaaggttaataaagtaat

SEQ ID NO: 790887 - DNA, 20 bp, Homo sapiens
gatcaaaataaaaagtgaca

SEQ ID NO: 790888 - DNA, 22 bp, Homo sapiens
gatcaaaccccgaccacctgcc

SEQ ID NO: 790889 - DNA, 16 bp, Homo sapiens
gatcaaacctttctgg

SEQ ID NO: 790890 - DNA, 17 bp, Homo sapiens
gatcaaacctttctggc

SEQ ID NO: 790891 - DNA, 23 bp, Homo sapiens
gatcaaataacttagggccaagt

SEQ ID NO: 790892 - DNA, 13 bp, Homo sapiens
gatcaactgttca

SEQ ID NO: 790893 - DNA, 22 bp, Homo sapiens
gatcaagagtccggatttctaa

SEQ ID NO: 790894 - DNA, 14 bp, Homo sapiens
gatcaagctgtgag

SEQ ID NO: 790895 - DNA, 15 bp, Homo sapiens
gatcaaggtgaaata

SEQ ID NO: 790896 - DNA, 13 bp, Homo sapiens
gatcaagttgttg

SEQ ID NO: 790897 - DNA, 16 bp, Homo sapiens
gatcaagttgttgact

SEQ ID NO: 790898 - DNA, 19 bp, Homo sapiens
gatcaatatttttatatca

SEQ ID NO: 790899 - DNA, 15 bp, Homo sapiens
gatcaattaaatgta

SEQ ID NO: 790900 - DNA, 19 bp, Homo sapiens
gatcaattttcattaaact

SEQ ID NO: 790901 - DNA, 23 bp, Homo sapiens
gatcgcgccactacactccagcc

SEQ ID NO: 790902 - DNA, 16 bp, Homo sapiens
gatcgctaagctggct

SEQ ID NO: 790903 - DNA, 15 bp, Homo sapiens
gatcgcttgagccca

SEQ ID NO: 790904 - DNA, 19 bp, Homo sapiens
gatcggactctgcccctgg

SEQ ID NO: 790905 - DNA, 13 bp, Homo sapiens
gatcgggaagcag

SEQ ID NO: 790906 - DNA, 21 bp, Homo sapiens
gatcgtctcggcccctctgat

SEQ ID NO: 790907 - DNA, 15 bp, Homo sapiens
gatcgtgctaaattt

SEQ ID NO: 790908 - DNA, 22 bp, Homo sapiens
gatcgtgctactgcactccagc

SEQ ID NO: 790909 - DNA, 21 bp, Homo sapiens
gatctaaggatgtcacagggc

SEQ ID NO: 790910 - DNA, 16 bp, Homo sapiens
gatctaatgtgaaaat

SEQ ID NO: 790911 - DNA, 15 bp, Homo sapiens
gatctacctggaggg

SEQ ID NO: 790912 - DNA, 16 bp, Homo sapiens
gatctataggcagctt

SEQ ID NO: 790913 - DNA, 17 bp, Homo sapiens
gatctataggcagcttc

SEQ ID NO: 790914 - DNA, 21 bp, Homo sapiens
gatctataggcagcttctaag

SEQ ID NO: 790915 - DNA, 16 bp, Homo sapiens
gatctatgcctttcaa

SEQ ID NO: 790916 - DNA, 15 bp, Homo sapiens
gatctcaagccagcc

SEQ ID NO: 790917 - DNA, 17 bp, Homo sapiens
gatctcaagccagcccc

SEQ ID NO: 790918 - DNA, 16 bp, Homo sapiens
gatctcacaggctgag

SEQ ID NO: 790919 - DNA, 22 bp, Homo sapiens
gatctcagctttgagaagcctt

SEQ ID NO: 790920 - DNA, 19 bp, Homo sapiens
gatctcaggggctgtttga

SEQ ID NO: 790921 - DNA, 15 bp, Homo sapiens
gatctcattcagtat

SEQ ID NO: 790922 - DNA, 20 bp, Homo sapiens
gatctcattcagtattaaag

SEQ ID NO: 790923 - DNA, 13 bp, Homo sapiens
gatctccaaggac

SEQ ID NO: 790924 - DNA, 16 bp, Homo sapiens
gatctccaaggaccag

SEQ ID NO: 790925 - DNA, 12 bp, Homo sapiens
gatctccctgcc

SEQ ID NO: 790926 - DNA, 14 bp, Homo sapiens
gatctccctgccgc

SEQ ID NO: 790927 - DNA, 18 bp, Homo sapiens
gatctcggctcagcctcc

SEQ ID NO: 790928 - DNA, 14 bp, Homo sapiens
gatctcggtttgcc

SEQ ID NO: 790929 - DNA, 21 bp, Homo sapiens
gatctctactaccacaaggaa

SEQ ID NO: 790930 - DNA, 13 bp, Homo sapiens
gatctctcaggag

SEQ ID NO: 790931 - DNA, 17 bp, Homo sapiens
gatctctcaggagcaca

SEQ ID NO: 790932 - DNA, 20 bp, Homo sapiens
gatctctcaggagcacaggc

SEQ ID NO: 790933 - DNA, 21 bp, Homo sapiens
gatctctcaggagcacaggca

SEQ ID NO: 790934 - DNA, 24 bp, Homo sapiens
gatctctcaggagcacaggcagct

SEQ ID NO: 790935 - DNA, 16 bp, Homo sapiens
gatctctgacctctgc

SEQ ID NO: 790936 - DNA, 12 bp, Homo sapiens
gatctcttaaga

SEQ ID NO: 790937 - DNA, 19 bp, Homo sapiens
gatctcttagaagccatgg

SEQ ID NO: 790938 - DNA, 12 bp, Homo sapiens
gatctcttcctg

SEQ ID NO: 790939 - DNA, 16 bp, Homo sapiens
gatctcttgagcctgg

SEQ ID NO: 790940 - DNA, 17 bp, Homo sapiens
gatctgaccctcccagt

SEQ ID NO: 790941 - DNA, 20 bp, Homo sapiens
gatctgaccctcccagtctc

SEQ ID NO: 790942 - DNA, 12 bp, Homo sapiens
gatctgagaaca

SEQ ID NO: 790943 - DNA, 22 bp, Homo sapiens
gatctgagaacacgttgccagg

SEQ ID NO: 790944 - DNA, 15 bp, Homo sapiens
gatctgagctcccac

SEQ ID NO: 790945 - DNA, 13 bp, Homo sapiens
gatctgagggaga

SEQ ID NO: 790946 - DNA, 22 bp, Homo sapiens
gatctgaggttggatttgctca

SEQ ID NO: 790947 - DNA, 15 bp, Homo sapiens
gatctgatggtgagc

SEQ ID NO: 790948 - DNA, 19 bp, Homo sapiens
gatctgatggtgagctggg

SEQ ID NO: 790949 - DNA, 18 bp, Homo sapiens
gatctgcaccaccatgcc

SEQ ID NO: 790950 - DNA, 12 bp, Homo sapiens
gatctgcctggg

SEQ ID NO: 790951 - DNA, 21 bp, Homo sapiens
gatctgcctgggcctgtgcag

SEQ ID NO: 790952 - DNA, 18 bp, Homo sapiens
gatctgctgggctctgcc

SEQ ID NO: 790953 - DNA, 22 bp, Homo sapiens
gatctgggaccctttccttcct

SEQ ID NO: 790954 - DNA, 16 bp, Homo sapiens
gatctggggaggcagg

SEQ ID NO: 790955 - DNA, 18 bp, Homo sapiens
gatctggggctctgggat

SEQ ID NO: 790956 - DNA, 15 bp, Homo sapiens
gatctggggggtggg

SEQ ID NO: 790957 - DNA, 16 bp, Homo sapiens
gatctggggggtgggg

SEQ ID NO: 790958 - DNA, 18 bp, Homo sapiens
gatctggggggtggggag

SEQ ID NO: 790959 - DNA, 19 bp, Homo sapiens
gatctggggggtggggagg

SEQ ID NO: 790960 - DNA, 16 bp, Homo sapiens
gatctgtactttgtgt

SEQ ID NO: 790961 - DNA, 21 bp, Homo sapiens
gatctgtagacttctggttgt

SEQ ID NO: 790962 - DNA, 16 bp, Homo sapiens
gatctgtataaataag

SEQ ID NO: 790963 - DNA, 17 bp, Homo sapiens
gatctgtataaataaga

SEQ ID NO: 790964 - DNA, 15 bp, Homo sapiens
gatctgtatatacaa

SEQ ID NO: 790965 - DNA, 20 bp, Homo sapiens
gatctgtatatacaataaca

SEQ ID NO: 790966 - DNA, 15 bp, Homo sapiens
gatctgtccaaggaa

SEQ ID NO: 790967 - DNA, 13 bp, Homo sapiens
gatctgtctgtgg

SEQ ID NO: 790968 - DNA, 18 bp, Homo sapiens
gatctgtgccccatgcct

SEQ ID NO: 790969 - DNA, 15 bp, Homo sapiens
gatctgtgcctggga

SEQ ID NO: 790970 - DNA, 16 bp, Homo sapiens
gatctgtgcctgggat

SEQ ID NO: 790971 - DNA, 20 bp, Homo sapiens
gatctgtgtacaattttagt

SEQ ID NO: 790972 - DNA, 15 bp, Homo sapiens
gatctgtttccaaat

SEQ ID NO: 790973 - DNA, 19 bp, Homo sapiens
gatctgttttgaaggcaaa

SEQ ID NO: 790974 - DNA, 16 bp, Homo sapiens
gatcttaatataaatt

SEQ ID NO: 790975 - DNA, 18 bp, Homo sapiens
gatcttattttgtgaact

SEQ ID NO: 790976 - DNA, 14 bp, Homo sapiens
gatcttcagagcag

SEQ ID NO: 790977 - DNA, 23 bp, Homo sapiens
gatcttcccacaggagggccagc

SEQ ID NO: 790978 - DNA, 22 bp, Homo sapiens
gatcttcccacctcacagtgat

SEQ ID NO: 790979 - DNA, 15 bp, Homo sapiens
gatcttccttccgct

SEQ ID NO: 790980 - DNA, 18 bp, Homo sapiens
gatcttctatcattccaa

SEQ ID NO: 790981 - DNA, 14 bp, Homo sapiens
gatcttcttcatcc

SEQ ID NO: 790982 - DNA, 23 bp, Homo sapiens
gatcttgaatgtggtctcaggat

SEQ ID NO: 790983 - DNA, 15 bp, Homo sapiens
gatcttgatggtgtt

SEQ ID NO: 790984 - DNA, 21 bp, Homo sapiens
gatcttgcctaaatcccaaga

SEQ ID NO: 790985 - DNA, 13 bp, Homo sapiens
gatcttgtgctca

SEQ ID NO: 790986 - DNA, 17 bp, Homo sapiens
gatcttgttactgtgat

SEQ ID NO: 790987 - DNA, 12 bp, Homo sapiens
gatctttctctt

SEQ ID NO: 790988 - DNA, 14 bp, Homo sapiens
gatctttctcttcc

SEQ ID NO: 790989 - DNA, 20 bp, Homo sapiens
gatctttctttccaaaacat

SEQ ID NO: 790990 - DNA, 13 bp, Homo sapiens
gatctttgagccc

SEQ ID NO: 790991 - DNA, 16 bp, Homo sapiens
gatctttgagcccatt

SEQ ID NO: 790992 - DNA, 21 bp, Homo sapiens
gatctttgagcccattcttct

SEQ ID NO: 790993 - DNA, 22 bp, Homo sapiens
gatctttgagcccattcttctg

SEQ ID NO: 790994 - DNA, 16 bp, Homo sapiens
gatctttgtggccaag

SEQ ID NO: 790995 - DNA, 13 bp, Homo sapiens
gatctttgtttaa

SEQ ID NO: 790996 - DNA, 19 bp, Homo sapiens
gatctttgtttaaatgcca

SEQ ID NO: 790997 - DNA, 20 bp, Homo sapiens
gatctttgtttaaatgccaa

SEQ ID NO: 790998 - DNA, 20 bp, Homo sapiens
gatcttttaaagtgttactt

SEQ ID NO: 790999 - DNA, 18 bp, Homo sapiens
gatcttttagaagtgaga

SEQ ID NO: 791000 - DNA, 23 bp, Homo sapiens
gatgaaaagtatattgataacct

SEQ ID NO: 791001 - DNA, 19 bp, Homo sapiens
gatgaaaataattttccaa

SEQ ID NO: 791002 - DNA, 20 bp, Homo sapiens
gatgaaatctgctagaaagt

SEQ ID NO: 791003 - DNA, 23 bp, Homo sapiens
gatgaaattttctagactttctg

SEQ ID NO: 791004 - DNA, 16 bp, Homo sapiens
gatgaactgactgaag

SEQ ID NO: 791005 - DNA, 13 bp, Homo sapiens
gatgaactttctc

SEQ ID NO: 791006 - DNA, 17 bp, Homo sapiens
gatgaagaacacagcat

SEQ ID NO: 791007 - DNA, 14 bp, Homo sapiens
gatgaagagtgaga

SEQ ID NO: 791008 - DNA, 21 bp, Homo sapiens
gatgaagcaaggaagatatac

SEQ ID NO: 791009 - DNA, 23 bp, Homo sapiens
gatgaagcaaggaagatatacat

SEQ ID NO: 791010 - DNA, 21 bp, Homo sapiens
gatgaatagaagttttaaatt

SEQ ID NO: 791011 - DNA, 16 bp, Homo sapiens
gatgaatcaatgaaaa

SEQ ID NO: 791012 - DNA, 13 bp, Homo sapiens
gatgaatgagaat

SEQ ID NO: 791013 - DNA, 19 bp, Homo sapiens
gatgaatgaggtcccaggc

SEQ ID NO: 791014 - DNA, 15 bp, Homo sapiens
gatgaatgcagatta

SEQ ID NO: 791015 - DNA, 16 bp, Homo sapiens
gatgaatgccgtggat

SEQ ID NO: 791016 - DNA, 14 bp, Homo sapiens
gatgaatgtactat

SEQ ID NO: 791017 - DNA, 13 bp, Homo sapiens
gatgaatgtatgt

SEQ ID NO: 791018 - DNA, 16 bp, Homo sapiens
gatgaattaaatttaa

SEQ ID NO: 791019 - DNA, 16 bp, Homo sapiens
gatgaattcttcctct

SEQ ID NO: 791020 - DNA, 22 bp, Homo sapiens
gatgacagggcagagcaggaag

SEQ ID NO: 791021 - DNA, 22 bp, Homo sapiens
gatgacaggtgtgagccactgc

SEQ ID NO: 791022 - DNA, 23 bp, Homo sapiens
gatgacatttcgttttttacacg

SEQ ID NO: 791023 - DNA, 22 bp, Homo sapiens
gatgaccaaagtcccttcctgc

SEQ ID NO: 791024 - DNA, 18 bp, Homo sapiens
gatgaccaatgggatgag

SEQ ID NO: 791025 - DNA, 22 bp, Homo sapiens
gatgaccacacccgaagtcctg

SEQ ID NO: 791026 - DNA, 19 bp, Homo sapiens
gatgaccacgcacctccac

SEQ ID NO: 791027 - DNA, 17 bp, Homo sapiens
gatgaccagggatgctg

SEQ ID NO: 791028 - DNA, 18 bp, Homo sapiens
gatgaccagggatgctgg

SEQ ID NO: 791029 - DNA, 22 bp, Homo sapiens
gatgaccagggatgctgggctg

SEQ ID NO: 791030 - DNA, 16 bp, Homo sapiens
gatgaccgtgtacaat

SEQ ID NO: 791031 - DNA, 21 bp, Homo sapiens
gatgacgacgacaacgatgat

SEQ ID NO: 791032 - DNA, 18 bp, Homo sapiens
gatgactaaaatatttat

SEQ ID NO: 791033 - DNA, 13 bp, Homo sapiens
gatgactctctcc

SEQ ID NO: 791034 - DNA, 12 bp, Homo sapiens
gatgactctgag

SEQ ID NO: 791035 - DNA, 14 bp, Homo sapiens
gatgacttcagtga

SEQ ID NO: 791036 - DNA, 20 bp, Homo sapiens
gatgactttctgttttctgt

SEQ ID NO: 791037 - DNA, 13 bp, Homo sapiens
gatgagaaaaaac

SEQ ID NO: 791038 - DNA, 17 bp, Homo sapiens
gatgagaacaaagctgt

SEQ ID NO: 791039 - DNA, 13 bp, Homo sapiens
gatgagaagccag

SEQ ID NO: 791040 - DNA, 15 bp, Homo sapiens
gatgagaagccagga

SEQ ID NO: 791041 - DNA, 13 bp, Homo sapiens
gatgagaatgtga

SEQ ID NO: 791042 - DNA, 23 bp, Homo sapiens
gatgagacttccaaacctgacag

SEQ ID NO: 791043 - DNA, 18 bp, Homo sapiens
gatgaggcaaacagcaag

SEQ ID NO: 791044 - DNA, 22 bp, Homo sapiens
gatgaggccagaccatggacac

SEQ ID NO: 791045 - DNA, 23 bp, Homo sapiens
gatgaggcctcttggacctctgc

SEQ ID NO: 791046 - DNA, 12 bp, Homo sapiens
gatgagggaagg

SEQ ID NO: 791047 - DNA, 19 bp, Homo sapiens
gatgagggatgggcctggc

SEQ ID NO: 791048 - DNA, 14 bp, Homo sapiens
gatgagggcatgtg

SEQ ID NO: 791049 - DNA, 15 bp, Homo sapiens
gatgaggggccactg

SEQ ID NO: 791050 - DNA, 17 bp, Homo sapiens
gatgaggggccactgac

SEQ ID NO: 791051 - DNA, 24 bp, Homo sapiens
gatgaggggccactgacccacctg

SEQ ID NO: 791052 - DNA, 16 bp, Homo sapiens
gatgaggggtgctggg

SEQ ID NO: 791053 - DNA, 18 bp, Homo sapiens
gatgaggtaattctccct

SEQ ID NO: 791054 - DNA, 16 bp, Homo sapiens
gatgaggtattttttc

SEQ ID NO: 791055 - DNA, 14 bp, Homo sapiens
gatgagtcagacac

SEQ ID NO: 791056 - DNA, 22 bp, Homo sapiens
gatgagtgggaggcgtgccccc

SEQ ID NO: 791057 - DNA, 18 bp, Homo sapiens
gatgagttgcagttttta

SEQ ID NO: 791058 - DNA, 19 bp, Homo sapiens
gatgagttgcagtttttat

SEQ ID NO: 791059 - DNA, 23 bp, Homo sapiens
gatgataaaaggaatctggcatt

SEQ ID NO: 791060 - DNA, 14 bp, Homo sapiens
gatgataaagtccc

SEQ ID NO: 791061 - DNA, 17 bp, Homo sapiens
gatgataacacttaaaa

SEQ ID NO: 791062 - DNA, 20 bp, Homo sapiens
gatgataagttcctttcctt

SEQ ID NO: 791063 - DNA, 19 bp, Homo sapiens
gatgatactaataaactaa

SEQ ID NO: 791064 - DNA, 14 bp, Homo sapiens
gatgatactgtttc

SEQ ID NO: 791065 - DNA, 18 bp, Homo sapiens
gatgatagaggattttat

SEQ ID NO: 791066 - DNA, 22 bp, Homo sapiens
gatgatcccagtcactcctctc

SEQ ID NO: 791067 - DNA, 21 bp, Homo sapiens
gatgatctactcagaaatttt

SEQ ID NO: 791068 - DNA, 13 bp, Homo sapiens
gatgatctctcca

SEQ ID NO: 791069 - DNA, 23 bp, Homo sapiens
gatgatgataatgatgatgacga

SEQ ID NO: 791070 - DNA, 14 bp, Homo sapiens
gatgatgctgccag

SEQ ID NO: 791071 - DNA, 15 bp, Homo sapiens
gatgatggaaacgca

SEQ ID NO: 791072 - DNA, 22 bp, Homo sapiens
gatgatggggtgggagactttc

SEQ ID NO: 791073 - DNA, 15 bp, Homo sapiens
gatgatggtgttttg

SEQ ID NO: 791074 - DNA, 14 bp, Homo sapiens
gatgatgttttgat

SEQ ID NO: 791075 - DNA, 15 bp, Homo sapiens
gatgattcagaaatt

SEQ ID NO: 791076 - DNA, 17 bp, Homo sapiens
gatgattcttaacacag

SEQ ID NO: 791077 - DNA, 19 bp, Homo sapiens
gatgatttcagaaggagaa

SEQ ID NO: 791078 - DNA, 22 bp, Homo sapiens
gatgatttcatcttctggaata

SEQ ID NO: 791079 - DNA, 14 bp, Homo sapiens
gatgatttccaagc

SEQ ID NO: 791080 - DNA, 20 bp, Homo sapiens
gatgatttctagcaggcagg

SEQ ID NO: 791081 - DNA, 23 bp, Homo sapiens
gatgattttcatttcatgaaaat

SEQ ID NO: 791082 - DNA, 20 bp, Homo sapiens
gatgattttgtaattcttat

SEQ ID NO: 791083 - DNA, 17 bp, Homo sapiens
gatgcaagatatttata

SEQ ID NO: 791084 - DNA, 21 bp, Homo sapiens
gatgcaagttattttatttgc

SEQ ID NO: 791085 - DNA, 18 bp, Homo sapiens
gatgcaatcagacaagtg

SEQ ID NO: 791086 - DNA, 19 bp, Homo sapiens
gatgcaatcttggctcact

SEQ ID NO: 791087 - DNA, 13 bp, Homo sapiens
gatgcaattaaaa

SEQ ID NO: 791088 - DNA, 14 bp, Homo sapiens
gatgcaattaaaac

SEQ ID NO: 791089 - DNA, 15 bp, Homo sapiens
gatgcacatccctgg

SEQ ID NO: 791090 - DNA, 16 bp, Homo sapiens
gatgcacatccctgga

SEQ ID NO: 791091 - DNA, 15 bp, Homo sapiens
gatgcacatttctgg

SEQ ID NO: 791092 - DNA, 16 bp, Homo sapiens
gatgcacatttctgga

SEQ ID NO: 791093 - DNA, 20 bp, Homo sapiens
gatgcactatatgtttacac

SEQ ID NO: 791094 - DNA, 18 bp, Homo sapiens
gatgcagataaaatattt

SEQ ID NO: 791095 - DNA, 19 bp, Homo sapiens
gatgcagcacctctcagga

SEQ ID NO: 791096 - DNA, 22 bp, Homo sapiens
gatgcagcgccgtgtcctctct

SEQ ID NO: 791097 - DNA, 15 bp, Homo sapiens
gatgcagctactgga

SEQ ID NO: 791098 - DNA, 18 bp, Homo sapiens
gatgcagctgttgagaaa

SEQ ID NO: 791099 - DNA, 12 bp, Homo sapiens
gatgcagtgatg

SEQ ID NO: 791100 - DNA, 13 bp, Homo sapiens
gatgcagtgatgt

SEQ ID NO: 791101 - DNA, 15 bp, Homo sapiens
gatgcagtgatgtga

SEQ ID NO: 791102 - DNA, 18 bp, Homo sapiens
gatgcatacagttttcta

SEQ ID NO: 791103 - DNA, 22 bp, Homo sapiens
gatgcatcacactcaaggacag

SEQ ID NO: 791104 - DNA, 23 bp, Homo sapiens
gatgcatcacactcaaggacagg

SEQ ID NO: 791105 - DNA, 24 bp, Homo sapiens
gatgcatcacactcaaggacagga

SEQ ID NO: 791106 - DNA, 17 bp, Homo sapiens
gatgcatcgggaaagaa

SEQ ID NO: 791107 - DNA, 13 bp, Homo sapiens
gatgcatgcgcag

SEQ ID NO: 791108 - DNA, 22 bp, Homo sapiens
gatgcatgtcttttaaaatgca

SEQ ID NO: 791109 - DNA, 20 bp, Homo sapiens
gatgcattctgataggaggg

SEQ ID NO: 791110 - DNA, 14 bp, Homo sapiens
gatgcatttaataa

SEQ ID NO: 791111 - DNA, 15 bp, Homo sapiens
gatgcatttaataaa

SEQ ID NO: 791112 - DNA, 22 bp, Homo sapiens
gatgcatttaataaagatgagt

SEQ ID NO: 791113 - DNA, 20 bp, Homo sapiens
gatgccaaagatgtttgaaa

SEQ ID NO: 791114 - DNA, 21 bp, Homo sapiens
gatgccaacttcccacacggc

SEQ ID NO: 791115 - DNA, 24 bp, Homo sapiens
gatgccaacttcccacacggcagc

SEQ ID NO: 791116 - DNA, 21 bp, Homo sapiens
gatgccaagaagtttaaggaa

SEQ ID NO: 791117 - DNA, 19 bp, Homo sapiens
gatgccaatattaaatctg

SEQ ID NO: 791118 - DNA, 17 bp, Homo sapiens
gatgccaatttcctctc

SEQ ID NO: 791119 - DNA, 18 bp, Homo sapiens
gatgccaatttcctctcc

SEQ ID NO: 791120 - DNA, 15 bp, Homo sapiens
gatgccactcctccc

SEQ ID NO: 791121 - DNA, 17 bp, Homo sapiens
gatgccactcctccctc

SEQ ID NO: 791122 - DNA, 16 bp, Homo sapiens
gatgccagagggccag

SEQ ID NO: 791123 - DNA, 21 bp, Homo sapiens
gatcagccccgcctgtcacaa

SEQ ID NO: 791124 - DNA, 11 bp, Homo sapiens
gatcagcctcc

SEQ ID NO: 791125 - DNA, 16 bp, Homo sapiens
gatcagctgtttgtca

SEQ ID NO: 791126 - DNA, 15 bp, Homo sapiens
gatcaggaaccaggg

SEQ ID NO: 791127 - DNA, 20 bp, Homo sapiens
gatcaggaaccagggcctcc

SEQ ID NO: 791128 - DNA, 22 bp, Homo sapiens
gatcaggcacccggggccagag

SEQ ID NO: 791129 - DNA, 23 bp, Homo sapiens
gatcaggtgacttctagcagaga

SEQ ID NO: 791130 - DNA, 14 bp, Homo sapiens
gatcagtaaaatta

SEQ ID NO: 791131 - DNA, 23 bp, Homo sapiens
gatcagtcctttgatcagtataa

SEQ ID NO: 791132 - DNA, 20 bp, Homo sapiens
gatcagtgtaccatttgcct

SEQ ID NO: 791133 - DNA, 11 bp, Homo sapiens
gatcagtgttg

SEQ ID NO: 791134 - DNA, 16 bp, Homo sapiens
gatcataggaagtggc

SEQ ID NO: 791135 - DNA, 19 bp, Homo sapiens
gatcataggaagtggctgg

SEQ ID NO: 791136 - DNA, 18 bp, Homo sapiens
gatcataggtatttcaaa

SEQ ID NO: 791137 - DNA, 20 bp, Homo sapiens
gatcatatggagctcatgtc

SEQ ID NO: 791138 - DNA, 22 bp, Homo sapiens
gatcatatttaaagatctttta

SEQ ID NO: 791139 - DNA, 14 bp, Homo sapiens
gatcatccaggcct

SEQ ID NO: 791140 - DNA, 22 bp, Homo sapiens
gatcatccgtctgtgtggggtt

SEQ ID NO: 791141 - DNA, 14 bp, Homo sapiens
gatcatctggggac

SEQ ID NO: 791142 - DNA, 12 bp, Homo sapiens
gatcatgcattg

SEQ ID NO: 791143 - DNA, 15 bp, Homo sapiens
gatcatgtacttttt

SEQ ID NO: 791144 - DNA, 20 bp, Homo sapiens
gatcatgtactttttagtaa

SEQ ID NO: 791145 - DNA, 15 bp, Homo sapiens
gatcatgtgtggaag

SEQ ID NO: 791146 - DNA, 22 bp, Homo sapiens
gatcattacatggctgtggttc

SEQ ID NO: 791147 - DNA, 12 bp, Homo sapiens
gatcattgcatt

SEQ ID NO: 791148 - DNA, 16 bp, Homo sapiens
gatcatttatttcatg

SEQ ID NO: 791149 - DNA, 17 bp, Homo sapiens
gatcatttctgccatga

SEQ ID NO: 791150 - DNA, 13 bp, Homo sapiens
gatcattttctta

SEQ ID NO: 791151 - DNA, 21 bp, Homo sapiens
gatcatttttaactgattctt

SEQ ID NO: 791152 - DNA, 20 bp, Homo sapiens
gatccaactaatgccttact

SEQ ID NO: 791153 - DNA, 23 bp, Homo sapiens
gatccacactttgggcttagtat

SEQ ID NO: 791154 - DNA, 16 bp, Homo sapiens
gatccacccaacccta

SEQ ID NO: 791155 - DNA, 19 bp, Homo sapiens
gatccaccctcaaatgtca

SEQ ID NO: 791156 - DNA, 14 bp, Homo sapiens
gatccagaacagtg

SEQ ID NO: 791157 - DNA, 21 bp, Homo sapiens
gatccagaatggagtcttttc

SEQ ID NO: 791158 - DNA, 13 bp, Homo sapiens
gatccagcactgg

SEQ ID NO: 791159 - DNA, 14 bp, Homo sapiens
gatccagcactggt

SEQ ID NO: 791160 - DNA, 12 bp, Homo sapiens
gatccagccctg

SEQ ID NO: 791161 - DNA, 17 bp, Homo sapiens
gatccagcctttccaag

SEQ ID NO: 791162 - DNA, 18 bp, Homo sapiens
gatccagggatggagatg

SEQ ID NO: 791163 - DNA, 19 bp, Homo sapiens
gatccagggatggagatgg

SEQ ID NO: 791164 - DNA, 14 bp, Homo sapiens
gatccaggggaagc

SEQ ID NO: 791165 - DNA, 16 bp, Homo sapiens
gatccagtataagact

SEQ ID NO: 791166 - DNA, 21 bp, Homo sapiens
gatccataggactaccgcagg

SEQ ID NO: 791167 - DNA, 15 bp, Homo sapiens
gatccatcttgagcc

SEQ ID NO: 791168 - DNA, 11 bp, Homo sapiens
gatcccacccc

SEQ ID NO: 791169 - DNA, 20 bp, Homo sapiens
gatcccaccccctcctcccc

SEQ ID NO: 791170 - DNA, 21 bp, Homo sapiens
gatcccaccccctcctccccc

SEQ ID NO: 791171 - DNA, 22 bp, Homo sapiens
gatcccaccccctcctccccca

SEQ ID NO: 791172 - DNA, 15 bp, Homo sapiens
gatcccactggaaga

SEQ ID NO: 791173 - DNA, 20 bp, Homo sapiens
gatcccaggtgcgtgtgtct

SEQ ID NO: 791174 - DNA, 20 bp, Homo sapiens
gatccccaagcctggcaagg

SEQ ID NO: 791175 - DNA, 20 bp, Homo sapiens
gatccccaagtgtgaacaaa

SEQ ID NO: 791176 - DNA, 18 bp, Homo sapiens
gatccccagctttctcct

SEQ ID NO: 791177 - DNA, 15 bp, Homo sapiens
gatccccagggcagc

SEQ ID NO: 791178 - DNA, 19 bp, Homo sapiens
gatccccctctttgcacag

SEQ ID NO: 791179 - DNA, 17 bp, Homo sapiens
gatccccgcctggccag

SEQ ID NO: 791180 - DNA, 18 bp, Homo sapiens
gatccccgcctggccagg

SEQ ID NO: 791181 - DNA, 21 bp, Homo sapiens
gatccccgcctggccaggagc

SEQ ID NO: 791182 - DNA, 14 bp, Homo sapiens
gatcccctgagccc

SEQ ID NO: 791183 - DNA, 20 bp, Homo sapiens
gatcccgaggtatggcagag

SEQ ID NO: 791184 - DNA, 14 bp, Homo sapiens
gatccctccacccc

SEQ ID NO: 791185 - DNA, 17 bp, Homo sapiens
gatccctgaacccctgg

SEQ ID NO: 791186 - DNA, 13 bp, Homo sapiens
gatccctggccac

SEQ ID NO: 791187 - DNA, 17 bp, Homo sapiens
gatccctggccactgaa

SEQ ID NO: 791188 - DNA, 14 bp, Homo sapiens
gatccctgtgttgt

SEQ ID NO: 791189 - DNA, 19 bp, Homo sapiens
gatccctgtgttgtctcta

SEQ ID NO: 791190 - DNA, 21 bp, Homo sapiens
gatccctgtgttgtctctaga

SEQ ID NO: 791191 - DNA, 17 bp, Homo sapiens
gatccgactgctttgga

SEQ ID NO: 791192 - DNA, 14 bp, Homo sapiens
gatccggaaagaag

SEQ ID NO: 791193 - DNA, 13 bp, Homo sapiens
gatccggctgctc

SEQ ID NO: 791194 - DNA, 16 bp, Homo sapiens
gatccggctgctcctc

SEQ ID NO: 791195 - DNA, 22 bp, Homo sapiens
gatccggctgctcctccagccc

SEQ ID NO: 791196 - DNA, 17 bp, Homo sapiens
gatcctaaactctctag

SEQ ID NO: 791197 - DNA, 20 bp, Homo sapiens
gatcctagccttatcctctg

SEQ ID NO: 791198 - DNA, 22 bp, Homo sapiens
gatcctagccttatcctctgat

SEQ ID NO: 791199 - DNA, 18 bp, Homo sapiens
gatcctaggcatttgctg

SEQ ID NO: 791200 - DNA, 20 bp, Homo sapiens
gatcctagggcacttctagt

SEQ ID NO: 791201 - DNA, 18 bp, Homo sapiens
gatcctattctcaccagg

SEQ ID NO: 791202 - DNA, 21 bp, Homo sapiens
gatcctcacactacagatcag

SEQ ID NO: 791203 - DNA, 21 bp, Homo sapiens
gatcctccaatgtctaatttt

SEQ ID NO: 791204 - DNA, 14 bp, Homo sapiens
gatcctccacagag

SEQ ID NO: 791205 - DNA, 15 bp, Homo sapiens
gatcctccacagaga

SEQ ID NO: 791206 - DNA, 16 bp, Homo sapiens
gatcctccctcatggc

SEQ ID NO: 791207 - DNA, 22 bp, Homo sapiens
gatcctcctgcagaccacgccc

SEQ ID NO: 791208 - DNA, 13 bp, Homo sapiens
gatcctctatttt

SEQ ID NO: 791209 - DNA, 14 bp, Homo sapiens
gatcctctattttg

SEQ ID NO: 791210 - DNA, 19 bp, Homo sapiens
gatcctctattttgtgatg

SEQ ID NO: 791211 - DNA, 15 bp, Homo sapiens
gatcctctcacctca

SEQ ID NO: 791212 - DNA, 16 bp, Homo sapiens
gatcctctccaccctc

SEQ ID NO: 791213 - DNA, 18 bp, Homo sapiens
gatcctctccaccctcct

SEQ ID NO: 791214 - DNA, 15 bp, Homo sapiens
gatcctgcaccccag

SEQ ID NO: 791215 - DNA, 20 bp, Homo sapiens
gatggccagcccctggggcc

SEQ ID NO: 791216 - DNA, 14 bp, Homo sapiens
gatggccataggag

SEQ ID NO: 791217 - DNA, 22 bp, Homo sapiens
gatggccatgctcaacccccct

SEQ ID NO: 791218 - DNA, 18 bp, Homo sapiens
gatggcccaagggatggc

SEQ ID NO: 791219 - DNA, 18 bp, Homo sapiens
gatggcccagcaggcagg

SEQ ID NO: 791220 - DNA, 20 bp, Homo sapiens
gatggccccaacaagcaccc

SEQ ID NO: 791221 - DNA, 22 bp, Homo sapiens
gatggccccaacaagcaccccg

SEQ ID NO: 791222 - DNA, 22 bp, Homo sapiens
gatttgatctttgtttaaatgc

SEQ ID NO: 791223 - DNA, 15 bp, Homo sapiens
gatttgatgctggag

SEQ ID NO: 791224 - DNA, 21 bp, Homo sapiens
gatttgatgctggagaggtta

SEQ ID NO: 791225 - DNA, 22 bp, Homo sapiens
gatttgatgtgactttttttgg

SEQ ID NO: 791226 - DNA, 20 bp, Homo sapiens
gatttgattcattttcctgt

SEQ ID NO: 791227 - DNA, 19 bp, Homo sapiens
gatttgcaggattcccttc

SEQ ID NO: 791228 - DNA, 20 bp, Homo sapiens
gatttgcaggattcccttct

SEQ ID NO: 791229 - DNA, 13 bp, Homo sapiens
gatttgcatggat

SEQ ID NO: 791230 - DNA, 13 bp, Homo sapiens
gatttggaagaga

SEQ ID NO: 791231 - DNA, 16 bp, Homo sapiens
gatttgggggaggctt

SEQ ID NO: 791232 - DNA, 20 bp, Homo sapiens
gatttgggggctcggggagg

SEQ ID NO: 791233 - DNA, 11 bp, Homo sapiens
gatttgtacca

SEQ ID NO: 791234 - DNA, 23 bp, Homo sapiens
gatttgtaccattccttcaaata

SEQ ID NO: 791235 - DNA, 16 bp, Homo sapiens
gatttgtagcactgag

SEQ ID NO: 791236 - DNA, 22 bp, Homo sapiens
gatttgtagcataactgtagct

SEQ ID NO: 791237 - DNA, 20 bp, Homo sapiens
gatttgtcccagcctggggc

SEQ ID NO: 791238 - DNA, 20 bp, Homo sapiens
gatttgtcttatccccccca

SEQ ID NO: 791239 - DNA, 17 bp, Homo sapiens
gatttgttcatgaatat

SEQ ID NO: 791240 - DNA, 15 bp, Homo sapiens
gattttaaaaaatca

SEQ ID NO: 791241 - DNA, 20 bp, Homo sapiens
gattttaacaaaagcaagac

SEQ ID NO: 791242 - DNA, 15 bp, Homo sapiens
gattttaacttaact

SEQ ID NO: 791243 - DNA, 21 bp, Homo sapiens
gattttaagtttctctgcaga

SEQ ID NO: 791244 - DNA, 22 bp, Homo sapiens
gattttaatagggaatatatct

SEQ ID NO: 791245 - DNA, 17 bp, Homo sapiens
gattttaatcaagttga

SEQ ID NO: 791246 - DNA, 19 bp, Homo sapiens
gattttaatttcaggaaaa

SEQ ID NO: 791247 - DNA, 17 bp, Homo sapiens
gattttacaaaagatgt

SEQ ID NO: 791248 - DNA, 13 bp, Homo sapiens
gattttacaagta

SEQ ID NO: 791249 - DNA, 19 bp, Homo sapiens
gattttacaattgaaatga

SEQ ID NO: 791250 - DNA, 14 bp, Homo sapiens
gattttaccaaagc

SEQ ID NO: 791251 - DNA, 16 bp, Homo sapiens
gattttaccaaagcat

SEQ ID NO: 791252 - DNA, 17 bp, Homo sapiens
gattttagcctcttccc

SEQ ID NO: 791253 - DNA, 17 bp, Homo sapiens
gattttatgcacagcct

SEQ ID NO: 791254 - DNA, 19 bp, Homo sapiens
gattttattacagaaatgt

SEQ ID NO: 791255 - DNA, 20 bp, Homo sapiens
gattttattacagaaatgtt

SEQ ID NO: 791256 - DNA, 23 bp, Homo sapiens
gattttatttatggaattaacca

SEQ ID NO: 791257 - DNA, 17 bp, Homo sapiens
gattttatttttgcaaa

SEQ ID NO: 791258 - DNA, 21 bp, Homo sapiens
gattttatttttgcaaaataa

SEQ ID NO: 791259 - DNA, 21 bp, Homo sapiens
gattttattttttgtgagtga

SEQ ID NO: 791260 - DNA, 12 bp, Homo sapiens
gattttcagtta

SEQ ID NO: 791261 - DNA, 17 bp, Homo sapiens
gattttctactgtaaga

SEQ ID NO: 791262 - DNA, 23 bp, Homo sapiens
gattttctattatggaaaactgt

SEQ ID NO: 791263 - DNA, 12 bp, Homo sapiens
gattttctattg

SEQ ID NO: 791264 - DNA, 13 bp, Homo sapiens
gattttctccagc

SEQ ID NO: 791265 - DNA, 20 bp, Homo sapiens
gattttctgctactttgctg

SEQ ID NO: 791266 - DNA, 20 bp, Homo sapiens
gattttcttaaggaattttg

SEQ ID NO: 791267 - DNA, 12 bp, Homo sapiens
gattttgaactt

SEQ ID NO: 791268 - DNA, 14 bp, Homo sapiens
gattttgaattaga

SEQ ID NO: 791269 - DNA, 13 bp, Homo sapiens
gattttgcctgtg

SEQ ID NO: 791270 - DNA, 17 bp, Homo sapiens
gattttggataataaac

SEQ ID NO: 791271 - DNA, 22 bp, Homo sapiens
gattttgggagtgactcaagaa

SEQ ID NO: 791272 - DNA, 13 bp, Homo sapiens
gattttgtaaccc

SEQ ID NO: 791273 - DNA, 11 bp, Homo sapiens
gattttgtaat

SEQ ID NO: 791274 - DNA, 18 bp, Homo sapiens
gattttgtaattcttatg

SEQ ID NO: 791275 - DNA, 12 bp, Homo sapiens
gattttgtagtt

SEQ ID NO: 791276 - DNA, 23 bp, Homo sapiens
gattttgtatctgcaggcagaca

SEQ ID NO: 791277 - DNA, 15 bp, Homo sapiens
gatttttaagaactt

SEQ ID NO: 791278 - DNA, 15 bp, Homo sapiens
gatttttacactaat

SEQ ID NO: 791279 - DNA, 15 bp, Homo sapiens
gatttttagaattaa

SEQ ID NO: 791280 - DNA, 18 bp, Homo sapiens
gatttttatccatttctt

SEQ ID NO: 791281 - DNA, 15 bp, Homo sapiens
gatttttatgtgttt

SEQ ID NO: 791282 - DNA, 13 bp, Homo sapiens
gatttttccatgt

SEQ ID NO: 791283 - DNA, 12 bp, Homo sapiens
gatttttcttta

SEQ ID NO: 791284 - DNA, 15 bp, Homo sapiens
gatttttctttacaa

SEQ ID NO: 791285 - DNA, 20 bp, Homo sapiens
gatttttctttacaaaacaa

SEQ ID NO: 791286 - DNA, 21 bp, Homo sapiens
gatttttgttttccactgtgc

SEQ ID NO: 791287 - DNA, 18 bp, Homo sapiens
gatttttgtttttgtaat

SEQ ID NO: 791288 - DNA, 16 bp, Homo sapiens
gattttttaataattt

SEQ ID NO: 791289 - DNA, 19 bp, Homo sapiens
gattttttaataatttaga

SEQ ID NO: 791290 - DNA, 17 bp, Homo sapiens
gattttttatgtacaac

SEQ ID NO: 791291 - DNA, 21 bp, Homo sapiens
gattttttcagacttgtcaag

SEQ ID NO: 791292 - DNA, 12 bp, Homo sapiens
gattttttccaa

SEQ ID NO: 791293 - DNA, 13 bp, Homo sapiens
gattttttccctt

SEQ ID NO: 791294 - DNA, 16 bp, Homo sapiens
gattttttcccttttt

SEQ ID NO: 791295 - DNA, 17 bp, Homo sapiens
gatttttttaaagtagt

SEQ ID NO: 791296 - DNA, 21 bp, Homo sapiens
gatttttttcccaattgagaa

SEQ ID NO: 791297 - DNA, 16 bp, Homo sapiens
gatttttttcctcccc

SEQ ID NO: 791298 - DNA, 14 bp, Homo sapiens
gatttttttctgag

SEQ ID NO: 791299 - DNA, 20 bp, Homo sapiens
gatttttttgtgtatgtttt

SEQ ID NO: 791300 - DNA, 15 bp, Homo sapiens
gattttttttaaagt

SEQ ID NO: 791301 - DNA, 13 bp, Homo sapiens
gcaaaaaaaatta

SEQ ID NO: 791302 - DNA, 23 bp, Homo sapiens
gcaaaaaacatacttacatttca

SEQ ID NO: 791303 - DNA, 13 bp, Homo sapiens
gcaaaaaagaaaa

SEQ ID NO: 791304 - DNA, 15 bp, Homo sapiens
gcaaaaaagaaaacc

SEQ ID NO: 791305 - DNA, 20 bp, Homo sapiens
gcaaaaaaggtaactaactg

SEQ ID NO: 791306 - DNA, 20 bp, Homo sapiens
gcaaaaaatactttttctaa

SEQ ID NO: 791307 - DNA, 20 bp, Homo sapiens
gcaaaaacaaaaagaaaaga

SEQ ID NO: 791308 - DNA, 21 bp, Homo sapiens
gcaaaaacaaaaagaaaagaa

SEQ ID NO: 791309 - DNA, 22 bp, Homo sapiens
gcaaaaacatgtatgtgcattt

SEQ ID NO: 791310 - DNA, 19 bp, Homo sapiens
gcaaaaactacattttgca

SEQ ID NO: 791311 - DNA, 19 bp, Homo sapiens
gcaaaaagaaaaaaagaaa

SEQ ID NO: 791312 - DNA, 20 bp, Homo sapiens
gcaaaaagcaagggagaaaa

SEQ ID NO: 791313 - DNA, 22 bp, Homo sapiens
gcaaaaagcaagggagaaaaga

SEQ ID NO: 791314 - DNA, 13 bp, Homo sapiens
gcaaaaataatca

SEQ ID NO: 791315 - DNA, 23 bp, Homo sapiens
gcaaaaatagtttggatatgtaa

SEQ ID NO: 791316 - DNA, 14 bp, Homo sapiens
gcaaaaatatttat

SEQ ID NO: 791317 - DNA, 23 bp, Homo sapiens
gcaaaaatatttataaaacttct

SEQ ID NO: 791318 - DNA, 18 bp, Homo sapiens
gcaaaaatccgaggtgct

SEQ ID NO: 791319 - DNA, 21 bp, Homo sapiens
gcaaaaatgacaacagaaaaa

SEQ ID NO: 791320 - DNA, 18 bp, Homo sapiens
gcaaaacaaaagtacatt

SEQ ID NO: 791321 - DNA, 21 bp, Homo sapiens
gcaaaaccactagaactctcc

SEQ ID NO: 791322 - DNA, 16 bp, Homo sapiens
gcaaaacccacagaag

SEQ ID NO: 791323 - DNA, 16 bp, Homo sapiens
gcaaaacggatgagtt

SEQ ID NO: 791324 - DNA, 15 bp, Homo sapiens
gcaaaactcacagag

SEQ ID NO: 791325 - DNA, 22 bp, Homo sapiens
gcaaaactctacttaatccaat

SEQ ID NO: 791326 - DNA, 19 bp, Homo sapiens
gcaaaactggaagcacagc

SEQ ID NO: 791327 - DNA, 19 bp, Homo sapiens
gcaaaagaatggcagaaaa

SEQ ID NO: 791328 - DNA, 11 bp, Homo sapiens
gcaaaagactg

SEQ ID NO: 791329 - DNA, 22 bp, Homo sapiens
gcaaaagactggtttgtttgct

SEQ ID NO: 791330 - DNA, 17 bp, Homo sapiens
gcaaaagatgcttctca

SEQ ID NO: 791331 - DNA, 11 bp, Homo sapiens
gcaaaaggaaa

SEQ ID NO: 791332 - DNA, 20 bp, Homo sapiens
gcaaaaggatctttgtggcc

SEQ ID NO: 791333 - DNA, 14 bp, Homo sapiens
gcaaaaggcagctc

SEQ ID NO: 791334 - DNA, 15 bp, Homo sapiens
gcaaaaggcagctca

SEQ ID NO: 791335 - DNA, 23 bp, Homo sapiens
gcaaaaggcctcttgtaaagact

SEQ ID NO: 791336 - DNA, 15 bp, Homo sapiens
gcaaaagtgagaaaa

SEQ ID NO: 791337 - DNA, 13 bp, Homo sapiens
gcaaaagtggggc

SEQ ID NO: 791338 - DNA, 15 bp, Homo sapiens
gcaaaataaaacata

SEQ ID NO: 791339 - DNA, 19 bp, Homo sapiens
gcaaaatacacgtttatct

SEQ ID NO: 791340 - DNA, 17 bp, Homo sapiens
gcaaaatacatgaagct

SEQ ID NO: 791341 - DNA, 14 bp, Homo sapiens
gcaaaccttcctgg

SEQ ID NO: 791342 - DNA, 15 bp, Homo sapiens
gcaaaccttcctggg

SEQ ID NO: 791343 - DNA, 16 bp, Homo sapiens
gcaaaccttcctggga

SEQ ID NO: 791344 - DNA, 14 bp, Homo sapiens
gcaaacgctaaaga

SEQ ID NO: 791345 - DNA, 14 bp, Homo sapiens
gcaaactatgattt

SEQ ID NO: 791346 - DNA, 17 bp, Homo sapiens
gcaaactcactgctcaa

SEQ ID NO: 791347 - DNA, 14 bp, Homo sapiens
gcaaactctgctgt

SEQ ID NO: 791348 - DNA, 17 bp, Homo sapiens
gcaaactgatgctgagg

SEQ ID NO: 791349 - DNA, 19 bp, Homo sapiens
gcaaactgatgctgaggat

SEQ ID NO: 791350 - DNA, 14 bp, Homo sapiens
gcaaactgctttat

SEQ ID NO: 791351 - DNA, 21 bp, Homo sapiens
gcaaactgtcctctacatcaa

SEQ ID NO: 791352 - DNA, 23 bp, Homo sapiens
gcaaagaaaaaaaaaaaagccag

SEQ ID NO: 791353 - DNA, 12 bp, Homo sapiens
gcaaagaaaatg

SEQ ID NO: 791354 - DNA, 15 bp, Homo sapiens
gcaaagaagcttcat

SEQ ID NO: 791355 - DNA, 18 bp, Homo sapiens
gcaaagaagtaagtttat

SEQ ID NO: 791356 - DNA, 19 bp, Homo sapiens
gcaaagacaaaagaaactt

SEQ ID NO: 791357 - DNA, 13 bp, Homo sapiens
gcaaagactctga

SEQ ID NO: 791358 - DNA, 15 bp, Homo sapiens
gcaaagactctgagc

SEQ ID NO: 791359 - DNA, 20 bp, Homo sapiens
gcaaagactctgagccaagg

SEQ ID NO: 791360 - DNA, 22 bp, Homo sapiens
gcaaagactctgagccaaggga

SEQ ID NO: 791361 - DNA, 15 bp, Homo sapiens
gcaaagaggggcgct

SEQ ID NO: 791362 - DNA, 21 bp, Homo sapiens
gcaaagaggggcgctgtcctg

SEQ ID NO: 791363 - DNA, 15 bp, Homo sapiens
gcaaagatcaaaata

SEQ ID NO: 791364 - DNA, 16 bp, Homo sapiens
gcaaagatttcagtag

SEQ ID NO: 791365 - DNA, 22 bp, Homo sapiens
gcaaagatttcagtagaatttt

SEQ ID NO: 791366 - DNA, 20 bp, Homo sapiens
gcaaagattttcaaacaaaa

SEQ ID NO: 791367 - DNA, 13 bp, Homo sapiens
gcaaagcaccagc

SEQ ID NO: 791368 - DNA, 16 bp, Homo sapiens
gcaaagcactctctgc

SEQ ID NO: 791369 - DNA, 21 bp, Homo sapiens
gcaaagcccagcttgaaacct

SEQ ID NO: 791370 - DNA, 13 bp, Homo sapiens
gcaaagcctcctt

SEQ ID NO: 791371 - DNA, 15 bp, Homo sapiens
gcaaagcgacagatt

SEQ ID NO: 791372 - DNA, 21 bp, Homo sapiens
gcaaagcgcccacccaggtcc

SEQ ID NO: 791373 - DNA, 11 bp, Homo sapiens
gcaaagcttgt

SEQ ID NO: 791374 - DNA, 12 bp, Homo sapiens
gcaaaggaaaat

SEQ ID NO: 791375 - DNA, 14 bp, Homo sapiens
gcaaaggaaatacc

SEQ ID NO: 791376 - DNA, 12 bp, Homo sapiens
gcaaaggagaag

SEQ ID NO: 791377 - DNA, 14 bp, Homo sapiens
gcaaaggagaagca

SEQ ID NO: 791378 - DNA, 19 bp, Homo sapiens
gcaaaggagacaaagcagg

SEQ ID NO: 791379 - DNA, 20 bp, Homo sapiens
gcaaaggaggggaaacaatg

SEQ ID NO: 791380 - DNA, 11 bp, Homo sapiens
gcaaaggcaga

SEQ ID NO: 791381 - DNA, 13 bp, Homo sapiens
gcaaaggcagggc

SEQ ID NO: 791382 - DNA, 15 bp, Homo sapiens
gcaaaggcagtcccg

SEQ ID NO: 791383 - DNA, 14 bp, Homo sapiens
gcaaaggcctgggc

SEQ ID NO: 791384 - DNA, 15 bp, Homo sapiens
gcaaagggctgaaag

SEQ ID NO: 791385 - DNA, 14 bp, Homo sapiens
gcaaaggggacagc

SEQ ID NO: 791386 - DNA, 19 bp, Homo sapiens
gcaaaggggacagctgtgt

SEQ ID NO: 791387 - DNA, 16 bp, Homo sapiens
gcaaaggtcttgaata

SEQ ID NO: 791388 - DNA, 15 bp, Homo sapiens
gcaaaggtgcctcat

SEQ ID NO: 791389 - DNA, 23 bp, Homo sapiens
gcaaaggtgcctcatagcatagc

SEQ ID NO: 791390 - DNA, 21 bp, Homo sapiens
gcaaaggtggcaatgcttaaa

SEQ ID NO: 791391 - DNA, 19 bp, Homo sapiens
gcaaaggttccaactgtat

SEQ ID NO: 791392 - DNA, 13 bp, Homo sapiens
gcaaagtagtact

SEQ ID NO: 791393 - DNA, 23 bp, Homo sapiens
gcaaagtagtacttcttctgtaa

SEQ ID NO: 791394 - DNA, 23 bp, Homo sapiens
gcaaagtatcaaagaaaaacaat

SEQ ID NO: 791395 - DNA, 16 bp, Homo sapiens
gcaaagtatccctact

SEQ ID NO: 791396 - DNA, 20 bp, Homo sapiens
gcaaagtattgtaaattata

SEQ ID NO: 791397 - DNA, 14 bp, Homo sapiens
gcaaagtcgccagt

SEQ ID NO: 791398 - DNA, 18 bp, Homo sapiens
gcaaagtcgccagtcact

SEQ ID NO: 791399 - DNA, 22 bp, Homo sapiens
gcaaagtgaagttgcttcttct

SEQ ID NO: 791400 - DNA, 16 bp, Homo sapiens
gcaaagtgctgtaccc

SEQ ID NO: 791401 - DNA, 23 bp, Homo sapiens
gcaaagtgttttctcagaacagc

SEQ ID NO: 791402 - DNA, 14 bp, Homo sapiens
gcaaagtttacaga

SEQ ID NO: 791403 - DNA, 14 bp, Homo sapiens
gcaaataaagcctt

SEQ ID NO: 791404 - DNA, 19 bp, Homo sapiens
gcaaataaagccttttaaa

SEQ ID NO: 791405 - DNA, 23 bp, Homo sapiens
gcaaataagtgtattttgaaatt

SEQ ID NO: 791406 - DNA, 20 bp, Homo sapiens
gcaaataatgatcgaaaaaa

SEQ ID NO: 791407 - DNA, 16 bp, Homo sapiens
gcaaataatggaaaaa

SEQ ID NO: 791408 - DNA, 22 bp, Homo sapiens
gcaaataatttcctggtgtgaa

SEQ ID NO: 791409 - DNA, 18 bp, Homo sapiens
gcaaatacctatgtcaac

SEQ ID NO: 791410 - DNA, 13 bp, Homo sapiens
gcaaatatagaaa

SEQ ID NO: 791411 - DNA, 19 bp, Homo sapiens
gcaaatattatccagcaag

SEQ ID NO: 791412 - DNA, 12 bp, Homo sapiens
gcaaatcaatgc

SEQ ID NO: 791413 - DNA, 13 bp, Homo sapiens
gcaaatcagaaac

SEQ ID NO: 791414 - DNA, 20 bp, Homo sapiens
gcaaatcagaaacttgtgaa

SEQ ID NO: 791415 - DNA, 18 bp, Homo sapiens
gcaaatcaggggccagag

SEQ ID NO: 791416 - DNA, 19 bp, Homo sapiens
gcaaatcaggggccagaga

SEQ ID NO: 791417 - DNA, 18 bp, Homo sapiens
gcaaatcagttactaaga

SEQ ID NO: 791418 - DNA, 14 bp, Homo sapiens
gcaaatcatctgca

SEQ ID NO: 791419 - DNA, 22 bp, Homo sapiens
gcaaatcatctgcattcctgat

SEQ ID NO: 791420 - DNA, 18 bp, Homo sapiens
gcaaatcatttgtttaaa

SEQ ID NO: 791421 - DNA, 23 bp, Homo sapiens
gcaaatctttctgtaaacagaat

SEQ ID NO: 791422 - DNA, 13 bp, Homo sapiens
gcaaatgaatcat

SEQ ID NO: 791423 - DNA, 14 bp, Homo sapiens
gcaaatgaatcatt

SEQ ID NO: 791424 - DNA, 14 bp, Homo sapiens
gcaaatgccagggc

SEQ ID NO: 791425 - DNA, 15 bp, Homo sapiens
gcaaatgccagggcc

SEQ ID NO: 791426 - DNA, 17 bp, Homo sapiens
gcaaatgccagggcccg

SEQ ID NO: 791427 - DNA, 19 bp, Homo sapiens
gcaaatggaggcttttcac

SEQ ID NO: 791428 - DNA, 13 bp, Homo sapiens
gcaaatggcagtt

SEQ ID NO: 791429 - DNA, 15 bp, Homo sapiens
gcaaatggctgagat

SEQ ID NO: 791430 - DNA, 21 bp, Homo sapiens
gcaaatgggcagctccatcct

SEQ ID NO: 791431 - DNA, 17 bp, Homo sapiens
gcaaatgtcttccaggt

SEQ ID NO: 791432 - DNA, 15 bp, Homo sapiens
gcaaatgtggctcct

SEQ ID NO: 791433 - DNA, 17 bp, Homo sapiens
gcaaatgtttatttaaa

SEQ ID NO: 791434 - DNA, 13 bp, Homo sapiens
gcaagatgtgaat

SEQ ID NO: 791435 - DNA, 17 bp, Homo sapiens
gcaagatgtgaattatt

SEQ ID NO: 791436 - DNA, 16 bp, Homo sapiens
gcaagatgtttcttat

SEQ ID NO: 791437 - DNA, 17 bp, Homo sapiens
gcaagattggaaagaca

SEQ ID NO: 791438 - DNA, 20 bp, Homo sapiens
gcaagattggaaagacagga

SEQ ID NO: 791439 - DNA, 22 bp, Homo sapiens
gcaagattggaaagacaggaag

SEQ ID NO: 791440 - DNA, 23 bp, Homo sapiens
gcaagattggaaagacaggaaga

SEQ ID NO: 791441 - DNA, 22 bp, Homo sapiens
gcaagattttccacaagattcc

SEQ ID NO: 791442 - DNA, 15 bp, Homo sapiens
gcaagcacagccctt

SEQ ID NO: 791443 - DNA, 21 bp, Homo sapiens
gcaagcacctgttaataaagg

SEQ ID NO: 791444 - DNA, 23 bp, Homo sapiens
gcaagcagctttttattccctgc

SEQ ID NO: 791445 - DNA, 14 bp, Homo sapiens
gcaagcagggaaag

SEQ ID NO: 791446 - DNA, 21 bp, Homo sapiens
gcaagcagtctaccctgtcct

SEQ ID NO: 791447 - DNA, 11 bp, Homo sapiens
gcaagccacag

SEQ ID NO: 791448 - DNA, 15 bp, Homo sapiens
gcaagccacaggaag

SEQ ID NO: 791449 - DNA, 19 bp, Homo sapiens
gcaagccacaggaaggagg

SEQ ID NO: 791450 - DNA, 11 bp, Homo sapiens
gcaagccacca

SEQ ID NO: 791451 - DNA, 23 bp, Homo sapiens
gcaagccagacctagcaggctgt

SEQ ID NO: 791452 - DNA, 12 bp, Homo sapiens
gcaagccagggc

SEQ ID NO: 791453 - DNA, 15 bp, Homo sapiens
gcaagccagggccca

SEQ ID NO: 791454 - DNA, 22 bp, Homo sapiens
gcaagccagggcccagagccct

SEQ ID NO: 791455 - DNA, 19 bp, Homo sapiens
gcaagccataacgtgcccc

SEQ ID NO: 791456 - DNA, 20 bp, Homo sapiens
gcaagccataacgtgccccc

SEQ ID NO: 791457 - DNA, 16 bp, Homo sapiens
gcaagccccagggcct

SEQ ID NO: 791458 - DNA, 17 bp, Homo sapiens
gcaagccccagggcctg

SEQ ID NO: 791459 - DNA, 18 bp, Homo sapiens
gcaagccccagggcctgg

SEQ ID NO: 791460 - DNA, 20 bp, Homo sapiens
gcaagccctacagagctgtg

SEQ ID NO: 791461 - DNA, 21 bp, Homo sapiens
gcaagccctacagagctgtgg

SEQ ID NO: 791462 - DNA, 15 bp, Homo sapiens
gcaagccctgttgac

SEQ ID NO: 791463 - DNA, 16 bp, Homo sapiens
gcaagcgacgacagat

SEQ ID NO: 791464 - DNA, 17 bp, Homo sapiens
gcaagcgagcacagtat

SEQ ID NO: 791465 - DNA, 14 bp, Homo sapiens
gcaagctgaaattt

SEQ ID NO: 791466 - DNA, 13 bp, Homo sapiens
gcaagctgcaggt

SEQ ID NO: 791467 - DNA, 21 bp, Homo sapiens
gcaagcttacacaagaagtga

SEQ ID NO: 791468 - DNA, 20 bp, Homo sapiens
gcaagcttggtcaaactttt

SEQ ID NO: 791469 - DNA, 10 bp, Homo sapiens
gcaaggaaag

SEQ ID NO: 791470 - DNA, 15 bp, Homo sapiens
gcaaggaaggaaaga

SEQ ID NO: 791471 - DNA, 12 bp, Homo sapiens
gcaaggaaggac

SEQ ID NO: 791472 - DNA, 21 bp, Homo sapiens
gcaaggaccaggactccctcc

SEQ ID NO: 791473 - DNA, 18 bp, Homo sapiens
gcaaggagatttacaact

SEQ ID NO: 791474 - DNA, 16 bp, Homo sapiens
gcaaggagcacaagcc

SEQ ID NO: 791475 - DNA, 20 bp, Homo sapiens
gcaaggagtttattacaatg

SEQ ID NO: 791476 - DNA, 21 bp, Homo sapiens
gcaaggatttttccatgtgtg

SEQ ID NO: 791477 - DNA, 23 bp, Homo sapiens
gcaaggatttttccatgtgtggt

SEQ ID NO: 791478 - DNA, 11 bp, Homo sapiens
gcaaggcaggt

SEQ ID NO: 791479 - DNA, 13 bp, Homo sapiens
gcaaggcaggtgc

SEQ ID NO: 791480 - DNA, 21 bp, Homo sapiens
gcaaggcaggtgcctccaggt

SEQ ID NO: 791481 - DNA, 21 bp, Homo sapiens
gcaaggccgctgttcacccac

SEQ ID NO: 791482 - DNA, 19 bp, Homo sapiens
gcaaggcctctcagaccca

SEQ ID NO: 791483 - DNA, 24 bp, Homo sapiens
gcaaggccttggtggagcagccag

SEQ ID NO: 791484 - DNA, 21 bp, Homo sapiens
gcaagggaatttcttcaactc

SEQ ID NO: 791485 - DNA, 14 bp, Homo sapiens
gcacaggacatgcg

SEQ ID NO: 791486 - DNA, 12 bp, Homo sapiens
gcacaggcactg

SEQ ID NO: 791487 - DNA, 13 bp, Homo sapiens
gcacaggcactga

SEQ ID NO: 791488 - DNA, 18 bp, Homo sapiens
gcacaggcactgaacagg

SEQ ID NO: 791489 - DNA, 22 bp, Homo sapiens
gcacaggcccgccctctgcctc

SEQ ID NO: 791490 - DNA, 15 bp, Homo sapiens
gcacaggccctagct

SEQ ID NO: 791491 - DNA, 23 bp, Homo sapiens
gcacagggtctgctctttctctg

SEQ ID NO: 791492 - DNA, 15 bp, Homo sapiens
gcacaggtcccacct

SEQ ID NO: 791493 - DNA, 14 bp, Homo sapiens
gcacagtaaaagta

SEQ ID NO: 791494 - DNA, 22 bp, Homo sapiens
gcacagtaaaagtaaagactat

SEQ ID NO: 791495 - DNA, 16 bp, Homo sapiens
gcacagtcactgctct

SEQ ID NO: 791496 - DNA, 23 bp, Homo sapiens
gcacagtcaggggctgggcatcc

SEQ ID NO: 791497 - DNA, 17 bp, Homo sapiens
gcacagtccacagctga

SEQ ID NO: 791498 - DNA, 13 bp, Homo sapiens
gcacagtccagga

SEQ ID NO: 791499 - DNA, 16 bp, Homo sapiens
gcacagtgacttctga

SEQ ID NO: 791500 - DNA, 17 bp, Homo sapiens
gcacagtgacttctgag

SEQ ID NO: 791501 - DNA, 22 bp, Homo sapiens
gcacagtgatgccgggcgccag

SEQ ID NO: 791502 - DNA, 15 bp, Homo sapiens
gcacagtgcatctca

SEQ ID NO: 791503 - DNA, 13 bp, Homo sapiens
gcacagtgctgcc

SEQ ID NO: 791504 - DNA, 18 bp, Homo sapiens
gcacagtgctgccccttg

SEQ ID NO: 791505 - DNA, 22 bp, Homo sapiens
gcacagtgctgccccttgcaag

SEQ ID NO: 791506 - DNA, 13 bp, Homo sapiens
gcacagtgggagc

SEQ ID NO: 791507 - DNA, 14 bp, Homo sapiens
gcacagtgggagct

SEQ ID NO: 791508 - DNA, 22 bp, Homo sapiens
gcacagtgtaatccaggggtgt

SEQ ID NO: 791509 - DNA, 13 bp, Homo sapiens
gcacagtgtgtga

SEQ ID NO: 791510 - DNA, 17 bp, Homo sapiens
gcacagtgttaaatgaa

SEQ ID NO: 791511 - DNA, 21 bp, Homo sapiens
gcacagtttagaacagaggga

SEQ ID NO: 791512 - DNA, 15 bp, Homo sapiens
gcacagtttgaacaa

SEQ ID NO: 791513 - DNA, 14 bp, Homo sapiens
gcacataaactttg

SEQ ID NO: 791514 - DNA, 23 bp, Homo sapiens
gcacatacgggctttaatagtca

SEQ ID NO: 791515 - DNA, 18 bp, Homo sapiens
gcacatagtgtcctgccc

SEQ ID NO: 791516 - DNA, 19 bp, Homo sapiens
gcacatattagtgcagcca

SEQ ID NO: 791517 - DNA, 22 bp, Homo sapiens
gcacatcatattctattgttta

SEQ ID NO: 791518 - DNA, 16 bp, Homo sapiens
gcacatctccagaaaa

SEQ ID NO: 791519 - DNA, 22 bp, Homo sapiens
gcacatctccagaaaaatgaaa

SEQ ID NO: 791520 - DNA, 20 bp, Homo sapiens
gcacatctctctgccctctc

SEQ ID NO: 791521 - DNA, 21 bp, Homo sapiens
gcacatctgcattttcacccc

SEQ ID NO: 791522 - DNA, 21 bp, Homo sapiens
gcacatctggatgccttcccc

SEQ ID NO: 791523 - DNA, 17 bp, Homo sapiens
gcacatctgtgtcttgt

SEQ ID NO: 791524 - DNA, 23 bp, Homo sapiens
gcacatgcccgggggacgcctgc

SEQ ID NO: 791525 - DNA, 18 bp, Homo sapiens
gcacatgccttaagccag

SEQ ID NO: 791526 - DNA, 17 bp, Homo sapiens
gcagctactgtaacttt

SEQ ID NO: 791527 - DNA, 21 bp, Homo sapiens
gcagctagactggagtgaggc

SEQ ID NO: 791528 - DNA, 13 bp, Homo sapiens
gcagctagtgcct

SEQ ID NO: 791529 - DNA, 17 bp, Homo sapiens
gcagctatttcagcctc

SEQ ID NO: 791530 - DNA, 20 bp, Homo sapiens
gcagctatttcagcctcctg

SEQ ID NO: 791531 - DNA, 17 bp, Homo sapiens
gcagctcacccctgggc

SEQ ID NO: 791532 - DNA, 17 bp, Homo sapiens
gcagctcccgcagggct

SEQ ID NO: 791533 - DNA, 22 bp, Homo sapiens
gcagctccctttctcaggagct

SEQ ID NO: 791534 - DNA, 13 bp, Homo sapiens
gcagctcctcagc

SEQ ID NO: 791535 - DNA, 14 bp, Homo sapiens
gcagctcctcagcg

SEQ ID NO: 791536 - DNA, 13 bp, Homo sapiens
gcagctcctctcc

SEQ ID NO: 791537 - DNA, 16 bp, Homo sapiens
gcagctcttctggagt

SEQ ID NO: 791538 - DNA, 17 bp, Homo sapiens
gcagctcttctggagtt

SEQ ID NO: 791539 - DNA, 23 bp, Homo sapiens
gcagctcttctggagtttctcta

SEQ ID NO: 791540 - DNA, 20 bp, Homo sapiens
gcagctcttctgggcagagc

SEQ ID NO: 791541 - DNA, 23 bp, Homo sapiens
gcagctcttctgggcagagcctg

SEQ ID NO: 791542 - DNA, 17 bp, Homo sapiens
gcagctgagaccagggt

SEQ ID NO: 791543 - DNA, 14 bp, Homo sapiens
gcagctgagagccc

SEQ ID NO: 791544 - DNA, 17 bp, Homo sapiens
gcagctgagagccctgc

SEQ ID NO: 791545 - DNA, 21 bp, Homo sapiens
gcagctgagagccctgctgtg

SEQ ID NO: 791546 - DNA, 21 bp, Homo sapiens
gcagctgaggacacaccccac

SEQ ID NO: 791547 - DNA, 15 bp, Homo sapiens
gcagctgattttaac

SEQ ID NO: 791548 - DNA, 18 bp, Homo sapiens
gcagctgattttaacaat

SEQ ID NO: 791549 - DNA, 14 bp, Homo sapiens
gcagctgcccctcc

SEQ ID NO: 791550 - DNA, 10 bp, Homo sapiens
gcagctgcct

SEQ ID NO: 791551 - DNA, 12 bp, Homo sapiens
gcagctgcctct

SEQ ID NO: 791552 - DNA, 13 bp, Homo sapiens
gcagctgcctctg

SEQ ID NO: 791553 - DNA, 14 bp, Homo sapiens
gcagctgcctctgc

SEQ ID NO: 791554 - DNA, 18 bp, Homo sapiens
gcagctgcctctgctccc

SEQ ID NO: 791555 - DNA, 19 bp, Homo sapiens
gcagctgcctctgctccct

SEQ ID NO: 791556 - DNA, 12 bp, Homo sapiens
gcagctgcctgg

SEQ ID NO: 791557 - DNA, 15 bp, Homo sapiens
gcagctgcctggggc

SEQ ID NO: 791558 - DNA, 23 bp, Homo sapiens
gcagctgctatccccatctccct

SEQ ID NO: 791559 - DNA, 22 bp, Homo sapiens
gcagctgctatttattttccta

SEQ ID NO: 791560 - DNA, 18 bp, Homo sapiens
gcagctggaccatctctg

SEQ ID NO: 791561 - DNA, 20 bp, Homo sapiens
gcagctggaccatctctgta

SEQ ID NO: 791562 - DNA, 21 bp, Homo sapiens
gcagctggaccatctctgtag

SEQ ID NO: 791563 - DNA, 16 bp, Homo sapiens
gcagctggactaccca

SEQ ID NO: 791564 - DNA, 13 bp, Homo sapiens
gcagctggccccc

SEQ ID NO: 791565 - DNA, 15 bp, Homo sapiens
gcagctggcccccag

SEQ ID NO: 791566 - DNA, 17 bp, Homo sapiens
gcagctggcccccagcc

SEQ ID NO: 791567 - DNA, 20 bp, Homo sapiens
gcagctggcccccagccctg

SEQ ID NO: 791568 - DNA, 22 bp, Homo sapiens
gcagctggcccccagccctggg

SEQ ID NO: 791569 - DNA, 18 bp, Homo sapiens
gcagctggctctccacct

SEQ ID NO: 791570 - DNA, 18 bp, Homo sapiens
gcagctgggccccaccta

SEQ ID NO: 791571 - DNA, 21 bp, Homo sapiens
gcagctgggccccatgctctg

SEQ ID NO: 791572 - DNA, 15 bp, Homo sapiens
gcagctggggtaggc

SEQ ID NO: 791573 - DNA, 21 bp, Homo sapiens
gcagctggggtaggctgtctg

SEQ ID NO: 791574 - DNA, 12 bp, Homo sapiens
gcagctgggtgg

SEQ ID NO: 791575 - DNA, 23 bp, Homo sapiens
gcagctggtcagtctttgctcag

SEQ ID NO: 791576 - DNA, 18 bp, Homo sapiens
gcagctgtagctcccgag

SEQ ID NO: 791577 - DNA, 22 bp, Homo sapiens
gcagctgtctaaaatgcagtgg

SEQ ID NO: 791578 - DNA, 10 bp, Homo sapiens
gcagctgtga

SEQ ID NO: 791579 - DNA, 17 bp, Homo sapiens
gcagctgttgagaaaac

SEQ ID NO: 791580 - DNA, 21 bp, Homo sapiens
gcagctgttgagaaaacgaag

SEQ ID NO: 791581 - DNA, 18 bp, Homo sapiens
gcagctgtttctcatgaa

SEQ ID NO: 791582 - DNA, 15 bp, Homo sapiens
gcagcttaacattga

SEQ ID NO: 791583 - DNA, 20 bp, Homo sapiens
gcagcttagggccctggagg

SEQ ID NO: 791584 - DNA, 21 bp, Homo sapiens
gcagcttagggccctggaggc

SEQ ID NO: 791585 - DNA, 21 bp, Homo sapiens
gcagcttcaacttttctcttt

SEQ ID NO: 791586 - DNA, 12 bp, Homo sapiens
gcagcttccaga

SEQ ID NO: 791587 - DNA, 15 bp, Homo sapiens
gcagcttcttgggct

SEQ ID NO: 791588 - DNA, 13 bp, Homo sapiens
gcagcttgcagtc

SEQ ID NO: 791589 - DNA, 19 bp, Homo sapiens
gcagctttaaactcaggga

SEQ ID NO: 791590 - DNA, 20 bp, Homo sapiens
gcagctttaaactcagggac

SEQ ID NO: 791591 - DNA, 21 bp, Homo sapiens
gcagctttaaactcagggaca

SEQ ID NO: 791592 - DNA, 22 bp, Homo sapiens
gcagctttttattccctgccca

SEQ ID NO: 791593 - DNA, 15 bp, Homo sapiens
gcagctttttctgtg

SEQ ID NO: 791594 - DNA, 21 bp, Homo sapiens
gcagctttttctgtggaggac

SEQ ID NO: 791595 - DNA, 18 bp, Homo sapiens
gcaggaaagccacatctt

SEQ ID NO: 791596 - DNA, 18 bp, Homo sapiens
gcaggaacaaacagggct

SEQ ID NO: 791597 - DNA, 14 bp, Homo sapiens
gcaggaacatacag

SEQ ID NO: 791598 - DNA, 16 bp, Homo sapiens
gcaggaacgagcactg

SEQ ID NO: 791599 - DNA, 17 bp, Homo sapiens
gcaggaacgagcactgg

SEQ ID NO: 791600 - DNA, 16 bp, Homo sapiens
gcaggaactgggctgg

SEQ ID NO: 791601 - DNA, 19 bp, Homo sapiens
gcaggaactgggctgggcc

SEQ ID NO: 791602 - DNA, 17 bp, Homo sapiens
gcaggaagaggcccact

SEQ ID NO: 791603 - DNA, 22 bp, Homo sapiens
gcaggaagatgtatgctttgaa

SEQ ID NO: 791604 - DNA, 20 bp, Homo sapiens
gcaggaagcattcagagagc

SEQ ID NO: 791605 - DNA, 21 bp, Homo sapiens
gcaggaagcattcagagagca

SEQ ID NO: 791606 - DNA, 14 bp, Homo sapiens
gcaggaaggacccc

SEQ ID NO: 791607 - DNA, 16 bp, Homo sapiens
gcaggaaggagagcct

SEQ ID NO: 791608 - DNA, 10 bp, Homo sapiens
gcaggaatgg

SEQ ID NO: 791609 - DNA, 13 bp, Homo sapiens
gcaggaatggggg

SEQ ID NO: 791610 - DNA, 16 bp, Homo sapiens
gcaggaatttcttttt

SEQ ID NO: 791611 - DNA, 20 bp, Homo sapiens
gcaggacacatcccggcctc

SEQ ID NO: 791612 - DNA, 23 bp, Homo sapiens
gcaggacacatcccggcctcttc

SEQ ID NO: 791613 - DNA, 16 bp, Homo sapiens
gcaggacagccagcag

SEQ ID NO: 791614 - DNA, 17 bp, Homo sapiens
gcaggacagccagcagc

SEQ ID NO: 791615 - DNA, 18 bp, Homo sapiens
gcaggacagtcaaggtga

SEQ ID NO: 791616 - DNA, 14 bp, Homo sapiens
gcaggaccaggact

SEQ ID NO: 791617 - DNA, 14 bp, Homo sapiens
gcaggaccctgctg

SEQ ID NO: 791618 - DNA, 16 bp, Homo sapiens
gcaggaccctgctgac

SEQ ID NO: 791619 - DNA, 12 bp, Homo sapiens
gcaggaccctgt

SEQ ID NO: 791620 - DNA, 18 bp, Homo sapiens
gcaggaccctgtcctgca

SEQ ID NO: 791621 - DNA, 21 bp, Homo sapiens
gcaggacctagctgttgtaaa

SEQ ID NO: 791622 - DNA, 11 bp, Homo sapiens
gcaggacctca

SEQ ID NO: 791623 - DNA, 15 bp, Homo sapiens
gcaggacctcagagt

SEQ ID NO: 791624 - DNA, 22 bp, Homo sapiens
gcaggacctcagagtccaggcc

SEQ ID NO: 791625 - DNA, 16 bp, Homo sapiens
gcaggacctcccttcc

SEQ ID NO: 791626 - DNA, 18 bp, Homo sapiens
gcaggacctcccttccga

SEQ ID NO: 791627 - DNA, 21 bp, Homo sapiens
gcaggacctcccttccgaccc

SEQ ID NO: 791628 - DNA, 15 bp, Homo sapiens
gcaggacctgtgctt

SEQ ID NO: 791629 - DNA, 14 bp, Homo sapiens
gcaggactccaggc

SEQ ID NO: 791630 - DNA, 22 bp, Homo sapiens
gcaggagaagaacaagaaatgg

SEQ ID NO: 791631 - DNA, 22 bp, Homo sapiens
gcaggagaatcacttgcactcc

SEQ ID NO: 791632 - DNA, 22 bp, Homo sapiens
gcaggagagtgtgtgggcaggg

SEQ ID NO: 791633 - DNA, 13 bp, Homo sapiens
gcaggagcagtat

SEQ ID NO: 791634 - DNA, 16 bp, Homo sapiens
gcaggagccccgccac

SEQ ID NO: 791635 - DNA, 18 bp, Homo sapiens
gcaggagccccgccacag

SEQ ID NO: 791636 - DNA, 15 bp, Homo sapiens
gcaggagcccctggg

SEQ ID NO: 791637 - DNA, 16 bp, Homo sapiens
gcaggagcctccctgc

SEQ ID NO: 791638 - DNA, 24 bp, Homo sapiens
gcaggagcctccctgcacggccca

SEQ ID NO: 791639 - DNA, 21 bp, Homo sapiens
gcaggaggatcacttgaggcc

SEQ ID NO: 791640 - DNA, 15 bp, Homo sapiens
gcaggaggccaataa

SEQ ID NO: 791641 - DNA, 18 bp, Homo sapiens
gcaggaggcccctggccc

SEQ ID NO: 791642 - DNA, 11 bp, Homo sapiens
gcaggagggag

SEQ ID NO: 791643 - DNA, 23 bp, Homo sapiens
gcaggagggaggcggggaggagg

SEQ ID NO: 791644 - DNA, 18 bp, Homo sapiens
gcaggagggccctacctg

SEQ ID NO: 791645 - DNA, 22 bp, Homo sapiens
gcaggagggccctacctgattg

SEQ ID NO: 791646 - DNA, 15 bp, Homo sapiens
gcaggaggtggagaa

SEQ ID NO: 791647 - DNA, 22 bp, Homo sapiens
gcaggaggttctgggcctctga

SEQ ID NO: 791648 - DNA, 17 bp, Homo sapiens
gcaggagtctctgccac

SEQ ID NO: 791649 - DNA, 22 bp, Homo sapiens
gcaggagtctctgccacccact

SEQ ID NO: 791650 - DNA, 20 bp, Homo sapiens
catgactgtgaccaccttct

SEQ ID NO: 791651 - DNA, 11 bp, Homo sapiens
gcaggctgaca

SEQ ID NO: 791652 - DNA, 20 bp, Homo sapiens
gcaggctgagtccagagctt

SEQ ID NO: 791653 - DNA, 12 bp, Homo sapiens
gcaggctgattt

SEQ ID NO: 791654 - DNA, 17 bp, Homo sapiens
gcaggctgcagagcccg

SEQ ID NO: 791655 - DNA, 18 bp, Homo sapiens
gcaggctgcagagcccgg

SEQ ID NO: 791656 - DNA, 16 bp, Homo sapiens
gcaggctgcaggaggg

SEQ ID NO: 791657 - DNA, 20 bp, Homo sapiens
gcaggctggaggtaaggcct

SEQ ID NO: 791658 - DNA, 17 bp, Homo sapiens
gcaggctggcagctctc

SEQ ID NO: 791659 - DNA, 23 bp, Homo sapiens
gcaggctggcagctctccagtca

SEQ ID NO: 791660 - DNA, 12 bp, Homo sapiens
gcaggctggcca

SEQ ID NO: 791661 - DNA, 17 bp, Homo sapiens
gcaggctggcctatgtg

SEQ ID NO: 791662 - DNA, 14 bp, Homo sapiens
gcaggctggggagg

SEQ ID NO: 791663 - DNA, 19 bp, Homo sapiens
gcaggctggggaggtgctg

SEQ ID NO: 791664 - DNA, 13 bp, Homo sapiens
gcaggcttccccc

SEQ ID NO: 791665 - DNA, 15 bp, Homo sapiens
gcagggaaagctcca

SEQ ID NO: 791666 - DNA, 16 bp, Homo sapiens
gcagggaaagctccac

SEQ ID NO: 791667 - DNA, 16 bp, Homo sapiens
gcagggaaggcctgac

SEQ ID NO: 791668 - DNA, 20 bp, Homo sapiens
gcagggaaggggaggcagcc

SEQ ID NO: 791669 - DNA, 15 bp, Homo sapiens
gcagggaatgcagca

SEQ ID NO: 791670 - DNA, 16 bp, Homo sapiens
gcagggaatgcagcag

SEQ ID NO: 791671 - DNA, 18 bp, Homo sapiens
gcagggaatgcagcagga

SEQ ID NO: 791672 - DNA, 22 bp, Homo sapiens
gcagggaatgcagcaggaagga

SEQ ID NO: 791673 - DNA, 18 bp, Homo sapiens
gcagggaatgcctggagg

SEQ ID NO: 791674 - DNA, 15 bp, Homo sapiens
gcagggaattcctgg

SEQ ID NO: 791675 - DNA, 14 bp, Homo sapiens
gcagggacaaagag

SEQ ID NO: 791676 - DNA, 15 bp, Homo sapiens
gcagggacacccccc

SEQ ID NO: 791677 - DNA, 22 bp, Homo sapiens
gcagggacaccccccgcccccc

SEQ ID NO: 791678 - DNA, 20 bp, Homo sapiens
gcagggacatggggcaagcc

SEQ ID NO: 791679 - DNA, 21 bp, Homo sapiens
gcagggacatggggcaagcca

SEQ ID NO: 791680 - DNA, 20 bp, Homo sapiens
gcagggagagcgcctcttcc

SEQ ID NO: 791681 - DNA, 15 bp, Homo sapiens
gcagggagagttggg

SEQ ID NO: 791682 - DNA, 19 bp, Homo sapiens
gcagggagcaactctccac

SEQ ID NO: 791683 - DNA, 19 bp, Homo sapiens
gcagggagcggccggccag

SEQ ID NO: 791684 - DNA, 24 bp, Homo sapiens
gcagggaggcaacactgctgtcca

SEQ ID NO: 791685 - DNA, 14 bp, Homo sapiens
gcagggagggcagt

SEQ ID NO: 791686 - DNA, 18 bp, Homo sapiens
gcagggagggcagttttc

SEQ ID NO: 791687 - DNA, 17 bp, Homo sapiens
gcagggagggcttgggg

SEQ ID NO: 791688 - DNA, 13 bp, Homo sapiens
gcagggaggggct

SEQ ID NO: 791689 - DNA, 14 bp, Homo sapiens
gcagggaggggctg

SEQ ID NO: 791690 - DNA, 17 bp, Homo sapiens
gcagggaggggctgggg

SEQ ID NO: 791691 - DNA, 16 bp, Homo sapiens
gcagggatattgcctt

SEQ ID NO: 791692 - DNA, 23 bp, Homo sapiens
gcagggatgccctggaggtggct

SEQ ID NO: 791693 - DNA, 22 bp, Homo sapiens
gcagggattaacctctgcacta

SEQ ID NO: 791694 - DNA, 12 bp, Homo sapiens
gcagggcacaga

SEQ ID NO: 791695 - DNA, 16 bp, Homo sapiens
gcagggcacggggacc

SEQ ID NO: 791696 - DNA, 19 bp, Homo sapiens
gcagggcacggggacctgg

SEQ ID NO: 791697 - DNA, 23 bp, Homo sapiens
gcagggcacggggacctggatag

SEQ ID NO: 791698 - DNA, 14 bp, Homo sapiens
gcagggcagaggga

SEQ ID NO: 791699 - DNA, 21 bp, Homo sapiens
gcagggcatctcctgtgcatg

SEQ ID NO: 791700 - DNA, 20 bp, Homo sapiens
gcagggccacctgcaggacc

SEQ ID NO: 791701 - DNA, 12 bp, Homo sapiens
gcagggccaggg

SEQ ID NO: 791702 - DNA, 13 bp, Homo sapiens
gcagggccagggc

SEQ ID NO: 791703 - DNA, 14 bp, Homo sapiens
gcagggccagggca

SEQ ID NO: 791704 - DNA, 16 bp, Homo sapiens
gcagggccagggcaat

SEQ ID NO: 791705 - DNA, 17 bp, Homo sapiens
gcagggccagggcaatg

SEQ ID NO: 791706 - DNA, 20 bp, Homo sapiens
gcagggccagggcaatgcca

SEQ ID NO: 791707 - DNA, 15 bp, Homo sapiens
gcagggccatgcaga

SEQ ID NO: 791708 - DNA, 18 bp, Homo sapiens
gcagggccatgcagacct

SEQ ID NO: 791709 - DNA, 12 bp, Homo sapiens
gcagggcccacc

SEQ ID NO: 791710 - DNA, 23 bp, Homo sapiens
gcagggcccaccttggaccctgg

SEQ ID NO: 791711 - DNA, 23 bp, Homo sapiens
gcagggcccctgaccctcccggc

SEQ ID NO: 791712 - DNA, 18 bp, Homo sapiens
gcagggccttgcccagag

SEQ ID NO: 791713 - DNA, 19 bp, Homo sapiens
gcagggccttgcccagaga

SEQ ID NO: 791714 - DNA, 23 bp, Homo sapiens
gcagggcgaggaccaataatttt

SEQ ID NO: 791715 - DNA, 17 bp, Homo sapiens
gcagggcgcccctggga

SEQ ID NO: 791716 - DNA, 13 bp, Homo sapiens
gcagggcggctgc

SEQ ID NO: 791717 - DNA, 17 bp, Homo sapiens
gcagggcgggcagaggg

SEQ ID NO: 791718 - DNA, 22 bp, Homo sapiens
gcagggcgggcagagggctgga

SEQ ID NO: 791719 - DNA, 20 bp, Homo sapiens
gcagggctaccctgagctga

SEQ ID NO: 791720 - DNA, 23 bp, Homo sapiens
gcagggctaccctgagctgaggc

SEQ ID NO: 791721 - DNA, 16 bp, Homo sapiens
gcagggctctcccgtg

SEQ ID NO: 791722 - DNA, 21 bp, Homo sapiens
gcagggctgactccctctcag

SEQ ID NO: 791723 - DNA, 19 bp, Homo sapiens
gcagggctgcagagggaga

SEQ ID NO: 791724 - DNA, 20 bp, Homo sapiens
gcagggctgcagagggagac

SEQ ID NO: 791725 - DNA, 23 bp, Homo sapiens
gcagggctggaatgggagacctg

SEQ ID NO: 791726 - DNA, 12 bp, Homo sapiens
gcagggctgggc

SEQ ID NO: 791727 - DNA, 16 bp, Homo sapiens
gcagggctgggcctgc

SEQ ID NO: 791728 - DNA, 13 bp, Homo sapiens
gcagggctgtgct

SEQ ID NO: 791729 - DNA, 22 bp, Homo sapiens
gcaggggacaagggaggcagtg

SEQ ID NO: 791730 - DNA, 13 bp, Homo sapiens
gcaggggagaagc

SEQ ID NO: 791731 - DNA, 15 bp, Homo sapiens
gcaggggcaccttcc

SEQ ID NO: 791732 - DNA, 15 bp, Homo sapiens
gcaggggcaggcgca

SEQ ID NO: 791733 - DNA, 20 bp, Homo sapiens
gcaggggccactccaaactc

SEQ ID NO: 791734 - DNA, 12 bp, Homo sapiens
gcaggggcccac

SEQ ID NO: 791735 - DNA, 21 bp, Homo sapiens
gcaggggcccacttggggcct

SEQ ID NO: 791736 - DNA, 10 bp, Homo sapiens
gcaggggcta

SEQ ID NO: 791737 - DNA, 17 bp, Homo sapiens
gcaggggctctgagccc

SEQ ID NO: 791738 - DNA, 17 bp, Homo sapiens
gcagggggaggaggact

SEQ ID NO: 791739 - DNA, 19 bp, Homo sapiens
gcagggggaggaggacttg

SEQ ID NO: 791740 - DNA, 15 bp, Homo sapiens
gcagggggccccgcc

SEQ ID NO: 791741 - DNA, 12 bp, Homo sapiens
gcaggggtcccc

SEQ ID NO: 791742 - DNA, 13 bp, Homo sapiens
gcaggggtccctg

SEQ ID NO: 791743 - DNA, 16 bp, Homo sapiens
gcaggggtccctgcta

SEQ ID NO: 791744 - DNA, 14 bp, Homo sapiens
gcaggggtgagagc

SEQ ID NO: 791745 - DNA, 15 bp, Homo sapiens
gcaggggtgggagag

SEQ ID NO: 791746 - DNA, 18 bp, Homo sapiens
gcaggggtgggagagcca

SEQ ID NO: 791747 - DNA, 19 bp, Homo sapiens
gcaggggtgggagagccag

SEQ ID NO: 791748 - DNA, 20 bp, Homo sapiens
gcaggggtgggggtggaggc

SEQ ID NO: 791749 - DNA, 21 bp, Homo sapiens
gcaggggtgggggtggaggct

SEQ ID NO: 791750 - DNA, 23 bp, Homo sapiens
gcaggggtttgggtgggggctgt

SEQ ID NO: 791751 - DNA, 13 bp, Homo sapiens
gcagggtaccctt

SEQ ID NO: 791752 - DNA, 17 bp, Homo sapiens
gcagggtcaggagaggg

SEQ ID NO: 791753 - DNA, 19 bp, Homo sapiens
gcagggtcctagaaattcc

SEQ ID NO: 791754 - DNA, 21 bp, Homo sapiens
gcagggtcctcttctgggcct

SEQ ID NO: 791755 - DNA, 14 bp, Homo sapiens
gcagggtctgggct

SEQ ID NO: 791756 - DNA, 15 bp, Homo sapiens
gcagggtctgggctg

SEQ ID NO: 791757 - DNA, 19 bp, Homo sapiens
gcagggtctgggctgggca

SEQ ID NO: 791758 - DNA, 19 bp, Homo sapiens
gcagggtctgtttggactg

SEQ ID NO: 791759 - DNA, 15 bp, Homo sapiens
gcagggtcttttcat

SEQ ID NO: 791760 - DNA, 14 bp, Homo sapiens
gcagggtgacgcct

SEQ ID NO: 791761 - DNA, 15 bp, Homo sapiens
gcagggtgacgcctg

SEQ ID NO: 791762 - DNA, 18 bp, Homo sapiens
gcagggtgacgcctgaga

SEQ ID NO: 791763 - DNA, 13 bp, Homo sapiens
gcagggtgcagga

SEQ ID NO: 791764 - DNA, 14 bp, Homo sapiens
gcagggtgcaggag

SEQ ID NO: 791765 - DNA, 15 bp, Homo sapiens
gcagggtgggatgga

SEQ ID NO: 791766 - DNA, 18 bp, Homo sapiens
gcagggtgggcagcctat

SEQ ID NO: 791767 - DNA, 20 bp, Homo sapiens
gcagggtggggtctgggagg

SEQ ID NO: 791768 - DNA, 22 bp, Homo sapiens
gcagggtggggtctgggagggg

SEQ ID NO: 791769 - DNA, 18 bp, Homo sapiens
gcagggtggtgctgggac

SEQ ID NO: 791770 - DNA, 20 bp, Homo sapiens
gcagggtggtggtattctgt

SEQ ID NO: 791771 - DNA, 22 bp, Homo sapiens
gcaggtacttcctcctgatggc

SEQ ID NO: 791772 - DNA, 20 bp, Homo sapiens
gcaggtagatcgcttgagcc

SEQ ID NO: 791773 - DNA, 21 bp, Homo sapiens
gcaggtcaacagctatgctgg

SEQ ID NO: 791774 - DNA, 15 bp, Homo sapiens
gcaggtcctgcccat

SEQ ID NO: 791775 - DNA, 21 bp, Homo sapiens
gcaggtgattggaccaggcca

SEQ ID NO: 791776 - DNA, 14 bp, Homo sapiens
gcaggtgcctccag

SEQ ID NO: 791777 - DNA, 13 bp, Homo sapiens
gcaggtggatcta

SEQ ID NO: 791778 - DNA, 17 bp, Homo sapiens
gcaggtggcatctctaa

SEQ ID NO: 791779 - DNA, 18 bp, Homo sapiens
gcaggtggccgcccctga

SEQ ID NO: 791780 - DNA, 21 bp, Homo sapiens
gcaggtggccgcccctgaggc

SEQ ID NO: 791781 - DNA, 17 bp, Homo sapiens
gcaggtgggctgcctgc

SEQ ID NO: 791782 - DNA, 22 bp, Homo sapiens
gcaggtgggctgcctgctgtgt

SEQ ID NO: 791783 - DNA, 16 bp, Homo sapiens
gcaggtgggctgggcc

SEQ ID NO: 791784 - DNA, 22 bp, Homo sapiens
gcaggtgggctgggcccaccca

SEQ ID NO: 791785 - DNA, 21 bp, Homo sapiens
gcaggtggtcctgagacctga

SEQ ID NO: 791786 - DNA, 17 bp, Homo sapiens
gcaggtggtggaggggc

SEQ ID NO: 791787 - DNA, 20 bp, Homo sapiens
gcaggtggtggcactgagcc

SEQ ID NO: 791788 - DNA, 22 bp, Homo sapiens
gcaggtggtggcactgagcccc

SEQ ID NO: 791789 - DNA, 20 bp, Homo sapiens
gcaggtggtgtcgggccctt

SEQ ID NO: 791790 - DNA, 14 bp, Homo sapiens
gcaggttcatggat

SEQ ID NO: 791791 - DNA, 13 bp, Homo sapiens
gcaggttcccaag

SEQ ID NO: 791792 - DNA, 18 bp, Homo sapiens
gcaggttcccaagctcag

SEQ ID NO: 791793 - DNA, 13 bp, Homo sapiens
gcaggttcctggg

SEQ ID NO: 791794 - DNA, 20 bp, Homo sapiens
gcaggttcttcttcctgaag

SEQ ID NO: 791795 - DNA, 15 bp, Homo sapiens
gcaggttcttgatgt

SEQ ID NO: 791796 - DNA, 22 bp, Homo sapiens
gcaggttcttgttggtgcacag

SEQ ID NO: 791797 - DNA, 23 bp, Homo sapiens
gcaggttcttgttggtgcacagc

SEQ ID NO: 791798 - DNA, 14 bp, Homo sapiens
gcaggttgaagcca

SEQ ID NO: 791799 - DNA, 17 bp, Homo sapiens
gcaggttgaagccatgt

SEQ ID NO: 791800 - DNA, 16 bp, Homo sapiens
gcagtaaaacacattt

SEQ ID NO: 791801 - DNA, 23 bp, Homo sapiens
gcagtacctataaagtaaagcta

SEQ ID NO: 791802 - DNA, 14 bp, Homo sapiens
gcagtacctgggaa

SEQ ID NO: 791803 - DNA, 22 bp, Homo sapiens
gcagtacctgggaaaggaccca

SEQ ID NO: 791804 - DNA, 20 bp, Homo sapiens
gcagtaggggaacctaggag

SEQ ID NO: 791805 - DNA, 13 bp, Homo sapiens
gcagtaggggagg

SEQ ID NO: 791806 - DNA, 16 bp, Homo sapiens
gcagtatataataact

SEQ ID NO: 791807 - DNA, 19 bp, Homo sapiens
gcagtatataataacttta

SEQ ID NO: 791808 - DNA, 21 bp, Homo sapiens
gcagtatataataactttatt

SEQ ID NO: 791809 - DNA, 23 bp, Homo sapiens
gcagtatataataactttattgc

SEQ ID NO: 791810 - DNA, 21 bp, Homo sapiens
gcagtatcatgccctgtgcaa

SEQ ID NO: 791811 - DNA, 20 bp, Homo sapiens
gcagtatgatggcaggagaa

SEQ ID NO: 791812 - DNA, 15 bp, Homo sapiens
gcagtatgtgatgga

SEQ ID NO: 791813 - DNA, 16 bp, Homo sapiens
gcagtatgtgatggac

SEQ ID NO: 791814 - DNA, 17 bp, Homo sapiens
gcagtattttgtgtcct

SEQ ID NO: 791815 - DNA, 23 bp, Homo sapiens
gcagtattttgtgtcctccagga

SEQ ID NO: 791816 - DNA, 17 bp, Homo sapiens
gcagtcacatctcttcc

SEQ ID NO: 791817 - DNA, 15 bp, Homo sapiens
gcagtcaccacccag

SEQ ID NO: 791818 - DNA, 19 bp, Homo sapiens
gcagtcaccacccagccct

SEQ ID NO: 791819 - DNA, 23 bp, Homo sapiens
gcagtcaccacccagcccttcct

SEQ ID NO: 791820 - DNA, 13 bp, Homo sapiens
gcagtcagagtcc

SEQ ID NO: 791821 - DNA, 15 bp, Homo sapiens
gcagtcagagtccag

SEQ ID NO: 791822 - DNA, 23 bp, Homo sapiens
gcagtcagcagatgctgttgtga

SEQ ID NO: 791823 - DNA, 15 bp, Homo sapiens
gcagtcagtggaggg

SEQ ID NO: 791824 - DNA, 15 bp, Homo sapiens
gcagtcagtgtttct

SEQ ID NO: 791825 - DNA, 19 bp, Homo sapiens
gcagtcattatccaggtaa

SEQ ID NO: 791826 - DNA, 12 bp, Homo sapiens
gcagtccagagc

SEQ ID NO: 791827 - DNA, 13 bp, Homo sapiens
gcagtccagagct

SEQ ID NO: 791828 - DNA, 15 bp, Homo sapiens
gcagtccagagcttt

SEQ ID NO: 791829 - DNA, 18 bp, Homo sapiens
gcagtccaggcctctctc

SEQ ID NO: 791830 - DNA, 21 bp, Homo sapiens
gcagtccaggcctctctctgc

SEQ ID NO: 791831 - DNA, 22 bp, Homo sapiens
gcagtccaggcctctctctgct

SEQ ID NO: 791832 - DNA, 15 bp, Homo sapiens
gcagtcccacactgt

SEQ ID NO: 791833 - DNA, 20 bp, Homo sapiens
gcagtcccacactgtgcaga

SEQ ID NO: 791834 - DNA, 22 bp, Homo sapiens
gcagtcccagtattctcagagc

SEQ ID NO: 791835 - DNA, 14 bp, Homo sapiens
gcagtccccagccc

SEQ ID NO: 791836 - DNA, 16 bp, Homo sapiens
gcagtccccagccctt

SEQ ID NO: 791837 - DNA, 19 bp, Homo sapiens
gcagtccccagcccttctg

SEQ ID NO: 791838 - DNA, 23 bp, Homo sapiens
gcagtccccagcccttctgcctt

SEQ ID NO: 791839 - DNA, 13 bp, Homo sapiens
gcagtcccgggag

SEQ ID NO: 791840 - DNA, 18 bp, Homo sapiens
gcagtcctgcctcagcct

SEQ ID NO: 791841 - DNA, 14 bp, Homo sapiens
gcagtcctgttcaa

SEQ ID NO: 791842 - DNA, 15 bp, Homo sapiens
gcagtcggcatgcca

SEQ ID NO: 791843 - DNA, 16 bp, Homo sapiens
gcagtcggcatgccag

SEQ ID NO: 791844 - DNA, 18 bp, Homo sapiens
gcagtcggcatgccagga

SEQ ID NO: 791845 - DNA, 16 bp, Homo sapiens
gcagtcgggggctggc

SEQ ID NO: 791846 - DNA, 21 bp, Homo sapiens
gcagtcgggggctggcctagg

SEQ ID NO: 791847 - DNA, 19 bp, Homo sapiens
gcagtcgtgcctgtgtcca

SEQ ID NO: 791848 - DNA, 19 bp, Homo sapiens
gcagtctaccctgtccttt

SEQ ID NO: 791849 - DNA, 14 bp, Homo sapiens
gcagtctctatatt

SEQ ID NO: 791850 - DNA, 20 bp, Homo sapiens
gcagtctctatattatgtct

SEQ ID NO: 791851 - DNA, 19 bp, Homo sapiens
gcagtctgaacccttgtgc

SEQ ID NO: 791852 - DNA, 21 bp, Homo sapiens
gcagtctgcccacgcagagga

SEQ ID NO: 791853 - DNA, 22 bp, Homo sapiens
gcagtctgcccacgcagaggac

SEQ ID NO: 791854 - DNA, 12 bp, Homo sapiens
gcagtctgctct

SEQ ID NO: 791855 - DNA, 13 bp, Homo sapiens
gcagtctgctctg

SEQ ID NO: 791856 - DNA, 16 bp, Homo sapiens
gcagtgaaaaatatgt

SEQ ID NO: 791857 - DNA, 20 bp, Homo sapiens
gcagtgactcgacaaaggcc

SEQ ID NO: 791858 - DNA, 15 bp, Homo sapiens
gcagtgactggcagg

SEQ ID NO: 791859 - DNA, 16 bp, Homo sapiens
gcagtgactggcaggt

SEQ ID NO: 791860 - DNA, 20 bp, Homo sapiens
gcagtgagaaaaagctcctg

SEQ ID NO: 791861 - DNA, 21 bp, Homo sapiens
gcagtgagaaaaagctcctgt

SEQ ID NO: 791862 - DNA, 13 bp, Homo sapiens
gcagtgagactgg

SEQ ID NO: 791863 - DNA, 16 bp, Homo sapiens
gcagtgagcagggtgg

SEQ ID NO: 791864 - DNA, 17 bp, Homo sapiens
gcagtgagcagggtggg

SEQ ID NO: 791865 - DNA, 20 bp, Homo sapiens
gcagtgagccgagattgcac

SEQ ID NO: 791866 - DNA, 14 bp, Homo sapiens
gcagtgagctgtgt

SEQ ID NO: 791867 - DNA, 14 bp, Homo sapiens
gcagtgagtgccat

SEQ ID NO: 791868 - DNA, 15 bp, Homo sapiens
gcagtgatacatgta

SEQ ID NO: 791869 - DNA, 18 bp, Homo sapiens
gcagtgatgacttgctgt

SEQ ID NO: 791870 - DNA, 13 bp, Homo sapiens
gcagtgcatgcat

SEQ ID NO: 791871 - DNA, 13 bp, Homo sapiens
gcagtgcatgtga

SEQ ID NO: 791872 - DNA, 14 bp, Homo sapiens
gcagtgccacagcc

SEQ ID NO: 791873 - DNA, 21 bp, Homo sapiens
gcagtgccacagcctgctggc

SEQ ID NO: 791874 - DNA, 13 bp, Homo sapiens
gcagtgccccagg

SEQ ID NO: 791875 - DNA, 14 bp, Homo sapiens
gcagtgccccaggg

SEQ ID NO: 791876 - DNA, 13 bp, Homo sapiens
gcagtgcccggct

SEQ ID NO: 791877 - DNA, 22 bp, Homo sapiens
gcagtgccttccataattatga

SEQ ID NO: 791878 - DNA, 13 bp, Homo sapiens
gcagtgccttgca

SEQ ID NO: 791879 - DNA, 23 bp, Homo sapiens
gcagtgccttggggaatttcctc

SEQ ID NO: 791880 - DNA, 16 bp, Homo sapiens
gcagtgcttctctaca

SEQ ID NO: 791881 - DNA, 14 bp, Homo sapiens
gcagtggactcaga

SEQ ID NO: 791882 - DNA, 15 bp, Homo sapiens
gcagtggagagggac

SEQ ID NO: 791883 - DNA, 22 bp, Homo sapiens
gcagtggccacgttcagggagg

SEQ ID NO: 791884 - DNA, 23 bp, Homo sapiens
gcagtggccacgttcagggaggg

SEQ ID NO: 791885 - DNA, 19 bp, Homo sapiens
gcatcgtagaagagatgtg

SEQ ID NO: 791886 - DNA, 14 bp, Homo sapiens
gcatctaatgaaaa

SEQ ID NO: 791887 - DNA, 21 bp, Homo sapiens
gcatctactctaaagaaaaat

SEQ ID NO: 791888 - DNA, 20 bp, Homo sapiens
gcatctatcgagtttgcaat

SEQ ID NO: 791889 - DNA, 20 bp, Homo sapiens
gcatctatctggtgatttct

SEQ ID NO: 791890 - DNA, 19 bp, Homo sapiens
gcatctcaaaacagagggc

SEQ ID NO: 791891 - DNA, 14 bp, Homo sapiens
gcatctcagcccac

SEQ ID NO: 791892 - DNA, 13 bp, Homo sapiens
gcatctcccagat

SEQ ID NO: 791893 - DNA, 21 bp, Homo sapiens
gcatctcccagataatgtgaa

SEQ ID NO: 791894 - DNA, 16 bp, Homo sapiens
gcatctcctgtgcatg

SEQ ID NO: 791895 - DNA, 22 bp, Homo sapiens
gcatctctgtcccattccctgg

SEQ ID NO: 791896 - DNA, 17 bp, Homo sapiens
gcatctcttccccagag

SEQ ID NO: 791897 - DNA, 19 bp, Homo sapiens
gcatctcttccccagagag

SEQ ID NO: 791898 - DNA, 23 bp, Homo sapiens
gcatctcttccccagagaggcac

SEQ ID NO: 791899 - DNA, 21 bp, Homo sapiens
gcatctcttgaggccaggagt

SEQ ID NO: 791900 - DNA, 17 bp, Homo sapiens
gcatctgacacaaaaaa

SEQ ID NO: 791901 - DNA, 11 bp, Homo sapiens
gcatctgaccc

SEQ ID NO: 791902 - DNA, 19 bp, Homo sapiens
gcatctgactcacaagaag

SEQ ID NO: 791903 - DNA, 15 bp, Homo sapiens
gcatctgagggggag

SEQ ID NO: 791904 - DNA, 19 bp, Homo sapiens
gcatctgagtccagctccc

SEQ ID NO: 791905 - DNA, 14 bp, Homo sapiens
gcatctgcaggcac

SEQ ID NO: 791906 - DNA, 15 bp, Homo sapiens
gcatctgcccctccc

SEQ ID NO: 791907 - DNA, 18 bp, Homo sapiens
gcatctgctaataaaacc

SEQ ID NO: 791908 - DNA, 16 bp, Homo sapiens
gcatctggattgaaag

SEQ ID NO: 791909 - DNA, 13 bp, Homo sapiens
gcatctggctgtc

SEQ ID NO: 791910 - DNA, 16 bp, Homo sapiens
gcatctgggattccca

SEQ ID NO: 791911 - DNA, 23 bp, Homo sapiens
gcatctgggattcccaccaaggt

SEQ ID NO: 791912 - DNA, 17 bp, Homo sapiens
gcatctgggtagctgta

SEQ ID NO: 791913 - DNA, 11 bp, Homo sapiens
gcatctgtata

SEQ ID NO: 791914 - DNA, 13 bp, Homo sapiens
gcatctgtataag

SEQ ID NO: 791915 - DNA, 15 bp, Homo sapiens
gcatcttactgaagg

SEQ ID NO: 791916 - DNA, 16 bp, Homo sapiens
gcatcttactgaaggt

SEQ ID NO: 791917 - DNA, 23 bp, Homo sapiens
gcatcttactgaaggtaaaattg

SEQ ID NO: 791918 - DNA, 13 bp, Homo sapiens
gcatcttcctctg

SEQ ID NO: 791919 - DNA, 23 bp, Homo sapiens
gcatcttctggagtctccagtgg

SEQ ID NO: 791920 - DNA, 15 bp, Homo sapiens
gcatcttgccagcct

SEQ ID NO: 791921 - DNA, 13 bp, Homo sapiens
gcatctttgcctt

SEQ ID NO: 791922 - DNA, 15 bp, Homo sapiens
gcatctttgccttgg

SEQ ID NO: 791923 - DNA, 18 bp, Homo sapiens
gcatctttgccttgggct

SEQ ID NO: 791924 - DNA, 21 bp, Homo sapiens
gcatcttttctagagacacat

SEQ ID NO: 791925 - DNA, 12 bp, Homo sapiens
gcatcttttgta

SEQ ID NO: 791926 - DNA, 16 bp, Homo sapiens
gcatcttttgtattaa

SEQ ID NO: 791927 - DNA, 15 bp, Homo sapiens
gcatgaaataaaata

SEQ ID NO: 791928 - DNA, 23 bp, Homo sapiens
gcatgaaccctcttgccatcctg

SEQ ID NO: 791929 - DNA, 14 bp, Homo sapiens
gcatgaataaaaca

SEQ ID NO: 791930 - DNA, 18 bp, Homo sapiens
gcatgaataaaacactca

SEQ ID NO: 791931 - DNA, 21 bp, Homo sapiens
gcatgaataaaacactcatcc

SEQ ID NO: 791932 - DNA, 22 bp, Homo sapiens
gcatgaataaaacactcatccc

SEQ ID NO: 791933 - DNA, 15 bp, Homo sapiens
gcatgacaagcccca

SEQ ID NO: 791934 - DNA, 16 bp, Homo sapiens
gcatgacaagccccag

SEQ ID NO: 791935 - DNA, 16 bp, Homo sapiens
gcatgacagcctgcag

SEQ ID NO: 791936 - DNA, 17 bp, Homo sapiens
gcatgacctcagtcagg

SEQ ID NO: 791937 - DNA, 18 bp, Homo sapiens
gcatgacctcagtcaggc

SEQ ID NO: 791938 - DNA, 15 bp, Homo sapiens
gcatgacgtttaagg

SEQ ID NO: 791939 - DNA, 22 bp, Homo sapiens
gcatggggtcagccccaagggc

SEQ ID NO: 791940 - DNA, 16 bp, Homo sapiens
gcatgggtccaagaga

SEQ ID NO: 791941 - DNA, 15 bp, Homo sapiens
gcatgggtccagggc

SEQ ID NO: 791942 - DNA, 16 bp, Homo sapiens
gcatgggtccagggcc

SEQ ID NO: 791943 - DNA, 22 bp, Homo sapiens
gcatgggtccttgatgccagag

SEQ ID NO: 791944 - DNA, 23 bp, Homo sapiens
gcatgggtccttgatgccagagg

SEQ ID NO: 791945 - DNA, 19 bp, Homo sapiens
gcatggtataattgaaact

SEQ ID NO: 791946 - DNA, 18 bp, Homo sapiens
gcatggtccctgccttag

SEQ ID NO: 791947 - DNA, 16 bp, Homo sapiens
gcatggtgcagggaga

SEQ ID NO: 791948 - DNA, 18 bp, Homo sapiens
gcatggtggctcatgcct

SEQ ID NO: 791949 - DNA, 21 bp, Homo sapiens
gcatggtgtttatgcacacag

SEQ ID NO: 791950 - DNA, 17 bp, Homo sapiens
gcatggttccttccctg

SEQ ID NO: 791951 - DNA, 19 bp, Homo sapiens
gcatggttccttccctggg

SEQ ID NO: 791952 - DNA, 21 bp, Homo sapiens
gcatggttccttccctgggaa

SEQ ID NO: 791953 - DNA, 22 bp, Homo sapiens
gcatggttccttccctgggaag

SEQ ID NO: 791954 - DNA, 17 bp, Homo sapiens
gcatgtaaaagcggaaa

SEQ ID NO: 791955 - DNA, 21 bp, Homo sapiens
gcatgtacggattttcagtta

SEQ ID NO: 791956 - DNA, 13 bp, Homo sapiens
gcatgtacttgaa

SEQ ID NO: 791957 - DNA, 16 bp, Homo sapiens
gcatgtacttgaagga

SEQ ID NO: 791958 - DNA, 22 bp, Homo sapiens
gcatgtagccagttaaggaaag

SEQ ID NO: 791959 - DNA, 23 bp, Homo sapiens
gcatgtagccagttaaggaaaga

SEQ ID NO: 791960 - DNA, 14 bp, Homo sapiens
gcatgtaggagaat

SEQ ID NO: 791961 - DNA, 16 bp, Homo sapiens
gcatgtagtaacacta

SEQ ID NO: 791962 - DNA, 17 bp, Homo sapiens
gcatgtagtaacactaa

SEQ ID NO: 791963 - DNA, 23 bp, Homo sapiens
gcatgtagtaacactaatatatt

SEQ ID NO: 791964 - DNA, 14 bp, Homo sapiens
gcatgtatgaatgt

SEQ ID NO: 791965 - DNA, 17 bp, Homo sapiens
gcatgtattggcctgga

SEQ ID NO: 791966 - DNA, 21 bp, Homo sapiens
gcatgtcagacagaacttgaa

SEQ ID NO: 791967 - DNA, 15 bp, Homo sapiens
gcatgtcagaggacc

SEQ ID NO: 791968 - DNA, 20 bp, Homo sapiens
gcatgtcagaggaccccagg

SEQ ID NO: 791969 - DNA, 23 bp, Homo sapiens
gcatgtcagaggaccccagggtg

SEQ ID NO: 791970 - DNA, 15 bp, Homo sapiens
gcatgtcccacccac

SEQ ID NO: 791971 - DNA, 19 bp, Homo sapiens
gcatgtcccacccacccgc

SEQ ID NO: 791972 - DNA, 13 bp, Homo sapiens
gcatgtcctttcc

SEQ ID NO: 791973 - DNA, 19 bp, Homo sapiens
gcatgtcctttccatctgt

SEQ ID NO: 791974 - DNA, 14 bp, Homo sapiens
gcatgtcgcacaat

SEQ ID NO: 791975 - DNA, 14 bp, Homo sapiens
gcatgtctgcacct

SEQ ID NO: 791976 - DNA, 14 bp, Homo sapiens
gcatgtgagcacat

SEQ ID NO: 791977 - DNA, 20 bp, Homo sapiens
gcatgtgatcacgcctggct

SEQ ID NO: 791978 - DNA, 23 bp, Homo sapiens
gcatgtgccaagattctactctt

SEQ ID NO: 791979 - DNA, 15 bp, Homo sapiens
gcatgtgctgtctcc

SEQ ID NO: 791980 - DNA, 16 bp, Homo sapiens
gcatgtggcctttatc

SEQ ID NO: 791981 - DNA, 13 bp, Homo sapiens
gcatgtggcttct

SEQ ID NO: 791982 - DNA, 16 bp, Homo sapiens
gcatgtggcttctctg

SEQ ID NO: 791983 - DNA, 14 bp, Homo sapiens
gcatgtgtgtgctc

SEQ ID NO: 791984 - DNA, 18 bp, Homo sapiens
gcatgtgtgtgtctgtct

SEQ ID NO: 791985 - DNA, 22 bp, Homo sapiens
gcatgtgtttggttctggggcc

SEQ ID NO: 791986 - DNA, 13 bp, Homo sapiens
gcatgttacataa

SEQ ID NO: 791987 - DNA, 16 bp, Homo sapiens
gcattgtaaaataatt

SEQ ID NO: 791988 - DNA, 11 bp, Homo sapiens
gcattgttcca

SEQ ID NO: 791989 - DNA, 21 bp, Homo sapiens
gcattgttccacacatttaaa

SEQ ID NO: 791990 - DNA, 15 bp, Homo sapiens
gcattgttgaggtgg

SEQ ID NO: 791991 - DNA, 16 bp, Homo sapiens
gcattgttgaggtggt

SEQ ID NO: 791992 - DNA, 23 bp, Homo sapiens
gcattgtttgcttattgttccaa

SEQ ID NO: 791993 - DNA, 12 bp, Homo sapiens
gcatttaaaaga

SEQ ID NO: 791994 - DNA, 17 bp, Homo sapiens
gcatttaaaagatacag

SEQ ID NO: 791995 - DNA, 22 bp, Homo sapiens
gcatttaaactctgccagaaaa

SEQ ID NO: 791996 - DNA, 16 bp, Homo sapiens
gcatttaaagtattct

SEQ ID NO: 791997 - DNA, 18 bp, Homo sapiens
gcatttaacttacatttg

SEQ ID NO: 791998 - DNA, 14 bp, Homo sapiens
gcatttaagaattg

SEQ ID NO: 791999 - DNA, 23 bp, Homo sapiens
gcatttaagaattgccagtcttt

SEQ ID NO: 792000 - DNA, 12 bp, Homo sapiens
gcatttaataaa

SEQ ID NO: 792001 - DNA, 17 bp, Homo sapiens
gcatttaatggcagcta

SEQ ID NO: 792002 - DNA, 21 bp, Homo sapiens
gcatttagttttatggcatga

SEQ ID NO: 792003 - DNA, 15 bp, Homo sapiens
gcatttattttataa

SEQ ID NO: 792004 - DNA, 18 bp, Homo sapiens
gcatttcaaagccctgcc

SEQ ID NO: 792005 - DNA, 20 bp, Homo sapiens
gcatttcaaagccctgcctc

SEQ ID NO: 792006 - DNA, 22 bp, Homo sapiens
gcatttcaaagccctgcctctg

SEQ ID NO: 792007 - DNA, 22 bp, Homo sapiens
gcatttcaagcagctgaagaaa

SEQ ID NO: 792008 - DNA, 18 bp, Homo sapiens
gcatttcaaggaatggaa

SEQ ID NO: 792009 - DNA, 21 bp, Homo sapiens
gcatttcacgaactgttcaca

SEQ ID NO: 792010 - DNA, 19 bp, Homo sapiens
gcatttcattatgctttga

SEQ ID NO: 792011 - DNA, 14 bp, Homo sapiens
gcatttcattcaaa

SEQ ID NO: 792012 - DNA, 19 bp, Homo sapiens
gcatttccagaaatctgcc

SEQ ID NO: 792013 - DNA, 19 bp, Homo sapiens
gcatttccagagcagagcc

SEQ ID NO: 792014 - DNA, 21 bp, Homo sapiens
gcatttcctatcacctatttc

SEQ ID NO: 792015 - DNA, 21 bp, Homo sapiens
gcatttcctgtgtttgtcctg

SEQ ID NO: 792016 - DNA, 21 bp, Homo sapiens
gcatttctatgcaggcagcac

SEQ ID NO: 792017 - DNA, 23 bp, Homo sapiens
gcatttctcttctcagctcttcc

SEQ ID NO: 792018 - DNA, 20 bp, Homo sapiens
gcatttcttgatgttgctta

SEQ ID NO: 792019 - DNA, 14 bp, Homo sapiens
gcatttgaaaattt

SEQ ID NO: 792020 - DNA, 13 bp, Homo sapiens
gcatttgaggggc

SEQ ID NO: 792021 - DNA, 21 bp, Homo sapiens
gcatttgaggtctgttctttc

SEQ ID NO: 792022 - DNA, 23 bp, Homo sapiens
gcatttgctgaatacagaggcaa

SEQ ID NO: 792023 - DNA, 16 bp, Homo sapiens
gcatttgctgatttct

SEQ ID NO: 792024 - DNA, 18 bp, Homo sapiens
gcatttgctgatttctag

SEQ ID NO: 792025 - DNA, 20 bp, Homo sapiens
gcatttgctgatttctagtg

SEQ ID NO: 792026 - DNA, 20 bp, Homo sapiens
gcatttggtaggtagtgatt

SEQ ID NO: 792027 - DNA, 19 bp, Homo sapiens
gcatttggtctcaggcagc

SEQ ID NO: 792028 - DNA, 15 bp, Homo sapiens
gcatttggtgagagt

SEQ ID NO: 792029 - DNA, 20 bp, Homo sapiens
gccaccttcccaccccttca

SEQ ID NO: 792030 - DNA, 18 bp, Homo sapiens
gccaccttgcttgaggga

SEQ ID NO: 792031 - DNA, 16 bp, Homo sapiens
gccacctttcaccctc

SEQ ID NO: 792032 - DNA, 23 bp, Homo sapiens
gccacctttcaccctcatgaaaa

SEQ ID NO: 792033 - DNA, 17 bp, Homo sapiens
gccacctttgtgcagct

SEQ ID NO: 792034 - DNA, 19 bp, Homo sapiens
gccacgaacagcccgccag

SEQ ID NO: 792035 - DNA, 14 bp, Homo sapiens
gccacgactgccat

SEQ ID NO: 792036 - DNA, 15 bp, Homo sapiens
gccacgaggttaaag

SEQ ID NO: 792037 - DNA, 22 bp, Homo sapiens
gccacgaggttaaagaagctgc

SEQ ID NO: 792038 - DNA, 14 bp, Homo sapiens
gccacgattggaga

SEQ ID NO: 792039 - DNA, 16 bp, Homo sapiens
gccacgattggagaat

SEQ ID NO: 792040 - DNA, 20 bp, Homo sapiens
gccacgattggagaatactt

SEQ ID NO: 792041 - DNA, 22 bp, Homo sapiens
gccacgcacttcctctctcgga

SEQ ID NO: 792042 - DNA, 23 bp, Homo sapiens
gccacgcaggccacccgggctgc

SEQ ID NO: 792043 - DNA, 23 bp, Homo sapiens
gccacgcaggggccctgagccaa

SEQ ID NO: 792044 - DNA, 19 bp, Homo sapiens
gccacgcagtgcctggagt

SEQ ID NO: 792045 - DNA, 16 bp, Homo sapiens
gccacgccccagcccg

SEQ ID NO: 792046 - DNA, 15 bp, Homo sapiens
gccacgctcagtgcc

SEQ ID NO: 792047 - DNA, 15 bp, Homo sapiens
gccacgctccagctg

SEQ ID NO: 792048 - DNA, 21 bp, Homo sapiens
gccacggagggaggcaccatg

SEQ ID NO: 792049 - DNA, 16 bp, Homo sapiens
gccacgggtttccctc

SEQ ID NO: 792050 - DNA, 17 bp, Homo sapiens
gtcagccgggccctgag

SEQ ID NO: 792051 - DNA, 14 bp, Homo sapiens
gtcagcgagaagga

SEQ ID NO: 792052 - DNA, 21 bp, Homo sapiens
gtcagcgcaggtttagtttac

SEQ ID NO: 792053 - DNA, 20 bp, Homo sapiens
gtcagcgggcgctgctggga

SEQ ID NO: 792054 - DNA, 19 bp, Homo sapiens
gtcagctactaatgatgtt

SEQ ID NO: 792055 - DNA, 19 bp, Homo sapiens
gtcagctcaggcagctcga

SEQ ID NO: 792056 - DNA, 12 bp, Homo sapiens
gtcagctccagc

SEQ ID NO: 792057 - DNA, 13 bp, Homo sapiens
gtcagctccagct

SEQ ID NO: 792058 - DNA, 13 bp, Homo sapiens
gtcagctctctgc

SEQ ID NO: 792059 - DNA, 14 bp, Homo sapiens
gtcagctctctgcc

SEQ ID NO: 792060 - DNA, 16 bp, Homo sapiens
gtcagctctctgccct

SEQ ID NO: 792061 - DNA, 12 bp, Homo sapiens
gtcagctgaggc

SEQ ID NO: 792062 - DNA, 17 bp, Homo sapiens
gtcagctgctccctggc

SEQ ID NO: 792063 - DNA, 15 bp, Homo sapiens
gtcagctgcttctgc

SEQ ID NO: 792064 - DNA, 14 bp, Homo sapiens
gtcagctgggagcc

SEQ ID NO: 792065 - DNA, 17 bp, Homo sapiens
gtcagctgggagccagt

SEQ ID NO: 792066 - DNA, 16 bp, Homo sapiens
gtcaggaacagaagga

SEQ ID NO: 792067 - DNA, 16 bp, Homo sapiens
gtcaggaacagtggct

SEQ ID NO: 792068 - DNA, 22 bp, Homo sapiens
gtcaggaacagtggctgggtgg

SEQ ID NO: 792069 - DNA, 15 bp, Homo sapiens
gtcaggaagaaatca

SEQ ID NO: 792070 - DNA, 21 bp, Homo sapiens
gtcaggacggctcctcagagc

SEQ ID NO: 792071 - DNA, 21 bp, Homo sapiens
gtcaggagatcgagaccatcc

SEQ ID NO: 792072 - DNA, 22 bp, Homo sapiens
gtcaggagttgtttctgaccca

SEQ ID NO: 792073 - DNA, 20 bp, Homo sapiens
gtcaggatgcacatttctgg

SEQ ID NO: 792074 - DNA, 21 bp, Homo sapiens
gtcaggatgcacatttctgga

SEQ ID NO: 792075 - DNA, 14 bp, Homo sapiens
gtcaggcagaggca

SEQ ID NO: 792076 - DNA, 15 bp, Homo sapiens
gtcaggcagaggcaa

SEQ ID NO: 792077 - DNA, 21 bp, Homo sapiens
gtcaggcaggtttgccagtga

SEQ ID NO: 792078 - DNA, 19 bp, Homo sapiens
gtcaggccagcctgtccct

SEQ ID NO: 792079 - DNA, 12 bp, Homo sapiens
gtcaggccaggt

SEQ ID NO: 792080 - DNA, 14 bp, Homo sapiens
gtcaggccaggtgg

SEQ ID NO: 792081 - DNA, 21 bp, Homo sapiens
gtcaggcccgtcggagctgcc

SEQ ID NO: 792082 - DNA, 22 bp, Homo sapiens
gtcaggcccgtcggagctgcct

SEQ ID NO: 792083 - DNA, 13 bp, Homo sapiens
gtcaggccctctg

SEQ ID NO: 792084 - DNA, 23 bp, Homo sapiens
gtcaggccctctgcctgcactcc

SEQ ID NO: 792085 - DNA, 17 bp, Homo sapiens
gtcaggccctgactcct

SEQ ID NO: 792086 - DNA, 22 bp, Homo sapiens
gtcaggcccttattttcaagaa

SEQ ID NO: 792087 - DNA, 14 bp, Homo sapiens
gtcagggaccaagg

SEQ ID NO: 792088 - DNA, 21 bp, Homo sapiens
gtcagggaccaaggacccctc

SEQ ID NO: 792089 - DNA, 20 bp, Homo sapiens
gtcagggagaggtcaccagc

SEQ ID NO: 792090 - DNA, 16 bp, Homo sapiens
gtcagggagggccagg

SEQ ID NO: 792091 - DNA, 18 bp, Homo sapiens
gtcagggaggggcaacca

SEQ ID NO: 792092 - DNA, 14 bp, Homo sapiens
gtcagggagtgctg

SEQ ID NO: 792093 - DNA, 21 bp, Homo sapiens
gtcagggcacagctgccctgc

SEQ ID NO: 792094 - DNA, 22 bp, Homo sapiens
gtcagggcacagctgccctgct

SEQ ID NO: 792095 - DNA, 16 bp, Homo sapiens
gtcagggcagtggcca

SEQ ID NO: 792096 - DNA, 20 bp, Homo sapiens
gtcagggcagtggccaagcc

SEQ ID NO: 792097 - DNA, 16 bp, Homo sapiens
gtcagggccagactgg

SEQ ID NO: 792098 - DNA, 12 bp, Homo sapiens
gtcagggcccaa

SEQ ID NO: 792099 - DNA, 18 bp, Homo sapiens
gtcagggccttggcccag

SEQ ID NO: 792100 - DNA, 14 bp, Homo sapiens
gtcagggctcagag

SEQ ID NO: 792101 - DNA, 14 bp, Homo sapiens
gtcaggggctctgt

SEQ ID NO: 792102 - DNA, 14 bp, Homo sapiens
gtcagggttcactt

SEQ ID NO: 792103 - DNA, 13 bp, Homo sapiens
gtcaggtcccagc

SEQ ID NO: 792104 - DNA, 22 bp, Homo sapiens
gtcaggtcccagcgagccacag

SEQ ID NO: 792105 - DNA, 19 bp, Homo sapiens
gtcaggtccccatggcttg

SEQ ID NO: 792106 - DNA, 17 bp, Homo sapiens
gtcaggtgtcaggcccg

SEQ ID NO: 792107 - DNA, 19 bp, Homo sapiens
gtcaggttatactcctcct

SEQ ID NO: 792108 - DNA, 16 bp, Homo sapiens
gtcagtaccttcaaac

SEQ ID NO: 792109 - DNA, 22 bp, Homo sapiens
gtcagtaccttcaaactagggc

SEQ ID NO: 792110 - DNA, 20 bp, Homo sapiens
gtcagtaggtccaagggcca

SEQ ID NO: 792111 - DNA, 14 bp, Homo sapiens
gtcagtatccaggc

SEQ ID NO: 792112 - DNA, 20 bp, Homo sapiens
gtcagtatctgtatctctct

SEQ ID NO: 792113 - DNA, 14 bp, Homo sapiens
gtcagtatgacatt

SEQ ID NO: 792114 - DNA, 14 bp, Homo sapiens
gtcagtattatcta

SEQ ID NO: 792115 - DNA, 16 bp, Homo sapiens
gtcagtcacagccacc

SEQ ID NO: 792116 - DNA, 12 bp, Homo sapiens
gtcagtctaaca

SEQ ID NO: 792117 - DNA, 13 bp, Homo sapiens
gtccccctcagca

SEQ ID NO: 792118 - DNA, 11 bp, Homo sapiens
gtccccctccc

SEQ ID NO: 792119 - DNA, 19 bp, Homo sapiens
gtccccctcccctcccagt

SEQ ID NO: 792120 - DNA, 17 bp, Homo sapiens
gtccccctccctgccca

SEQ ID NO: 792121 - DNA, 23 bp, Homo sapiens
gtccccctccctgcccaaactcc

SEQ ID NO: 792122 - DNA, 22 bp, Homo sapiens
gtccccctcctcccagggcctc

SEQ ID NO: 792123 - DNA, 12 bp, Homo sapiens
gtccccctctgg

SEQ ID NO: 792124 - DNA, 19 bp, Homo sapiens
gtccccctctgtccaggca

SEQ ID NO: 792125 - DNA, 16 bp, Homo sapiens
gtccccgaggagctgg

SEQ ID NO: 792126 - DNA, 20 bp, Homo sapiens
gtccccgaggagctgggccc

SEQ ID NO: 792127 - DNA, 21 bp, Homo sapiens
gtccccgagggcgaaggccat

SEQ ID NO: 792128 - DNA, 17 bp, Homo sapiens
gtccccgagtgcctagg

SEQ ID NO: 792129 - DNA, 22 bp, Homo sapiens
gtccccggggttccccacacag

SEQ ID NO: 792130 - DNA, 14 bp, Homo sapiens
gtccccggttgctg

SEQ ID NO: 792131 - DNA, 22 bp, Homo sapiens
gtccccggttgctggtcaggtc

SEQ ID NO: 792132 - DNA, 18 bp, Homo sapiens
gtcccctaacccccagtc

SEQ ID NO: 792133 - DNA, 15 bp, Homo sapiens
gtcccctaaggaaat

SEQ ID NO: 792134 - DNA, 20 bp, Homo sapiens
gtcccctactccctcttcac

SEQ ID NO: 792135 - DNA, 15 bp, Homo sapiens
gtcccctcactctgt

SEQ ID NO: 792136 - DNA, 16 bp, Homo sapiens
gtcccctcactctgtc

SEQ ID NO: 792137 - DNA, 17 bp, Homo sapiens
gtcccctcactctgtca

SEQ ID NO: 792138 - DNA, 18 bp, Homo sapiens
gtcccctcactctgtcag

SEQ ID NO: 792139 - DNA, 20 bp, Homo sapiens
gtcccctcactctgtcagcc

SEQ ID NO: 792140 - DNA, 19 bp, Homo sapiens
gtcccctccacatcccagc

SEQ ID NO: 792141 - DNA, 12 bp, Homo sapiens
gtcccctcccat

SEQ ID NO: 792142 - DNA, 16 bp, Homo sapiens
gtcccctcccatctgg

SEQ ID NO: 792143 - DNA, 13 bp, Homo sapiens
gtcccctccgcca

SEQ ID NO: 792144 - DNA, 18 bp, Homo sapiens
gtcccctccgccatgggg

SEQ ID NO: 792145 - DNA, 19 bp, Homo sapiens
gtcccctccgccgtgccgg

SEQ ID NO: 792146 - DNA, 15 bp, Homo sapiens
gtcccctctcccctt

SEQ ID NO: 792147 - DNA, 16 bp, Homo sapiens
gtcccctctccccttg

SEQ ID NO: 792148 - DNA, 14 bp, Homo sapiens
gtcccctctctctg

SEQ ID NO: 792149 - DNA, 11 bp, Homo sapiens
gtcccctctgt

SEQ ID NO: 792150 - DNA, 22 bp, Homo sapiens
gtcccctctgtcatcactccct

SEQ ID NO: 792151 - DNA, 14 bp, Homo sapiens
gtcccctctgtgct

SEQ ID NO: 792152 - DNA, 15 bp, Homo sapiens
gtcccctctgtgctt

SEQ ID NO: 792153 - DNA, 20 bp, Homo sapiens
gtcccctctgtgcttcgact

SEQ ID NO: 792154 - DNA, 14 bp, Homo sapiens
gtcccctgacaggg

SEQ ID NO: 792155 - DNA, 14 bp, Homo sapiens
gtcccctgacctgt

SEQ ID NO: 792156 - DNA, 18 bp, Homo sapiens
gtcccctgacctgtccag

SEQ ID NO: 792157 - DNA, 15 bp, Homo sapiens
gtcccctgcagcctg

SEQ ID NO: 792158 - DNA, 18 bp, Homo sapiens
gtcccctgcagcctgggt

SEQ ID NO: 792159 - DNA, 21 bp, Homo sapiens
gtcccctgcagcctgggtctg

SEQ ID NO: 792160 - DNA, 20 bp, Homo sapiens
gtcccctgcgggcgcgggca

SEQ ID NO: 792161 - DNA, 23 bp, Homo sapiens
gtcccctgctactcctgtgctct

SEQ ID NO: 792162 - DNA, 21 bp, Homo sapiens
gtcctcgaattttatctgtgg

SEQ ID NO: 792163 - DNA, 23 bp, Homo sapiens
gtcctcgaattttatctgtggag

SEQ ID NO: 792164 - DNA, 21 bp, Homo sapiens
gtcctctagcccactccctgc

SEQ ID NO: 792165 - DNA, 18 bp, Homo sapiens
gtcctctcccccttcagc

SEQ ID NO: 792166 - DNA, 20 bp, Homo sapiens
gtcctctcccccttcagctc

SEQ ID NO: 792167 - DNA, 23 bp, Homo sapiens
gtcctctcccccttcagctcctg

SEQ ID NO: 792168 - DNA, 14 bp, Homo sapiens
gtcctctctctgtg

SEQ ID NO: 792169 - DNA, 18 bp, Homo sapiens
gtcctctctctgtggggc

SEQ ID NO: 792170 - DNA, 20 bp, Homo sapiens
gtcctctgaggcactcatct

SEQ ID NO: 792171 - DNA, 17 bp, Homo sapiens
gtcctctgcctgggctc

SEQ ID NO: 792172 - DNA, 18 bp, Homo sapiens
gtcctctgcctgggctct

SEQ ID NO: 792173 - DNA, 11 bp, Homo sapiens
gtcctctggat

SEQ ID NO: 792174 - DNA, 18 bp, Homo sapiens
gtcctctggatggcacca

SEQ ID NO: 792175 - DNA, 14 bp, Homo sapiens
gtcctctgtagtat

SEQ ID NO: 792176 - DNA, 18 bp, Homo sapiens
gtcctcttccctctctgc

SEQ ID NO: 792177 - DNA, 20 bp, Homo sapiens
gtcctcttccctctctgcag

SEQ ID NO: 792178 - DNA, 15 bp, Homo sapiens
gtcctctttcaaagg

SEQ ID NO: 792179 - DNA, 19 bp, Homo sapiens
gtcctgaaacatgaaccca

SEQ ID NO: 792180 - DNA, 16 bp, Homo sapiens
gtcctgaagaggcggg

SEQ ID NO: 792181 - DNA, 17 bp, Homo sapiens
gtcctgaagaggcgggc

SEQ ID NO: 792182 - DNA, 19 bp, Homo sapiens
gtcctgaagatcaagccag

SEQ ID NO: 792183 - DNA, 14 bp, Homo sapiens
gtcctgaccaccct

SEQ ID NO: 792184 - DNA, 19 bp, Homo sapiens
gtcctgaccaccctcccct

SEQ ID NO: 792185 - DNA, 23 bp, Homo sapiens
gtcctgaccaccctcccctctct

SEQ ID NO: 792186 - DNA, 16 bp, Homo sapiens
gtcctgacggcgcccc

SEQ ID NO: 792187 - DNA, 13 bp, Homo sapiens
gtcctgagacctg

SEQ ID NO: 792188 - DNA, 16 bp, Homo sapiens
gtcctgaggagccctg

SEQ ID NO: 792189 - DNA, 18 bp, Homo sapiens
gtcctgaggagccctgag

SEQ ID NO: 792190 - DNA, 21 bp, Homo sapiens
gtcctgaggagccctgaggac

SEQ ID NO: 792191 - DNA, 15 bp, Homo sapiens
gtcctgatccctcca

SEQ ID NO: 792192 - DNA, 15 bp, Homo sapiens
gtcctgatggtcagc

SEQ ID NO: 792193 - DNA, 20 bp, Homo sapiens
gtcctgatggtcagctccct

SEQ ID NO: 792194 - DNA, 12 bp, Homo sapiens
gtcctgcagagg

SEQ ID NO: 792195 - DNA, 21 bp, Homo sapiens
gtcctgcagaggaccacagtg

SEQ ID NO: 792196 - DNA, 14 bp, Homo sapiens
gtcctgcagcctgc

SEQ ID NO: 792197 - DNA, 20 bp, Homo sapiens
gtcctgcagtcccacactgt

SEQ ID NO: 792198 - DNA, 20 bp, Homo sapiens
gtcctgcatggggcagaggc

SEQ ID NO: 792199 - DNA, 11 bp, Homo sapiens
gtcctgccagc

SEQ ID NO: 792200 - DNA, 13 bp, Homo sapiens
gtcctgcccatgt

SEQ ID NO: 792201 - DNA, 14 bp, Homo sapiens
gtcctgcccatgtg

SEQ ID NO: 792202 - DNA, 17 bp, Homo sapiens
gtcctgcccatgtgtcc

SEQ ID NO: 792203 - DNA, 23 bp, Homo sapiens
gtcctgcccatgtgtcccctcac

SEQ ID NO: 792204 - DNA, 21 bp, Homo sapiens
gtcctgccctccggaggagca

SEQ ID NO: 792205 - DNA, 18 bp, Homo sapiens
gtcctgccctgtggaatg

SEQ ID NO: 792206 - DNA, 17 bp, Homo sapiens
gtcctgcctcagcctcc

SEQ ID NO: 792207 - DNA, 14 bp, Homo sapiens
gtcctgcctcctca

SEQ ID NO: 792208 - DNA, 15 bp, Homo sapiens
gtcctgcctcctcat

SEQ ID NO: 792209 - DNA, 16 bp, Homo sapiens
gtcctgcctcctcatc

SEQ ID NO: 792210 - DNA, 23 bp, Homo sapiens
gtcctgcctcttgtttctgtgcc

SEQ ID NO: 792211 - DNA, 13 bp, Homo sapiens
gtcctgcctgtgg

SEQ ID NO: 792212 - DNA, 14 bp, Homo sapiens
gtcctgcctgtggc

SEQ ID NO: 792213 - DNA, 19 bp, Homo sapiens
gtcctgctgtccctgtcag

SEQ ID NO: 792214 - DNA, 15 bp, Homo sapiens
gtcctgctttcctat

SEQ ID NO: 792215 - DNA, 14 bp, Homo sapiens
gtcctggacacctc

SEQ ID NO: 792216 - DNA, 20 bp, Homo sapiens
gtcctggacacctcccaggg

SEQ ID NO: 792217 - DNA, 23 bp, Homo sapiens
gtcctggacacctcccaggggac

SEQ ID NO: 792218 - DNA, 22 bp, Homo sapiens
gtcctggactcctgccaccagc

SEQ ID NO: 792219 - DNA, 14 bp, Homo sapiens
gtcctggaggggct

SEQ ID NO: 792220 - DNA, 17 bp, Homo sapiens
gtcctggatgatactaa

SEQ ID NO: 792221 - DNA, 22 bp, Homo sapiens
gtcctggcccttcagtctgctc

SEQ ID NO: 792222 - DNA, 19 bp, Homo sapiens
gtcctggctacatcccagc

SEQ ID NO: 792223 - DNA, 11 bp, Homo sapiens
gtcctggctcc

SEQ ID NO: 792224 - DNA, 17 bp, Homo sapiens
gtcctggctcctgaggg

SEQ ID NO: 792225 - DNA, 14 bp, Homo sapiens
gtcctggctgcact

SEQ ID NO: 792226 - DNA, 15 bp, Homo sapiens
gtcctggctgcactc

SEQ ID NO: 792227 - DNA, 19 bp, Homo sapiens
gtcctgggaggatcctgag

SEQ ID NO: 792228 - DNA, 19 bp, Homo sapiens
gtcctgggcatgggtccag

SEQ ID NO: 792229 - DNA, 22 bp, Homo sapiens
gtcctgggcatgggtccagggc

SEQ ID NO: 792230 - DNA, 23 bp, Homo sapiens
gtcctgggcatgggtccagggcc

SEQ ID NO: 792231 - DNA, 16 bp, Homo sapiens
gtcctgggcgtgaccc

SEQ ID NO: 792232 - DNA, 22 bp, Homo sapiens
gtcctggggcctcggagcctca

SEQ ID NO: 792233 - DNA, 12 bp, Homo sapiens
gtcctggtgccc

SEQ ID NO: 792234 - DNA, 15 bp, Homo sapiens
gtcctggtgctctct

SEQ ID NO: 792235 - DNA, 20 bp, Homo sapiens
gtcctgtagcacgctgcctg

SEQ ID NO: 792236 - DNA, 20 bp, Homo sapiens
gtctgtatactcctgtcacc

SEQ ID NO: 792237 - DNA, 19 bp, Homo sapiens
gtctgtatttatgtgtgag

SEQ ID NO: 792238 - DNA, 14 bp, Homo sapiens
gtctgtatttcatg

SEQ ID NO: 792239 - DNA, 17 bp, Homo sapiens
gtctgtatttcatgtgg

SEQ ID NO: 792240 - DNA, 16 bp, Homo sapiens
gtctgtcaaatgtttc

SEQ ID NO: 792241 - DNA, 21 bp, Homo sapiens
gtctgtcaatcacagtctcag

SEQ ID NO: 792242 - DNA, 21 bp, Homo sapiens
gtctgtcacaggctgggtcaa

SEQ ID NO: 792243 - DNA, 22 bp, Homo sapiens
gtctgtccatctgtctgtccta

SEQ ID NO: 792244 - DNA, 16 bp, Homo sapiens
gtctgtcctacccgcc

SEQ ID NO: 792245 - DNA, 16 bp, Homo sapiens
gtctgtcctcagagca

SEQ ID NO: 792246 - DNA, 19 bp, Homo sapiens
gtctgtcctgatttctaca

SEQ ID NO: 792247 - DNA, 14 bp, Homo sapiens
gtctgtctagtgtc

SEQ ID NO: 792248 - DNA, 16 bp, Homo sapiens
gtctgtctcgatgcct

SEQ ID NO: 792249 - DNA, 19 bp, Homo sapiens
gtctgtctctccccctctg

SEQ ID NO: 792250 - DNA, 15 bp, Homo sapiens
gtctgtctcttggct

SEQ ID NO: 792251 - DNA, 13 bp, Homo sapiens
gtctgtctgtggg

SEQ ID NO: 792252 - DNA, 14 bp, Homo sapiens
gtctgtctgtgggc

SEQ ID NO: 792253 - DNA, 20 bp, Homo sapiens
gtctgtctttcctgaaccat

SEQ ID NO: 792254 - DNA, 21 bp, Homo sapiens
gtctgtgaacagagagaccct

SEQ ID NO: 792255 - DNA, 12 bp, Homo sapiens
gtctgtgactgg

SEQ ID NO: 792256 - DNA, 15 bp, Homo sapiens
gtctgtgactggatc

SEQ ID NO: 792257 - DNA, 19 bp, Homo sapiens
gtctgtgccctccaaagag

SEQ ID NO: 792258 - DNA, 14 bp, Homo sapiens
gtctgtggactgca

SEQ ID NO: 792259 - DNA, 13 bp, Homo sapiens
gtctgtggatcag

SEQ ID NO: 792260 - DNA, 22 bp, Homo sapiens
gtctgtgggccgcccctggcca

SEQ ID NO: 792261 - DNA, 12 bp, Homo sapiens
gtctgtgggctt

SEQ ID NO: 792262 - DNA, 13 bp, Homo sapiens
gtctgtgggcttc

SEQ ID NO: 792263 - DNA, 19 bp, Homo sapiens
gtctgtgggcttcagcact

SEQ ID NO: 792264 - DNA, 13 bp, Homo sapiens
gtctgtgtgaatg

SEQ ID NO: 792265 - DNA, 20 bp, Homo sapiens
gtctgtgtgatgaactttct

SEQ ID NO: 792266 - DNA, 11 bp, Homo sapiens
gtctgtgtgct

SEQ ID NO: 792267 - DNA, 12 bp, Homo sapiens
gtctgtgtgggg

SEQ ID NO: 792268 - DNA, 15 bp, Homo sapiens
gtctgtgttgcttca

SEQ ID NO: 792269 - DNA, 21 bp, Homo sapiens
gtctgttaccataagtctgat

SEQ ID NO: 792270 - DNA, 20 bp, Homo sapiens
gtctgttaccatgtcactgt

SEQ ID NO: 792271 - DNA, 16 bp, Homo sapiens
gtctgttatgcactgt

SEQ ID NO: 792272 - DNA, 14 bp, Homo sapiens
gtctgttatttatt

SEQ ID NO: 792273 - DNA, 15 bp, Homo sapiens
gtctgttcagcaaac

SEQ ID NO: 792274 - DNA, 13 bp, Homo sapiens
gtctgttgattaa

SEQ ID NO: 792275 - DNA, 14 bp, Homo sapiens
gtctgttggcaggc

SEQ ID NO: 792276 - DNA, 22 bp, Homo sapiens
gtctgtttattaactactgaat

SEQ ID NO: 792277 - DNA, 15 bp, Homo sapiens
gtctgtttgccactt

SEQ ID NO: 792278 - DNA, 13 bp, Homo sapiens
gtctgtttggact

SEQ ID NO: 792279 - DNA, 14 bp, Homo sapiens
gtcttaaaaaatgt

SEQ ID NO: 792280 - DNA, 14 bp, Homo sapiens
gtcttaaaaattta

SEQ ID NO: 792281 - DNA, 13 bp, Homo sapiens
gtcttaaatgaga

SEQ ID NO: 792282 - DNA, 12 bp, Homo sapiens
gtcttaaatgct

SEQ ID NO: 792283 - DNA, 22 bp, Homo sapiens
gtcttaacaaaccaacatcttt

SEQ ID NO: 792284 - DNA, 23 bp, Homo sapiens
gtcttaacaaaccaacatctttg

SEQ ID NO: 792285 - DNA, 17 bp, Homo sapiens
gtctgactccagagtct

SEQ ID NO: 792286 - DNA, 20 bp, Homo sapiens
gtctgactccagagtctgag

SEQ ID NO: 792287 - DNA, 21 bp, Homo sapiens
gtctgactccagagtctgagc

SEQ ID NO: 792288 - DNA, 23 bp, Homo sapiens
gtctgactccagagtctgagccc

SEQ ID NO: 792289 - DNA, 20 bp, Homo sapiens
gtctgactccctccccaccc

SEQ ID NO: 792290 - DNA, 14 bp, Homo sapiens
gtctgactctgggt

SEQ ID NO: 792291 - DNA, 11 bp, Homo sapiens
gtctgagaaat

SEQ ID NO: 792292 - DNA, 22 bp, Homo sapiens
gtctgagaaataggtatcaaaa

SEQ ID NO: 792293 - DNA, 15 bp, Homo sapiens
gtctgagcaccccct

SEQ ID NO: 792294 - DNA, 13 bp, Homo sapiens
gtctgagctagct

SEQ ID NO: 792295 - DNA, 14 bp, Homo sapiens
gtctgagctggacg

SEQ ID NO: 792296 - DNA, 21 bp, Homo sapiens
gtctgaggactgtcctcccac

SEQ ID NO: 792297 - DNA, 22 bp, Homo sapiens
gtctgaggcctcatccctcgga

SEQ ID NO: 792298 - DNA, 14 bp, Homo sapiens
gtctgaggcctgcc

SEQ ID NO: 792299 - DNA, 17 bp, Homo sapiens
gtctgaggcctgccccc

SEQ ID NO: 792300 - DNA, 17 bp, Homo sapiens
gtctgagtcctgtctct

SEQ ID NO: 792301 - DNA, 18 bp, Homo sapiens
gtctgagtcctgtctctg

SEQ ID NO: 792302 - DNA, 20 bp, Homo sapiens
gtctgattggctcacccaag

SEQ ID NO: 792303 - DNA, 22 bp, Homo sapiens
gtctgatttcaggatactctgt

SEQ ID NO: 792304 - DNA, 23 bp, Homo sapiens
gtctgattttctcactgaactcc

SEQ ID NO: 792305 - DNA, 13 bp, Homo sapiens
gtctgcacccagg

SEQ ID NO: 792306 - DNA, 19 bp, Homo sapiens
gtctgcagcccggcgccac

SEQ ID NO: 792307 - DNA, 15 bp, Homo sapiens
gtctgcagcctgctg

SEQ ID NO: 792308 - DNA, 17 bp, Homo sapiens
gtctgcagcctgctggg

SEQ ID NO: 792309 - DNA, 10 bp, Homo sapiens
gtctgcaggg

SEQ ID NO: 792310 - DNA, 14 bp, Homo sapiens
gtctgcaggggcct

SEQ ID NO: 792311 - DNA, 18 bp, Homo sapiens
gtctgcaggggcctggag

SEQ ID NO: 792312 - DNA, 19 bp, Homo sapiens
gtctgcaggggcctggagg

SEQ ID NO: 792313 - DNA, 22 bp, Homo sapiens
gtctgcattgttattgtggaag

SEQ ID NO: 792314 - DNA, 20 bp, Homo sapiens
gtctgcatttcggtggctag

SEQ ID NO: 792315 - DNA, 21 bp, Homo sapiens
gtctgccaggcccatctcagg

SEQ ID NO: 792316 - DNA, 20 bp, Homo sapiens
gtctgcccacgcagaggacg

SEQ ID NO: 792317 - DNA, 21 bp, Homo sapiens
gtctgcccacgcagaggacgc

SEQ ID NO: 792318 - DNA, 17 bp, Homo sapiens
gtctgccccacatgtgg

SEQ ID NO: 792319 - DNA, 13 bp, Homo sapiens
gtctgccccaccc

SEQ ID NO: 792320 - DNA, 12 bp, Homo sapiens
gtctgccccagc

SEQ ID NO: 792321 - DNA, 14 bp, Homo sapiens
gtctgccctgccca

SEQ ID NO: 792322 - DNA, 17 bp, Homo sapiens
gtcttgctcctggggag

SEQ ID NO: 792323 - DNA, 14 bp, Homo sapiens
gtcttgctctgtcc

SEQ ID NO: 792324 - DNA, 22 bp, Homo sapiens
gtcttggaagctgtttggaaaa

SEQ ID NO: 792325 - DNA, 20 bp, Homo sapiens
gtcttggcattaaaccacat

SEQ ID NO: 792326 - DNA, 14 bp, Homo sapiens
gtcttggccagcca

SEQ ID NO: 792327 - DNA, 23 bp, Homo sapiens
gtcttggcggcagcagccatcat

SEQ ID NO: 792328 - DNA, 16 bp, Homo sapiens
gtcttggctttcatgt

SEQ ID NO: 792329 - DNA, 19 bp, Homo sapiens
gtcttgggcagagctggct

SEQ ID NO: 792330 - DNA, 20 bp, Homo sapiens
gtcttgggcagagctggctc

SEQ ID NO: 792331 - DNA, 17 bp, Homo sapiens
gtcttgggctactggca

SEQ ID NO: 792332 - DNA, 20 bp, Homo sapiens
gtcttgggctactggcagct

SEQ ID NO: 792333 - DNA, 20 bp, Homo sapiens
gtcttggggccactttcaga

SEQ ID NO: 792334 - DNA, 19 bp, Homo sapiens
gtcttgggggtcagggggg

SEQ ID NO: 792335 - DNA, 23 bp, Homo sapiens
gtcttggggtcatgaagggctgg

SEQ ID NO: 792336 - DNA, 22 bp, Homo sapiens
gtcttggtgccttttgtgtgat

SEQ ID NO: 792337 - DNA, 21 bp, Homo sapiens
gtcttgtaaaaaggggaggag

SEQ ID NO: 792338 - DNA, 13 bp, Homo sapiens
gtcttgtacttct

SEQ ID NO: 792339 - DNA, 15 bp, Homo sapiens
gtcttgtacttctgt

SEQ ID NO: 792340 - DNA, 16 bp, Homo sapiens
gtcttgtacttctgtg

SEQ ID NO: 792341 - DNA, 18 bp, Homo sapiens
gtcttgtacttctgtgtt

SEQ ID NO: 792342 - DNA, 20 bp, Homo sapiens
gtcttgtacttctgtgttca

SEQ ID NO: 792343 - DNA, 22 bp, Homo sapiens
gtcttgtacttctgtgttcatt

SEQ ID NO: 792344 - DNA, 17 bp, Homo sapiens
gtcttgtcatacaaatt

SEQ ID NO: 792345 - DNA, 20 bp, Homo sapiens
gtcttgtcccaattaaaata

SEQ ID NO: 792346 - DNA, 12 bp, Homo sapiens
gtcttgtgcata

SEQ ID NO: 792347 - DNA, 23 bp, Homo sapiens
gtcttgtgtttccacagcctgca

SEQ ID NO: 792348 - DNA, 16 bp, Homo sapiens
gtcttgttagaaaaca

SEQ ID NO: 792349 - DNA, 17 bp, Homo sapiens
gtcttgttatgtacaaa

SEQ ID NO: 792350 - DNA, 19 bp, Homo sapiens
gtcttgttatgtacaaact

SEQ ID NO: 792351 - DNA, 23 bp, Homo sapiens
gtctttaagatcttggcttaatt

SEQ ID NO: 792352 - DNA, 13 bp, Homo sapiens
gtctttagctatt

SEQ ID NO: 792353 - DNA, 17 bp, Homo sapiens
gtctttaggcagcagct

SEQ ID NO: 792354 - DNA, 21 bp, Homo sapiens
gtctttataacccatattttc

SEQ ID NO: 792355 - DNA, 15 bp, Homo sapiens
gtctttattcttatt

SEQ ID NO: 792356 - DNA, 19 bp, Homo sapiens
gtctttcactggaatgaag

SEQ ID NO: 792357 - DNA, 15 bp, Homo sapiens
gtctttcagtacttt

SEQ ID NO: 792358 - DNA, 21 bp, Homo sapiens
gtctttccaaattatttctta

SEQ ID NO: 792359 - DNA, 18 bp, Homo sapiens
gtctttccacggagccac

SEQ ID NO: 792360 - DNA, 20 bp, Homo sapiens
gtctttccattggatctcat

SEQ ID NO: 792361 - DNA, 20 bp, Homo sapiens
gtctttcccatggggaggga

SEQ ID NO: 792362 - DNA, 21 bp, Homo sapiens
gtctttcctcctaccttttgt

SEQ ID NO: 792363 - DNA, 13 bp, Homo sapiens
gtctttctagcca

SEQ ID NO: 792364 - DNA, 13 bp, Homo sapiens
gtctttctataga

SEQ ID NO: 792365 - DNA, 14 bp, Homo sapiens
gtctttgcacatgt

SEQ ID NO: 792366 - DNA, 16 bp, Homo sapiens
gtctttgcacatgtga

SEQ ID NO: 792367 - DNA, 15 bp, Homo sapiens
gtctttgccttctct

SEQ ID NO: 792368 - DNA, 13 bp, Homo sapiens
gtctttgctcagt

SEQ ID NO: 792369 - DNA, 15 bp, Homo sapiens
gtctttgctgtactc

SEQ ID NO: 792370 - DNA, 18 bp, Homo sapiens
gtctttggagaaatgctt

SEQ ID NO: 792371 - DNA, 22 bp, Homo sapiens
gtctttggagaaatgcttagaa

SEQ ID NO: 792372 - DNA, 19 bp, Homo sapiens
gtctttggataataggaat

SEQ ID NO: 792373 - DNA, 18 bp, Homo sapiens
gtctttgtaatgtcacca

SEQ ID NO: 792374 - DNA, 21 bp, Homo sapiens
gtctttgtaatgtcaccacct

SEQ ID NO: 792375 - DNA, 23 bp, Homo sapiens
gtctttgtgggagggtaagacaa

SEQ ID NO: 792376 - DNA, 15 bp, Homo sapiens
gtcttttaaactgga

SEQ ID NO: 792377 - DNA, 20 bp, Homo sapiens
gtcttttaccctgtgtcaga

SEQ ID NO: 792378 - DNA, 17 bp, Homo sapiens
gtcttttctcctccgcc

SEQ ID NO: 792379 - DNA, 14 bp, Homo sapiens
gtcttttgacatgt

SEQ ID NO: 792380 - DNA, 16 bp, Homo sapiens
gtcttttgacatgtgg

SEQ ID NO: 792381 - DNA, 19 bp, Homo sapiens
gtcttttgacatgtggaaa

SEQ ID NO: 792382 - DNA, 23 bp, Homo sapiens
gtcttttgagctattcacctcag

SEQ ID NO: 792383 - DNA, 12 bp, Homo sapiens
gtcttttgcttt

SEQ ID NO: 792384 - DNA, 23 bp, Homo sapiens
gtgacaaaccatccagtggaggt

SEQ ID NO: 792385 - DNA, 16 bp, Homo sapiens
gtgacaaccctggcct

SEQ ID NO: 792386 - DNA, 14 bp, Homo sapiens
gtgacaataaaaca

SEQ ID NO: 792387 - DNA, 16 bp, Homo sapiens
gtgacaattctgtttt

SEQ ID NO: 792388 - DNA, 20 bp, Homo sapiens
gtgacacaggtcagggctca

SEQ ID NO: 792389 - DNA, 21 bp, Homo sapiens
gtgacacaggtcagggctcag

SEQ ID NO: 792390 - DNA, 23 bp, Homo sapiens
gtgacaccaataaatgtttgtta

SEQ ID NO: 792391 - DNA, 23 bp, Homo sapiens
gtgacacccagagggagtagaat

SEQ ID NO: 792392 - DNA, 15 bp, Homo sapiens
gtgacacctccccct

SEQ ID NO: 792393 - DNA, 20 bp, Homo sapiens
gtgacagactggattaaaaa

SEQ ID NO: 792394 - DNA, 14 bp, Homo sapiens
gtgacagactttgg

SEQ ID NO: 792395 - DNA, 18 bp, Homo sapiens
gtgacagagttcactata

SEQ ID NO: 792396 - DNA, 13 bp, Homo sapiens
gtgacagccttgg

SEQ ID NO: 792397 - DNA, 23 bp, Homo sapiens
gtgacagccttgggcctttcagt

SEQ ID NO: 792398 - DNA, 14 bp, Homo sapiens
gtgacagcttcctt

SEQ ID NO: 792399 - DNA, 19 bp, Homo sapiens
gtgacagctttctgggatg

SEQ ID NO: 792400 - DNA, 15 bp, Homo sapiens
gtgacaggcccagtg

SEQ ID NO: 792401 - DNA, 21 bp, Homo sapiens
gtgacaggctcgtcagccacc

SEQ ID NO: 792402 - DNA, 13 bp, Homo sapiens
gtgacagggccag

SEQ ID NO: 792403 - DNA, 21 bp, Homo sapiens
gtgacagggccagtggggcct

SEQ ID NO: 792404 - DNA, 23 bp, Homo sapiens
gtgacagggccagtggggcctgt

SEQ ID NO: 792405 - DNA, 16 bp, Homo sapiens
gtgacagtcataaata

SEQ ID NO: 792406 - DNA, 19 bp, Homo sapiens
gtgacagtcatcatcaggg

SEQ ID NO: 792407 - DNA, 17 bp, Homo sapiens
gtgacagtgcctgggaa

SEQ ID NO: 792408 - DNA, 18 bp, Homo sapiens
gtgacagtggattgcatt

SEQ ID NO: 792409 - DNA, 12 bp, Homo sapiens
gtgacagtggct

SEQ ID NO: 792410 - DNA, 14 bp, Homo sapiens
gtgacagtttccaa

SEQ ID NO: 792411 - DNA, 23 bp, Homo sapiens
gtgacataatatattctattttt

SEQ ID NO: 792412 - DNA, 19 bp, Homo sapiens
gtgacatgcccaaggccac

SEQ ID NO: 792413 - DNA, 21 bp, Homo sapiens
gtgacatgcggctgcccacgc

SEQ ID NO: 792414 - DNA, 17 bp, Homo sapiens
gtgacatggggaaggca

SEQ ID NO: 792415 - DNA, 19 bp, Homo sapiens
gtgacatggtgcctgagag

SEQ ID NO: 792416 - DNA, 20 bp, Homo sapiens
gtgacatggtgcctgagagg

SEQ ID NO: 792417 - DNA, 24 bp, Homo sapiens
gtgacatggtgcctgagaggcagg

SEQ ID NO: 792418 - DNA, 20 bp, Homo sapiens
gtgacatgtctactttttaa

SEQ ID NO: 792419 - DNA, 22 bp, Homo sapiens
gtgacatgtctactttttaatt

SEQ ID NO: 792420 - DNA, 12 bp, Homo sapiens
gtgacattgaaa

SEQ ID NO: 792421 - DNA, 17 bp, Homo sapiens
gtgataaatcagtcaag

SEQ ID NO: 792422 - DNA, 19 bp, Homo sapiens
gtgataagggaaaagataa

SEQ ID NO: 792423 - DNA, 20 bp, Homo sapiens
gtgataaggggccttgctct

SEQ ID NO: 792424 - DNA, 21 bp, Homo sapiens
gtgataaggggccttgctctg

SEQ ID NO: 792425 - DNA, 15 bp, Homo sapiens
gtgatacaatgctgt

SEQ ID NO: 792426 - DNA, 20 bp, Homo sapiens
gtgatacatgtactccagag

SEQ ID NO: 792427 - DNA, 14 bp, Homo sapiens
gtgatacatttctg

SEQ ID NO: 792428 - DNA, 16 bp, Homo sapiens
gtgatacatttctgaa

SEQ ID NO: 792429 - DNA, 19 bp, Homo sapiens
gtgatagcattgctttcgt

SEQ ID NO: 792430 - DNA, 20 bp, Homo sapiens
gtgataggcccaaggtcccc

SEQ ID NO: 792431 - DNA, 23 bp, Homo sapiens
gtgataggcccaaggtcccctcc

SEQ ID NO: 792432 - DNA, 21 bp, Homo sapiens
gtgatatataagtgtacatat

SEQ ID NO: 792433 - DNA, 23 bp, Homo sapiens
gtgatatataagtgtacatatgt

SEQ ID NO: 792434 - DNA, 14 bp, Homo sapiens
gtgatattaaattt

SEQ ID NO: 792435 - DNA, 20 bp, Homo sapiens
gtgatatttttatgtgcagc

SEQ ID NO: 792436 - DNA, 15 bp, Homo sapiens
gtgatcaactgttca

SEQ ID NO: 792437 - DNA, 17 bp, Homo sapiens
gtgatcaataaaatgtg

SEQ ID NO: 792438 - DNA, 17 bp, Homo sapiens
gtgatcaatatttttat

SEQ ID NO: 792439 - DNA, 20 bp, Homo sapiens
gtgatcagaccataatgtta

SEQ ID NO: 792440 - DNA, 16 bp, Homo sapiens
gtgatcagcattgtga

SEQ ID NO: 792441 - DNA, 15 bp, Homo sapiens
gtgatcatttaaaaa

SEQ ID NO: 792442 - DNA, 17 bp, Homo sapiens
gtgatcatttaaaaagc

SEQ ID NO: 792443 - DNA, 14 bp, Homo sapiens
gtgatccagccctg

SEQ ID NO: 792444 - DNA, 21 bp, Homo sapiens
gtgatccatccatctccaggg

SEQ ID NO: 792445 - DNA, 23 bp, Homo sapiens
gtgatccgcccacctcagcctcc

SEQ ID NO: 792446 - DNA, 22 bp, Homo sapiens
gtgatccgcctacctcagcctc

SEQ ID NO: 792447 - DNA, 14 bp, Homo sapiens
gtgatcctctattt

SEQ ID NO: 792448 - DNA, 15 bp, Homo sapiens
gtgatcctctatttt

SEQ ID NO: 792449 - DNA, 18 bp, Homo sapiens
gtgatccttccacctcag

SEQ ID NO: 792450 - DNA, 19 bp, Homo sapiens
gtgatctgcccttctctgc

SEQ ID NO: 792451 - DNA, 18 bp, Homo sapiens
gtgatctgtagacttctg

SEQ ID NO: 792452 - DNA, 18 bp, Homo sapiens
gtgatctgtgtacaattt

SEQ ID NO: 792453 - DNA, 20 bp, Homo sapiens
gtgatcttcccacaccagcc

SEQ ID NO: 792454 - DNA, 17 bp, Homo sapiens
gtgatgaacatattcat

SEQ ID NO: 792455 - DNA, 14 bp, Homo sapiens
gtgatgaactttct

SEQ ID NO: 792456 - DNA, 19 bp, Homo sapiens
gtgatgaatcaatgaaaaa

SEQ ID NO: 792457 - DNA, 23 bp, Homo sapiens
gtgatgaatcaatgaaaaatgta

SEQ ID NO: 792458 - DNA, 16 bp, Homo sapiens
gtgatgacttgctgtc

SEQ ID NO: 792459 - DNA, 12 bp, Homo sapiens
gtgatgagctga

SEQ ID NO: 792460 - DNA, 11 bp, Homo sapiens
gtgatgatggg

SEQ ID NO: 792461 - DNA, 17 bp, Homo sapiens
gtgatgatttgggggag

SEQ ID NO: 792462 - DNA, 13 bp, Homo sapiens
gtgatgcaatctt

SEQ ID NO: 792463 - DNA, 15 bp, Homo sapiens
gtgatgccacacaga

SEQ ID NO: 792464 - DNA, 17 bp, Homo sapiens
gtgatgccacacagagt

SEQ ID NO: 792465 - DNA, 18 bp, Homo sapiens
gtgatgccgggcgccagg

SEQ ID NO: 792466 - DNA, 20 bp, Homo sapiens
gtgatgccgggcgccaggac

SEQ ID NO: 792467 - DNA, 18 bp, Homo sapiens
gtgatgccgtcctgctgg

SEQ ID NO: 792468 - DNA, 22 bp, Homo sapiens
gtgatgccgtcctgctggagtg

SEQ ID NO: 792469 - DNA, 19 bp, Homo sapiens
gtgatgctctggcttgccc

SEQ ID NO: 792470 - DNA, 18 bp, Homo sapiens
gtgatgctttcattatgt

SEQ ID NO: 792471 - DNA, 12 bp, Homo sapiens
gtgatgcttttg

SEQ ID NO: 792472 - DNA, 15 bp, Homo sapiens
gtgatgcttttgctg

SEQ ID NO: 792473 - DNA, 17 bp, Homo sapiens
gtgatgcttttgctgct

SEQ ID NO: 792474 - DNA, 13 bp, Homo sapiens
gtgatggagagga

SEQ ID NO: 792475 - DNA, 18 bp, Homo sapiens
gtgatggatggcacaatg

SEQ ID NO: 792476 - DNA, 15 bp, Homo sapiens
gtgatggccagcccc

SEQ ID NO: 792477 - DNA, 20 bp, Homo sapiens
gtgatggcgcgggaggcacc

SEQ ID NO: 792478 - DNA, 17 bp, Homo sapiens
gtgatggcgggcactgg

SEQ ID NO: 792479 - DNA, 20 bp, Homo sapiens
gtgatgggactcattgtaga

SEQ ID NO: 792480 - DNA, 22 bp, Homo sapiens
gtgatgggactcattgtagaaa

SEQ ID NO: 792481 - DNA, 14 bp, Homo sapiens
gtgatggggcaagg

SEQ ID NO: 792482 - DNA, 16 bp, Homo sapiens
gtgatgggggagaggg

SEQ ID NO: 792483 - DNA, 14 bp, Homo sapiens
gtgatgtattttca

SEQ ID NO: 792484 - DNA, 18 bp, Homo sapiens
gtgatgtattttcatagt

SEQ ID NO: 792485 - DNA, 12 bp, Homo sapiens
gtgatgtcatga

SEQ ID NO: 792486 - DNA, 15 bp, Homo sapiens
gtgatgtggaggaag

SEQ ID NO: 792487 - DNA, 15 bp, Homo sapiens
gtgattaaacgtgca

SEQ ID NO: 792488 - DNA, 13 bp, Homo sapiens
gtgattaatgttt

SEQ ID NO: 792489 - DNA, 21 bp, Homo sapiens
gtgattaatgttttcattatg

SEQ ID NO: 792490 - DNA, 22 bp, Homo sapiens
gtgattagagggaggagaatga

SEQ ID NO: 792491 - DNA, 20 bp, Homo sapiens
gtgattaggtgaagggatgg

SEQ ID NO: 792492 - DNA, 21 bp, Homo sapiens
gtgattatatttttgggggct

SEQ ID NO: 792493 - DNA, 21 bp, Homo sapiens
gtgattcaatctgtaaactgt

SEQ ID NO: 792494 - DNA, 22 bp, Homo sapiens
gtgattccactacacctggctg

SEQ ID NO: 792495 - DNA, 13 bp, Homo sapiens
gtgattctcctgc

SEQ ID NO: 792496 - DNA, 17 bp, Homo sapiens
gtgattctcctgcctca

SEQ ID NO: 792497 - DNA, 13 bp, Homo sapiens
gtgattctgcctt

SEQ ID NO: 792498 - DNA, 13 bp, Homo sapiens
gtgattgacagaa

SEQ ID NO: 792499 - DNA, 22 bp, Homo sapiens
gtgattgacagctttgctgctg

SEQ ID NO: 792500 - DNA, 15 bp, Homo sapiens
gtgattgcacagaat

SEQ ID NO: 792501 - DNA, 14 bp, Homo sapiens
gtgattgtggaatg

SEQ ID NO: 792502 - DNA, 19 bp, Homo sapiens
gtgattgtggaatggagat

SEQ ID NO: 792503 - DNA, 18 bp, Homo sapiens
gtgatttagaactgtatg

SEQ ID NO: 792504 - DNA, 15 bp, Homo sapiens
gtgatttccacaggt

SEQ ID NO: 792505 - DNA, 23 bp, Homo sapiens
gtgatttctcagtgatttcctac

SEQ ID NO: 792506 - DNA, 16 bp, Homo sapiens
gtgatttgaattctgt

SEQ ID NO: 792507 - DNA, 23 bp, Homo sapiens
gtgatttggaagagaggcacctg

SEQ ID NO: 792508 - DNA, 20 bp, Homo sapiens
gtgatttggttgcactttag

SEQ ID NO: 792509 - DNA, 19 bp, Homo sapiens
gtgattttatttttgcaaa

SEQ ID NO: 792510 - DNA, 15 bp, Homo sapiens
gtgattttgccctcc

SEQ ID NO: 792511 - DNA, 18 bp, Homo sapiens
gtgattttgccctcctgc

SEQ ID NO: 792512 - DNA, 20 bp, Homo sapiens
gtgattttgccctcctgccc

SEQ ID NO: 792513 - DNA, 13 bp, Homo sapiens
gtgatttttgtaa

SEQ ID NO: 792514 - DNA, 14 bp, Homo sapiens
gtgatttttttgtc

SEQ ID NO: 792515 - DNA, 18 bp, Homo sapiens
gtgcaaaatggtcagtat

SEQ ID NO: 792516 - DNA, 18 bp, Homo sapiens
gtgcaaacaacctgaatc

SEQ ID NO: 792517 - DNA, 23 bp, Homo sapiens
gtgcaaacaacctgaatcttttt

SEQ ID NO: 792518 - DNA, 16 bp, Homo sapiens
gtgcaaagactctgag

SEQ ID NO: 792519 - DNA, 19 bp, Homo sapiens
gtgcaaagactctgagcca

SEQ ID NO: 792520 - DNA, 16 bp, Homo sapiens
gtgcaaattcattttt

SEQ ID NO: 792521 - DNA, 14 bp, Homo sapiens
gtgcaaattgtatc

SEQ ID NO: 792522 - DNA, 15 bp, Homo sapiens
gtgcaacagacaagt

SEQ ID NO: 792523 - DNA, 20 bp, Homo sapiens
gtgcaacctgtggctcaggg

SEQ ID NO: 792524 - DNA, 14 bp, Homo sapiens
gtgcaactggccag

SEQ ID NO: 792525 - DNA, 23 bp, Homo sapiens
gtgcaacttagatctctcctgca

SEQ ID NO: 792526 - DNA, 13 bp, Homo sapiens
gtgcaacttttta

SEQ ID NO: 792527 - DNA, 15 bp, Homo sapiens
gtgcaagcccctgct

SEQ ID NO: 792528 - DNA, 15 bp, Homo sapiens
gtgcaaggacctaaa

SEQ ID NO: 792529 - DNA, 17 bp, Homo sapiens
gtgcaaggtggcctttg

SEQ ID NO: 792530 - DNA, 22 bp, Homo sapiens
gtgcaagtgtatgcacgtgtgc

SEQ ID NO: 792531 - DNA, 15 bp, Homo sapiens
gtgcaataatttgta

SEQ ID NO: 792532 - DNA, 23 bp, Homo sapiens
gtgcaatgcttgtagaagtagga

SEQ ID NO: 792533 - DNA, 17 bp, Homo sapiens
gtgcaatgtaaatattt

SEQ ID NO: 792534 - DNA, 15 bp, Homo sapiens
gtgcaattatttctt

SEQ ID NO: 792535 - DNA, 19 bp, Homo sapiens
gtgcaattccaagaaaata

SEQ ID NO: 792536 - DNA, 14 bp, Homo sapiens
gtgccagttgggct

SEQ ID NO: 792537 - DNA, 23 bp, Homo sapiens
gtgccagttgggctcgcactgcc

SEQ ID NO: 792538 - DNA, 13 bp, Homo sapiens
gtgccatgcccaa

SEQ ID NO: 792539 - DNA, 15 bp, Homo sapiens
gtgccatgctgggcc

SEQ ID NO: 792540 - DNA, 17 bp, Homo sapiens
gtgccatggatctgatc

SEQ ID NO: 792541 - DNA, 18 bp, Homo sapiens
gtgccatggccccccact

SEQ ID NO: 792542 - DNA, 19 bp, Homo sapiens
gtgccatgtcaaacaaata

SEQ ID NO: 792543 - DNA, 15 bp, Homo sapiens
gtgccattactactg

SEQ ID NO: 792544 - DNA, 17 bp, Homo sapiens
gtgccattactactgta

SEQ ID NO: 792545 - DNA, 16 bp, Homo sapiens
gtgccattatatttgc

SEQ ID NO: 792546 - DNA, 20 bp, Homo sapiens
gtgccattatatttgcatta

SEQ ID NO: 792547 - DNA, 13 bp, Homo sapiens
gtgccattcccag

SEQ ID NO: 792548 - DNA, 16 bp, Homo sapiens
gtgccattcccagcgt

SEQ ID NO: 792549 - DNA, 22 bp, Homo sapiens
gtgccattgtactccagcctgg

SEQ ID NO: 792550 - DNA, 15 bp, Homo sapiens
gtgcccaaaagccat

SEQ ID NO: 792551 - DNA, 14 bp, Homo sapiens
gtgcccaagtgggc

SEQ ID NO: 792552 - DNA, 21 bp, Homo sapiens
gtgcccaagtgggtccaagtg

SEQ ID NO: 792553 - DNA, 21 bp, Homo sapiens
gtgcccacaccggggacaggc

SEQ ID NO: 792554 - DNA, 13 bp, Homo sapiens
gtgcccacaggcc

SEQ ID NO: 792555 - DNA, 17 bp, Homo sapiens
gtgcccagaacttccct

SEQ ID NO: 792556 - DNA, 13 bp, Homo sapiens
gtgcccagcaggc

SEQ ID NO: 792557 - DNA, 17 bp, Homo sapiens
gtgcccagcaggcccag

SEQ ID NO: 792558 - DNA, 19 bp, Homo sapiens
gtgcccagcaggcccagca

SEQ ID NO: 792559 - DNA, 22 bp, Homo sapiens
gtgcccagcaggcccagcatgc

SEQ ID NO: 792560 - DNA, 17 bp, Homo sapiens
gtgcccaggcccttggc

SEQ ID NO: 792561 - DNA, 13 bp, Homo sapiens
gtgcccagggttt

SEQ ID NO: 792562 - DNA, 19 bp, Homo sapiens
gtgccccagactgagctct

SEQ ID NO: 792563 - DNA, 21 bp, Homo sapiens
gtgccccagactgagctctcc

SEQ ID NO: 792564 - DNA, 22 bp, Homo sapiens
gtgccccagactgagctctcca

SEQ ID NO: 792565 - DNA, 18 bp, Homo sapiens
gtgccccagggagtccag

SEQ ID NO: 792566 - DNA, 16 bp, Homo sapiens
gtgccccatgcctgtc

SEQ ID NO: 792567 - DNA, 18 bp, Homo sapiens
gtgccccatgcctgtcca

SEQ ID NO: 792568 - DNA, 13 bp, Homo sapiens
gtgcccccagagt

SEQ ID NO: 792569 - DNA, 14 bp, Homo sapiens
gtgcccccagcctc

SEQ ID NO: 792570 - DNA, 17 bp, Homo sapiens
gtgcccccagcctcagc

SEQ ID NO: 792571 - DNA, 21 bp, Homo sapiens
gtgcccccagcctcagcccaa

SEQ ID NO: 792572 - DNA, 23 bp, Homo sapiens
gtgcccccagcctcagcccaact

SEQ ID NO: 792573 - DNA, 20 bp, Homo sapiens
gtgccccccttgccagacat

SEQ ID NO: 792574 - DNA, 18 bp, Homo sapiens
gtgcccccgcctgccacc

SEQ ID NO: 792575 - DNA, 17 bp, Homo sapiens
gtgccccgcctccccga

SEQ ID NO: 792576 - DNA, 16 bp, Homo sapiens
gtgccccgcctgagtc

SEQ ID NO: 792577 - DNA, 13 bp, Homo sapiens
gtgcccctgctgc

SEQ ID NO: 792578 - DNA, 23 bp, Homo sapiens
gtgccccttaagggttgaaggca

SEQ ID NO: 792579 - DNA, 23 bp, Homo sapiens
gtgccccttgtcgcgcgtctccc

SEQ ID NO: 792580 - DNA, 21 bp, Homo sapiens
gtgcccctttccttcactgcc

SEQ ID NO: 792581 - DNA, 21 bp, Homo sapiens
gtgcccggggcagcagcagcc

SEQ ID NO: 792582 - DNA, 12 bp, Homo sapiens
gtgccctcacca

SEQ ID NO: 792583 - DNA, 13 bp, Homo sapiens
gtgccctcacccc

SEQ ID NO: 792584 - DNA, 23 bp, Homo sapiens
gtgccctcaccccaatccctgcc

SEQ ID NO: 792585 - DNA, 23 bp, Homo sapiens
gtgccctcctgagggaggacctg

SEQ ID NO: 792586 - DNA, 15 bp, Homo sapiens
gtgccctcgctgctt

SEQ ID NO: 792587 - DNA, 20 bp, Homo sapiens
gtgccctctgctcaggcctc

SEQ ID NO: 792588 - DNA, 21 bp, Homo sapiens
gtgccctgcaggcacagagga

SEQ ID NO: 792589 - DNA, 21 bp, Homo sapiens
gtgccctggaggctgacacag

SEQ ID NO: 792590 - DNA, 20 bp, Homo sapiens
gtgcccttggtagcagcctg

SEQ ID NO: 792591 - DNA, 15 bp, Homo sapiens
gtgccgcctgctcct

SEQ ID NO: 792592 - DNA, 20 bp, Homo sapiens
gtgccgggagaggactctgc

SEQ ID NO: 792593 - DNA, 23 bp, Homo sapiens
gtgccgtagggagtacctgctgc

SEQ ID NO: 792594 - DNA, 23 bp, Homo sapiens
gtgccgtgtcccctgacagggcc

SEQ ID NO: 792595 - DNA, 15 bp, Homo sapiens
gtgccgtgtgagtgt

SEQ ID NO: 792596 - DNA, 23 bp, Homo sapiens
gtgccgtgtgagtgtgacagggc

SEQ ID NO: 792597 - DNA, 20 bp, Homo sapiens
gtgcctaatggagaagaccc

SEQ ID NO: 792598 - DNA, 22 bp, Homo sapiens
gtgcctagattaggtagacttt

SEQ ID NO: 792599 - DNA, 20 bp, Homo sapiens
gtgcctcagagaccagggct

SEQ ID NO: 792600 - DNA, 14 bp, Homo sapiens
gtgcctcaggacct

SEQ ID NO: 792601 - DNA, 17 bp, Homo sapiens
gtgcctcaggccagggc

SEQ ID NO: 792602 - DNA, 23 bp, Homo sapiens
gtgcctcatagcatagccagcat

SEQ ID NO: 792603 - DNA, 21 bp, Homo sapiens
gtgcctccaccaccactggcc

SEQ ID NO: 792604 - DNA, 12 bp, Homo sapiens
gtgcctcccccc

SEQ ID NO: 792605 - DNA, 16 bp, Homo sapiens
gtgcctccccccagac

SEQ ID NO: 792606 - DNA, 13 bp, Homo sapiens
gtgcctcccttcc

SEQ ID NO: 792607 - DNA, 14 bp, Homo sapiens
gtgcctcccttccc

SEQ ID NO: 792608 - DNA, 18 bp, Homo sapiens
gtgcctcccttcccagtg

SEQ ID NO: 792609 - DNA, 22 bp, Homo sapiens
gtgcctcccttcccagtgggct

SEQ ID NO: 792610 - DNA, 10 bp, Homo sapiens
gtgcctcctg

SEQ ID NO: 792611 - DNA, 13 bp, Homo sapiens
gtgcctcctgcag

SEQ ID NO: 792612 - DNA, 22 bp, Homo sapiens
gtgcctctgcccaagcagcctg

SEQ ID NO: 792613 - DNA, 13 bp, Homo sapiens
gtgcctctgcctg

SEQ ID NO: 792614 - DNA, 18 bp, Homo sapiens
gtgcctctgtgcacagtg

SEQ ID NO: 792615 - DNA, 15 bp, Homo sapiens
gtgcctgagaggcag

SEQ ID NO: 792616 - DNA, 17 bp, Homo sapiens
gtgcctgagaggcaggc

SEQ ID NO: 792617 - DNA, 18 bp, Homo sapiens
gtgcctgagaggcaggca

SEQ ID NO: 792618 - DNA, 16 bp, Homo sapiens
gtgcctgcactgagag

SEQ ID NO: 792619 - DNA, 21 bp, Homo sapiens
gtgcctgcactgagagggcaa

SEQ ID NO: 792620 - DNA, 11 bp, Homo sapiens
gtgcctgcagc

SEQ ID NO: 792621 - DNA, 20 bp, Homo sapiens
gtgcctgcattcccaggaaa

SEQ ID NO: 792622 - DNA, 16 bp, Homo sapiens
gtgcctgctagagcaa

SEQ ID NO: 792623 - DNA, 19 bp, Homo sapiens
gtgcctgctagagcaaccc

SEQ ID NO: 792624 - DNA, 22 bp, Homo sapiens
gtgcctgctagagcaacccctg

SEQ ID NO: 792625 - DNA, 14 bp, Homo sapiens
gtgcctgctcagca

SEQ ID NO: 792626 - DNA, 20 bp, Homo sapiens
gtgcctgctcagcagccagt

SEQ ID NO: 792627 - DNA, 14 bp, Homo sapiens
gtgcctgcttctgt

SEQ ID NO: 792628 - DNA, 12 bp, Homo sapiens
gtgcctggaaga

SEQ ID NO: 792629 - DNA, 22 bp, Homo sapiens
gtgcctggacatttgccttgct

SEQ ID NO: 792630 - DNA, 19 bp, Homo sapiens
gtgcctggccagatttttc

SEQ ID NO: 792631 - DNA, 19 bp, Homo sapiens
gtgcctggcccattcttga

SEQ ID NO: 792632 - DNA, 16 bp, Homo sapiens
gtgcctggccccagcc

SEQ ID NO: 792633 - DNA, 22 bp, Homo sapiens
gtgcctggccgcagggcggggc

SEQ ID NO: 792634 - DNA, 15 bp, Homo sapiens
gtgcctgggaatgta

SEQ ID NO: 792635 - DNA, 17 bp, Homo sapiens
gtgcctgggaatgtatt

SEQ ID NO: 792636 - DNA, 11 bp, Homo sapiens
gtgcctgggat

SEQ ID NO: 792637 - DNA, 19 bp, Homo sapiens
gtgcctgggcccctcccct

SEQ ID NO: 792638 - DNA, 14 bp, Homo sapiens
gtgcctgggccctg

SEQ ID NO: 792639 - DNA, 17 bp, Homo sapiens
gtgcctgggtggggctg

SEQ ID NO: 792640 - DNA, 23 bp, Homo sapiens
gtgcctgggtggggctgctcctc

SEQ ID NO: 792641 - DNA, 23 bp, Homo sapiens
gtgcctgtaatctttttctccac

SEQ ID NO: 792642 - DNA, 15 bp, Homo sapiens
gtgccttgtccagga

SEQ ID NO: 792643 - DNA, 17 bp, Homo sapiens
gtgccttgtccaggaac

SEQ ID NO: 792644 - DNA, 19 bp, Homo sapiens
gtgccttgtccaggaactg

SEQ ID NO: 792645 - DNA, 18 bp, Homo sapiens
gtgcctttatctcagcca

SEQ ID NO: 792646 - DNA, 18 bp, Homo sapiens
gtgcctttcaaatttaga

SEQ ID NO: 792647 - DNA, 14 bp, Homo sapiens
gtgccttttatagc

SEQ ID NO: 792648 - DNA, 18 bp, Homo sapiens
gtgccttttgcacccctc

SEQ ID NO: 792649 - DNA, 22 bp, Homo sapiens
gtgccttttgcacccctcccat

SEQ ID NO: 792650 - DNA, 14 bp, Homo sapiens
gtgccttttggttt

SEQ ID NO: 792651 - DNA, 20 bp, Homo sapiens
gtgccttttggtttcacctt

SEQ ID NO: 792652 - DNA, 18 bp, Homo sapiens
gtgccttttgtgtgatgc

SEQ ID NO: 792653 - DNA, 18 bp, Homo sapiens
gtgccttttttcacggaa

SEQ ID NO: 792654 - DNA, 23 bp, Homo sapiens
gtgcgacagagagaggggagaga

SEQ ID NO: 792655 - DNA, 21 bp, Homo sapiens
gtgcgcagatctgtgcctggg

SEQ ID NO: 792656 - DNA, 16 bp, Homo sapiens
gtgcgcctgagtgagt

SEQ ID NO: 792657 - DNA, 17 bp, Homo sapiens
gtgcgcgtggcgtggcc

SEQ ID NO: 792658 - DNA, 22 bp, Homo sapiens
gtgcggacccttcccagccctc

SEQ ID NO: 792659 - DNA, 17 bp, Homo sapiens
gtgcggaggcaggagca

SEQ ID NO: 792660 - DNA, 14 bp, Homo sapiens
gtgcggcctcacca

SEQ ID NO: 792661 - DNA, 12 bp, Homo sapiens
gtgcggcctggg

SEQ ID NO: 792662 - DNA, 18 bp, Homo sapiens
gtgcggcggtcccagctc

SEQ ID NO: 792663 - DNA, 19 bp, Homo sapiens
gtgcggcgtgggggcactg

SEQ ID NO: 792664 - DNA, 17 bp, Homo sapiens
gtgcgggctgaggccag

SEQ ID NO: 792665 - DNA, 14 bp, Homo sapiens
gtgcgtgaaacaca

SEQ ID NO: 792666 - DNA, 14 bp, Homo sapiens
gtgcgtggctgtgg

SEQ ID NO: 792667 - DNA, 12 bp, Homo sapiens
gtgcgtgggtga

SEQ ID NO: 792668 - DNA, 13 bp, Homo sapiens
gtgcgtgtgtgca

SEQ ID NO: 792669 - DNA, 21 bp, Homo sapiens
gtgcgtgttagtgtgtgtgca

SEQ ID NO: 792670 - DNA, 23 bp, Homo sapiens
gtgctaaaaaattaaaccaagca

SEQ ID NO: 792671 - DNA, 16 bp, Homo sapiens
gtgctaagtctttccc

SEQ ID NO: 792672 - DNA, 18 bp, Homo sapiens
gtgctaagtctttcccaa

SEQ ID NO: 792673 - DNA, 13 bp, Homo sapiens
gtgctaagtgctt

SEQ ID NO: 792674 - DNA, 14 bp, Homo sapiens
gtgctaatatactt

SEQ ID NO: 792675 - DNA, 21 bp, Homo sapiens
gtgctacacccttttccagct

SEQ ID NO: 792676 - DNA, 22 bp, Homo sapiens
gtgctaccagagttaaagcata

SEQ ID NO: 792677 - DNA, 19 bp, Homo sapiens
gtgctacctgggtcctttt

SEQ ID NO: 792678 - DNA, 17 bp, Homo sapiens
gtgctagaacaatggga

SEQ ID NO: 792679 - DNA, 19 bp, Homo sapiens
gtgctagaatactttttaa

SEQ ID NO: 792680 - DNA, 23 bp, Homo sapiens
gtgctataatctgtttttacgta

SEQ ID NO: 792681 - DNA, 21 bp, Homo sapiens
gtgctatactgcatacttttt

SEQ ID NO: 792682 - DNA, 14 bp, Homo sapiens
gtgctatagtattt

SEQ ID NO: 792683 - DNA, 15 bp, Homo sapiens
gtgctatagtatttg

SEQ ID NO: 792684 - DNA, 17 bp, Homo sapiens
gtgctatgcggaggaaa

SEQ ID NO: 792685 - DNA, 19 bp, Homo sapiens
gtgctatggatggcttcta

SEQ ID NO: 792686 - DNA, 13 bp, Homo sapiens
gtgctattaatat

SEQ ID NO: 792687 - DNA, 14 bp, Homo sapiens
gtgctattctgtgt

SEQ ID NO: 792688 - DNA, 14 bp, Homo sapiens
gtgctatttctatt

SEQ ID NO: 792689 - DNA, 20 bp, Homo sapiens
gtgctatttctattccttat

SEQ ID NO: 792690 - DNA, 15 bp, Homo sapiens
gtgctcaccagccct

SEQ ID NO: 792691 - DNA, 18 bp, Homo sapiens
gtgctcaccagccctgca

SEQ ID NO: 792692 - DNA, 20 bp, Homo sapiens
gtgctcaccagccctgcagc

SEQ ID NO: 792693 - DNA, 17 bp, Homo sapiens
gtgctcacgctcccccg

SEQ ID NO: 792694 - DNA, 20 bp, Homo sapiens
gtgctcacgctcccccgcag

SEQ ID NO: 792695 - DNA, 21 bp, Homo sapiens
gtgctcacgctcccccgcagt

SEQ ID NO: 792696 - DNA, 23 bp, Homo sapiens
gtgctcacgttaccttgacacat

SEQ ID NO: 792697 - DNA, 19 bp, Homo sapiens
gtgctcagccaaatttcct

SEQ ID NO: 792698 - DNA, 14 bp, Homo sapiens
gtgctcattttgca

SEQ ID NO: 792699 - DNA, 20 bp, Homo sapiens
gtgctcccaaaacattttaa

SEQ ID NO: 792700 - DNA, 14 bp, Homo sapiens
gtgctcccacggcc

SEQ ID NO: 792701 - DNA, 14 bp, Homo sapiens
gtgctcccctgcca

SEQ ID NO: 792702 - DNA, 13 bp, Homo sapiens
gtgctccctccca

SEQ ID NO: 792703 - DNA, 14 bp, Homo sapiens
gtgctccctctgtc

SEQ ID NO: 792704 - DNA, 21 bp, Homo sapiens
gtgctcgagacacagtgaagc

SEQ ID NO: 792705 - DNA, 16 bp, Homo sapiens
gtgctcgccccagcag

SEQ ID NO: 792706 - DNA, 14 bp, Homo sapiens
gtgctcgccctgcg

SEQ ID NO: 792707 - DNA, 17 bp, Homo sapiens
gtgctctgaagtgtcct

SEQ ID NO: 792708 - DNA, 20 bp, Homo sapiens
gtgctctgaatgggagccag

SEQ ID NO: 792709 - DNA, 22 bp, Homo sapiens
gtgctctgaggtcaataaagca

SEQ ID NO: 792710 - DNA, 13 bp, Homo sapiens
gtgctctgcctca

SEQ ID NO: 792711 - DNA, 11 bp, Homo sapiens
gtgctctggcg

SEQ ID NO: 792712 - DNA, 22 bp, Homo sapiens
gtgctctggggatttctgggat

SEQ ID NO: 792713 - DNA, 18 bp, Homo sapiens
gtgctctgggggtccctt

SEQ ID NO: 792714 - DNA, 21 bp, Homo sapiens
gtgctcttggctgacccctct

SEQ ID NO: 792715 - DNA, 13 bp, Homo sapiens
gtgctgaacattg

SEQ ID NO: 792716 - DNA, 19 bp, Homo sapiens
gtgctgaatggttttcaaa

SEQ ID NO: 792717 - DNA, 20 bp, Homo sapiens
gtgctgaatggttttcaaaa

SEQ ID NO: 792718 - DNA, 18 bp, Homo sapiens
gtgctgacaacttagctc

SEQ ID NO: 792719 - DNA, 20 bp, Homo sapiens
gtgctgacaacttagctcag

SEQ ID NO: 792720 - DNA, 21 bp, Homo sapiens
gtgctgacaacttagctcagg

SEQ ID NO: 792721 - DNA, 20 bp, Homo sapiens
gtgctgacaatactgctgcc

SEQ ID NO: 792722 - DNA, 22 bp, Homo sapiens
gtgctgacgggacccacatgct

SEQ ID NO: 792723 - DNA, 18 bp, Homo sapiens
gtgctgagattgcagatg

SEQ ID NO: 792724 - DNA, 14 bp, Homo sapiens
gtgctgaggccagg

SEQ ID NO: 792725 - DNA, 19 bp, Homo sapiens
gtgctgaggggcactctcc

SEQ ID NO: 792726 - DNA, 22 bp, Homo sapiens
gtgctgatcgtgctaaattttc

SEQ ID NO: 792727 - DNA, 15 bp, Homo sapiens
gtgctgatgtttaca

SEQ ID NO: 792728 - DNA, 13 bp, Homo sapiens
gtgctgcaggagt

SEQ ID NO: 792729 - DNA, 18 bp, Homo sapiens
gtgctgcaggtggcagag

SEQ ID NO: 792730 - DNA, 12 bp, Homo sapiens
gtgctgcattta

SEQ ID NO: 792731 - DNA, 20 bp, Homo sapiens
gtgctgcatttaaaagatac

SEQ ID NO: 792732 - DNA, 14 bp, Homo sapiens
gtgctgccatgcca

SEQ ID NO: 792733 - DNA, 19 bp, Homo sapiens
gtgctgccatgccactgcc

SEQ ID NO: 792734 - DNA, 23 bp, Homo sapiens
gtgctgccatgccactgccaggc

SEQ ID NO: 792735 - DNA, 16 bp, Homo sapiens
gggaacacagttctgg

SEQ ID NO: 792736 - DNA, 15 bp, Homo sapiens
gggaacagacaggag

SEQ ID NO: 792737 - DNA, 19 bp, Homo sapiens
gggaacaggccccacgccc

SEQ ID NO: 792738 - DNA, 20 bp, Homo sapiens
gggaacagtgtttcccataa

SEQ ID NO: 792739 - DNA, 17 bp, Homo sapiens
gggaacatgacccagcc

SEQ ID NO: 792740 - DNA, 15 bp, Homo sapiens
gggaaccactcccac

SEQ ID NO: 792741 - DNA, 22 bp, Homo sapiens
gtggccacgttcagggaggggc

SEQ ID NO: 792742 - DNA, 15 bp, Homo sapiens
gtggccagagctgga

SEQ ID NO: 792743 - DNA, 13 bp, Homo sapiens
gtggccagcccgg

SEQ ID NO: 792744 - DNA, 14 bp, Homo sapiens
gtggccagcccggc

SEQ ID NO: 792745 - DNA, 13 bp, Homo sapiens
gtggccaggcctt

SEQ ID NO: 792746 - DNA, 23 bp, Homo sapiens
gtggccagggcttccccatcagc

SEQ ID NO: 792747 - DNA, 17 bp, Homo sapiens
gtggccatatatgctgt

SEQ ID NO: 792748 - DNA, 21 bp, Homo sapiens
gtggccatatatgctgtattt

SEQ ID NO: 792749 - DNA, 17 bp, Homo sapiens
gtggccatcactcagcc

SEQ ID NO: 792750 - DNA, 15 bp, Homo sapiens
gtggccatccctggg

SEQ ID NO: 792751 - DNA, 19 bp, Homo sapiens
gtggccatccctgggcccc

SEQ ID NO: 792752 - DNA, 20 bp, Homo sapiens
gtggccatccctgggcccct

SEQ ID NO: 792753 - DNA, 12 bp, Homo sapiens
gtggccatggcc

SEQ ID NO: 792754 - DNA, 19 bp, Homo sapiens
gtggccatggcctctgcaa

SEQ ID NO: 792755 - DNA, 19 bp, Homo sapiens
gtggccatgttatgctggt

SEQ ID NO: 792756 - DNA, 14 bp, Homo sapiens
gtggcccagagcct

SEQ ID NO: 792757 - DNA, 12 bp, Homo sapiens
gtggcccaggcc

SEQ ID NO: 792758 - DNA, 15 bp, Homo sapiens
gtggccccaagaggg

SEQ ID NO: 792759 - DNA, 19 bp, Homo sapiens
gtggccccaccctgggccc

SEQ ID NO: 792760 - DNA, 23 bp, Homo sapiens
gtggccccaccctgggccctggg

SEQ ID NO: 792761 - DNA, 13 bp, Homo sapiens
gtggcccccgggc

SEQ ID NO: 792762 - DNA, 15 bp, Homo sapiens
gtggcccccgggcct

SEQ ID NO: 792763 - DNA, 21 bp, Homo sapiens
gtggcccccgggcctgcacag

SEQ ID NO: 792764 - DNA, 16 bp, Homo sapiens
gtggccccttttactt

SEQ ID NO: 792765 - DNA, 16 bp, Homo sapiens
gtggcccgacagcctg

SEQ ID NO: 792766 - DNA, 18 bp, Homo sapiens
gtggcccgacagcctggc

SEQ ID NO: 792767 - DNA, 17 bp, Homo sapiens
gtggcccgtggcctggc

SEQ ID NO: 792768 - DNA, 13 bp, Homo sapiens
gtggccctccctc

SEQ ID NO: 792769 - DNA, 14 bp, Homo sapiens
gtggccctccctca

SEQ ID NO: 792770 - DNA, 23 bp, Homo sapiens
gtggccctgactgtcagggaggg

SEQ ID NO: 792771 - DNA, 21 bp, Homo sapiens
gtggccctgccatcttcccag

SEQ ID NO: 792772 - DNA, 16 bp, Homo sapiens
gtggccgcacgcctct

SEQ ID NO: 792773 - DNA, 17 bp, Homo sapiens
gtggccgcccaaggccc

SEQ ID NO: 792774 - DNA, 14 bp, Homo sapiens
gtggccgctcctcc

SEQ ID NO: 792775 - DNA, 21 bp, Homo sapiens
gtggccgctcctccctgctcc

SEQ ID NO: 792776 - DNA, 18 bp, Homo sapiens
gtggccgtcacgctttca

SEQ ID NO: 792777 - DNA, 18 bp, Homo sapiens
gtggccgtctcctccctc

SEQ ID NO: 792778 - DNA, 19 bp, Homo sapiens
gtggcctacaaatcagtaa

SEQ ID NO: 792779 - DNA, 18 bp, Homo sapiens
gtggcctagagcactctc

SEQ ID NO: 792780 - DNA, 9 bp, Homo sapiens
gtggcctca

SEQ ID NO: 792781 - DNA, 20 bp, Homo sapiens
gtggcctcaaccctccctca

SEQ ID NO: 792782 - DNA, 15 bp, Homo sapiens
gtggcctcagccctc

SEQ ID NO: 792783 - DNA, 18 bp, Homo sapiens
gtggcctcagccctcaga

SEQ ID NO: 792784 - DNA, 13 bp, Homo sapiens
gtggcctccctgc

SEQ ID NO: 792785 - DNA, 17 bp, Homo sapiens
gtggcctccctggctcc

SEQ ID NO: 792786 - DNA, 18 bp, Homo sapiens
gtggcctccgcagtgtct

SEQ ID NO: 792787 - DNA, 14 bp, Homo sapiens
gtggcctctctctc

SEQ ID NO: 792788 - DNA, 14 bp, Homo sapiens
gtggcctctgcctg

SEQ ID NO: 792789 - DNA, 17 bp, Homo sapiens
gtggcctcttgagcagt

SEQ ID NO: 792790 - DNA, 17 bp, Homo sapiens
gtggcctgcccagcctc

SEQ ID NO: 792791 - DNA, 18 bp, Homo sapiens
gtggcctggcatctgtgc

SEQ ID NO: 792792 - DNA, 13 bp, Homo sapiens
gtggcctggccag

SEQ ID NO: 792793 - DNA, 20 bp, Homo sapiens
gtggcctggccaggagctct

SEQ ID NO: 792794 - DNA, 21 bp, Homo sapiens
gtggcctggccaggagctctt

SEQ ID NO: 792795 - DNA, 17 bp, Homo sapiens
gtggcctggccctcctg

SEQ ID NO: 792796 - DNA, 12 bp, Homo sapiens
gtggcctgggca

SEQ ID NO: 792797 - DNA, 17 bp, Homo sapiens
gtggcctgggcttggcc

SEQ ID NO: 792798 - DNA, 18 bp, Homo sapiens
gtggcctgggcttggccc

SEQ ID NO: 792799 - DNA, 19 bp, Homo sapiens
gtggcctggtgggtcaggg

SEQ ID NO: 792800 - DNA, 19 bp, Homo sapiens
gtggccttccccagcatgc

SEQ ID NO: 792801 - DNA, 19 bp, Homo sapiens
gtggccttggccggctgtg

SEQ ID NO: 792802 - DNA, 21 bp, Homo sapiens
gtggccttggccggctgtgct

SEQ ID NO: 792803 - DNA, 15 bp, Homo sapiens
gtggccttgggagga

SEQ ID NO: 792804 - DNA, 17 bp, Homo sapiens
gtggccttttttataac

SEQ ID NO: 792805 - DNA, 14 bp, Homo sapiens
gtggcgctggtgca

SEQ ID NO: 792806 - DNA, 15 bp, Homo sapiens
gtggcgggcgcctgt

SEQ ID NO: 792807 - DNA, 13 bp, Homo sapiens
gtggcggggtggg

SEQ ID NO: 792808 - DNA, 16 bp, Homo sapiens
gtggcggggtggggtg

SEQ ID NO: 792809 - DNA, 19 bp, Homo sapiens
gtggcgtgagctgcccggc

SEQ ID NO: 792810 - DNA, 18 bp, Homo sapiens
gtggcgttatggcagccc

SEQ ID NO: 792811 - DNA, 22 bp, Homo sapiens
gtggcgttatggcagcccggct

SEQ ID NO: 792812 - DNA, 22 bp, Homo sapiens
gtggctagcaaattagaaacac

SEQ ID NO: 792813 - DNA, 19 bp, Homo sapiens
gtggctagtcaagctcctc

SEQ ID NO: 792814 - DNA, 23 bp, Homo sapiens
gtggctagtggggtgaacagctg

SEQ ID NO: 792815 - DNA, 16 bp, Homo sapiens
gtggctcacgcctgta

SEQ ID NO: 792816 - DNA, 22 bp, Homo sapiens
gtggctcacgcctgtaatccca

SEQ ID NO: 792817 - DNA, 23 bp, Homo sapiens
gtggctcacgcctgtaatcccag

SEQ ID NO: 792818 - DNA, 16 bp, Homo sapiens
gtggctcactggctgg

SEQ ID NO: 792819 - DNA, 19 bp, Homo sapiens
gtggctcactggctgggag

SEQ ID NO: 792820 - DNA, 22 bp, Homo sapiens
gtggctcagtgccacctatgcc

SEQ ID NO: 792821 - DNA, 17 bp, Homo sapiens
gtggctccccacctgga

SEQ ID NO: 792822 - DNA, 20 bp, Homo sapiens
gtggctccccacctggacac

SEQ ID NO: 792823 - DNA, 16 bp, Homo sapiens
gtggctccccctctgc

SEQ ID NO: 792824 - DNA, 17 bp, Homo sapiens
gtggctccccctctgct

SEQ ID NO: 792825 - DNA, 15 bp, Homo sapiens
gtggctcctcccagc

SEQ ID NO: 792826 - DNA, 15 bp, Homo sapiens
gtggctcctcctagg

SEQ ID NO: 792827 - DNA, 15 bp, Homo sapiens
gtggctcctggtaac

SEQ ID NO: 792828 - DNA, 15 bp, Homo sapiens
gtggctctgctggcc

SEQ ID NO: 792829 - DNA, 14 bp, Homo sapiens
gtggctgacccagt

SEQ ID NO: 792830 - DNA, 19 bp, Homo sapiens
gtggctgacccagtccctg

SEQ ID NO: 792831 - DNA, 17 bp, Homo sapiens
gtggctgaggccaccca

SEQ ID NO: 792832 - DNA, 19 bp, Homo sapiens
gtggctgccacacccaggg

SEQ ID NO: 792833 - DNA, 22 bp, Homo sapiens
gtggctgcctttgatcacagga

SEQ ID NO: 792834 - DNA, 23 bp, Homo sapiens
gtggctgcctttgatcacaggag

SEQ ID NO: 792835 - DNA, 19 bp, Homo sapiens
gtggctgctagcacttgga

SEQ ID NO: 792836 - DNA, 24 bp, Homo sapiens
gtggctggaaccacattgaagaat

SEQ ID NO: 792837 - DNA, 12 bp, Homo sapiens
gtggctggaaga

SEQ ID NO: 792838 - DNA, 22 bp, Homo sapiens
gtggctggcctttcaggtccag

SEQ ID NO: 792839 - DNA, 12 bp, Homo sapiens
gtggctggctct

SEQ ID NO: 792840 - DNA, 16 bp, Homo sapiens
gtggctggctctacct

SEQ ID NO: 792841 - DNA, 12 bp, Homo sapiens
gtggctgggtgc

SEQ ID NO: 792842 - DNA, 20 bp, Homo sapiens
gtggctgggtgggcccagaa

SEQ ID NO: 792843 - DNA, 16 bp, Homo sapiens
gtggctggtagaaaaa

SEQ ID NO: 792844 - DNA, 12 bp, Homo sapiens
gtggctggtctg

SEQ ID NO: 792845 - DNA, 13 bp, Homo sapiens
gtggctggtgccc

SEQ ID NO: 792846 - DNA, 14 bp, Homo sapiens
gtggctggtgtccc

SEQ ID NO: 792847 - DNA, 18 bp, Homo sapiens
gtggctggtgtccccttc

SEQ ID NO: 792848 - DNA, 21 bp, Homo sapiens
gtggctggtgtccccttcccc

SEQ ID NO: 792849 - DNA, 23 bp, Homo sapiens
gtggctggtgtccccttcccctg

SEQ ID NO: 792850 - DNA, 20 bp, Homo sapiens
gtggctgtgacaaccctggc

SEQ ID NO: 792851 - DNA, 16 bp, Homo sapiens
gtggctgtgacatcta

SEQ ID NO: 792852 - DNA, 15 bp, Homo sapiens
gtggctgtggcacag

SEQ ID NO: 792853 - DNA, 13 bp, Homo sapiens
gtggcttcccagc

SEQ ID NO: 792854 - DNA, 15 bp, Homo sapiens
gtggcttctctgtct

SEQ ID NO: 792855 - DNA, 16 bp, Homo sapiens
gtggcttggcatctgt

SEQ ID NO: 792856 - DNA, 17 bp, Homo sapiens
gtggctttcaaggctgg

SEQ ID NO: 792857 - DNA, 20 bp, Homo sapiens
gtggctttcaaggctggggc

SEQ ID NO: 792858 - DNA, 21 bp, Homo sapiens
gtggctttcaaggctggggca

SEQ ID NO: 792859 - DNA, 16 bp, Homo sapiens
gtggctttggcagtgt

SEQ ID NO: 792860 - DNA, 17 bp, Homo sapiens
gtgggaactgtgcaaag

SEQ ID NO: 792861 - DNA, 23 bp, Homo sapiens
gtgggaactgtgcaaagggctgc

SEQ ID NO: 792862 - DNA, 17 bp, Homo sapiens
gtgggaagcgtctgtcc

SEQ ID NO: 792863 - DNA, 11 bp, Homo sapiens
gtgggaaggaa

SEQ ID NO: 792864 - DNA, 18 bp, Homo sapiens
gtgggaaggaaaggcaga

SEQ ID NO: 792865 - DNA, 13 bp, Homo sapiens
gtgggaaggccag

SEQ ID NO: 792866 - DNA, 11 bp, Homo sapiens
gtgtgctgctg

SEQ ID NO: 792867 - DNA, 12 bp, Homo sapiens
gtgtgctgctgc

SEQ ID NO: 792868 - DNA, 13 bp, Homo sapiens
gtgtgctgctgct

SEQ ID NO: 792869 - DNA, 23 bp, Homo sapiens
gtgtgctgtatggcccaggcagc

SEQ ID NO: 792870 - DNA, 16 bp, Homo sapiens
gtgtgctgtggccagg

SEQ ID NO: 792871 - DNA, 15 bp, Homo sapiens
gtgtgctgtttgaaa

SEQ ID NO: 792872 - DNA, 17 bp, Homo sapiens
gtgtgctgtttgaaaat

SEQ ID NO: 792873 - DNA, 17 bp, Homo sapiens
gtgtgctttttttgtgt

SEQ ID NO: 792874 - DNA, 13 bp, Homo sapiens
gtgtggagaagcg

SEQ ID NO: 792875 - DNA, 21 bp, Homo sapiens
gtgtggagaccctgccacagc

SEQ ID NO: 792876 - DNA, 17 bp, Homo sapiens
gtgtggagagagaggct

SEQ ID NO: 792877 - DNA, 11 bp, Homo sapiens
gtgtggagcag

SEQ ID NO: 792878 - DNA, 19 bp, Homo sapiens
gtgtggagttcaccttgga

SEQ ID NO: 792879 - DNA, 12 bp, Homo sapiens
gtgtggcagcca

SEQ ID NO: 792880 - DNA, 18 bp, Homo sapiens
gtgtggccaaccaggacc

SEQ ID NO: 792881 - DNA, 19 bp, Homo sapiens
gtgtggccaaccaggaccc

SEQ ID NO: 792882 - DNA, 13 bp, Homo sapiens
gtgtggccaggct

SEQ ID NO: 792883 - DNA, 17 bp, Homo sapiens
gtgtggccatcactcag

SEQ ID NO: 792884 - DNA, 15 bp, Homo sapiens
gtgtggcccgtggcc

SEQ ID NO: 792885 - DNA, 21 bp, Homo sapiens
gtgtggcctcagccctcagaa

SEQ ID NO: 792886 - DNA, 12 bp, Homo sapiens
gtgtggcctccg

SEQ ID NO: 792887 - DNA, 17 bp, Homo sapiens
gtgtggcctccgtcctg

SEQ ID NO: 792888 - DNA, 19 bp, Homo sapiens
gtgtggctcacgtgtgtga

SEQ ID NO: 792889 - DNA, 12 bp, Homo sapiens
gtgtggctttcc

SEQ ID NO: 792890 - DNA, 16 bp, Homo sapiens
gtgtgggaagggagag

SEQ ID NO: 792891 - DNA, 18 bp, Homo sapiens
gtgtgggatggagagtgg

SEQ ID NO: 792892 - DNA, 13 bp, Homo sapiens
gtgtggggtgggg

SEQ ID NO: 792893 - DNA, 14 bp, Homo sapiens
gtgtggggtggggt

SEQ ID NO: 792894 - DNA, 18 bp, Homo sapiens
gtgttccccttccactga

SEQ ID NO: 792895 - DNA, 17 bp, Homo sapiens
gtgttcctatggaaaca

SEQ ID NO: 792896 - DNA, 14 bp, Homo sapiens
gtgttcctccattt

SEQ ID NO: 792897 - DNA, 22 bp, Homo sapiens
gtgttcctcggtgggccagagc

SEQ ID NO: 792898 - DNA, 23 bp, Homo sapiens
gtgttcctcggtgggccagagct

SEQ ID NO: 792899 - DNA, 17 bp, Homo sapiens
gtgttcctgaagctgct

SEQ ID NO: 792900 - DNA, 11 bp, Homo sapiens
gtgttcctgga

SEQ ID NO: 792901 - DNA, 19 bp, Homo sapiens
gtgttcgggggagcagaga

SEQ ID NO: 792902 - DNA, 21 bp, Homo sapiens
gtgttcgtttccatcatgtct

SEQ ID NO: 792903 - DNA, 16 bp, Homo sapiens
gtgttctgctcctgct

SEQ ID NO: 792904 - DNA, 18 bp, Homo sapiens
gtgttctgctcctgcttt

SEQ ID NO: 792905 - DNA, 16 bp, Homo sapiens
gtgttctgttgaaggt

SEQ ID NO: 792906 - DNA, 20 bp, Homo sapiens
gtgttctgttgaaggtgcca

SEQ ID NO: 792907 - DNA, 17 bp, Homo sapiens
gtgttcttcgtatatac

SEQ ID NO: 792908 - DNA, 13 bp, Homo sapiens
gtgttctttcctg

SEQ ID NO: 792909 - DNA, 20 bp, Homo sapiens
gtgttctttcctgccctgtc

SEQ ID NO: 792910 - DNA, 17 bp, Homo sapiens
gtgttgaaaatgttcag

SEQ ID NO: 792911 - DNA, 16 bp, Homo sapiens
gtgttgaaatggcatt

SEQ ID NO: 792912 - DNA, 18 bp, Homo sapiens
gtgttgaacacaattgat

SEQ ID NO: 792913 - DNA, 11 bp, Homo sapiens
gtgttgacact

SEQ ID NO: 792914 - DNA, 18 bp, Homo sapiens
gtgttgactttataaatt

SEQ ID NO: 792915 - DNA, 15 bp, Homo sapiens
gtgttgatcccaaga

SEQ ID NO: 792916 - DNA, 12 bp, Homo sapiens
gtgttgatctta

SEQ ID NO: 792917 - DNA, 19 bp, Homo sapiens
gtgttgattttctgttgta

SEQ ID NO: 792918 - DNA, 14 bp, Homo sapiens
gtgttgcactgaac

SEQ ID NO: 792919 - DNA, 17 bp, Homo sapiens
gtgttgccaaatatgtc

SEQ ID NO: 792920 - DNA, 19 bp, Homo sapiens
gtgttgccaaatatgtcct

SEQ ID NO: 792921 - DNA, 18 bp, Homo sapiens
gtgttgcgtgtcgtgggt

SEQ ID NO: 792922 - DNA, 16 bp, Homo sapiens
gtgttggaaactgtaa

SEQ ID NO: 792923 - DNA, 14 bp, Homo sapiens
gtgttggacagaga

SEQ ID NO: 792924 - DNA, 21 bp, Homo sapiens
gtgttggctaatgaagggaaa

SEQ ID NO: 792925 - DNA, 19 bp, Homo sapiens
gtgttggctgtgtgacaga

SEQ ID NO: 792926 - DNA, 20 bp, Homo sapiens
gtgttgggaaggggtcctgc

SEQ ID NO: 792927 - DNA, 22 bp, Homo sapiens
gtgttgggaaggggtcctgcag

SEQ ID NO: 792928 - DNA, 23 bp, Homo sapiens
gtgttgggaaggggtcctgcagg

SEQ ID NO: 792929 - DNA, 18 bp, Homo sapiens
gtgttggtttacagggta

SEQ ID NO: 792930 - DNA, 14 bp, Homo sapiens
gtgttgtattaaca

SEQ ID NO: 792931 - DNA, 16 bp, Homo sapiens
gtgttgtcagcaggca

SEQ ID NO: 792932 - DNA, 23 bp, Homo sapiens
gtgttgtcccatctgccctccct

SEQ ID NO: 792933 - DNA, 15 bp, Homo sapiens
gtgttgtctcttgag

SEQ ID NO: 792934 - DNA, 16 bp, Homo sapiens
gtgttgtcttgaaaga

SEQ ID NO: 792935 - DNA, 20 bp, Homo sapiens
gtgttgtgggcttcctgctg

SEQ ID NO: 792936 - DNA, 14 bp, Homo sapiens
gtgttgtgtctgtg

SEQ ID NO: 792937 - DNA, 12 bp, Homo sapiens
gtgtttaaaaaa

SEQ ID NO: 792938 - DNA, 22 bp, Homo sapiens
gtgtttaaaaagtaagttaata

SEQ ID NO: 792939 - DNA, 18 bp, Homo sapiens
gtgtttaaagagaggtta

SEQ ID NO: 792940 - DNA, 11 bp, Homo sapiens
gtgtttaaata

SEQ ID NO: 792941 - DNA, 18 bp, Homo sapiens
gtgtttactatgtgccag

SEQ ID NO: 792942 - DNA, 15 bp, Homo sapiens
gtgtttatcctttca

SEQ ID NO: 792943 - DNA, 20 bp, Homo sapiens
gtgtttatttttcatattgt

SEQ ID NO: 792944 - DNA, 11 bp, Homo sapiens
gtgtttcaatt

SEQ ID NO: 792945 - DNA, 18 bp, Homo sapiens
gtgtttcaattctgtaat

SEQ ID NO: 792946 - DNA, 18 bp, Homo sapiens
gtgtttcacttaatgttt

SEQ ID NO: 792947 - DNA, 13 bp, Homo sapiens
gtgtttcattggt

SEQ ID NO: 792948 - DNA, 16 bp, Homo sapiens
gtgtttcccttcctcg

SEQ ID NO: 792949 - DNA, 19 bp, Homo sapiens
gtgtttcgcgggtaactgg

SEQ ID NO: 792950 - DNA, 11 bp, Homo sapiens
gtgtttctagg

SEQ ID NO: 792951 - DNA, 17 bp, Homo sapiens
gtgtttctgacacaaga

SEQ ID NO: 792952 - DNA, 13 bp, Homo sapiens
gtgtttctgactc

SEQ ID NO: 792953 - DNA, 11 bp, Homo sapiens
gtgtttctgta

SEQ ID NO: 792954 - DNA, 20 bp, Homo sapiens
gtgtttctgtcctgtaactg

SEQ ID NO: 792955 - DNA, 15 bp, Homo sapiens
gtgtttctgttatta

SEQ ID NO: 792956 - DNA, 15 bp, Homo sapiens
gtgtttcttctggct

SEQ ID NO: 792957 - DNA, 18 bp, Homo sapiens
gtgtttgcaaaggttaaa

SEQ ID NO: 792958 - DNA, 20 bp, Homo sapiens
gtgtttgcagcctgctctag

SEQ ID NO: 792959 - DNA, 23 bp, Homo sapiens
gtgtttgcctaaaacaatctaaa

SEQ ID NO: 792960 - DNA, 14 bp, Homo sapiens
gtgtttgcttaaaa

SEQ ID NO: 792961 - DNA, 21 bp, Homo sapiens
gtgtttggatacatctgctgt

SEQ ID NO: 792962 - DNA, 14 bp, Homo sapiens
gtgtttgtctgtgt

SEQ ID NO: 792963 - DNA, 11 bp, Homo sapiens
gtgtttgtgtt

SEQ ID NO: 792964 - DNA, 23 bp, Homo sapiens
gtgtttgttcataataaaagtga

SEQ ID NO: 792965 - DNA, 21 bp, Homo sapiens
gtgttttaagactgaatgttt

SEQ ID NO: 792966 - DNA, 14 bp, Homo sapiens
gtgttttaattgta

SEQ ID NO: 792967 - DNA, 14 bp, Homo sapiens
gtgttttaatttaa

SEQ ID NO: 792968 - DNA, 15 bp, Homo sapiens
gtgttttaatttaaa

SEQ ID NO: 792969 - DNA, 21 bp, Homo sapiens
gtgttttataggagagattgg

SEQ ID NO: 792970 - DNA, 14 bp, Homo sapiens
gtgttttcaaggaa

SEQ ID NO: 792971 - DNA, 15 bp, Homo sapiens
gtgttttcataataa

SEQ ID NO: 792972 - DNA, 19 bp, Homo sapiens
gtgttttcatcatttcagc

SEQ ID NO: 792973 - DNA, 17 bp, Homo sapiens
gtgttttcccaaagcac

SEQ ID NO: 792974 - DNA, 18 bp, Homo sapiens
gtgttttctgaataacat

SEQ ID NO: 792975 - DNA, 19 bp, Homo sapiens
gtgttttctgaataacatt

SEQ ID NO: 792976 - DNA, 12 bp, Homo sapiens
gtgttttgctgt

SEQ ID NO: 792977 - DNA, 19 bp, Homo sapiens
gtgttttgtcctgcctctt

SEQ ID NO: 792978 - DNA, 18 bp, Homo sapiens
gtgttttgttttttaagg

SEQ ID NO: 792979 - DNA, 19 bp, Homo sapiens
gtgtttttctgcttttgaa

SEQ ID NO: 792980 - DNA, 13 bp, Homo sapiens
gtgttttttaaga

SEQ ID NO: 792981 - DNA, 21 bp, Homo sapiens
gtgttttttaagatagtgtaa

SEQ ID NO: 792982 - DNA, 15 bp, Homo sapiens
gtgttttttgttact

SEQ ID NO: 792983 - DNA, 16 bp, Homo sapiens
gtgttttttgttactg

SEQ ID NO: 792984 - DNA, 17 bp, Homo sapiens
gtgttttttgttactgt

SEQ ID NO: 792985 - DNA, 23 bp, Homo sapiens
gtgtttttttccctctcctgtcc

SEQ ID NO: 792986 - DNA, 18 bp, Homo sapiens
gttaaaaaacaaatgttc

SEQ ID NO: 792987 - DNA, 20 bp, Homo sapiens
gttaaaaaggccaaagataa

SEQ ID NO: 792988 - DNA, 21 bp, Homo sapiens
gttaaaaaggccaaagataaa

SEQ ID NO: 792989 - DNA, 23 bp, Homo sapiens
gttaaaacaaccagttaaagcca

SEQ ID NO: 792990 - DNA, 20 bp, Homo sapiens
gttaaaagactgcagctgct

SEQ ID NO: 792991 - DNA, 21 bp, Homo sapiens
gttaaaagactgcagctgctg

SEQ ID NO: 792992 - DNA, 22 bp, Homo sapiens
gttaaaagactgcagctgctga

SEQ ID NO: 792993 - DNA, 14 bp, Homo sapiens
gttaaaagcatttt

SEQ ID NO: 792994 - DNA, 23 bp, Homo sapiens
gttaaaagggaacacaaaacatt

SEQ ID NO: 792995 - DNA, 15 bp, Homo sapiens
gttaaaataaagcct

SEQ ID NO: 792996 - DNA, 22 bp, Homo sapiens
gttaaaataaagcctatttttc

SEQ ID NO: 792997 - DNA, 22 bp, Homo sapiens
gttaaaatacagttctgtcata

SEQ ID NO: 792998 - DNA, 17 bp, Homo sapiens
gttaaaatcacatttta

SEQ ID NO: 792999 - DNA, 15 bp, Homo sapiens
gttaaaattccatcc

SEQ ID NO: 793000 - DNA, 14 bp, Homo sapiens
gttaaacattgaag

SEQ ID NO: 793001 - DNA, 23 bp, Homo sapiens
gttaaacggtgcccatcctgcca

SEQ ID NO: 793002 - DNA, 21 bp, Homo sapiens
gttaaactaaaaaaaaaaagg

SEQ ID NO: 793003 - DNA, 23 bp, Homo sapiens
gttaaactattagagtatttccc

SEQ ID NO: 793004 - DNA, 15 bp, Homo sapiens
gttaaactgattagt

SEQ ID NO: 793005 - DNA, 19 bp, Homo sapiens
gttaaacttacttagtgtt

SEQ ID NO: 793006 - DNA, 15 bp, Homo sapiens
gttaaagaaaggaaa

SEQ ID NO: 793007 - DNA, 12 bp, Homo sapiens
gttaaagatgca

SEQ ID NO: 793008 - DNA, 11 bp, Homo sapiens
gttaaagcaga

SEQ ID NO: 793009 - DNA, 14 bp, Homo sapiens
gttaaagctaaact

SEQ ID NO: 793010 - DNA, 15 bp, Homo sapiens
gttaaagctaaactg

SEQ ID NO: 793011 - DNA, 20 bp, Homo sapiens
gttaaagctggaacatttga

SEQ ID NO: 793012 - DNA, 16 bp, Homo sapiens
gttaaagctgtacacc

SEQ ID NO: 793013 - DNA, 14 bp, Homo sapiens
gttaaagcttattt

SEQ ID NO: 793014 - DNA, 23 bp, Homo sapiens
gttaaagcttatttttatgtggt

SEQ ID NO: 793015 - DNA, 22 bp, Homo sapiens
gttaaaggcagtccagagcttt

SEQ ID NO: 793016 - DNA, 23 bp, Homo sapiens
gttaaaggctcgattttgtatct

SEQ ID NO: 793017 - DNA, 15 bp, Homo sapiens
gttaaataactgtgt

SEQ ID NO: 793018 - DNA, 15 bp, Homo sapiens
gttaaatactgtgca

SEQ ID NO: 793019 - DNA, 17 bp, Homo sapiens
gttccagttcccatggt

SEQ ID NO: 793020 - DNA, 23 bp, Homo sapiens
gttccagttcccatggtgtatgt

SEQ ID NO: 793021 - DNA, 21 bp, Homo sapiens
gttccatctcctataatctgt

SEQ ID NO: 793022 - DNA, 22 bp, Homo sapiens
gttccatctcctataatctgtc

SEQ ID NO: 793023 - DNA, 23 bp, Homo sapiens
gttccatgaagaccacatccaca

SEQ ID NO: 793024 - DNA, 20 bp, Homo sapiens
gttccatgagttatcatgaa

SEQ ID NO: 793025 - DNA, 15 bp, Homo sapiens
gttccatgcctgagg

SEQ ID NO: 793026 - DNA, 17 bp, Homo sapiens
gttccatgcctgagggt

SEQ ID NO: 793027 - DNA, 23 bp, Homo sapiens
gttccattgaagccgactctggc

SEQ ID NO: 793028 - DNA, 12 bp, Homo sapiens
gttcccaaggac

SEQ ID NO: 793029 - DNA, 22 bp, Homo sapiens
gttcccaaggacatgagtctgt

SEQ ID NO: 793030 - DNA, 18 bp, Homo sapiens
gttcccacattaaagaag

SEQ ID NO: 793031 - DNA, 21 bp, Homo sapiens
gttcccacattaaagaagacc

SEQ ID NO: 793032 - DNA, 22 bp, Homo sapiens
gttcccagtgacacttcagaga

SEQ ID NO: 793033 - DNA, 17 bp, Homo sapiens
gttcccatgtagccccc

SEQ ID NO: 793034 - DNA, 20 bp, Homo sapiens
gttccccagagagcaggcag

SEQ ID NO: 793035 - DNA, 12 bp, Homo sapiens
gttcccccagca

SEQ ID NO: 793036 - DNA, 13 bp, Homo sapiens
gttcccccagcaa

SEQ ID NO: 793037 - DNA, 17 bp, Homo sapiens
gttccccgctccacaga

SEQ ID NO: 793038 - DNA, 23 bp, Homo sapiens
gttcccctcagaaaaaaattcat

SEQ ID NO: 793039 - DNA, 19 bp, Homo sapiens
gttcccctctcccttccct

SEQ ID NO: 793040 - DNA, 22 bp, Homo sapiens
gttcccctctcccttccctcct

SEQ ID NO: 793041 - DNA, 20 bp, Homo sapiens
gttcccctcttgtctcccct

SEQ ID NO: 793042 - DNA, 22 bp, Homo sapiens
gttcccctcttgtctcccctgt

SEQ ID NO: 793043 - DNA, 22 bp, Homo sapiens
gttccccttccactgagggcag

SEQ ID NO: 793044 - DNA, 17 bp, Homo sapiens
gttccccttggcttcct

SEQ ID NO: 793045 - DNA, 19 bp, Homo sapiens
gttccccttggcttcctcc

SEQ ID NO: 793046 - DNA, 19 bp, Homo sapiens
gttcccgatggtctctctc

SEQ ID NO: 793047 - DNA, 20 bp, Homo sapiens
gttcccggagcacagccctg

SEQ ID NO: 793048 - DNA, 23 bp, Homo sapiens
gttcccggagcacagccctggga

SEQ ID NO: 793049 - DNA, 14 bp, Homo sapiens
gttcccgtttctcc

SEQ ID NO: 793050 - DNA, 18 bp, Homo sapiens
gttcccgtttctccacct

SEQ ID NO: 793051 - DNA, 20 bp, Homo sapiens
gttccctacttcctgtgact

SEQ ID NO: 793052 - DNA, 18 bp, Homo sapiens
gttccctcctagctctcc

SEQ ID NO: 793053 - DNA, 21 bp, Homo sapiens
gttccctcctgcccaggactg

SEQ ID NO: 793054 - DNA, 12 bp, Homo sapiens
gttccctcctgg

SEQ ID NO: 793055 - DNA, 13 bp, Homo sapiens
gttccctcctggt

SEQ ID NO: 793056 - DNA, 14 bp, Homo sapiens
gttccctcctggtc

SEQ ID NO: 793057 - DNA, 21 bp, Homo sapiens
gttccctcctggtcctggaca

SEQ ID NO: 793058 - DNA, 15 bp, Homo sapiens
gttccctctccctgt

SEQ ID NO: 793059 - DNA, 19 bp, Homo sapiens
gttccctgaaaacccagag

SEQ ID NO: 793060 - DNA, 16 bp, Homo sapiens
gttccctgaaacacga

SEQ ID NO: 793061 - DNA, 21 bp, Homo sapiens
gttccctgcgcttcatctcat

SEQ ID NO: 793062 - DNA, 17 bp, Homo sapiens
gttccctgtcagaggct

SEQ ID NO: 793063 - DNA, 16 bp, Homo sapiens
gttccctgttcttcct

SEQ ID NO: 793064 - DNA, 18 bp, Homo sapiens
gttcccttctcccccttg

SEQ ID NO: 793065 - DNA, 20 bp, Homo sapiens
gttcccttgaccattggctg

SEQ ID NO: 793066 - DNA, 20 bp, Homo sapiens
gttcccttgagggctgcagt

SEQ ID NO: 793067 - DNA, 18 bp, Homo sapiens
gttcccttggcctcagaa

SEQ ID NO: 793068 - DNA, 22 bp, Homo sapiens
gttccctttccttccatcccta

SEQ ID NO: 793069 - DNA, 16 bp, Homo sapiens
gttccctttgccttaa

SEQ ID NO: 793070 - DNA, 21 bp, Homo sapiens
gttccctttgccttaaacctg

SEQ ID NO: 793071 - DNA, 18 bp, Homo sapiens
gttccgcactttccactt

SEQ ID NO: 793072 - DNA, 23 bp, Homo sapiens
gttcctataataaaatggcacct

SEQ ID NO: 793073 - DNA, 20 bp, Homo sapiens
gttcctatggaaacatttta

SEQ ID NO: 793074 - DNA, 15 bp, Homo sapiens
gttcctattgtcatt

SEQ ID NO: 793075 - DNA, 22 bp, Homo sapiens
gttcctcaatggccttttgcta

SEQ ID NO: 793076 - DNA, 23 bp, Homo sapiens
gttcctcagcacccctagcatga

SEQ ID NO: 793077 - DNA, 19 bp, Homo sapiens
gttcctccttttcttcacc

SEQ ID NO: 793078 - DNA, 22 bp, Homo sapiens
gttcctcggtgggccagagctg

SEQ ID NO: 793079 - DNA, 13 bp, Homo sapiens
gttcctctgcctg

SEQ ID NO: 793080 - DNA, 13 bp, Homo sapiens
gttcctctgctca

SEQ ID NO: 793081 - DNA, 12 bp, Homo sapiens
gttcctctgggt

SEQ ID NO: 793082 - DNA, 19 bp, Homo sapiens
gttcctctgggtttctaag

SEQ ID NO: 793083 - DNA, 22 bp, Homo sapiens
gttcctctttggtgtacagact

SEQ ID NO: 793084 - DNA, 14 bp, Homo sapiens
gttcctgaagctgc

SEQ ID NO: 793085 - DNA, 21 bp, Homo sapiens
gttcctgaattctatttgctg

SEQ ID NO: 793086 - DNA, 20 bp, Homo sapiens
gttcctgcggagtgaagagg

SEQ ID NO: 793087 - DNA, 14 bp, Homo sapiens
gttcctgctctctg

SEQ ID NO: 793088 - DNA, 23 bp, Homo sapiens
gttcctgctctctgctcatgggt

SEQ ID NO: 793089 - DNA, 17 bp, Homo sapiens
gttcctggccttctgaa

SEQ ID NO: 793090 - DNA, 23 bp, Homo sapiens
gttcctggctgatgatccagaac

SEQ ID NO: 793091 - DNA, 17 bp, Homo sapiens
gttcctggggccgcctg

SEQ ID NO: 793092 - DNA, 20 bp, Homo sapiens
gttcctggggccgcctgccc

SEQ ID NO: 793093 - DNA, 20 bp, Homo sapiens
gttcctgtgcagatgctgct

SEQ ID NO: 793094 - DNA, 17 bp, Homo sapiens
gttcctgtggccaggag

SEQ ID NO: 793095 - DNA, 14 bp, Homo sapiens
gttcctgtggctcc

SEQ ID NO: 793096 - DNA, 22 bp, Homo sapiens
gttccttatttctctctcctgg

SEQ ID NO: 793097 - DNA, 23 bp, Homo sapiens
gttccttatttctctctcctggt

SEQ ID NO: 793098 - DNA, 14 bp, Homo sapiens
gttccttccctggg

SEQ ID NO: 793099 - DNA, 13 bp, Homo sapiens
gttccttcctcca

SEQ ID NO: 793100 - DNA, 17 bp, Homo sapiens
gttccttcgcacactgt

SEQ ID NO: 793101 - DNA, 12 bp, Homo sapiens
gttccttctctg

SEQ ID NO: 793102 - DNA, 14 bp, Homo sapiens
gttccttctctggg

SEQ ID NO: 793103 - DNA, 13 bp, Homo sapiens
gttccttgcctta

SEQ ID NO: 793104 - DNA, 15 bp, Homo sapiens
gttcctttcagatga

SEQ ID NO: 793105 - DNA, 18 bp, Homo sapiens
gttcctttgtgtgtactc

SEQ ID NO: 793106 - DNA, 14 bp, Homo sapiens
gttccttttgaaat

SEQ ID NO: 793107 - DNA, 16 bp, Homo sapiens
gttcctttttaaatgt

SEQ ID NO: 793108 - DNA, 17 bp, Homo sapiens
gttcctttttaaatgtg

SEQ ID NO: 793109 - DNA, 20 bp, Homo sapiens
gttcctttttcaaaaaccag

SEQ ID NO: 793110 - DNA, 20 bp, Homo sapiens
gttccttttttcaatatgca

SEQ ID NO: 793111 - DNA, 22 bp, Homo sapiens
gttcgaggactacaaccaattt

SEQ ID NO: 793112 - DNA, 14 bp, Homo sapiens
gttcgcatggtcac

SEQ ID NO: 793113 - DNA, 17 bp, Homo sapiens
gttcgggggagcagaga

SEQ ID NO: 793114 - DNA, 19 bp, Homo sapiens
gttcgtttcatcaggctct

SEQ ID NO: 793115 - DNA, 17 bp, Homo sapiens
gttcgtttccatcatgt

SEQ ID NO: 793116 - DNA, 17 bp, Homo sapiens
gttctaaagatggaaaa

SEQ ID NO: 793117 - DNA, 20 bp, Homo sapiens
gttctaaagatggaaaaacc

SEQ ID NO: 793118 - DNA, 13 bp, Homo sapiens
gttctaacctcct

SEQ ID NO: 793119 - DNA, 19 bp, Homo sapiens
gttctaagtctttccattg

SEQ ID NO: 793120 - DNA, 18 bp, Homo sapiens
gttctaattttggatgga

SEQ ID NO: 793121 - DNA, 19 bp, Homo sapiens
gttctacaagcatatttga

SEQ ID NO: 793122 - DNA, 16 bp, Homo sapiens
gttctacactcatctt

SEQ ID NO: 793123 - DNA, 23 bp, Homo sapiens
gttctactgacccaactgggggc

SEQ ID NO: 793124 - DNA, 18 bp, Homo sapiens
gttctagacctctggtta

SEQ ID NO: 793125 - DNA, 19 bp, Homo sapiens
gttctagacgcccctccca

SEQ ID NO: 793126 - DNA, 16 bp, Homo sapiens
gttctagacttcccca

SEQ ID NO: 793127 - DNA, 16 bp, Homo sapiens
gttctagtactgtatt

SEQ ID NO: 793128 - DNA, 23 bp, Homo sapiens
gttctagtctcctttgcactgag

SEQ ID NO: 793129 - DNA, 18 bp, Homo sapiens
gttctataagtgaggaag

SEQ ID NO: 793130 - DNA, 18 bp, Homo sapiens
gttctataataagttttg

SEQ ID NO: 793131 - DNA, 17 bp, Homo sapiens
gttctatccccaagctg

SEQ ID NO: 793132 - DNA, 22 bp, Homo sapiens
gttctattaatcacctctctgt

SEQ ID NO: 793133 - DNA, 15 bp, Homo sapiens
gttctatttaatgga

SEQ ID NO: 793134 - DNA, 16 bp, Homo sapiens
gttctatttcttgaag

SEQ ID NO: 793135 - DNA, 16 bp, Homo sapiens
gttctatttttcaatc

SEQ ID NO: 793136 - DNA, 14 bp, Homo sapiens
gttctcaaagttaa

SEQ ID NO: 793137 - DNA, 21 bp, Homo sapiens
gttcttaggctccatcctgtt

SEQ ID NO: 793138 - DNA, 15 bp, Homo sapiens
gttcttattttagta

SEQ ID NO: 793139 - DNA, 22 bp, Homo sapiens
gttcttattttgcattccagaa

SEQ ID NO: 793140 - DNA, 17 bp, Homo sapiens
gttcttatttttataac

SEQ ID NO: 793141 - DNA, 12 bp, Homo sapiens
gttcttcaagag

SEQ ID NO: 793142 - DNA, 13 bp, Homo sapiens
gttcttcctttcc

SEQ ID NO: 793143 - DNA, 19 bp, Homo sapiens
gttcttcctttccctggag

SEQ ID NO: 793144 - DNA, 22 bp, Homo sapiens
gttcttcttgttctgagattca

SEQ ID NO: 793145 - DNA, 15 bp, Homo sapiens
gttcttgaagcagta

SEQ ID NO: 793146 - DNA, 13 bp, Homo sapiens
gttcttgaattgt

SEQ ID NO: 793147 - DNA, 13 bp, Homo sapiens
gttcttgatgtca

SEQ ID NO: 793148 - DNA, 16 bp, Homo sapiens
gttcttgcctttctta

SEQ ID NO: 793149 - DNA, 14 bp, Homo sapiens
gttcttggaccagt

SEQ ID NO: 793150 - DNA, 21 bp, Homo sapiens
gttcttgggggaggccacccc

SEQ ID NO: 793151 - DNA, 14 bp, Homo sapiens
gttcttggtgactg

SEQ ID NO: 793152 - DNA, 14 bp, Homo sapiens
gttcttggttcctg

SEQ ID NO: 793153 - DNA, 19 bp, Homo sapiens
gttcttgtcataaaatgca

SEQ ID NO: 793154 - DNA, 12 bp, Homo sapiens
gttcttgtctga

SEQ ID NO: 793155 - DNA, 13 bp, Homo sapiens
gttctttaatgtt

SEQ ID NO: 793156 - DNA, 19 bp, Homo sapiens
gttctttagaggctttcaa

SEQ ID NO: 793157 - DNA, 22 bp, Homo sapiens
gttctttcatttgctttggaag

SEQ ID NO: 793158 - DNA, 19 bp, Homo sapiens
gttctttcctccccctgca

SEQ ID NO: 793159 - DNA, 20 bp, Homo sapiens
gttctttcctctttctgctc

SEQ ID NO: 793160 - DNA, 23 bp, Homo sapiens
gttctttcctctttctgctctgc

SEQ ID NO: 793161 - DNA, 13 bp, Homo sapiens
gttctttcctgcc

SEQ ID NO: 793162 - DNA, 15 bp, Homo sapiens
gttctttcttcctct

SEQ ID NO: 793163 - DNA, 19 bp, Homo sapiens
gttctttcttcctctgctg

SEQ ID NO: 793164 - DNA, 22 bp, Homo sapiens
gttctttgatttgtaccattcc

SEQ ID NO: 793165 - DNA, 14 bp, Homo sapiens
gttctttgctgccc

SEQ ID NO: 793166 - DNA, 13 bp, Homo sapiens
gttctttggaagc

SEQ ID NO: 793167 - DNA, 13 bp, Homo sapiens
gttcttttaaagg

SEQ ID NO: 793168 - DNA, 19 bp, Homo sapiens
gttcttttctcctttacca

SEQ ID NO: 793169 - DNA, 15 bp, Homo sapiens
gttcttttgagtcct

SEQ ID NO: 793170 - DNA, 18 bp, Homo sapiens
gttcttttgagtccttgt

SEQ ID NO: 793171 - DNA, 22 bp, Homo sapiens
gttctttttctgaactccattt

SEQ ID NO: 793172 - DNA, 16 bp, Homo sapiens
gttcttttttcagtta

SEQ ID NO: 793173 - DNA, 16 bp, Homo sapiens
gttgaaaaatctagtt

SEQ ID NO: 793174 - DNA, 20 bp, Homo sapiens
gttgaaaaatctagtttttt

SEQ ID NO: 793175 - DNA, 22 bp, Homo sapiens
gttgaaaataaagtgtatattt

SEQ ID NO: 793176 - DNA, 23 bp, Homo sapiens
gttgaaaatgtatttcctgaaat

SEQ ID NO: 793177 - DNA, 22 bp, Homo sapiens
gttgaaaattcaaaaagtgttt

SEQ ID NO: 793178 - DNA, 12 bp, Homo sapiens
gttgaaacatat

SEQ ID NO: 793179 - DNA, 13 bp, Homo sapiens
gttgaaaggtttt

SEQ ID NO: 793180 - DNA, 14 bp, Homo sapiens
gttgaaaggttttt

SEQ ID NO: 793181 - DNA, 15 bp, Homo sapiens
gttgaaatatgcata

SEQ ID NO: 793182 - DNA, 19 bp, Homo sapiens
gttgaaccacgtgaaactg

SEQ ID NO: 793183 - DNA, 15 bp, Homo sapiens
gttgaagaagggtta

SEQ ID NO: 793184 - DNA, 20 bp, Homo sapiens
gttgaagagacagagacaag

SEQ ID NO: 793185 - DNA, 22 bp, Homo sapiens
gttgaagagacagagacaagta

SEQ ID NO: 793186 - DNA, 16 bp, Homo sapiens
gttgaagtttgaacca

SEQ ID NO: 793187 - DNA, 13 bp, Homo sapiens
gttgaataaaagt

SEQ ID NO: 793188 - DNA, 17 bp, Homo sapiens
gttgaatactttttaca

SEQ ID NO: 793189 - DNA, 15 bp, Homo sapiens
gttgaatgacaacag

SEQ ID NO: 793190 - DNA, 20 bp, Homo sapiens
gttgaattttgttctctggg

SEQ ID NO: 793191 - DNA, 22 bp, Homo sapiens
gttgaattttgttctctgggag

SEQ ID NO: 793192 - DNA, 15 bp, Homo sapiens
gttgacaaaattttc

SEQ ID NO: 793193 - DNA, 15 bp, Homo sapiens
gttgacaacctagaa

SEQ ID NO: 793194 - DNA, 19 bp, Homo sapiens
gttgacaacctagaatgtc

SEQ ID NO: 793195 - DNA, 15 bp, Homo sapiens
gttgacaattctgca

SEQ ID NO: 793196 - DNA, 15 bp, Homo sapiens
gttgacacaggtctt

SEQ ID NO: 793197 - DNA, 19 bp, Homo sapiens
gttgacacagttgtagggt

SEQ ID NO: 793198 - DNA, 19 bp, Homo sapiens
gttgacacatatgaacaca

SEQ ID NO: 793199 - DNA, 18 bp, Homo sapiens
gttgacactgttttcctt

SEQ ID NO: 793200 - DNA, 21 bp, Homo sapiens
gttgacaggtacttggagggc

SEQ ID NO: 793201 - DNA, 17 bp, Homo sapiens
gttgacatatttaatgt

SEQ ID NO: 793202 - DNA, 20 bp, Homo sapiens
gttgacatatttaatgtttt

SEQ ID NO: 793203 - DNA, 19 bp, Homo sapiens
gttgacattctgaatgctt

SEQ ID NO: 793204 - DNA, 14 bp, Homo sapiens
gttgaccagataaa

SEQ ID NO: 793205 - DNA, 14 bp, Homo sapiens
gttgaccccagagg

SEQ ID NO: 793206 - DNA, 15 bp, Homo sapiens
gttgaccccagagga

SEQ ID NO: 793207 - DNA, 22 bp, Homo sapiens
gttgactcacaggccctggaga

SEQ ID NO: 793208 - DNA, 13 bp, Homo sapiens
gttgactgctgct

SEQ ID NO: 793209 - DNA, 14 bp, Homo sapiens
gttgactttcaggt

SEQ ID NO: 793210 - DNA, 21 bp, Homo sapiens
gttgagagctttctgccttag

SEQ ID NO: 793211 - DNA, 14 bp, Homo sapiens
gttgagagggaaaa

SEQ ID NO: 793212 - DNA, 18 bp, Homo sapiens
gttgagatgtagagtttt

SEQ ID NO: 793213 - DNA, 22 bp, Homo sapiens
gttgagatgttgtgtggcaatg

SEQ ID NO: 793214 - DNA, 20 bp, Homo sapiens
gttgagatttttaagaactt

SEQ ID NO: 793215 - DNA, 19 bp, Homo sapiens
gttgagcagggatcctggt

SEQ ID NO: 793216 - DNA, 10 bp, Homo sapiens
gttgagcccc

SEQ ID NO: 793217 - DNA, 20 bp, Homo sapiens
gttgagccccaagtcctgaa

SEQ ID NO: 793218 - DNA, 15 bp, Homo sapiens
gttgagcccctggag

SEQ ID NO: 793219 - DNA, 14 bp, Homo sapiens
gttgagccttttcc

SEQ ID NO: 793220 - DNA, 21 bp, Homo sapiens
gttgaggaaaagactgtgggt

SEQ ID NO: 793221 - DNA, 19 bp, Homo sapiens
gttgagggaacagacagga

SEQ ID NO: 793222 - DNA, 14 bp, Homo sapiens
gttgaggggaggag

SEQ ID NO: 793223 - DNA, 16 bp, Homo sapiens
gttgaggggcctggag

SEQ ID NO: 793224 - DNA, 17 bp, Homo sapiens
gttgaggggcctggaga

SEQ ID NO: 793225 - DNA, 16 bp, Homo sapiens
gttgaggggctcctgg

SEQ ID NO: 793226 - DNA, 18 bp, Homo sapiens
gttgaggggctcctggaa

SEQ ID NO: 793227 - DNA, 21 bp, Homo sapiens
gttgaggtctttctcctcagg

SEQ ID NO: 793228 - DNA, 22 bp, Homo sapiens
gttgaggtctttctcctcagga

SEQ ID NO: 793229 - DNA, 19 bp, Homo sapiens
gttgagtacagtgaggagg

SEQ ID NO: 793230 - DNA, 14 bp, Homo sapiens
gttgagtgagccgg

SEQ ID NO: 793231 - DNA, 13 bp, Homo sapiens
gttgagttttcca

SEQ ID NO: 793232 - DNA, 15 bp, Homo sapiens
gttgataaaaatact

SEQ ID NO: 793233 - DNA, 13 bp, Homo sapiens
gttgataagagga

SEQ ID NO: 793234 - DNA, 18 bp, Homo sapiens
gttgatattgtttgctgt

SEQ ID NO: 793235 - DNA, 20 bp, Homo sapiens
gttgatcactggcaatgaaa

SEQ ID NO: 793236 - DNA, 15 bp, Homo sapiens
gttgatctgcatatt

SEQ ID NO: 793237 - DNA, 14 bp, Homo sapiens
gttgatctgctctg

SEQ ID NO: 793238 - DNA, 21 bp, Homo sapiens
gttgatgtatctgagttgcca

SEQ ID NO: 793239 - DNA, 19 bp, Homo sapiens
gttgattaatttctgccat

SEQ ID NO: 793240 - DNA, 14 bp, Homo sapiens
gttgattgtttaag

SEQ ID NO: 793241 - DNA, 14 bp, Homo sapiens
gttgcaagatgtga

SEQ ID NO: 793242 - DNA, 17 bp, Homo sapiens
gttgcaagatgtgaatt

SEQ ID NO: 793243 - DNA, 14 bp, Homo sapiens
gttgcaagcccctc

SEQ ID NO: 793244 - DNA, 16 bp, Homo sapiens
gttgcaccatctgctt

SEQ ID NO: 793245 - DNA, 15 bp, Homo sapiens
gttgcactgaacagg

SEQ ID NO: 793246 - DNA, 20 bp, Homo sapiens
gttgcactttagacattttt

SEQ ID NO: 793247 - DNA, 19 bp, Homo sapiens
gttgcagatgtattgactg

SEQ ID NO: 793248 - DNA, 20 bp, Homo sapiens
gttgcagctgttttgttgac

SEQ ID NO: 793249 - DNA, 15 bp, Homo sapiens
gttgcaggacctcag

SEQ ID NO: 793250 - DNA, 15 bp, Homo sapiens
gttgcagggctgcag

SEQ ID NO: 793251 - DNA, 16 bp, Homo sapiens
gttgcagtcactgtga

SEQ ID NO: 793252 - DNA, 20 bp, Homo sapiens
gttgcagtgagccgagatca

SEQ ID NO: 793253 - DNA, 15 bp, Homo sapiens
gttgcagtgagctga

SEQ ID NO: 793254 - DNA, 16 bp, Homo sapiens
gttgcatgtagtaaca

SEQ ID NO: 793255 - DNA, 16 bp, Homo sapiens
gttgccaaagctggtc

SEQ ID NO: 793256 - DNA, 14 bp, Homo sapiens
gttggaaggatctg

SEQ ID NO: 793257 - DNA, 16 bp, Homo sapiens
gttggaatcttttata

SEQ ID NO: 793258 - DNA, 23 bp, Homo sapiens
gttggacagcaaaaccattgctt

SEQ ID NO: 793259 - DNA, 14 bp, Homo sapiens
gttggacagctgct

SEQ ID NO: 793260 - DNA, 15 bp, Homo sapiens
gttggacagctgctt

SEQ ID NO: 793261 - DNA, 17 bp, Homo sapiens
gttggacccgctctgga

SEQ ID NO: 793262 - DNA, 16 bp, Homo sapiens
gttggactctcaggga

SEQ ID NO: 793263 - DNA, 21 bp, Homo sapiens
gttggacttttcgttaacatt

SEQ ID NO: 793264 - DNA, 14 bp, Homo sapiens
gttggagagcagca

SEQ ID NO: 793265 - DNA, 16 bp, Homo sapiens
gttggagagccctgga

SEQ ID NO: 793266 - DNA, 17 bp, Homo sapiens
gttggagagccctggat

SEQ ID NO: 793267 - DNA, 20 bp, Homo sapiens
gttggagcagtgcttttcac

SEQ ID NO: 793268 - DNA, 12 bp, Homo sapiens
gttggagccact

SEQ ID NO: 793269 - DNA, 21 bp, Homo sapiens
gttggagccactcctgtcccg

SEQ ID NO: 793270 - DNA, 12 bp, Homo sapiens
gttggagcctgc

SEQ ID NO: 793271 - DNA, 14 bp, Homo sapiens
gttggagcctgcag

SEQ ID NO: 793272 - DNA, 16 bp, Homo sapiens
gttggagcctgcaggg

SEQ ID NO: 793273 - DNA, 18 bp, Homo sapiens
gttggagctcattctgtc

SEQ ID NO: 793274 - DNA, 16 bp, Homo sapiens
gttggaggcaatgtgg

SEQ ID NO: 793275 - DNA, 14 bp, Homo sapiens
gttggagggaacca

SEQ ID NO: 793276 - DNA, 23 bp, Homo sapiens
gttggagttttatttttaagaaa

SEQ ID NO: 793277 - DNA, 23 bp, Homo sapiens
gttggatggatgggtggatggcc

SEQ ID NO: 793278 - DNA, 19 bp, Homo sapiens
gttggatgggagtgggcac

SEQ ID NO: 793279 - DNA, 21 bp, Homo sapiens
gttggatttataaatgctatt

SEQ ID NO: 793280 - DNA, 18 bp, Homo sapiens
gttggcaaaaaggcagga

SEQ ID NO: 793281 - DNA, 19 bp, Homo sapiens
gttggcactcacagacctg

SEQ ID NO: 793282 - DNA, 14 bp, Homo sapiens
gttggcacttatag

SEQ ID NO: 793283 - DNA, 19 bp, Homo sapiens
gttggcagaccgggccccc

SEQ ID NO: 793284 - DNA, 12 bp, Homo sapiens
gttggcagctct

SEQ ID NO: 793285 - DNA, 13 bp, Homo sapiens
gttggcaggccca

SEQ ID NO: 793286 - DNA, 15 bp, Homo sapiens
gttggcaggcccact

SEQ ID NO: 793287 - DNA, 15 bp, Homo sapiens
gttggcatagctctg

SEQ ID NO: 793288 - DNA, 18 bp, Homo sapiens
gttggcatagctctgggg

SEQ ID NO: 793289 - DNA, 16 bp, Homo sapiens
gttggcccttccagtg

SEQ ID NO: 793290 - DNA, 15 bp, Homo sapiens
gttggccggcggcta

SEQ ID NO: 793291 - DNA, 13 bp, Homo sapiens
gttggcctctgca

SEQ ID NO: 793292 - DNA, 13 bp, Homo sapiens
gttggcctgcact

SEQ ID NO: 793293 - DNA, 11 bp, Homo sapiens
gttggcctgtg

SEQ ID NO: 793294 - DNA, 14 bp, Homo sapiens
gttggcctgtgggc

SEQ ID NO: 793295 - DNA, 14 bp, Homo sapiens
gttggcggcagaca

SEQ ID NO: 793296 - DNA, 16 bp, Homo sapiens
gttggcgggggcacgt

SEQ ID NO: 793297 - DNA, 15 bp, Homo sapiens
gttggctctctgacg

SEQ ID NO: 793298 - DNA, 17 bp, Homo sapiens
gttggctgggcccagaa

SEQ ID NO: 793299 - DNA, 23 bp, Homo sapiens
gttggctgtgttcgggggagcag

SEQ ID NO: 793300 - DNA, 16 bp, Homo sapiens
gttggctgttccagac

SEQ ID NO: 793301 - DNA, 17 bp, Homo sapiens
gttggctgttccagact

SEQ ID NO: 793302 - DNA, 12 bp, Homo sapiens
gttggctttgcc

SEQ ID NO: 793303 - DNA, 20 bp, Homo sapiens
gttgggaaaagcccacaggc

SEQ ID NO: 793304 - DNA, 21 bp, Homo sapiens
gttgggaaaagcccacaggcc

SEQ ID NO: 793305 - DNA, 22 bp, Homo sapiens
gttgggaaaagcccacaggcct

SEQ ID NO: 793306 - DNA, 18 bp, Homo sapiens
gttgggaacagcatggag

SEQ ID NO: 793307 - DNA, 18 bp, Homo sapiens
gttgggaaggggtcctgc

SEQ ID NO: 793308 - DNA, 20 bp, Homo sapiens
gttgggaaggggtcctgcag

SEQ ID NO: 793309 - DNA, 21 bp, Homo sapiens
gttgggaaggggtcctgcagg

SEQ ID NO: 793310 - DNA, 16 bp, Homo sapiens
gttgggagcactggag

SEQ ID NO: 793311 - DNA, 21 bp, Homo sapiens
gttgggaggatacagaggaga

SEQ ID NO: 793312 - DNA, 16 bp, Homo sapiens
gttgggattcctgacc

SEQ ID NO: 793313 - DNA, 22 bp, Homo sapiens
gttgggattcctgacccaggcc

SEQ ID NO: 793314 - DNA, 23 bp, Homo sapiens
gttgggattcctgacccaggccg

SEQ ID NO: 793315 - DNA, 14 bp, Homo sapiens
gttgggcagccaga

SEQ ID NO: 793316 - DNA, 22 bp, Homo sapiens
gttgggcagggtgaccctgaag

SEQ ID NO: 793317 - DNA, 12 bp, Homo sapiens
gttgggcatgtg

SEQ ID NO: 793318 - DNA, 16 bp, Homo sapiens
gttggggaaggcaaga

SEQ ID NO: 793319 - DNA, 14 bp, Homo sapiens
gttggggaggggcg

SEQ ID NO: 793320 - DNA, 12 bp, Homo sapiens
gttggggccctc

SEQ ID NO: 793321 - DNA, 15 bp, Homo sapiens
gttggggcccttaac

SEQ ID NO: 793322 - DNA, 11 bp, Homo sapiens
gttggggctgc

SEQ ID NO: 793323 - DNA, 18 bp, Homo sapiens
gttgggggaaccagcaga

SEQ ID NO: 793324 - DNA, 22 bp, Homo sapiens
gttgggggaatgcacctcccca

SEQ ID NO: 793325 - DNA, 22 bp, Homo sapiens
gttggggggactctgagcggga

SEQ ID NO: 793326 - DNA, 22 bp, Homo sapiens
gttgggggtcagtgctgcctgt

SEQ ID NO: 793327 - DNA, 16 bp, Homo sapiens
gttggggtctggcagc

SEQ ID NO: 793328 - DNA, 14 bp, Homo sapiens
gttggggtgacagt

SEQ ID NO: 793329 - DNA, 15 bp, Homo sapiens
gttggggtgacagtc

SEQ ID NO: 793330 - DNA, 12 bp, Homo sapiens
gttggggtggga

SEQ ID NO: 793331 - DNA, 16 bp, Homo sapiens
gttggggtgggagggc

SEQ ID NO: 793332 - DNA, 14 bp, Homo sapiens
gttgggtagaaaaa

SEQ ID NO: 793333 - DNA, 17 bp, Homo sapiens
gttgggtagaaaaatta

SEQ ID NO: 793334 - DNA, 19 bp, Homo sapiens
gttgtctagtcattgtcat

SEQ ID NO: 793335 - DNA, 22 bp, Homo sapiens
gttgtctattctgagccttgag

SEQ ID NO: 793336 - DNA, 15 bp, Homo sapiens
gttgtctcattttgg

SEQ ID NO: 793337 - DNA, 18 bp, Homo sapiens
gttgtctctgatgcagct

SEQ ID NO: 793338 - DNA, 12 bp, Homo sapiens
gttgtctgtcca

SEQ ID NO: 793339 - DNA, 17 bp, Homo sapiens
gttgtgaaatgtaacat

SEQ ID NO: 793340 - DNA, 14 bp, Homo sapiens
gttgtgagccctct

SEQ ID NO: 793341 - DNA, 13 bp, Homo sapiens
gttgtgaggcctg

SEQ ID NO: 793342 - DNA, 13 bp, Homo sapiens
gttgtgcttgagc

SEQ ID NO: 793343 - DNA, 22 bp, Homo sapiens
gttgtggatttaacagaaatgt

SEQ ID NO: 793344 - DNA, 14 bp, Homo sapiens
gttgtgtatagatg

SEQ ID NO: 793345 - DNA, 16 bp, Homo sapiens
gttgtgtattgtggtt

SEQ ID NO: 793346 - DNA, 17 bp, Homo sapiens
gttgtgtgtatatgtat

SEQ ID NO: 793347 - DNA, 14 bp, Homo sapiens
gttgtgttcctggc

SEQ ID NO: 793348 - DNA, 12 bp, Homo sapiens
gttgtgttgtca

SEQ ID NO: 793349 - DNA, 16 bp, Homo sapiens
gttgtgttttttaaga

SEQ ID NO: 793350 - DNA, 20 bp, Homo sapiens
gttgttaaaggcaatggttt

SEQ ID NO: 793351 - DNA, 22 bp, Homo sapiens
gttgttaattttattgcaaagt

SEQ ID NO: 793352 - DNA, 15 bp, Homo sapiens
gttgttacattttta

SEQ ID NO: 793353 - DNA, 21 bp, Homo sapiens
gttgttactaactaaactctc

SEQ ID NO: 793354 - DNA, 17 bp, Homo sapiens
gttgttatgtgatcatg

SEQ ID NO: 793355 - DNA, 19 bp, Homo sapiens
gttgttctgaaatgtcagt

SEQ ID NO: 793356 - DNA, 20 bp, Homo sapiens
gttgttctgtggtcacagtg

SEQ ID NO: 793357 - DNA, 15 bp, Homo sapiens
gttgttctgttaact

SEQ ID NO: 793358 - DNA, 22 bp, Homo sapiens
gttgttgactgtgattagatca

SEQ ID NO: 793359 - DNA, 17 bp, Homo sapiens
gttgttgcatgtttgaa

SEQ ID NO: 793360 - DNA, 17 bp, Homo sapiens
gttgttggcaagctgca

SEQ ID NO: 793361 - DNA, 18 bp, Homo sapiens
gttgttggcaagctgcag

SEQ ID NO: 793362 - DNA, 15 bp, Homo sapiens
gttgtttccaggaga

SEQ ID NO: 793363 - DNA, 13 bp, Homo sapiens
gttgtttctgttc

SEQ ID NO: 793364 - DNA, 14 bp, Homo sapiens
gttgtttgcttctt

SEQ ID NO: 793365 - DNA, 15 bp, Homo sapiens
gttgttttgtatgag

SEQ ID NO: 793366 - DNA, 20 bp, Homo sapiens
gtttaaaaaccgaataaatg

SEQ ID NO: 793367 - DNA, 19 bp, Homo sapiens
gtttaaaaagtaagttaat

SEQ ID NO: 793368 - DNA, 20 bp, Homo sapiens
gtttaaaactagttagattc

SEQ ID NO: 793369 - DNA, 11 bp, Homo sapiens
gtttaaaactt

SEQ ID NO: 793370 - DNA, 19 bp, Homo sapiens
gtttaaaaggctaagaata

SEQ ID NO: 793371 - DNA, 20 bp, Homo sapiens
gtttaaaattcagtttttgt

SEQ ID NO: 793372 - DNA, 17 bp, Homo sapiens
gtttaaacccaagtgct

SEQ ID NO: 793373 - DNA, 19 bp, Homo sapiens
gtttaaacccaagtgctgc

SEQ ID NO: 793374 - DNA, 20 bp, Homo sapiens
gtttaaacccaagtgctgca

SEQ ID NO: 793375 - DNA, 23 bp, Homo sapiens
gtttaaacccaagtgctgcacaa

SEQ ID NO: 793376 - DNA, 12 bp, Homo sapiens
gtttaaactgat

SEQ ID NO: 793377 - DNA, 16 bp, Homo sapiens
gtttaaactgattcat

SEQ ID NO: 793378 - DNA, 23 bp, Homo sapiens
gtttaaagaagctctccaggccc

SEQ ID NO: 793379 - DNA, 15 bp, Homo sapiens
gtttaaagagaggtt

SEQ ID NO: 793380 - DNA, 13 bp, Homo sapiens
gtttaaagcatta

SEQ ID NO: 793381 - DNA, 14 bp, Homo sapiens
gtttaaagctttta

SEQ ID NO: 793382 - DNA, 20 bp, Homo sapiens
gtttaaataaaatttaattt

SEQ ID NO: 793383 - DNA, 15 bp, Homo sapiens
gtttaaataaagacc

SEQ ID NO: 793384 - DNA, 16 bp, Homo sapiens
gtttaaataaagtatc

SEQ ID NO: 793385 - DNA, 19 bp, Homo sapiens
gtttaaataaagtatcatg

SEQ ID NO: 793386 - DNA, 17 bp, Homo sapiens
gtttaaatcatgtatgt

SEQ ID NO: 793387 - DNA, 14 bp, Homo sapiens
gtttaacaaatcta

SEQ ID NO: 793388 - DNA, 18 bp, Homo sapiens
gtttaacacttctgtatg

SEQ ID NO: 793389 - DNA, 15 bp, Homo sapiens
gtttaacatatatat

SEQ ID NO: 793390 - DNA, 17 bp, Homo sapiens
gtttaactggcatggat

SEQ ID NO: 793391 - DNA, 23 bp, Homo sapiens
gtttaactttaaaactgtattta

SEQ ID NO: 793392 - DNA, 17 bp, Homo sapiens
gtttaagaccagcctgg

SEQ ID NO: 793393 - DNA, 22 bp, Homo sapiens
gtttaagctactaacgataaaa

SEQ ID NO: 793394 - DNA, 23 bp, Homo sapiens
gtttaaggaatatgggagaaata

SEQ ID NO: 793395 - DNA, 21 bp, Homo sapiens
gtttaagggtggaaaaatgcc

SEQ ID NO: 793396 - DNA, 15 bp, Homo sapiens
gtttaagtagatttc

SEQ ID NO: 793397 - DNA, 18 bp, Homo sapiens
gtttaagtagatttcatg

SEQ ID NO: 793398 - DNA, 12 bp, Homo sapiens
gtttaagtgttg

SEQ ID NO: 793399 - DNA, 12 bp, Homo sapiens
gtttaatattta

SEQ ID NO: 793400 - DNA, 19 bp, Homo sapiens
gtttcatattttaaatctg

SEQ ID NO: 793401 - DNA, 15 bp, Homo sapiens
gtttcatcaggacca

SEQ ID NO: 793402 - DNA, 15 bp, Homo sapiens
gtttcatcaggctct

SEQ ID NO: 793403 - DNA, 19 bp, Homo sapiens
gtttcatgtatgtatataa

SEQ ID NO: 793404 - DNA, 17 bp, Homo sapiens
gtttcatgttagttacc

SEQ ID NO: 793405 - DNA, 12 bp, Homo sapiens
gtttcatgttct

SEQ ID NO: 793406 - DNA, 12 bp, Homo sapiens
gtttcattcact

SEQ ID NO: 793407 - DNA, 19 bp, Homo sapiens
gtttcattctcctgcctgt

SEQ ID NO: 793408 - DNA, 18 bp, Homo sapiens
gtttcatttatgatacaa

SEQ ID NO: 793409 - DNA, 14 bp, Homo sapiens
gtttcatttctgca

SEQ ID NO: 793410 - DNA, 14 bp, Homo sapiens
gtttcattttggtt

SEQ ID NO: 793411 - DNA, 22 bp, Homo sapiens
gtttccacgatgaaaaacttcc

SEQ ID NO: 793412 - DNA, 15 bp, Homo sapiens
gtttccatcatgtct

SEQ ID NO: 793413 - DNA, 13 bp, Homo sapiens
gtttcccataatt

SEQ ID NO: 793414 - DNA, 21 bp, Homo sapiens
gtttccccagcttcatctttg

SEQ ID NO: 793415 - DNA, 22 bp, Homo sapiens
gtttccccagggaaggaaaaat

SEQ ID NO: 793416 - DNA, 20 bp, Homo sapiens
gtttccccatctctgtctgg

SEQ ID NO: 793417 - DNA, 21 bp, Homo sapiens
gtttcccggttcaggaccact

SEQ ID NO: 793418 - DNA, 17 bp, Homo sapiens
gtttcctccaagctatt

SEQ ID NO: 793419 - DNA, 22 bp, Homo sapiens
gtttcctctagttctttgttca

SEQ ID NO: 793420 - DNA, 12 bp, Homo sapiens
gtttcctctgga

SEQ ID NO: 793421 - DNA, 23 bp, Homo sapiens
gtttcctctgttcaaagctgcct

SEQ ID NO: 793422 - DNA, 14 bp, Homo sapiens
gtttcctgaaatat

SEQ ID NO: 793423 - DNA, 15 bp, Homo sapiens
gtttccttaaacatg

SEQ ID NO: 793424 - DNA, 19 bp, Homo sapiens
gtttcctttaccttttcta

SEQ ID NO: 793425 - DNA, 21 bp, Homo sapiens
gtttcctttaccttttctata

SEQ ID NO: 793426 - DNA, 13 bp, Homo sapiens
gtttccttttgga

SEQ ID NO: 793427 - DNA, 14 bp, Homo sapiens
gtttccttttttcc

SEQ ID NO: 793428 - DNA, 15 bp, Homo sapiens
gtttccttttttccc

SEQ ID NO: 793429 - DNA, 15 bp, Homo sapiens
gtttcgactggtcca

SEQ ID NO: 793430 - DNA, 18 bp, Homo sapiens
gtttcgacttatttctta

SEQ ID NO: 793431 - DNA, 14 bp, Homo sapiens
gtttcgtttctgta

SEQ ID NO: 793432 - DNA, 17 bp, Homo sapiens
gtttctaaaactatggt

SEQ ID NO: 793433 - DNA, 15 bp, Homo sapiens
gtttctacttcccct

SEQ ID NO: 793434 - DNA, 18 bp, Homo sapiens
gtttctacttcccctggg

SEQ ID NO: 793435 - DNA, 19 bp, Homo sapiens
gtttctacttcccctggga

SEQ ID NO: 793436 - DNA, 16 bp, Homo sapiens
gtttctagactataaa

SEQ ID NO: 793437 - DNA, 18 bp, Homo sapiens
gtttctagaggcctcagt

SEQ ID NO: 793438 - DNA, 16 bp, Homo sapiens
gtttctagcctctgag

SEQ ID NO: 793439 - DNA, 16 bp, Homo sapiens
gtttctattctgtcag

SEQ ID NO: 793440 - DNA, 17 bp, Homo sapiens
gtttctattttttgaaa

SEQ ID NO: 793441 - DNA, 14 bp, Homo sapiens
gtttctcattaaac

SEQ ID NO: 793442 - DNA, 14 bp, Homo sapiens
gtttctcatttgtt

SEQ ID NO: 793443 - DNA, 14 bp, Homo sapiens
gtttctccccctgg

SEQ ID NO: 793444 - DNA, 20 bp, Homo sapiens
gtttctccttagttggctgg

SEQ ID NO: 793445 - DNA, 17 bp, Homo sapiens
gtttctccttgaaatga

SEQ ID NO: 793446 - DNA, 14 bp, Homo sapiens
gtttctctccctcc

SEQ ID NO: 793447 - DNA, 13 bp, Homo sapiens
gtttctctgctgt

SEQ ID NO: 793448 - DNA, 15 bp, Homo sapiens
gtttctctgctgttg

SEQ ID NO: 793449 - DNA, 17 bp, Homo sapiens
gtttctctgtgctctga

SEQ ID NO: 793450 - DNA, 20 bp, Homo sapiens
gtttctcttctagatgattt

SEQ ID NO: 793451 - DNA, 20 bp, Homo sapiens
gtttctcttgagctggcctc

SEQ ID NO: 793452 - DNA, 20 bp, Homo sapiens
gtttctcttttggtttctgc

SEQ ID NO: 793453 - DNA, 22 bp, Homo sapiens
gtttctgaaaatgtttaagtat

SEQ ID NO: 793454 - DNA, 15 bp, Homo sapiens
gtttctgaagtactt

SEQ ID NO: 793455 - DNA, 13 bp, Homo sapiens
gtttctgactctg

SEQ ID NO: 793456 - DNA, 19 bp, Homo sapiens
gtttctgatctgtactttg

SEQ ID NO: 793457 - DNA, 20 bp, Homo sapiens
gtttctgatctgtactttgt

SEQ ID NO: 793458 - DNA, 19 bp, Homo sapiens
gtttctgcagcccttgggc

SEQ ID NO: 793459 - DNA, 12 bp, Homo sapiens
gtttctgcttct

SEQ ID NO: 793460 - DNA, 16 bp, Homo sapiens
gtttctggaagactgc

SEQ ID NO: 793461 - DNA, 18 bp, Homo sapiens
gtttctggataaaccacc

SEQ ID NO: 793462 - DNA, 17 bp, Homo sapiens
gtttctgggtccctgct

SEQ ID NO: 793463 - DNA, 21 bp, Homo sapiens
gtttctgggtccctgctcccc

SEQ ID NO: 793464 - DNA, 16 bp, Homo sapiens
gtttctgggtcctgaa

SEQ ID NO: 793465 - DNA, 21 bp, Homo sapiens
gtttctgtagaaaagaaaaca

SEQ ID NO: 793466 - DNA, 21 bp, Homo sapiens
gtttctgtatatgattctctg

SEQ ID NO: 793467 - DNA, 17 bp, Homo sapiens
gtttctgtcgttaaaaa

SEQ ID NO: 793468 - DNA, 13 bp, Homo sapiens
gtttctgttccaa

SEQ ID NO: 793469 - DNA, 14 bp, Homo sapiens
gtttctgttccaaa

SEQ ID NO: 793470 - DNA, 15 bp, Homo sapiens
gtttctgttccaaat

SEQ ID NO: 793471 - DNA, 11 bp, Homo sapiens
gtttctgttga

SEQ ID NO: 793472 - DNA, 18 bp, Homo sapiens
gtttctgtttcaaagcac

SEQ ID NO: 793473 - DNA, 17 bp, Homo sapiens
gtttctgtttgattctt

SEQ ID NO: 793474 - DNA, 13 bp, Homo sapiens
gtttcttccaaag

SEQ ID NO: 793475 - DNA, 21 bp, Homo sapiens
gtttcttcctgctccttttgt

SEQ ID NO: 793476 - DNA, 14 bp, Homo sapiens
gtttcttctttcta

SEQ ID NO: 793477 - DNA, 18 bp, Homo sapiens
gtttcttctttcttttaa

SEQ ID NO: 793478 - DNA, 14 bp, Homo sapiens
gtttcttcttttcc

SEQ ID NO: 793479 - DNA, 15 bp, Homo sapiens
gtttcttcttttcct

SEQ ID NO: 793480 - DNA, 24 bp, Homo sapiens
gtttcttgcactgaatatataaac

SEQ ID NO: 793481 - DNA, 22 bp, Homo sapiens
gtttcttgctctctctccctgc

SEQ ID NO: 793482 - DNA, 14 bp, Homo sapiens
gtttcttgctgcca

SEQ ID NO: 793483 - DNA, 19 bp, Homo sapiens
gtttcttgcttggaagcca

SEQ ID NO: 793484 - DNA, 21 bp, Homo sapiens
gtttcttggggtcccagggaa

SEQ ID NO: 793485 - DNA, 14 bp, Homo sapiens
gtttcttgtgtaga

SEQ ID NO: 793486 - DNA, 22 bp, Homo sapiens
gtttcttgtgtagatttgaaaa

SEQ ID NO: 793487 - DNA, 16 bp, Homo sapiens
gtttctttagtttttg

SEQ ID NO: 793488 - DNA, 20 bp, Homo sapiens
gtttctttctctgaggacaa

SEQ ID NO: 793489 - DNA, 20 bp, Homo sapiens
gtttcttttaatgtgaggaa

SEQ ID NO: 793490 - DNA, 23 bp, Homo sapiens
gtttcttttcacattaggctgtt

SEQ ID NO: 793491 - DNA, 18 bp, Homo sapiens
gtttcttttgtgttccta

SEQ ID NO: 793492 - DNA, 21 bp, Homo sapiens
gtttctttttacagcattgtc

SEQ ID NO: 793493 - DNA, 23 bp, Homo sapiens
gtttctttttacagcattgtctt

SEQ ID NO: 793494 - DNA, 15 bp, Homo sapiens
gtttgaaaacaaaaa

SEQ ID NO: 793495 - DNA, 20 bp, Homo sapiens
gtttgaaaacttcagaagca

SEQ ID NO: 793496 - DNA, 11 bp, Homo sapiens
gtttgaaaagc

SEQ ID NO: 793497 - DNA, 15 bp, Homo sapiens
gtttgaaaagcaata

SEQ ID NO: 793498 - DNA, 15 bp, Homo sapiens
gtttgaaacaaagaa

SEQ ID NO: 793499 - DNA, 12 bp, Homo sapiens
gtttgaaatgtc

SEQ ID NO: 793500 - DNA, 20 bp, Homo sapiens
gtttgaacagatatgttttt

SEQ ID NO: 793501 - DNA, 21 bp, Homo sapiens
gtttgaagacacagcctcccc

SEQ ID NO: 793502 - DNA, 20 bp, Homo sapiens
gtttgaagcacaactccctt

SEQ ID NO: 793503 - DNA, 15 bp, Homo sapiens
gtttgaaggaaacag

SEQ ID NO: 793504 - DNA, 17 bp, Homo sapiens
gtttgaaggaaacagtt

SEQ ID NO: 793505 - DNA, 17 bp, Homo sapiens
gtttgaaggaggtgagg

SEQ ID NO: 793506 - DNA, 20 bp, Homo sapiens
gtttgaatttgtattaaaaa

SEQ ID NO: 793507 - DNA, 22 bp, Homo sapiens
gtttgacaccttagagaagcta

SEQ ID NO: 793508 - DNA, 16 bp, Homo sapiens
gtttgacggcaaggtt

SEQ ID NO: 793509 - DNA, 14 bp, Homo sapiens
gttttctttacaca

SEQ ID NO: 793510 - DNA, 14 bp, Homo sapiens
gttttctttgaatg

SEQ ID NO: 793511 - DNA, 15 bp, Homo sapiens
gttttctttggtttt

SEQ ID NO: 793512 - DNA, 19 bp, Homo sapiens
gttttgaaagtttaacaaa

SEQ ID NO: 793513 - DNA, 18 bp, Homo sapiens
gttttgaagctactgtgt

SEQ ID NO: 793514 - DNA, 15 bp, Homo sapiens
gttttgaaggcaaaa

SEQ ID NO: 793515 - DNA, 14 bp, Homo sapiens
gttttgaataaaaa

SEQ ID NO: 793516 - DNA, 23 bp, Homo sapiens
gttttgaataaaaagtgaacttt

SEQ ID NO: 793517 - DNA, 19 bp, Homo sapiens
gttttgaataaattttcaa

SEQ ID NO: 793518 - DNA, 13 bp, Homo sapiens
gttttgaatagat

SEQ ID NO: 793519 - DNA, 15 bp, Homo sapiens
gttttgaatgtggat

SEQ ID NO: 793520 - DNA, 21 bp, Homo sapiens
gttttgagctactggattctt

SEQ ID NO: 793521 - DNA, 12 bp, Homo sapiens
gttttgagcttt

SEQ ID NO: 793522 - DNA, 18 bp, Homo sapiens
gttttgaggcatgactaa

SEQ ID NO: 793523 - DNA, 22 bp, Homo sapiens
gttttgatgtttgtggcctcag

SEQ ID NO: 793524 - DNA, 13 bp, Homo sapiens
gttttgcaataac

SEQ ID NO: 793525 - DNA, 16 bp, Homo sapiens
gttttgcaataacttc

SEQ ID NO: 793526 - DNA, 12 bp, Homo sapiens
gttttgccagcc

SEQ ID NO: 793527 - DNA, 17 bp, Homo sapiens
gttttgctacataatta

SEQ ID NO: 793528 - DNA, 18 bp, Homo sapiens
gttttgctttggaaacac

SEQ ID NO: 793529 - DNA, 16 bp, Homo sapiens
gttttggaagctctga

SEQ ID NO: 793530 - DNA, 16 bp, Homo sapiens
gttttggactccatct

SEQ ID NO: 793531 - DNA, 19 bp, Homo sapiens
gttttggatcttgaatgtg

SEQ ID NO: 793532 - DNA, 20 bp, Homo sapiens
gttttggcaaacgctaaaga

SEQ ID NO: 793533 - DNA, 15 bp, Homo sapiens
gttttggctctccca

SEQ ID NO: 793534 - DNA, 20 bp, Homo sapiens
gttttggctctcccaccccg

SEQ ID NO: 793535 - DNA, 20 bp, Homo sapiens
gttttggctgaaattctcct

SEQ ID NO: 793536 - DNA, 23 bp, Homo sapiens
gttttgggccagaggcagcctct

SEQ ID NO: 793537 - DNA, 15 bp, Homo sapiens
gttttgggcctccat

SEQ ID NO: 793538 - DNA, 16 bp, Homo sapiens
gttttggggactcatt

SEQ ID NO: 793539 - DNA, 22 bp, Homo sapiens
gttttgggggtcaggcagccag

SEQ ID NO: 793540 - DNA, 18 bp, Homo sapiens
gttttggtcccctccctc

SEQ ID NO: 793541 - DNA, 19 bp, Homo sapiens
gttttggtcccctccctcg

SEQ ID NO: 793542 - DNA, 23 bp, Homo sapiens
gttttggtcccctccctcgtggg

SEQ ID NO: 793543 - DNA, 16 bp, Homo sapiens
gttttggttaataaaa

SEQ ID NO: 793544 - DNA, 19 bp, Homo sapiens
gttttgtaaaaactgaaga

SEQ ID NO: 793545 - DNA, 13 bp, Homo sapiens
gttttgtaaaaga

SEQ ID NO: 793546 - DNA, 13 bp, Homo sapiens
gttttgtaaacat

SEQ ID NO: 793547 - DNA, 17 bp, Homo sapiens
gttttgtaaacatttat

SEQ ID NO: 793548 - DNA, 11 bp, Homo sapiens
gttttgtaagc

SEQ ID NO: 793549 - DNA, 18 bp, Homo sapiens
gttttgtaagccctcttt

SEQ ID NO: 793550 - DNA, 14 bp, Homo sapiens
gttttgtacataga

SEQ ID NO: 793551 - DNA, 12 bp, Homo sapiens
gttttgtagatg

SEQ ID NO: 793552 - DNA, 22 bp, Homo sapiens
gttttgtatacagagaagaaaa

SEQ ID NO: 793553 - DNA, 23 bp, Homo sapiens
gttttgtattgagggccagtgat

SEQ ID NO: 793554 - DNA, 20 bp, Homo sapiens
gttttgtattttttaaaaca

SEQ ID NO: 793555 - DNA, 17 bp, Homo sapiens
gttttgtcaaactgtag

SEQ ID NO: 793556 - DNA, 15 bp, Homo sapiens
gttttgtcagacttc

SEQ ID NO: 793557 - DNA, 14 bp, Homo sapiens
gttttgtcttgaat

SEQ ID NO: 793558 - DNA, 17 bp, Homo sapiens
gttttgtggtttggaat

SEQ ID NO: 793559 - DNA, 13 bp, Homo sapiens
gttttgtgtgtat

SEQ ID NO: 793560 - DNA, 14 bp, Homo sapiens
gttttgtgtgtata

SEQ ID NO: 793561 - DNA, 17 bp, Homo sapiens
gttttgtgtttgttgta

SEQ ID NO: 793562 - DNA, 13 bp, Homo sapiens
gttttgttaatat

SEQ ID NO: 793563 - DNA, 17 bp, Homo sapiens
gttttgttatataattt

SEQ ID NO: 793564 - DNA, 14 bp, Homo sapiens
gttttgttccagag

SEQ ID NO: 793565 - DNA, 22 bp, Homo sapiens
gttttgttgacattctgaatgc

SEQ ID NO: 793566 - DNA, 15 bp, Homo sapiens
gttttgtttctgaaa

SEQ ID NO: 793567 - DNA, 17 bp, Homo sapiens
gttttgttttaaaatta

SEQ ID NO: 793568 - DNA, 20 bp, Homo sapiens
gttttgttttctaagatgtt

SEQ ID NO: 793569 - DNA, 16 bp, Homo sapiens
gttttgttttttaagg

SEQ ID NO: 793570 - DNA, 17 bp, Homo sapiens
gtttttaaaatagaatg

SEQ ID NO: 793571 - DNA, 22 bp, Homo sapiens
gtttttaaactgtacagtgtct

SEQ ID NO: 793572 - DNA, 23 bp, Homo sapiens
gtttttaaatagagtttgctatt

SEQ ID NO: 793573 - DNA, 20 bp, Homo sapiens
gtttttaaattttgtaatga

SEQ ID NO: 793574 - DNA, 22 bp, Homo sapiens
gtttttaacctgttttgttaat

SEQ ID NO: 793575 - DNA, 19 bp, Homo sapiens
gtttttaagctgtttccat

SEQ ID NO: 793576 - DNA, 20 bp, Homo sapiens
gtttttaatagctatggaat

SEQ ID NO: 793577 - DNA, 23 bp, Homo sapiens
gtttttaatgaccaattgagtaa

SEQ ID NO: 793578 - DNA, 12 bp, Homo sapiens
gtttttaatgta

SEQ ID NO: 793579 - DNA, 13 bp, Homo sapiens
gtttttaatgtat

SEQ ID NO: 793580 - DNA, 17 bp, Homo sapiens
gtttttacagttagggt

SEQ ID NO: 793581 - DNA, 19 bp, Homo sapiens
gtttttacattatgcaaat

SEQ ID NO: 793582 - DNA, 14 bp, Homo sapiens
gtttttactgctct

SEQ ID NO: 793583 - DNA, 17 bp, Homo sapiens
gtttttactttctgttg

SEQ ID NO: 793584 - DNA, 16 bp, Homo sapiens
gtttttatggggctga

SEQ ID NO: 793585 - DNA, 14 bp, Homo sapiens
gtttttcacatttt

SEQ ID NO: 793586 - DNA, 14 bp, Homo sapiens
gtttttcagctccc

SEQ ID NO: 793587 - DNA, 18 bp, Homo sapiens
gtttttccactactgcta

SEQ ID NO: 793588 - DNA, 18 bp, Homo sapiens
gtttttccctccccagaa

SEQ ID NO: 793589 - DNA, 18 bp, Homo sapiens
gtttttcctatcatgtta

SEQ ID NO: 793590 - DNA, 19 bp, Homo sapiens
gtttttcctgttcttaaga

SEQ ID NO: 793591 - DNA, 17 bp, Homo sapiens
gtttttccttatttgct

SEQ ID NO: 793592 - DNA, 13 bp, Homo sapiens
gtttttcctttct

SEQ ID NO: 793593 - DNA, 14 bp, Homo sapiens
gtttttcctttctt

SEQ ID NO: 793594 - DNA, 18 bp, Homo sapiens
gtttttcctttttttgta

SEQ ID NO: 793595 - DNA, 16 bp, Homo sapiens
gtttttcggacagttt

SEQ ID NO: 793596 - DNA, 18 bp, Homo sapiens
gtttttctaggcctgggg

SEQ ID NO: 793597 - DNA, 17 bp, Homo sapiens
gtttttctcatgtatct

SEQ ID NO: 793598 - DNA, 15 bp, Homo sapiens
gtttttctcgtcccc

SEQ ID NO: 793599 - DNA, 18 bp, Homo sapiens
gtttttctgtgtgtcagt

SEQ ID NO: 793600 - DNA, 12 bp, Homo sapiens
gtttttcttcaa

SEQ ID NO: 793601 - DNA, 23 bp, Homo sapiens
gtttttcttcaacatcaatgttc

SEQ ID NO: 793602 - DNA, 15 bp, Homo sapiens
gtttttgcatttttg

SEQ ID NO: 793603 - DNA, 12 bp, Homo sapiens
gtttttgccaaa

SEQ ID NO: 793604 - DNA, 12 bp, Homo sapiens
gtttttgctctc

SEQ ID NO: 793605 - DNA, 11 bp, Homo sapiens
gtttttgctgt

SEQ ID NO: 793606 - DNA, 13 bp, Homo sapiens
gtttttgcttctc

SEQ ID NO: 793607 - DNA, 20 bp, Homo sapiens
gtttttggctgagtactgga

SEQ ID NO: 793608 - DNA, 16 bp, Homo sapiens
gtttttgtcttaaaaa

SEQ ID NO: 793609 - DNA, 17 bp, Homo sapiens
gtttttgtgctgtgggc

SEQ ID NO: 793610 - DNA, 17 bp, Homo sapiens
gtttttgtttgtttctt

SEQ ID NO: 793611 - DNA, 17 bp, Homo sapiens
gtttttgtttttgcatg

SEQ ID NO: 793612 - DNA, 18 bp, Homo sapiens
gttttttaagatagtgta

SEQ ID NO: 793613 - DNA, 15 bp, Homo sapiens
gttttttatgctaat

SEQ ID NO: 793614 - DNA, 15 bp, Homo sapiens
gttttttcatagtgc

SEQ ID NO: 793615 - DNA, 14 bp, Homo sapiens
gttttttcctgagc

SEQ ID NO: 793616 - DNA, 19 bp, Homo sapiens
gttttttggggatgtggag

SEQ ID NO: 793617 - DNA, 18 bp, Homo sapiens
gttttttgtaactacaaa

SEQ ID NO: 793618 - DNA, 14 bp, Homo sapiens
gttttttgtaagat

SEQ ID NO: 793619 - DNA, 14 bp, Homo sapiens
gtttttttaacctg

SEQ ID NO: 793620 - DNA, 13 bp, Homo sapiens
gtttttttccagt

SEQ ID NO: 793621 - DNA, 17 bp, Homo sapiens
gtttttttcctcatgta

SEQ ID NO: 793622 - DNA, 22 bp, Homo sapiens
gtttttttcctcatgtaacatt

SEQ ID NO: 793623 - DNA, 13 bp, Homo sapiens
gtttttttcctgt

SEQ ID NO: 793624 - DNA, 18 bp, Homo sapiens
gtttttttggtcactcca

SEQ ID NO: 793625 - DNA, 21 bp, Homo sapiens
gtttgtttttaaaaagcaaat

SEQ ID NO: 793626 - DNA, 15 bp, Homo sapiens
gtttgttttttcatg

SEQ ID NO: 793627 - DNA, 15 bp, Homo sapiens
gtttgtttttttgcc

SEQ ID NO: 793628 - DNA, 15 bp, Homo sapiens
gttttaaaaaaactg

SEQ ID NO: 793629 - DNA, 17 bp, Homo sapiens
gttttaaaaaaactgaa

SEQ ID NO: 793630 - DNA, 15 bp, Homo sapiens
gttttaaaaagccag

SEQ ID NO: 793631 - DNA, 24 bp, Homo sapiens
gttttaaaataaaaattctgaatg

SEQ ID NO: 793632 - DNA, 12 bp, Homo sapiens
gttttaaaatta

SEQ ID NO: 793633 - DNA, 14 bp, Homo sapiens
gttttaaaattaaa

SEQ ID NO: 793634 - DNA, 19 bp, Homo sapiens
gttttaaacatagaaagtt

SEQ ID NO: 793635 - DNA, 16 bp, Homo sapiens
gttttaaacctttaat

SEQ ID NO: 793636 - DNA, 23 bp, Homo sapiens
gttttaaacctttaatgagaaaa

SEQ ID NO: 793637 - DNA, 16 bp, Homo sapiens
gttttaaactttcaat

SEQ ID NO: 793638 - DNA, 23 bp, Homo sapiens
gttttaaagggtgcccatttgtg

SEQ ID NO: 793639 - DNA, 22 bp, Homo sapiens
gttttaaatacgcactacatgt

SEQ ID NO: 793640 - DNA, 12 bp, Homo sapiens
gttttaaattct

SEQ ID NO: 793641 - DNA, 10 bp, Homo sapiens
gttttaacac

SEQ ID NO: 793642 - DNA, 20 bp, Homo sapiens
gttttaaccgcacatgcaca

SEQ ID NO: 793643 - DNA, 19 bp, Homo sapiens
gttttaactagaatttatt

SEQ ID NO: 793644 - DNA, 18 bp, Homo sapiens
gttttaaggatgcttgta

SEQ ID NO: 793645 - DNA, 22 bp, Homo sapiens
gttttaaggatgcttgtacata

SEQ ID NO: 793646 - DNA, 22 bp, Homo sapiens
gttttaagtgaaagtgaggaaa

SEQ ID NO: 793647 - DNA, 16 bp, Homo sapiens
gttttaataaacagta

SEQ ID NO: 793648 - DNA, 15 bp, Homo sapiens
gttttaatctacttt

SEQ ID NO: 793649 - DNA, 23 bp, Homo sapiens
gttttaatctactttttgtattt

SEQ ID NO: 793650 - DNA, 18 bp, Homo sapiens
gttttaattcaacatcaa

SEQ ID NO: 793651 - DNA, 23 bp, Homo sapiens
gttttaattcaacatcaaaactt

SEQ ID NO: 793652 - DNA, 19 bp, Homo sapiens
gttttaattccatgtcaga

SEQ ID NO: 793653 - DNA, 22 bp, Homo sapiens
gttttaattccatgtcagataa

SEQ ID NO: 793654 - DNA, 23 bp, Homo sapiens
gttttacaataaaatcttgaaaa

SEQ ID NO: 793655 - DNA, 16 bp, Homo sapiens
gttttacacagagaaa

SEQ ID NO: 793656 - DNA, 12 bp, Homo sapiens
gttttacattgt

SEQ ID NO: 793657 - DNA, 13 bp, Homo sapiens
gttttaccagctc

SEQ ID NO: 793658 - DNA, 14 bp, Homo sapiens
gttttaccagctcc

SEQ ID NO: 793659 - DNA, 18 bp, Homo sapiens
gttttacgcaaggaagga

SEQ ID NO: 793660 - DNA, 14 bp, Homo sapiens
gttttacgtgcaaa

SEQ ID NO: 793661 - DNA, 19 bp, Homo sapiens
gttttacgtgcaaacaacc

SEQ ID NO: 793662 - DNA, 14 bp, Homo sapiens
gttttactaaagaa

SEQ ID NO: 793663 - DNA, 16 bp, Homo sapiens
gttttactgcagcttt

SEQ ID NO: 793664 - DNA, 14 bp, Homo sapiens
gttttactgcctgt

SEQ ID NO: 793665 - DNA, 15 bp, Homo sapiens
gttttactgttttaa

SEQ ID NO: 793666 - DNA, 13 bp, Homo sapiens
gttttagaaaaca

SEQ ID NO: 793667 - DNA, 15 bp, Homo sapiens
gttttagaaattggt

SEQ ID NO: 793668 - DNA, 18 bp, Homo sapiens
gttttagaggcattgtta

SEQ ID NO: 793669 - DNA, 15 bp, Homo sapiens
gttttagcagcactt

SEQ ID NO: 793670 - DNA, 20 bp, Homo sapiens
gttttagccattgttggctt

SEQ ID NO: 793671 - DNA, 21 bp, Homo sapiens
gttttaggacaaacagctcag

SEQ ID NO: 793672 - DNA, 22 bp, Homo sapiens
gttttagggagtggttcctgtg

SEQ ID NO: 793673 - DNA, 16 bp, Homo sapiens
gttttaggtagaaaaa

SEQ ID NO: 793674 - DNA, 16 bp, Homo sapiens
gttttataaaatcaag

SEQ ID NO: 793675 - DNA, 16 bp, Homo sapiens
gttttatgttgatctg

SEQ ID NO: 793676 - DNA, 13 bp, Homo sapiens
gttttattacaaa

SEQ ID NO: 793677 - DNA, 23 bp, Homo sapiens
gttttattattgtttatgccaaa

SEQ ID NO: 793678 - DNA, 20 bp, Homo sapiens
gttttattctgacttcctct

SEQ ID NO: 793679 - DNA, 13 bp, Homo sapiens
gttttattgtgtt

SEQ ID NO: 793680 - DNA, 24 bp, Homo sapiens
gttttatttatatcttgttattaa

SEQ ID NO: 793681 - DNA, 22 bp, Homo sapiens
gttttcaaccggaaggaggcca

SEQ ID NO: 793682 - DNA, 13 bp, Homo sapiens
gttttcaagtcaa

SEQ ID NO: 793683 - DNA, 18 bp, Homo sapiens
gttttcaagtcaaattaa

SEQ ID NO: 793684 - DNA, 15 bp, Homo sapiens
gttttcaatgtgaaa

SEQ ID NO: 793685 - DNA, 18 bp, Homo sapiens
gttttcaattttaaacat

SEQ ID NO: 793686 - DNA, 20 bp, Homo sapiens
gttttcagaacctcttcccc

SEQ ID NO: 793687 - DNA, 16 bp, Homo sapiens
gttttcagaagaaata

SEQ ID NO: 793688 - DNA, 14 bp, Homo sapiens
gttttcagcccccc

SEQ ID NO: 793689 - DNA, 24 bp, Homo sapiens
gttttcaggagtgggttgatttca

SEQ ID NO: 793690 - DNA, 16 bp, Homo sapiens
gttttcaggtccagag

SEQ ID NO: 793691 - DNA, 16 bp, Homo sapiens
gttttcagtgtacatg

SEQ ID NO: 793692 - DNA, 16 bp, Homo sapiens
gttttcagtttgtata

SEQ ID NO: 793693 - DNA, 13 bp, Homo sapiens
gttttcatcattt

SEQ ID NO: 793694 - DNA, 18 bp, Homo sapiens
gttttcatcatttcagcc

SEQ ID NO: 793695 - DNA, 19 bp, Homo sapiens
gttttcatccataactgaa

SEQ ID NO: 793696 - DNA, 21 bp, Homo sapiens
gttttcatccataactgaaca

SEQ ID NO: 793697 - DNA, 17 bp, Homo sapiens
gttttcatcctggcctc

SEQ ID NO: 793698 - DNA, 18 bp, Homo sapiens
gttttcatcctggcctcc

SEQ ID NO: 793699 - DNA, 10 bp, Homo sapiens
gttttcatgg

SEQ ID NO: 793700 - DNA, 21 bp, Homo sapiens
gttttcatggtgaaaatgtac

SEQ ID NO: 793701 - DNA, 21 bp, Homo sapiens
gttttcattatgttcatgtaa

SEQ ID NO: 793702 - DNA, 22 bp, Homo sapiens
gttttcattatgttcatgtaag

SEQ ID NO: 793703 - DNA, 22 bp, Homo sapiens
gttttcatttactctaaaaact

SEQ ID NO: 793704 - DNA, 12 bp, Homo sapiens
gttttcatttgc

SEQ ID NO: 793705 - DNA, 13 bp, Homo sapiens
gttttccaaagag

SEQ ID NO: 793706 - DNA, 18 bp, Homo sapiens
gttttccagtattgaaaa

SEQ ID NO: 793707 - DNA, 14 bp, Homo sapiens
gttttccatgaaaa

SEQ ID NO: 793708 - DNA, 21 bp, Homo sapiens
gttttccccaaaccataaaac

SEQ ID NO: 793709 - DNA, 16 bp, Homo sapiens
gttttccccacattct

SEQ ID NO: 793710 - DNA, 17 bp, Homo sapiens
gttttcctaaatgcagt

SEQ ID NO: 793711 - DNA, 22 bp, Homo sapiens
gttttcctcatcctttccctct

SEQ ID NO: 793712 - DNA, 23 bp, Homo sapiens
gttttcctcatcctttccctctc

SEQ ID NO: 793713 - DNA, 22 bp, Homo sapiens
gttttcctctatacatctctcc

SEQ ID NO: 793714 - DNA, 19 bp, Homo sapiens
gttttcctgctttacaaaa

SEQ ID NO: 793715 - DNA, 19 bp, Homo sapiens
gttttcctttgtcatcatt

SEQ ID NO: 793716 - DNA, 19 bp, Homo sapiens
gttttcgaagctcagccca

SEQ ID NO: 793717 - DNA, 23 bp, Homo sapiens
gttttcgcacctaccatcaggga

SEQ ID NO: 793718 - DNA, 16 bp, Homo sapiens
gttttctaaagccagg

SEQ ID NO: 793719 - DNA, 15 bp, Homo sapiens
gttttctaagatgtt

SEQ ID NO: 793720 - DNA, 20 bp, Homo sapiens
gttttctcagaacagctgaa

SEQ ID NO: 793721 - DNA, 11 bp, Homo sapiens
gttttctccct

SEQ ID NO: 793722 - DNA, 13 bp, Homo sapiens
gttttctccctct

SEQ ID NO: 793723 - DNA, 16 bp, Homo sapiens
gttttctcctcccagg

SEQ ID NO: 793724 - DNA, 18 bp, Homo sapiens
gttttctcctcccaggaa

SEQ ID NO: 793725 - DNA, 15 bp, Homo sapiens
gttttctcctctgct

SEQ ID NO: 793726 - DNA, 17 bp, Homo sapiens
gttttctcctctgcttc

SEQ ID NO: 793727 - DNA, 17 bp, Homo sapiens
gttttctctcggctccc

SEQ ID NO: 793728 - DNA, 14 bp, Homo sapiens
gttttctctctgga

SEQ ID NO: 793729 - DNA, 15 bp, Homo sapiens
gttttctctctggat

SEQ ID NO: 793730 - DNA, 12 bp, Homo sapiens
gttttctcttga

SEQ ID NO: 793731 - DNA, 15 bp, Homo sapiens
gttttctgctgttta

SEQ ID NO: 793732 - DNA, 17 bp, Homo sapiens
gttttctggctggagcc

SEQ ID NO: 793733 - DNA, 18 bp, Homo sapiens
gttttctggctggagcct

SEQ ID NO: 793734 - DNA, 14 bp, Homo sapiens
gttttctgtagact

SEQ ID NO: 793735 - DNA, 19 bp, Homo sapiens
gttttctgttctttctggc

SEQ ID NO: 793736 - DNA, 15 bp, Homo sapiens
gttttctgtttgtaa

SEQ ID NO: 793737 - DNA, 16 bp, Homo sapiens
gttttctgtttgtaaa

SEQ ID NO: 793738 - DNA, 17 bp, Homo sapiens
gttttctgtttgtaaat

SEQ ID NO: 793739 - DNA, 17 bp, Homo sapiens
gttttcttaaccatctt

SEQ ID NO: 793740 - DNA, 22 bp, Homo sapiens
gttttcttcaagggaagaaaca

SEQ ID NO: 793741 - DNA, 23 bp, Homo sapiens
gttttcttcaagggaagaaacac

SEQ ID NO: 793742 - DNA, 12 bp, Homo sapiens
gttttcttccca

SEQ ID NO: 793743 - DNA, 20 bp, Homo sapiens
gttttcttcccatcactgga

SEQ ID NO: 793744 - DNA, 13 bp, Homo sapiens
gttttcttctttc

SEQ ID NO: 793745 - DNA, 14 bp, Homo sapiens
gttttcttctttcc

SEQ ID NO: 793746 - DNA, 15 bp, Homo sapiens
gttttcttctttccc

SEQ ID NO: 793747 - DNA, 22 bp, Homo sapiens
gttttcttctttccctggacag

SEQ ID NO: 793748 - DNA, 17 bp, Homo sapiens
gttttcttgtaaatgtt

SEQ ID NO: 793749 - DNA, 19 bp, Homo sapiens
gttttcttgtaaatgtttc

SEQ ID NO: 793750 - DNA, 18 bp, Homo sapiens
taaaaaaaaatactcttt

SEQ ID NO: 793751 - DNA, 22 bp, Homo sapiens
taaaaaaaacaaaaagaacaaa

SEQ ID NO: 793752 - DNA, 11 bp, Homo sapiens
taaaaaaaaga

SEQ ID NO: 793753 - DNA, 15 bp, Homo sapiens
taaaaaaaagaaaaa

SEQ ID NO: 793754 - DNA, 17 bp, Homo sapiens
taaaaaaaagaaaaaag

SEQ ID NO: 793755 - DNA, 15 bp, Homo sapiens
taaaaaaaatttgtg

SEQ ID NO: 793756 - DNA, 21 bp, Homo sapiens
taaaaaaacaatcatttgctt

SEQ ID NO: 793757 - DNA, 12 bp, Homo sapiens
taaaaaaactga

SEQ ID NO: 793758 - DNA, 14 bp, Homo sapiens
taaaaaaactgaag

SEQ ID NO: 793759 - DNA, 22 bp, Homo sapiens
taaaaaaataagaagaatgctt

SEQ ID NO: 793760 - DNA, 20 bp, Homo sapiens
taaaaaaataataataatgt

SEQ ID NO: 793761 - DNA, 12 bp, Homo sapiens
taaaaaaatttg

SEQ ID NO: 793762 - DNA, 16 bp, Homo sapiens
taaaaaaatttttgac

SEQ ID NO: 793763 - DNA, 22 bp, Homo sapiens
taaaaaaatttttgacactttt

SEQ ID NO: 793764 - DNA, 13 bp, Homo sapiens
taaaaaacaaaaa

SEQ ID NO: 793765 - DNA, 14 bp, Homo sapiens
taaaaaacaaagaa

SEQ ID NO: 793766 - DNA, 19 bp, Homo sapiens
taaaaaacaaagaagacaa

SEQ ID NO: 793767 - DNA, 13 bp, Homo sapiens
taaaaaacaagaa

SEQ ID NO: 793768 - DNA, 21 bp, Homo sapiens
taaaaaagactgaacatgttt

SEQ ID NO: 793769 - DNA, 13 bp, Homo sapiens
taaaaaagagaca

SEQ ID NO: 793770 - DNA, 19 bp, Homo sapiens
taaaaaagattctactaac

SEQ ID NO: 793771 - DNA, 15 bp, Homo sapiens
taaaaaagcaaagga

SEQ ID NO: 793772 - DNA, 14 bp, Homo sapiens
taaaaaagccttcc

SEQ ID NO: 793773 - DNA, 18 bp, Homo sapiens
taaaaaagctcttttaat

SEQ ID NO: 793774 - DNA, 18 bp, Homo sapiens
taaaaaaggagaattgaa

SEQ ID NO: 793775 - DNA, 19 bp, Homo sapiens
taaaaaataccattgaaat

SEQ ID NO: 793776 - DNA, 17 bp, Homo sapiens
taaaaaatattttaaga

SEQ ID NO: 793777 - DNA, 19 bp, Homo sapiens
taaaaaatattttaagaaa

SEQ ID NO: 793778 - DNA, 14 bp, Homo sapiens
taaaaaatattttc

SEQ ID NO: 793779 - DNA, 18 bp, Homo sapiens
taaaaaatcaatcaatgg

SEQ ID NO: 793780 - DNA, 23 bp, Homo sapiens
taaaaaatcaatcaatggtgcaa

SEQ ID NO: 793781 - DNA, 13 bp, Homo sapiens
taaaaaatggaaa

SEQ ID NO: 793782 - DNA, 14 bp, Homo sapiens
taaaaaatggtcac

SEQ ID NO: 793783 - DNA, 16 bp, Homo sapiens
taaaaaatgtaacatc

SEQ ID NO: 793784 - DNA, 16 bp, Homo sapiens
taaaaaattaaagccc

SEQ ID NO: 793785 - DNA, 18 bp, Homo sapiens
taaaaaattaaagcccat

SEQ ID NO: 793786 - DNA, 18 bp, Homo sapiens
taaaaaattatgacaatg

SEQ ID NO: 793787 - DNA, 13 bp, Homo sapiens
taaaaaatttgta

SEQ ID NO: 793788 - DNA, 17 bp, Homo sapiens
taaaaacaaaggaataa

SEQ ID NO: 793789 - DNA, 15 bp, Homo sapiens
taaaaacaactttca

SEQ ID NO: 793790 - DNA, 18 bp, Homo sapiens
taaaaacaactttcactt

SEQ ID NO: 793791 - DNA, 21 bp, Homo sapiens
taaaaacactacctcttttga

SEQ ID NO: 793792 - DNA, 16 bp, Homo sapiens
taaaaacagcattgct

SEQ ID NO: 793793 - DNA, 17 bp, Homo sapiens
taaaaacagcattgctt

SEQ ID NO: 793794 - DNA, 15 bp, Homo sapiens
taaaaacattttgaa

SEQ ID NO: 793795 - DNA, 17 bp, Homo sapiens
taaaaaccaatcatttt

SEQ ID NO: 793796 - DNA, 14 bp, Homo sapiens
taaaaacccaaaat

SEQ ID NO: 793797 - DNA, 21 bp, Homo sapiens
taaaaacccaagtttatttct

SEQ ID NO: 793798 - DNA, 16 bp, Homo sapiens
taaaaaccgaataaat

SEQ ID NO: 793799 - DNA, 20 bp, Homo sapiens
taaaaactagaggtgagaaa

SEQ ID NO: 793800 - DNA, 14 bp, Homo sapiens
taaaaactcttcag

SEQ ID NO: 793801 - DNA, 22 bp, Homo sapiens
taaaaactcttcagtgcaaatt

SEQ ID NO: 793802 - DNA, 13 bp, Homo sapiens
taaaaactgaaga

SEQ ID NO: 793803 - DNA, 21 bp, Homo sapiens
taaaaactgagtgactctata

SEQ ID NO: 793804 - DNA, 21 bp, Homo sapiens
taaaaactgtgtatcattaaa

SEQ ID NO: 793805 - DNA, 17 bp, Homo sapiens
taaaaacttgtactatg

SEQ ID NO: 793806 - DNA, 15 bp, Homo sapiens
taaaaactttaaaga

SEQ ID NO: 793807 - DNA, 23 bp, Homo sapiens
taaaaagaaaatattaaattaca

SEQ ID NO: 793808 - DNA, 21 bp, Homo sapiens
taaaaagaagatgaatggtct

SEQ ID NO: 793809 - DNA, 13 bp, Homo sapiens
taaaaagaaggaa

SEQ ID NO: 793810 - DNA, 21 bp, Homo sapiens
taaaaagaattccaccaggct

SEQ ID NO: 793811 - DNA, 16 bp, Homo sapiens
taaaaagacctggcct

SEQ ID NO: 793812 - DNA, 22 bp, Homo sapiens
taaaaagaggatgatttcagaa

SEQ ID NO: 793813 - DNA, 23 bp, Homo sapiens
taaaaagaggatgatttcagaag

SEQ ID NO: 793814 - DNA, 16 bp, Homo sapiens
taaaaagataatctca

SEQ ID NO: 793815 - DNA, 23 bp, Homo sapiens
taaaaagataatctcagtgcttt

SEQ ID NO: 793816 - DNA, 14 bp, Homo sapiens
taaaaagatcactt

SEQ ID NO: 793817 - DNA, 23 bp, Homo sapiens
taaaaagatccagggatggagat

SEQ ID NO: 793818 - DNA, 18 bp, Homo sapiens
taaaaagattgaagtatt

SEQ ID NO: 793819 - DNA, 21 bp, Homo sapiens
taaaaagcagaattttaatgt

SEQ ID NO: 793820 - DNA, 12 bp, Homo sapiens
taaaaagcagca

SEQ ID NO: 793821 - DNA, 17 bp, Homo sapiens
taaaaagccagggctgg

SEQ ID NO: 793822 - DNA, 16 bp, Homo sapiens
taaaaagctcactgct

SEQ ID NO: 793823 - DNA, 18 bp, Homo sapiens
taaaaagctcactgctga

SEQ ID NO: 793824 - DNA, 17 bp, Homo sapiens
taaaaagcttttgtcta

SEQ ID NO: 793825 - DNA, 19 bp, Homo sapiens
taaaaaggacatcagcaaa

SEQ ID NO: 793826 - DNA, 21 bp, Homo sapiens
taaaaaggacatcagcaaaca

SEQ ID NO: 793827 - DNA, 15 bp, Homo sapiens
taaaaaggccaaaga

SEQ ID NO: 793828 - DNA, 19 bp, Homo sapiens
taaaaaggccaaagataaa

SEQ ID NO: 793829 - DNA, 22 bp, Homo sapiens
taaaaaggccaaagataaaagg

SEQ ID NO: 793830 - DNA, 20 bp, Homo sapiens
taaaaagggcagggcatctc

SEQ ID NO: 793831 - DNA, 16 bp, Homo sapiens
taaaaaggtaaatggt

SEQ ID NO: 793832 - DNA, 19 bp, Homo sapiens
taaaaaggtctgttaatgt

SEQ ID NO: 793833 - DNA, 21 bp, Homo sapiens
taaaaagtaatgacttagaaa

SEQ ID NO: 793834 - DNA, 13 bp, Homo sapiens
taaaaagtataaa

SEQ ID NO: 793835 - DNA, 15 bp, Homo sapiens
taaaaagtctgtatg

SEQ ID NO: 793836 - DNA, 21 bp, Homo sapiens
taaaaagtgaacttttgtaat

SEQ ID NO: 793837 - DNA, 17 bp, Homo sapiens
taaaaataaatttggtt

SEQ ID NO: 793838 - DNA, 19 bp, Homo sapiens
taaaaataagtcaacagta

SEQ ID NO: 793839 - DNA, 19 bp, Homo sapiens
taaaaataataataaagtg

SEQ ID NO: 793840 - DNA, 17 bp, Homo sapiens
taaaaatagcagtatta

SEQ ID NO: 793841 - DNA, 12 bp, Homo sapiens
taaaaatataaa

SEQ ID NO: 793842 - DNA, 17 bp, Homo sapiens
taaaaatataaattgta

SEQ ID NO: 793843 - DNA, 15 bp, Homo sapiens
taaaaatatagcaaa

SEQ ID NO: 793844 - DNA, 16 bp, Homo sapiens
taaaaatatagcaaat

SEQ ID NO: 793845 - DNA, 19 bp, Homo sapiens
taaaaatatagcaaatgca

SEQ ID NO: 793846 - DNA, 14 bp, Homo sapiens
taaaaatatatatt

SEQ ID NO: 793847 - DNA, 15 bp, Homo sapiens
taaaaatatgtacaa

SEQ ID NO: 793848 - DNA, 13 bp, Homo sapiens
taaaaatatttca

SEQ ID NO: 793849 - DNA, 15 bp, Homo sapiens
taaaaatcatagtac

SEQ ID NO: 793850 - DNA, 16 bp, Homo sapiens
taaaaatccttttgaa

SEQ ID NO: 793851 - DNA, 20 bp, Homo sapiens
taaaaatctcaaatttctaa

SEQ ID NO: 793852 - DNA, 16 bp, Homo sapiens
taaaaatgaaagtgac

SEQ ID NO: 793853 - DNA, 15 bp, Homo sapiens
taaaaatgagacttt

SEQ ID NO: 793854 - DNA, 17 bp, Homo sapiens
taaaaatgagacttttt

SEQ ID NO: 793855 - DNA, 15 bp, Homo sapiens
taaaacccaatactt

SEQ ID NO: 793856 - DNA, 15 bp, Homo sapiens
taaaaccttgttcta

SEQ ID NO: 793857 - DNA, 19 bp, Homo sapiens
taaaaccttgttctatttt

SEQ ID NO: 793858 - DNA, 21 bp, Homo sapiens
taaaaccttgttctatttttc

SEQ ID NO: 793859 - DNA, 22 bp, Homo sapiens
taaaaccttgttctatttttca

SEQ ID NO: 793860 - DNA, 12 bp, Homo sapiens
taaaactaaata

SEQ ID NO: 793861 - DNA, 20 bp, Homo sapiens
taaaactaaatatatgtctg

SEQ ID NO: 793862 - DNA, 21 bp, Homo sapiens
taaaactaagctctttgagaa

SEQ ID NO: 793863 - DNA, 18 bp, Homo sapiens
taaaactaatgagtatga

SEQ ID NO: 793864 - DNA, 18 bp, Homo sapiens
taaaactatggttcccaa

SEQ ID NO: 793865 - DNA, 22 bp, Homo sapiens
taaaactatggttcccaataaa

SEQ ID NO: 793866 - DNA, 14 bp, Homo sapiens
taaaactatttaaa

SEQ ID NO: 793867 - DNA, 19 bp, Homo sapiens
taaaactatttaaaattgg

SEQ ID NO: 793868 - DNA, 20 bp, Homo sapiens
taaaactatttaaaattggc

SEQ ID NO: 793869 - DNA, 12 bp, Homo sapiens
taaaactcagaa

SEQ ID NO: 793870 - DNA, 13 bp, Homo sapiens
taaaactcagaat

SEQ ID NO: 793871 - DNA, 17 bp, Homo sapiens
taaaactcataatgttg

SEQ ID NO: 793872 - DNA, 15 bp, Homo sapiens
taaaactcataatta

SEQ ID NO: 793873 - DNA, 20 bp, Homo sapiens
taaaactctcattatttgtg

SEQ ID NO: 793874 - DNA, 21 bp, Homo sapiens
taaaactctcattatttgtgt

SEQ ID NO: 793875 - DNA, 13 bp, Homo sapiens
taaaactctcctt

SEQ ID NO: 793876 - DNA, 20 bp, Homo sapiens
taaaactgcacagtgctgtt

SEQ ID NO: 793877 - DNA, 20 bp, Homo sapiens
taaaactgcgaggacatcaa

SEQ ID NO: 793878 - DNA, 21 bp, Homo sapiens
taaaactgcgaggacatcaaa

SEQ ID NO: 793879 - DNA, 17 bp, Homo sapiens
taaaactggctttggct

SEQ ID NO: 793880 - DNA, 16 bp, Homo sapiens
taaaactgtcactgtt

SEQ ID NO: 793881 - DNA, 18 bp, Homo sapiens
taaaacttatgctagttt

SEQ ID NO: 793882 - DNA, 22 bp, Homo sapiens
taaaacttcagtttcacagaaa

SEQ ID NO: 793883 - DNA, 17 bp, Homo sapiens
taaaacttggatggact

SEQ ID NO: 793884 - DNA, 19 bp, Homo sapiens
taaaactttaaaaggcaac

SEQ ID NO: 793885 - DNA, 13 bp, Homo sapiens
taaaactttattt

SEQ ID NO: 793886 - DNA, 14 bp, Homo sapiens
taaaactttgctgc

SEQ ID NO: 793887 - DNA, 12 bp, Homo sapiens
taaaacttttta

SEQ ID NO: 793888 - DNA, 13 bp, Homo sapiens
taaaagaaacact

SEQ ID NO: 793889 - DNA, 14 bp, Homo sapiens
taaaagaaactttc

SEQ ID NO: 793890 - DNA, 17 bp, Homo sapiens
taaaagaaactttcttt

SEQ ID NO: 793891 - DNA, 19 bp, Homo sapiens
taaaagaaatcttgcttca

SEQ ID NO: 793892 - DNA, 18 bp, Homo sapiens
taaaagaacttactgatt

SEQ ID NO: 793893 - DNA, 12 bp, Homo sapiens
taaaagaagaga

SEQ ID NO: 793894 - DNA, 18 bp, Homo sapiens
taaaagaattttaccatt

SEQ ID NO: 793895 - DNA, 23 bp, Homo sapiens
taaaagacactgtttacaagaaa

SEQ ID NO: 793896 - DNA, 14 bp, Homo sapiens
taaaagacagcagg

SEQ ID NO: 793897 - DNA, 19 bp, Homo sapiens
taaaagagagagagagaaa

SEQ ID NO: 793898 - DNA, 14 bp, Homo sapiens
taaaagataaatta

SEQ ID NO: 793899 - DNA, 17 bp, Homo sapiens
taaaagatacagttact

SEQ ID NO: 793900 - DNA, 21 bp, Homo sapiens
taaaagatacagttactcaga

SEQ ID NO: 793901 - DNA, 17 bp, Homo sapiens
taaaagatcaccttgta

SEQ ID NO: 793902 - DNA, 18 bp, Homo sapiens
taaaagatcaccttgtat

SEQ ID NO: 793903 - DNA, 14 bp, Homo sapiens
taaaagatcctttt

SEQ ID NO: 793904 - DNA, 14 bp, Homo sapiens
taaaagatgaaggc

SEQ ID NO: 793905 - DNA, 22 bp, Homo sapiens
taaaagatgaagttttatacac

SEQ ID NO: 793906 - DNA, 19 bp, Homo sapiens
taaaagcaaaaaagaaaac

SEQ ID NO: 793907 - DNA, 20 bp, Homo sapiens
taaaagcaaaaaagaaaacc

SEQ ID NO: 793908 - DNA, 23 bp, Homo sapiens
taaaagcaaaaaagaaaaccttt

SEQ ID NO: 793909 - DNA, 17 bp, Homo sapiens
taaaagcaaaaagatgt

SEQ ID NO: 793910 - DNA, 18 bp, Homo sapiens
taaaagcaaaaagatgta

SEQ ID NO: 793911 - DNA, 16 bp, Homo sapiens
taaaagcaattctgac

SEQ ID NO: 793912 - DNA, 20 bp, Homo sapiens
taaaagcacaagtacttttg

SEQ ID NO: 793913 - DNA, 20 bp, Homo sapiens
taaaagcagcatctgctaat

SEQ ID NO: 793914 - DNA, 17 bp, Homo sapiens
taaaagcataaatgcaa

SEQ ID NO: 793915 - DNA, 18 bp, Homo sapiens
taaaagcataaatgcaaa

SEQ ID NO: 793916 - DNA, 14 bp, Homo sapiens
taaaagcatgaaac

SEQ ID NO: 793917 - DNA, 21 bp, Homo sapiens
taaaagcattttaatactaag

SEQ ID NO: 793918 - DNA, 18 bp, Homo sapiens
taaaagcattttgtaata

SEQ ID NO: 793919 - DNA, 14 bp, Homo sapiens
taaaagcatttttt

SEQ ID NO: 793920 - DNA, 22 bp, Homo sapiens
taaaagctatcttcatgtaaat

SEQ ID NO: 793921 - DNA, 17 bp, Homo sapiens
taaaagctcagatgaca

SEQ ID NO: 793922 - DNA, 15 bp, Homo sapiens
taaaagctttcatgt

SEQ ID NO: 793923 - DNA, 14 bp, Homo sapiens
taaaaggaaaagca

SEQ ID NO: 793924 - DNA, 15 bp, Homo sapiens
taaaaggaaaaggtt

SEQ ID NO: 793925 - DNA, 15 bp, Homo sapiens
taaaaggaaagaaaa

SEQ ID NO: 793926 - DNA, 11 bp, Homo sapiens
taaaaggatgt

SEQ ID NO: 793927 - DNA, 15 bp, Homo sapiens
taaaaggatgttaca

SEQ ID NO: 793928 - DNA, 16 bp, Homo sapiens
taaaaggatgttacaa

SEQ ID NO: 793929 - DNA, 20 bp, Homo sapiens
taaaaggattattactaatt

SEQ ID NO: 793930 - DNA, 21 bp, Homo sapiens
taaaaggcaactcaaagatga

SEQ ID NO: 793931 - DNA, 18 bp, Homo sapiens
taaaaggcttgaagctgt

SEQ ID NO: 793932 - DNA, 20 bp, Homo sapiens
taaaagggaacacaaaacat

SEQ ID NO: 793933 - DNA, 23 bp, Homo sapiens
taaaagggatacacaggactgaa

SEQ ID NO: 793934 - DNA, 21 bp, Homo sapiens
taaaagggggtccgtggaaga

SEQ ID NO: 793935 - DNA, 12 bp, Homo sapiens
taaaaggtgacc

SEQ ID NO: 793936 - DNA, 14 bp, Homo sapiens
taaaagtaaacatt

SEQ ID NO: 793937 - DNA, 21 bp, Homo sapiens
taaaagtactttaaaaaggaa

SEQ ID NO: 793938 - DNA, 22 bp, Homo sapiens
taaaagtatctttaacaattgt

SEQ ID NO: 793939 - DNA, 17 bp, Homo sapiens
taaaagtcattattcct

SEQ ID NO: 793940 - DNA, 18 bp, Homo sapiens
taaaagtcattattcctg

SEQ ID NO: 793941 - DNA, 20 bp, Homo sapiens
taaaagtgaagtgaatctga

SEQ ID NO: 793942 - DNA, 15 bp, Homo sapiens
taaaagtgcatttaa

SEQ ID NO: 793943 - DNA, 17 bp, Homo sapiens
taaaagtgcatttaagg

SEQ ID NO: 793944 - DNA, 20 bp, Homo sapiens
taaaagtgcatttaaggaga

SEQ ID NO: 793945 - DNA, 22 bp, Homo sapiens
taaaagtgggcttgattctgca

SEQ ID NO: 793946 - DNA, 23 bp, Homo sapiens
taaaagtgggcttgattctgcag

SEQ ID NO: 793947 - DNA, 14 bp, Homo sapiens
taaaagtgtgagca

SEQ ID NO: 793948 - DNA, 18 bp, Homo sapiens
taaaagtgtgagcagtga

SEQ ID NO: 793949 - DNA, 12 bp, Homo sapiens
taaaagttactt

SEQ ID NO: 793950 - DNA, 17 bp, Homo sapiens
taaaagttataataact

SEQ ID NO: 793951 - DNA, 23 bp, Homo sapiens
taaaagttcctctcccttccctt

SEQ ID NO: 793952 - DNA, 18 bp, Homo sapiens
taaaagttgaaaaaccac

SEQ ID NO: 793953 - DNA, 17 bp, Homo sapiens
taaaagttgcattttaa

SEQ ID NO: 793954 - DNA, 21 bp, Homo sapiens
taaaagttgcgtttaagttgt

SEQ ID NO: 793955 - DNA, 14 bp, Homo sapiens
taaaagttgtgatt

SEQ ID NO: 793956 - DNA, 16 bp, Homo sapiens
taaaagtttacaactt

SEQ ID NO: 793957 - DNA, 18 bp, Homo sapiens
taaaagtttcaatgtgat

SEQ ID NO: 793958 - DNA, 18 bp, Homo sapiens
taaaagtttgaaaagcaa

SEQ ID NO: 793959 - DNA, 20 bp, Homo sapiens
taaaagtttgaaaagcaata

SEQ ID NO: 793960 - DNA, 16 bp, Homo sapiens
taaaagttttctccaa

SEQ ID NO: 793961 - DNA, 21 bp, Homo sapiens
taaaagttttgaaggaaacct

SEQ ID NO: 793962 - DNA, 20 bp, Homo sapiens
taaaagttttgatatttatt

SEQ ID NO: 793963 - DNA, 12 bp, Homo sapiens
taaaataaaaaa

SEQ ID NO: 793964 - DNA, 13 bp, Homo sapiens
taaaataaaacaa

SEQ ID NO: 793965 - DNA, 14 bp, Homo sapiens
taaaataaaacaag

SEQ ID NO: 793966 - DNA, 17 bp, Homo sapiens
taaaataaacttcttaa

SEQ ID NO: 793967 - DNA, 13 bp, Homo sapiens
taaaataaagaaa

SEQ ID NO: 793968 - DNA, 17 bp, Homo sapiens
taaaataaagtatatat

SEQ ID NO: 793969 - DNA, 20 bp, Homo sapiens
taaaataaccccgggcaaga

SEQ ID NO: 793970 - DNA, 17 bp, Homo sapiens
taaaataagtctgattt

SEQ ID NO: 793971 - DNA, 18 bp, Homo sapiens
taaaataagtctgattta

SEQ ID NO: 793972 - DNA, 16 bp, Homo sapiens
taaatatgtcagatgt

SEQ ID NO: 793973 - DNA, 20 bp, Homo sapiens
taaatatgtgaagaaaaaga

SEQ ID NO: 793974 - DNA, 18 bp, Homo sapiens
taaatatgttttttagat

SEQ ID NO: 793975 - DNA, 15 bp, Homo sapiens
taaatattcatatta

SEQ ID NO: 793976 - DNA, 14 bp, Homo sapiens
taaatattctgaat

SEQ ID NO: 793977 - DNA, 17 bp, Homo sapiens
taaatattcttgtccac

SEQ ID NO: 793978 - DNA, 21 bp, Homo sapiens
taaatattcttgtccacattc

SEQ ID NO: 793979 - DNA, 23 bp, Homo sapiens
taaatattcttgtccacattcta

SEQ ID NO: 793980 - DNA, 19 bp, Homo sapiens
taaatatttaccttgaaaa

SEQ ID NO: 793981 - DNA, 13 bp, Homo sapiens
taaatatttactc

SEQ ID NO: 793982 - DNA, 21 bp, Homo sapiens
taaatatttactctttgcaaa

SEQ ID NO: 793983 - DNA, 14 bp, Homo sapiens
taaatatttatgct

SEQ ID NO: 793984 - DNA, 17 bp, Homo sapiens
taaatatttatgtagat

SEQ ID NO: 793985 - DNA, 15 bp, Homo sapiens
taaatatttccttaa

SEQ ID NO: 793986 - DNA, 14 bp, Homo sapiens
taaatattttaaag

SEQ ID NO: 793987 - DNA, 16 bp, Homo sapiens
taaatattttctattt

SEQ ID NO: 793988 - DNA, 17 bp, Homo sapiens
taaatattttctatttt

SEQ ID NO: 793989 - DNA, 13 bp, Homo sapiens
taaatattttgat

SEQ ID NO: 793990 - DNA, 17 bp, Homo sapiens
taaatattttgatacaa

SEQ ID NO: 793991 - DNA, 19 bp, Homo sapiens
taaatattttgatacaaat

SEQ ID NO: 793992 - DNA, 14 bp, Homo sapiens
taaatatttttccc

SEQ ID NO: 793993 - DNA, 17 bp, Homo sapiens
taaatatttttccctcc

SEQ ID NO: 793994 - DNA, 23 bp, Homo sapiens
taaatcaatgtcacttaaaggct

SEQ ID NO: 793995 - DNA, 16 bp, Homo sapiens
taaatcacagaaaatt

SEQ ID NO: 793996 - DNA, 18 bp, Homo sapiens
taaatcacagaaaattta

SEQ ID NO: 793997 - DNA, 20 bp, Homo sapiens
taaatcaccatagggctggg

SEQ ID NO: 793998 - DNA, 12 bp, Homo sapiens
taaatcagaaag

SEQ ID NO: 793999 - DNA, 12 bp, Homo sapiens
taaatcagacca

SEQ ID NO: 794000 - DNA, 22 bp, Homo sapiens
taaatcagatgttttggtcaag

SEQ ID NO: 794001 - DNA, 15 bp, Homo sapiens
taaatcagtgaactg

SEQ ID NO: 794002 - DNA, 20 bp, Homo sapiens
taaatcagtgcctggtgttc

SEQ ID NO: 794003 - DNA, 14 bp, Homo sapiens
taaatcagttggag

SEQ ID NO: 794004 - DNA, 16 bp, Homo sapiens
taaatcagttggagtt

SEQ ID NO: 794005 - DNA, 20 bp, Homo sapiens
taaatcatatataataaatt

SEQ ID NO: 794006 - DNA, 22 bp, Homo sapiens
taaatcatgatgctagccagca

SEQ ID NO: 794007 - DNA, 12 bp, Homo sapiens
taaatcatgtat

SEQ ID NO: 794008 - DNA, 19 bp, Homo sapiens
taaatcatttcagtatcat

SEQ ID NO: 794009 - DNA, 23 bp, Homo sapiens
taaatcatttcagtatcatctcc

SEQ ID NO: 794010 - DNA, 15 bp, Homo sapiens
taaatcatttggtta

SEQ ID NO: 794011 - DNA, 19 bp, Homo sapiens
taaatccaatatcatgtct

SEQ ID NO: 794012 - DNA, 13 bp, Homo sapiens
taaatcccctcac

SEQ ID NO: 794013 - DNA, 15 bp, Homo sapiens
taaatccgacttgaa

SEQ ID NO: 794014 - DNA, 18 bp, Homo sapiens
taaatcctgaagagcatt

SEQ ID NO: 794015 - DNA, 17 bp, Homo sapiens
taaatcctgccatttaa

SEQ ID NO: 794016 - DNA, 17 bp, Homo sapiens
taaatcctttactgtta

SEQ ID NO: 794017 - DNA, 19 bp, Homo sapiens
taaatctaggatgtgatga

SEQ ID NO: 794018 - DNA, 16 bp, Homo sapiens
taaatctatttattaa

SEQ ID NO: 794019 - DNA, 18 bp, Homo sapiens
taaatctatttattaata

SEQ ID NO: 794020 - DNA, 19 bp, Homo sapiens
taaatctatttattaatat

SEQ ID NO: 794021 - DNA, 17 bp, Homo sapiens
taaatctcaaatttatt

SEQ ID NO: 794022 - DNA, 18 bp, Homo sapiens
taaatctccaaaataaaa

SEQ ID NO: 794023 - DNA, 21 bp, Homo sapiens
taaatctccaaaataaaactt

SEQ ID NO: 794024 - DNA, 15 bp, Homo sapiens
taaatctgaagaaag

SEQ ID NO: 794025 - DNA, 23 bp, Homo sapiens
taaatctgagaggtaagaagtaa

SEQ ID NO: 794026 - DNA, 20 bp, Homo sapiens
taaatctgctggagtttcat

SEQ ID NO: 794027 - DNA, 22 bp, Homo sapiens
taaatctggggaagaggtttta

SEQ ID NO: 794028 - DNA, 12 bp, Homo sapiens
taaatctgtgat

SEQ ID NO: 794029 - DNA, 15 bp, Homo sapiens
taaatcttaaacaat

SEQ ID NO: 794030 - DNA, 15 bp, Homo sapiens
taaatcttaatgttc

SEQ ID NO: 794031 - DNA, 17 bp, Homo sapiens
taaatcttaatgttcct

SEQ ID NO: 794032 - DNA, 13 bp, Homo sapiens
taaatcttttata

SEQ ID NO: 794033 - DNA, 19 bp, Homo sapiens
taaatcttttataggattt

SEQ ID NO: 794034 - DNA, 17 bp, Homo sapiens
taaatctttttgcttct

SEQ ID NO: 794035 - DNA, 21 bp, Homo sapiens
taaatctttttgcttctactt

SEQ ID NO: 794036 - DNA, 21 bp, Homo sapiens
taaatgaaaggagtttaaaaa

SEQ ID NO: 794037 - DNA, 23 bp, Homo sapiens
taaatgaagaaagggaggcccag

SEQ ID NO: 794038 - DNA, 17 bp, Homo sapiens
taaatgaagcagcttta

SEQ ID NO: 794039 - DNA, 15 bp, Homo sapiens
taaatgacaaagtgt

SEQ ID NO: 794040 - DNA, 14 bp, Homo sapiens
taaatgacacccag

SEQ ID NO: 794041 - DNA, 17 bp, Homo sapiens
taaatgacttgattgta

SEQ ID NO: 794042 - DNA, 16 bp, Homo sapiens
taaatgacttttctta

SEQ ID NO: 794043 - DNA, 17 bp, Homo sapiens
taaatgaggggcctcag

SEQ ID NO: 794044 - DNA, 21 bp, Homo sapiens
taaatgatgtggtgcctgagg

SEQ ID NO: 794045 - DNA, 15 bp, Homo sapiens
taaatgattccaaat

SEQ ID NO: 794046 - DNA, 16 bp, Homo sapiens
taaatgattccaaata

SEQ ID NO: 794047 - DNA, 15 bp, Homo sapiens
taaatgatttaaatt

SEQ ID NO: 794048 - DNA, 14 bp, Homo sapiens
taaatgattttaat

SEQ ID NO: 794049 - DNA, 19 bp, Homo sapiens
taaatgcaaccagaattgt

SEQ ID NO: 794050 - DNA, 15 bp, Homo sapiens
taaatgcaataattt

SEQ ID NO: 794051 - DNA, 18 bp, Homo sapiens
taaatgcaatattcttga

SEQ ID NO: 794052 - DNA, 23 bp, Homo sapiens
taaatgcacctggaatatataac

SEQ ID NO: 794053 - DNA, 16 bp, Homo sapiens
taaatgcagttttaag

SEQ ID NO: 794054 - DNA, 18 bp, Homo sapiens
taaatgcagttttaagaa

SEQ ID NO: 794055 - DNA, 16 bp, Homo sapiens
taaatgcataaatgca

SEQ ID NO: 794056 - DNA, 20 bp, Homo sapiens
taaatgcatatcctgagcca

SEQ ID NO: 794057 - DNA, 14 bp, Homo sapiens
taaatgcatgtctt

SEQ ID NO: 794058 - DNA, 22 bp, Homo sapiens
taaatgcatgtcttaaatgctc

SEQ ID NO: 794059 - DNA, 15 bp, Homo sapiens
taaatgccctcttct

SEQ ID NO: 794060 - DNA, 15 bp, Homo sapiens
taaatgccttgtata

SEQ ID NO: 794061 - DNA, 17 bp, Homo sapiens
taaatgccttgtataaa

SEQ ID NO: 794062 - DNA, 14 bp, Homo sapiens
taaatgctattttt

SEQ ID NO: 794063 - DNA, 14 bp, Homo sapiens
taaatgctcataaa

SEQ ID NO: 794064 - DNA, 16 bp, Homo sapiens
taaatggaaccactct

SEQ ID NO: 794065 - DNA, 17 bp, Homo sapiens
taaatggaattattttg

SEQ ID NO: 794066 - DNA, 22 bp, Homo sapiens
taaatggcatcagcactttaac

SEQ ID NO: 794067 - DNA, 12 bp, Homo sapiens
taaatggccagt

SEQ ID NO: 794068 - DNA, 21 bp, Homo sapiens
taaatggccagtgctgcttct

SEQ ID NO: 794069 - DNA, 11 bp, Homo sapiens
taaatggctgc

SEQ ID NO: 794070 - DNA, 16 bp, Homo sapiens
taaatgggaattctca

SEQ ID NO: 794071 - DNA, 14 bp, Homo sapiens
taaatggggcccat

SEQ ID NO: 794072 - DNA, 16 bp, Homo sapiens
taaatgggtagagaaa

SEQ ID NO: 794073 - DNA, 23 bp, Homo sapiens
taaatgggtgtatataattttat

SEQ ID NO: 794074 - DNA, 17 bp, Homo sapiens
taaatggtcgcccagga

SEQ ID NO: 794075 - DNA, 15 bp, Homo sapiens
taaatggtgtacata

SEQ ID NO: 794076 - DNA, 16 bp, Homo sapiens
taaatggtgtacataa

SEQ ID NO: 794077 - DNA, 17 bp, Homo sapiens
taaatggtttctgaaaa

SEQ ID NO: 794078 - DNA, 18 bp, Homo sapiens
taaatggtttctgaaaat

SEQ ID NO: 794079 - DNA, 22 bp, Homo sapiens
taaatggtttggtgctttttat

SEQ ID NO: 794080 - DNA, 21 bp, Homo sapiens
taaatgtaaaaatgaaggaat

SEQ ID NO: 794081 - DNA, 17 bp, Homo sapiens
taaatgtaaagatattt

SEQ ID NO: 794082 - DNA, 15 bp, Homo sapiens
taaatgtaacttatt

SEQ ID NO: 794083 - DNA, 22 bp, Homo sapiens
taaatgtacatttccaaatgaa

SEQ ID NO: 794084 - DNA, 16 bp, Homo sapiens
taaatgtaggtatgaa

SEQ ID NO: 794085 - DNA, 20 bp, Homo sapiens
taaatgtatactatagtacc

SEQ ID NO: 794086 - DNA, 21 bp, Homo sapiens
taaatgtatcatttttgtgca

SEQ ID NO: 794087 - DNA, 14 bp, Homo sapiens
taaatgtccctaat

SEQ ID NO: 794088 - DNA, 14 bp, Homo sapiens
taaatgtgaatttt

SEQ ID NO: 794089 - DNA, 21 bp, Homo sapiens
taaatgtgaatttttatttct

SEQ ID NO: 794090 - DNA, 19 bp, Homo sapiens
taaatgtgatgaatactgt

SEQ ID NO: 794091 - DNA, 19 bp, Homo sapiens
taaatgtgattcacctctt

SEQ ID NO: 794092 - DNA, 19 bp, Homo sapiens
taaatgtgcaatagaaggt

SEQ ID NO: 794093 - DNA, 17 bp, Homo sapiens
taaatgtggattttgta

SEQ ID NO: 794094 - DNA, 14 bp, Homo sapiens
taaatgtgtacaat

SEQ ID NO: 794095 - DNA, 14 bp, Homo sapiens
taaatgtgtgtatg

SEQ ID NO: 794096 - DNA, 16 bp, Homo sapiens
taaatgtgtgtatgtg

SEQ ID NO: 794097 - DNA, 21 bp, Homo sapiens
taaatgtgttttgtttattaa

SEQ ID NO: 794098 - DNA, 17 bp, Homo sapiens
taaatgttaactacata

SEQ ID NO: 794099 - DNA, 22 bp, Homo sapiens
taaatgttaatggatttcagaa

SEQ ID NO: 794100 - DNA, 21 bp, Homo sapiens
taaatgttatgactatgtaaa

SEQ ID NO: 794101 - DNA, 15 bp, Homo sapiens
taaatgttgaaagat

SEQ ID NO: 794102 - DNA, 17 bp, Homo sapiens
taacatttagactaaat

SEQ ID NO: 794103 - DNA, 16 bp, Homo sapiens
taacatttctgttctc

SEQ ID NO: 794104 - DNA, 17 bp, Homo sapiens
taacatttctgttctca

SEQ ID NO: 794105 - DNA, 12 bp, Homo sapiens
taacatttgcct

SEQ ID NO: 794106 - DNA, 15 bp, Homo sapiens
taacatttgccttgc

SEQ ID NO: 794107 - DNA, 16 bp, Homo sapiens
taacatttgccttgca

SEQ ID NO: 794108 - DNA, 21 bp, Homo sapiens
taacatttgccttgcagaact

SEQ ID NO: 794109 - DNA, 13 bp, Homo sapiens
taacatttgctgt

SEQ ID NO: 794110 - DNA, 13 bp, Homo sapiens
taacattttaaat

SEQ ID NO: 794111 - DNA, 17 bp, Homo sapiens
taaccaaaggtgaagga

SEQ ID NO: 794112 - DNA, 22 bp, Homo sapiens
taaccaaatattaaagattctc

SEQ ID NO: 794113 - DNA, 18 bp, Homo sapiens
taaccaacattaaaactc

SEQ ID NO: 794114 - DNA, 20 bp, Homo sapiens
taaccaagctgagtttccta

SEQ ID NO: 794115 - DNA, 19 bp, Homo sapiens
taaccacaaagcacagttt

SEQ ID NO: 794116 - DNA, 18 bp, Homo sapiens
taaccaccgcatatgcat

SEQ ID NO: 794117 - DNA, 20 bp, Homo sapiens
taaccaccgcatatgcatgc

SEQ ID NO: 794118 - DNA, 19 bp, Homo sapiens
taaccaggccatttttggt

SEQ ID NO: 794119 - DNA, 19 bp, Homo sapiens
taaccaggccccagcctcc

SEQ ID NO: 794120 - DNA, 19 bp, Homo sapiens
taaccagtacctctgtata

SEQ ID NO: 794121 - DNA, 18 bp, Homo sapiens
taaccatttaaagaaaga

SEQ ID NO: 794122 - DNA, 18 bp, Homo sapiens
taaccatttaataaagaa

SEQ ID NO: 794123 - DNA, 14 bp, Homo sapiens
taaccatttgcact

SEQ ID NO: 794124 - DNA, 12 bp, Homo sapiens
taacccaaggag

SEQ ID NO: 794125 - DNA, 14 bp, Homo sapiens
taacccagttactt

SEQ ID NO: 794126 - DNA, 22 bp, Homo sapiens
taacccagttacttttttacac

SEQ ID NO: 794127 - DNA, 13 bp, Homo sapiens
taaccccagcctg

SEQ ID NO: 794128 - DNA, 20 bp, Homo sapiens
taacccccagcccacagagc

SEQ ID NO: 794129 - DNA, 16 bp, Homo sapiens
taacccccagtcctca

SEQ ID NO: 794130 - DNA, 13 bp, Homo sapiens
taacccctttcct

SEQ ID NO: 794131 - DNA, 19 bp, Homo sapiens
taaccctcattgctgtctt

SEQ ID NO: 794132 - DNA, 18 bp, Homo sapiens
taaccctcccatggcacc

SEQ ID NO: 794133 - DNA, 20 bp, Homo sapiens
taaccctcctgggcccaagt

SEQ ID NO: 794134 - DNA, 17 bp, Homo sapiens
taacccttatcaccagc

SEQ ID NO: 794135 - DNA, 19 bp, Homo sapiens
taacccttcatcttcctgt

SEQ ID NO: 794136 - DNA, 20 bp, Homo sapiens
taaccctttggtttttttct

SEQ ID NO: 794137 - DNA, 19 bp, Homo sapiens
taaccgcacatgcacacac

SEQ ID NO: 794138 - DNA, 21 bp, Homo sapiens
taaccggcatgtttccagcag

SEQ ID NO: 794139 - DNA, 17 bp, Homo sapiens
taacctagttaaagaaa

SEQ ID NO: 794140 - DNA, 19 bp, Homo sapiens
taacctagttaaagaaagg

SEQ ID NO: 794141 - DNA, 22 bp, Homo sapiens
taacctagttaaagaaaggaaa

SEQ ID NO: 794142 - DNA, 20 bp, Homo sapiens
taacctatatgatttatagt

SEQ ID NO: 794143 - DNA, 12 bp, Homo sapiens
taacctattttt

SEQ ID NO: 794144 - DNA, 14 bp, Homo sapiens
taacctcagctctg

SEQ ID NO: 794145 - DNA, 14 bp, Homo sapiens
taacctcagtattt

SEQ ID NO: 794146 - DNA, 22 bp, Homo sapiens
taacctcagtatttatgtaatt

SEQ ID NO: 794147 - DNA, 23 bp, Homo sapiens
taacctcagtatttatgtaattt

SEQ ID NO: 794148 - DNA, 19 bp, Homo sapiens
taacctcagtgtcatttat

SEQ ID NO: 794149 - DNA, 14 bp, Homo sapiens
taacctcatcttct

SEQ ID NO: 794150 - DNA, 20 bp, Homo sapiens
taacctctgcttttatctca

SEQ ID NO: 794151 - DNA, 22 bp, Homo sapiens
taacctgactggttaacagcag

SEQ ID NO: 794152 - DNA, 17 bp, Homo sapiens
taacctgccagtcccag

SEQ ID NO: 794153 - DNA, 15 bp, Homo sapiens
taacctggccactgt

SEQ ID NO: 794154 - DNA, 18 bp, Homo sapiens
taacctgggcattgttga

SEQ ID NO: 794155 - DNA, 22 bp, Homo sapiens
taacctggtgctggatattttc

SEQ ID NO: 794156 - DNA, 23 bp, Homo sapiens
taacctggtgctggatattttca

SEQ ID NO: 794157 - DNA, 17 bp, Homo sapiens
taaccttccaagactga

SEQ ID NO: 794158 - DNA, 18 bp, Homo sapiens
taaccttccaagactgaa

SEQ ID NO: 794159 - DNA, 15 bp, Homo sapiens
taaccttgaatgctg

SEQ ID NO: 794160 - DNA, 18 bp, Homo sapiens
taaccttgaatgctgcca

SEQ ID NO: 794161 - DNA, 17 bp, Homo sapiens
taaccttgagtcagaaa

SEQ ID NO: 794162 - DNA, 16 bp, Homo sapiens
taaccttgcctggtac

SEQ ID NO: 794163 - DNA, 19 bp, Homo sapiens
taaccttgcctggtacagt

SEQ ID NO: 794164 - DNA, 13 bp, Homo sapiens
taacctttcagaa

SEQ ID NO: 794165 - DNA, 20 bp, Homo sapiens
taaccttttttgtcttattg

SEQ ID NO: 794166 - DNA, 23 bp, Homo sapiens
taacgacttcagggcagggctct

SEQ ID NO: 794167 - DNA, 20 bp, Homo sapiens
taacgccctatttttgcaat

SEQ ID NO: 794168 - DNA, 22 bp, Homo sapiens
taacgcgtatctaggctttggt

SEQ ID NO: 794169 - DNA, 12 bp, Homo sapiens
taacggctccag

SEQ ID NO: 794170 - DNA, 13 bp, Homo sapiens
taacggtgctaaa

SEQ ID NO: 794171 - DNA, 20 bp, Homo sapiens
taacggtttaattctgtctt

SEQ ID NO: 794172 - DNA, 15 bp, Homo sapiens
taacgtaaatacaca

SEQ ID NO: 794173 - DNA, 18 bp, Homo sapiens
taacgtccactagcttac

SEQ ID NO: 794174 - DNA, 16 bp, Homo sapiens
taacgtgcccccagag

SEQ ID NO: 794175 - DNA, 15 bp, Homo sapiens
taacgtgctgctcaa

SEQ ID NO: 794176 - DNA, 12 bp, Homo sapiens
taacgtggcttg

SEQ ID NO: 794177 - DNA, 20 bp, Homo sapiens
taacgtttaagccaaaacaa

SEQ ID NO: 794178 - DNA, 14 bp, Homo sapiens
taactaaaaggtat

SEQ ID NO: 794179 - DNA, 12 bp, Homo sapiens
taactaaaataa

SEQ ID NO: 794180 - DNA, 19 bp, Homo sapiens
taactaaaataattttgta

SEQ ID NO: 794181 - DNA, 21 bp, Homo sapiens
taactaaaataattttgtaat

SEQ ID NO: 794182 - DNA, 14 bp, Homo sapiens
taactaaaatgtat

SEQ ID NO: 794183 - DNA, 16 bp, Homo sapiens
taactaaaattgttct

SEQ ID NO: 794184 - DNA, 15 bp, Homo sapiens
taactaaataaacag

SEQ ID NO: 794185 - DNA, 13 bp, Homo sapiens
taactaaatgctc

SEQ ID NO: 794186 - DNA, 14 bp, Homo sapiens
taactaaatgctca

SEQ ID NO: 794187 - DNA, 16 bp, Homo sapiens
taactaaatgctcata

SEQ ID NO: 794188 - DNA, 14 bp, Homo sapiens
taactaaattttaa

SEQ ID NO: 794189 - DNA, 19 bp, Homo sapiens
taactaactgcttcatctc

SEQ ID NO: 794190 - DNA, 15 bp, Homo sapiens
taactaactggcagg

SEQ ID NO: 794191 - DNA, 17 bp, Homo sapiens
taactaatgctaagaaa

SEQ ID NO: 794192 - DNA, 23 bp, Homo sapiens
taactaatttgaatgtggttact

SEQ ID NO: 794193 - DNA, 17 bp, Homo sapiens
taactacaaaaggcaat

SEQ ID NO: 794194 - DNA, 16 bp, Homo sapiens
taactacatctgcctc

SEQ ID NO: 794195 - DNA, 17 bp, Homo sapiens
taactactccggagaca

SEQ ID NO: 794196 - DNA, 21 bp, Homo sapiens
taactactccggagacagggt

SEQ ID NO: 794197 - DNA, 17 bp, Homo sapiens
taactactgtgttcctg

SEQ ID NO: 794198 - DNA, 16 bp, Homo sapiens
taactactttataact

SEQ ID NO: 794199 - DNA, 23 bp, Homo sapiens
taactactttataactaacatgt

SEQ ID NO: 794200 - DNA, 13 bp, Homo sapiens
taactagaattag

SEQ ID NO: 794201 - DNA, 15 bp, Homo sapiens
taactagaatttatt

SEQ ID NO: 794202 - DNA, 13 bp, Homo sapiens
taactagtggctc

SEQ ID NO: 794203 - DNA, 17 bp, Homo sapiens
taactagtgttgcttgg

SEQ ID NO: 794204 - DNA, 19 bp, Homo sapiens
taactataaggtgcctcag

SEQ ID NO: 794205 - DNA, 18 bp, Homo sapiens
taactatatttgcttttt

SEQ ID NO: 794206 - DNA, 14 bp, Homo sapiens
taactatgatcatc

SEQ ID NO: 794207 - DNA, 15 bp, Homo sapiens
taactattaaccttt

SEQ ID NO: 794208 - DNA, 16 bp, Homo sapiens
taactattaacctttt

SEQ ID NO: 794209 - DNA, 18 bp, Homo sapiens
taactattaacctttttt

SEQ ID NO: 794210 - DNA, 16 bp, Homo sapiens
taactattgcatttat

SEQ ID NO: 794211 - DNA, 17 bp, Homo sapiens
taactattgggtgaata

SEQ ID NO: 794212 - DNA, 13 bp, Homo sapiens
taactcactgcct

SEQ ID NO: 794213 - DNA, 14 bp, Homo sapiens
taactcagaattat

SEQ ID NO: 794214 - DNA, 19 bp, Homo sapiens
taactcatacctttaaagg

SEQ ID NO: 794215 - DNA, 14 bp, Homo sapiens
taactcatctgtta

SEQ ID NO: 794216 - DNA, 20 bp, Homo sapiens
taactcatttgttaaaatta

SEQ ID NO: 794217 - DNA, 16 bp, Homo sapiens
taactccaccaaccca

SEQ ID NO: 794218 - DNA, 22 bp, Homo sapiens
taactccaccaacccatcagaa

SEQ ID NO: 794219 - DNA, 19 bp, Homo sapiens
taactccagatagagaaat

SEQ ID NO: 794220 - DNA, 18 bp, Homo sapiens
taactctaaaagatcctt

SEQ ID NO: 794221 - DNA, 19 bp, Homo sapiens
taactctaaccctgtggaa

SEQ ID NO: 794222 - DNA, 14 bp, Homo sapiens
taactctattaatg

SEQ ID NO: 794223 - DNA, 15 bp, Homo sapiens
taactctattaatga

SEQ ID NO: 794224 - DNA, 15 bp, Homo sapiens
taactgaaggagaag

SEQ ID NO: 794225 - DNA, 18 bp, Homo sapiens
taactgaataccactctg

SEQ ID NO: 794226 - DNA, 19 bp, Homo sapiens
taactgaataccactctgt

SEQ ID NO: 794227 - DNA, 13 bp, Homo sapiens
taactgaatttgg

SEQ ID NO: 794228 - DNA, 16 bp, Homo sapiens
taactgacaagccatc

SEQ ID NO: 794229 - DNA, 16 bp, Homo sapiens
taactgactctgttat

SEQ ID NO: 794230 - DNA, 17 bp, Homo sapiens
taactgactctgttatt

SEQ ID NO: 794231 - DNA, 20 bp, Homo sapiens
taactgagtagctctcctga

SEQ ID NO: 794232 - DNA, 16 bp, Homo sapiens
taactgatttaacact

SEQ ID NO: 794233 - DNA, 19 bp, Homo sapiens
taactgatttaacactttt

SEQ ID NO: 794234 - DNA, 23 bp, Homo sapiens
taactgcaaccttgtttattaaa

SEQ ID NO: 794235 - DNA, 17 bp, Homo sapiens
taactgcacctgggcag

SEQ ID NO: 794236 - DNA, 22 bp, Homo sapiens
taactgcacctgggcagctcct

SEQ ID NO: 794237 - DNA, 11 bp, Homo sapiens
taactgcccag

SEQ ID NO: 794238 - DNA, 16 bp, Homo sapiens
taactgctcagagctt

SEQ ID NO: 794239 - DNA, 15 bp, Homo sapiens
taactgctccaaatt

SEQ ID NO: 794240 - DNA, 13 bp, Homo sapiens
taactgctgagcc

SEQ ID NO: 794241 - DNA, 16 bp, Homo sapiens
taactgctgagccact

SEQ ID NO: 794242 - DNA, 17 bp, Homo sapiens
taactgctgagccactc

SEQ ID NO: 794243 - DNA, 20 bp, Homo sapiens
taactgctttctgttccaaa

SEQ ID NO: 794244 - DNA, 15 bp, Homo sapiens
taactggaaaacaga

SEQ ID NO: 794245 - DNA, 19 bp, Homo sapiens
taactggaaaacagaacac

SEQ ID NO: 794246 - DNA, 24 bp, Homo sapiens
taactggcagttttccattggttt

SEQ ID NO: 794247 - DNA, 14 bp, Homo sapiens
taactggcatggat

SEQ ID NO: 794248 - DNA, 19 bp, Homo sapiens
taactggcctaaatttctt

SEQ ID NO: 794249 - DNA, 17 bp, Homo sapiens
taactgggggaaaagat

SEQ ID NO: 794250 - DNA, 19 bp, Homo sapiens
taactgggtaatgaaacaa

SEQ ID NO: 794251 - DNA, 20 bp, Homo sapiens
taactgggtaatgaaacaaa

SEQ ID NO: 794252 - DNA, 17 bp, Homo sapiens
taactggtgcactttgt

SEQ ID NO: 794253 - DNA, 12 bp, Homo sapiens
taactgtaaact

SEQ ID NO: 794254 - DNA, 13 bp, Homo sapiens
taactgtaaactt

SEQ ID NO: 794255 - DNA, 14 bp, Homo sapiens
taactgtaaacttg

SEQ ID NO: 794256 - DNA, 12 bp, Homo sapiens
taactgtaaatc

SEQ ID NO: 794257 - DNA, 13 bp, Homo sapiens
taactgtaaatca

SEQ ID NO: 794258 - DNA, 18 bp, Homo sapiens
taactgtagctcaagttt

SEQ ID NO: 794259 - DNA, 19 bp, Homo sapiens
taactgtagctcaagttta

SEQ ID NO: 794260 - DNA, 16 bp, Homo sapiens
taactgtatatttgta

SEQ ID NO: 794261 - DNA, 20 bp, Homo sapiens
taactgtatatttgtatgat

SEQ ID NO: 794262 - DNA, 14 bp, Homo sapiens
taactgtcctgtcc

SEQ ID NO: 794263 - DNA, 15 bp, Homo sapiens
taactgtcctgtcct

SEQ ID NO: 794264 - DNA, 14 bp, Homo sapiens
taactgtcttgttt

SEQ ID NO: 794265 - DNA, 16 bp, Homo sapiens
taactgtcttgtttca

SEQ ID NO: 794266 - DNA, 20 bp, Homo sapiens
taactgtcttgtttcagtga

SEQ ID NO: 794267 - DNA, 17 bp, Homo sapiens
taactgtggaatataaa

SEQ ID NO: 794268 - DNA, 21 bp, Homo sapiens
taactgtggaatataaatagc

SEQ ID NO: 794269 - DNA, 14 bp, Homo sapiens
taagaaaatacaat

SEQ ID NO: 794270 - DNA, 20 bp, Homo sapiens
taagaaaatattttgtctaa

SEQ ID NO: 794271 - DNA, 12 bp, Homo sapiens
taagaaaatgta

SEQ ID NO: 794272 - DNA, 12 bp, Homo sapiens
taagaaaattta

SEQ ID NO: 794273 - DNA, 22 bp, Homo sapiens
taagaaacacagggttttgtat

SEQ ID NO: 794274 - DNA, 21 bp, Homo sapiens
taagaaaccctctgtcattcg

SEQ ID NO: 794275 - DNA, 19 bp, Homo sapiens
taagaaagagaatgaactg

SEQ ID NO: 794276 - DNA, 20 bp, Homo sapiens
taagaaagagaatgaactgt

SEQ ID NO: 794277 - DNA, 22 bp, Homo sapiens
taagaaagccaccttgttacaa

SEQ ID NO: 794278 - DNA, 19 bp, Homo sapiens
taagaaagcctaaaattga

SEQ ID NO: 794279 - DNA, 15 bp, Homo sapiens
taagaaaggaagcat

SEQ ID NO: 794280 - DNA, 20 bp, Homo sapiens
taagaaaggaagcattgtaa

SEQ ID NO: 794281 - DNA, 14 bp, Homo sapiens
taagaaaggatata

SEQ ID NO: 794282 - DNA, 18 bp, Homo sapiens
taagaaagtataaagtca

SEQ ID NO: 794283 - DNA, 15 bp, Homo sapiens
taagaaatacagact

SEQ ID NO: 794284 - DNA, 19 bp, Homo sapiens
taagaaatatctgtgaaat

SEQ ID NO: 794285 - DNA, 19 bp, Homo sapiens
taagaaatgaacaaaagat

SEQ ID NO: 794286 - DNA, 20 bp, Homo sapiens
taagaaatgctgaaaatcaa

SEQ ID NO: 794287 - DNA, 18 bp, Homo sapiens
taagaaatggtggaactg

SEQ ID NO: 794288 - DNA, 14 bp, Homo sapiens
taagaaatttcaca

SEQ ID NO: 794289 - DNA, 22 bp, Homo sapiens
taagaacaaagagaaaaaatac

SEQ ID NO: 794290 - DNA, 16 bp, Homo sapiens
taagaacaactacctg

SEQ ID NO: 794291 - DNA, 17 bp, Homo sapiens
taagaacataaggcagg

SEQ ID NO: 794292 - DNA, 12 bp, Homo sapiens
taagaaccaaaa

SEQ ID NO: 794293 - DNA, 19 bp, Homo sapiens
taagaacccagggtggaga

SEQ ID NO: 794294 - DNA, 19 bp, Homo sapiens
taagaactgctttctttcg

SEQ ID NO: 794295 - DNA, 22 bp, Homo sapiens
taagaactgctttctttcgttt

SEQ ID NO: 794296 - DNA, 21 bp, Homo sapiens
taagaactgtacattgtgagc

SEQ ID NO: 794297 - DNA, 15 bp, Homo sapiens
taagaactgtgaaat

SEQ ID NO: 794298 - DNA, 12 bp, Homo sapiens
taagaactgtgt

SEQ ID NO: 794299 - DNA, 14 bp, Homo sapiens
taagaagacatgaa

SEQ ID NO: 794300 - DNA, 15 bp, Homo sapiens
taagaagacatgaac

SEQ ID NO: 794301 - DNA, 17 bp, Homo sapiens
taagaagacatgacaat

SEQ ID NO: 794302 - DNA, 21 bp, Homo sapiens
taagaagagtttttattacaa

SEQ ID NO: 794303 - DNA, 13 bp, Homo sapiens
taagaagcaataa

SEQ ID NO: 794304 - DNA, 18 bp, Homo sapiens
taagaagcaatctttgaa

SEQ ID NO: 794305 - DNA, 20 bp, Homo sapiens
taagaagcaatctttgaaat

SEQ ID NO: 794306 - DNA, 22 bp, Homo sapiens
taagaagcaatctttgaaataa

SEQ ID NO: 794307 - DNA, 23 bp, Homo sapiens
taagaagccttaatttgcacagt

SEQ ID NO: 794308 - DNA, 20 bp, Homo sapiens
taagaagggggagtgaaaca

SEQ ID NO: 794309 - DNA, 21 bp, Homo sapiens
taagaagggggagtgaaacag

SEQ ID NO: 794310 - DNA, 22 bp, Homo sapiens
taagaagggggagtgaaacaga

SEQ ID NO: 794311 - DNA, 22 bp, Homo sapiens
taagaagttattttcttgttta

SEQ ID NO: 794312 - DNA, 17 bp, Homo sapiens
taagaagttgtttgagg

SEQ ID NO: 794313 - DNA, 15 bp, Homo sapiens
taagaagttttaaaa

SEQ ID NO: 794314 - DNA, 20 bp, Homo sapiens
taagaataaaatgttgaaaa

SEQ ID NO: 794315 - DNA, 14 bp, Homo sapiens
taagaataataaaa

SEQ ID NO: 794316 - DNA, 19 bp, Homo sapiens
taagaatatgtttccttgt

SEQ ID NO: 794317 - DNA, 18 bp, Homo sapiens
taagaatcttagataact

SEQ ID NO: 794318 - DNA, 14 bp, Homo sapiens
taagaatctttaga

SEQ ID NO: 794319 - DNA, 16 bp, Homo sapiens
taagaatgaagttctg

SEQ ID NO: 794320 - DNA, 14 bp, Homo sapiens
taagaatgcattat

SEQ ID NO: 794321 - DNA, 18 bp, Homo sapiens
taagaattgagtaatggt

SEQ ID NO: 794322 - DNA, 21 bp, Homo sapiens
taagaattgagtaatggtgta

SEQ ID NO: 794323 - DNA, 16 bp, Homo sapiens
taagaattgtctctgg

SEQ ID NO: 794324 - DNA, 19 bp, Homo sapiens
taagaattgtctctgggct

SEQ ID NO: 794325 - DNA, 21 bp, Homo sapiens
taagaattgtttttgaattta

SEQ ID NO: 794326 - DNA, 13 bp, Homo sapiens
taagaatttctgc

SEQ ID NO: 794327 - DNA, 18 bp, Homo sapiens
taagaatttctgctaaat

SEQ ID NO: 794328 - DNA, 13 bp, Homo sapiens
taagaatttgcat

SEQ ID NO: 794329 - DNA, 23 bp, Homo sapiens
taagaattttgttttactttttt

SEQ ID NO: 794330 - DNA, 19 bp, Homo sapiens
taagaatttttttttaaat

SEQ ID NO: 794331 - DNA, 17 bp, Homo sapiens
taagacaaaaagccttg

SEQ ID NO: 794332 - DNA, 22 bp, Homo sapiens
taagacaatggaccctttttgt

SEQ ID NO: 794333 - DNA, 14 bp, Homo sapiens
taagacacaaatgc

SEQ ID NO: 794334 - DNA, 23 bp, Homo sapiens
taagacactgaaaaatctaagtg

SEQ ID NO: 794335 - DNA, 14 bp, Homo sapiens
taagacactgtgag

SEQ ID NO: 794336 - DNA, 13 bp, Homo sapiens
taagacagagacc

SEQ ID NO: 794337 - DNA, 14 bp, Homo sapiens
taagacagcatgtg

SEQ ID NO: 794338 - DNA, 14 bp, Homo sapiens
taagacagtgtaca

SEQ ID NO: 794339 - DNA, 20 bp, Homo sapiens
taagacatactccttccatc

SEQ ID NO: 794340 - DNA, 20 bp, Homo sapiens
taagacatgatttccttgaa

SEQ ID NO: 794341 - DNA, 21 bp, Homo sapiens
taagacatgatttccttgaat

SEQ ID NO: 794342 - DNA, 21 bp, Homo sapiens
taagacatgcactatgaggaa

SEQ ID NO: 794343 - DNA, 13 bp, Homo sapiens
taagacatttgta

SEQ ID NO: 794344 - DNA, 14 bp, Homo sapiens
taagacatttgtat

SEQ ID NO: 794345 - DNA, 15 bp, Homo sapiens
taagacatttgtata

SEQ ID NO: 794346 - DNA, 17 bp, Homo sapiens
taagacatttgtatatt

SEQ ID NO: 794347 - DNA, 20 bp, Homo sapiens
taagacatttgtatattgtg

SEQ ID NO: 794348 - DNA, 13 bp, Homo sapiens
taagaccagcctg

SEQ ID NO: 794349 - DNA, 16 bp, Homo sapiens
taagaccctaattctt

SEQ ID NO: 794350 - DNA, 23 bp, Homo sapiens
taagaccgtgtcccaaggagctg

SEQ ID NO: 794351 - DNA, 15 bp, Homo sapiens
taagacgtgtttgtg

SEQ ID NO: 794352 - DNA, 19 bp, Homo sapiens
taagactataaataaaaac

SEQ ID NO: 794353 - DNA, 21 bp, Homo sapiens
taagactgtttttaagtaact

SEQ ID NO: 794354 - DNA, 15 bp, Homo sapiens
taagacttaatgaga

SEQ ID NO: 794355 - DNA, 14 bp, Homo sapiens
taagacttgacagt

SEQ ID NO: 794356 - DNA, 15 bp, Homo sapiens
taagacttgtgcatg

SEQ ID NO: 794357 - DNA, 20 bp, Homo sapiens
taagactttgggataggaaa

SEQ ID NO: 794358 - DNA, 13 bp, Homo sapiens
taagagaaagaaa

SEQ ID NO: 794359 - DNA, 20 bp, Homo sapiens
taagagaagacctagctatg

SEQ ID NO: 794360 - DNA, 12 bp, Homo sapiens
taagagaagtag

SEQ ID NO: 794361 - DNA, 19 bp, Homo sapiens
taagagaatattttaagta

SEQ ID NO: 794362 - DNA, 22 bp, Homo sapiens
taagagaattatatatttctaa

SEQ ID NO: 794363 - DNA, 23 bp, Homo sapiens
taagagacagaatgtatctgtga

SEQ ID NO: 794364 - DNA, 15 bp, Homo sapiens
taagagacagacact

SEQ ID NO: 794365 - DNA, 18 bp, Homo sapiens
taagagacagttctctgt

SEQ ID NO: 794366 - DNA, 14 bp, Homo sapiens
taagagactcttta

SEQ ID NO: 794367 - DNA, 14 bp, Homo sapiens
taagagagatgaga

SEQ ID NO: 794368 - DNA, 19 bp, Homo sapiens
taagagatacttgatgcca

SEQ ID NO: 794369 - DNA, 15 bp, Homo sapiens
taagagatgggacta

SEQ ID NO: 794370 - DNA, 14 bp, Homo sapiens
taagagattcttct

SEQ ID NO: 794371 - DNA, 11 bp, Homo sapiens
taagagattta

SEQ ID NO: 794372 - DNA, 16 bp, Homo sapiens
taagagatttatcttt

SEQ ID NO: 794373 - DNA, 21 bp, Homo sapiens
taagagatttatctttataca

SEQ ID NO: 794374 - DNA, 20 bp, Homo sapiens
taagagcaaaagaatggcag

SEQ ID NO: 794375 - DNA, 22 bp, Homo sapiens
taagagcaaaagaatggcagaa

SEQ ID NO: 794376 - DNA, 21 bp, Homo sapiens
taagagcacaggttagggcat

SEQ ID NO: 794377 - DNA, 22 bp, Homo sapiens
taagagcaccttcctcacttcc

SEQ ID NO: 794378 - DNA, 23 bp, Homo sapiens
taagagcatccggccaaatgcaa

SEQ ID NO: 794379 - DNA, 15 bp, Homo sapiens
taagagcgaacttca

SEQ ID NO: 794380 - DNA, 18 bp, Homo sapiens
taagagcttgatctgtga

SEQ ID NO: 794381 - DNA, 22 bp, Homo sapiens
taagaggaatttggtataatta

SEQ ID NO: 794382 - DNA, 21 bp, Homo sapiens
taagaggacataatggggtcc

SEQ ID NO: 794383 - DNA, 15 bp, Homo sapiens
taagaggcagcgtga

SEQ ID NO: 794384 - DNA, 21 bp, Homo sapiens
taagaggtgtgggtgtctgtt

SEQ ID NO: 794385 - DNA, 14 bp, Homo sapiens
taagagtactggga

SEQ ID NO: 794386 - DNA, 21 bp, Homo sapiens
taagagtagaaactgcaggga

SEQ ID NO: 794387 - DNA, 14 bp, Homo sapiens
taagagtgctgggc

SEQ ID NO: 794388 - DNA, 17 bp, Homo sapiens
taagagtggaggaggag

SEQ ID NO: 794389 - DNA, 19 bp, Homo sapiens
taagagtgggggagagcag

SEQ ID NO: 794390 - DNA, 22 bp, Homo sapiens
taagataaaaataataataaag

SEQ ID NO: 794391 - DNA, 16 bp, Homo sapiens
taagataaatgtgctg

SEQ ID NO: 794392 - DNA, 17 bp, Homo sapiens
taagataaatgtgctga

SEQ ID NO: 794393 - DNA, 18 bp, Homo sapiens
taagataacttactgtat

SEQ ID NO: 794394 - DNA, 21 bp, Homo sapiens
taagatacactgcactttgtt

SEQ ID NO: 794395 - DNA, 22 bp, Homo sapiens
taagatacactgcactttgttt

SEQ ID NO: 794396 - DNA, 22 bp, Homo sapiens
taagatacttagattagaccta

SEQ ID NO: 794397 - DNA, 12 bp, Homo sapiens
taagatagaaca

SEQ ID NO: 794398 - DNA, 14 bp, Homo sapiens
taagatagaacaca

SEQ ID NO: 794399 - DNA, 15 bp, Homo sapiens
taagatatatacatg

SEQ ID NO: 794400 - DNA, 16 bp, Homo sapiens
taagatatccatcttt

SEQ ID NO: 794401 - DNA, 22 bp, Homo sapiens
taagatatttgcagtttttcat

SEQ ID NO: 794402 - DNA, 17 bp, Homo sapiens
taagatcctaaactctc

SEQ ID NO: 794403 - DNA, 19 bp, Homo sapiens
taagatcctaaactctcta

SEQ ID NO: 794404 - DNA, 13 bp, Homo sapiens
taagatgaaattg

SEQ ID NO: 794405 - DNA, 18 bp, Homo sapiens
taagatgaaattgccaaa

SEQ ID NO: 794406 - DNA, 16 bp, Homo sapiens
taagatgactctgaga

SEQ ID NO: 794407 - DNA, 20 bp, Homo sapiens
taagatgagatttgccagca

SEQ ID NO: 794408 - DNA, 21 bp, Homo sapiens
taagatgagatttgccagcac

SEQ ID NO: 794409 - DNA, 19 bp, Homo sapiens
taagatggctgtggcattt

SEQ ID NO: 794410 - DNA, 18 bp, Homo sapiens
taagatgggcctgtatga

SEQ ID NO: 794411 - DNA, 19 bp, Homo sapiens
taagatgtacatttaataa

SEQ ID NO: 794412 - DNA, 16 bp, Homo sapiens
taagatgtgtcttcaa

SEQ ID NO: 794413 - DNA, 17 bp, Homo sapiens
taagatgtgttcttatt

SEQ ID NO: 794414 - DNA, 18 bp, Homo sapiens
taagatgttaatctccca

SEQ ID NO: 794415 - DNA, 23 bp, Homo sapiens
taagatgtttattaatagaatga

SEQ ID NO: 794416 - DNA, 18 bp, Homo sapiens
taagattaaaggaaggaa

SEQ ID NO: 794417 - DNA, 17 bp, Homo sapiens
taagattccaaaaagca

SEQ ID NO: 794418 - DNA, 14 bp, Homo sapiens
taagattccagaga

SEQ ID NO: 794419 - DNA, 14 bp, Homo sapiens
taagattcttttaa

SEQ ID NO: 794420 - DNA, 14 bp, Homo sapiens
taagattggaaatg

SEQ ID NO: 794421 - DNA, 19 bp, Homo sapiens
taagatttagagatgaatt

SEQ ID NO: 794422 - DNA, 15 bp, Homo sapiens
taagatttgttttta

SEQ ID NO: 794423 - DNA, 18 bp, Homo sapiens
taagatttgtttttaaac

SEQ ID NO: 794424 - DNA, 18 bp, Homo sapiens
taagattttactttaaca

SEQ ID NO: 794425 - DNA, 21 bp, Homo sapiens
taagatttttatattaaaaat

SEQ ID NO: 794426 - DNA, 13 bp, Homo sapiens
taagcaaaaacgt

SEQ ID NO: 794427 - DNA, 13 bp, Homo sapiens
taagcaaaggctc

SEQ ID NO: 794428 - DNA, 22 bp, Homo sapiens
taagcaaaggggacagctgtgt

SEQ ID NO: 794429 - DNA, 19 bp, Homo sapiens
taagcaaattttgtattat

SEQ ID NO: 794430 - DNA, 23 bp, Homo sapiens
taagcaacatctagcaaatgtta

SEQ ID NO: 794431 - DNA, 18 bp, Homo sapiens
taagcaacttgcttctaa

SEQ ID NO: 794432 - DNA, 18 bp, Homo sapiens
taagcaagagagatgttt

SEQ ID NO: 794433 - DNA, 16 bp, Homo sapiens
taagcaatcattttat

SEQ ID NO: 794434 - DNA, 13 bp, Homo sapiens
taagcacttctag

SEQ ID NO: 794435 - DNA, 15 bp, Homo sapiens
taagcacttctagaa

SEQ ID NO: 794436 - DNA, 14 bp, Homo sapiens
taagcacttgcctg

SEQ ID NO: 794437 - DNA, 21 bp, Homo sapiens
taagcacttgcctggaataaa

SEQ ID NO: 794438 - DNA, 22 bp, Homo sapiens
taagcacttgcctggaataaaa

SEQ ID NO: 794439 - DNA, 13 bp, Homo sapiens
taagcagaaacag

SEQ ID NO: 794440 - DNA, 17 bp, Homo sapiens
taagcagaccactgata

SEQ ID NO: 794441 - DNA, 18 bp, Homo sapiens
taagcagcatggaaaaat

SEQ ID NO: 794442 - DNA, 22 bp, Homo sapiens
taagcaggtggatctatttcat

SEQ ID NO: 794443 - DNA, 22 bp, Homo sapiens
taagcaggtttgttttcagcac

SEQ ID NO: 794444 - DNA, 15 bp, Homo sapiens
taagcagtaaaaact

SEQ ID NO: 794445 - DNA, 12 bp, Homo sapiens
taagcagtatat

SEQ ID NO: 794446 - DNA, 23 bp, Homo sapiens
taagcagttatggtgatgactta

SEQ ID NO: 794447 - DNA, 21 bp, Homo sapiens
taagcatatcgtaaagctgtt

SEQ ID NO: 794448 - DNA, 22 bp, Homo sapiens
taagcatatcgtaaagctgttc

SEQ ID NO: 794449 - DNA, 17 bp, Homo sapiens
taagcatgtgtcccagg

SEQ ID NO: 794450 - DNA, 22 bp, Homo sapiens
taagcattgaatggctatgttt

SEQ ID NO: 794451 - DNA, 18 bp, Homo sapiens
taagcattgggtgggtaa

SEQ ID NO: 794452 - DNA, 17 bp, Homo sapiens
taagcattgtttgctta

SEQ ID NO: 794453 - DNA, 12 bp, Homo sapiens
taagcatttatt

SEQ ID NO: 794454 - DNA, 12 bp, Homo sapiens
taagcatttgta

SEQ ID NO: 794455 - DNA, 18 bp, Homo sapiens
taagccaaaactgagcat

SEQ ID NO: 794456 - DNA, 11 bp, Homo sapiens
taagccaaaga

SEQ ID NO: 794457 - DNA, 23 bp, Homo sapiens
taagccaaagaaacaagctgtgc

SEQ ID NO: 794458 - DNA, 20 bp, Homo sapiens
taagccaacttgatgtgaaa

SEQ ID NO: 794459 - DNA, 16 bp, Homo sapiens
taagccacaagaaatt

SEQ ID NO: 794460 - DNA, 22 bp, Homo sapiens
taagccacaagaaatttgattt

SEQ ID NO: 794461 - DNA, 12 bp, Homo sapiens
taagccacagct

SEQ ID NO: 794462 - DNA, 13 bp, Homo sapiens
taagccagagcct

SEQ ID NO: 794463 - DNA, 15 bp, Homo sapiens
taagccagagcctgg

SEQ ID NO: 794464 - DNA, 24 bp, Homo sapiens
taagccagcctggtccatgcaggg

SEQ ID NO: 794465 - DNA, 14 bp, Homo sapiens
taagccaggaaaca

SEQ ID NO: 794466 - DNA, 17 bp, Homo sapiens
taagccaggaaacatga

SEQ ID NO: 794467 - DNA, 13 bp, Homo sapiens
taagccaggcctg

SEQ ID NO: 794468 - DNA, 19 bp, Homo sapiens
taagccagttttcattttg

SEQ ID NO: 794469 - DNA, 19 bp, Homo sapiens
taagccatagaccctgagg

SEQ ID NO: 794470 - DNA, 18 bp, Homo sapiens
taagcccacagtatattt

SEQ ID NO: 794471 - DNA, 19 bp, Homo sapiens
taagcccagtgctgctgta

SEQ ID NO: 794472 - DNA, 20 bp, Homo sapiens
taagcccagtgctgctgtaa

SEQ ID NO: 794473 - DNA, 15 bp, Homo sapiens
taagcccccagggcc

SEQ ID NO: 794474 - DNA, 19 bp, Homo sapiens
taagccctcgaaccaaggc

SEQ ID NO: 794475 - DNA, 22 bp, Homo sapiens
taagccctcgaaccaaggcagc

SEQ ID NO: 794476 - DNA, 13 bp, Homo sapiens
taagccctggcag

SEQ ID NO: 794477 - DNA, 16 bp, Homo sapiens
taagccctgtcgagac

SEQ ID NO: 794478 - DNA, 20 bp, Homo sapiens
taagccctgtcgagacactt

SEQ ID NO: 794479 - DNA, 15 bp, Homo sapiens
taagccctttgctct

SEQ ID NO: 794480 - DNA, 19 bp, Homo sapiens
taagccctttgctctggag

SEQ ID NO: 794481 - DNA, 20 bp, Homo sapiens
taagcctccatttagttctt

SEQ ID NO: 794482 - DNA, 21 bp, Homo sapiens
taagcctccatttagttcttt

SEQ ID NO: 794483 - DNA, 12 bp, Homo sapiens
taagcctggaag

SEQ ID NO: 794484 - DNA, 13 bp, Homo sapiens
taagcctggaagc

SEQ ID NO: 794485 - DNA, 13 bp, Homo sapiens
taagcctgtcccc

SEQ ID NO: 794486 - DNA, 18 bp, Homo sapiens
taagcctgtccccagacc

SEQ ID NO: 794487 - DNA, 13 bp, Homo sapiens
taagcctgttgct

SEQ ID NO: 794488 - DNA, 14 bp, Homo sapiens
taagccttcatttg

SEQ ID NO: 794489 - DNA, 19 bp, Homo sapiens
taagccttcatttgcaatt

SEQ ID NO: 794490 - DNA, 15 bp, Homo sapiens
taagcctttccataa

SEQ ID NO: 794491 - DNA, 22 bp, Homo sapiens
taagcgaagtctttgccttctc

SEQ ID NO: 794492 - DNA, 23 bp, Homo sapiens
taagcgaagtctttgccttctct

SEQ ID NO: 794493 - DNA, 23 bp, Homo sapiens
taagcgaatgtgtacaaagtgta

SEQ ID NO: 794494 - DNA, 16 bp, Homo sapiens
taagcgatttgaaaca

SEQ ID NO: 794495 - DNA, 22 bp, Homo sapiens
taagctaacccccttctactga

SEQ ID NO: 794496 - DNA, 15 bp, Homo sapiens
taagctatcagcaat

SEQ ID NO: 794497 - DNA, 19 bp, Homo sapiens
taagctcacgtcctgagaa

SEQ ID NO: 794498 - DNA, 22 bp, Homo sapiens
taagctcacgtcctgagaaagc

SEQ ID NO: 794499 - DNA, 12 bp, Homo sapiens
taagctcagaat

SEQ ID NO: 794500 - DNA, 20 bp, Homo sapiens
taagctcaggatatggctta

SEQ ID NO: 794501 - DNA, 17 bp, Homo sapiens
taagctccatgtgcata

SEQ ID NO: 794502 - DNA, 23 bp, Homo sapiens
taagctgcaaatctgatggcctt

SEQ ID NO: 794503 - DNA, 16 bp, Homo sapiens
taagctgctctattgt

SEQ ID NO: 794504 - DNA, 19 bp, Homo sapiens
taagctggagctcttggaa

SEQ ID NO: 794505 - DNA, 18 bp, Homo sapiens
taagctggctctgtttga

SEQ ID NO: 794506 - DNA, 20 bp, Homo sapiens
taagctggctctgtttgatg

SEQ ID NO: 794507 - DNA, 19 bp, Homo sapiens
taagctgtttgccaagctg

SEQ ID NO: 794508 - DNA, 20 bp, Homo sapiens
taagctgtttgccaagctga

SEQ ID NO: 794509 - DNA, 21 bp, Homo sapiens
taagctgtttgccaagctgaa

SEQ ID NO: 794510 - DNA, 22 bp, Homo sapiens
taagctgtttgccaagctgaag

SEQ ID NO: 794511 - DNA, 16 bp, Homo sapiens
taagcttatgtcagac

SEQ ID NO: 794512 - DNA, 22 bp, Homo sapiens
taagcttgcgtagaattgcagg

SEQ ID NO: 794513 - DNA, 16 bp, Homo sapiens
taagctttattgtgat

SEQ ID NO: 794514 - DNA, 14 bp, Homo sapiens
taagctttctcaga

SEQ ID NO: 794515 - DNA, 16 bp, Homo sapiens
taagctttctcagaat

SEQ ID NO: 794516 - DNA, 15 bp, Homo sapiens
taagctttctctcag

SEQ ID NO: 794517 - DNA, 14 bp, Homo sapiens
taagtaataatttg

SEQ ID NO: 794518 - DNA, 21 bp, Homo sapiens
taagtaattatcgggaacagt

SEQ ID NO: 794519 - DNA, 23 bp, Homo sapiens
taagtaattatcgggaacagtgt

SEQ ID NO: 794520 - DNA, 21 bp, Homo sapiens
taagtaattgcatttctgctc

SEQ ID NO: 794521 - DNA, 15 bp, Homo sapiens
taagtaatttagaag

SEQ ID NO: 794522 - DNA, 19 bp, Homo sapiens
taagtaccaatgggaagca

SEQ ID NO: 794523 - DNA, 17 bp, Homo sapiens
taagtaccactcaggcc

SEQ ID NO: 794524 - DNA, 19 bp, Homo sapiens
taagtaccctgatgccttt

SEQ ID NO: 794525 - DNA, 22 bp, Homo sapiens
taagtactagatgcatcactgg

SEQ ID NO: 794526 - DNA, 16 bp, Homo sapiens
taagtactatgtatca

SEQ ID NO: 794527 - DNA, 19 bp, Homo sapiens
taagtagaacaaaaaaccc

SEQ ID NO: 794528 - DNA, 12 bp, Homo sapiens
taagtagatttc

SEQ ID NO: 794529 - DNA, 15 bp, Homo sapiens
taagtagatttcatg

SEQ ID NO: 794530 - DNA, 20 bp, Homo sapiens
taagtagggctaagccagtt

SEQ ID NO: 794531 - DNA, 17 bp, Homo sapiens
taagtagttggtttgta

SEQ ID NO: 794532 - DNA, 13 bp, Homo sapiens
taagtatatagta

SEQ ID NO: 794533 - DNA, 14 bp, Homo sapiens
taagtatatagtat

SEQ ID NO: 794534 - DNA, 19 bp, Homo sapiens
taagtatcaagtatagaaa

SEQ ID NO: 794535 - DNA, 20 bp, Homo sapiens
taagtatcaagtatagaaaa

SEQ ID NO: 794536 - DNA, 22 bp, Homo sapiens
taagtatctgggattattcttt

SEQ ID NO: 794537 - DNA, 14 bp, Homo sapiens
taagtatgttattt

SEQ ID NO: 794538 - DNA, 20 bp, Homo sapiens
taagtattcttatttaatga

SEQ ID NO: 794539 - DNA, 17 bp, Homo sapiens
taagtattgcatctgta

SEQ ID NO: 794540 - DNA, 17 bp, Homo sapiens
taagtattgtttcctga

SEQ ID NO: 794541 - DNA, 16 bp, Homo sapiens
taagtatttaaatgtt

SEQ ID NO: 794542 - DNA, 18 bp, Homo sapiens
taagtatttaaatgttct

SEQ ID NO: 794543 - DNA, 20 bp, Homo sapiens
taagtatttaggtttttgtt

SEQ ID NO: 794544 - DNA, 23 bp, Homo sapiens
taagtatttatatatttataact

SEQ ID NO: 794545 - DNA, 19 bp, Homo sapiens
taagtatttcagatgcttt

SEQ ID NO: 794546 - DNA, 20 bp, Homo sapiens
taagtattttcctgttgtca

SEQ ID NO: 794547 - DNA, 16 bp, Homo sapiens
taagtcaacagtaaac

SEQ ID NO: 794548 - DNA, 16 bp, Homo sapiens
taagtcaagcacatgt

SEQ ID NO: 794549 - DNA, 14 bp, Homo sapiens
taagtcagaacagc

SEQ ID NO: 794550 - DNA, 21 bp, Homo sapiens
taagtcaggagtgtagttgga

SEQ ID NO: 794551 - DNA, 22 bp, Homo sapiens
taagtcagggaagagcagtgct

SEQ ID NO: 794552 - DNA, 19 bp, Homo sapiens
taagtcatctacttaataa

SEQ ID NO: 794553 - DNA, 20 bp, Homo sapiens
taagtcatctacttaataaa

SEQ ID NO: 794554 - DNA, 17 bp, Homo sapiens
taagtcatgtatgtttc

SEQ ID NO: 794555 - DNA, 22 bp, Homo sapiens
taagtcattgaaatttactgtg

SEQ ID NO: 794556 - DNA, 20 bp, Homo sapiens
taagtcattttcatgtgtgt

SEQ ID NO: 794557 - DNA, 12 bp, Homo sapiens
taagtccagtgt

SEQ ID NO: 794558 - DNA, 13 bp, Homo sapiens
taagtcccttcct

SEQ ID NO: 794559 - DNA, 14 bp, Homo sapiens
taagtcccttccta

SEQ ID NO: 794560 - DNA, 17 bp, Homo sapiens
taagtcctttatgtgga

SEQ ID NO: 794561 - DNA, 18 bp, Homo sapiens
taataggaaaaacggaag

SEQ ID NO: 794562 - DNA, 20 bp, Homo sapiens
taataggaatgtccaccatg

SEQ ID NO: 794563 - DNA, 22 bp, Homo sapiens
taataggaatgtccaccatgaa

SEQ ID NO: 794564 - DNA, 17 bp, Homo sapiens
taatagtaatttgtaaa

SEQ ID NO: 794565 - DNA, 18 bp, Homo sapiens
taatagttcagtagaatt

SEQ ID NO: 794566 - DNA, 23 bp, Homo sapiens
taatagttcagtagaattaccat

SEQ ID NO: 794567 - DNA, 21 bp, Homo sapiens
taatataaaaagcttccatga

SEQ ID NO: 794568 - DNA, 14 bp, Homo sapiens
taatataaattcac

SEQ ID NO: 794569 - DNA, 14 bp, Homo sapiens
taatataaatttaa

SEQ ID NO: 794570 - DNA, 17 bp, Homo sapiens
taatataaatttaagca

SEQ ID NO: 794571 - DNA, 16 bp, Homo sapiens
taatatacctggttta

SEQ ID NO: 794572 - DNA, 17 bp, Homo sapiens
taatatacctggtttac

SEQ ID NO: 794573 - DNA, 23 bp, Homo sapiens
taatatagaaaaaaacattctat

SEQ ID NO: 794574 - DNA, 16 bp, Homo sapiens
taatatagctgagact

SEQ ID NO: 794575 - DNA, 15 bp, Homo sapiens
taatatatacatttt

SEQ ID NO: 794576 - DNA, 22 bp, Homo sapiens
taatatatagtccagacactta

SEQ ID NO: 794577 - DNA, 21 bp, Homo sapiens
taatatatggacctagcttga

SEQ ID NO: 794578 - DNA, 20 bp, Homo sapiens
taatatatgtattatttata

SEQ ID NO: 794579 - DNA, 21 bp, Homo sapiens
taatatattaaaattccaaat

SEQ ID NO: 794580 - DNA, 14 bp, Homo sapiens
taatatattgtaca

SEQ ID NO: 794581 - DNA, 15 bp, Homo sapiens
taatatattgtacaa

SEQ ID NO: 794582 - DNA, 17 bp, Homo sapiens
taatatatttaaaaata

SEQ ID NO: 794583 - DNA, 17 bp, Homo sapiens
taatatattttctgttt

SEQ ID NO: 794584 - DNA, 21 bp, Homo sapiens
taatatattttctgttttctt

SEQ ID NO: 794585 - DNA, 16 bp, Homo sapiens
taatatcactcattaa

SEQ ID NO: 794586 - DNA, 12 bp, Homo sapiens
taatatcctaaa

SEQ ID NO: 794587 - DNA, 17 bp, Homo sapiens
taatatcctaaacatca

SEQ ID NO: 794588 - DNA, 16 bp, Homo sapiens
taatatcggggggtgg

SEQ ID NO: 794589 - DNA, 17 bp, Homo sapiens
taatatcggggggtgga

SEQ ID NO: 794590 - DNA, 21 bp, Homo sapiens
taatatctaaagttatatttc

SEQ ID NO: 794591 - DNA, 14 bp, Homo sapiens
taatatctggcact

SEQ ID NO: 794592 - DNA, 14 bp, Homo sapiens
taatatgaaaactt

SEQ ID NO: 794593 - DNA, 12 bp, Homo sapiens
taatatgagaat

SEQ ID NO: 794594 - DNA, 14 bp, Homo sapiens
taatatgagcttca

SEQ ID NO: 794595 - DNA, 15 bp, Homo sapiens
taatatgcaaagtct

SEQ ID NO: 794596 - DNA, 17 bp, Homo sapiens
taatatgcacacatttt

SEQ ID NO: 794597 - DNA, 19 bp, Homo sapiens
taatatgcacacatttttt

SEQ ID NO: 794598 - DNA, 22 bp, Homo sapiens
taatatgctgcaacaaaatgta

SEQ ID NO: 794599 - DNA, 20 bp, Homo sapiens
taatatgcttataacctagt

SEQ ID NO: 794600 - DNA, 18 bp, Homo sapiens
taatatggaaccttccct

SEQ ID NO: 794601 - DNA, 15 bp, Homo sapiens
taatatggcaaaaat

SEQ ID NO: 794602 - DNA, 18 bp, Homo sapiens
taatatggctatgcttaa

SEQ ID NO: 794603 - DNA, 20 bp, Homo sapiens
taatatggctatgcttaaaa

SEQ ID NO: 794604 - DNA, 18 bp, Homo sapiens
taatatgggcattgtagt

SEQ ID NO: 794605 - DNA, 21 bp, Homo sapiens
taatatgttaacctcagtgtc

SEQ ID NO: 794606 - DNA, 20 bp, Homo sapiens
taatatgtttaatgttcatt

SEQ ID NO: 794607 - DNA, 23 bp, Homo sapiens
taatatgtttagttttacatttt

SEQ ID NO: 794608 - DNA, 18 bp, Homo sapiens
taatattaaaaatatgga

SEQ ID NO: 794609 - DNA, 21 bp, Homo sapiens
taatattactgtctttattct

SEQ ID NO: 794610 - DNA, 17 bp, Homo sapiens
taatattagtgattctg

SEQ ID NO: 794611 - DNA, 19 bp, Homo sapiens
taatattagtgattctgat

SEQ ID NO: 794612 - DNA, 19 bp, Homo sapiens
taatattcagccagcttaa

SEQ ID NO: 794613 - DNA, 11 bp, Homo sapiens
taatattccaa

SEQ ID NO: 794614 - DNA, 17 bp, Homo sapiens
taatattgaaaattgaa

SEQ ID NO: 794615 - DNA, 22 bp, Homo sapiens
taatattgaaaattgaaaagta

SEQ ID NO: 794616 - DNA, 18 bp, Homo sapiens
taatattgacttgtatat

SEQ ID NO: 794617 - DNA, 16 bp, Homo sapiens
taatattgagaatcag

SEQ ID NO: 794618 - DNA, 17 bp, Homo sapiens
taatattgagaatcagg

SEQ ID NO: 794619 - DNA, 20 bp, Homo sapiens
taatattgagaatcaggttg

SEQ ID NO: 794620 - DNA, 21 bp, Homo sapiens
taatattgtaaatactggact

SEQ ID NO: 794621 - DNA, 13 bp, Homo sapiens
taatatttaaaca

SEQ ID NO: 794622 - DNA, 21 bp, Homo sapiens
taatatttaaacagcagtgtt

SEQ ID NO: 794623 - DNA, 14 bp, Homo sapiens
taatatttaatgga

SEQ ID NO: 794624 - DNA, 13 bp, Homo sapiens
taatatttacaat

SEQ ID NO: 794625 - DNA, 15 bp, Homo sapiens
taatatttacaatgt

SEQ ID NO: 794626 - DNA, 20 bp, Homo sapiens
taatatttacaatgtattaa

SEQ ID NO: 794627 - DNA, 13 bp, Homo sapiens
taatatttactgt

SEQ ID NO: 794628 - DNA, 16 bp, Homo sapiens
taatatttatatattt

SEQ ID NO: 794629 - DNA, 22 bp, Homo sapiens
taatatttcttaatttggataa

SEQ ID NO: 794630 - DNA, 14 bp, Homo sapiens
taatatttgaattt

SEQ ID NO: 794631 - DNA, 15 bp, Homo sapiens
taatatttgaatttt

SEQ ID NO: 794632 - DNA, 18 bp, Homo sapiens
taatattttgtaatattc

SEQ ID NO: 794633 - DNA, 14 bp, Homo sapiens
taatcaaagctcat

SEQ ID NO: 794634 - DNA, 13 bp, Homo sapiens
taatcaagagaaa

SEQ ID NO: 794635 - DNA, 15 bp, Homo sapiens
taatcaagagaaact

SEQ ID NO: 794636 - DNA, 13 bp, Homo sapiens
taatcaagatttt

SEQ ID NO: 794637 - DNA, 21 bp, Homo sapiens
taatcaagtaaggatgtatgt

SEQ ID NO: 794638 - DNA, 14 bp, Homo sapiens
taatcaagttgaat

SEQ ID NO: 794639 - DNA, 17 bp, Homo sapiens
taatcaagttgtaactt

SEQ ID NO: 794640 - DNA, 13 bp, Homo sapiens
taatcaattatta

SEQ ID NO: 794641 - DNA, 14 bp, Homo sapiens
taatcactctgagt

SEQ ID NO: 794642 - DNA, 15 bp, Homo sapiens
taatcagcaataaaa

SEQ ID NO: 794643 - DNA, 16 bp, Homo sapiens
taatcagcattagaga

SEQ ID NO: 794644 - DNA, 21 bp, Homo sapiens
taatcagccccagagtgcttt

SEQ ID NO: 794645 - DNA, 11 bp, Homo sapiens
taatcagcctc

SEQ ID NO: 794646 - DNA, 14 bp, Homo sapiens
taatcagcctctta

SEQ ID NO: 794647 - DNA, 23 bp, Homo sapiens
taatcagctctcctggctccctc

SEQ ID NO: 794648 - DNA, 15 bp, Homo sapiens
taatcaggaaaaatg

SEQ ID NO: 794649 - DNA, 19 bp, Homo sapiens
taatcagggaggtcatttt

SEQ ID NO: 794650 - DNA, 22 bp, Homo sapiens
taatcaggtcctcagagaattt

SEQ ID NO: 794651 - DNA, 14 bp, Homo sapiens
taatcagtgactga

SEQ ID NO: 794652 - DNA, 21 bp, Homo sapiens
taatcagtgactgaaaccatt

SEQ ID NO: 794653 - DNA, 23 bp, Homo sapiens
taatcagtgactgaaaccatttt

SEQ ID NO: 794654 - DNA, 14 bp, Homo sapiens
taatcatacaaact

SEQ ID NO: 794655 - DNA, 22 bp, Homo sapiens
taatcatataataaatgtacat

SEQ ID NO: 794656 - DNA, 17 bp, Homo sapiens
taatgaatttaaggcaa

SEQ ID NO: 794657 - DNA, 18 bp, Homo sapiens
taatgaatttaaggcaaa

SEQ ID NO: 794658 - DNA, 19 bp, Homo sapiens
taatgaatttaaggcaaaa

SEQ ID NO: 794659 - DNA, 21 bp, Homo sapiens
taatgaatttaaggcaaaaaa

SEQ ID NO: 794660 - DNA, 18 bp, Homo sapiens
taatgacagatgcaagtt

SEQ ID NO: 794661 - DNA, 15 bp, Homo sapiens
taatgacaggcctgt

SEQ ID NO: 794662 - DNA, 16 bp, Homo sapiens
taatgaccatgaaaga

SEQ ID NO: 794663 - DNA, 20 bp, Homo sapiens
taatgaccatgaaagacttc

SEQ ID NO: 794664 - DNA, 14 bp, Homo sapiens
taatgacgaggaac

SEQ ID NO: 794665 - DNA, 22 bp, Homo sapiens
taatgactctttctgaaggaag

SEQ ID NO: 794666 - DNA, 18 bp, Homo sapiens
taatgagagtgcactgct

SEQ ID NO: 794667 - DNA, 16 bp, Homo sapiens
taatgagcatttcctt

SEQ ID NO: 794668 - DNA, 18 bp, Homo sapiens
taatgataaaataaataa

SEQ ID NO: 794669 - DNA, 20 bp, Homo sapiens
taatgataaaataaataatt

SEQ ID NO: 794670 - DNA, 12 bp, Homo sapiens
taatgataaact

SEQ ID NO: 794671 - DNA, 15 bp, Homo sapiens
taatgatactgtgtg

SEQ ID NO: 794672 - DNA, 16 bp, Homo sapiens
taatgatactgtgtgt

SEQ ID NO: 794673 - DNA, 15 bp, Homo sapiens
taatgatatgcttgt

SEQ ID NO: 794674 - DNA, 16 bp, Homo sapiens
taatgatatgcttgta

SEQ ID NO: 794675 - DNA, 20 bp, Homo sapiens
taatgatctcggatgaccaa

SEQ ID NO: 794676 - DNA, 18 bp, Homo sapiens
taatgatgtaacagtgca

SEQ ID NO: 794677 - DNA, 16 bp, Homo sapiens
taatgatgttgataat

SEQ ID NO: 794678 - DNA, 18 bp, Homo sapiens
taattaaccttactaatt

SEQ ID NO: 794679 - DNA, 20 bp, Homo sapiens
taattaacttaactgaagaa

SEQ ID NO: 794680 - DNA, 21 bp, Homo sapiens
taattaacttaactgaagaaa

SEQ ID NO: 794681 - DNA, 15 bp, Homo sapiens
taattaagcagaaac

SEQ ID NO: 794682 - DNA, 14 bp, Homo sapiens
taattaagtactat

SEQ ID NO: 794683 - DNA, 20 bp, Homo sapiens
taattaagtactatgtatca

SEQ ID NO: 794684 - DNA, 14 bp, Homo sapiens
taattaagtatctg

SEQ ID NO: 794685 - DNA, 13 bp, Homo sapiens
taattaatagaat

SEQ ID NO: 794686 - DNA, 20 bp, Homo sapiens
taattaatatattaaaattc

SEQ ID NO: 794687 - DNA, 15 bp, Homo sapiens
taattaatttggagc

SEQ ID NO: 794688 - DNA, 13 bp, Homo sapiens
taattacatattt

SEQ ID NO: 794689 - DNA, 14 bp, Homo sapiens
taattacattccta

SEQ ID NO: 794690 - DNA, 16 bp, Homo sapiens
taattacattcctaac

SEQ ID NO: 794691 - DNA, 17 bp, Homo sapiens
taattaccaacctgtta

SEQ ID NO: 794692 - DNA, 17 bp, Homo sapiens
taattacgtttaaagtg

SEQ ID NO: 794693 - DNA, 21 bp, Homo sapiens
taattactgctataaataggt

SEQ ID NO: 794694 - DNA, 19 bp, Homo sapiens
taattacttaagatgttta

SEQ ID NO: 794695 - DNA, 15 bp, Homo sapiens
taattagaaatcaac

SEQ ID NO: 794696 - DNA, 19 bp, Homo sapiens
taattagaaatcaacttgt

SEQ ID NO: 794697 - DNA, 18 bp, Homo sapiens
taattagatccattaatt

SEQ ID NO: 794698 - DNA, 18 bp, Homo sapiens
taattaggggttgctaag

SEQ ID NO: 794699 - DNA, 19 bp, Homo sapiens
taattagtgccacttaatg

SEQ ID NO: 794700 - DNA, 15 bp, Homo sapiens
taattataatctctt

SEQ ID NO: 794701 - DNA, 14 bp, Homo sapiens
taattatataactg

SEQ ID NO: 794702 - DNA, 16 bp, Homo sapiens
taattatataactgta

SEQ ID NO: 794703 - DNA, 20 bp, Homo sapiens
taattatataactgtatttg

SEQ ID NO: 794704 - DNA, 13 bp, Homo sapiens
taattatatttct

SEQ ID NO: 794705 - DNA, 13 bp, Homo sapiens
taattattattaa

SEQ ID NO: 794706 - DNA, 12 bp, Homo sapiens
taattattattt

SEQ ID NO: 794707 - DNA, 13 bp, Homo sapiens
taattattattta

SEQ ID NO: 794708 - DNA, 14 bp, Homo sapiens
taattattatttgt

SEQ ID NO: 794709 - DNA, 14 bp, Homo sapiens
taattattttaaaa

SEQ ID NO: 794710 - DNA, 18 bp, Homo sapiens
taattattttaaaatatt

SEQ ID NO: 794711 - DNA, 19 bp, Homo sapiens
taattattttaaaatattt

SEQ ID NO: 794712 - DNA, 18 bp, Homo sapiens
taattatttttaatttaa

SEQ ID NO: 794713 - DNA, 22 bp, Homo sapiens
taattcaaagctctattaagat

SEQ ID NO: 794714 - DNA, 17 bp, Homo sapiens
taattcaagcctctaaa

SEQ ID NO: 794715 - DNA, 13 bp, Homo sapiens
taattcaataaaa

SEQ ID NO: 794716 - DNA, 16 bp, Homo sapiens
taattcaattcaaagc

SEQ ID NO: 794717 - DNA, 14 bp, Homo sapiens
taattcacagtgct

SEQ ID NO: 794718 - DNA, 21 bp, Homo sapiens
taattcacagtgctcttttct

SEQ ID NO: 794719 - DNA, 22 bp, Homo sapiens
taattcacagtgctcttttctc

SEQ ID NO: 794720 - DNA, 16 bp, Homo sapiens
taattcaccaaagtat

SEQ ID NO: 794721 - DNA, 18 bp, Homo sapiens
taattcaccaaagtattt

SEQ ID NO: 794722 - DNA, 15 bp, Homo sapiens
taattcacctatgtt

SEQ ID NO: 794723 - DNA, 23 bp, Homo sapiens
taattcacctatgttattttgtg

SEQ ID NO: 794724 - DNA, 18 bp, Homo sapiens
taattcacctcagcctgg

SEQ ID NO: 794725 - DNA, 18 bp, Homo sapiens
taattcagaactaaattt

SEQ ID NO: 794726 - DNA, 12 bp, Homo sapiens
taattcagcact

SEQ ID NO: 794727 - DNA, 18 bp, Homo sapiens
taattcagcactgatttc

SEQ ID NO: 794728 - DNA, 21 bp, Homo sapiens
taattcagcactgatttcaca

SEQ ID NO: 794729 - DNA, 22 bp, Homo sapiens
taattcagcactgatttcacaa

SEQ ID NO: 794730 - DNA, 13 bp, Homo sapiens
taattcaggactc

SEQ ID NO: 794731 - DNA, 16 bp, Homo sapiens
taattcaggactccaa

SEQ ID NO: 794732 - DNA, 17 bp, Homo sapiens
taattcaggtttttcct

SEQ ID NO: 794733 - DNA, 17 bp, Homo sapiens
taattcagtacaaccca

SEQ ID NO: 794734 - DNA, 19 bp, Homo sapiens
taattcatcccaactgtct

SEQ ID NO: 794735 - DNA, 13 bp, Homo sapiens
taattcatttgta

SEQ ID NO: 794736 - DNA, 19 bp, Homo sapiens
taattcatttgtattgctt

SEQ ID NO: 794737 - DNA, 16 bp, Homo sapiens
taattccaatatgatg

SEQ ID NO: 794738 - DNA, 18 bp, Homo sapiens
taattccaatatgatgac

SEQ ID NO: 794739 - DNA, 20 bp, Homo sapiens
taattccaatatgatgactc

SEQ ID NO: 794740 - DNA, 17 bp, Homo sapiens
taattccacacctttta

SEQ ID NO: 794741 - DNA, 18 bp, Homo sapiens
taattccatgtcagataa

SEQ ID NO: 794742 - DNA, 16 bp, Homo sapiens
taattcccattttgca

SEQ ID NO: 794743 - DNA, 19 bp, Homo sapiens
taattcccattttgcaaaa

SEQ ID NO: 794744 - DNA, 20 bp, Homo sapiens
taattcccattttgcaaaat

SEQ ID NO: 794745 - DNA, 21 bp, Homo sapiens
taattcccattttgcaaaatt

SEQ ID NO: 794746 - DNA, 13 bp, Homo sapiens
taattcctacagc

SEQ ID NO: 794747 - DNA, 13 bp, Homo sapiens
taattcctatgaa

SEQ ID NO: 794748 - DNA, 22 bp, Homo sapiens
taattcctctcactaaacttta

SEQ ID NO: 794749 - DNA, 21 bp, Homo sapiens
taattcgtacataataagttt

SEQ ID NO: 794750 - DNA, 13 bp, Homo sapiens
taattctccttcc

SEQ ID NO: 794751 - DNA, 14 bp, Homo sapiens
taattctgaaacaa

SEQ ID NO: 794752 - DNA, 17 bp, Homo sapiens
taattctgagttttgtg

SEQ ID NO: 794753 - DNA, 12 bp, Homo sapiens
taattctgtaaa

SEQ ID NO: 794754 - DNA, 18 bp, Homo sapiens
taattcttagctcattct

SEQ ID NO: 794755 - DNA, 21 bp, Homo sapiens
taattcttagtggaagacaat

SEQ ID NO: 794756 - DNA, 16 bp, Homo sapiens
taattcttatgactaa

SEQ ID NO: 794757 - DNA, 17 bp, Homo sapiens
taattcttcacctttgt

SEQ ID NO: 794758 - DNA, 16 bp, Homo sapiens
taattcttgtatatta

SEQ ID NO: 794759 - DNA, 15 bp, Homo sapiens
taattctttgttctg

SEQ ID NO: 794760 - DNA, 19 bp, Homo sapiens
taattctttgttctgtttt

SEQ ID NO: 794761 - DNA, 23 bp, Homo sapiens
taattgaaaagaagtagtgtctg

SEQ ID NO: 794762 - DNA, 13 bp, Homo sapiens
taattgaagaact

SEQ ID NO: 794763 - DNA, 18 bp, Homo sapiens
taattgaagaactgcact

SEQ ID NO: 794764 - DNA, 19 bp, Homo sapiens
taattgaagaactgcactt

SEQ ID NO: 794765 - DNA, 21 bp, Homo sapiens
taattgacaggtaatgaagct

SEQ ID NO: 794766 - DNA, 18 bp, Homo sapiens
taattgatcaaattcatt

SEQ ID NO: 794767 - DNA, 19 bp, Homo sapiens
taattgatcaaattcattt

SEQ ID NO: 794768 - DNA, 19 bp, Homo sapiens
taattgatttcaagacctt

SEQ ID NO: 794769 - DNA, 22 bp, Homo sapiens
taattgcagataactttgactt

SEQ ID NO: 794770 - DNA, 14 bp, Homo sapiens
taattgcatttaaa

SEQ ID NO: 794771 - DNA, 17 bp, Homo sapiens
taattgcctagaaatat

SEQ ID NO: 794772 - DNA, 21 bp, Homo sapiens
taattgcctgttaaatataca

SEQ ID NO: 794773 - DNA, 12 bp, Homo sapiens
taattgctattt

SEQ ID NO: 794774 - DNA, 20 bp, Homo sapiens
taattggaagaaattcctgt

SEQ ID NO: 794775 - DNA, 14 bp, Homo sapiens
taattggatgttca

SEQ ID NO: 794776 - DNA, 15 bp, Homo sapiens
taattggatttccta

SEQ ID NO: 794777 - DNA, 17 bp, Homo sapiens
taattgggcactattta

SEQ ID NO: 794778 - DNA, 16 bp, Homo sapiens
taattggtgctatttg

SEQ ID NO: 794779 - DNA, 18 bp, Homo sapiens
taattggtttagttctta

SEQ ID NO: 794780 - DNA, 15 bp, Homo sapiens
taattggttttatgc

SEQ ID NO: 794781 - DNA, 22 bp, Homo sapiens
taattgtaaagtaaaagctata

SEQ ID NO: 794782 - DNA, 16 bp, Homo sapiens
taattgtaagtgaaat

SEQ ID NO: 794783 - DNA, 15 bp, Homo sapiens
taattgtaattccaa

SEQ ID NO: 794784 - DNA, 12 bp, Homo sapiens
taattgtataag

SEQ ID NO: 794785 - DNA, 13 bp, Homo sapiens
taattgtataagt

SEQ ID NO: 794786 - DNA, 12 bp, Homo sapiens
taattgtcatta

SEQ ID NO: 794787 - DNA, 18 bp, Homo sapiens
taattgtccctgtttcaa

SEQ ID NO: 794788 - DNA, 14 bp, Homo sapiens
taattgtcctgtgt

SEQ ID NO: 794789 - DNA, 23 bp, Homo sapiens
taattgtcctgtgtctatgtacc

SEQ ID NO: 794790 - DNA, 22 bp, Homo sapiens
taattgtgattagacagaacac

SEQ ID NO: 794791 - DNA, 23 bp, Homo sapiens
taattgtgattagacagaacacc

SEQ ID NO: 794792 - DNA, 13 bp, Homo sapiens
taattgtgtaaaa

SEQ ID NO: 794793 - DNA, 12 bp, Homo sapiens
taattgtgtatt

SEQ ID NO: 794794 - DNA, 22 bp, Homo sapiens
taattgttcattttgagctgaa

SEQ ID NO: 794795 - DNA, 16 bp, Homo sapiens
tacaagtggctcccca

SEQ ID NO: 794796 - DNA, 13 bp, Homo sapiens
tacaagtgtatat

SEQ ID NO: 794797 - DNA, 21 bp, Homo sapiens
tacaagtgtatatcagaaaag

SEQ ID NO: 794798 - DNA, 22 bp, Homo sapiens
tacaagtgttttagatgttact

SEQ ID NO: 794799 - DNA, 20 bp, Homo sapiens
tacaagttgttattgttgaa

SEQ ID NO: 794800 - DNA, 13 bp, Homo sapiens
tacaagtttcaga

SEQ ID NO: 794801 - DNA, 18 bp, Homo sapiens
tacaagtttcagacaggg

SEQ ID NO: 794802 - DNA, 15 bp, Homo sapiens
tacaagttttgtata

SEQ ID NO: 794803 - DNA, 13 bp, Homo sapiens
tacaataaaaaga

SEQ ID NO: 794804 - DNA, 21 bp, Homo sapiens
tacaataaaactttgctgcca

SEQ ID NO: 794805 - DNA, 16 bp, Homo sapiens
tacaataaaagagctt

SEQ ID NO: 794806 - DNA, 18 bp, Homo sapiens
tacaataaaagagcttta

SEQ ID NO: 794807 - DNA, 11 bp, Homo sapiens
tacaataaact

SEQ ID NO: 794808 - DNA, 19 bp, Homo sapiens
ttgtacaattactaaattg

SEQ ID NO: 794809 - DNA, 14 bp, Homo sapiens
ttgtacaattttaa

SEQ ID NO: 794810 - DNA, 20 bp, Homo sapiens
ttgtacaattttaaagttct

SEQ ID NO: 794811 - DNA, 23 bp, Homo sapiens
ttgtacaggactgtaaagatttg

SEQ ID NO: 794812 - DNA, 22 bp, Homo sapiens
ttgtacagttaactctcccagg

SEQ ID NO: 794813 - DNA, 14 bp, Homo sapiens
ttgtacataatgcg

SEQ ID NO: 794814 - DNA, 18 bp, Homo sapiens
ttgtacataatgcgtgca

SEQ ID NO: 794815 - DNA, 21 bp, Homo sapiens
ttgtacatatttgtggaataa

SEQ ID NO: 794816 - DNA, 20 bp, Homo sapiens
ttgtacatttgggagttttt

SEQ ID NO: 794817 - DNA, 19 bp, Homo sapiens
ttgtacatttttgggggga

SEQ ID NO: 794818 - DNA, 21 bp, Homo sapiens
ttgtaccatagaaaaatgtat

SEQ ID NO: 794819 - DNA, 21 bp, Homo sapiens
ttgtaccattccttcaaataa

SEQ ID NO: 794820 - DNA, 15 bp, Homo sapiens
ttgtaccattttcta

SEQ ID NO: 794821 - DNA, 18 bp, Homo sapiens
ttgtacctatttctgatg

SEQ ID NO: 794822 - DNA, 17 bp, Homo sapiens
ttgtacgtaaagcttaa

SEQ ID NO: 794823 - DNA, 21 bp, Homo sapiens
ttgtactcaaagcccagaatc

SEQ ID NO: 794824 - DNA, 16 bp, Homo sapiens
ttgtactccagcctgg

SEQ ID NO: 794825 - DNA, 22 bp, Homo sapiens
ttgtactgttgctttaatatga

SEQ ID NO: 794826 - DNA, 17 bp, Homo sapiens
ttgtactgtttaatgtt

SEQ ID NO: 794827 - DNA, 24 bp, Homo sapiens
ttgtactgtttaatgttctgtgat

SEQ ID NO: 794828 - DNA, 22 bp, Homo sapiens
ttgtacttagccagttcaaagt

SEQ ID NO: 794829 - DNA, 12 bp, Homo sapiens
ttgtacttctgc

SEQ ID NO: 794830 - DNA, 12 bp, Homo sapiens
ttgtacttctgt

SEQ ID NO: 794831 - DNA, 15 bp, Homo sapiens
ttgtacttctgtgtt

SEQ ID NO: 794832 - DNA, 18 bp, Homo sapiens
ttgtacttctgtgttcat

SEQ ID NO: 794833 - DNA, 19 bp, Homo sapiens
ttgtacttttctggttcca

SEQ ID NO: 794834 - DNA, 22 bp, Homo sapiens
ttgtagaaacacagttttgaaa

SEQ ID NO: 794835 - DNA, 19 bp, Homo sapiens
ttgtagaactcactctggg

SEQ ID NO: 794836 - DNA, 22 bp, Homo sapiens
ttgtagaactcactctgggctg

SEQ ID NO: 794837 - DNA, 18 bp, Homo sapiens
ttgtagaataaatggttt

SEQ ID NO: 794838 - DNA, 23 bp, Homo sapiens
ttgtagagaacacgcgtatttac

SEQ ID NO: 794839 - DNA, 18 bp, Homo sapiens
ttgtagagagagctgtat

SEQ ID NO: 794840 - DNA, 18 bp, Homo sapiens
ttgtagagtgtagactgt

SEQ ID NO: 794841 - DNA, 15 bp, Homo sapiens
ttgtagatgaacttg

SEQ ID NO: 794842 - DNA, 18 bp, Homo sapiens
ttgtagcagctatatatt

SEQ ID NO: 794843 - DNA, 19 bp, Homo sapiens
ttgtagcaggtttcactat

SEQ ID NO: 794844 - DNA, 15 bp, Homo sapiens
ttgtagcataactgt

SEQ ID NO: 794845 - DNA, 16 bp, Homo sapiens
ttgtagcatttcttga

SEQ ID NO: 794846 - DNA, 16 bp, Homo sapiens
ttgtaggaatctgcct

SEQ ID NO: 794847 - DNA, 20 bp, Homo sapiens
ttgtaggagctgaggtttca

SEQ ID NO: 794848 - DNA, 17 bp, Homo sapiens
ttgtaggataagtgaaa

SEQ ID NO: 794849 - DNA, 20 bp, Homo sapiens
ttgtaggcgaatcatttgtt

SEQ ID NO: 794850 - DNA, 19 bp, Homo sapiens
ttgtaggggtcaaagaaat

SEQ ID NO: 794851 - DNA, 20 bp, Homo sapiens
ttgtaggggtcaaagaaatg

SEQ ID NO: 794852 - DNA, 15 bp, Homo sapiens
ttgtagtaaaagtgg

SEQ ID NO: 794853 - DNA, 21 bp, Homo sapiens
ttgtagtagcgttttttaaat

SEQ ID NO: 794854 - DNA, 20 bp, Homo sapiens
tttgcttatttttataatta

SEQ ID NO: 794855 - DNA, 22 bp, Homo sapiens
tttgcttcaacaactttgtgct

SEQ ID NO: 794856 - DNA, 20 bp, Homo sapiens
tttgcttcataaatgaagca

SEQ ID NO: 794857 - DNA, 13 bp, Homo sapiens
tttgcttccatta

SEQ ID NO: 794858 - DNA, 10 bp, Homo sapiens
tttgcttccg

SEQ ID NO: 794859 - DNA, 20 bp, Homo sapiens
tttgcttctctttcccccac

SEQ ID NO: 794860 - DNA, 23 bp, Homo sapiens
tttgcttgctttgaagtagctct

SEQ ID NO: 794861 - DNA, 18 bp, Homo sapiens
tttgctttgctttctgct

SEQ ID NO: 794862 - DNA, 18 bp, Homo sapiens
tttgcttttgtatatcct

SEQ ID NO: 794863 - DNA, 14 bp, Homo sapiens
tttgctttttgcta

SEQ ID NO: 794864 - DNA, 17 bp, Homo sapiens
tttggaaaaaactctga

SEQ ID NO: 794865 - DNA, 18 bp, Homo sapiens
tttggaaaaaactctgaa

SEQ ID NO: 794866 - DNA, 17 bp, Homo sapiens
tttggaaactgctaaat

SEQ ID NO: 794867 - DNA, 20 bp, Homo sapiens
tttggaaagtacactctgct

SEQ ID NO: 794868 - DNA, 22 bp, Homo sapiens
tttggaaagtacactctgctgt

SEQ ID NO: 794869 - DNA, 11 bp, Homo sapiens
tttggaaatcc

SEQ ID NO: 794870 - DNA, 23 bp, Homo sapiens
tttggaacatttctttcttgctg

SEQ ID NO: 794871 - DNA, 22 bp, Homo sapiens
tttggaaccaaagtctaaactg

SEQ ID NO: 794872 - DNA, 23 bp, Homo sapiens
tttggaagagaggcacctgctgg

SEQ ID NO: 794873 - DNA, 14 bp, Homo sapiens
tttggaagttttca

SEQ ID NO: 794874 - DNA, 13 bp, Homo sapiens
tttggaataaagt

SEQ ID NO: 794875 - DNA, 18 bp, Homo sapiens
tttggaataatttctatt

SEQ ID NO: 794876 - DNA, 20 bp, Homo sapiens
tttggaataatttctattaa

SEQ ID NO: 794877 - DNA, 16 bp, Homo sapiens
tttggaatatttgaat

SEQ ID NO: 794878 - DNA, 21 bp, Homo sapiens
tttggaatcatactgcctact

SEQ ID NO: 794879 - DNA, 12 bp, Homo sapiens
tttggaattcag

SEQ ID NO: 794880 - DNA, 20 bp, Homo sapiens
tttggaattgaactctctgc

SEQ ID NO: 794881 - DNA, 12 bp, Homo sapiens
tttggacagtgg

SEQ ID NO: 794882 - DNA, 13 bp, Homo sapiens
tttggacagtggc

SEQ ID NO: 794883 - DNA, 16 bp, Homo sapiens
tttggacagtggcctc

SEQ ID NO: 794884 - DNA, 18 bp, Homo sapiens
tttggactccatctctca

SEQ ID NO: 794885 - DNA, 18 bp, Homo sapiens
tttggactgttttcaata

SEQ ID NO: 794886 - DNA, 12 bp, Homo sapiens
tttggagaaaaa

SEQ ID NO: 794887 - DNA, 22 bp, Homo sapiens
tttggagaacgccagtctccca

SEQ ID NO: 794888 - DNA, 20 bp, Homo sapiens
tttggagagggggcctggga

SEQ ID NO: 794889 - DNA, 22 bp, Homo sapiens
tttggagcattaactaaatgct

SEQ ID NO: 794890 - DNA, 21 bp, Homo sapiens
tttggagcctcccttctgcct

SEQ ID NO: 794891 - DNA, 22 bp, Homo sapiens
tttggagtgttatgtatttcct

SEQ ID NO: 794892 - DNA, 20 bp, Homo sapiens
tttggagttaggtcctcact

SEQ ID NO: 794893 - DNA, 20 bp, Homo sapiens
tttggataataggaattcaa

SEQ ID NO: 794894 - DNA, 16 bp, Homo sapiens
tttggataatcttaaa

SEQ ID NO: 794895 - DNA, 15 bp, Homo sapiens
tttggatacagctgc

SEQ ID NO: 794896 - DNA, 18 bp, Homo sapiens
tttggatacatctgctgt

SEQ ID NO: 794897 - DNA, 20 bp, Homo sapiens
tttggatctccaattgcctc

SEQ ID NO: 794898 - DNA, 21 bp, Homo sapiens
tttggatgggagtgagacaga

SEQ ID NO: 794899 - DNA, 19 bp, Homo sapiens
tttggatgttgtaaataaa

SEQ ID NO: 794900 - DNA, 22 bp, Homo sapiens
tttggattggatgaattccaaa

SEQ ID NO: 794901 - DNA, 16 bp, Homo sapiens
tttggcaattttgtgg

SEQ ID NO: 794902 - DNA, 11 bp, Homo sapiens
tttggcactgg

SEQ ID NO: 794903 - DNA, 17 bp, Homo sapiens
tttggcactggggcact

SEQ ID NO: 794904 - DNA, 13 bp, Homo sapiens
tttggcacttgta

SEQ ID NO: 794905 - DNA, 16 bp, Homo sapiens
tttggcacttgtattt

SEQ ID NO: 794906 - DNA, 19 bp, Homo sapiens
tttggcacttgtatttaat

SEQ ID NO: 794907 - DNA, 17 bp, Homo sapiens
tttggcaggaagatgta

SEQ ID NO: 794908 - DNA, 13 bp, Homo sapiens
tttggccccactt

SEQ ID NO: 794909 - DNA, 16 bp, Homo sapiens
tttggccccactttga

SEQ ID NO: 794910 - DNA, 20 bp, Homo sapiens
tttggcccccgagctggggg

SEQ ID NO: 794911 - DNA, 15 bp, Homo sapiens
tttggccctggagcc

SEQ ID NO: 794912 - DNA, 19 bp, Homo sapiens
tttggccctggagccaggg

SEQ ID NO: 794913 - DNA, 12 bp, Homo sapiens
tttggccttaag

SEQ ID NO: 794914 - DNA, 17 bp, Homo sapiens
tttggcgggccaaggac

SEQ ID NO: 794915 - DNA, 13 bp, Homo sapiens
tttggctctccca

SEQ ID NO: 794916 - DNA, 19 bp, Homo sapiens
tttggctggtagcagcagg

SEQ ID NO: 794917 - DNA, 19 bp, Homo sapiens
tttggctgtgtctaaactg

SEQ ID NO: 794918 - DNA, 15 bp, Homo sapiens
tttggcttataaaca

SEQ ID NO: 794919 - DNA, 17 bp, Homo sapiens
tttggcttctcctgtga

SEQ ID NO: 794920 - DNA, 14 bp, Homo sapiens
tttggcttgctgtt

SEQ ID NO: 794921 - DNA, 19 bp, Homo sapiens
tttgggaaagatggataaa

SEQ ID NO: 794922 - DNA, 11 bp, Homo sapiens
tttgggaagac

SEQ ID NO: 794923 - DNA, 21 bp, Homo sapiens
tttgggaagacgttttcttta

SEQ ID NO: 794924 - DNA, 23 bp, Homo sapiens
tttgggagctgaaccaaagcctc

SEQ ID NO: 794925 - DNA, 17 bp, Homo sapiens
tttgggaggccaaggca

SEQ ID NO: 794926 - DNA, 17 bp, Homo sapiens
tttgggaggctgaggcg

SEQ ID NO: 794927 - DNA, 15 bp, Homo sapiens
tttgggagtttttat

SEQ ID NO: 794928 - DNA, 15 bp, Homo sapiens
tttgggcccctcaga

SEQ ID NO: 794929 - DNA, 19 bp, Homo sapiens
tttgggctgaatgtatgta

SEQ ID NO: 794930 - DNA, 14 bp, Homo sapiens
tttgggctgccctg

SEQ ID NO: 794931 - DNA, 18 bp, Homo sapiens
tttggggaagtttatttg

SEQ ID NO: 794932 - DNA, 22 bp, Homo sapiens
tttgggggaaacgggctccttc

SEQ ID NO: 794933 - DNA, 18 bp, Homo sapiens
tttgggggacgtttctca

SEQ ID NO: 794934 - DNA, 21 bp, Homo sapiens
tttgggggcgccctctctgct

SEQ ID NO: 794935 - DNA, 20 bp, Homo sapiens
tttggggggttttcttgcct

SEQ ID NO: 794936 - DNA, 18 bp, Homo sapiens
tttggggtagaccttgag

SEQ ID NO: 794937 - DNA, 16 bp, Homo sapiens
tttggggtctttgtgg

SEQ ID NO: 794938 - DNA, 11 bp, Homo sapiens
tttggggtgcc

SEQ ID NO: 794939 - DNA, 13 bp, Homo sapiens
tttgggtgggggc

SEQ ID NO: 794940 - DNA, 17 bp, Homo sapiens
tttgggtttggccaggg

SEQ ID NO: 794941 - DNA, 19 bp, Homo sapiens
tttgggtttggccagggag

SEQ ID NO: 794942 - DNA, 16 bp, Homo sapiens
tttgggtttttttcct

SEQ ID NO: 794943 - DNA, 15 bp, Homo sapiens
tttggtaaatttttg

SEQ ID NO: 794944 - DNA, 16 bp, Homo sapiens
tttggtaaatttttga

SEQ ID NO: 794945 - DNA, 15 bp, Homo sapiens
tttggtaataacaaa

SEQ ID NO: 794946 - DNA, 16 bp, Homo sapiens
tttggtacaaaaataa

SEQ ID NO: 794947 - DNA, 23 bp, Homo sapiens
tttggtacttttgagtgtgtgtg

SEQ ID NO: 794948 - DNA, 22 bp, Homo sapiens
tttggtattacactgtatttgt

SEQ ID NO: 794949 - DNA, 17 bp, Homo sapiens
tttggtatttatgtaaa

SEQ ID NO: 794950 - DNA, 16 bp, Homo sapiens
tttggtcccctccctc

SEQ ID NO: 794951 - DNA, 21 bp, Homo sapiens
tttggtcccctccctcgtggg

SEQ ID NO: 794952 - DNA, 21 bp, Homo sapiens
tttggtccttcaaaggcttgt

SEQ ID NO: 794953 - DNA, 18 bp, Homo sapiens
tttggtcgaggagtaaca

SEQ ID NO: 794954 - DNA, 19 bp, Homo sapiens
tttggtcgaggagtaacaa

SEQ ID NO: 794955 - DNA, 16 bp, Homo sapiens
tttggtctgccagaat

SEQ ID NO: 794956 - DNA, 16 bp, Homo sapiens
tttggtctggactgac

SEQ ID NO: 794957 - DNA, 21 bp, Homo sapiens
tttggtctggactgacagcat

SEQ ID NO: 794958 - DNA, 21 bp, Homo sapiens
tttggtgaattccttctaaga

SEQ ID NO: 794959 - DNA, 19 bp, Homo sapiens
tttggtgagagtcaaagct

SEQ ID NO: 794960 - DNA, 14 bp, Homo sapiens
tttggtgcagaggt

SEQ ID NO: 794961 - DNA, 21 bp, Homo sapiens
tttggtgcttctcagatttct

SEQ ID NO: 794962 - DNA, 15 bp, Homo sapiens
tttggtggagataaa

SEQ ID NO: 794963 - DNA, 18 bp, Homo sapiens
tttggtgtggattttcta

SEQ ID NO: 794964 - DNA, 16 bp, Homo sapiens
tttggtgttcctggaa

SEQ ID NO: 794965 - DNA, 19 bp, Homo sapiens
tttggtgttcctggaagca

SEQ ID NO: 794966 - DNA, 16 bp, Homo sapiens
tttggtgtttgtctgt

SEQ ID NO: 794967 - DNA, 20 bp, Homo sapiens
tttggttcattaattctata

SEQ ID NO: 794968 - DNA, 17 bp, Homo sapiens
tttggttgaataaacta

SEQ ID NO: 794969 - DNA, 22 bp, Homo sapiens
tttggttgtaaatgctcgtgtg

SEQ ID NO: 794970 - DNA, 19 bp, Homo sapiens
tttggtttcccaagagcta

SEQ ID NO: 794971 - DNA, 20 bp, Homo sapiens
tttggtttgctttggtttat

SEQ ID NO: 794972 - DNA, 9 bp, Homo sapiens
tttggtttt

SEQ ID NO: 794973 - DNA, 17 bp, Homo sapiens
tttgtaaaaactgaaga

SEQ ID NO: 794974 - DNA, 21 bp, Homo sapiens
tttgtaaaagaacagtaaaca

SEQ ID NO: 794975 - DNA, 12 bp, Homo sapiens
tttgtaaaatct

SEQ ID NO: 794976 - DNA, 16 bp, Homo sapiens
tttgtaaaatgtatta

SEQ ID NO: 794977 - DNA, 13 bp, Homo sapiens
tttgtaaacattt

SEQ ID NO: 794978 - DNA, 18 bp, Homo sapiens
tttgtaaactacaaagta

SEQ ID NO: 794979 - DNA, 22 bp, Homo sapiens
tttgtaaagttggttggataag

SEQ ID NO: 794980 - DNA, 17 bp, Homo sapiens
tttgtaaataagagatt

SEQ ID NO: 794981 - DNA, 22 bp, Homo sapiens
tttgtaaataagagatttggag

SEQ ID NO: 794982 - DNA, 20 bp, Homo sapiens
tttgtaaataggatttttag

SEQ ID NO: 794983 - DNA, 12 bp, Homo sapiens
tttgtaaatgat

SEQ ID NO: 794984 - DNA, 15 bp, Homo sapiens
tttgtaaattaactt

SEQ ID NO: 794985 - DNA, 16 bp, Homo sapiens
tttgtaaattaacttt

SEQ ID NO: 794986 - DNA, 18 bp, Homo sapiens
tttgtaaattatttgcta

SEQ ID NO: 794987 - DNA, 17 bp, Homo sapiens
tttgtaaattgaataag

SEQ ID NO: 794988 - DNA, 15 bp, Homo sapiens
tttgtaacattgtaa

SEQ ID NO: 794989 - DNA, 23 bp, Homo sapiens
tttgtaacattgtaaagtatgtg

SEQ ID NO: 794990 - DNA, 21 bp, Homo sapiens
tttgtaacccagattttgctg

SEQ ID NO: 794991 - DNA, 19 bp, Homo sapiens
tttgtaacctcagctctgg

SEQ ID NO: 794992 - DNA, 22 bp, Homo sapiens
tttgtaactacaaagctttgct

SEQ ID NO: 794993 - DNA, 10 bp, Homo sapiens
tttgtaactt

SEQ ID NO: 794994 - DNA, 20 bp, Homo sapiens
tttgtaagcaacttgcttct

SEQ ID NO: 794995 - DNA, 22 bp, Homo sapiens
tttgtaaggtcatgctggtggg

SEQ ID NO: 794996 - DNA, 20 bp, Homo sapiens
tttgtaagttgaagcaaatc

SEQ ID NO: 794997 - DNA, 22 bp, Homo sapiens
tttgtaatatggaaatctttta

SEQ ID NO: 794998 - DNA, 19 bp, Homo sapiens
tttgtaatatttgaatttt

SEQ ID NO: 794999 - DNA, 15 bp, Homo sapiens
tttgtaatattttcc

SEQ ID NO: 795000 - DNA, 16 bp, Homo sapiens
tttgtaatcccagtta

SEQ ID NO: 795001 - DNA, 19 bp, Homo sapiens
tttgtaatgcactgttttt

SEQ ID NO: 795002 - DNA, 23 bp, Homo sapiens
tttgtaatgtcaccaccttccca

SEQ ID NO: 795003 - DNA, 18 bp, Homo sapiens
tttgtaatgtgtgaaaaa

SEQ ID NO: 795004 - DNA, 15 bp, Homo sapiens
tttgtaattcttatg

SEQ ID NO: 795005 - DNA, 20 bp, Homo sapiens
tttgtaattgcttacatttt

SEQ ID NO: 795006 - DNA, 14 bp, Homo sapiens
tttgtaattgtgta

SEQ ID NO: 795007 - DNA, 16 bp, Homo sapiens
tttgtaattgtgtaaa

SEQ ID NO: 795008 - DNA, 14 bp, Homo sapiens
tttgtaatttgaat

SEQ ID NO: 795009 - DNA, 22 bp, Homo sapiens
tttgtacagaccgagaggccag

SEQ ID NO: 795010 - DNA, 14 bp, Homo sapiens
tttgtacagagtgc

SEQ ID NO: 795011 - DNA, 13 bp, Homo sapiens
tttgtacaggggc

SEQ ID NO: 795012 - DNA, 21 bp, Homo sapiens
tttgtacaggggccatgcccc

SEQ ID NO: 795013 - DNA, 20 bp, Homo sapiens
tttgtaccattccttcaaat

SEQ ID NO: 795014 - DNA, 21 bp, Homo sapiens
tttgtaccctgaagtgttttt

SEQ ID NO: 795015 - DNA, 14 bp, Homo sapiens
tttgtacctctaag

SEQ ID NO: 795016 - DNA, 14 bp, Homo sapiens
tttgtacttttagt

SEQ ID NO: 795017 - DNA, 17 bp, Homo sapiens
tttgtagaataaatggt

SEQ ID NO: 795018 - DNA, 19 bp, Homo sapiens
tttgtagatggagtttcac

SEQ ID NO: 795019 - DNA, 12 bp, Homo sapiens
tttgtagatgtt

SEQ ID NO: 795020 - DNA, 10 bp, Homo sapiens
tttgtagcat

SEQ ID NO: 795021 - DNA, 20 bp, Homo sapiens
tttgtagccatcctgttaaa

SEQ ID NO: 795022 - DNA, 17 bp, Homo sapiens
tttgtagccttcctcca

SEQ ID NO: 795023 - DNA, 23 bp, Homo sapiens
tttgtaggggtcaaagaaatgct

SEQ ID NO: 795024 - DNA, 15 bp, Homo sapiens
tttgtagtagcgttt

SEQ ID NO: 795025 - DNA, 17 bp, Homo sapiens
tttgtagtagcgttttt

SEQ ID NO: 795026 - DNA, 13 bp, Homo sapiens
tttgtagttgttg

SEQ ID NO: 795027 - DNA, 16 bp, Homo sapiens
tttgtataaaaaggaa

SEQ ID NO: 795028 - DNA, 18 bp, Homo sapiens
tttgtataaaaaggaaat

SEQ ID NO: 795029 - DNA, 16 bp, Homo sapiens
tttgtataaactgtca

SEQ ID NO: 795030 - DNA, 14 bp, Homo sapiens
tttgtatacaagta

SEQ ID NO: 795031 - DNA, 16 bp, Homo sapiens
tttgtatagtaaagtg

SEQ ID NO: 795032 - DNA, 19 bp, Homo sapiens
tttgtatataggcttctca

SEQ ID NO: 795033 - DNA, 23 bp, Homo sapiens
tttgtatatcatgaaacacttct

SEQ ID NO: 795034 - DNA, 12 bp, Homo sapiens
tttgtatattgt

SEQ ID NO: 795035 - DNA, 16 bp, Homo sapiens
tttgtatattgtagga

SEQ ID NO: 795036 - DNA, 20 bp, Homo sapiens
tttgtatctctgaagcatgt

SEQ ID NO: 795037 - DNA, 22 bp, Homo sapiens
tttgtatctgcaggcagacacg

SEQ ID NO: 795038 - DNA, 14 bp, Homo sapiens
tttgtatcttcctt

SEQ ID NO: 795039 - DNA, 15 bp, Homo sapiens
tttgtatctttatgc

SEQ ID NO: 795040 - DNA, 12 bp, Homo sapiens
tttgtatgaaat

SEQ ID NO: 795041 - DNA, 19 bp, Homo sapiens
tttgtatgaaatatatgtg

SEQ ID NO: 795042 - DNA, 20 bp, Homo sapiens
tttgtatgaaatatatgtga

SEQ ID NO: 795043 - DNA, 13 bp, Homo sapiens
tttgtatgacagt

SEQ ID NO: 795044 - DNA, 14 bp, Homo sapiens
tttgtatgagatgg

SEQ ID NO: 795045 - DNA, 15 bp, Homo sapiens
tttgtatgagatggt

SEQ ID NO: 795046 - DNA, 16 bp, Homo sapiens
tttgtatgcactttgt

SEQ ID NO: 795047 - DNA, 13 bp, Homo sapiens
tttgtatgtgtgt

SEQ ID NO: 795048 - DNA, 19 bp, Homo sapiens
tttgtatgtttagtagaaa

SEQ ID NO: 795049 - DNA, 21 bp, Homo sapiens
tttgtatgtttagtagaaacg

SEQ ID NO: 795050 - DNA, 12 bp, Homo sapiens
tttgtatgtttt

SEQ ID NO: 795051 - DNA, 22 bp, Homo sapiens
tttgtattaaaaaaaaatactc

SEQ ID NO: 795052 - DNA, 16 bp, Homo sapiens
tttgtattaagaaagg

SEQ ID NO: 795053 - DNA, 17 bp, Homo sapiens
tttgtattacatctaat

SEQ ID NO: 795054 - DNA, 16 bp, Homo sapiens
tttgtattataaaagc

SEQ ID NO: 795055 - DNA, 16 bp, Homo sapiens
tttgtattataattgt

SEQ ID NO: 795056 - DNA, 17 bp, Homo sapiens
tttgtattataattgtt

SEQ ID NO: 795057 - DNA, 17 bp, Homo sapiens
tttgtattattacaaat

SEQ ID NO: 795058 - DNA, 12 bp, Homo sapiens
tttgtattgctt

SEQ ID NO: 795059 - DNA, 14 bp, Homo sapiens
tttgtattgtatat

SEQ ID NO: 795060 - DNA, 18 bp, Homo sapiens
tttgtattgttaatatct

SEQ ID NO: 795061 - DNA, 19 bp, Homo sapiens
tttgtattgttaatatctt

SEQ ID NO: 795062 - DNA, 22 bp, Homo sapiens
tttgtattgttctaatgcaaca

SEQ ID NO: 795063 - DNA, 13 bp, Homo sapiens
tttgtatttggaa

SEQ ID NO: 795064 - DNA, 10 bp, Homo sapiens
tttgtatttt

SEQ ID NO: 795065 - DNA, 14 bp, Homo sapiens
tttgtatttttagt

SEQ ID NO: 795066 - DNA, 19 bp, Homo sapiens
tttgtattttttatttaca

SEQ ID NO: 795067 - DNA, 16 bp, Homo sapiens
tttgtattttttcctt

SEQ ID NO: 795068 - DNA, 17 bp, Homo sapiens
tttgtcaaactgtagaa

SEQ ID NO: 795069 - DNA, 15 bp, Homo sapiens
tttgtcaattgctaa

SEQ ID NO: 795070 - DNA, 13 bp, Homo sapiens
tttgtcacttgcc

SEQ ID NO: 795071 - DNA, 15 bp, Homo sapiens
tttgtcacttttcct

SEQ ID NO: 795072 - DNA, 15 bp, Homo sapiens
tttgtcagacttcca

SEQ ID NO: 795073 - DNA, 22 bp, Homo sapiens
tttgtcatgctgggatttccaa

SEQ ID NO: 795074 - DNA, 18 bp, Homo sapiens
tttgtcattatgatttca

SEQ ID NO: 795075 - DNA, 23 bp, Homo sapiens
tttgtcattcaagcctgtgaata

SEQ ID NO: 795076 - DNA, 20 bp, Homo sapiens
tttgtcattttaaaatctga

SEQ ID NO: 795077 - DNA, 20 bp, Homo sapiens
tttgtccaattgtgtagacg

SEQ ID NO: 795078 - DNA, 13 bp, Homo sapiens
tttgtcccagcct

SEQ ID NO: 795079 - DNA, 20 bp, Homo sapiens
tttgtccccagggcccctcc

SEQ ID NO: 795080 - DNA, 14 bp, Homo sapiens
tttgtcccccaact

SEQ ID NO: 795081 - DNA, 21 bp, Homo sapiens
tttgtcccccaacttgagatg

SEQ ID NO: 795082 - DNA, 18 bp, Homo sapiens
tttgtcctgcatcatctt

SEQ ID NO: 795083 - DNA, 20 bp, Homo sapiens
tttgtcctgcctcttgtttc

SEQ ID NO: 795084 - DNA, 17 bp, Homo sapiens
tttgtcctttttcactt

SEQ ID NO: 795085 - DNA, 11 bp, Homo sapiens
tttgtctaaaa

SEQ ID NO: 795086 - DNA, 15 bp, Homo sapiens
tttgtctaaaatgcc

SEQ ID NO: 795087 - DNA, 14 bp, Homo sapiens
tttgtctatgaagt

SEQ ID NO: 795088 - DNA, 16 bp, Homo sapiens
tttgtctatgaagttg

SEQ ID NO: 795089 - DNA, 20 bp, Homo sapiens
tttgtctatgaagttgctgt

SEQ ID NO: 795090 - DNA, 18 bp, Homo sapiens
tttgtctattttaaaata

SEQ ID NO: 795091 - DNA, 19 bp, Homo sapiens
tttgtctcttagaaatact

SEQ ID NO: 795092 - DNA, 13 bp, Homo sapiens
tttgtctggcctc

SEQ ID NO: 795093 - DNA, 13 bp, Homo sapiens
tttgtctgtacat

SEQ ID NO: 795094 - DNA, 12 bp, Homo sapiens
tttgtcttaaaa

SEQ ID NO: 795095 - DNA, 22 bp, Homo sapiens
tttgtcttaaaaaatgtgaaat

SEQ ID NO: 795096 - DNA, 14 bp, Homo sapiens
tttgtcttatatat

SEQ ID NO: 795097 - DNA, 23 bp, Homo sapiens
tttgtcttatcccccccagcctg

SEQ ID NO: 795098 - DNA, 16 bp, Homo sapiens
tttgtcttattgaaaa

SEQ ID NO: 795099 - DNA, 12 bp, Homo sapiens
tttgtcttgtac

SEQ ID NO: 795100 - DNA, 15 bp, Homo sapiens
tttgtcttgtacttc

SEQ ID NO: 795101 - DNA, 21 bp, Homo sapiens
tttgtcttgtgtttctttagt

SEQ ID NO: 795102 - DNA, 21 bp, Homo sapiens
tttgtgaaacagttgctgtga

SEQ ID NO: 795103 - DNA, 22 bp, Homo sapiens
tttgtgaacaagtccctgtaat

SEQ ID NO: 795104 - DNA, 12 bp, Homo sapiens
tttgtgaatttg

SEQ ID NO: 795105 - DNA, 13 bp, Homo sapiens
tttgtgaatttgc

SEQ ID NO: 795106 - DNA, 15 bp, Homo sapiens
tttgtgacattcctt

SEQ ID NO: 795107 - DNA, 22 bp, Homo sapiens
tttgtgactatatagagatgtt

SEQ ID NO: 795108 - DNA, 20 bp, Homo sapiens
tttgtgagagcccagtcatt

SEQ ID NO: 795109 - DNA, 18 bp, Homo sapiens
tttgtgagtcaatacata

SEQ ID NO: 795110 - DNA, 15 bp, Homo sapiens
tttgtgatacaatgc

SEQ ID NO: 795111 - DNA, 23 bp, Homo sapiens
tttgtgatattaaatttcaaatg

SEQ ID NO: 795112 - DNA, 18 bp, Homo sapiens
tttgtgatcagcattgtg

SEQ ID NO: 795113 - DNA, 22 bp, Homo sapiens
tttgtgcattatctagatactg

SEQ ID NO: 795114 - DNA, 17 bp, Homo sapiens
tttgtgcattctttggt

SEQ ID NO: 795115 - DNA, 21 bp, Homo sapiens
tttgtgccacacgcatgggca

SEQ ID NO: 795116 - DNA, 13 bp, Homo sapiens
tttgtgccagccg

SEQ ID NO: 795117 - DNA, 20 bp, Homo sapiens
tttgtgccattatatttgca

SEQ ID NO: 795118 - DNA, 22 bp, Homo sapiens
tttgtgctgaatgttgggactg

SEQ ID NO: 795119 - DNA, 13 bp, Homo sapiens
tttgtgctgtggg

SEQ ID NO: 795120 - DNA, 22 bp, Homo sapiens
tttgtgctgtgggcagcaccct

SEQ ID NO: 795121 - DNA, 20 bp, Homo sapiens
tttgtgcttgtcattccaga

SEQ ID NO: 795122 - DNA, 23 bp, Homo sapiens
tttgtggactgtgggtctggact

SEQ ID NO: 795123 - DNA, 16 bp, Homo sapiens
tttgtggaggtgagaa

SEQ ID NO: 795124 - DNA, 18 bp, Homo sapiens
tttgtggccaaggagctg

SEQ ID NO: 795125 - DNA, 14 bp, Homo sapiens
tttgtggcctcaga

SEQ ID NO: 795126 - DNA, 23 bp, Homo sapiens
tttgtgggaggagtgacatgaag

SEQ ID NO: 795127 - DNA, 21 bp, Homo sapiens
tttgtggtgggcgctggggaa

SEQ ID NO: 795128 - DNA, 13 bp, Homo sapiens
tttgtggtgtctt

SEQ ID NO: 795129 - DNA, 14 bp, Homo sapiens
tttgtggtgtcttc

SEQ ID NO: 795130 - DNA, 19 bp, Homo sapiens
tttgtggttatcactttaa

SEQ ID NO: 795131 - DNA, 15 bp, Homo sapiens
tttgtggtttggaat

SEQ ID NO: 795132 - DNA, 19 bp, Homo sapiens
tttgtgtaatagaaaactg

SEQ ID NO: 795133 - DNA, 16 bp, Homo sapiens
tttgtgtaatgaaaat

SEQ ID NO: 795134 - DNA, 20 bp, Homo sapiens
tttgtgtatattggtgtata

SEQ ID NO: 795135 - DNA, 13 bp, Homo sapiens
tttgtgtatgtac

SEQ ID NO: 795136 - DNA, 12 bp, Homo sapiens
tttgtgtcctcc

SEQ ID NO: 795137 - DNA, 16 bp, Homo sapiens
tttgtgtcctccagga

SEQ ID NO: 795138 - DNA, 18 bp, Homo sapiens
tttgtgtcctccaggagc

SEQ ID NO: 795139 - DNA, 17 bp, Homo sapiens
tttgtgtctttgtctgg

SEQ ID NO: 795140 - DNA, 14 bp, Homo sapiens
tttgtgtggctcct

SEQ ID NO: 795141 - DNA, 13 bp, Homo sapiens
tttgtgtgtatat

SEQ ID NO: 795142 - DNA, 14 bp, Homo sapiens
tttgtgtgtatata

SEQ ID NO: 795143 - DNA, 15 bp, Homo sapiens
tttgtgtgtatatat

SEQ ID NO: 795144 - DNA, 16 bp, Homo sapiens
tttgtgtgtatttgct

SEQ ID NO: 795145 - DNA, 13 bp, Homo sapiens
tttgtgtgtctta

SEQ ID NO: 795146 - DNA, 19 bp, Homo sapiens
tttgtgtgttgtcttgaaa

SEQ ID NO: 795147 - DNA, 16 bp, Homo sapiens
tttgtgttattcgtga

SEQ ID NO: 795148 - DNA, 16 bp, Homo sapiens
tttgtgtttacttttt

SEQ ID NO: 795149 - DNA, 12 bp, Homo sapiens
tttgtgtttcta

SEQ ID NO: 795150 - DNA, 23 bp, Homo sapiens
tttgtgttttaaaaaaactgaag

SEQ ID NO: 795151 - DNA, 19 bp, Homo sapiens
tttgtgttttcttgtaaat

SEQ ID NO: 795152 - DNA, 16 bp, Homo sapiens
tttgtgtttttctata

SEQ ID NO: 795153 - DNA, 22 bp, Homo sapiens
tttgttaaagctggaacatttg

SEQ ID NO: 795154 - DNA, 18 bp, Homo sapiens
tttgttaacagtatttct

SEQ ID NO: 795155 - DNA, 21 bp, Homo sapiens
tttgttaatttagaaaacttt

SEQ ID NO: 795156 - DNA, 21 bp, Homo sapiens
tttgttaccatactgtctctg

SEQ ID NO: 795157 - DNA, 23 bp, Homo sapiens
tttgttaccatactgtctctgga

SEQ ID NO: 795158 - DNA, 14 bp, Homo sapiens
tttgttactatgta

SEQ ID NO: 795159 - DNA, 14 bp, Homo sapiens
tttgttactgtatt

SEQ ID NO: 795160 - DNA, 15 bp, Homo sapiens
tttgttagatagctg

SEQ ID NO: 795161 - DNA, 15 bp, Homo sapiens
tttgttagcaaagat

SEQ ID NO: 795162 - DNA, 17 bp, Homo sapiens
tttgttaggattttcac

SEQ ID NO: 795163 - DNA, 18 bp, Homo sapiens
tttgttatataatttaga

SEQ ID NO: 795164 - DNA, 15 bp, Homo sapiens
tttgttatttacact

SEQ ID NO: 795165 - DNA, 18 bp, Homo sapiens
tttgttatttacactggt

SEQ ID NO: 795166 - DNA, 20 bp, Homo sapiens
tttgttattttcagtatttt

SEQ ID NO: 795167 - DNA, 17 bp, Homo sapiens
tttgttcaagttttggg

SEQ ID NO: 795168 - DNA, 17 bp, Homo sapiens
tttgttcactgaaggtg

SEQ ID NO: 795169 - DNA, 19 bp, Homo sapiens
tttgttcataataaaagtg

SEQ ID NO: 795170 - DNA, 13 bp, Homo sapiens
tttgttcatctgt

SEQ ID NO: 795171 - DNA, 12 bp, Homo sapiens
tttgttcctgga

SEQ ID NO: 795172 - DNA, 12 bp, Homo sapiens
tttgttctgttt

SEQ ID NO: 795173 - DNA, 13 bp, Homo sapiens
tttgttctgtttt

SEQ ID NO: 795174 - DNA, 22 bp, Homo sapiens
tttgttgaaaatggtttcaagt

SEQ ID NO: 795175 - DNA, 15 bp, Homo sapiens
tttgttgaaattatg

SEQ ID NO: 795176 - DNA, 19 bp, Homo sapiens
tttgttgacaaaattttct

SEQ ID NO: 795177 - DNA, 20 bp, Homo sapiens
tttgttgacagcaaaatgtt

SEQ ID NO: 795178 - DNA, 17 bp, Homo sapiens
tttgttgaccattttgt

SEQ ID NO: 795179 - DNA, 20 bp, Homo sapiens
tttgttgaccattttgttaa

SEQ ID NO: 795180 - DNA, 16 bp, Homo sapiens
tttgttgcaagatgtg

SEQ ID NO: 795181 - DNA, 15 bp, Homo sapiens
tttgttgcccaggct

SEQ ID NO: 795182 - DNA, 14 bp, Homo sapiens
tttgttgctgtttt

SEQ ID NO: 795183 - DNA, 16 bp, Homo sapiens
tttgttggcccttcca

SEQ ID NO: 795184 - DNA, 22 bp, Homo sapiens
tttgttggcccttccagtggga

SEQ ID NO: 795185 - DNA, 15 bp, Homo sapiens
tttgttgtagatgct

SEQ ID NO: 795186 - DNA, 22 bp, Homo sapiens
tttgttgtccttgccccactcc

SEQ ID NO: 795187 - DNA, 13 bp, Homo sapiens
tttgttgtgttct

SEQ ID NO: 795188 - DNA, 14 bp, Homo sapiens
tttgtttaaaaagt

SEQ ID NO: 795189 - DNA, 13 bp, Homo sapiens
tttgtttaaagaa

SEQ ID NO: 795190 - DNA, 16 bp, Homo sapiens
tttgtttaaagaataa

SEQ ID NO: 795191 - DNA, 21 bp, Homo sapiens
tttgtttaatttttatttctt

SEQ ID NO: 795192 - DNA, 13 bp, Homo sapiens
tttgtttcagtgc

SEQ ID NO: 795193 - DNA, 19 bp, Homo sapiens
tttgtttcccccacagttt

SEQ ID NO: 795194 - DNA, 12 bp, Homo sapiens
tttgtttcctct

SEQ ID NO: 795195 - DNA, 17 bp, Homo sapiens
tttgtttcctctgttca

SEQ ID NO: 795196 - DNA, 15 bp, Homo sapiens
tttgtttcctttgtt

SEQ ID NO: 795197 - DNA, 13 bp, Homo sapiens
tttgtttcttctt

SEQ ID NO: 795198 - DNA, 17 bp, Homo sapiens
tttgtttctttctctga

SEQ ID NO: 795199 - DNA, 12 bp, Homo sapiens
tttgtttgaact

SEQ ID NO: 795200 - DNA, 13 bp, Homo sapiens
tttgtttgaactg

SEQ ID NO: 795201 - DNA, 18 bp, Homo sapiens
tttgtttgaactgataaa

SEQ ID NO: 795202 - DNA, 14 bp, Homo sapiens
tttgtttgcttaat

SEQ ID NO: 795203 - DNA, 20 bp, Homo sapiens
tttgtttgcttaatttcctt

SEQ ID NO: 795204 - DNA, 18 bp, Homo sapiens
tttgtttgtaagtttgaa

SEQ ID NO: 795205 - DNA, 12 bp, Homo sapiens
tttgtttgtatt

SEQ ID NO: 795206 - DNA, 15 bp, Homo sapiens
tttgttttaaaatta

SEQ ID NO: 795207 - DNA, 18 bp, Homo sapiens
tttgttttacaatgtcat

SEQ ID NO: 795208 - DNA, 14 bp, Homo sapiens
tttgttttcatggt

SEQ ID NO: 795209 - DNA, 16 bp, Homo sapiens
tttgtttttaaactgt

SEQ ID NO: 795210 - DNA, 13 bp, Homo sapiens
tttgtttttaatt

SEQ ID NO: 795211 - DNA, 21 bp, Homo sapiens
tttgtttttcaagaaatgatt

SEQ ID NO: 795212 - DNA, 16 bp, Homo sapiens
tttgtttttgcttgtt

SEQ ID NO: 795213 - DNA, 13 bp, Homo sapiens
tttgttttttggt

SEQ ID NO: 795214 - DNA, 15 bp, Homo sapiens
tttgttttttggtga

SEQ ID NO: 795215 - DNA, 13 bp, Homo sapiens
tttgttttttgta

SEQ ID NO: 795216 - DNA, 19 bp, Homo sapiens
ttttaaaaaaaatttgtgt

SEQ ID NO: 795217 - DNA, 21 bp, Homo sapiens
ttttaaaaaaaatttgtgtgc

SEQ ID NO: 795218 - DNA, 15 bp, Homo sapiens
ttttaaaaaaactga

SEQ ID NO: 795219 - DNA, 16 bp, Homo sapiens
ttttaaaaaaactgaa

SEQ ID NO: 795220 - DNA, 23 bp, Homo sapiens
ttttaaaaaagcaacagaaacct

SEQ ID NO: 795221 - DNA, 15 bp, Homo sapiens
ttttaaaaaagctta

SEQ ID NO: 795222 - DNA, 20 bp, Homo sapiens
ttttaaaaaagcttaaaact

SEQ ID NO: 795223 - DNA, 22 bp, Homo sapiens
ttttaaaaaataccattgaaat

SEQ ID NO: 795224 - DNA, 21 bp, Homo sapiens
ttttaaaaaatattttaagaa

SEQ ID NO: 795225 - DNA, 20 bp, Homo sapiens
ttttaaaaaatcaatcaatg

SEQ ID NO: 795226 - DNA, 19 bp, Homo sapiens
ttttaaaaacatagaaaaa

SEQ ID NO: 795227 - DNA, 13 bp, Homo sapiens
ttttaaaaaccta

SEQ ID NO: 795228 - DNA, 19 bp, Homo sapiens
ttttaaaaactcttcagtg

SEQ ID NO: 795229 - DNA, 14 bp, Homo sapiens
ttttaaaaagcaaa

SEQ ID NO: 795230 - DNA, 17 bp, Homo sapiens
ttttaaaaagcaaatct

SEQ ID NO: 795231 - DNA, 18 bp, Homo sapiens
ttttaaaaaggtaaatgg

SEQ ID NO: 795232 - DNA, 23 bp, Homo sapiens
ttttaaaaatgtcctgcctttta

SEQ ID NO: 795233 - DNA, 19 bp, Homo sapiens
ttttaaaaattgttattta

SEQ ID NO: 795234 - DNA, 15 bp, Homo sapiens
ttttaaaacactaaa

SEQ ID NO: 795235 - DNA, 13 bp, Homo sapiens
ttttaaaacccag

SEQ ID NO: 795236 - DNA, 13 bp, Homo sapiens
ttttaaaagaaca

SEQ ID NO: 795237 - DNA, 14 bp, Homo sapiens
ttttaaaagacaag

SEQ ID NO: 795238 - DNA, 19 bp, Homo sapiens
ttttaaaagccacaggtgt

SEQ ID NO: 795239 - DNA, 21 bp, Homo sapiens
ttttaaaaggatgtataaatt

SEQ ID NO: 795240 - DNA, 22 bp, Homo sapiens
ttttaaaaggtagagtcttaca

SEQ ID NO: 795241 - DNA, 24 bp, Homo sapiens
ttttaaaaggtagagtcttacaat

SEQ ID NO: 795242 - DNA, 21 bp, Homo sapiens
ttttaaaaggtattttgaata

SEQ ID NO: 795243 - DNA, 21 bp, Homo sapiens
ttttaaaataagttaaaggca

SEQ ID NO: 795244 - DNA, 23 bp, Homo sapiens
ttttaaaatagaaattttgtaag

SEQ ID NO: 795245 - DNA, 16 bp, Homo sapiens
ttttaaaatagaatga

SEQ ID NO: 795246 - DNA, 21 bp, Homo sapiens
ttttaaaatagcgttcttgta

SEQ ID NO: 795247 - DNA, 17 bp, Homo sapiens
ttttaaaatatatgtat

SEQ ID NO: 795248 - DNA, 21 bp, Homo sapiens
ttttaaaatatttaacttttt

SEQ ID NO: 795249 - DNA, 12 bp, Homo sapiens
ttttaaaatgag

SEQ ID NO: 795250 - DNA, 16 bp, Homo sapiens
ttttaaaatgcaatgt

SEQ ID NO: 795251 - DNA, 15 bp, Homo sapiens
ttttaaaatttcata

SEQ ID NO: 795252 - DNA, 20 bp, Homo sapiens
ttttaaacaaaatttcacag

SEQ ID NO: 795253 - DNA, 23 bp, Homo sapiens
ttttaaacaaaatttcacagttc

SEQ ID NO: 795254 - DNA, 11 bp, Homo sapiens
ttttaaacata

SEQ ID NO: 795255 - DNA, 17 bp, Homo sapiens
ttttaaacataaagaat

SEQ ID NO: 795256 - DNA, 14 bp, Homo sapiens
ttttaaaccaaaac

SEQ ID NO: 795257 - DNA, 13 bp, Homo sapiens
ttttaaactgtac

SEQ ID NO: 795258 - DNA, 17 bp, Homo sapiens
ttttaaactgtacagtg

SEQ ID NO: 795259 - DNA, 15 bp, Homo sapiens
ttttaaacttgaaat

SEQ ID NO: 795260 - DNA, 13 bp, Homo sapiens
ttttaaagaattg

SEQ ID NO: 795261 - DNA, 13 bp, Homo sapiens
ttttaaagacatg

SEQ ID NO: 795262 - DNA, 21 bp, Homo sapiens
ttttaaagacccaacttgcca

SEQ ID NO: 795263 - DNA, 20 bp, Homo sapiens
ttttaaagatctgtaagtaa

SEQ ID NO: 795264 - DNA, 22 bp, Homo sapiens
ttttaaagtatgttattgcata

SEQ ID NO: 795265 - DNA, 13 bp, Homo sapiens
ttttaaagtattt

SEQ ID NO: 795266 - DNA, 20 bp, Homo sapiens
ttttaaagtatttataaaaa

SEQ ID NO: 795267 - DNA, 19 bp, Homo sapiens
ttttaaagtgattaaacgt

SEQ ID NO: 795268 - DNA, 12 bp, Homo sapiens
ttttaaagttca

SEQ ID NO: 795269 - DNA, 14 bp, Homo sapiens
ttttaaagtttgtt

SEQ ID NO: 795270 - DNA, 20 bp, Homo sapiens
ttttaaagtttgttcactta

SEQ ID NO: 795271 - DNA, 16 bp, Homo sapiens
ttttaaataaaagcac

SEQ ID NO: 795272 - DNA, 17 bp, Homo sapiens
ttttaaataaaagcaca

SEQ ID NO: 795273 - DNA, 17 bp, Homo sapiens
ttttaaataaaagtgat

SEQ ID NO: 795274 - DNA, 13 bp, Homo sapiens
ttttaaatcaagg

SEQ ID NO: 795275 - DNA, 14 bp, Homo sapiens
ttttaaatcaagga

SEQ ID NO: 795276 - DNA, 14 bp, Homo sapiens
ttttaaatctaaat

SEQ ID NO: 795277 - DNA, 18 bp, Homo sapiens
ttttaaatctaaatctat

SEQ ID NO: 795278 - DNA, 21 bp, Homo sapiens
ttttaaatctaaatctattta

SEQ ID NO: 795279 - DNA, 18 bp, Homo sapiens
ttttaaatgatcatgaaa

SEQ ID NO: 795280 - DNA, 19 bp, Homo sapiens
ttttaaatgcataaatgca

SEQ ID NO: 795281 - DNA, 15 bp, Homo sapiens
ttttaaatgtacaga

SEQ ID NO: 795282 - DNA, 22 bp, Homo sapiens
ttttaaatgtacagacatattt

SEQ ID NO: 795283 - DNA, 12 bp, Homo sapiens
ttttaaatgtat

SEQ ID NO: 795284 - DNA, 16 bp, Homo sapiens
ttttaaatgtatacta

SEQ ID NO: 795285 - DNA, 13 bp, Homo sapiens
ttttaaatgtgaa

SEQ ID NO: 795286 - DNA, 22 bp, Homo sapiens
ttttaaattaagtcattttgta

SEQ ID NO: 795287 - DNA, 17 bp, Homo sapiens
ttttaaattaatatctt

SEQ ID NO: 795288 - DNA, 18 bp, Homo sapiens
ttttaaattagaaaatat

SEQ ID NO: 795289 - DNA, 21 bp, Homo sapiens
ttttaaattataacttaaaat

SEQ ID NO: 795290 - DNA, 13 bp, Homo sapiens
ttttaaattccac

SEQ ID NO: 795291 - DNA, 20 bp, Homo sapiens
ttttaaattcccgttttgtc

SEQ ID NO: 795292 - DNA, 13 bp, Homo sapiens
ttttaaatttcag

SEQ ID NO: 795293 - DNA, 15 bp, Homo sapiens
ttttaaattttgtaa

SEQ ID NO: 795294 - DNA, 16 bp, Homo sapiens
ttttaaattttgtaat

SEQ ID NO: 795295 - DNA, 21 bp, Homo sapiens
ttttaacaaaaaacagattct

SEQ ID NO: 795296 - DNA, 16 bp, Homo sapiens
ttttaacaaaagcaag

SEQ ID NO: 795297 - DNA, 22 bp, Homo sapiens
ttttaacaataactactgtgtt

SEQ ID NO: 795298 - DNA, 14 bp, Homo sapiens
ttttaacactttgt

SEQ ID NO: 795299 - DNA, 18 bp, Homo sapiens
ttttaacactttgtatta

SEQ ID NO: 795300 - DNA, 21 bp, Homo sapiens
ttttaacagcatgctgctttg

SEQ ID NO: 795301 - DNA, 12 bp, Homo sapiens
ttttaacatctt

SEQ ID NO: 795302 - DNA, 18 bp, Homo sapiens
ttttaacatctttgtttt

SEQ ID NO: 795303 - DNA, 21 bp, Homo sapiens
ttttaaccaaggaggggccag

SEQ ID NO: 795304 - DNA, 14 bp, Homo sapiens
ttttaacctgtttt

SEQ ID NO: 795305 - DNA, 20 bp, Homo sapiens
ttttaacgtggcttgtagaa

SEQ ID NO: 795306 - DNA, 12 bp, Homo sapiens
ttttaactagaa

SEQ ID NO: 795307 - DNA, 12 bp, Homo sapiens
ttttaactcacc

SEQ ID NO: 795308 - DNA, 17 bp, Homo sapiens
ttttaactgaaaatgta

SEQ ID NO: 795309 - DNA, 20 bp, Homo sapiens
ttttaactgaaaatgtaaat

SEQ ID NO: 795310 - DNA, 21 bp, Homo sapiens
ttttaactgaaaatgtaaatt

SEQ ID NO: 795311 - DNA, 20 bp, Homo sapiens
ttttaactgatttaacactt

SEQ ID NO: 795312 - DNA, 16 bp, Homo sapiens
ttttaactgcactcat

SEQ ID NO: 795313 - DNA, 19 bp, Homo sapiens
ttttaactttaagtttcag

SEQ ID NO: 795314 - DNA, 14 bp, Homo sapiens
ttttaactttgaaa

SEQ ID NO: 795315 - DNA, 15 bp, Homo sapiens
ttttaagaaaaacaa

SEQ ID NO: 795316 - DNA, 13 bp, Homo sapiens
ttttaagaaagag

SEQ ID NO: 795317 - DNA, 12 bp, Homo sapiens
ttttaagaagac

SEQ ID NO: 795318 - DNA, 16 bp, Homo sapiens
ttttaagaatatctgt

SEQ ID NO: 795319 - DNA, 19 bp, Homo sapiens
ttttaagagaaaactgcag

SEQ ID NO: 795320 - DNA, 13 bp, Homo sapiens
ttttaagatagtg

SEQ ID NO: 795321 - DNA, 16 bp, Homo sapiens
ttttaagatagtgtaa

SEQ ID NO: 795322 - DNA, 23 bp, Homo sapiens
ttttaagatagtgtaacttgctt

SEQ ID NO: 795323 - DNA, 15 bp, Homo sapiens
ttttaagatttgtgt

SEQ ID NO: 795324 - DNA, 18 bp, Homo sapiens
ttttaagcatttgtatat

SEQ ID NO: 795325 - DNA, 19 bp, Homo sapiens
ttttaagctccatgtgcat

SEQ ID NO: 795326 - DNA, 22 bp, Homo sapiens
ttttaagctccatgtgcatata

SEQ ID NO: 795327 - DNA, 17 bp, Homo sapiens
ttttaaggtctttcagt

SEQ ID NO: 795328 - DNA, 21 bp, Homo sapiens
ttttaaggtctttcagtactt

SEQ ID NO: 795329 - DNA, 18 bp, Homo sapiens
ttttaagtatttatatat

SEQ ID NO: 795330 - DNA, 22 bp, Homo sapiens
ttttaagtgacataattgtcca

SEQ ID NO: 795331 - DNA, 23 bp, Homo sapiens
ttttaagtgacataattgtccag

SEQ ID NO: 795332 - DNA, 16 bp, Homo sapiens
ttttaagtgcaacatt

SEQ ID NO: 795333 - DNA, 15 bp, Homo sapiens
ttttaagtgctgcat

SEQ ID NO: 795334 - DNA, 17 bp, Homo sapiens
ttttaagtgctgcattt

SEQ ID NO: 795335 - DNA, 14 bp, Homo sapiens
ttttaagttgctga

SEQ ID NO: 795336 - DNA, 13 bp, Homo sapiens
ttttaataaacta

SEQ ID NO: 795337 - DNA, 14 bp, Homo sapiens
ttttaataaattga

SEQ ID NO: 795338 - DNA, 18 bp, Homo sapiens
ttttaataagaacagatc

SEQ ID NO: 795339 - DNA, 12 bp, Homo sapiens
ttttaatacagg

SEQ ID NO: 795340 - DNA, 22 bp, Homo sapiens
ttttaatacattgatcaggcca

SEQ ID NO: 795341 - DNA, 15 bp, Homo sapiens
ttttaatagaatttt

SEQ ID NO: 795342 - DNA, 21 bp, Homo sapiens
ttttaatagtcattccaaata

SEQ ID NO: 795343 - DNA, 22 bp, Homo sapiens
ttttaatatgcttaaaataagc

SEQ ID NO: 795344 - DNA, 19 bp, Homo sapiens
ttttaatattactgtcttt

SEQ ID NO: 795345 - DNA, 20 bp, Homo sapiens
ttttaatattcttttgtttc

SEQ ID NO: 795346 - DNA, 21 bp, Homo sapiens
ttttaatattcttttgtttcc

SEQ ID NO: 795347 - DNA, 15 bp, Homo sapiens
ttttaatattttgta

SEQ ID NO: 795348 - DNA, 21 bp, Homo sapiens
ttttaatctctaacagtggac

SEQ ID NO: 795349 - DNA, 16 bp, Homo sapiens
ttttaatctttgtgac

SEQ ID NO: 795350 - DNA, 22 bp, Homo sapiens
ttttaatgatggtgttaaagct

SEQ ID NO: 795351 - DNA, 20 bp, Homo sapiens
ttttaatgtcatttgttaaa

SEQ ID NO: 795352 - DNA, 22 bp, Homo sapiens
ttttaatgtctgtttattaact

SEQ ID NO: 795353 - DNA, 13 bp, Homo sapiens
ttttaatgtgaag

SEQ ID NO: 795354 - DNA, 19 bp, Homo sapiens
ttttaatgtgaagacattt

SEQ ID NO: 795355 - DNA, 21 bp, Homo sapiens
ttttaattactgctataaata

SEQ ID NO: 795356 - DNA, 16 bp, Homo sapiens
ttttaattcagtacaa

SEQ ID NO: 795357 - DNA, 14 bp, Homo sapiens
ttttaattctctgt

SEQ ID NO: 795358 - DNA, 12 bp, Homo sapiens
ttttaattgtag

SEQ ID NO: 795359 - DNA, 14 bp, Homo sapiens
ttttaattgtttaa

SEQ ID NO: 795360 - DNA, 17 bp, Homo sapiens
ttttaatttaaagctta

SEQ ID NO: 795361 - DNA, 17 bp, Homo sapiens
ttttaatttacaaaaat

SEQ ID NO: 795362 - DNA, 14 bp, Homo sapiens
ttttaatttagtaa

SEQ ID NO: 795363 - DNA, 20 bp, Homo sapiens
ttttaatttagtaaatgtta

SEQ ID NO: 795364 - DNA, 13 bp, Homo sapiens
ttttaatttcagg

SEQ ID NO: 795365 - DNA, 15 bp, Homo sapiens
ttttaatttcaggaa

SEQ ID NO: 795366 - DNA, 12 bp, Homo sapiens
ttttaatttcta

SEQ ID NO: 795367 - DNA, 19 bp, Homo sapiens
ttttaatttgatgaaagct

SEQ ID NO: 795368 - DNA, 14 bp, Homo sapiens
ttttaatttgtttt

SEQ ID NO: 795369 - DNA, 12 bp, Homo sapiens
ttttaattttta

SEQ ID NO: 795370 - DNA, 19 bp, Homo sapiens
ttttacaaaactgctttgt

SEQ ID NO: 795371 - DNA, 12 bp, Homo sapiens
ttttacaagtaa

SEQ ID NO: 795372 - DNA, 17 bp, Homo sapiens
ttttacaataaaatctt

SEQ ID NO: 795373 - DNA, 18 bp, Homo sapiens
ttttacaataaataatct

SEQ ID NO: 795374 - DNA, 14 bp, Homo sapiens
ttttacacagcacc

SEQ ID NO: 795375 - DNA, 20 bp, Homo sapiens
ttttacacatgtgctgatgt

SEQ ID NO: 795376 - DNA, 19 bp, Homo sapiens
ttttacacattagatttta

SEQ ID NO: 795377 - DNA, 17 bp, Homo sapiens
ttttacacgagatttct

SEQ ID NO: 795378 - DNA, 18 bp, Homo sapiens
ttttacacgagatttctt

SEQ ID NO: 795379 - DNA, 16 bp, Homo sapiens
ttttacagctgcctgc

SEQ ID NO: 795380 - DNA, 22 bp, Homo sapiens
ttttacagttagggttttgcaa

SEQ ID NO: 795381 - DNA, 21 bp, Homo sapiens
ttttacatgaagctgtataat

SEQ ID NO: 795382 - DNA, 13 bp, Homo sapiens
ttttacattaaat

SEQ ID NO: 795383 - DNA, 15 bp, Homo sapiens
ttttacattatgcaa

SEQ ID NO: 795384 - DNA, 17 bp, Homo sapiens
ttttacattctgtgtgt

SEQ ID NO: 795385 - DNA, 16 bp, Homo sapiens
ttttacatttgttgta

SEQ ID NO: 795386 - DNA, 17 bp, Homo sapiens
ttttaccaagagtaact

SEQ ID NO: 795387 - DNA, 19 bp, Homo sapiens
ttttaccagctcccagggt

SEQ ID NO: 795388 - DNA, 15 bp, Homo sapiens
ttttaccctgtgtca

SEQ ID NO: 795389 - DNA, 17 bp, Homo sapiens
ttttaccgtttcttccc

SEQ ID NO: 795390 - DNA, 18 bp, Homo sapiens
ttttacctaccacagtgt

SEQ ID NO: 795391 - DNA, 14 bp, Homo sapiens
ttttacctttcata

SEQ ID NO: 795392 - DNA, 16 bp, Homo sapiens
ttttacgtgcaaacaa

SEQ ID NO: 795393 - DNA, 19 bp, Homo sapiens
ttttactaagttttcaaat

SEQ ID NO: 795394 - DNA, 22 bp, Homo sapiens
ttttactccaggttattgcaat

SEQ ID NO: 795395 - DNA, 23 bp, Homo sapiens
ttttactccaggttattgcaata

SEQ ID NO: 795396 - DNA, 13 bp, Homo sapiens
ttttactctgcct

SEQ ID NO: 795397 - DNA, 15 bp, Homo sapiens
ttttactctgtgtaa

SEQ ID NO: 795398 - DNA, 23 bp, Homo sapiens
ttttactctgtgtaaagacttga

SEQ ID NO: 795399 - DNA, 11 bp, Homo sapiens
ttttactgaac

SEQ ID NO: 795400 - DNA, 13 bp, Homo sapiens
ttttactgaacaa

SEQ ID NO: 795401 - DNA, 18 bp, Homo sapiens
ttttactggttgcatgga

SEQ ID NO: 795402 - DNA, 22 bp, Homo sapiens
ttttactttggtttagtctttt

SEQ ID NO: 795403 - DNA, 20 bp, Homo sapiens
ttttacttttaaactgtgta

SEQ ID NO: 795404 - DNA, 21 bp, Homo sapiens
ttttacttttcacactgtctt

SEQ ID NO: 795405 - DNA, 12 bp, Homo sapiens
ttttacttttgt

SEQ ID NO: 795406 - DNA, 15 bp, Homo sapiens
ttttacttttttaac

SEQ ID NO: 795407 - DNA, 16 bp, Homo sapiens
ttttactttttttagt

SEQ ID NO: 795408 - DNA, 14 bp, Homo sapiens
ttttagaaaacagc

SEQ ID NO: 795409 - DNA, 13 bp, Homo sapiens
ttttagaataaga

SEQ ID NO: 795410 - DNA, 21 bp, Homo sapiens
ttttagaccctattgctgctt

SEQ ID NO: 795411 - DNA, 19 bp, Homo sapiens
ttttagacttaccttgaac

SEQ ID NO: 795412 - DNA, 17 bp, Homo sapiens
ttttagagcttccaaat

SEQ ID NO: 795413 - DNA, 18 bp, Homo sapiens
ttttagagcttccaaatg

SEQ ID NO: 795414 - DNA, 18 bp, Homo sapiens
ttttagatactttgctag

SEQ ID NO: 795415 - DNA, 16 bp, Homo sapiens
ttttagatcaaatact

SEQ ID NO: 795416 - DNA, 19 bp, Homo sapiens
ttttagccataattttgca

SEQ ID NO: 795417 - DNA, 20 bp, Homo sapiens
ttttagcccagtgttttctt

SEQ ID NO: 795418 - DNA, 20 bp, Homo sapiens
ttttaggaaaatcactttgt

SEQ ID NO: 795419 - DNA, 15 bp, Homo sapiens
ttttaggacatctta

SEQ ID NO: 795420 - DNA, 15 bp, Homo sapiens
ttttaggcactctta

SEQ ID NO: 795421 - DNA, 22 bp, Homo sapiens
ttttagggtaagaagtttgtgt

SEQ ID NO: 795422 - DNA, 22 bp, Homo sapiens
ttttagtagagacggggtttca

SEQ ID NO: 795423 - DNA, 19 bp, Homo sapiens
ttttagtcactaagacttt

SEQ ID NO: 795424 - DNA, 13 bp, Homo sapiens
ttttagtgtatta

SEQ ID NO: 795425 - DNA, 13 bp, Homo sapiens
ttttagttcatat

SEQ ID NO: 795426 - DNA, 18 bp, Homo sapiens
ttttagtttttcattaaa

SEQ ID NO: 795427 - DNA, 13 bp, Homo sapiens
ttttataaatact

SEQ ID NO: 795428 - DNA, 16 bp, Homo sapiens
ttttataaattaaata

SEQ ID NO: 795429 - DNA, 22 bp, Homo sapiens
ttttataacatgttaaaatgta

SEQ ID NO: 795430 - DNA, 17 bp, Homo sapiens
ttttataaccttgttct

SEQ ID NO: 795431 - DNA, 18 bp, Homo sapiens
ttttataagcaaaaacgt

SEQ ID NO: 795432 - DNA, 18 bp, Homo sapiens
ttttataatgttattcat

SEQ ID NO: 795433 - DNA, 16 bp, Homo sapiens
ttttataattaaagat

SEQ ID NO: 795434 - DNA, 14 bp, Homo sapiens
ttttatacaaacct

SEQ ID NO: 795435 - DNA, 13 bp, Homo sapiens
ttttatacaattt

SEQ ID NO: 795436 - DNA, 19 bp, Homo sapiens
ttttatactgcacagtggc

SEQ ID NO: 795437 - DNA, 19 bp, Homo sapiens
ttttatagcttaactaatt

SEQ ID NO: 795438 - DNA, 13 bp, Homo sapiens
ttttatagtgtgt

SEQ ID NO: 795439 - DNA, 14 bp, Homo sapiens
ttttatatcataca

SEQ ID NO: 795440 - DNA, 22 bp, Homo sapiens
ttttatatgaagataagtgtat

SEQ ID NO: 795441 - DNA, 16 bp, Homo sapiens
ttttatatgtaaatgt

SEQ ID NO: 795442 - DNA, 14 bp, Homo sapiens
ttttatatgtcaaa

SEQ ID NO: 795443 - DNA, 14 bp, Homo sapiens
ttttatatgttcat

SEQ ID NO: 795444 - DNA, 16 bp, Homo sapiens
ttttatatgttgctat

SEQ ID NO: 795445 - DNA, 14 bp, Homo sapiens
ttttatattaaagt

SEQ ID NO: 795446 - DNA, 20 bp, Homo sapiens
ttttatattacttttgtaaa

SEQ ID NO: 795447 - DNA, 13 bp, Homo sapiens
ttttatatttaaa

SEQ ID NO: 795448 - DNA, 14 bp, Homo sapiens
ttttatatttaaaa

SEQ ID NO: 795449 - DNA, 13 bp, Homo sapiens
ttttatatttagt

SEQ ID NO: 795450 - DNA, 23 bp, Homo sapiens
ttttatatttagttatagtttca

SEQ ID NO: 795451 - DNA, 20 bp, Homo sapiens
ttttatatttattgttagaa

SEQ ID NO: 795452 - DNA, 23 bp, Homo sapiens
ttttatatttcctttatgtgaat

SEQ ID NO: 795453 - DNA, 12 bp, Homo sapiens
ttttatcagtag

SEQ ID NO: 795454 - DNA, 13 bp, Homo sapiens
ttttatcatgaat

SEQ ID NO: 795455 - DNA, 15 bp, Homo sapiens
ttttatcccaaagtt

SEQ ID NO: 795456 - DNA, 13 bp, Homo sapiens
ttttatctgcaga

SEQ ID NO: 795457 - DNA, 20 bp, Homo sapiens
ttttatgaagaaaaagtaca

SEQ ID NO: 795458 - DNA, 21 bp, Homo sapiens
ttttatgaagtgcgtgaatgt

SEQ ID NO: 795459 - DNA, 16 bp, Homo sapiens
ttttatgcaaaagtca

SEQ ID NO: 795460 - DNA, 12 bp, Homo sapiens
ttttatgcagac

SEQ ID NO: 795461 - DNA, 22 bp, Homo sapiens
ttttatgcagacagtctgttat

SEQ ID NO: 795462 - DNA, 18 bp, Homo sapiens
ttttatgcgtgtgacagt

SEQ ID NO: 795463 - DNA, 17 bp, Homo sapiens
ttttatggcatgattta

SEQ ID NO: 795464 - DNA, 18 bp, Homo sapiens
ttttatggcttttgtgca

SEQ ID NO: 795465 - DNA, 15 bp, Homo sapiens
ttttatggttatgtt

SEQ ID NO: 795466 - DNA, 13 bp, Homo sapiens
ttttatgtacaac

SEQ ID NO: 795467 - DNA, 19 bp, Homo sapiens
ttttatgtagtaattgaca

SEQ ID NO: 795468 - DNA, 18 bp, Homo sapiens
ttttatgtgagagaaagt

SEQ ID NO: 795469 - DNA, 16 bp, Homo sapiens
ttttatgtgatgccaa

SEQ ID NO: 795470 - DNA, 22 bp, Homo sapiens
ttttatgtgcagcgacccttgg

SEQ ID NO: 795471 - DNA, 14 bp, Homo sapiens
ttttatgtggtctt

SEQ ID NO: 795472 - DNA, 23 bp, Homo sapiens
ttttatgtgtttggatacatctg

SEQ ID NO: 795473 - DNA, 18 bp, Homo sapiens
ttttatgttcttggcttt

SEQ ID NO: 795474 - DNA, 17 bp, Homo sapiens
ttttatgttttctttct

SEQ ID NO: 795475 - DNA, 22 bp, Homo sapiens
ttttattaaaatatttcaggtt

SEQ ID NO: 795476 - DNA, 19 bp, Homo sapiens
ttttattaaacaattttgt

SEQ ID NO: 795477 - DNA, 19 bp, Homo sapiens
ttttattaatgcactttct

SEQ ID NO: 795478 - DNA, 17 bp, Homo sapiens
ttttattacaaatgcaa

SEQ ID NO: 795479 - DNA, 18 bp, Homo sapiens
ttttattacagaaatgtt

SEQ ID NO: 795480 - DNA, 17 bp, Homo sapiens
ttttccattgtttgaaa

SEQ ID NO: 795481 - DNA, 18 bp, Homo sapiens
ttttcccaaagcactttt

SEQ ID NO: 795482 - DNA, 13 bp, Homo sapiens
ttttcccaataaa

SEQ ID NO: 795483 - DNA, 11 bp, Homo sapiens
ttttcccagtg

SEQ ID NO: 795484 - DNA, 16 bp, Homo sapiens
ttttcccataagacaa

SEQ ID NO: 795485 - DNA, 22 bp, Homo sapiens
ttttcccatttatctaaatatg

SEQ ID NO: 795486 - DNA, 21 bp, Homo sapiens
ttttccccacattctatagcc

SEQ ID NO: 795487 - DNA, 17 bp, Homo sapiens
ttttccccctgttttta

SEQ ID NO: 795488 - DNA, 16 bp, Homo sapiens
ttttccccctttgtgc

SEQ ID NO: 795489 - DNA, 23 bp, Homo sapiens
ttttccccggtcccttgagacct

SEQ ID NO: 795490 - DNA, 19 bp, Homo sapiens
ttttcccctacagaatttt

SEQ ID NO: 795491 - DNA, 13 bp, Homo sapiens
ttttccccttcct

SEQ ID NO: 795492 - DNA, 15 bp, Homo sapiens
ttttcccctttctgt

SEQ ID NO: 795493 - DNA, 16 bp, Homo sapiens
ttttcccttaaataca

SEQ ID NO: 795494 - DNA, 22 bp, Homo sapiens
ttttcccttaaatacagataat

SEQ ID NO: 795495 - DNA, 14 bp, Homo sapiens
ttttccctttgcct

SEQ ID NO: 795496 - DNA, 17 bp, Homo sapiens
ttttccctttttatgtg

SEQ ID NO: 795497 - DNA, 18 bp, Homo sapiens
ttttcctaagtgtttact

SEQ ID NO: 795498 - DNA, 20 bp, Homo sapiens
ttttcctaataaagttctgt

SEQ ID NO: 795499 - DNA, 11 bp, Homo sapiens
ttttcctatat

SEQ ID NO: 795500 - DNA, 15 bp, Homo sapiens
ttttcctatgctatt

SEQ ID NO: 795501 - DNA, 13 bp, Homo sapiens
ttttcctatttgt

SEQ ID NO: 795502 - DNA, 18 bp, Homo sapiens
ttttcctcaagcaataat

SEQ ID NO: 795503 - DNA, 12 bp, Homo sapiens
ttttcctcatcc

SEQ ID NO: 795504 - DNA, 23 bp, Homo sapiens
ttttcctcatcctttccctctcc

SEQ ID NO: 795505 - DNA, 21 bp, Homo sapiens
ttttcctcccttctgctactg

SEQ ID NO: 795506 - DNA, 14 bp, Homo sapiens
ttttcctcctctgc

SEQ ID NO: 795507 - DNA, 16 bp, Homo sapiens
ttttcctcttgtgatt

SEQ ID NO: 795508 - DNA, 19 bp, Homo sapiens
ttttcctggacttaaagaa

SEQ ID NO: 795509 - DNA, 19 bp, Homo sapiens
ttttcctgggaatggaata

SEQ ID NO: 795510 - DNA, 23 bp, Homo sapiens
ttttcctgggaatggaataacta

SEQ ID NO: 795511 - DNA, 14 bp, Homo sapiens
ttttcctgttcagt

SEQ ID NO: 795512 - DNA, 19 bp, Homo sapiens
ttttccttcccttttctgt

SEQ ID NO: 795513 - DNA, 12 bp, Homo sapiens
ttttccttctgt

SEQ ID NO: 795514 - DNA, 20 bp, Homo sapiens
ttttccttgctatttcaata

SEQ ID NO: 795515 - DNA, 21 bp, Homo sapiens
ttttccttgctatttcaataa

SEQ ID NO: 795516 - DNA, 19 bp, Homo sapiens
ttttccttgtatgttcttg

SEQ ID NO: 795517 - DNA, 20 bp, Homo sapiens
ttttcctttcttctagtatt

SEQ ID NO: 795518 - DNA, 17 bp, Homo sapiens
ttttccttttcatctgt

SEQ ID NO: 795519 - DNA, 14 bp, Homo sapiens
ttttccttttctta

SEQ ID NO: 795520 - DNA, 23 bp, Homo sapiens
ttttcgaacattctttgcctggt

SEQ ID NO: 795521 - DNA, 16 bp, Homo sapiens
ttttcgttaacattga

SEQ ID NO: 795522 - DNA, 13 bp, Homo sapiens
ttttctaaaagct

SEQ ID NO: 795523 - DNA, 17 bp, Homo sapiens
ttttctaaactcaataa

SEQ ID NO: 795524 - DNA, 14 bp, Homo sapiens
ttttctaaagtgct

SEQ ID NO: 795525 - DNA, 17 bp, Homo sapiens
ttttctaagaaccaaaa

SEQ ID NO: 795526 - DNA, 19 bp, Homo sapiens
ttttctaagacagttttta

SEQ ID NO: 795527 - DNA, 15 bp, Homo sapiens
ttttctaagagaagt

SEQ ID NO: 795528 - DNA, 21 bp, Homo sapiens
ttttctaatgaggagagaaaa

SEQ ID NO: 795529 - DNA, 17 bp, Homo sapiens
ttttctactttttttaa

SEQ ID NO: 795530 - DNA, 13 bp, Homo sapiens
ttttctagagaca

SEQ ID NO: 795531 - DNA, 16 bp, Homo sapiens
ttttctagagacacat

SEQ ID NO: 795532 - DNA, 15 bp, Homo sapiens
ttttctagatacaat

SEQ ID NO: 795533 - DNA, 22 bp, Homo sapiens
ttttctagcaattttctttgtt

SEQ ID NO: 795534 - DNA, 20 bp, Homo sapiens
ttttctagtttcagtaaata

SEQ ID NO: 795535 - DNA, 12 bp, Homo sapiens
ttttctataaat

SEQ ID NO: 795536 - DNA, 15 bp, Homo sapiens
ttttctataatcact

SEQ ID NO: 795537 - DNA, 15 bp, Homo sapiens
ttttctatatagttc

SEQ ID NO: 795538 - DNA, 18 bp, Homo sapiens
ttttctatatagttcctt

SEQ ID NO: 795539 - DNA, 14 bp, Homo sapiens
ttttctatttctct

SEQ ID NO: 795540 - DNA, 15 bp, Homo sapiens
ttttctcaaagggca

SEQ ID NO: 795541 - DNA, 15 bp, Homo sapiens
ttttctcatgtatct

SEQ ID NO: 795542 - DNA, 18 bp, Homo sapiens
ttttctccacccaaaccc

SEQ ID NO: 795543 - DNA, 12 bp, Homo sapiens
ttttctccagct

SEQ ID NO: 795544 - DNA, 11 bp, Homo sapiens
ttttctccctc

SEQ ID NO: 795545 - DNA, 21 bp, Homo sapiens
ttttctccgggtcctcctaag

SEQ ID NO: 795546 - DNA, 21 bp, Homo sapiens
ttttctcctcactgtatccag

SEQ ID NO: 795547 - DNA, 19 bp, Homo sapiens
ttttctcctcccaggaact

SEQ ID NO: 795548 - DNA, 20 bp, Homo sapiens
ttttctctaggaaatatact

SEQ ID NO: 795549 - DNA, 11 bp, Homo sapiens
ttttctctcca

SEQ ID NO: 795550 - DNA, 14 bp, Homo sapiens
ttttctctctggat

SEQ ID NO: 795551 - DNA, 14 bp, Homo sapiens
ttttctctgctctt

SEQ ID NO: 795552 - DNA, 13 bp, Homo sapiens
ttttctctggaaa

SEQ ID NO: 795553 - DNA, 16 bp, Homo sapiens
ttttctctggtaatat

SEQ ID NO: 795554 - DNA, 14 bp, Homo sapiens
ttttctctgtactt

SEQ ID NO: 795555 - DNA, 13 bp, Homo sapiens
ttttctcttctgt

SEQ ID NO: 795556 - DNA, 12 bp, Homo sapiens
ttttctctttct

SEQ ID NO: 795557 - DNA, 15 bp, Homo sapiens
ttttctctttctctc

SEQ ID NO: 795558 - DNA, 22 bp, Homo sapiens
ttttctctttgtttctgtttct

SEQ ID NO: 795559 - DNA, 12 bp, Homo sapiens
ttttctgaaaca

SEQ ID NO: 795560 - DNA, 15 bp, Homo sapiens
ttttctgaaacacac

SEQ ID NO: 795561 - DNA, 13 bp, Homo sapiens
ttttctgaataaa

SEQ ID NO: 795562 - DNA, 14 bp, Homo sapiens
ttttctgaattatg

SEQ ID NO: 795563 - DNA, 23 bp, Homo sapiens
ttttctgacttctagctgtctgt

SEQ ID NO: 795564 - DNA, 20 bp, Homo sapiens
ttttctgagatttttgatat

SEQ ID NO: 795565 - DNA, 22 bp, Homo sapiens
ttttctgagcccgggctgcctg

SEQ ID NO: 795566 - DNA, 15 bp, Homo sapiens
ttttctgagcgatta

SEQ ID NO: 795567 - DNA, 23 bp, Homo sapiens
ttttctgatcgtctcggcccctc

SEQ ID NO: 795568 - DNA, 12 bp, Homo sapiens
ttttctgccctg

SEQ ID NO: 795569 - DNA, 16 bp, Homo sapiens
ttttctgccctggctg

SEQ ID NO: 795570 - DNA, 12 bp, Homo sapiens
ttttctgctgtt

SEQ ID NO: 795571 - DNA, 16 bp, Homo sapiens
ttttctgcttttgaaa

SEQ ID NO: 795572 - DNA, 22 bp, Homo sapiens
ttttctggggaattactttcct

SEQ ID NO: 795573 - DNA, 14 bp, Homo sapiens
ttttctggttccaa

SEQ ID NO: 795574 - DNA, 15 bp, Homo sapiens
ttttctggttccaaa

SEQ ID NO: 795575 - DNA, 20 bp, Homo sapiens
ttttctggttccaaaccagt

SEQ ID NO: 795576 - DNA, 15 bp, Homo sapiens
ttttctgtctctgcc

SEQ ID NO: 795577 - DNA, 17 bp, Homo sapiens
ttttctgtctctgcctc

SEQ ID NO: 795578 - DNA, 18 bp, Homo sapiens
ttttctgtgcctgaatat

SEQ ID NO: 795579 - DNA, 22 bp, Homo sapiens
ttttctgttacctcaacaagaa

SEQ ID NO: 795580 - DNA, 13 bp, Homo sapiens
ttttctgttcttt

SEQ ID NO: 795581 - DNA, 23 bp, Homo sapiens
ttttctgttgaagtttacaatca

SEQ ID NO: 795582 - DNA, 23 bp, Homo sapiens
ttttctgtttcctcaagtctcag

SEQ ID NO: 795583 - DNA, 14 bp, Homo sapiens
ttttctgtttgtaa

SEQ ID NO: 795584 - DNA, 13 bp, Homo sapiens
ttttcttaaagtg

SEQ ID NO: 795585 - DNA, 22 bp, Homo sapiens
ttttcttaagtaatgatactgt

SEQ ID NO: 795586 - DNA, 13 bp, Homo sapiens
ttttcttacataa

SEQ ID NO: 795587 - DNA, 21 bp, Homo sapiens
ttttcttcaacatcaatgttc

SEQ ID NO: 795588 - DNA, 22 bp, Homo sapiens
ttttcttcaacatcaatgttca

SEQ ID NO: 795589 - DNA, 17 bp, Homo sapiens
ttttcttcactcaaatt

SEQ ID NO: 795590 - DNA, 15 bp, Homo sapiens
ttttcttcttccctc

SEQ ID NO: 795591 - DNA, 13 bp, Homo sapiens
ttttcttcttcct

SEQ ID NO: 795592 - DNA, 16 bp, Homo sapiens
ttttcttgatcttaaa

SEQ ID NO: 795593 - DNA, 22 bp, Homo sapiens
ttttcttggttcttttttcagt

SEQ ID NO: 795594 - DNA, 12 bp, Homo sapiens
ttttcttggttt

SEQ ID NO: 795595 - DNA, 13 bp, Homo sapiens
ttttcttgtaatt

SEQ ID NO: 795596 - DNA, 19 bp, Homo sapiens
ttttcttgtatctggattc

SEQ ID NO: 795597 - DNA, 13 bp, Homo sapiens
ttttcttgtctat

SEQ ID NO: 795598 - DNA, 13 bp, Homo sapiens
ttttcttgtttaa

SEQ ID NO: 795599 - DNA, 17 bp, Homo sapiens
ttttcttgtttaacata

SEQ ID NO: 795600 - DNA, 18 bp, Homo sapiens
ttttctttaaagaagttg

SEQ ID NO: 795601 - DNA, 15 bp, Homo sapiens
ttttctttaaagatg

SEQ ID NO: 795602 - DNA, 18 bp, Homo sapiens
ttttctttaactgccgta

SEQ ID NO: 795603 - DNA, 12 bp, Homo sapiens
ttttctttaata

SEQ ID NO: 795604 - DNA, 16 bp, Homo sapiens
ttttctttaatatgat

SEQ ID NO: 795605 - DNA, 20 bp, Homo sapiens
ttttctttatttttgttaat

SEQ ID NO: 795606 - DNA, 15 bp, Homo sapiens
ttttattatcagtta

SEQ ID NO: 795607 - DNA, 18 bp, Homo sapiens
ttttattcagtagtttga

SEQ ID NO: 795608 - DNA, 13 bp, Homo sapiens
ttttattccctgc

SEQ ID NO: 795609 - DNA, 13 bp, Homo sapiens
ttttattgaaatg

SEQ ID NO: 795610 - DNA, 22 bp, Homo sapiens
ttttattgaaatgtataattaa

SEQ ID NO: 795611 - DNA, 19 bp, Homo sapiens
ttttattgaatctatttaa

SEQ ID NO: 795612 - DNA, 16 bp, Homo sapiens
ttttattgacacagaa

SEQ ID NO: 795613 - DNA, 19 bp, Homo sapiens
ttttattgagaattttaaa

SEQ ID NO: 795614 - DNA, 11 bp, Homo sapiens
ttttattgtgt

SEQ ID NO: 795615 - DNA, 13 bp, Homo sapiens
ttttatttacatt

SEQ ID NO: 795616 - DNA, 23 bp, Homo sapiens
ttttatttagggccttttctgtg

SEQ ID NO: 795617 - DNA, 16 bp, Homo sapiens
ttttatttataaacta

SEQ ID NO: 795618 - DNA, 13 bp, Homo sapiens
ttttatttatcaa

SEQ ID NO: 795619 - DNA, 13 bp, Homo sapiens
ttttatttctaag

SEQ ID NO: 795620 - DNA, 12 bp, Homo sapiens
ttttatttctat

SEQ ID NO: 795621 - DNA, 15 bp, Homo sapiens
ttttatttgcatgtg

SEQ ID NO: 795622 - DNA, 12 bp, Homo sapiens
ttttattttcaa

SEQ ID NO: 795623 - DNA, 13 bp, Homo sapiens
ttttattttgctg

SEQ ID NO: 795624 - DNA, 14 bp, Homo sapiens
ttttattttgtttt

SEQ ID NO: 795625 - DNA, 15 bp, Homo sapiens
ttttatttttaagaa

SEQ ID NO: 795626 - DNA, 16 bp, Homo sapiens
ttttatttttaagaaa

SEQ ID NO: 795627 - DNA, 18 bp, Homo sapiens
ttttatttttctaaaaaa

SEQ ID NO: 795628 - DNA, 12 bp, Homo sapiens
ttttatttttgc

SEQ ID NO: 795629 - DNA, 18 bp, Homo sapiens
ttttattttttcttttgt

SEQ ID NO: 795630 - DNA, 17 bp, Homo sapiens
ttttatttttttctacc

SEQ ID NO: 795631 - DNA, 16 bp, Homo sapiens
ttttcaaaagaagaca

SEQ ID NO: 795632 - DNA, 18 bp, Homo sapiens
ttttcaaaagataatatt

SEQ ID NO: 795633 - DNA, 16 bp, Homo sapiens
ttttcaaacaaagatg

SEQ ID NO: 795634 - DNA, 14 bp, Homo sapiens
ttttcaaactgctg

SEQ ID NO: 795635 - DNA, 17 bp, Homo sapiens
ttttcaaataataggta

SEQ ID NO: 795636 - DNA, 15 bp, Homo sapiens
ttttcaaatagattt

SEQ ID NO: 795637 - DNA, 22 bp, Homo sapiens
ttttcaacactgaaaaaatact

SEQ ID NO: 795638 - DNA, 18 bp, Homo sapiens
ttttcaaccataaaagaa

SEQ ID NO: 795639 - DNA, 22 bp, Homo sapiens
ttttcaacgcagccctgctttg

SEQ ID NO: 795640 - DNA, 14 bp, Homo sapiens
ttttcaagaaatga

SEQ ID NO: 795641 - DNA, 14 bp, Homo sapiens
ttttcaagattcta

SEQ ID NO: 795642 - DNA, 17 bp, Homo sapiens
ttttcaaggaagaaaac

SEQ ID NO: 795643 - DNA, 18 bp, Homo sapiens
ttttcaaggaagaaaacg

SEQ ID NO: 795644 - DNA, 19 bp, Homo sapiens
ttttcaaggaagaaaacgg

SEQ ID NO: 795645 - DNA, 12 bp, Homo sapiens
ttttcaaggcat

SEQ ID NO: 795646 - DNA, 21 bp, Homo sapiens
ttttcaaggccttcagtttat

SEQ ID NO: 795647 - DNA, 19 bp, Homo sapiens
ttttcaagtaattttcata

SEQ ID NO: 795648 - DNA, 21 bp, Homo sapiens
ttttcaagtttacacttcata

SEQ ID NO: 795649 - DNA, 20 bp, Homo sapiens
ttttcaataccaattacatg

SEQ ID NO: 795650 - DNA, 18 bp, Homo sapiens
ttttcaatatattgaact

SEQ ID NO: 795651 - DNA, 22 bp, Homo sapiens
ttttcaatatattgaacttttg

SEQ ID NO: 795652 - DNA, 13 bp, Homo sapiens
ttttcaatatgca

SEQ ID NO: 795653 - DNA, 20 bp, Homo sapiens
ttttcaatcaactttactgt

SEQ ID NO: 795654 - DNA, 18 bp, Homo sapiens
ttttcaatgaattttata

SEQ ID NO: 795655 - DNA, 13 bp, Homo sapiens
ttttcaatttgga

SEQ ID NO: 795656 - DNA, 18 bp, Homo sapiens
ttttcaatttgtcatgtt

SEQ ID NO: 795657 - DNA, 19 bp, Homo sapiens
ttttcaatttgtcatgtta

SEQ ID NO: 795658 - DNA, 17 bp, Homo sapiens
ttttcaattttaaacat

SEQ ID NO: 795659 - DNA, 18 bp, Homo sapiens
ttttcacactgtcttccc

SEQ ID NO: 795660 - DNA, 12 bp, Homo sapiens
ttttcacatttt

SEQ ID NO: 795661 - DNA, 13 bp, Homo sapiens
ttttcaccccacc

SEQ ID NO: 795662 - DNA, 23 bp, Homo sapiens
ttttcacctggaagcatttgttt

SEQ ID NO: 795663 - DNA, 17 bp, Homo sapiens
ttttcacggaagttttc

SEQ ID NO: 795664 - DNA, 20 bp, Homo sapiens
ttttcacggaagttttcaat

SEQ ID NO: 795665 - DNA, 16 bp, Homo sapiens
ttttcactagggctga

SEQ ID NO: 795666 - DNA, 19 bp, Homo sapiens
ttttcactgctggctgcct

SEQ ID NO: 795667 - DNA, 14 bp, Homo sapiens
ttttcacttgtatt

SEQ ID NO: 795668 - DNA, 15 bp, Homo sapiens
ttttcacttgtctcc

SEQ ID NO: 795669 - DNA, 20 bp, Homo sapiens
ttttcactttgtgtattaaa

SEQ ID NO: 795670 - DNA, 15 bp, Homo sapiens
ttttcagaaatatgt

SEQ ID NO: 795671 - DNA, 17 bp, Homo sapiens
ttttcagaacctcttcc

SEQ ID NO: 795672 - DNA, 18 bp, Homo sapiens
ttttcagaacctcttccc

SEQ ID NO: 795673 - DNA, 20 bp, Homo sapiens
ttttcagaagcaagccagac

SEQ ID NO: 795674 - DNA, 21 bp, Homo sapiens
ttttcagaagtcagcctacat

SEQ ID NO: 795675 - DNA, 11 bp, Homo sapiens
ttttcagaccc

SEQ ID NO: 795676 - DNA, 22 bp, Homo sapiens
ttttcagatataaaagactgac

SEQ ID NO: 795677 - DNA, 18 bp, Homo sapiens
ttttcagcaaactctttt

SEQ ID NO: 795678 - DNA, 20 bp, Homo sapiens
ttttcagcacccccacccac

SEQ ID NO: 795679 - DNA, 23 bp, Homo sapiens
ttttcagctcaattgttaatgtg

SEQ ID NO: 795680 - DNA, 12 bp, Homo sapiens
ttttcagctccc

SEQ ID NO: 795681 - DNA, 13 bp, Homo sapiens
ttttcaggaagct

SEQ ID NO: 795682 - DNA, 17 bp, Homo sapiens
ttttcagtatactgtgt

SEQ ID NO: 795683 - DNA, 19 bp, Homo sapiens
ttttcagtatactgtgtgg

SEQ ID NO: 795684 - DNA, 23 bp, Homo sapiens
ttttcagtcatataaaagctatg

SEQ ID NO: 795685 - DNA, 23 bp, Homo sapiens
ttttcagtcttgtagtgtgtgct

SEQ ID NO: 795686 - DNA, 15 bp, Homo sapiens
ttttcagtgcatcat

SEQ ID NO: 795687 - DNA, 20 bp, Homo sapiens
ttttcagttcatatgcagaa

SEQ ID NO: 795688 - DNA, 16 bp, Homo sapiens
ttttcagttccaagaa

SEQ ID NO: 795689 - DNA, 22 bp, Homo sapiens
ttttcagttgtttgtttttgct

SEQ ID NO: 795690 - DNA, 12 bp, Homo sapiens
ttttcataataa

SEQ ID NO: 795691 - DNA, 22 bp, Homo sapiens
ttttcatagatttgaaaaactt

SEQ ID NO: 795692 - DNA, 15 bp, Homo sapiens
ttttcataggtctga

SEQ ID NO: 795693 - DNA, 16 bp, Homo sapiens
ttttcataggtctgaa

SEQ ID NO: 795694 - DNA, 20 bp, Homo sapiens
ttttcatagtatccatattt

SEQ ID NO: 795695 - DNA, 23 bp, Homo sapiens
ttttcatagtgacctgtgtttca

SEQ ID NO: 795696 - DNA, 15 bp, Homo sapiens
ttttcatagtgcctt

SEQ ID NO: 795697 - DNA, 16 bp, Homo sapiens
ttttcatatcatttct

SEQ ID NO: 795698 - DNA, 13 bp, Homo sapiens
ttttcatattgtg

SEQ ID NO: 795699 - DNA, 17 bp, Homo sapiens
ttttcatcatttcagcc

SEQ ID NO: 795700 - DNA, 11 bp, Homo sapiens
ttttcatcctg

SEQ ID NO: 795701 - DNA, 16 bp, Homo sapiens
ttttcatcctggcctc

SEQ ID NO: 795702 - DNA, 16 bp, Homo sapiens
ttttcatccttcccca

SEQ ID NO: 795703 - DNA, 14 bp, Homo sapiens
ttttcatcttcagt

SEQ ID NO: 795704 - DNA, 21 bp, Homo sapiens
ttttcatcttctctggcgaca

SEQ ID NO: 795705 - DNA, 14 bp, Homo sapiens
ttttcatgaatgtg

SEQ ID NO: 795706 - DNA, 18 bp, Homo sapiens
ttttcatgaatgtgctgg

SEQ ID NO: 795707 - DNA, 19 bp, Homo sapiens
ttttcatggaagtggcagt

SEQ ID NO: 795708 - DNA, 14 bp, Homo sapiens
ttttcattaaactt

SEQ ID NO: 795709 - DNA, 14 bp, Homo sapiens
ttttcattaaataa

SEQ ID NO: 795710 - DNA, 20 bp, Homo sapiens
ttttcattaaataaatttga

SEQ ID NO: 795711 - DNA, 22 bp, Homo sapiens
ttttcattaaataaatttgact

SEQ ID NO: 795712 - DNA, 12 bp, Homo sapiens
ttttcattatgt

SEQ ID NO: 795713 - DNA, 18 bp, Homo sapiens
ttttcattccctgtagtt

SEQ ID NO: 795714 - DNA, 18 bp, Homo sapiens
ttttcattgaacagcaaa

SEQ ID NO: 795715 - DNA, 20 bp, Homo sapiens
ttttcattgattatatgggt

SEQ ID NO: 795716 - DNA, 14 bp, Homo sapiens
ttttcatttcatga

SEQ ID NO: 795717 - DNA, 11 bp, Homo sapiens
ttttcatttgt

SEQ ID NO: 795718 - DNA, 12 bp, Homo sapiens
ttttcatttgta

SEQ ID NO: 795719 - DNA, 13 bp, Homo sapiens
ttttcatttgtac

SEQ ID NO: 795720 - DNA, 13 bp, Homo sapiens
ttttcatttttgt

SEQ ID NO: 795721 - DNA, 13 bp, Homo sapiens
ttttccaaaacaa

SEQ ID NO: 795722 - DNA, 12 bp, Homo sapiens
ttttccaaagag

SEQ ID NO: 795723 - DNA, 22 bp, Homo sapiens
ttttccaaatgtaataaacttt

SEQ ID NO: 795724 - DNA, 17 bp, Homo sapiens
ttttccaagtaaagtga

SEQ ID NO: 795725 - DNA, 14 bp, Homo sapiens
ttttccaatcacag

SEQ ID NO: 795726 - DNA, 13 bp, Homo sapiens
ttttccactactg

SEQ ID NO: 795727 - DNA, 18 bp, Homo sapiens
ttttccactcctatggaa

SEQ ID NO: 795728 - DNA, 19 bp, Homo sapiens
ttttccaggatcctgcagg

SEQ ID NO: 795729 - DNA, 13 bp, Homo sapiens
ttttccagtattg

SEQ ID NO: 795730 - DNA, 18 bp, Homo sapiens
ttttccagtctcttgtac

SEQ ID NO: 795731 - DNA, 12 bp, Homo sapiens
ttttccatgtgt

SEQ ID NO: 795732 - DNA, 15 bp, Homo sapiens
ttttctttgaccaga

SEQ ID NO: 795733 - DNA, 22 bp, Homo sapiens
ttttctttgttaaaaccaaact

SEQ ID NO: 795734 - DNA, 13 bp, Homo sapiens
ttttcttttaaga

SEQ ID NO: 795735 - DNA, 15 bp, Homo sapiens
ttttcttttaagaat

SEQ ID NO: 795736 - DNA, 15 bp, Homo sapiens
ttttcttttccatta

SEQ ID NO: 795737 - DNA, 13 bp, Homo sapiens
ttttcttttgtaa

SEQ ID NO: 795738 - DNA, 16 bp, Homo sapiens
ttttctttttctttct

SEQ ID NO: 795739 - DNA, 21 bp, Homo sapiens
ttttctttttgaaacagtctt

SEQ ID NO: 795740 - DNA, 13 bp, Homo sapiens
ttttgaaaaatat

SEQ ID NO: 795741 - DNA, 20 bp, Homo sapiens
ttttgaaaagcagacatttt

SEQ ID NO: 795742 - DNA, 14 bp, Homo sapiens
ttttgaaaattatg

SEQ ID NO: 795743 - DNA, 12 bp, Homo sapiens
ttttgaaagaat

SEQ ID NO: 795744 - DNA, 23 bp, Homo sapiens
ttttgaaatcaatgcaagagtga

SEQ ID NO: 795745 - DNA, 17 bp, Homo sapiens
ttttgaaattaacctct

SEQ ID NO: 795746 - DNA, 16 bp, Homo sapiens
ttttgaaatttactgt

SEQ ID NO: 795747 - DNA, 20 bp, Homo sapiens
ttttgaactaataaaagcat

SEQ ID NO: 795748 - DNA, 13 bp, Homo sapiens
ttttgaactgcct

SEQ ID NO: 795749 - DNA, 17 bp, Homo sapiens
ttttgaacttttcattc

SEQ ID NO: 795750 - DNA, 21 bp, Homo sapiens
ttttgaagcagtcttgctctg

SEQ ID NO: 795751 - DNA, 17 bp, Homo sapiens
ttttgaagccttttgtt

SEQ ID NO: 795752 - DNA, 12 bp, Homo sapiens
ttttgaagctgt

SEQ ID NO: 795753 - DNA, 14 bp, Homo sapiens
ttttgaagctgttg

SEQ ID NO: 795754 - DNA, 15 bp, Homo sapiens
ttttgaagctgttgc

SEQ ID NO: 795755 - DNA, 13 bp, Homo sapiens
ttttgaaggcaaa

SEQ ID NO: 795756 - DNA, 14 bp, Homo sapiens
ttttgaaggcaaaa

SEQ ID NO: 795757 - DNA, 21 bp, Homo sapiens
ttttgaaggtttcagatgagg

SEQ ID NO: 795758 - DNA, 22 bp, Homo sapiens
ttttgaagtgtaggcagacaca

SEQ ID NO: 795759 - DNA, 17 bp, Homo sapiens
ttttgaataaaaagtga

SEQ ID NO: 795760 - DNA, 13 bp, Homo sapiens
ttttgaatcaata

SEQ ID NO: 795761 - DNA, 18 bp, Homo sapiens
ttttgaatgcttcctgac

SEQ ID NO: 795762 - DNA, 17 bp, Homo sapiens
ttttgaatgtcacaaat

SEQ ID NO: 795763 - DNA, 15 bp, Homo sapiens
ttttgaatttaaata

SEQ ID NO: 795764 - DNA, 18 bp, Homo sapiens
ttttgaatttaaataaag

SEQ ID NO: 795765 - DNA, 20 bp, Homo sapiens
ttttgaatttaaataaagtt

SEQ ID NO: 795766 - DNA, 16 bp, Homo sapiens
ttttgacactgaaata

SEQ ID NO: 795767 - DNA, 19 bp, Homo sapiens
ttttgacagtgttgaaaat

SEQ ID NO: 795768 - DNA, 15 bp, Homo sapiens
ttttgacatggaaat

SEQ ID NO: 795769 - DNA, 21 bp, Homo sapiens
ttttgaccttcatttcatgta

SEQ ID NO: 795770 - DNA, 15 bp, Homo sapiens
ttttgacggatgatt

SEQ ID NO: 795771 - DNA, 19 bp, Homo sapiens
ttttgactaaagctatgtt

SEQ ID NO: 795772 - DNA, 22 bp, Homo sapiens
ttttgactagggattcaggctg

SEQ ID NO: 795773 - DNA, 21 bp, Homo sapiens
ttttgactctggcaaagcttt

SEQ ID NO: 795774 - DNA, 17 bp, Homo sapiens
ttttgacttaaagcaga

SEQ ID NO: 795775 - DNA, 15 bp, Homo sapiens
ttttgacttaatgtg

SEQ ID NO: 795776 - DNA, 18 bp, Homo sapiens
ttttgacttaatgtgatt

SEQ ID NO: 795777 - DNA, 11 bp, Homo sapiens
ttttgagctat

SEQ ID NO: 795778 - DNA, 21 bp, Homo sapiens
ttttgagtacggctatagcct

SEQ ID NO: 795779 - DNA, 13 bp, Homo sapiens
ttttgagtattcc

SEQ ID NO: 795780 - DNA, 13 bp, Homo sapiens
ttttgagtgtact

SEQ ID NO: 795781 - DNA, 22 bp, Homo sapiens
ttttgagtgtactgtgcctggt

SEQ ID NO: 795782 - DNA, 18 bp, Homo sapiens
ttttgagtgtgtgtgtgc

SEQ ID NO: 795783 - DNA, 16 bp, Homo sapiens
ttttgataaagtaatt

SEQ ID NO: 795784 - DNA, 18 bp, Homo sapiens
ttttgatactaagcattg

SEQ ID NO: 795785 - DNA, 15 bp, Homo sapiens
ttttgatagttgtgt

SEQ ID NO: 795786 - DNA, 19 bp, Homo sapiens
ttttgatatgcatatttgt

SEQ ID NO: 795787 - DNA, 22 bp, Homo sapiens
ttttgatatttatttcctgcta

SEQ ID NO: 795788 - DNA, 17 bp, Homo sapiens
ttttgatcatccctttc

SEQ ID NO: 795789 - DNA, 22 bp, Homo sapiens
ttttgatcatccctttctccca

SEQ ID NO: 795790 - DNA, 13 bp, Homo sapiens
ttttgatgtgaaa

SEQ ID NO: 795791 - DNA, 13 bp, Homo sapiens
ttttgattaatgt

SEQ ID NO: 795792 - DNA, 12 bp, Homo sapiens
ttttgattatgt

SEQ ID NO: 795793 - DNA, 15 bp, Homo sapiens
ttttgatttatgcat

SEQ ID NO: 795794 - DNA, 22 bp, Homo sapiens
ttttgatttgaatgtaaaacag

SEQ ID NO: 795795 - DNA, 13 bp, Homo sapiens
ttttgatttggtg

SEQ ID NO: 795796 - DNA, 21 bp, Homo sapiens
ttttgatttggtggatgtgat

SEQ ID NO: 795797 - DNA, 21 bp, Homo sapiens
ttttgatttgtactgaaaaat

SEQ ID NO: 795798 - DNA, 16 bp, Homo sapiens
ttttgcaacaattaag

SEQ ID NO: 795799 - DNA, 17 bp, Homo sapiens
ttttgcaacctcgctgg

SEQ ID NO: 795800 - DNA, 18 bp, Homo sapiens
ttttgcaatcccttaata

SEQ ID NO: 795801 - DNA, 17 bp, Homo sapiens
ttttgcaatggctatat

SEQ ID NO: 795802 - DNA, 17 bp, Homo sapiens
ttttgcacccctcccat

SEQ ID NO: 795803 - DNA, 21 bp, Homo sapiens
ttttgcacgtcttgctatttg

SEQ ID NO: 795804 - DNA, 18 bp, Homo sapiens
ttttgcagaaaaaacaaa

SEQ ID NO: 795805 - DNA, 16 bp, Homo sapiens
ttttgcagaaggaaat

SEQ ID NO: 795806 - DNA, 17 bp, Homo sapiens
ttttgcagaaggaaatg

SEQ ID NO: 795807 - DNA, 13 bp, Homo sapiens
ttttgcagcagag

SEQ ID NO: 795808 - DNA, 18 bp, Homo sapiens
ttttgcagcagaggagct

SEQ ID NO: 795809 - DNA, 14 bp, Homo sapiens
ttttgcagcagtga

SEQ ID NO: 795810 - DNA, 13 bp, Homo sapiens
ttttgcaggagca

SEQ ID NO: 795811 - DNA, 9 bp, Homo sapiens
ttttgcagt

SEQ ID NO: 795812 - DNA, 16 bp, Homo sapiens
ttttgcagtaactgtt

SEQ ID NO: 795813 - DNA, 22 bp, Homo sapiens
ttttgcagtagagtcatctcca

SEQ ID NO: 795814 - DNA, 22 bp, Homo sapiens
ttttgcataagattaaaggaag

SEQ ID NO: 795815 - DNA, 17 bp, Homo sapiens
ttttgcatactgaaaat

SEQ ID NO: 795816 - DNA, 16 bp, Homo sapiens
ttttgcattccagaat

SEQ ID NO: 795817 - DNA, 18 bp, Homo sapiens
ttttgcattccagaatct

SEQ ID NO: 795818 - DNA, 14 bp, Homo sapiens
ttttgccacagctt

SEQ ID NO: 795819 - DNA, 19 bp, Homo sapiens
ttttgcccattttgaatca

SEQ ID NO: 795820 - DNA, 18 bp, Homo sapiens
ttttgcccttcacagtgt

SEQ ID NO: 795821 - DNA, 23 bp, Homo sapiens
ttttgccggctggtgaattcaaa

SEQ ID NO: 795822 - DNA, 17 bp, Homo sapiens
ttttgcctatctttaaa

SEQ ID NO: 795823 - DNA, 18 bp, Homo sapiens
ttttgcctatctttaaac

SEQ ID NO: 795824 - DNA, 22 bp, Homo sapiens
ttttgcctatctttaaacattt

SEQ ID NO: 795825 - DNA, 15 bp, Homo sapiens
ttttgcctctgccca

SEQ ID NO: 795826 - DNA, 15 bp, Homo sapiens
ttttgcctcttttct

SEQ ID NO: 795827 - DNA, 13 bp, Homo sapiens
ttttgcctgtaag

SEQ ID NO: 795828 - DNA, 14 bp, Homo sapiens
ttttgcctgtaaga

SEQ ID NO: 795829 - DNA, 17 bp, Homo sapiens
ttttgcgtacacagaga

SEQ ID NO: 795830 - DNA, 13 bp, Homo sapiens
ttttgctaaaaag

SEQ ID NO: 795831 - DNA, 13 bp, Homo sapiens
ttttgctccctct

SEQ ID NO: 795832 - DNA, 15 bp, Homo sapiens
ttttgctgaattcct

SEQ ID NO: 795833 - DNA, 13 bp, Homo sapiens
ttttgctgagact

SEQ ID NO: 795834 - DNA, 19 bp, Homo sapiens
ttttgctggtgtctgagct

SEQ ID NO: 795835 - DNA, 13 bp, Homo sapiens
ttttgctgtagaa

SEQ ID NO: 795836 - DNA, 15 bp, Homo sapiens
ttttgcttgcaatgt

SEQ ID NO: 795837 - DNA, 21 bp, Homo sapiens
ttttgctttagagaatgccac

SEQ ID NO: 795838 - DNA, 12 bp, Homo sapiens
ttttgcttttgt

SEQ ID NO: 795839 - DNA, 23 bp, Homo sapiens
ttttggaaactgctaaattctat

SEQ ID NO: 795840 - DNA, 17 bp, Homo sapiens
ttttggaaagtcagaat

SEQ ID NO: 795841 - DNA, 22 bp, Homo sapiens
ttttggaagaagttttttactt

SEQ ID NO: 795842 - DNA, 18 bp, Homo sapiens
ttttggaattcagcagtt

SEQ ID NO: 795843 - DNA, 18 bp, Homo sapiens
ttttggaattggtgtata

SEQ ID NO: 795844 - DNA, 19 bp, Homo sapiens
ttttggaattggtgtatat

SEQ ID NO: 795845 - DNA, 13 bp, Homo sapiens
ttttggactggca

SEQ ID NO: 795846 - DNA, 15 bp, Homo sapiens
ttttggaggtgctta

SEQ ID NO: 795847 - DNA, 17 bp, Homo sapiens
ttttggagtgttatgta

SEQ ID NO: 795848 - DNA, 20 bp, Homo sapiens
ttttggagtgttatgtattt

SEQ ID NO: 795849 - DNA, 19 bp, Homo sapiens
ttttggatgattaaaaaat

SEQ ID NO: 795850 - DNA, 19 bp, Homo sapiens
ttttggcaaacgctaaaga

SEQ ID NO: 795851 - DNA, 22 bp, Homo sapiens
ttttggcacttgccattccaaa

SEQ ID NO: 795852 - DNA, 13 bp, Homo sapiens
ttttggcagctga

SEQ ID NO: 795853 - DNA, 14 bp, Homo sapiens
ttttggcctgtttg

SEQ ID NO: 795854 - DNA, 18 bp, Homo sapiens
ttttggcctgtttgatgt

SEQ ID NO: 795855 - DNA, 11 bp, Homo sapiens
ttttggccttg

SEQ ID NO: 795856 - DNA, 14 bp, Homo sapiens
ttttggctctccca

SEQ ID NO: 795857 - DNA, 17 bp, Homo sapiens
ttttggcttcatttcaa

SEQ ID NO: 795858 - DNA, 22 bp, Homo sapiens
ttttgggaagacgttttcttta

SEQ ID NO: 795859 - DNA, 10 bp, Homo sapiens
ttttgggcca

SEQ ID NO: 795860 - DNA, 18 bp, Homo sapiens
ttttggggaagtgaggaa

SEQ ID NO: 795861 - DNA, 22 bp, Homo sapiens
ttttggggattttcaaaagata

SEQ ID NO: 795862 - DNA, 13 bp, Homo sapiens
ttttgggggcttt

SEQ ID NO: 795863 - DNA, 18 bp, Homo sapiens
ttttgggggtcaggcagc

SEQ ID NO: 795864 - DNA, 23 bp, Homo sapiens
ttttgggtattgtaatctgaagt

SEQ ID NO: 795865 - DNA, 21 bp, Homo sapiens
ttttggtagatcttcaatttg

SEQ ID NO: 795866 - DNA, 23 bp, Homo sapiens
ttttggtattacactgtatttgt

SEQ ID NO: 795867 - DNA, 17 bp, Homo sapiens
ttttggtgcacaaatac

SEQ ID NO: 795868 - DNA, 19 bp, Homo sapiens
ttttggtgttgcttttcaa

SEQ ID NO: 795869 - DNA, 16 bp, Homo sapiens
ttttggttcttagttc

SEQ ID NO: 795870 - DNA, 23 bp, Homo sapiens
ttttggttgctgatgtttataaa

SEQ ID NO: 795871 - DNA, 14 bp, Homo sapiens
ttttggtttacctg

SEQ ID NO: 795872 - DNA, 19 bp, Homo sapiens
ttttggtttcaccttccct

SEQ ID NO: 795873 - DNA, 13 bp, Homo sapiens
ttttgtaaaaaat

SEQ ID NO: 795874 - DNA, 12 bp, Homo sapiens
ttttgtaaaata

SEQ ID NO: 795875 - DNA, 14 bp, Homo sapiens
ttttgtaaacattt

SEQ ID NO: 795876 - DNA, 15 bp, Homo sapiens
ttttgtaacaaatga

SEQ ID NO: 795877 - DNA, 15 bp, Homo sapiens
ttttgtaagatgctg

SEQ ID NO: 795878 - DNA, 20 bp, Homo sapiens
ttttgtaagatgctgggttg

SEQ ID NO: 795879 - DNA, 16 bp, Homo sapiens
ttttgtaataagcaat

SEQ ID NO: 795880 - DNA, 13 bp, Homo sapiens
ttttgtaatgaat

SEQ ID NO: 795881 - DNA, 18 bp, Homo sapiens
ttttgtaattcttatgac

SEQ ID NO: 795882 - DNA, 15 bp, Homo sapiens
ttttgtaattgtgta

SEQ ID NO: 795883 - DNA, 16 bp, Homo sapiens
ttttgtaattgtgtaa

SEQ ID NO: 795884 - DNA, 15 bp, Homo sapiens
ttttgtaatttgaat

SEQ ID NO: 795885 - DNA, 19 bp, Homo sapiens
ttttgtacaattactaaat

SEQ ID NO: 795886 - DNA, 16 bp, Homo sapiens
ttttgtacatattgtt

SEQ ID NO: 795887 - DNA, 22 bp, Homo sapiens
ttttgtagagagagctgtatta

SEQ ID NO: 795888 - DNA, 16 bp, Homo sapiens
ttttgtaggctgttcc

SEQ ID NO: 795889 - DNA, 13 bp, Homo sapiens
ttttgtatacaga

SEQ ID NO: 795890 - DNA, 14 bp, Homo sapiens
ttttgtatgctgaa

SEQ ID NO: 795891 - DNA, 20 bp, Homo sapiens
ttttgtatgtaaatgtgcat

SEQ ID NO: 795892 - DNA, 18 bp, Homo sapiens
ttttgtcactttttctga

SEQ ID NO: 795893 - DNA, 17 bp, Homo sapiens
ttttgtcagacttccaa

SEQ ID NO: 795894 - DNA, 16 bp, Homo sapiens
ttttgtcatataagat

SEQ ID NO: 795895 - DNA, 18 bp, Homo sapiens
ttttgtccaagttcacag

SEQ ID NO: 795896 - DNA, 16 bp, Homo sapiens
ttttgtccccagggcc

SEQ ID NO: 795897 - DNA, 20 bp, Homo sapiens
ttttgtcccccaacttgaga

SEQ ID NO: 795898 - DNA, 13 bp, Homo sapiens
ttttgtctgttta

SEQ ID NO: 795899 - DNA, 14 bp, Homo sapiens
ttttgtgaattagg

SEQ ID NO: 795900 - DNA, 19 bp, Homo sapiens
ttttgtgagctttacttct

SEQ ID NO: 795901 - DNA, 13 bp, Homo sapiens
ttttgtgatgaac

SEQ ID NO: 795902 - DNA, 21 bp, Homo sapiens
ttttgtgcaaaagcttcaaat

SEQ ID NO: 795903 - DNA, 22 bp, Homo sapiens
ttttgtgcaaaagcttcaaatt

SEQ ID NO: 795904 - DNA, 17 bp, Homo sapiens
ttttgtgcattatctag

SEQ ID NO: 795905 - DNA, 20 bp, Homo sapiens
ttttgtgcattatctagata

SEQ ID NO: 795906 - DNA, 23 bp, Homo sapiens
ttttgtgcattatctagatactg

SEQ ID NO: 795907 - DNA, 15 bp, Homo sapiens
ttttgtgctgcttct

SEQ ID NO: 795908 - DNA, 16 bp, Homo sapiens
ttttgtggtttggaat

SEQ ID NO: 795909 - DNA, 11 bp, Homo sapiens
ttttgtgtatg

SEQ ID NO: 795910 - DNA, 15 bp, Homo sapiens
ttttgtgtatgtact

SEQ ID NO: 795911 - DNA, 17 bp, Homo sapiens
ttttgtgtatgtactta

SEQ ID NO: 795912 - DNA, 16 bp, Homo sapiens
ttttgtgtctcattta

SEQ ID NO: 795913 - DNA, 13 bp, Homo sapiens
ttttgtgtttcta

SEQ ID NO: 795914 - DNA, 16 bp, Homo sapiens
ttttgttaacagtatt

SEQ ID NO: 795915 - DNA, 14 bp, Homo sapiens
ttttgttaatgctc

SEQ ID NO: 795916 - DNA, 16 bp, Homo sapiens
ttttgttagcaaagat

SEQ ID NO: 795917 - DNA, 14 bp, Homo sapiens
ttttgttatagaat

SEQ ID NO: 795918 - DNA, 14 bp, Homo sapiens
ttttgttcaaagtt

SEQ ID NO: 795919 - DNA, 23 bp, Homo sapiens
ttttgttcgcatggtcacacact

SEQ ID NO: 795920 - DNA, 15 bp, Homo sapiens
ttttgttctacatga

SEQ ID NO: 795921 - DNA, 13 bp, Homo sapiens
ttttgttctctgg

SEQ ID NO: 795922 - DNA, 14 bp, Homo sapiens
ttttgttctctggg

SEQ ID NO: 795923 - DNA, 11 bp, Homo sapiens
ttttgttgaaa

SEQ ID NO: 795924 - DNA, 19 bp, Homo sapiens
ttttgttgacattctgaat

SEQ ID NO: 795925 - DNA, 13 bp, Homo sapiens
ttttgttggcata

SEQ ID NO: 795926 - DNA, 21 bp, Homo sapiens
ttttgttggcatagctctggg

SEQ ID NO: 795927 - DNA, 21 bp, Homo sapiens
ttttgttgtgcactagtgcaa

SEQ ID NO: 795928 - DNA, 13 bp, Homo sapiens
ttttgttgtgtgt

SEQ ID NO: 795929 - DNA, 19 bp, Homo sapiens
ttttgttgtttcttaaata

SEQ ID NO: 795930 - DNA, 17 bp, Homo sapiens
ttttgtttaaaactcag

SEQ ID NO: 795931 - DNA, 19 bp, Homo sapiens
ttttgtttgtttcttcttt

SEQ ID NO: 795932 - DNA, 21 bp, Homo sapiens
ttttgtttgtttctttgtgtt

SEQ ID NO: 795933 - DNA, 16 bp, Homo sapiens
ttttgtttttgtaatg

SEQ ID NO: 795934 - DNA, 16 bp, Homo sapiens
ttttgtttttgtctta

SEQ ID NO: 795935 - DNA, 14 bp, Homo sapiens
ttttgtttttgtta

SEQ ID NO: 795936 - DNA, 12 bp, Homo sapiens
tttttaaaaaat

SEQ ID NO: 795937 - DNA, 17 bp, Homo sapiens
tttttaaaaaataccat

SEQ ID NO: 795938 - DNA, 18 bp, Homo sapiens
tttttaaaaaatattttc

SEQ ID NO: 795939 - DNA, 18 bp, Homo sapiens
tttttaaaaagaaactat

SEQ ID NO: 795940 - DNA, 17 bp, Homo sapiens
tttttaaaacaaaagag

SEQ ID NO: 795941 - DNA, 22 bp, Homo sapiens
tttttaaaacactaaaagcagc

SEQ ID NO: 795942 - DNA, 12 bp, Homo sapiens
tttttaaaatat

SEQ ID NO: 795943 - DNA, 13 bp, Homo sapiens
tttttaaaatata

SEQ ID NO: 795944 - DNA, 17 bp, Homo sapiens
tttttaaaatatttatt

SEQ ID NO: 795945 - DNA, 22 bp, Homo sapiens
tttttaaaatgctgctttgtcc

SEQ ID NO: 795946 - DNA, 13 bp, Homo sapiens
tttttaaactgta

SEQ ID NO: 795947 - DNA, 12 bp, Homo sapiens
tttttaaacttg

SEQ ID NO: 795948 - DNA, 18 bp, Homo sapiens
tttttaaacttgaaatat

SEQ ID NO: 795949 - DNA, 12 bp, Homo sapiens
tttttaaagaca

SEQ ID NO: 795950 - DNA, 14 bp, Homo sapiens
tttttaaagactgt

SEQ ID NO: 795951 - DNA, 12 bp, Homo sapiens
tttttaaagatc

SEQ ID NO: 795952 - DNA, 15 bp, Homo sapiens
tttttaaagctacaa

SEQ ID NO: 795953 - DNA, 12 bp, Homo sapiens
tttttaaagtaa

SEQ ID NO: 795954 - DNA, 20 bp, Homo sapiens
tttttaaagtgtttctgtta

SEQ ID NO: 795955 - DNA, 19 bp, Homo sapiens
tttttaaagtttgttcact

SEQ ID NO: 795956 - DNA, 18 bp, Homo sapiens
tttttaaataaaagcaca

SEQ ID NO: 795957 - DNA, 16 bp, Homo sapiens
tttttaaatcaaggaa

SEQ ID NO: 795958 - DNA, 18 bp, Homo sapiens
tttttaaatgatcatgaa

SEQ ID NO: 795959 - DNA, 23 bp, Homo sapiens
tttttaaatgtatactatagtac

SEQ ID NO: 795960 - DNA, 15 bp, Homo sapiens
tttttaaatgtgaat

SEQ ID NO: 795961 - DNA, 14 bp, Homo sapiens
tttttaaattgttt

SEQ ID NO: 795962 - DNA, 15 bp, Homo sapiens
tttttaaatttcagt

SEQ ID NO: 795963 - DNA, 12 bp, Homo sapiens
tttttaaatttg

SEQ ID NO: 795964 - DNA, 19 bp, Homo sapiens
tttttaacaaaaaacagat

SEQ ID NO: 795965 - DNA, 22 bp, Homo sapiens
tttttaacaaaaaacagattct

SEQ ID NO: 795966 - DNA, 13 bp, Homo sapiens
tttttaacacata

SEQ ID NO: 795967 - DNA, 16 bp, Homo sapiens
tttttaacacttaaat

SEQ ID NO: 795968 - DNA, 22 bp, Homo sapiens
tttttaaccaaggaggggccag

SEQ ID NO: 795969 - DNA, 13 bp, Homo sapiens
tttttaacctgtt

SEQ ID NO: 795970 - DNA, 17 bp, Homo sapiens
tttttaactgaaaatgt

SEQ ID NO: 795971 - DNA, 18 bp, Homo sapiens
tttttaactgaaaatgta

SEQ ID NO: 795972 - DNA, 17 bp, Homo sapiens
tttttaactttaccatg

SEQ ID NO: 795973 - DNA, 21 bp, Homo sapiens
tttttaactttaccatgctca

SEQ ID NO: 795974 - DNA, 12 bp, Homo sapiens
tttttaagaaaa

SEQ ID NO: 795975 - DNA, 16 bp, Homo sapiens
tttttaagtatttata

SEQ ID NO: 795976 - DNA, 13 bp, Homo sapiens
tttttaagtgaaa

SEQ ID NO: 795977 - DNA, 20 bp, Homo sapiens
tttttaagtgaaaatatagc

SEQ ID NO: 795978 - DNA, 18 bp, Homo sapiens
tttttaagtgtatcttaa

SEQ ID NO: 795979 - DNA, 18 bp, Homo sapiens
tttttaagttaatagatt

SEQ ID NO: 795980 - DNA, 18 bp, Homo sapiens
tttttaagttacacattt

SEQ ID NO: 795981 - DNA, 14 bp, Homo sapiens
tttttaataattta

SEQ ID NO: 795982 - DNA, 20 bp, Homo sapiens
tttttaatgaccaattgagt

SEQ ID NO: 795983 - DNA, 13 bp, Homo sapiens
tttttaatgctat

SEQ ID NO: 795984 - DNA, 21 bp, Homo sapiens
tgcatgaaactaggcttctgt

SEQ ID NO: 795985 - DNA, 21 bp, Homo sapiens
tgcatgaagagaagcaatttt

SEQ ID NO: 795986 - DNA, 20 bp, Homo sapiens
tgcatgaagtaatatgcaca

SEQ ID NO: 795987 - DNA, 19 bp, Homo sapiens
tgcatgaatatcatacaaa

SEQ ID NO: 795988 - DNA, 21 bp, Homo sapiens
tgcatgacaaaccttatggaa

SEQ ID NO: 795989 - DNA, 16 bp, Homo sapiens
tgcatgaccaaagtga

SEQ ID NO: 795990 - DNA, 18 bp, Homo sapiens
tgcatgaccaaagtgata

SEQ ID NO: 795991 - DNA, 16 bp, Homo sapiens
tgcatgacctaccagg

SEQ ID NO: 795992 - DNA, 21 bp, Homo sapiens
tgcatgatatcttcaagcctg

SEQ ID NO: 795993 - DNA, 17 bp, Homo sapiens
tgcatgatgtttgccca

SEQ ID NO: 795994 - DNA, 18 bp, Homo sapiens
tgcatgattcttctcttg

SEQ ID NO: 795995 - DNA, 23 bp, Homo sapiens
tgcatgcaactaattcaataaaa

SEQ ID NO: 795996 - DNA, 19 bp, Homo sapiens
tgcatgcactgttccccct

SEQ ID NO: 795997 - DNA, 17 bp, Homo sapiens
tgcatgctctctgcagc

SEQ ID NO: 795998 - DNA, 13 bp, Homo sapiens
tgcatgctctgga

SEQ ID NO: 795999 - DNA, 16 bp, Homo sapiens
tgcatgctctggaagc

SEQ ID NO: 796000 - DNA, 22 bp, Homo sapiens
tgcatgctctggaagcctggac

SEQ ID NO: 796001 - DNA, 14 bp, Homo sapiens
tgcatggaaatcag

SEQ ID NO: 796002 - DNA, 22 bp, Homo sapiens
tgcatggaaatcagccaagttt

SEQ ID NO: 796003 - DNA, 14 bp, Homo sapiens
tgcatggagcctgg

SEQ ID NO: 796004 - DNA, 19 bp, Homo sapiens
tgcatggcagggcctcatc

SEQ ID NO: 796005 - DNA, 20 bp, Homo sapiens
tgcatggcagggcctcatct

SEQ ID NO: 796006 - DNA, 18 bp, Homo sapiens
tgcatggctccagaaatg

SEQ ID NO: 796007 - DNA, 11 bp, Homo sapiens
tgcatgggctc

SEQ ID NO: 796008 - DNA, 18 bp, Homo sapiens
tgcatggggaggcagcag

SEQ ID NO: 796009 - DNA, 23 bp, Homo sapiens
tgcatgggggaccctgtgcatct

SEQ ID NO: 796010 - DNA, 22 bp, Homo sapiens
tgcatgtactagtcctctagaa

SEQ ID NO: 796011 - DNA, 24 bp, Homo sapiens
tgcatgtactagtcctctagaaat

SEQ ID NO: 796012 - DNA, 13 bp, Homo sapiens
tgcatgtacttga

SEQ ID NO: 796013 - DNA, 14 bp, Homo sapiens
tgcatgtagtaaca

SEQ ID NO: 796014 - DNA, 16 bp, Homo sapiens
tgcatgtcctgtaaag

SEQ ID NO: 796015 - DNA, 23 bp, Homo sapiens
tgcatgtctactcagcatttgat

SEQ ID NO: 796016 - DNA, 17 bp, Homo sapiens
tgcatgtgagcacatgc

SEQ ID NO: 796017 - DNA, 20 bp, Homo sapiens
tgcatgtgtgtgtctgtctt

SEQ ID NO: 796018 - DNA, 21 bp, Homo sapiens
tgcatgtgtgtgtctgtcttt

SEQ ID NO: 796019 - DNA, 22 bp, Homo sapiens
tgcatgttaggaaaatttcaca

SEQ ID NO: 796020 - DNA, 11 bp, Homo sapiens
tgcatgtttac

SEQ ID NO: 796021 - DNA, 20 bp, Homo sapiens
tgcatgtttactttattaga

SEQ ID NO: 796022 - DNA, 16 bp, Homo sapiens
tgcatgtttgaaatga

SEQ ID NO: 796023 - DNA, 15 bp, Homo sapiens
tgcatgtttgtgatt

SEQ ID NO: 796024 - DNA, 12 bp, Homo sapiens
tgcattaaaaaa

SEQ ID NO: 796025 - DNA, 23 bp, Homo sapiens
tgcattaaaaaaaaaaaaaaact

SEQ ID NO: 796026 - DNA, 15 bp, Homo sapiens
tgcattaaattcaca

SEQ ID NO: 796027 - DNA, 18 bp, Homo sapiens
tgcattaatctaagaaaa

SEQ ID NO: 796028 - DNA, 12 bp, Homo sapiens
tgcattacagag

SEQ ID NO: 796029 - DNA, 17 bp, Homo sapiens
tgcattacagagaggag

SEQ ID NO: 796030 - DNA, 23 bp, Homo sapiens
tgcattacagagaggagaaacac

SEQ ID NO: 796031 - DNA, 22 bp, Homo sapiens
tgcattaccgcgttgtaaaata

SEQ ID NO: 796032 - DNA, 20 bp, Homo sapiens
tgcattagaaatagacagta

SEQ ID NO: 796033 - DNA, 21 bp, Homo sapiens
tgcattagagcccatttcaat

SEQ ID NO: 796034 - DNA, 17 bp, Homo sapiens
tgcattatctagatact

SEQ ID NO: 796035 - DNA, 18 bp, Homo sapiens
tgcattatgtatttataa

SEQ ID NO: 796036 - DNA, 15 bp, Homo sapiens
tgcattattaaattg

SEQ ID NO: 796037 - DNA, 17 bp, Homo sapiens
tgcattattaaattgta

SEQ ID NO: 796038 - DNA, 18 bp, Homo sapiens
tgcattattaaattgtaa

SEQ ID NO: 796039 - DNA, 12 bp, Homo sapiens
tgcattcaaatt

SEQ ID NO: 796040 - DNA, 14 bp, Homo sapiens
tgcattcaaattaa

SEQ ID NO: 796041 - DNA, 23 bp, Homo sapiens
tgcattcacaggggttggctggg

SEQ ID NO: 796042 - DNA, 19 bp, Homo sapiens
tgcattcaccttagtgcaa

SEQ ID NO: 796043 - DNA, 20 bp, Homo sapiens
tgcattcatttttatagcaa

SEQ ID NO: 796044 - DNA, 13 bp, Homo sapiens
tgcattccagaat

SEQ ID NO: 796045 - DNA, 24 bp, Homo sapiens
tgcattccagaatcttgactttct

SEQ ID NO: 796046 - DNA, 14 bp, Homo sapiens
tgcattcccagtgg

SEQ ID NO: 796047 - DNA, 22 bp, Homo sapiens
tgcattccctgaatctgtgcct

SEQ ID NO: 796048 - DNA, 15 bp, Homo sapiens
tgcattcctgtgccc

SEQ ID NO: 796049 - DNA, 16 bp, Homo sapiens
tgcattcctttgtctt

SEQ ID NO: 796050 - DNA, 18 bp, Homo sapiens
tgcattcctttgtcttca

SEQ ID NO: 796051 - DNA, 20 bp, Homo sapiens
tgcattcctttttcttcact

SEQ ID NO: 796052 - DNA, 13 bp, Homo sapiens
tgcattctactag

SEQ ID NO: 796053 - DNA, 15 bp, Homo sapiens
tgcattctctcccat

SEQ ID NO: 796054 - DNA, 21 bp, Homo sapiens
tgcattctctcccatcctggg

SEQ ID NO: 796055 - DNA, 19 bp, Homo sapiens
tgcattctgataggagggg

SEQ ID NO: 796056 - DNA, 20 bp, Homo sapiens
tgcattctgataggaggggg

SEQ ID NO: 796057 - DNA, 19 bp, Homo sapiens
tgcattctgtttcctcttg

SEQ ID NO: 796058 - DNA, 14 bp, Homo sapiens
tgcattcttaacaa

SEQ ID NO: 796059 - DNA, 19 bp, Homo sapiens
tgcattcttaacaaactct

SEQ ID NO: 796060 - DNA, 13 bp, Homo sapiens
tgcattctttggt

SEQ ID NO: 796061 - DNA, 15 bp, Homo sapiens
tgcattctttggtaa

SEQ ID NO: 796062 - DNA, 16 bp, Homo sapiens
tgcattctttggtaat

SEQ ID NO: 796063 - DNA, 20 bp, Homo sapiens
tgcattcttttaaagtttta

SEQ ID NO: 796064 - DNA, 15 bp, Homo sapiens
tgcattgaacacaaa

SEQ ID NO: 796065 - DNA, 18 bp, Homo sapiens
tgcattgaacacaaactg

SEQ ID NO: 796066 - DNA, 20 bp, Homo sapiens
tgcattgaccgcgactaatt

SEQ ID NO: 796067 - DNA, 22 bp, Homo sapiens
tgcattgaccgcgactaatttc

SEQ ID NO: 796068 - DNA, 18 bp, Homo sapiens
tgcattgctagataaaag

SEQ ID NO: 796069 - DNA, 20 bp, Homo sapiens
tgcattgctctggatctgtt

SEQ ID NO: 796070 - DNA, 16 bp, Homo sapiens
tgcattgctggtagag

SEQ ID NO: 796071 - DNA, 22 bp, Homo sapiens
tgcattgtctccttccacaatg

SEQ ID NO: 796072 - DNA, 17 bp, Homo sapiens
tgcattgtgattggcct

SEQ ID NO: 796073 - DNA, 19 bp, Homo sapiens
tgcattgtgattggcctgt

SEQ ID NO: 796074 - DNA, 18 bp, Homo sapiens
tgcattgttattgtggaa

SEQ ID NO: 796075 - DNA, 19 bp, Homo sapiens
tgcatttaaaacagacact

SEQ ID NO: 796076 - DNA, 20 bp, Homo sapiens
tgcatttaaaacagacactg

SEQ ID NO: 796077 - DNA, 16 bp, Homo sapiens
tgcatttaaaagatac

SEQ ID NO: 796078 - DNA, 19 bp, Homo sapiens
tgcatttaaacatgtttaa

SEQ ID NO: 796079 - DNA, 14 bp, Homo sapiens
tgcatttaaactct

SEQ ID NO: 796080 - DNA, 15 bp, Homo sapiens
tgcatttaaggagat

SEQ ID NO: 796081 - DNA, 23 bp, Homo sapiens
tgcatttcaagcagctgaagaaa

SEQ ID NO: 796082 - DNA, 19 bp, Homo sapiens
tgcatttcaaggaatggaa

SEQ ID NO: 796083 - DNA, 22 bp, Homo sapiens
tgcatttcagcttgaacctgct

SEQ ID NO: 796084 - DNA, 16 bp, Homo sapiens
tgcatttccagaaatc

SEQ ID NO: 796085 - DNA, 15 bp, Homo sapiens
tgcatttcctgtgtt

SEQ ID NO: 796086 - DNA, 22 bp, Homo sapiens
tgcatttcctgtgtttgtcctg

SEQ ID NO: 796087 - DNA, 14 bp, Homo sapiens
tgcatttctcttct

SEQ ID NO: 796088 - DNA, 16 bp, Homo sapiens
tgcatttctcttctca

SEQ ID NO: 796089 - DNA, 17 bp, Homo sapiens
tgcatttgagagaagcc

SEQ ID NO: 796090 - DNA, 22 bp, Homo sapiens
tgcatttgagagaagccacgct

SEQ ID NO: 796091 - DNA, 23 bp, Homo sapiens
tgcatttgagagaagccacgctg

SEQ ID NO: 796092 - DNA, 22 bp, Homo sapiens
tgcatttgaggggccaggggca

SEQ ID NO: 796093 - DNA, 19 bp, Homo sapiens
tgcatttgaggtctgttct

SEQ ID NO: 796094 - DNA, 21 bp, Homo sapiens
tgcatttgaggtctgttcttt

SEQ ID NO: 796095 - DNA, 18 bp, Homo sapiens
tgcatttgccccttgagc

SEQ ID NO: 796096 - DNA, 14 bp, Homo sapiens
tgcatttggcactg

SEQ ID NO: 796097 - DNA, 18 bp, Homo sapiens
tgcatttgtaaatgctgt

SEQ ID NO: 796098 - DNA, 21 bp, Homo sapiens
tgcatttgtttatgtaatttc

SEQ ID NO: 796099 - DNA, 19 bp, Homo sapiens
tgcattttaattttaacca

SEQ ID NO: 796100 - DNA, 16 bp, Homo sapiens
tgcattttacacatgt

SEQ ID NO: 796101 - DNA, 13 bp, Homo sapiens
tgcattttcctct

SEQ ID NO: 796102 - DNA, 15 bp, Homo sapiens
tgcattttcctcttg

SEQ ID NO: 796103 - DNA, 20 bp, Homo sapiens
tgcattttcctcttgtcctg

SEQ ID NO: 796104 - DNA, 13 bp, Homo sapiens
tgcattttcttca

SEQ ID NO: 796105 - DNA, 15 bp, Homo sapiens
tgcattttcttcaca

SEQ ID NO: 796106 - DNA, 15 bp, Homo sapiens
tgcattttcttcaga

SEQ ID NO: 796107 - DNA, 19 bp, Homo sapiens
tgcattttgctattgtaaa

SEQ ID NO: 796108 - DNA, 19 bp, Homo sapiens
tgcattttgtttctgtata

SEQ ID NO: 796109 - DNA, 19 bp, Homo sapiens
tgcatttttaaacttgaaa

SEQ ID NO: 796110 - DNA, 21 bp, Homo sapiens
tgcatttttcttatttatatc

SEQ ID NO: 796111 - DNA, 20 bp, Homo sapiens
tgcatttttggatcattttt

SEQ ID NO: 796112 - DNA, 14 bp, Homo sapiens
tgcatttttgtgaa

SEQ ID NO: 796113 - DNA, 16 bp, Homo sapiens
tgcatttttgtgaaat

SEQ ID NO: 796114 - DNA, 19 bp, Homo sapiens
tgcatttttgtgaaatgaa

SEQ ID NO: 796115 - DNA, 19 bp, Homo sapiens
tgcatttttgttttgaaag

SEQ ID NO: 796116 - DNA, 22 bp, Homo sapiens
tgcatttttgttttgaaagttt

SEQ ID NO: 796117 - DNA, 19 bp, Homo sapiens
tgccaaaaccacatgggct

SEQ ID NO: 796118 - DNA, 19 bp, Homo sapiens
tgccaaaatcattttaatg

SEQ ID NO: 796119 - DNA, 16 bp, Homo sapiens
tgccaaaatgacttta

SEQ ID NO: 796120 - DNA, 23 bp, Homo sapiens
tgccaaaatgttggctgcgtact

SEQ ID NO: 796121 - DNA, 17 bp, Homo sapiens
tgccaaaattcatttct

SEQ ID NO: 796122 - DNA, 19 bp, Homo sapiens
tgccaaagatgtttgaaaa

SEQ ID NO: 796123 - DNA, 21 bp, Homo sapiens
tgccaaagctagggtggccct

SEQ ID NO: 796124 - DNA, 22 bp, Homo sapiens
tgccaaagctagggtggccctt

SEQ ID NO: 796125 - DNA, 16 bp, Homo sapiens
tgccaaagctttacta

SEQ ID NO: 796126 - DNA, 18 bp, Homo sapiens
tgccaaagggaaatatca

SEQ ID NO: 796127 - DNA, 19 bp, Homo sapiens
tgccaaagtacagaatttg

SEQ ID NO: 796128 - DNA, 22 bp, Homo sapiens
tgccaaagtgcctgggaagccc

SEQ ID NO: 796129 - DNA, 21 bp, Homo sapiens
tgccaaagtgtctacatgtgc

SEQ ID NO: 796130 - DNA, 21 bp, Homo sapiens
tgccaaataaatcatcctcat

SEQ ID NO: 796131 - DNA, 16 bp, Homo sapiens
tgccaaataataaaaa

SEQ ID NO: 796132 - DNA, 21 bp, Homo sapiens
tgccaaatagccccagactgg

SEQ ID NO: 796133 - DNA, 14 bp, Homo sapiens
tgccaaatcagttt

SEQ ID NO: 796134 - DNA, 15 bp, Homo sapiens
tgccaaattgagata

SEQ ID NO: 796135 - DNA, 18 bp, Homo sapiens
tgccaaattgtagttctt

SEQ ID NO: 796136 - DNA, 19 bp, Homo sapiens
tgccaacaccttcttggct

SEQ ID NO: 796137 - DNA, 19 bp, Homo sapiens
tgccaaccataccttcctt

SEQ ID NO: 796138 - DNA, 19 bp, Homo sapiens
tgccaaccccacccagctc

SEQ ID NO: 796139 - DNA, 18 bp, Homo sapiens
tgccaacctaaaactctt

SEQ ID NO: 796140 - DNA, 16 bp, Homo sapiens
tgccaacctctggagc

SEQ ID NO: 796141 - DNA, 20 bp, Homo sapiens
tgccaacctgatgccccttc

SEQ ID NO: 796142 - DNA, 22 bp, Homo sapiens
tgccaacctgatgccccttccc

SEQ ID NO: 796143 - DNA, 15 bp, Homo sapiens
tgccaacgcctcctg

SEQ ID NO: 796144 - DNA, 13 bp, Homo sapiens
tgccaactaagcc

SEQ ID NO: 796145 - DNA, 13 bp, Homo sapiens
tgccaactcctca

SEQ ID NO: 796146 - DNA, 21 bp, Homo sapiens
tgccaactgaagccttcttct

SEQ ID NO: 796147 - DNA, 22 bp, Homo sapiens
tgccaactgaagccttcttctg

SEQ ID NO: 796148 - DNA, 15 bp, Homo sapiens
tgccaacttcccaca

SEQ ID NO: 796149 - DNA, 17 bp, Homo sapiens
tgccaacttcccacacg

SEQ ID NO: 796150 - DNA, 22 bp, Homo sapiens
tgccaagacaaatcaacagaag

SEQ ID NO: 796151 - DNA, 17 bp, Homo sapiens
tgccaagagtgaaggga

SEQ ID NO: 796152 - DNA, 19 bp, Homo sapiens
tgccaagattctactcttg

SEQ ID NO: 796153 - DNA, 22 bp, Homo sapiens
tgccaagattctactcttgtca

SEQ ID NO: 796154 - DNA, 14 bp, Homo sapiens
tgccaagcactcga

SEQ ID NO: 796155 - DNA, 13 bp, Homo sapiens
tgccaagccttct

SEQ ID NO: 796156 - DNA, 19 bp, Homo sapiens
tgccaagctaatctgcctg

SEQ ID NO: 796157 - DNA, 15 bp, Homo sapiens
tgccaagctccaagc

SEQ ID NO: 796158 - DNA, 16 bp, Homo sapiens
tgccaagctccaagcc

SEQ ID NO: 796159 - DNA, 23 bp, Homo sapiens
tgccaagctccaagccccatctt

SEQ ID NO: 796160 - DNA, 16 bp, Homo sapiens
tgccaagctgaagcta

SEQ ID NO: 796161 - DNA, 17 bp, Homo sapiens
tgccaagctgaagctac

SEQ ID NO: 796162 - DNA, 15 bp, Homo sapiens
tgccaagcttcctgt

SEQ ID NO: 796163 - DNA, 16 bp, Homo sapiens
tgccaagcttcctgtg

SEQ ID NO: 796164 - DNA, 17 bp, Homo sapiens
tgccaaggcagaggcct

SEQ ID NO: 796165 - DNA, 22 bp, Homo sapiens
tgccaagggcaggaccaatggc

SEQ ID NO: 796166 - DNA, 13 bp, Homo sapiens
tgccaagggcccc

SEQ ID NO: 796167 - DNA, 15 bp, Homo sapiens
tgccaagggccccag

SEQ ID NO: 796168 - DNA, 18 bp, Homo sapiens
tgccaagggccccagggg

SEQ ID NO: 796169 - DNA, 20 bp, Homo sapiens
tgccaaggtggagggaagga

SEQ ID NO: 796170 - DNA, 23 bp, Homo sapiens
tgccaagtcatagccataaatga

SEQ ID NO: 796171 - DNA, 13 bp, Homo sapiens
tgccaagtgccta

SEQ ID NO: 796172 - DNA, 20 bp, Homo sapiens
tgccaagtggacttggagct

SEQ ID NO: 796173 - DNA, 18 bp, Homo sapiens
tgccaataaaagttttct

SEQ ID NO: 796174 - DNA, 15 bp, Homo sapiens
tgccaatatgtattg

SEQ ID NO: 796175 - DNA, 19 bp, Homo sapiens
tgccaatatgtattgtaaa

SEQ ID NO: 796176 - DNA, 21 bp, Homo sapiens
tgccaatattaaatctgctgg

SEQ ID NO: 796177 - DNA, 20 bp, Homo sapiens
tgccaatcggctacccctcg

SEQ ID NO: 796178 - DNA, 21 bp, Homo sapiens
tgccaatgaggtctgaaatgg

SEQ ID NO: 796179 - DNA, 17 bp, Homo sapiens
tgccaatgctacagtaa

SEQ ID NO: 796180 - DNA, 15 bp, Homo sapiens
tgccaatgtgggctg

SEQ ID NO: 796181 - DNA, 21 bp, Homo sapiens
tgccaattattgttacacatt

SEQ ID NO: 796182 - DNA, 15 bp, Homo sapiens
tgccaatttcctctc

SEQ ID NO: 796183 - DNA, 21 bp, Homo sapiens
tgccacaaaccaccaggactg

SEQ ID NO: 796184 - DNA, 16 bp, Homo sapiens
tgccacaacaccagcc

SEQ ID NO: 796185 - DNA, 18 bp, Homo sapiens
tgccacaatgcagttctg

SEQ ID NO: 796186 - DNA, 20 bp, Homo sapiens
tgccacacagagtggtcttt

SEQ ID NO: 796187 - DNA, 21 bp, Homo sapiens
tgccacacagtgacttggccc

SEQ ID NO: 796188 - DNA, 14 bp, Homo sapiens
tgccacaccctccc

SEQ ID NO: 796189 - DNA, 22 bp, Homo sapiens
tgccacaccctcccccgccact

SEQ ID NO: 796190 - DNA, 22 bp, Homo sapiens
tgccacactcagtcccccacca

SEQ ID NO: 796191 - DNA, 14 bp, Homo sapiens
tgccacactctcca

SEQ ID NO: 796192 - DNA, 18 bp, Homo sapiens
tgccacactctccatcac

SEQ ID NO: 796193 - DNA, 16 bp, Homo sapiens
tgccacactgatggct

SEQ ID NO: 796194 - DNA, 14 bp, Homo sapiens
tgccacacttcagg

SEQ ID NO: 796195 - DNA, 16 bp, Homo sapiens
tgccacacttcaggct

SEQ ID NO: 796196 - DNA, 13 bp, Homo sapiens
tgccacagccaga

SEQ ID NO: 796197 - DNA, 13 bp, Homo sapiens
tgccacagcctcc

SEQ ID NO: 796198 - DNA, 17 bp, Homo sapiens
tgccacagcctcccctg

SEQ ID NO: 796199 - DNA, 21 bp, Homo sapiens
tgccagcagcctcgcacaggc

SEQ ID NO: 796200 - DNA, 19 bp, Homo sapiens
tgccagcaggggggctgtg

SEQ ID NO: 796201 - DNA, 22 bp, Homo sapiens
tgccagcaggggggctgtgcca

SEQ ID NO: 796202 - DNA, 11 bp, Homo sapiens
tgccagccagc

SEQ ID NO: 796203 - DNA, 12 bp, Homo sapiens
tgccagccagca

SEQ ID NO: 796204 - DNA, 23 bp, Homo sapiens
tgccagccagcagccagctctca

SEQ ID NO: 796205 - DNA, 20 bp, Homo sapiens
tgccagcccactgcctcctg

SEQ ID NO: 796206 - DNA, 22 bp, Homo sapiens
tgccagccgaccctcctggcct

SEQ ID NO: 796207 - DNA, 11 bp, Homo sapiens
tgccagcctcc

SEQ ID NO: 796208 - DNA, 17 bp, Homo sapiens
tgccagcctccttgctg

SEQ ID NO: 796209 - DNA, 21 bp, Homo sapiens
tgccagcctccttgctgaccc

SEQ ID NO: 796210 - DNA, 17 bp, Homo sapiens
tgccagcctggcttctg

SEQ ID NO: 796211 - DNA, 17 bp, Homo sapiens
tgccagccttcctctgc

SEQ ID NO: 796212 - DNA, 23 bp, Homo sapiens
tgccagccttcctctgcagctga

SEQ ID NO: 796213 - DNA, 21 bp, Homo sapiens
tgccagccttgagccctggct

SEQ ID NO: 796214 - DNA, 15 bp, Homo sapiens
tgccattccactcca

SEQ ID NO: 796215 - DNA, 20 bp, Homo sapiens
tgccattccactccactcag

SEQ ID NO: 796216 - DNA, 17 bp, Homo sapiens
tgccattgcactccagc

SEQ ID NO: 796217 - DNA, 17 bp, Homo sapiens
tgccattggcctcttgt

SEQ ID NO: 796218 - DNA, 20 bp, Homo sapiens
tgccattggcctcttgtccc

SEQ ID NO: 796219 - DNA, 20 bp, Homo sapiens
tgccattgtactccagcctg

SEQ ID NO: 796220 - DNA, 22 bp, Homo sapiens
tgccattgtactccagcctggg

SEQ ID NO: 796221 - DNA, 14 bp, Homo sapiens
tgccatttaaaaag

SEQ ID NO: 796222 - DNA, 18 bp, Homo sapiens
tgccatttgatttttcta

SEQ ID NO: 796223 - DNA, 22 bp, Homo sapiens
tgccatttgcaccctccgcctt

SEQ ID NO: 796224 - DNA, 13 bp, Homo sapiens
tgccatttttcta

SEQ ID NO: 796225 - DNA, 17 bp, Homo sapiens
tgccatttttctataaa

SEQ ID NO: 796226 - DNA, 18 bp, Homo sapiens
tgccatttttctataaat

SEQ ID NO: 796227 - DNA, 21 bp, Homo sapiens
tgccatttttctataaatcag

SEQ ID NO: 796228 - DNA, 23 bp, Homo sapiens
tgcccaaaagaggtgtcatgctt

SEQ ID NO: 796229 - DNA, 13 bp, Homo sapiens
tgcccaaaagcca

SEQ ID NO: 796230 - DNA, 16 bp, Homo sapiens
tgcccaaaagccatgt

SEQ ID NO: 796231 - DNA, 16 bp, Homo sapiens
tgcccaaactcccctt

SEQ ID NO: 796232 - DNA, 23 bp, Homo sapiens
tgcccaaactccccttccctggg

SEQ ID NO: 796233 - DNA, 19 bp, Homo sapiens
tgcccaaagattgatttgt

SEQ ID NO: 796234 - DNA, 18 bp, Homo sapiens
tgcccaaattatgtgaaa

SEQ ID NO: 796235 - DNA, 23 bp, Homo sapiens
tgcccaagaatagatgctgactg

SEQ ID NO: 796236 - DNA, 23 bp, Homo sapiens
tgcccaagataggagttctctga

SEQ ID NO: 796237 - DNA, 18 bp, Homo sapiens
tgcccaagcagcctggag

SEQ ID NO: 796238 - DNA, 14 bp, Homo sapiens
tgcccaagccagag

SEQ ID NO: 796239 - DNA, 11 bp, Homo sapiens
tgcccaaggat

SEQ ID NO: 796240 - DNA, 18 bp, Homo sapiens
tgcccaaggatgccttag

SEQ ID NO: 796241 - DNA, 16 bp, Homo sapiens
tgcccaagtgaccagg

SEQ ID NO: 796242 - DNA, 19 bp, Homo sapiens
tgcccaagtgaccagggaa

SEQ ID NO: 796243 - DNA, 16 bp, Homo sapiens
tgcccaagtgggcagt

SEQ ID NO: 796244 - DNA, 19 bp, Homo sapiens
tgcccaagtgggcagtcac

SEQ ID NO: 796245 - DNA, 21 bp, Homo sapiens
tgcccaatgagactctagggt

SEQ ID NO: 796246 - DNA, 20 bp, Homo sapiens
tgcccacaacttgtcaccca

SEQ ID NO: 796247 - DNA, 21 bp, Homo sapiens
tgcccacaggccgccctgcgg

SEQ ID NO: 796248 - DNA, 16 bp, Homo sapiens
tgcccacatcccaggc

SEQ ID NO: 796249 - DNA, 19 bp, Homo sapiens
tgcccacatgggacctggc

SEQ ID NO: 796250 - DNA, 21 bp, Homo sapiens
tgcccacatttgggctcaggg

SEQ ID NO: 796251 - DNA, 22 bp, Homo sapiens
tgcccacatttgggctcagggt

SEQ ID NO: 796252 - DNA, 12 bp, Homo sapiens
tgcccaccaaag

SEQ ID NO: 796253 - DNA, 23 bp, Homo sapiens
tgcccacccccaccatgcagccc

SEQ ID NO: 796254 - DNA, 14 bp, Homo sapiens
tgcccaccccctca

SEQ ID NO: 796255 - DNA, 24 bp, Homo sapiens
tgcccaccccctcaagccaatccc

SEQ ID NO: 796256 - DNA, 18 bp, Homo sapiens
tgcccaccccctgccctg

SEQ ID NO: 796257 - DNA, 22 bp, Homo sapiens
tgcccacccctcactccccagg

SEQ ID NO: 796258 - DNA, 23 bp, Homo sapiens
tgcccacccctcactccccaggg

SEQ ID NO: 796259 - DNA, 19 bp, Homo sapiens
tgcccacccgtggagatgg

SEQ ID NO: 796260 - DNA, 21 bp, Homo sapiens
tgcccacccgtggagatggga

SEQ ID NO: 796261 - DNA, 18 bp, Homo sapiens
tgcccaccctaccagctc

SEQ ID NO: 796262 - DNA, 23 bp, Homo sapiens
tgcccaccctaccagctcctcca

SEQ ID NO: 796263 - DNA, 13 bp, Homo sapiens
tgcccaccgccct

SEQ ID NO: 796264 - DNA, 14 bp, Homo sapiens
tgcccaccgccctc

SEQ ID NO: 796265 - DNA, 12 bp, Homo sapiens
tgcccacctctc

SEQ ID NO: 796266 - DNA, 16 bp, Homo sapiens
tgcccacctctccctg

SEQ ID NO: 796267 - DNA, 18 bp, Homo sapiens
tgcccacctctccctgca

SEQ ID NO: 796268 - DNA, 15 bp, Homo sapiens
tgcccacctcttctg

SEQ ID NO: 796269 - DNA, 14 bp, Homo sapiens
tgcccacctgccca

SEQ ID NO: 796270 - DNA, 15 bp, Homo sapiens
tgcccacctggggtc

SEQ ID NO: 796271 - DNA, 20 bp, Homo sapiens
tgcccacctggggtctctct

SEQ ID NO: 796272 - DNA, 22 bp, Homo sapiens
tgcccacctggggtctctctcc

SEQ ID NO: 796273 - DNA, 16 bp, Homo sapiens
tgcccacgatcccctc

SEQ ID NO: 796274 - DNA, 21 bp, Homo sapiens
tgcccacgatcccctccccca

SEQ ID NO: 796275 - DNA, 16 bp, Homo sapiens
tgcccacgcagacctg

SEQ ID NO: 796276 - DNA, 16 bp, Homo sapiens
tgcccacgcagaggac

SEQ ID NO: 796277 - DNA, 20 bp, Homo sapiens
tgcccacgcagaggacgcac

SEQ ID NO: 796278 - DNA, 19 bp, Homo sapiens
tgcccactctccatcagat

SEQ ID NO: 796279 - DNA, 21 bp, Homo sapiens
tgcccactggccgctgagcgc

SEQ ID NO: 796280 - DNA, 23 bp, Homo sapiens
tgcccacttagccgtccatggca

SEQ ID NO: 796281 - DNA, 22 bp, Homo sapiens
tgcccacttgattgagaaagat

SEQ ID NO: 796282 - DNA, 13 bp, Homo sapiens
tgcccacttgtca

SEQ ID NO: 796283 - DNA, 17 bp, Homo sapiens
tgcccagaacttccctg

SEQ ID NO: 796284 - DNA, 21 bp, Homo sapiens
tgcccagaataagttattgca

SEQ ID NO: 796285 - DNA, 21 bp, Homo sapiens
tgcccagacacagactggcaa

SEQ ID NO: 796286 - DNA, 13 bp, Homo sapiens
tgcccagactgat

SEQ ID NO: 796287 - DNA, 12 bp, Homo sapiens
tgcccagagatg

SEQ ID NO: 796288 - DNA, 18 bp, Homo sapiens
tgcccagagatgcctcca

SEQ ID NO: 796289 - DNA, 20 bp, Homo sapiens
tgcccagagggcccaggcag

SEQ ID NO: 796290 - DNA, 17 bp, Homo sapiens
tgcccagattcccagac

SEQ ID NO: 796291 - DNA, 20 bp, Homo sapiens
tgcccagattcccagacctt

SEQ ID NO: 796292 - DNA, 14 bp, Homo sapiens
tgcccagcagaggt

SEQ ID NO: 796293 - DNA, 14 bp, Homo sapiens
tgcccagcaggccc

SEQ ID NO: 796294 - DNA, 16 bp, Homo sapiens
tgcccagcaggcccag

SEQ ID NO: 796295 - DNA, 16 bp, Homo sapiens
tgcccagccacccctc

SEQ ID NO: 796296 - DNA, 15 bp, Homo sapiens
tgcccagccactcca

SEQ ID NO: 796297 - DNA, 16 bp, Homo sapiens
tgcccagccactccaa

SEQ ID NO: 796298 - DNA, 17 bp, Homo sapiens
tgcccagccactccaag

SEQ ID NO: 796299 - DNA, 19 bp, Homo sapiens
tgcccagccactccaagcc

SEQ ID NO: 796300 - DNA, 19 bp, Homo sapiens
tgcccagccccgctcaggc

SEQ ID NO: 796301 - DNA, 16 bp, Homo sapiens
tgcccagccccttttc

SEQ ID NO: 796302 - DNA, 17 bp, Homo sapiens
tgcccagccccttttct

SEQ ID NO: 796303 - DNA, 23 bp, Homo sapiens
tgcccagccccttttctctgctc

SEQ ID NO: 796304 - DNA, 19 bp, Homo sapiens
tgcccagccctaaacatca

SEQ ID NO: 796305 - DNA, 12 bp, Homo sapiens
tgcccagcctgt

SEQ ID NO: 796306 - DNA, 14 bp, Homo sapiens
tgcccagctctctg

SEQ ID NO: 796307 - DNA, 16 bp, Homo sapiens
tgcccagctctctgac

SEQ ID NO: 796308 - DNA, 20 bp, Homo sapiens
tgcccagcttgggcccagct

SEQ ID NO: 796309 - DNA, 16 bp, Homo sapiens
tgcccaggagagccag

SEQ ID NO: 796310 - DNA, 18 bp, Homo sapiens
tgcccaggagagccagcc

SEQ ID NO: 796311 - DNA, 20 bp, Homo sapiens
tgcccaggatgacatagcca

SEQ ID NO: 796312 - DNA, 19 bp, Homo sapiens
tgcccaggcccttggctgc

SEQ ID NO: 796313 - DNA, 20 bp, Homo sapiens
tgcccaggcctatctggaag

SEQ ID NO: 796314 - DNA, 14 bp, Homo sapiens
tgcccaggctggag

SEQ ID NO: 796315 - DNA, 17 bp, Homo sapiens
tgcccaggctggtctca

SEQ ID NO: 796316 - DNA, 20 bp, Homo sapiens
tgcccaggctggtcttgaac

SEQ ID NO: 796317 - DNA, 11 bp, Homo sapiens
tgcccagggct

SEQ ID NO: 796318 - DNA, 15 bp, Homo sapiens
tgcccagggctcagc

SEQ ID NO: 796319 - DNA, 11 bp, Homo sapiens
tgcccaggggt

SEQ ID NO: 796320 - DNA, 15 bp, Homo sapiens
tgcccaggggtgccc

SEQ ID NO: 796321 - DNA, 20 bp, Homo sapiens
tgcccaggggtgccccctcc

SEQ ID NO: 796322 - DNA, 17 bp, Homo sapiens
tgcccagggtcctgtgc

SEQ ID NO: 796323 - DNA, 18 bp, Homo sapiens
tgcccagggtcctgtgcc

SEQ ID NO: 796324 - DNA, 23 bp, Homo sapiens
tgcccagggtggctgccagccca

SEQ ID NO: 796325 - DNA, 18 bp, Homo sapiens
tgcccaggtaccaccctt

SEQ ID NO: 796326 - DNA, 16 bp, Homo sapiens
tacagctcattaaact

SEQ ID NO: 796327 - DNA, 16 bp, Homo sapiens
tacagctcccttccct

SEQ ID NO: 796328 - DNA, 21 bp, Homo sapiens
tacagctcttggcattttcct

SEQ ID NO: 796329 - DNA, 14 bp, Homo sapiens
tacagctgcctgca

SEQ ID NO: 796330 - DNA, 11 bp, Homo sapiens
tacagctggct

SEQ ID NO: 796331 - DNA, 12 bp, Homo sapiens
tacagctgtgtt

SEQ ID NO: 796332 - DNA, 14 bp, Homo sapiens
tacagctgtttaag

SEQ ID NO: 796333 - DNA, 14 bp, Homo sapiens
tacagcttcaccct

SEQ ID NO: 796334 - DNA, 15 bp, Homo sapiens
tacagcttcaccctg

SEQ ID NO: 796335 - DNA, 17 bp, Homo sapiens
tacaggaaaaatgaaaa

SEQ ID NO: 796336 - DNA, 21 bp, Homo sapiens
tacaggaagctttttgtatta

SEQ ID NO: 796337 - DNA, 22 bp, Homo sapiens
tacaggactggtactcaagcca

SEQ ID NO: 796338 - DNA, 13 bp, Homo sapiens
tacaggagaggca

SEQ ID NO: 796339 - DNA, 14 bp, Homo sapiens
tacaggagaggcag

SEQ ID NO: 796340 - DNA, 15 bp, Homo sapiens
tacaggagaggcagc

SEQ ID NO: 796341 - DNA, 13 bp, Homo sapiens
tacaggagggccc

SEQ ID NO: 796342 - DNA, 14 bp, Homo sapiens
tacaggcaccgaga

SEQ ID NO: 796343 - DNA, 16 bp, Homo sapiens
tacaggcatgtgccac

SEQ ID NO: 796344 - DNA, 14 bp, Homo sapiens
tacaggccctgctc

SEQ ID NO: 796345 - DNA, 16 bp, Homo sapiens
tacaggccctgctcct

SEQ ID NO: 796346 - DNA, 22 bp, Homo sapiens
tacagggagaaaatccaggtca

SEQ ID NO: 796347 - DNA, 23 bp, Homo sapiens
tacagggagaaaatccaggtcat

SEQ ID NO: 796348 - DNA, 16 bp, Homo sapiens
tacagggagctgggac

SEQ ID NO: 796349 - DNA, 21 bp, Homo sapiens
tacagggcatgcattttgcag

SEQ ID NO: 796350 - DNA, 11 bp, Homo sapiens
tacaggggcca

SEQ ID NO: 796351 - DNA, 19 bp, Homo sapiens
tacaggggccatgccccac

SEQ ID NO: 796352 - DNA, 19 bp, Homo sapiens
tacagggtagataacctgt

SEQ ID NO: 796353 - DNA, 21 bp, Homo sapiens
tacaggttactaccctcaccc

SEQ ID NO: 796354 - DNA, 19 bp, Homo sapiens
tacagtaaccaaaacagca

SEQ ID NO: 796355 - DNA, 23 bp, Homo sapiens
tacagtaactttatgtgtaaata

SEQ ID NO: 796356 - DNA, 21 bp, Homo sapiens
tacagtaagctgctctattgt

SEQ ID NO: 796357 - DNA, 15 bp, Homo sapiens
tacagtaatgtcata

SEQ ID NO: 796358 - DNA, 13 bp, Homo sapiens
tacagtagctgct

SEQ ID NO: 796359 - DNA, 18 bp, Homo sapiens
tacagtaggagcccagct

SEQ ID NO: 796360 - DNA, 20 bp, Homo sapiens
tacagtagtttccctactga

SEQ ID NO: 796361 - DNA, 17 bp, Homo sapiens
tacagtattcttttaaa

SEQ ID NO: 796362 - DNA, 21 bp, Homo sapiens
tacagtatttttctgtgacca

SEQ ID NO: 796363 - DNA, 18 bp, Homo sapiens
tacagtcaagatagaaag

SEQ ID NO: 796364 - DNA, 15 bp, Homo sapiens
tacagtcgtaaaaga

SEQ ID NO: 796365 - DNA, 16 bp, Homo sapiens
tacagtcgtaaaagag

SEQ ID NO: 796366 - DNA, 14 bp, Homo sapiens
tacagtctaaagct

SEQ ID NO: 796367 - DNA, 20 bp, Homo sapiens
tacagtctctttcttccttt

SEQ ID NO: 796368 - DNA, 14 bp, Homo sapiens
tacagtctgtcatg

SEQ ID NO: 796369 - DNA, 15 bp, Homo sapiens
tacagtctgtcatga

SEQ ID NO: 796370 - DNA, 15 bp, Homo sapiens
tacagtcttccacaa

SEQ ID NO: 796371 - DNA, 21 bp, Homo sapiens
tgccacagcctcccctgccag

SEQ ID NO: 796372 - DNA, 16 bp, Homo sapiens
tgccacagcctgctgg

SEQ ID NO: 796373 - DNA, 21 bp, Homo sapiens
tgccacagcctgctggcaggg

SEQ ID NO: 796374 - DNA, 11 bp, Homo sapiens
tgccacagctt

SEQ ID NO: 796375 - DNA, 12 bp, Homo sapiens
tgccacattttc

SEQ ID NO: 796376 - DNA, 14 bp, Homo sapiens
tgccacattttctt

SEQ ID NO: 796377 - DNA, 16 bp, Homo sapiens
tgccaccaacttacaa

SEQ ID NO: 796378 - DNA, 15 bp, Homo sapiens
tgccaccacctctgt

SEQ ID NO: 796379 - DNA, 16 bp, Homo sapiens
tgccaccacctctgtg

SEQ ID NO: 796380 - DNA, 22 bp, Homo sapiens
tgccaccacctctgtggcattg

SEQ ID NO: 796381 - DNA, 21 bp, Homo sapiens
tgccaccacgtctgccaggcc

SEQ ID NO: 796382 - DNA, 20 bp, Homo sapiens
tgccaccactagagctgaga

SEQ ID NO: 796383 - DNA, 13 bp, Homo sapiens
tgccaccaggaga

SEQ ID NO: 796384 - DNA, 14 bp, Homo sapiens
tgccaccaggagaa

SEQ ID NO: 796385 - DNA, 14 bp, Homo sapiens
tgccaccaggccac

SEQ ID NO: 796386 - DNA, 21 bp, Homo sapiens
tgccaccagggagcttcctgg

SEQ ID NO: 796387 - DNA, 23 bp, Homo sapiens
tgccaccagggagcttcctggct

SEQ ID NO: 796388 - DNA, 19 bp, Homo sapiens
tgcccaggtcaccaagcag

SEQ ID NO: 796389 - DNA, 20 bp, Homo sapiens
tgcccaggtggcctcctggc

SEQ ID NO: 796390 - DNA, 19 bp, Homo sapiens
tgcccagtacatttaaatt

SEQ ID NO: 796391 - DNA, 15 bp, Homo sapiens
tgcccagtcctgggt

SEQ ID NO: 796392 - DNA, 18 bp, Homo sapiens
tgcccagtgcaaaccact

SEQ ID NO: 796393 - DNA, 20 bp, Homo sapiens
tgcccagtgcaaaccacttc

SEQ ID NO: 796394 - DNA, 22 bp, Homo sapiens
tgcccagtgttgtttgtaaata

SEQ ID NO: 796395 - DNA, 16 bp, Homo sapiens
tgcccatactgagcct

SEQ ID NO: 796396 - DNA, 17 bp, Homo sapiens
tgcccatactgagcctg

SEQ ID NO: 796397 - DNA, 22 bp, Homo sapiens
tgcccatcagtgacagactgga

SEQ ID NO: 796398 - DNA, 20 bp, Homo sapiens
tgcccatcctgccatcctca

SEQ ID NO: 796399 - DNA, 16 bp, Homo sapiens
tgcccatggctgggaa

SEQ ID NO: 796400 - DNA, 16 bp, Homo sapiens
tgcccatgggagctgg

SEQ ID NO: 796401 - DNA, 18 bp, Homo sapiens
tgcccatgggatatgtgg

SEQ ID NO: 796402 - DNA, 19 bp, Homo sapiens
tgcccatgggatatgtggt

SEQ ID NO: 796403 - DNA, 19 bp, Homo sapiens
tgcccatgtgtacattctg

SEQ ID NO: 796404 - DNA, 14 bp, Homo sapiens
tgcccatgtgtccc

SEQ ID NO: 796405 - DNA, 19 bp, Homo sapiens
tgcccattcaccaaaatta

SEQ ID NO: 796406 - DNA, 23 bp, Homo sapiens
tgcccatttcgaagatatacaaa

SEQ ID NO: 796407 - DNA, 17 bp, Homo sapiens
tgcccatttttgctaat

SEQ ID NO: 796408 - DNA, 20 bp, Homo sapiens
tgccccaaataacttcagtc

SEQ ID NO: 796409 - DNA, 15 bp, Homo sapiens
tgccccaagcagcca

SEQ ID NO: 796410 - DNA, 19 bp, Homo sapiens
tgccccaaggccccaggga

SEQ ID NO: 796411 - DNA, 20 bp, Homo sapiens
tgccccaaggccccagggac

SEQ ID NO: 796412 - DNA, 20 bp, Homo sapiens
tgccccaatcgggtccagag

SEQ ID NO: 796413 - DNA, 22 bp, Homo sapiens
tgccccaatcgggtccagagac

SEQ ID NO: 796414 - DNA, 21 bp, Homo sapiens
tgccccacacggactcccggg

SEQ ID NO: 796415 - DNA, 20 bp, Homo sapiens
tgccccacccaccccacaga

SEQ ID NO: 796416 - DNA, 22 bp, Homo sapiens
tgccccaccccatccagccaga

SEQ ID NO: 796417 - DNA, 20 bp, Homo sapiens
tgccccacccccctcctccc

SEQ ID NO: 796418 - DNA, 23 bp, Homo sapiens
tgccccacccccctcctccccct

SEQ ID NO: 796419 - DNA, 14 bp, Homo sapiens
tgccccacctcccc

SEQ ID NO: 796420 - DNA, 20 bp, Homo sapiens
tgccccacctccccacacac

SEQ ID NO: 796421 - DNA, 19 bp, Homo sapiens
tgccccacctcccgccctc

SEQ ID NO: 796422 - DNA, 23 bp, Homo sapiens
tgccccacgctgtggccctggag

SEQ ID NO: 796423 - DNA, 19 bp, Homo sapiens
tgccccacggagacagagg

SEQ ID NO: 796424 - DNA, 12 bp, Homo sapiens
tgccccactcct

SEQ ID NO: 796425 - DNA, 16 bp, Homo sapiens
tgccccactctgcctg

SEQ ID NO: 796426 - DNA, 16 bp, Homo sapiens
tgccccagaaagggga

SEQ ID NO: 796427 - DNA, 18 bp, Homo sapiens
tgccccagactgagctct

SEQ ID NO: 796428 - DNA, 13 bp, Homo sapiens
tgccccagagctg

SEQ ID NO: 796429 - DNA, 17 bp, Homo sapiens
tgccccagagctgttta

SEQ ID NO: 796430 - DNA, 12 bp, Homo sapiens
tgccccagccag

SEQ ID NO: 796431 - DNA, 12 bp, Homo sapiens
tgccccagcccc

SEQ ID NO: 796432 - DNA, 14 bp, Homo sapiens
tgccccagccccta

SEQ ID NO: 796433 - DNA, 17 bp, Homo sapiens
tgccccagcgtcttgac

SEQ ID NO: 796434 - DNA, 20 bp, Homo sapiens
tgccccagctgactgtggcc

SEQ ID NO: 796435 - DNA, 12 bp, Homo sapiens
tgccccaggcca

SEQ ID NO: 796436 - DNA, 15 bp, Homo sapiens
tgccccaggccctac

SEQ ID NO: 796437 - DNA, 13 bp, Homo sapiens
tgccccaggccgg

SEQ ID NO: 796438 - DNA, 14 bp, Homo sapiens
tgccccaggccgga

SEQ ID NO: 796439 - DNA, 13 bp, Homo sapiens
tgccccaggcctg

SEQ ID NO: 796440 - DNA, 14 bp, Homo sapiens
tgccccaggcctgg

SEQ ID NO: 796441 - DNA, 18 bp, Homo sapiens
tgccccagggagtccagg

SEQ ID NO: 796442 - DNA, 15 bp, Homo sapiens
tgccccagggctccc

SEQ ID NO: 796443 - DNA, 21 bp, Homo sapiens
tgccccagtcggccccatctc

SEQ ID NO: 796444 - DNA, 18 bp, Homo sapiens
tgccccatcactgcgcca

SEQ ID NO: 796445 - DNA, 15 bp, Homo sapiens
tgccccattccttgc

SEQ ID NO: 796446 - DNA, 19 bp, Homo sapiens
tgcccccactgtcccccta

SEQ ID NO: 796447 - DNA, 21 bp, Homo sapiens
tgcccccagagtgtagggggc

SEQ ID NO: 796448 - DNA, 17 bp, Homo sapiens
tgcccccatccagccac

SEQ ID NO: 796449 - DNA, 14 bp, Homo sapiens
tgcccccatccctc

SEQ ID NO: 796450 - DNA, 18 bp, Homo sapiens
tgcccccatctccccagg

SEQ ID NO: 796451 - DNA, 22 bp, Homo sapiens
tgcccccatctccccaggcctc

SEQ ID NO: 796452 - DNA, 17 bp, Homo sapiens
tgcccccattctcccag

SEQ ID NO: 796453 - DNA, 18 bp, Homo sapiens
tgcccccattctcccagt

SEQ ID NO: 796454 - DNA, 20 bp, Homo sapiens
tgcccccattctcccagtct

SEQ ID NO: 796455 - DNA, 17 bp, Homo sapiens
tgcccccatttcaccca

SEQ ID NO: 796456 - DNA, 16 bp, Homo sapiens
tgccccccaccccagc

SEQ ID NO: 796457 - DNA, 12 bp, Homo sapiens
tgccccccagcc

SEQ ID NO: 796458 - DNA, 14 bp, Homo sapiens
tgccccccagcctc

SEQ ID NO: 796459 - DNA, 15 bp, Homo sapiens
tgccccccagcctct

SEQ ID NO: 796460 - DNA, 19 bp, Homo sapiens
tgccccccagcctctggca

SEQ ID NO: 796461 - DNA, 12 bp, Homo sapiens
tgccccccaggg

SEQ ID NO: 796462 - DNA, 13 bp, Homo sapiens
tgccccccagggc

SEQ ID NO: 796463 - DNA, 14 bp, Homo sapiens
tgccccccagggct

SEQ ID NO: 796464 - DNA, 16 bp, Homo sapiens
tgccccccagggctag

SEQ ID NO: 796465 - DNA, 23 bp, Homo sapiens
tgccccccatgaggaaggaacag

SEQ ID NO: 796466 - DNA, 19 bp, Homo sapiens
tgccccccgaggctgctag

SEQ ID NO: 796467 - DNA, 15 bp, Homo sapiens
tgccccccgccctca

SEQ ID NO: 796468 - DNA, 23 bp, Homo sapiens
tgcccccctcaaacctcctcttc

SEQ ID NO: 796469 - DNA, 13 bp, Homo sapiens
tgcccccctcctc

SEQ ID NO: 796470 - DNA, 15 bp, Homo sapiens
tgcccccctcctcca

SEQ ID NO: 796471 - DNA, 19 bp, Homo sapiens
tgcccccgacggctgtgac

SEQ ID NO: 796472 - DNA, 14 bp, Homo sapiens
tgcccccgcctgcc

SEQ ID NO: 796473 - DNA, 17 bp, Homo sapiens
tgcccccgcctgccacc

SEQ ID NO: 796474 - DNA, 18 bp, Homo sapiens
tgcccccgcgggttctag

SEQ ID NO: 796475 - DNA, 21 bp, Homo sapiens
tgcccccgctcccgctcccag

SEQ ID NO: 796476 - DNA, 16 bp, Homo sapiens
tgcccccgcttagccc

SEQ ID NO: 796477 - DNA, 23 bp, Homo sapiens
tgccccctatcttgtcctggaat

SEQ ID NO: 796478 - DNA, 13 bp, Homo sapiens
tgccccctccagg

SEQ ID NO: 796479 - DNA, 23 bp, Homo sapiens
tgccccctccaggagagagccag

SEQ ID NO: 796480 - DNA, 17 bp, Homo sapiens
tgccccctcccaccctg

SEQ ID NO: 796481 - DNA, 14 bp, Homo sapiens
tgccccctccccca

SEQ ID NO: 796482 - DNA, 20 bp, Homo sapiens
tgccccctcccccatgggct

SEQ ID NO: 796483 - DNA, 21 bp, Homo sapiens
tgccccctcccccatgggctg

SEQ ID NO: 796484 - DNA, 13 bp, Homo sapiens
tgccccctccctt

SEQ ID NO: 796485 - DNA, 16 bp, Homo sapiens
tgccccctcccttcac

SEQ ID NO: 796486 - DNA, 12 bp, Homo sapiens
tgccccctcctc

SEQ ID NO: 796487 - DNA, 14 bp, Homo sapiens
tgccccctcctctc

SEQ ID NO: 796488 - DNA, 21 bp, Homo sapiens
tgccccctcgggggcctgtgg

SEQ ID NO: 796489 - DNA, 12 bp, Homo sapiens
tgccccctgcca

SEQ ID NO: 796490 - DNA, 15 bp, Homo sapiens
tgccccctgccagcc

SEQ ID NO: 796491 - DNA, 16 bp, Homo sapiens
tgccccctgggctggg

SEQ ID NO: 796492 - DNA, 17 bp, Homo sapiens
tgcccccttccccagcc

SEQ ID NO: 796493 - DNA, 20 bp, Homo sapiens
tgcccccttccccagccctt

SEQ ID NO: 796494 - DNA, 13 bp, Homo sapiens
tgcccccttctcc

SEQ ID NO: 796495 - DNA, 16 bp, Homo sapiens
tgcccccttctcccac

SEQ ID NO: 796496 - DNA, 17 bp, Homo sapiens
tgcccccttctcccaca

SEQ ID NO: 796497 - DNA, 19 bp, Homo sapiens
tgcccccttctcccacact

SEQ ID NO: 796498 - DNA, 22 bp, Homo sapiens
tgcccccttctcccacactgct

SEQ ID NO: 796499 - DNA, 19 bp, Homo sapiens
tgcccccttgcccatcagc

SEQ ID NO: 796500 - DNA, 16 bp, Homo sapiens
tgccccctttcagatg

SEQ ID NO: 796501 - DNA, 23 bp, Homo sapiens
tgccccctttcagatgtcttctg

SEQ ID NO: 796502 - DNA, 19 bp, Homo sapiens
tgccccctttgaccttccc

SEQ ID NO: 796503 - DNA, 19 bp, Homo sapiens
tgccccgaatttagtcaca

SEQ ID NO: 796504 - DNA, 16 bp, Homo sapiens
tgccccgccccccaga

SEQ ID NO: 796505 - DNA, 17 bp, Homo sapiens
tgccccgccccccagag

SEQ ID NO: 796506 - DNA, 20 bp, Homo sapiens
tgccccgccccccagagcca

SEQ ID NO: 796507 - DNA, 21 bp, Homo sapiens
tgccccgccccccagagccag

SEQ ID NO: 796508 - DNA, 20 bp, Homo sapiens
tgccccgccttcgtgtgctg

SEQ ID NO: 796509 - DNA, 15 bp, Homo sapiens
tgccccgcgggcttt

SEQ ID NO: 796510 - DNA, 22 bp, Homo sapiens
tgccccggacctacctccctcc

SEQ ID NO: 796511 - DNA, 17 bp, Homo sapiens
tgccccggcccctcccc

SEQ ID NO: 796512 - DNA, 13 bp, Homo sapiens
tgcctctgacagc

SEQ ID NO: 796513 - DNA, 22 bp, Homo sapiens
tgcctctgacagcagcctgtga

SEQ ID NO: 796514 - DNA, 21 bp, Homo sapiens
tgcctctgacagtccacaggg

SEQ ID NO: 796515 - DNA, 14 bp, Homo sapiens
tgcctctgcctgtc

SEQ ID NO: 796516 - DNA, 14 bp, Homo sapiens
tgcctctgctccct

SEQ ID NO: 796517 - DNA, 19 bp, Homo sapiens
tgcctctggaggcctctgg

SEQ ID NO: 796518 - DNA, 13 bp, Homo sapiens
tgcctctgggcag

SEQ ID NO: 796519 - DNA, 14 bp, Homo sapiens
tgcctctgggcagc

SEQ ID NO: 796520 - DNA, 17 bp, Homo sapiens
tgcctctgggcagcctg

SEQ ID NO: 796521 - DNA, 14 bp, Homo sapiens
tgcctctgggccat

SEQ ID NO: 796522 - DNA, 11 bp, Homo sapiens
tgcctctgtgc

SEQ ID NO: 796523 - DNA, 12 bp, Homo sapiens
tgcctctgtgca

SEQ ID NO: 796524 - DNA, 12 bp, Homo sapiens
tgcctctgtgct

SEQ ID NO: 796525 - DNA, 14 bp, Homo sapiens
tgcctctgtgctgt

SEQ ID NO: 796526 - DNA, 17 bp, Homo sapiens
tgcctctgtgctgtgtg

SEQ ID NO: 796527 - DNA, 21 bp, Homo sapiens
tgcctctgtgctgtgtgtgac

SEQ ID NO: 796528 - DNA, 22 bp, Homo sapiens
tgcctctgtgtagccgccctga

SEQ ID NO: 796529 - DNA, 23 bp, Homo sapiens
tgcctctgtgtagccgccctgag

SEQ ID NO: 796530 - DNA, 12 bp, Homo sapiens
tgcctcttccag

SEQ ID NO: 796531 - DNA, 21 bp, Homo sapiens
tgcctcttctcttgacagtct

SEQ ID NO: 796532 - DNA, 20 bp, Homo sapiens
tgcctcttctgggagggcag

SEQ ID NO: 796533 - DNA, 24 bp, Homo sapiens
tgcctcttggcttctcagcccctt

SEQ ID NO: 796534 - DNA, 14 bp, Homo sapiens
tgcctcttgttgca

SEQ ID NO: 796535 - DNA, 11 bp, Homo sapiens
tgcctctttcc

SEQ ID NO: 796536 - DNA, 18 bp, Homo sapiens
tgcctctttcctgttgtt

SEQ ID NO: 796537 - DNA, 14 bp, Homo sapiens
tgcctgaaacagcc

SEQ ID NO: 796538 - DNA, 20 bp, Homo sapiens
tgcctgaaacagccatgtcc

SEQ ID NO: 796539 - DNA, 14 bp, Homo sapiens
tgcctgaactccag

SEQ ID NO: 796540 - DNA, 13 bp, Homo sapiens
tgcctgaagaaca

SEQ ID NO: 796541 - DNA, 19 bp, Homo sapiens
tgcctgaagttggagtgag

SEQ ID NO: 796542 - DNA, 18 bp, Homo sapiens
tgcctgacactgagcccc

SEQ ID NO: 796543 - DNA, 14 bp, Homo sapiens
tgcctgacagcctt

SEQ ID NO: 796544 - DNA, 18 bp, Homo sapiens
tgcctgacatttggagtg

SEQ ID NO: 796545 - DNA, 18 bp, Homo sapiens
tgcctgacccatcccttt

SEQ ID NO: 796546 - DNA, 22 bp, Homo sapiens
tgcctgactaatttttgtattt

SEQ ID NO: 796547 - DNA, 22 bp, Homo sapiens
tgcctgagaagaagtggctgcc

SEQ ID NO: 796548 - DNA, 14 bp, Homo sapiens
tgcctgagaggcag

SEQ ID NO: 796549 - DNA, 17 bp, Homo sapiens
tgcctgagaggcaggca

SEQ ID NO: 796550 - DNA, 18 bp, Homo sapiens
tgcctgagaggcaggcat

SEQ ID NO: 796551 - DNA, 15 bp, Homo sapiens
tgcctgagctgggga

SEQ ID NO: 796552 - DNA, 16 bp, Homo sapiens
tgcctgagctggggaa

SEQ ID NO: 796553 - DNA, 11 bp, Homo sapiens
tgcctgaggag

SEQ ID NO: 796554 - DNA, 13 bp, Homo sapiens
tgcctgaggagga

SEQ ID NO: 796555 - DNA, 14 bp, Homo sapiens
tgcctgagggcagt

SEQ ID NO: 796556 - DNA, 16 bp, Homo sapiens
tgcctgagggcccctc

SEQ ID NO: 796557 - DNA, 17 bp, Homo sapiens
tgcctgagggcccctct

SEQ ID NO: 796558 - DNA, 19 bp, Homo sapiens
tgcctgagggcgaggggag

SEQ ID NO: 796559 - DNA, 14 bp, Homo sapiens
tgcctgatataaat

SEQ ID NO: 796560 - DNA, 18 bp, Homo sapiens
tgcctgatcctccaacag

SEQ ID NO: 796561 - DNA, 13 bp, Homo sapiens
tgcctgcacctcc

SEQ ID NO: 796562 - DNA, 21 bp, Homo sapiens
tgcctgcacctccgcgggctg

SEQ ID NO: 796563 - DNA, 21 bp, Homo sapiens
tgcctgcactgggaaggaaac

SEQ ID NO: 796564 - DNA, 20 bp, Homo sapiens
tgcctgcagaggtctgtgct

SEQ ID NO: 796565 - DNA, 17 bp, Homo sapiens
tgcctgcagcgcctccc

SEQ ID NO: 796566 - DNA, 21 bp, Homo sapiens
tgcctgcaggtcagttgtaat

SEQ ID NO: 796567 - DNA, 22 bp, Homo sapiens
tgcctgcaggtcagttgtaata

SEQ ID NO: 796568 - DNA, 14 bp, Homo sapiens
tgcctgcagtttct

SEQ ID NO: 796569 - DNA, 23 bp, Homo sapiens
tgcctgcataggagtttggagga

SEQ ID NO: 796570 - DNA, 15 bp, Homo sapiens
tgcctgccactctct

SEQ ID NO: 796571 - DNA, 16 bp, Homo sapiens
tgcctgccactctctg

SEQ ID NO: 796572 - DNA, 13 bp, Homo sapiens
tgcctgcccaccc

SEQ ID NO: 796573 - DNA, 14 bp, Homo sapiens
tgcctgccccacac

SEQ ID NO: 796574 - DNA, 22 bp, Homo sapiens
tgcctgccccccagtctcccca

SEQ ID NO: 796575 - DNA, 17 bp, Homo sapiens
tgcctgccccgccccca

SEQ ID NO: 796576 - DNA, 22 bp, Homo sapiens
tgcctgcccctaccctggactt

SEQ ID NO: 796577 - DNA, 11 bp, Homo sapiens
tgcctgccctg

SEQ ID NO: 796578 - DNA, 13 bp, Homo sapiens
tgcctgccctgcc

SEQ ID NO: 796579 - DNA, 21 bp, Homo sapiens
tgcctgccctgcctcagccag

SEQ ID NO: 796580 - DNA, 16 bp, Homo sapiens
tgcctgccgcccaaag

SEQ ID NO: 796581 - DNA, 13 bp, Homo sapiens
tgcctgccgctgc

SEQ ID NO: 796582 - DNA, 15 bp, Homo sapiens
tgcctgccgctgcac

SEQ ID NO: 796583 - DNA, 16 bp, Homo sapiens
tgcctgccgctgcacc

SEQ ID NO: 796584 - DNA, 19 bp, Homo sapiens
tgcctgccgctgcacctgc

SEQ ID NO: 796585 - DNA, 14 bp, Homo sapiens
tgcctgcctccacc

SEQ ID NO: 796586 - DNA, 15 bp, Homo sapiens
tgcctgcctccaccc

SEQ ID NO: 796587 - DNA, 14 bp, Homo sapiens
tgcctgcgcctgct

SEQ ID NO: 796588 - DNA, 16 bp, Homo sapiens
tgcctgcgcctgctgc

SEQ ID NO: 796589 - DNA, 16 bp, Homo sapiens
tgcctgcgtcttccgc

SEQ ID NO: 796590 - DNA, 18 bp, Homo sapiens
tgcctgcgtcttccgccc

SEQ ID NO: 796591 - DNA, 19 bp, Homo sapiens
tgcctgcgtgggtgtgtgc

SEQ ID NO: 796592 - DNA, 12 bp, Homo sapiens
tgcctgctagag

SEQ ID NO: 796593 - DNA, 15 bp, Homo sapiens
tgcctgctcagcagc

SEQ ID NO: 796594 - DNA, 19 bp, Homo sapiens
tgcctgctcagcagccagt

SEQ ID NO: 796595 - DNA, 21 bp, Homo sapiens
tgcctgctcagcagccagtct

SEQ ID NO: 796596 - DNA, 23 bp, Homo sapiens
tgcctgctcagcagccagtctca

SEQ ID NO: 796597 - DNA, 13 bp, Homo sapiens
tgcctgctcctgt

SEQ ID NO: 796598 - DNA, 16 bp, Homo sapiens
tgcctgctccttggca

SEQ ID NO: 796599 - DNA, 19 bp, Homo sapiens
tgcctgcttctgtgtacca

SEQ ID NO: 796600 - DNA, 15 bp, Homo sapiens
tgcctgctttttgga

SEQ ID NO: 796601 - DNA, 17 bp, Homo sapiens
tgcctgctttttggaaa

SEQ ID NO: 796602 - DNA, 15 bp, Homo sapiens
tgcctggacaaaccc

SEQ ID NO: 796603 - DNA, 20 bp, Homo sapiens
tgcctggagacaaggtgcta

SEQ ID NO: 796604 - DNA, 21 bp, Homo sapiens
tgcctggagggtaactggggg

SEQ ID NO: 796605 - DNA, 22 bp, Homo sapiens
tgcctggagtgtcggatcctgt

SEQ ID NO: 796606 - DNA, 21 bp, Homo sapiens
tgcctggatgaggcacttctg

SEQ ID NO: 796607 - DNA, 22 bp, Homo sapiens
tgcctggatgggggtgcaggca

SEQ ID NO: 796608 - DNA, 17 bp, Homo sapiens
tgcctggcacagaccag

SEQ ID NO: 796609 - DNA, 23 bp, Homo sapiens
tgcctggcaggctgtctggccag

SEQ ID NO: 796610 - DNA, 17 bp, Homo sapiens
tgcctggccagattttt

SEQ ID NO: 796611 - DNA, 14 bp, Homo sapiens
tgcctggccaggca

SEQ ID NO: 796612 - DNA, 16 bp, Homo sapiens
tgcctggccaggcaga

SEQ ID NO: 796613 - DNA, 13 bp, Homo sapiens
tgcctggccatgc

SEQ ID NO: 796614 - DNA, 21 bp, Homo sapiens
tgcctggcccattcttgagtt

SEQ ID NO: 796615 - DNA, 11 bp, Homo sapiens
tgcctggcccc

SEQ ID NO: 796616 - DNA, 17 bp, Homo sapiens
tgcctggccccagcctg

SEQ ID NO: 796617 - DNA, 19 bp, Homo sapiens
tgcctggccccagcctggg

SEQ ID NO: 796618 - DNA, 21 bp, Homo sapiens
tgcctggcccctcgcctgtgg

SEQ ID NO: 796619 - DNA, 16 bp, Homo sapiens
tgcctggccctcccca

SEQ ID NO: 796620 - DNA, 18 bp, Homo sapiens
tgcctggccctccccaca

SEQ ID NO: 796621 - DNA, 21 bp, Homo sapiens
tgcctggccgcagggcggggc

SEQ ID NO: 796622 - DNA, 18 bp, Homo sapiens
tgcctggctgtggaggcc

SEQ ID NO: 796623 - DNA, 20 bp, Homo sapiens
tgcctggctgtggaggcctg

SEQ ID NO: 796624 - DNA, 15 bp, Homo sapiens
tgcctgggaatgtat

SEQ ID NO: 796625 - DNA, 20 bp, Homo sapiens
tgcctgggatcgtgcatttg

SEQ ID NO: 796626 - DNA, 22 bp, Homo sapiens
tgcctgggcccctcccctcaga

SEQ ID NO: 796627 - DNA, 15 bp, Homo sapiens
tgcctgggccctggg

SEQ ID NO: 796628 - DNA, 21 bp, Homo sapiens
tgcctgggccgtggcacagct

SEQ ID NO: 796629 - DNA, 15 bp, Homo sapiens
tgcctgggcctgtgc

SEQ ID NO: 796630 - DNA, 16 bp, Homo sapiens
tgcctgggcctgtgca

SEQ ID NO: 796631 - DNA, 19 bp, Homo sapiens
tgcctgggccttggctggg

SEQ ID NO: 796632 - DNA, 22 bp, Homo sapiens
tgcctgggctcccttgtgcgtg

SEQ ID NO: 796633 - DNA, 17 bp, Homo sapiens
tgcctgggctgggcagc

SEQ ID NO: 796634 - DNA, 19 bp, Homo sapiens
tgcctgggctgggcagcct

SEQ ID NO: 796635 - DNA, 17 bp, Homo sapiens
tgcctgggctgttggca

SEQ ID NO: 796636 - DNA, 11 bp, Homo sapiens
tgcctggggcc

SEQ ID NO: 796637 - DNA, 17 bp, Homo sapiens
tgcctggggcctccaga

SEQ ID NO: 796638 - DNA, 22 bp, Homo sapiens
tgcctggggcctccagaagctg

SEQ ID NO: 796639 - DNA, 23 bp, Homo sapiens
tgcctggggcctccagaagctgc

SEQ ID NO: 796640 - DNA, 19 bp, Homo sapiens
tgcctgggggagttttcct

SEQ ID NO: 796641 - DNA, 21 bp, Homo sapiens
tgcctggggtggcctggccct

SEQ ID NO: 796642 - DNA, 22 bp, Homo sapiens
tgcctggggtggcctggccctc

SEQ ID NO: 796643 - DNA, 17 bp, Homo sapiens
tgcctgggtggccatcc

SEQ ID NO: 796644 - DNA, 15 bp, Homo sapiens
tgcctggtacagtat

SEQ ID NO: 796645 - DNA, 17 bp, Homo sapiens
tgcctggtactctggca

SEQ ID NO: 796646 - DNA, 19 bp, Homo sapiens
tgcctggtactctggcaaa

SEQ ID NO: 796647 - DNA, 13 bp, Homo sapiens
tgcctggtatttt

SEQ ID NO: 796648 - DNA, 12 bp, Homo sapiens
tgcctggtgggg

SEQ ID NO: 796649 - DNA, 23 bp, Homo sapiens
tgcctggtgggggaaggggagga

SEQ ID NO: 796650 - DNA, 13 bp, Homo sapiens
tgcctgtaaacat

SEQ ID NO: 796651 - DNA, 16 bp, Homo sapiens
tgcctgtaatcttttt

SEQ ID NO: 796652 - DNA, 19 bp, Homo sapiens
tgcctgtaatctttttctc

SEQ ID NO: 796653 - DNA, 20 bp, Homo sapiens
tgcctgtaatctttttctcc

SEQ ID NO: 796654 - DNA, 21 bp, Homo sapiens
tgcctgtagcaatggccagag

SEQ ID NO: 796655 - DNA, 13 bp, Homo sapiens
tgcctgtagtgcc

SEQ ID NO: 796656 - DNA, 13 bp, Homo sapiens
tgcctgtagttag

SEQ ID NO: 796657 - DNA, 20 bp, Homo sapiens
tgcctgtagttaggaaataa

SEQ ID NO: 796658 - DNA, 14 bp, Homo sapiens
tgcctgtattttcg

SEQ ID NO: 796659 - DNA, 18 bp, Homo sapiens
tgcctgtcacctgggagg

SEQ ID NO: 796660 - DNA, 16 bp, Homo sapiens
tgcctgtccagcctgg

SEQ ID NO: 796661 - DNA, 19 bp, Homo sapiens
tgcctgtccagcctgggca

SEQ ID NO: 796662 - DNA, 20 bp, Homo sapiens
tgcctgtccagcctgggcag

SEQ ID NO: 796663 - DNA, 16 bp, Homo sapiens
tgcctgtcccaccccc

SEQ ID NO: 796664 - DNA, 17 bp, Homo sapiens
tgcctgtccccatgctt

SEQ ID NO: 796665 - DNA, 15 bp, Homo sapiens
tgcctgtctctgttc

SEQ ID NO: 796666 - DNA, 14 bp, Homo sapiens
tgcctgtctgcccc

SEQ ID NO: 796667 - DNA, 16 bp, Homo sapiens
tgcctgtctggtgcct

SEQ ID NO: 796668 - DNA, 21 bp, Homo sapiens
tgcctgtctgtctctccatct

SEQ ID NO: 796669 - DNA, 18 bp, Homo sapiens
tgcctgtctgttacactg

SEQ ID NO: 796670 - DNA, 16 bp, Homo sapiens
tgcctgtgaagcagtc

SEQ ID NO: 796671 - DNA, 14 bp, Homo sapiens
tgcctgtgccaata

SEQ ID NO: 796672 - DNA, 17 bp, Homo sapiens
tgcctgtgccatgccca

SEQ ID NO: 796673 - DNA, 14 bp, Homo sapiens
tgcctgtgcccgca

SEQ ID NO: 796674 - DNA, 22 bp, Homo sapiens
tgcctgtgcccgcatgtgtgcc

SEQ ID NO: 796675 - DNA, 14 bp, Homo sapiens
tgcctgtgggaggg

SEQ ID NO: 796676 - DNA, 17 bp, Homo sapiens
tgcctgtgggaggggga

SEQ ID NO: 796677 - DNA, 22 bp, Homo sapiens
tgcctgtgtccatgcgctcagg

SEQ ID NO: 796678 - DNA, 15 bp, Homo sapiens
tgcctgttaaatata

SEQ ID NO: 796679 - DNA, 15 bp, Homo sapiens
tgcctgttaatttat

SEQ ID NO: 796680 - DNA, 19 bp, Homo sapiens
tgcctgttataactctgca

SEQ ID NO: 796681 - DNA, 14 bp, Homo sapiens
tgcctgttcccatt

SEQ ID NO: 796682 - DNA, 20 bp, Homo sapiens
tgcctgttgctttcttcctg

SEQ ID NO: 796683 - DNA, 15 bp, Homo sapiens
tgcctgttggcaggc

SEQ ID NO: 796684 - DNA, 20 bp, Homo sapiens
tgcctgttggcaggcccact

SEQ ID NO: 796685 - DNA, 23 bp, Homo sapiens
tgcctgttggcaggcccactccc

SEQ ID NO: 796686 - DNA, 14 bp, Homo sapiens
tgcctgtttcccag

SEQ ID NO: 796687 - DNA, 19 bp, Homo sapiens
tgcctgtttcccaggccca

SEQ ID NO: 796688 - DNA, 17 bp, Homo sapiens
tgccttaaaaggagaga

SEQ ID NO: 796689 - DNA, 14 bp, Homo sapiens
tgccttaaacctga

SEQ ID NO: 796690 - DNA, 16 bp, Homo sapiens
tgccttaaacctgaag

SEQ ID NO: 796691 - DNA, 12 bp, Homo sapiens
tgccttaagcag

SEQ ID NO: 796692 - DNA, 19 bp, Homo sapiens
tgccttaagcagaacaaat

SEQ ID NO: 796693 - DNA, 20 bp, Homo sapiens
tgccttaagcagaacaaatg

SEQ ID NO: 796694 - DNA, 20 bp, Homo sapiens
tgccttaataaaaaatgaaa

SEQ ID NO: 796695 - DNA, 13 bp, Homo sapiens
tgccttaataaat

SEQ ID NO: 796696 - DNA, 20 bp, Homo sapiens
tgccttaataaatatgtaat

SEQ ID NO: 796697 - DNA, 23 bp, Homo sapiens
tgccttaataagaatggttgcct

SEQ ID NO: 796698 - DNA, 18 bp, Homo sapiens
tgccttacatcttttcta

SEQ ID NO: 796699 - DNA, 20 bp, Homo sapiens
tgccttacatcttttctaat

SEQ ID NO: 796700 - DNA, 22 bp, Homo sapiens
tgccttaccaagttgtgctttt

SEQ ID NO: 796701 - DNA, 20 bp, Homo sapiens
tgccttaccctcatgttctt

SEQ ID NO: 796702 - DNA, 14 bp, Homo sapiens
tgccttacctcctg

SEQ ID NO: 796703 - DNA, 15 bp, Homo sapiens
tgccttacctcctgc

SEQ ID NO: 796704 - DNA, 19 bp, Homo sapiens
tgccttacctcctgcccag

SEQ ID NO: 796705 - DNA, 18 bp, Homo sapiens
tgccttactcttcttgaa

SEQ ID NO: 796706 - DNA, 14 bp, Homo sapiens
tgccttagaacctt

SEQ ID NO: 796707 - DNA, 22 bp, Homo sapiens
tgccttagcaatgggggcctcc

SEQ ID NO: 796708 - DNA, 14 bp, Homo sapiens
tgccttagcctctt

SEQ ID NO: 796709 - DNA, 21 bp, Homo sapiens
tgccttaggcctacctgatgg

SEQ ID NO: 796710 - DNA, 15 bp, Homo sapiens
tgccttagtctcagt

SEQ ID NO: 796711 - DNA, 20 bp, Homo sapiens
tgccttagtctcagtttgtg

SEQ ID NO: 796712 - DNA, 17 bp, Homo sapiens
tgccttatgttgaaaaa

SEQ ID NO: 796713 - DNA, 15 bp, Homo sapiens
tgccttatttgtctg

SEQ ID NO: 796714 - DNA, 23 bp, Homo sapiens
tgccttatttgtctgtaaaaaat

SEQ ID NO: 796715 - DNA, 19 bp, Homo sapiens
tgccttcaaggactgtttc

SEQ ID NO: 796716 - DNA, 19 bp, Homo sapiens
tgccttcagctagaatcct

SEQ ID NO: 796717 - DNA, 17 bp, Homo sapiens
tgccttcaggcttctgt

SEQ ID NO: 796718 - DNA, 14 bp, Homo sapiens
tgccttcagggaga

SEQ ID NO: 796719 - DNA, 14 bp, Homo sapiens
tgccttccacgctg

SEQ ID NO: 796720 - DNA, 17 bp, Homo sapiens
tgccttccacgctgtct

SEQ ID NO: 796721 - DNA, 20 bp, Homo sapiens
tgccttccacgctgtctcca

SEQ ID NO: 796722 - DNA, 17 bp, Homo sapiens
tgccttccagcccagac

SEQ ID NO: 796723 - DNA, 21 bp, Homo sapiens
tgccttccataattatgacag

SEQ ID NO: 796724 - DNA, 14 bp, Homo sapiens
tgccttccctagct

SEQ ID NO: 796725 - DNA, 16 bp, Homo sapiens
tgccttccctagcttt

SEQ ID NO: 796726 - DNA, 13 bp, Homo sapiens
tgccttcctcctt

SEQ ID NO: 796727 - DNA, 14 bp, Homo sapiens
tgccttcctcctta

SEQ ID NO: 796728 - DNA, 20 bp, Homo sapiens
tgccttcctcgtgcagagct

SEQ ID NO: 796729 - DNA, 22 bp, Homo sapiens
tgccttcctcgtgcagagctgg

SEQ ID NO: 796730 - DNA, 21 bp, Homo sapiens
tgccttcctctctctaccagt

SEQ ID NO: 796731 - DNA, 14 bp, Homo sapiens
tgccttcctctgag

SEQ ID NO: 796732 - DNA, 16 bp, Homo sapiens
tgccttcctctgagga

SEQ ID NO: 796733 - DNA, 15 bp, Homo sapiens
tgccttcctgttttt

SEQ ID NO: 796734 - DNA, 19 bp, Homo sapiens
tgccttcctgtttttcaca

SEQ ID NO: 796735 - DNA, 16 bp, Homo sapiens
tgccttcctttctcca

SEQ ID NO: 796736 - DNA, 19 bp, Homo sapiens
tgccttcctttctccagga

SEQ ID NO: 796737 - DNA, 20 bp, Homo sapiens
tgccttcctttctccaggac

SEQ ID NO: 796738 - DNA, 23 bp, Homo sapiens
tgccttcctttctccaggaccaa

SEQ ID NO: 796739 - DNA, 16 bp, Homo sapiens
tgccttctaaaggtgt

SEQ ID NO: 796740 - DNA, 16 bp, Homo sapiens
tgccttctacttttaa

SEQ ID NO: 796741 - DNA, 18 bp, Homo sapiens
tgccttctcctctctggg

SEQ ID NO: 796742 - DNA, 13 bp, Homo sapiens
tgccttctgggct

SEQ ID NO: 796743 - DNA, 22 bp, Homo sapiens
tgccttctgtggccagagtctt

SEQ ID NO: 796744 - DNA, 17 bp, Homo sapiens
tgccttcttcacccagc

SEQ ID NO: 796745 - DNA, 13 bp, Homo sapiens
tgccttcttccag

SEQ ID NO: 796746 - DNA, 21 bp, Homo sapiens
tgccttcttcggggaactcct

SEQ ID NO: 796747 - DNA, 22 bp, Homo sapiens
tgccttcttcggggaactcctg

SEQ ID NO: 796748 - DNA, 16 bp, Homo sapiens
tgccttcttttgatta

SEQ ID NO: 796749 - DNA, 14 bp, Homo sapiens
tgccttgaagccac

SEQ ID NO: 796750 - DNA, 15 bp, Homo sapiens
tgccttgaagccact

SEQ ID NO: 796751 - DNA, 12 bp, Homo sapiens
tgccttgaataa

SEQ ID NO: 796752 - DNA, 19 bp, Homo sapiens
tgccttgacaacagactga

SEQ ID NO: 796753 - DNA, 21 bp, Homo sapiens
tgccttgacaacagactgaat

SEQ ID NO: 796754 - DNA, 18 bp, Homo sapiens
tgccttgagtccccaggg

SEQ ID NO: 796755 - DNA, 19 bp, Homo sapiens
tgccttgataaatatatat

SEQ ID NO: 796756 - DNA, 20 bp, Homo sapiens
tgccttgcagaactgccatt

SEQ ID NO: 796757 - DNA, 14 bp, Homo sapiens
tgccttgcccacag

SEQ ID NO: 796758 - DNA, 15 bp, Homo sapiens
tgccttgcccacagg

SEQ ID NO: 796759 - DNA, 16 bp, Homo sapiens
tgccttgctcctagca

SEQ ID NO: 796760 - DNA, 18 bp, Homo sapiens
tgccttgctcctagcaga

SEQ ID NO: 796761 - DNA, 22 bp, Homo sapiens
tgccttgctgttggtcatgtgg

SEQ ID NO: 796762 - DNA, 22 bp, Homo sapiens
tgccttgctgtttgtcctgaga

SEQ ID NO: 796763 - DNA, 17 bp, Homo sapiens
tgccttggatgagaagt

SEQ ID NO: 796764 - DNA, 13 bp, Homo sapiens
tgccttggctcag

SEQ ID NO: 796765 - DNA, 13 bp, Homo sapiens
tgccttggcttca

SEQ ID NO: 796766 - DNA, 16 bp, Homo sapiens
tgccttgggctgctcc

SEQ ID NO: 796767 - DNA, 19 bp, Homo sapiens
tgccttgggctgctcctca

SEQ ID NO: 796768 - DNA, 21 bp, Homo sapiens
tgccttggggaatttcctcta

SEQ ID NO: 796769 - DNA, 13 bp, Homo sapiens
tgccttggtgccg

SEQ ID NO: 796770 - DNA, 22 bp, Homo sapiens
tgccttggtgccggtcacactc

SEQ ID NO: 796771 - DNA, 17 bp, Homo sapiens
tgccttggttctggcca

SEQ ID NO: 796772 - DNA, 23 bp, Homo sapiens
tgccttggtttttactgctctga

SEQ ID NO: 796773 - DNA, 14 bp, Homo sapiens
tgccttgtccagga

SEQ ID NO: 796774 - DNA, 15 bp, Homo sapiens
tgccttgtccaggaa

SEQ ID NO: 796775 - DNA, 16 bp, Homo sapiens
tgccttgtttcatagt

SEQ ID NO: 796776 - DNA, 20 bp, Homo sapiens
tgccttgttttttgtttgtt

SEQ ID NO: 796777 - DNA, 14 bp, Homo sapiens
tgcctttaaatgaa

SEQ ID NO: 796778 - DNA, 16 bp, Homo sapiens
tgcctttaagccaaag

SEQ ID NO: 796779 - DNA, 18 bp, Homo sapiens
tgcctttaagccaaagaa

SEQ ID NO: 796780 - DNA, 22 bp, Homo sapiens
tgcctttaagccaaagaaacaa

SEQ ID NO: 796781 - DNA, 19 bp, Homo sapiens
tgcctttaattttcttgtt

SEQ ID NO: 796782 - DNA, 11 bp, Homo sapiens
tgcctttagaa

SEQ ID NO: 796783 - DNA, 18 bp, Homo sapiens
tgcctttagcctggacca

SEQ ID NO: 796784 - DNA, 17 bp, Homo sapiens
tgcctttatctcagcca

SEQ ID NO: 796785 - DNA, 19 bp, Homo sapiens
tgcctttatctctgaggct

SEQ ID NO: 796786 - DNA, 16 bp, Homo sapiens
tgcctttatgatgcta

SEQ ID NO: 796787 - DNA, 12 bp, Homo sapiens
tgcctttcaaat

SEQ ID NO: 796788 - DNA, 21 bp, Homo sapiens
tgcctttcaggcccattacct

SEQ ID NO: 796789 - DNA, 13 bp, Homo sapiens
tgcctttcccccc

SEQ ID NO: 796790 - DNA, 14 bp, Homo sapiens
tgcctttcccccct

SEQ ID NO: 796791 - DNA, 13 bp, Homo sapiens
tgcctttctagtc

SEQ ID NO: 796792 - DNA, 22 bp, Homo sapiens
tgcctttctgcagtttttcagg

SEQ ID NO: 796793 - DNA, 14 bp, Homo sapiens
tgcctttctgcctt

SEQ ID NO: 796794 - DNA, 16 bp, Homo sapiens
tgcctttcttctgccc

SEQ ID NO: 796795 - DNA, 18 bp, Homo sapiens
tgcctttcttctgccctt

SEQ ID NO: 796796 - DNA, 20 bp, Homo sapiens
tgcctttgatcacaggagca

SEQ ID NO: 796797 - DNA, 11 bp, Homo sapiens
tgcctttgtaa

SEQ ID NO: 796798 - DNA, 13 bp, Homo sapiens
tgcctttgtatgt

SEQ ID NO: 796799 - DNA, 16 bp, Homo sapiens
tgcctttgtatgtgga

SEQ ID NO: 796800 - DNA, 21 bp, Homo sapiens
tgcctttgtatgtggaagtat

SEQ ID NO: 796801 - DNA, 14 bp, Homo sapiens
tgcctttgtcccca

SEQ ID NO: 796802 - DNA, 21 bp, Homo sapiens
tgcctttgtggcccatgaaag

SEQ ID NO: 796803 - DNA, 15 bp, Homo sapiens
tgccttttaagtttg

SEQ ID NO: 796804 - DNA, 14 bp, Homo sapiens
tgccttttatccca

SEQ ID NO: 796805 - DNA, 19 bp, Homo sapiens
tgccttttcacgttttctt

SEQ ID NO: 796806 - DNA, 13 bp, Homo sapiens
tgccttttctgaa

SEQ ID NO: 796807 - DNA, 13 bp, Homo sapiens
tgccttttctgga

SEQ ID NO: 796808 - DNA, 21 bp, Homo sapiens
tgccttttctgtgattgggtg

SEQ ID NO: 796809 - DNA, 17 bp, Homo sapiens
tgccttttgcacccctc

SEQ ID NO: 796810 - DNA, 19 bp, Homo sapiens
tgccttttgcagaagaggg

SEQ ID NO: 796811 - DNA, 21 bp, Homo sapiens
tgccttttggtttcaccttcc

SEQ ID NO: 796812 - DNA, 12 bp, Homo sapiens
tgccttttgtgt

SEQ ID NO: 796813 - DNA, 14 bp, Homo sapiens
tgccttttgtgtga

SEQ ID NO: 796814 - DNA, 14 bp, Homo sapiens
tgcctttttcctta

SEQ ID NO: 796815 - DNA, 20 bp, Homo sapiens
tgccttttttcacggaagtt

SEQ ID NO: 796816 - DNA, 13 bp, Homo sapiens
tgccttttttcta

SEQ ID NO: 796817 - DNA, 19 bp, Homo sapiens
tgccttttttgtagttttt

SEQ ID NO: 796818 - DNA, 15 bp, Homo sapiens
tgcgaaatgttctca

SEQ ID NO: 796819 - DNA, 18 bp, Homo sapiens
tgcgacagagagagggga

SEQ ID NO: 796820 - DNA, 18 bp, Homo sapiens
tgcgactttctgcctgga

SEQ ID NO: 796821 - DNA, 21 bp, Homo sapiens
tgcgagacgcacacagctgag

SEQ ID NO: 796822 - DNA, 15 bp, Homo sapiens
tgcgagactctgatg

SEQ ID NO: 796823 - DNA, 12 bp, Homo sapiens
tgcgagctgccg

SEQ ID NO: 796824 - DNA, 14 bp, Homo sapiens
tgcgagcttggcct

SEQ ID NO: 796825 - DNA, 21 bp, Homo sapiens
tgcgagcttggccttgggccg

SEQ ID NO: 796826 - DNA, 17 bp, Homo sapiens
tgcgaggggccagcaga

SEQ ID NO: 796827 - DNA, 16 bp, Homo sapiens
tgcgagtccaaggcca

SEQ ID NO: 796828 - DNA, 13 bp, Homo sapiens
tgcgagtgtgtgc

SEQ ID NO: 796829 - DNA, 21 bp, Homo sapiens
tgcgagtgtgtgcatgtgtgt

SEQ ID NO: 796830 - DNA, 22 bp, Homo sapiens
tgcgagtgtgtgcatgtgtgtg

SEQ ID NO: 796831 - DNA, 14 bp, Homo sapiens
tgcgataactgaga

SEQ ID NO: 796832 - DNA, 18 bp, Homo sapiens
tgcgatcttcagagcagg

SEQ ID NO: 796833 - DNA, 24 bp, Homo sapiens
tgcgatgtggacgtcacgctccct

SEQ ID NO: 796834 - DNA, 19 bp, Homo sapiens
tgcgattttgcctgtgtct

SEQ ID NO: 796835 - DNA, 13 bp, Homo sapiens
tgcgcaatgtggc

SEQ ID NO: 796836 - DNA, 22 bp, Homo sapiens
tgcgcacaaggctgaccaagag

SEQ ID NO: 796837 - DNA, 21 bp, Homo sapiens
tgcgcacagagggaagccatg

SEQ ID NO: 796838 - DNA, 18 bp, Homo sapiens
tgcgcacttaccgccctg

SEQ ID NO: 796839 - DNA, 21 bp, Homo sapiens
tgcgcagatctgtgcctggga

SEQ ID NO: 796840 - DNA, 19 bp, Homo sapiens
tgcgcagatgaggggccac

SEQ ID NO: 796841 - DNA, 21 bp, Homo sapiens
tgcgcagatgaggggccactg

SEQ ID NO: 796842 - DNA, 15 bp, Homo sapiens
tgcgccactgccatc

SEQ ID NO: 796843 - DNA, 16 bp, Homo sapiens
tgcgccaggcagagct

SEQ ID NO: 796844 - DNA, 18 bp, Homo sapiens
tgcgccaggcagagctga

SEQ ID NO: 796845 - DNA, 22 bp, Homo sapiens
tgcgccaggcagagctgagggc

SEQ ID NO: 796846 - DNA, 16 bp, Homo sapiens
tgcgccagtcctgcta

SEQ ID NO: 796847 - DNA, 19 bp, Homo sapiens
tgcgcccagagctggcctc

SEQ ID NO: 796848 - DNA, 20 bp, Homo sapiens
tgcgcccagagctggcctcc

SEQ ID NO: 796849 - DNA, 17 bp, Homo sapiens
tgcgccccgcctgacct

SEQ ID NO: 796850 - DNA, 21 bp, Homo sapiens
tgcgccgagaccgcagaggga

SEQ ID NO: 796851 - DNA, 17 bp, Homo sapiens
tgcgcctcagccctcag

SEQ ID NO: 796852 - DNA, 17 bp, Homo sapiens
tgcgcctcaggctgctg

SEQ ID NO: 796853 - DNA, 15 bp, Homo sapiens
tgcgcctccatccat

SEQ ID NO: 796854 - DNA, 21 bp, Homo sapiens
tgcgcctccatccatctgtcc

SEQ ID NO: 796855 - DNA, 16 bp, Homo sapiens
tgcgcctgcaggcaga

SEQ ID NO: 796856 - DNA, 17 bp, Homo sapiens
tgcgcctgcaggcagag

SEQ ID NO: 796857 - DNA, 20 bp, Homo sapiens
tgcgcctgcaggcagagctg

SEQ ID NO: 796858 - DNA, 13 bp, Homo sapiens
tgcgcctttgtat

SEQ ID NO: 796859 - DNA, 14 bp, Homo sapiens
tgcgcctttgtatt

SEQ ID NO: 796860 - DNA, 16 bp, Homo sapiens
tgcgcctttgtattat

SEQ ID NO: 796861 - DNA, 22 bp, Homo sapiens
tgcgcgtgagtgtgtgagcgct

SEQ ID NO: 796862 - DNA, 13 bp, Homo sapiens
tgcgctagcagcc

SEQ ID NO: 796863 - DNA, 16 bp, Homo sapiens
tgcgctagcagccctt

SEQ ID NO: 796864 - DNA, 13 bp, Homo sapiens
tgcgctcagggcc

SEQ ID NO: 796865 - DNA, 17 bp, Homo sapiens
tgcgctcccgcatttct

SEQ ID NO: 796866 - DNA, 17 bp, Homo sapiens
tgcgctctctttgcaac

SEQ ID NO: 796867 - DNA, 12 bp, Homo sapiens
tgcgctcttggt

SEQ ID NO: 796868 - DNA, 17 bp, Homo sapiens
tgcgctcttggtccctg

SEQ ID NO: 796869 - DNA, 15 bp, Homo sapiens
tgcgctgtcccaggc

SEQ ID NO: 796870 - DNA, 17 bp, Homo sapiens
tgcgctgtcccaggcat

SEQ ID NO: 796871 - DNA, 13 bp, Homo sapiens
tgctccaagggac

SEQ ID NO: 796872 - DNA, 15 bp, Homo sapiens
tgctccaagggacag

SEQ ID NO: 796873 - DNA, 19 bp, Homo sapiens
tgctccaagggacaggtgg

SEQ ID NO: 796874 - DNA, 15 bp, Homo sapiens
tgctccaatctctgg

SEQ ID NO: 796875 - DNA, 15 bp, Homo sapiens
tgctccaatttcccc

SEQ ID NO: 796876 - DNA, 20 bp, Homo sapiens
tgctccacgaagccttaagc

SEQ ID NO: 796877 - DNA, 12 bp, Homo sapiens
tgctccagaaga

SEQ ID NO: 796878 - DNA, 17 bp, Homo sapiens
tgctccagattctgatg

SEQ ID NO: 796879 - DNA, 18 bp, Homo sapiens
tgctccagattctgatgc

SEQ ID NO: 796880 - DNA, 19 bp, Homo sapiens
tgctccagcaactgccctt

SEQ ID NO: 796881 - DNA, 22 bp, Homo sapiens
tgctccagcaactgcccttcca

SEQ ID NO: 796882 - DNA, 20 bp, Homo sapiens
tgctccagccaacccctgtg

SEQ ID NO: 796883 - DNA, 22 bp, Homo sapiens
tgctccagccaacccctgtgga

SEQ ID NO: 796884 - DNA, 23 bp, Homo sapiens
tgctccagccaacccctgtggag

SEQ ID NO: 796885 - DNA, 15 bp, Homo sapiens
tgctccagccccttt

SEQ ID NO: 796886 - DNA, 16 bp, Homo sapiens
tgctccagctgtcgtc

SEQ ID NO: 796887 - DNA, 18 bp, Homo sapiens
tgctccagctgtcgtctg

SEQ ID NO: 796888 - DNA, 13 bp, Homo sapiens
tgctccaggcctg

SEQ ID NO: 796889 - DNA, 20 bp, Homo sapiens
tgctccaggcctgcagcagg

SEQ ID NO: 796890 - DNA, 15 bp, Homo sapiens
tgctccatatttgat

SEQ ID NO: 796891 - DNA, 22 bp, Homo sapiens
tgctccatccccctgcctccca

SEQ ID NO: 796892 - DNA, 15 bp, Homo sapiens
tgctccatcctcctg

SEQ ID NO: 796893 - DNA, 19 bp, Homo sapiens
tgctccattttttcttccc

SEQ ID NO: 796894 - DNA, 19 bp, Homo sapiens
tgctcccacacttgtgcca

SEQ ID NO: 796895 - DNA, 20 bp, Homo sapiens
tgctcccacacttgtgccag

SEQ ID NO: 796896 - DNA, 19 bp, Homo sapiens
tgctcccaccccagaaatc

SEQ ID NO: 796897 - DNA, 15 bp, Homo sapiens
tgctcccagcagccc

SEQ ID NO: 796898 - DNA, 13 bp, Homo sapiens
tgctcccagcctg

SEQ ID NO: 796899 - DNA, 15 bp, Homo sapiens
tgctcccagcctgct

SEQ ID NO: 796900 - DNA, 21 bp, Homo sapiens
tgctcccagcctgctgagagc

SEQ ID NO: 796901 - DNA, 17 bp, Homo sapiens
tgctcccagctgtgctg

SEQ ID NO: 796902 - DNA, 22 bp, Homo sapiens
tgctcccatcattccttctggc

SEQ ID NO: 796903 - DNA, 18 bp, Homo sapiens
tgctcccattcctccctc

SEQ ID NO: 796904 - DNA, 20 bp, Homo sapiens
tgctcccattcctccctccg

SEQ ID NO: 796905 - DNA, 13 bp, Homo sapiens
tgctccccacagc

SEQ ID NO: 796906 - DNA, 14 bp, Homo sapiens
tgctccccacagcg

SEQ ID NO: 796907 - DNA, 20 bp, Homo sapiens
tgctccccacagcgtccctg

SEQ ID NO: 796908 - DNA, 21 bp, Homo sapiens
tgctccccacagcgtccctgg

SEQ ID NO: 796909 - DNA, 18 bp, Homo sapiens
tgctccccagccctggct

SEQ ID NO: 796910 - DNA, 23 bp, Homo sapiens
tgctccccagccctggctctgca

SEQ ID NO: 796911 - DNA, 23 bp, Homo sapiens
tgctcccccaccccctccccagg

SEQ ID NO: 796912 - DNA, 13 bp, Homo sapiens
tgctcccccatcc

SEQ ID NO: 796913 - DNA, 18 bp, Homo sapiens
tgctcccccatcctcccc

SEQ ID NO: 796914 - DNA, 19 bp, Homo sapiens
tgctcccccatcctcccct

SEQ ID NO: 796915 - DNA, 19 bp, Homo sapiens
tgctcccctgccacactga

SEQ ID NO: 796916 - DNA, 24 bp, Homo sapiens
tgctcccctgccacactgatggct

SEQ ID NO: 796917 - DNA, 13 bp, Homo sapiens
tgctcccctttgg

SEQ ID NO: 796918 - DNA, 13 bp, Homo sapiens
tgctccctcccct

SEQ ID NO: 796919 - DNA, 14 bp, Homo sapiens
tgctccctcccctg

SEQ ID NO: 796920 - DNA, 18 bp, Homo sapiens
tgctccctcccctgccct

SEQ ID NO: 796921 - DNA, 19 bp, Homo sapiens
tgctccctcccctgccctg

SEQ ID NO: 796922 - DNA, 11 bp, Homo sapiens
tgctccctctg

SEQ ID NO: 796923 - DNA, 12 bp, Homo sapiens
tgctccctttta

SEQ ID NO: 796924 - DNA, 18 bp, Homo sapiens
tgctccgctcccaccgcc

SEQ ID NO: 796925 - DNA, 15 bp, Homo sapiens
tgctccgtgcctcca

SEQ ID NO: 796926 - DNA, 14 bp, Homo sapiens
tgctccgtggactg

SEQ ID NO: 796927 - DNA, 15 bp, Homo sapiens
tgctccgtggactgc

SEQ ID NO: 796928 - DNA, 19 bp, Homo sapiens
tgctccgtggactgcagtc

SEQ ID NO: 796929 - DNA, 16 bp, Homo sapiens
tgctccgttggtcagc

SEQ ID NO: 796930 - DNA, 17 bp, Homo sapiens
tgctcctacatccagct

SEQ ID NO: 796931 - DNA, 21 bp, Homo sapiens
tgctcctacatccagctcctc

SEQ ID NO: 796932 - DNA, 20 bp, Homo sapiens
tgctcctagagggaggggcc

SEQ ID NO: 796933 - DNA, 15 bp, Homo sapiens
tgctcctcacctgtc

SEQ ID NO: 796934 - DNA, 20 bp, Homo sapiens
tgctcctccagcccttcaga

SEQ ID NO: 796935 - DNA, 11 bp, Homo sapiens
tgctcctccct

SEQ ID NO: 796936 - DNA, 12 bp, Homo sapiens
tgctcctccctg

SEQ ID NO: 796937 - DNA, 18 bp, Homo sapiens
tgctcctccctgcccccc

SEQ ID NO: 796938 - DNA, 23 bp, Homo sapiens
tgctcctccctggctgccctggc

SEQ ID NO: 796939 - DNA, 19 bp, Homo sapiens
tgctcctcctgccctgtcc

SEQ ID NO: 796940 - DNA, 11 bp, Homo sapiens
tgctcctctcc

SEQ ID NO: 796941 - DNA, 15 bp, Homo sapiens
tgctcctctccaggc

SEQ ID NO: 796942 - DNA, 18 bp, Homo sapiens
tgctcctcttgattcctg

SEQ ID NO: 796943 - DNA, 20 bp, Homo sapiens
tgctcctcttgattcctggt

SEQ ID NO: 796944 - DNA, 15 bp, Homo sapiens
tgctcctgcagcatg

SEQ ID NO: 796945 - DNA, 13 bp, Homo sapiens
tgctcctgcccag

SEQ ID NO: 796946 - DNA, 16 bp, Homo sapiens
tgctcctgcttttctg

SEQ ID NO: 796947 - DNA, 19 bp, Homo sapiens
tgctcctggcccactgcat

SEQ ID NO: 796948 - DNA, 13 bp, Homo sapiens
tgctcctggggag

SEQ ID NO: 796949 - DNA, 15 bp, Homo sapiens
tgctcctggggagaa

SEQ ID NO: 796950 - DNA, 23 bp, Homo sapiens
tgctcctggggagaaagaggggc

SEQ ID NO: 796951 - DNA, 23 bp, Homo sapiens
tgctcctgtacttgtcctcagct

SEQ ID NO: 796952 - DNA, 15 bp, Homo sapiens
tgctcctgtggcagg

SEQ ID NO: 796953 - DNA, 21 bp, Homo sapiens
tgctcctgttcacaccagaga

SEQ ID NO: 796954 - DNA, 23 bp, Homo sapiens
tgctccttgagaggagaaatgca

SEQ ID NO: 796955 - DNA, 16 bp, Homo sapiens
tgctccttggcacccc

SEQ ID NO: 796956 - DNA, 19 bp, Homo sapiens
tgctccttggcacccccat

SEQ ID NO: 796957 - DNA, 22 bp, Homo sapiens
tgctccttggcttacctgacct

SEQ ID NO: 796958 - DNA, 20 bp, Homo sapiens
tgctgctccggtttgggctg

SEQ ID NO: 796959 - DNA, 12 bp, Homo sapiens
tgctgctcctct

SEQ ID NO: 796960 - DNA, 12 bp, Homo sapiens
tgctgctctcag

SEQ ID NO: 796961 - DNA, 12 bp, Homo sapiens
tgctgctgaaga

SEQ ID NO: 796962 - DNA, 13 bp, Homo sapiens
tgctgctgcctgg

SEQ ID NO: 796963 - DNA, 19 bp, Homo sapiens
tgctgctgcctggccactg

SEQ ID NO: 796964 - DNA, 12 bp, Homo sapiens
tgctgctgctgc

SEQ ID NO: 796965 - DNA, 16 bp, Homo sapiens
tgctgctgctgcgccc

SEQ ID NO: 796966 - DNA, 11 bp, Homo sapiens
tgctgctggcc

SEQ ID NO: 796967 - DNA, 12 bp, Homo sapiens
tgctgctggcca

SEQ ID NO: 796968 - DNA, 11 bp, Homo sapiens
tgctgctgtaa

SEQ ID NO: 796969 - DNA, 19 bp, Homo sapiens
tgctgctgtaactgctgag

SEQ ID NO: 796970 - DNA, 21 bp, Homo sapiens
tgctgctgtaactgctgagcc

SEQ ID NO: 796971 - DNA, 24 bp, Homo sapiens
tgctgctgtaactgctgagccact

SEQ ID NO: 796972 - DNA, 16 bp, Homo sapiens
tgctgctgtcagacga

SEQ ID NO: 796973 - DNA, 13 bp, Homo sapiens
tgctgctgtccct

SEQ ID NO: 796974 - DNA, 14 bp, Homo sapiens
tgctgctgtgtgct

SEQ ID NO: 796975 - DNA, 14 bp, Homo sapiens
tgctgctgtgtttt

SEQ ID NO: 796976 - DNA, 16 bp, Homo sapiens
tgctgcttccctctgc

SEQ ID NO: 796977 - DNA, 20 bp, Homo sapiens
tgctgcttccctctgcctgt

SEQ ID NO: 796978 - DNA, 21 bp, Homo sapiens
tgctgcttccctctgcctgtc

SEQ ID NO: 796979 - DNA, 16 bp, Homo sapiens
tgctgcttctcttggg

SEQ ID NO: 796980 - DNA, 15 bp, Homo sapiens
tgctgcttgtgcctc

SEQ ID NO: 796981 - DNA, 17 bp, Homo sapiens
tgctgcttgtgcctccc

SEQ ID NO: 796982 - DNA, 15 bp, Homo sapiens
tgctgctttcccctg

SEQ ID NO: 796983 - DNA, 17 bp, Homo sapiens
tgctgctttcccctgtg

SEQ ID NO: 796984 - DNA, 14 bp, Homo sapiens
tgctgctttgtcca

SEQ ID NO: 796985 - DNA, 18 bp, Homo sapiens
tgctgctttttggcacag

SEQ ID NO: 796986 - DNA, 18 bp, Homo sapiens
tgctggaacccaggaggt

SEQ ID NO: 796987 - DNA, 17 bp, Homo sapiens
tgctggaacctgcaaaa

SEQ ID NO: 796988 - DNA, 14 bp, Homo sapiens
tgctggaagctgtc

SEQ ID NO: 796989 - DNA, 19 bp, Homo sapiens
tgctggaagctgtcaggct

SEQ ID NO: 796990 - DNA, 19 bp, Homo sapiens
tgctggaagggaggaaggc

SEQ ID NO: 796991 - DNA, 14 bp, Homo sapiens
tgctggaaggggca

SEQ ID NO: 796992 - DNA, 15 bp, Homo sapiens
tgctggaaggggcag

SEQ ID NO: 796993 - DNA, 19 bp, Homo sapiens
tgctggacatgagatggag

SEQ ID NO: 796994 - DNA, 16 bp, Homo sapiens
tgctggaccagctggc

SEQ ID NO: 796995 - DNA, 20 bp, Homo sapiens
tgctggacggcattcctgct

SEQ ID NO: 796996 - DNA, 22 bp, Homo sapiens
tgctggactagcaaaggaaaat

SEQ ID NO: 796997 - DNA, 14 bp, Homo sapiens
tgctggactgtcat

SEQ ID NO: 796998 - DNA, 15 bp, Homo sapiens
tgctggactgtcata

SEQ ID NO: 796999 - DNA, 23 bp, Homo sapiens
tgctggactgttccaggccctcc

SEQ ID NO: 797000 - DNA, 18 bp, Homo sapiens
tgctggactttaaaaaaa

SEQ ID NO: 797001 - DNA, 22 bp, Homo sapiens
tgctggactttaaaaaaacaat

SEQ ID NO: 797002 - DNA, 23 bp, Homo sapiens
tgctggaggaggggaagctgggc

SEQ ID NO: 797003 - DNA, 13 bp, Homo sapiens
tgctggaggcctc

SEQ ID NO: 797004 - DNA, 21 bp, Homo sapiens
tgctggagggaggctgggcgg

SEQ ID NO: 797005 - DNA, 14 bp, Homo sapiens
tgctggaggggctg

SEQ ID NO: 797006 - DNA, 12 bp, Homo sapiens
tgcttttccagg

SEQ ID NO: 797007 - DNA, 21 bp, Homo sapiens
tgcttttccaggatcctgcag

SEQ ID NO: 797008 - DNA, 17 bp, Homo sapiens
tgcttttccctatccac

SEQ ID NO: 797009 - DNA, 18 bp, Homo sapiens
tgcttttccctttgtgag

SEQ ID NO: 797010 - DNA, 16 bp, Homo sapiens
tgcttttcctcaagca

SEQ ID NO: 797011 - DNA, 18 bp, Homo sapiens
tgcttttcctcaagcaat

SEQ ID NO: 797012 - DNA, 20 bp, Homo sapiens
tgcttttctccaatatcagt

SEQ ID NO: 797013 - DNA, 17 bp, Homo sapiens
tgcttttctgtatttta

SEQ ID NO: 797014 - DNA, 14 bp, Homo sapiens
tgcttttctgtcct

SEQ ID NO: 797015 - DNA, 13 bp, Homo sapiens
tgcttttctgtct

SEQ ID NO: 797016 - DNA, 17 bp, Homo sapiens
tgcttttcttttctaac

SEQ ID NO: 797017 - DNA, 14 bp, Homo sapiens
tgcttttgccactt

SEQ ID NO: 797018 - DNA, 12 bp, Homo sapiens
tgcttttgctgc

SEQ ID NO: 797019 - DNA, 13 bp, Homo sapiens
tgcttttgctgct

SEQ ID NO: 797020 - DNA, 15 bp, Homo sapiens
tgcttttgctgctgc

SEQ ID NO: 797021 - DNA, 22 bp, Homo sapiens
tgcttttgctgctgcttaatcc

SEQ ID NO: 797022 - DNA, 16 bp, Homo sapiens
tgcttttgcttgcaat

SEQ ID NO: 797023 - DNA, 19 bp, Homo sapiens
tgcttttggcaaaactcta

SEQ ID NO: 797024 - DNA, 16 bp, Homo sapiens
tgcttttgtgagaaag

SEQ ID NO: 797025 - DNA, 10 bp, Homo sapiens
tgcttttgtt

SEQ ID NO: 797026 - DNA, 16 bp, Homo sapiens
tgcttttgttgtgact

SEQ ID NO: 797027 - DNA, 19 bp, Homo sapiens
tgcttttgttgtgactttt

SEQ ID NO: 797028 - DNA, 20 bp, Homo sapiens
tgcttttgtttttttcctca

SEQ ID NO: 797029 - DNA, 23 bp, Homo sapiens
tgctttttaatattgatatgctt

SEQ ID NO: 797030 - DNA, 16 bp, Homo sapiens
tgctttttataaaaag

SEQ ID NO: 797031 - DNA, 21 bp, Homo sapiens
tgctttttcctctcattgtct

SEQ ID NO: 797032 - DNA, 17 bp, Homo sapiens
tgctttttccttttcat

SEQ ID NO: 797033 - DNA, 14 bp, Homo sapiens
tgctttttctaatg

SEQ ID NO: 797034 - DNA, 14 bp, Homo sapiens
tgctttttcttgtt

SEQ ID NO: 797035 - DNA, 13 bp, Homo sapiens
tgctttttggtga

SEQ ID NO: 797036 - DNA, 16 bp, Homo sapiens
tgctttttttcttaaa

SEQ ID NO: 797037 - DNA, 17 bp, Homo sapiens
tgctttttttgtgtgta

SEQ ID NO: 797038 - DNA, 17 bp, Homo sapiens
tgcttttttttttccag

SEQ ID NO: 797039 - DNA, 19 bp, Homo sapiens
tgcttttttttttccagca

SEQ ID NO: 797040 - DNA, 12 bp, Homo sapiens
tggaaaaaaaca

SEQ ID NO: 797041 - DNA, 18 bp, Homo sapiens
tggaaaaaaacataaaaa

SEQ ID NO: 797042 - DNA, 23 bp, Homo sapiens
tggaaaaacatctgaaagccacg

SEQ ID NO: 797043 - DNA, 15 bp, Homo sapiens
tggaaaaatagtaaa

SEQ ID NO: 797044 - DNA, 13 bp, Homo sapiens
tggaaaaatgccc

SEQ ID NO: 797045 - DNA, 22 bp, Homo sapiens
tggaaaaatggttgatggaaaa

SEQ ID NO: 797046 - DNA, 18 bp, Homo sapiens
tggaaaaattgacaaaaa

SEQ ID NO: 797047 - DNA, 17 bp, Homo sapiens
tggaaaacaaggaagtc

SEQ ID NO: 797048 - DNA, 14 bp, Homo sapiens
tggaaaacagaaac

SEQ ID NO: 797049 - DNA, 16 bp, Homo sapiens
tggaaaaccaaactag

SEQ ID NO: 797050 - DNA, 13 bp, Homo sapiens
tggaaaaccagga

SEQ ID NO: 797051 - DNA, 21 bp, Homo sapiens
tggaaaactattgagccttgc

SEQ ID NO: 797052 - DNA, 20 bp, Homo sapiens
tggaaaacttgtgcccttgt

SEQ ID NO: 797053 - DNA, 22 bp, Homo sapiens
tggaaaagaagaaactttgcct

SEQ ID NO: 797054 - DNA, 23 bp, Homo sapiens
tggaaaagaatccctgcagcctg

SEQ ID NO: 797055 - DNA, 12 bp, Homo sapiens
tggaaaagacag

SEQ ID NO: 797056 - DNA, 21 bp, Homo sapiens
tggaaaagcaacttcatttga

SEQ ID NO: 797057 - DNA, 15 bp, Homo sapiens
tggaaaaggaagact

SEQ ID NO: 797058 - DNA, 21 bp, Homo sapiens
tggaaaagggtcttgggaaat

SEQ ID NO: 797059 - DNA, 21 bp, Homo sapiens
tggaaaaggtgaaaatgtttt

SEQ ID NO: 797060 - DNA, 14 bp, Homo sapiens
tggaaaataaacat

SEQ ID NO: 797061 - DNA, 16 bp, Homo sapiens
tggaaaataaattatt

SEQ ID NO: 797062 - DNA, 21 bp, Homo sapiens
tggaaaataatttagtggatg

SEQ ID NO: 797063 - DNA, 16 bp, Homo sapiens
tggaaaataccagtgt

SEQ ID NO: 797064 - DNA, 22 bp, Homo sapiens
tggaaaatacctaattgtggat

SEQ ID NO: 797065 - DNA, 12 bp, Homo sapiens
tggaaaatgtat

SEQ ID NO: 797066 - DNA, 15 bp, Homo sapiens
tggaaaattttctcc

SEQ ID NO: 797067 - DNA, 14 bp, Homo sapiens
tggaaacaggacca

SEQ ID NO: 797068 - DNA, 17 bp, Homo sapiens
tggaaacattacagttc

SEQ ID NO: 797069 - DNA, 13 bp, Homo sapiens
tggaaacatttta

SEQ ID NO: 797070 - DNA, 15 bp, Homo sapiens
tggaaacctgaaaaa

SEQ ID NO: 797071 - DNA, 17 bp, Homo sapiens
tggaaacctgaaaaaaa

SEQ ID NO: 797072 - DNA, 17 bp, Homo sapiens
tggaaacctgccctgcc

SEQ ID NO: 797073 - DNA, 22 bp, Homo sapiens
tggaaacctgccctgcctgagg

SEQ ID NO: 797074 - DNA, 17 bp, Homo sapiens
tggaacatactgttcac

SEQ ID NO: 797075 - DNA, 15 bp, Homo sapiens
tggaacatatgcaca

SEQ ID NO: 797076 - DNA, 18 bp, Homo sapiens
tggaacatatgcacaggg

SEQ ID NO: 797077 - DNA, 20 bp, Homo sapiens
tggaacattggaatgttctc

SEQ ID NO: 797078 - DNA, 12 bp, Homo sapiens
tggaacatttct

SEQ ID NO: 797079 - DNA, 13 bp, Homo sapiens
tggaacatttctt

SEQ ID NO: 797080 - DNA, 18 bp, Homo sapiens
tggaacatttgatatttt

SEQ ID NO: 797081 - DNA, 13 bp, Homo sapiens
tggaaccaaagtc

SEQ ID NO: 797082 - DNA, 15 bp, Homo sapiens
tggaaccaaagtcta

SEQ ID NO: 797083 - DNA, 19 bp, Homo sapiens
tggaaccaaagtctaaact

SEQ ID NO: 797084 - DNA, 19 bp, Homo sapiens
tggaaccagcaagtcccag

SEQ ID NO: 797085 - DNA, 15 bp, Homo sapiens
tggaaccagccccat

SEQ ID NO: 797086 - DNA, 19 bp, Homo sapiens
tggaaccagggaggagagg

SEQ ID NO: 797087 - DNA, 18 bp, Homo sapiens
tggaaccccccaggccct

SEQ ID NO: 797088 - DNA, 19 bp, Homo sapiens
tggaacccttttggccccc

SEQ ID NO: 797089 - DNA, 21 bp, Homo sapiens
tggaacccttttggcccccga

SEQ ID NO: 797090 - DNA, 13 bp, Homo sapiens
tggaaccttccct

SEQ ID NO: 797091 - DNA, 17 bp, Homo sapiens
tggaaccttccctccaa

SEQ ID NO: 797092 - DNA, 23 bp, Homo sapiens
tggaaccttctagaacacctgcc

SEQ ID NO: 797093 - DNA, 15 bp, Homo sapiens
tggaaccttgctgtc

SEQ ID NO: 797094 - DNA, 18 bp, Homo sapiens
tggaaccttgctgtcctg

SEQ ID NO: 797095 - DNA, 13 bp, Homo sapiens
tggaaccttgttt

SEQ ID NO: 797096 - DNA, 20 bp, Homo sapiens
tggaacgggcatgggcctct

SEQ ID NO: 797097 - DNA, 21 bp, Homo sapiens
tggaacgggcatgggcctctc

SEQ ID NO: 797098 - DNA, 22 bp, Homo sapiens
tggaactaaggactccaatgtc

SEQ ID NO: 797099 - DNA, 17 bp, Homo sapiens
tggaactacattactgt

SEQ ID NO: 797100 - DNA, 16 bp, Homo sapiens
tggaactactgtactt

SEQ ID NO: 797101 - DNA, 17 bp, Homo sapiens
tggaactactgtacttt

SEQ ID NO: 797102 - DNA, 21 bp, Homo sapiens
tggaactgaagtccaaattgt

SEQ ID NO: 797103 - DNA, 23 bp, Homo sapiens
tggaactgaagtccaaattgttt

SEQ ID NO: 797104 - DNA, 14 bp, Homo sapiens
tggaacttagccat

SEQ ID NO: 797105 - DNA, 14 bp, Homo sapiens
tggaacttctaata

SEQ ID NO: 797106 - DNA, 15 bp, Homo sapiens
tggaacttctaatat

SEQ ID NO: 797107 - DNA, 16 bp, Homo sapiens
tggaacttctaatata

SEQ ID NO: 797108 - DNA, 17 bp, Homo sapiens
tggaactttagggggtg

SEQ ID NO: 797109 - DNA, 21 bp, Homo sapiens
tggaactttttagattattcc

SEQ ID NO: 797110 - DNA, 21 bp, Homo sapiens
tggaagaaaaaaaccacacaa

SEQ ID NO: 797111 - DNA, 12 bp, Homo sapiens
tggaagaaacac

SEQ ID NO: 797112 - DNA, 19 bp, Homo sapiens
tggaagaaatggctatgaa

SEQ ID NO: 797113 - DNA, 12 bp, Homo sapiens
tggaagaaggga

SEQ ID NO: 797114 - DNA, 19 bp, Homo sapiens
tggaagaagggagaagaaa

SEQ ID NO: 797115 - DNA, 21 bp, Homo sapiens
tggaagaagggagaagaaagg

SEQ ID NO: 797116 - DNA, 13 bp, Homo sapiens
tggaagacacttc

SEQ ID NO: 797117 - DNA, 16 bp, Homo sapiens
tggaagacacttcaga

SEQ ID NO: 797118 - DNA, 13 bp, Homo sapiens
tggaagaccccac

SEQ ID NO: 797119 - DNA, 17 bp, Homo sapiens
tggaagaccccacccaa

SEQ ID NO: 797120 - DNA, 12 bp, Homo sapiens
tggaagacgtgg

SEQ ID NO: 797121 - DNA, 15 bp, Homo sapiens
tggaagagaggcacc

SEQ ID NO: 797122 - DNA, 16 bp, Homo sapiens
tggaagagaggcacct

SEQ ID NO: 797123 - DNA, 23 bp, Homo sapiens
tggaagagaggcacctgctggaa

SEQ ID NO: 797124 - DNA, 16 bp, Homo sapiens
tggaagagcagcctga

SEQ ID NO: 797125 - DNA, 22 bp, Homo sapiens
tggaagagcccgccgtctgcag

SEQ ID NO: 797126 - DNA, 23 bp, Homo sapiens
tggaagagcccgccgtctgcagg

SEQ ID NO: 797127 - DNA, 14 bp, Homo sapiens
tggaagagctcttc

SEQ ID NO: 797128 - DNA, 15 bp, Homo sapiens
tggaagaggaggagg

SEQ ID NO: 797129 - DNA, 16 bp, Homo sapiens
tggaagaggaggagga

SEQ ID NO: 797130 - DNA, 21 bp, Homo sapiens
tggaagatcccctctcctgcc

SEQ ID NO: 797131 - DNA, 21 bp, Homo sapiens
tggaagatcctgcgggtgggg

SEQ ID NO: 797132 - DNA, 22 bp, Homo sapiens
tggaagattttggtaatgatgt

SEQ ID NO: 797133 - DNA, 12 bp, Homo sapiens
tggaagcaaaga

SEQ ID NO: 797134 - DNA, 19 bp, Homo sapiens
tggaagcaaagacaaaaga

SEQ ID NO: 797135 - DNA, 23 bp, Homo sapiens
tggaagcaaagacaaaagaaact

SEQ ID NO: 797136 - DNA, 20 bp, Homo sapiens
tggaagcacagcctcgggga

SEQ ID NO: 797137 - DNA, 17 bp, Homo sapiens
tggaagcatgtaggaga

SEQ ID NO: 797138 - DNA, 22 bp, Homo sapiens
tggaagcatgtaggagaatcca

SEQ ID NO: 797139 - DNA, 12 bp, Homo sapiens
tggaagccaggt

SEQ ID NO: 797140 - DNA, 20 bp, Homo sapiens
tggaagccaggtacaggaga

SEQ ID NO: 797141 - DNA, 22 bp, Homo sapiens
tggaagccaggtacaggagagg

SEQ ID NO: 797142 - DNA, 15 bp, Homo sapiens
tggaagccctccttc

SEQ ID NO: 797143 - DNA, 16 bp, Homo sapiens
tggaagccctccttcc

SEQ ID NO: 797144 - DNA, 17 bp, Homo sapiens
tggaagccggcggccca

SEQ ID NO: 797145 - DNA, 15 bp, Homo sapiens
tggaagcctgagcag

SEQ ID NO: 797146 - DNA, 17 bp, Homo sapiens
tggaagctaatttgcat

SEQ ID NO: 797147 - DNA, 17 bp, Homo sapiens
tggaagctaccagagct

SEQ ID NO: 797148 - DNA, 20 bp, Homo sapiens
tggaagctagacacatgaag

SEQ ID NO: 797149 - DNA, 23 bp, Homo sapiens
tggaagctagacacatgaaggta

SEQ ID NO: 797150 - DNA, 17 bp, Homo sapiens
tggaagctgccctgccc

SEQ ID NO: 797151 - DNA, 20 bp, Homo sapiens
tggaagctgtttggaaaaga

SEQ ID NO: 797152 - DNA, 14 bp, Homo sapiens
tggaaggaatcaaa

SEQ ID NO: 797153 - DNA, 14 bp, Homo sapiens
tggaaggacacagt

SEQ ID NO: 797154 - DNA, 17 bp, Homo sapiens
tggaaggacacagtgat

SEQ ID NO: 797155 - DNA, 20 bp, Homo sapiens
tggaaggacacagtgatgaa

SEQ ID NO: 797156 - DNA, 19 bp, Homo sapiens
tggaaggaccacattttat

SEQ ID NO: 797157 - DNA, 14 bp, Homo sapiens
tggaaggagcagaa

SEQ ID NO: 797158 - DNA, 23 bp, Homo sapiens
tggaaggatgggatgggttccag

SEQ ID NO: 797159 - DNA, 17 bp, Homo sapiens
tggaaggcagagaaatc

SEQ ID NO: 797160 - DNA, 20 bp, Homo sapiens
tggaaggcagagaaatctaa

SEQ ID NO: 797161 - DNA, 14 bp, Homo sapiens
tggaaggcagggca

SEQ ID NO: 797162 - DNA, 18 bp, Homo sapiens
tggaaggcagggcagagg

SEQ ID NO: 797163 - DNA, 21 bp, Homo sapiens
tggaaggcattgaagcttgca

SEQ ID NO: 797164 - DNA, 16 bp, Homo sapiens
tggaaggcctccctct

SEQ ID NO: 797165 - DNA, 15 bp, Homo sapiens
tggaaggctggctga

SEQ ID NO: 797166 - DNA, 17 bp, Homo sapiens
tggaagggaagttcagg

SEQ ID NO: 797167 - DNA, 15 bp, Homo sapiens
tggaagggactagga

SEQ ID NO: 797168 - DNA, 19 bp, Homo sapiens
tggaagggttctggctgcc

SEQ ID NO: 797169 - DNA, 15 bp, Homo sapiens
tggaagggtttgtgg

SEQ ID NO: 797170 - DNA, 20 bp, Homo sapiens
tggaagtaaccatttgcact

SEQ ID NO: 797171 - DNA, 19 bp, Homo sapiens
tggaagtcacctttctggg

SEQ ID NO: 797172 - DNA, 22 bp, Homo sapiens
tggaagtcacctttctgggctt

SEQ ID NO: 797173 - DNA, 23 bp, Homo sapiens
tggaagtcacctttctgggcttt

SEQ ID NO: 797174 - DNA, 19 bp, Homo sapiens
tggaagtgcagtcagcaga

SEQ ID NO: 797175 - DNA, 16 bp, Homo sapiens
tggaagtggttctatg

SEQ ID NO: 797176 - DNA, 16 bp, Homo sapiens
tggaagtgtatttatt

SEQ ID NO: 797177 - DNA, 22 bp, Homo sapiens
tggaagtgtatttattttacag

SEQ ID NO: 797178 - DNA, 14 bp, Homo sapiens
tggaagtgttcaga

SEQ ID NO: 797179 - DNA, 14 bp, Homo sapiens
tggaagttcttcaa

SEQ ID NO: 797180 - DNA, 16 bp, Homo sapiens
tggaagttcttcaaga

SEQ ID NO: 797181 - DNA, 23 bp, Homo sapiens
tggaagttgttgctatacatgtt

SEQ ID NO: 797182 - DNA, 16 bp, Homo sapiens
tggaagtttgtgttct

SEQ ID NO: 797183 - DNA, 23 bp, Homo sapiens
tggaagtttgtgttctgtttgtt

SEQ ID NO: 797184 - DNA, 19 bp, Homo sapiens
tggaagttttcctacactt

SEQ ID NO: 797185 - DNA, 14 bp, Homo sapiens
tggaagttttgcat

SEQ ID NO: 797186 - DNA, 15 bp, Homo sapiens
tggaataaaaggctt

SEQ ID NO: 797187 - DNA, 22 bp, Homo sapiens
tggaataaaatataaaactgaa

SEQ ID NO: 797188 - DNA, 16 bp, Homo sapiens
tggaataaagttgcag

SEQ ID NO: 797189 - DNA, 14 bp, Homo sapiens
tggaataaatcctt

SEQ ID NO: 797190 - DNA, 20 bp, Homo sapiens
tggacacacacagactattt

SEQ ID NO: 797191 - DNA, 21 bp, Homo sapiens
tggacacacactcaccagtgg

SEQ ID NO: 797192 - DNA, 23 bp, Homo sapiens
tggacacacactcaccagtggcc

SEQ ID NO: 797193 - DNA, 13 bp, Homo sapiens
tggacaccccaga

SEQ ID NO: 797194 - DNA, 17 bp, Homo sapiens
tggacaccgctcagtat

SEQ ID NO: 797195 - DNA, 18 bp, Homo sapiens
tggacaccgctcagtatt

SEQ ID NO: 797196 - DNA, 19 bp, Homo sapiens
tggacaccgctcagtatta

SEQ ID NO: 797197 - DNA, 21 bp, Homo sapiens
tggacacgagccacaagctgc

SEQ ID NO: 797198 - DNA, 22 bp, Homo sapiens
tggacacgagccacaagctgca

SEQ ID NO: 797199 - DNA, 17 bp, Homo sapiens
tggacactacacccagc

SEQ ID NO: 797200 - DNA, 18 bp, Homo sapiens
tggacactacacccagca

SEQ ID NO: 797201 - DNA, 13 bp, Homo sapiens
tggacactccagg

SEQ ID NO: 797202 - DNA, 23 bp, Homo sapiens
tggacactccagggacacacagc

SEQ ID NO: 797203 - DNA, 23 bp, Homo sapiens
tggacactttgaaatgtgtttct

SEQ ID NO: 797204 - DNA, 14 bp, Homo sapiens
tggacagacacctc

SEQ ID NO: 797205 - DNA, 20 bp, Homo sapiens
tggacagacacctcccccta

SEQ ID NO: 797206 - DNA, 13 bp, Homo sapiens
tggacagacactg

SEQ ID NO: 797207 - DNA, 18 bp, Homo sapiens
tggacagacactgttgca

SEQ ID NO: 797208 - DNA, 14 bp, Homo sapiens
tggacagaggggac

SEQ ID NO: 797209 - DNA, 21 bp, Homo sapiens
tggactccagcctgcctggca

SEQ ID NO: 797210 - DNA, 19 bp, Homo sapiens
tggactccggaggactgag

SEQ ID NO: 797211 - DNA, 15 bp, Homo sapiens
tggagcacaaaattc

SEQ ID NO: 797212 - DNA, 17 bp, Homo sapiens
tggagcacaaaattcaa

SEQ ID NO: 797213 - DNA, 17 bp, Homo sapiens
tggagcaccaggcacga

SEQ ID NO: 797214 - DNA, 14 bp, Homo sapiens
tggagcacctgggc

SEQ ID NO: 797215 - DNA, 20 bp, Homo sapiens
tggagcactagtttgattat

SEQ ID NO: 797216 - DNA, 21 bp, Homo sapiens
tggagcactctgagtttacca

SEQ ID NO: 797217 - DNA, 17 bp, Homo sapiens
tggagcacttgttttaa

SEQ ID NO: 797218 - DNA, 13 bp, Homo sapiens
tggagcagaccac

SEQ ID NO: 797219 - DNA, 23 bp, Homo sapiens
tggagcagcagccactgcacagg

SEQ ID NO: 797220 - DNA, 12 bp, Homo sapiens
tggagcagccag

SEQ ID NO: 797221 - DNA, 12 bp, Homo sapiens
tggagcaggcaa

SEQ ID NO: 797222 - DNA, 16 bp, Homo sapiens
tggagcatctgactca

SEQ ID NO: 797223 - DNA, 15 bp, Homo sapiens
tggagccaagtccag

SEQ ID NO: 797224 - DNA, 22 bp, Homo sapiens
tggagccacaggcaggggtgag

SEQ ID NO: 797225 - DNA, 11 bp, Homo sapiens
tggagccactc

SEQ ID NO: 797226 - DNA, 14 bp, Homo sapiens
tggagccactcctg

SEQ ID NO: 797227 - DNA, 18 bp, Homo sapiens
tggagccactcctgtccc

SEQ ID NO: 797228 - DNA, 23 bp, Homo sapiens
tggagccactcctgtcccgcctt

SEQ ID NO: 797229 - DNA, 13 bp, Homo sapiens
tggagccagagag

SEQ ID NO: 797230 - DNA, 14 bp, Homo sapiens
tggagccagggagc

SEQ ID NO: 797231 - DNA, 15 bp, Homo sapiens
tggagccagggcaga

SEQ ID NO: 797232 - DNA, 19 bp, Homo sapiens
tggagccagggcagaggaa

SEQ ID NO: 797233 - DNA, 22 bp, Homo sapiens
tggagcccacagcgagcctgtg

SEQ ID NO: 797234 - DNA, 22 bp, Homo sapiens
tggagcccccagatagagctgg

SEQ ID NO: 797235 - DNA, 16 bp, Homo sapiens
tggagcccccagcaga

SEQ ID NO: 797236 - DNA, 15 bp, Homo sapiens
tggagcccctcctcc

SEQ ID NO: 797237 - DNA, 16 bp, Homo sapiens
tggagcccctcctccc

SEQ ID NO: 797238 - DNA, 12 bp, Homo sapiens
tggagcccctgg

SEQ ID NO: 797239 - DNA, 14 bp, Homo sapiens
tggagcccctgggt

SEQ ID NO: 797240 - DNA, 23 bp, Homo sapiens
tggagcccctgggtgggtggtgg

SEQ ID NO: 797241 - DNA, 16 bp, Homo sapiens
tggagcccgcaccccc

SEQ ID NO: 797242 - DNA, 17 bp, Homo sapiens
tggagcccgcaccccca

SEQ ID NO: 797243 - DNA, 22 bp, Homo sapiens
tggagcccgcacccccaccctt

SEQ ID NO: 797244 - DNA, 15 bp, Homo sapiens
tggagcccgtgcagt

SEQ ID NO: 797245 - DNA, 21 bp, Homo sapiens
tggagccctgttggcagctct

SEQ ID NO: 797246 - DNA, 15 bp, Homo sapiens
tggagcctaaagaga

SEQ ID NO: 797247 - DNA, 24 bp, Homo sapiens
tggagcctctttttccttcttcag

SEQ ID NO: 797248 - DNA, 15 bp, Homo sapiens
tggagcgtggactgg

SEQ ID NO: 797249 - DNA, 16 bp, Homo sapiens
tggagcgtggactggt

SEQ ID NO: 797250 - DNA, 16 bp, Homo sapiens
tggagcgtttgctgtg

SEQ ID NO: 797251 - DNA, 14 bp, Homo sapiens
tggagctcatgtca

SEQ ID NO: 797252 - DNA, 16 bp, Homo sapiens
tggagctcgcccctcc

SEQ ID NO: 797253 - DNA, 17 bp, Homo sapiens
tggagctcgcccctccc

SEQ ID NO: 797254 - DNA, 20 bp, Homo sapiens
tggagctcgcccctcccctc

SEQ ID NO: 797255 - DNA, 14 bp, Homo sapiens
tggagctcttggaa

SEQ ID NO: 797256 - DNA, 21 bp, Homo sapiens
tggagctcttggaagagctct

SEQ ID NO: 797257 - DNA, 16 bp, Homo sapiens
tggagctcttgttgca

SEQ ID NO: 797258 - DNA, 20 bp, Homo sapiens
tggagctgaagacctaaagt

SEQ ID NO: 797259 - DNA, 19 bp, Homo sapiens
tggagctgagaagaggagg

SEQ ID NO: 797260 - DNA, 23 bp, Homo sapiens
tggagctgagaagaggaggaggt

SEQ ID NO: 797261 - DNA, 13 bp, Homo sapiens
tggagctgagcct

SEQ ID NO: 797262 - DNA, 14 bp, Homo sapiens
tggagctgaggaat

SEQ ID NO: 797263 - DNA, 16 bp, Homo sapiens
tggagctgccacagag

SEQ ID NO: 797264 - DNA, 19 bp, Homo sapiens
tggagctgccacagagaag

SEQ ID NO: 797265 - DNA, 20 bp, Homo sapiens
tggagctgccgtgcctgtgt

SEQ ID NO: 797266 - DNA, 17 bp, Homo sapiens
tggagcttaagccactg

SEQ ID NO: 797267 - DNA, 18 bp, Homo sapiens
tggagcttaagccactgc

SEQ ID NO: 797268 - DNA, 21 bp, Homo sapiens
tggagcttgtggagttgatga

SEQ ID NO: 797269 - DNA, 14 bp, Homo sapiens
tggagcttttttcc

SEQ ID NO: 797270 - DNA, 16 bp, Homo sapiens
tggagcttttttcttt

SEQ ID NO: 797271 - DNA, 21 bp, Homo sapiens
tggaggaaaaccaagccgtgg

SEQ ID NO: 797272 - DNA, 16 bp, Homo sapiens
tggaggaaagggagga

SEQ ID NO: 797273 - DNA, 22 bp, Homo sapiens
tggaggaacttgctgctgtgcc

SEQ ID NO: 797274 - DNA, 23 bp, Homo sapiens
tggaggaacttgctgctgtgcct

SEQ ID NO: 797275 - DNA, 15 bp, Homo sapiens
tggaggaagagccac

SEQ ID NO: 797276 - DNA, 16 bp, Homo sapiens
tggaggaagagccacc

SEQ ID NO: 797277 - DNA, 22 bp, Homo sapiens
tggaggaagagccacctgcaag

SEQ ID NO: 797278 - DNA, 11 bp, Homo sapiens
tggaggaaggc

SEQ ID NO: 797279 - DNA, 16 bp, Homo sapiens
tggaggaaggctctgt

SEQ ID NO: 797280 - DNA, 20 bp, Homo sapiens
tggaggaaggctctgtcact

SEQ ID NO: 797281 - DNA, 17 bp, Homo sapiens
tggaggaagtggggtct

SEQ ID NO: 797282 - DNA, 22 bp, Homo sapiens
tggaggaagttctccagcttca

SEQ ID NO: 797283 - DNA, 17 bp, Homo sapiens
tggaggaatcactgggg

SEQ ID NO: 797284 - DNA, 22 bp, Homo sapiens
tggaggaatgctcccccatcct

SEQ ID NO: 797285 - DNA, 12 bp, Homo sapiens
tggaggacagac

SEQ ID NO: 797286 - DNA, 13 bp, Homo sapiens
tggaggacagacg

SEQ ID NO: 797287 - DNA, 17 bp, Homo sapiens
tggaggaccccgagggc

SEQ ID NO: 797288 - DNA, 22 bp, Homo sapiens
tggaggaccccgagggctgagg

SEQ ID NO: 797289 - DNA, 12 bp, Homo sapiens
tggaggagagga

SEQ ID NO: 797290 - DNA, 14 bp, Homo sapiens
tggaggagaggaga

SEQ ID NO: 797291 - DNA, 20 bp, Homo sapiens
tggaggagcagcttccttct

SEQ ID NO: 797292 - DNA, 21 bp, Homo sapiens
tggaggagcagcttccttctg

SEQ ID NO: 797293 - DNA, 16 bp, Homo sapiens
tggaggagctgaggga

SEQ ID NO: 797294 - DNA, 17 bp, Homo sapiens
tggaggagctgagggag

SEQ ID NO: 797295 - DNA, 13 bp, Homo sapiens
tggaggaggaagg

SEQ ID NO: 797296 - DNA, 21 bp, Homo sapiens
tggaggaggaaggcaagaggg

SEQ ID NO: 797297 - DNA, 20 bp, Homo sapiens
tggaggaggaggaggagcct

SEQ ID NO: 797298 - DNA, 16 bp, Homo sapiens
tggaggaggggaagct

SEQ ID NO: 797299 - DNA, 18 bp, Homo sapiens
tggaggcaagagggaggg

SEQ ID NO: 797300 - DNA, 11 bp, Homo sapiens
tggaggcagag

SEQ ID NO: 797301 - DNA, 19 bp, Homo sapiens
tggaggcaggggctgctgc

SEQ ID NO: 797302 - DNA, 21 bp, Homo sapiens
tggaggccagagtctcccagt

SEQ ID NO: 797303 - DNA, 21 bp, Homo sapiens
tggaggccatcgggctcccag

SEQ ID NO: 797304 - DNA, 12 bp, Homo sapiens
tggaggcccagg

SEQ ID NO: 797305 - DNA, 16 bp, Homo sapiens
tggaggccctcctgtg

SEQ ID NO: 797306 - DNA, 14 bp, Homo sapiens
tggaggcctcaggt

SEQ ID NO: 797307 - DNA, 20 bp, Homo sapiens
tggaggcctcaggtgctgtc

SEQ ID NO: 797308 - DNA, 18 bp, Homo sapiens
tggaggcctctggccctc

SEQ ID NO: 797309 - DNA, 14 bp, Homo sapiens
tggaggcctgatgc

SEQ ID NO: 797310 - DNA, 18 bp, Homo sapiens
tggaggccttccagctgc

SEQ ID NO: 797311 - DNA, 19 bp, Homo sapiens
tggaggccttccagctgct

SEQ ID NO: 797312 - DNA, 22 bp, Homo sapiens
tggaggcggtgcggcagggaag

SEQ ID NO: 797313 - DNA, 20 bp, Homo sapiens
tggaggctcagcccaccctc

SEQ ID NO: 797314 - DNA, 16 bp, Homo sapiens
tggaggcttttcactg

SEQ ID NO: 797315 - DNA, 12 bp, Homo sapiens
tggagggaacca

SEQ ID NO: 797316 - DNA, 23 bp, Homo sapiens
tggagggacttttaatcagtgaa

SEQ ID NO: 797317 - DNA, 20 bp, Homo sapiens
tggagggcaaggggtttcca

SEQ ID NO: 797318 - DNA, 22 bp, Homo sapiens
tggagggcaaggggtttccaca

SEQ ID NO: 797319 - DNA, 12 bp, Homo sapiens
tggagggcactt

SEQ ID NO: 797320 - DNA, 11 bp, Homo sapiens
tggaggggaaa

SEQ ID NO: 797321 - DNA, 15 bp, Homo sapiens
tggaggggaaacgca

SEQ ID NO: 797322 - DNA, 21 bp, Homo sapiens
tggaggggcagagccaggaag

SEQ ID NO: 797323 - DNA, 18 bp, Homo sapiens
tggaggggcagcctgtgc

SEQ ID NO: 797324 - DNA, 17 bp, Homo sapiens
tggaggggcgcccaggg

SEQ ID NO: 797325 - DNA, 18 bp, Homo sapiens
tggaggggcgcccagggt

SEQ ID NO: 797326 - DNA, 18 bp, Homo sapiens
tggaggggctgtcctcct

SEQ ID NO: 797327 - DNA, 23 bp, Homo sapiens
tggaggggctgtcctccttcctg

SEQ ID NO: 797328 - DNA, 19 bp, Homo sapiens
tggaggggggtgctggccc

SEQ ID NO: 797329 - DNA, 19 bp, Homo sapiens
tggaggggtggtcctgact

SEQ ID NO: 797330 - DNA, 20 bp, Homo sapiens
tggaggggtggtcctgactc

SEQ ID NO: 797331 - DNA, 16 bp, Homo sapiens
tggagggtaactgggg

SEQ ID NO: 797332 - DNA, 21 bp, Homo sapiens
tggagggtctgggggcagctg

SEQ ID NO: 797333 - DNA, 23 bp, Homo sapiens
tggccctgaggtgtgggggctgc

SEQ ID NO: 797334 - DNA, 18 bp, Homo sapiens
tggccctgcaaaaatata

SEQ ID NO: 797335 - DNA, 12 bp, Homo sapiens
tggccctgccct

SEQ ID NO: 797336 - DNA, 12 bp, Homo sapiens
tggccctgcctt

SEQ ID NO: 797337 - DNA, 16 bp, Homo sapiens
tggccctgccttcttc

SEQ ID NO: 797338 - DNA, 14 bp, Homo sapiens
tggccctgcttcct

SEQ ID NO: 797339 - DNA, 12 bp, Homo sapiens
tggccctggagc

SEQ ID NO: 797340 - DNA, 15 bp, Homo sapiens
tggccctggagccag

SEQ ID NO: 797341 - DNA, 18 bp, Homo sapiens
tggccctggagccagggc

SEQ ID NO: 797342 - DNA, 15 bp, Homo sapiens
tggccctggcctgct

SEQ ID NO: 797343 - DNA, 16 bp, Homo sapiens
tggccctggcctgctg

SEQ ID NO: 797344 - DNA, 13 bp, Homo sapiens
tggccctggggtc

SEQ ID NO: 797345 - DNA, 15 bp, Homo sapiens
tggccctgtgcagac

SEQ ID NO: 797346 - DNA, 21 bp, Homo sapiens
tggccctgtgcagaccttact

SEQ ID NO: 797347 - DNA, 13 bp, Homo sapiens
tggccctgtgcct

SEQ ID NO: 797348 - DNA, 20 bp, Homo sapiens
tggccctgtgcctgggccct

SEQ ID NO: 797349 - DNA, 19 bp, Homo sapiens
tggccctgttctcctcccc

SEQ ID NO: 797350 - DNA, 23 bp, Homo sapiens
tggcccttacttgcttctctagc

SEQ ID NO: 797351 - DNA, 18 bp, Homo sapiens
tggcccttcagtctgctc

SEQ ID NO: 797352 - DNA, 22 bp, Homo sapiens
tggcccttcagtctgctccacc

SEQ ID NO: 797353 - DNA, 15 bp, Homo sapiens
tggcccttccagtgg

SEQ ID NO: 797354 - DNA, 19 bp, Homo sapiens
tggcccttctgtccaccag

SEQ ID NO: 797355 - DNA, 12 bp, Homo sapiens
tggcccttggaa

SEQ ID NO: 797356 - DNA, 15 bp, Homo sapiens
tggcccttgtctttt

SEQ ID NO: 797357 - DNA, 18 bp, Homo sapiens
tggccctttccttccaga

SEQ ID NO: 797358 - DNA, 18 bp, Homo sapiens
tggccgaagccccttgga

SEQ ID NO: 797359 - DNA, 19 bp, Homo sapiens
tggccgaagccccttggag

SEQ ID NO: 797360 - DNA, 19 bp, Homo sapiens
tgggtgggcagggaggggc

SEQ ID NO: 797361 - DNA, 19 bp, Homo sapiens
tgggtgggccctgccggga

SEQ ID NO: 797362 - DNA, 12 bp, Homo sapiens
tgggtgggcctg

SEQ ID NO: 797363 - DNA, 19 bp, Homo sapiens
tgggtgggctctgtgcagt

SEQ ID NO: 797364 - DNA, 20 bp, Homo sapiens
tgggtggggaggaaatagaa

SEQ ID NO: 797365 - DNA, 21 bp, Homo sapiens
tgggtggggaggccctgcctg

SEQ ID NO: 797366 - DNA, 13 bp, Homo sapiens
tgggtggggctgc

SEQ ID NO: 797367 - DNA, 12 bp, Homo sapiens
tgggtgggggct

SEQ ID NO: 797368 - DNA, 14 bp, Homo sapiens
tgggtggtaccctc

SEQ ID NO: 797369 - DNA, 18 bp, Homo sapiens
tgggtggtaccctctgga

SEQ ID NO: 797370 - DNA, 23 bp, Homo sapiens
tgggtgtaacaggtctcctctta

SEQ ID NO: 797371 - DNA, 17 bp, Homo sapiens
tgggtgtatataatttt

SEQ ID NO: 797372 - DNA, 20 bp, Homo sapiens
tgggtgtatttattttcctc

SEQ ID NO: 797373 - DNA, 21 bp, Homo sapiens
tgggtgtgctttttgggacca

SEQ ID NO: 797374 - DNA, 13 bp, Homo sapiens
tgggtgtggccag

SEQ ID NO: 797375 - DNA, 17 bp, Homo sapiens
tgggtgtgtggcctccc

SEQ ID NO: 797376 - DNA, 18 bp, Homo sapiens
tgggtgtgtggcctccct

SEQ ID NO: 797377 - DNA, 20 bp, Homo sapiens
tgggtgttcctggcagttta

SEQ ID NO: 797378 - DNA, 14 bp, Homo sapiens
tgggtgttctttcc

SEQ ID NO: 797379 - DNA, 19 bp, Homo sapiens
tgggtgttctttcctgccc

SEQ ID NO: 797380 - DNA, 23 bp, Homo sapiens
tgggtgtttattacaagtggctc

SEQ ID NO: 797381 - DNA, 15 bp, Homo sapiens
tgggtgtttccagaa

SEQ ID NO: 797382 - DNA, 17 bp, Homo sapiens
tgggttaattcatttgg

SEQ ID NO: 797383 - DNA, 17 bp, Homo sapiens
tgggttagctaaaccaa

SEQ ID NO: 797384 - DNA, 22 bp, Homo sapiens
tgggttaggcattaatgtttct

SEQ ID NO: 797385 - DNA, 22 bp, Homo sapiens
tgggttaggtggccgctcctcc

SEQ ID NO: 797386 - DNA, 20 bp, Homo sapiens
tgggttagtcgggtgccagg

SEQ ID NO: 797387 - DNA, 20 bp, Homo sapiens
tgggttcacttgccatgcag

SEQ ID NO: 797388 - DNA, 11 bp, Homo sapiens
tgggttcatta

SEQ ID NO: 797389 - DNA, 13 bp, Homo sapiens
tgggttcattatt

SEQ ID NO: 797390 - DNA, 12 bp, Homo sapiens
tgggttccagag

SEQ ID NO: 797391 - DNA, 13 bp, Homo sapiens
tgggttcctcttc

SEQ ID NO: 797392 - DNA, 18 bp, Homo sapiens
tgggttctttctgggggg

SEQ ID NO: 797393 - DNA, 22 bp, Homo sapiens
tgggttgattctcgactgcttt

SEQ ID NO: 797394 - DNA, 15 bp, Homo sapiens
tgggttgtcaccaag

SEQ ID NO: 797395 - DNA, 18 bp, Homo sapiens
tgggttgtttccaggaga

SEQ ID NO: 797396 - DNA, 21 bp, Homo sapiens
tgggttgtttccaggagaaag

SEQ ID NO: 797397 - DNA, 13 bp, Homo sapiens
tgggtttcaagaa

SEQ ID NO: 797398 - DNA, 20 bp, Homo sapiens
tgggtttcaagaaaatcttt

SEQ ID NO: 797399 - DNA, 16 bp, Homo sapiens
tgggtttctagcccat

SEQ ID NO: 797400 - DNA, 14 bp, Homo sapiens
tgggtttggacccc

SEQ ID NO: 797401 - DNA, 19 bp, Homo sapiens
tgggtttggaccccagctg

SEQ ID NO: 797402 - DNA, 20 bp, Homo sapiens
tgggtttggaccccagctgg

SEQ ID NO: 797403 - DNA, 13 bp, Homo sapiens
tgggtttggccag

SEQ ID NO: 797404 - DNA, 16 bp, Homo sapiens
tgggtttggccaggga

SEQ ID NO: 797405 - DNA, 18 bp, Homo sapiens
tgggtttggccagggagg

SEQ ID NO: 797406 - DNA, 19 bp, Homo sapiens
tgggtttggttagaggaag

SEQ ID NO: 797407 - DNA, 14 bp, Homo sapiens
tgggttttcttccc

SEQ ID NO: 797408 - DNA, 16 bp, Homo sapiens
tgggtttttgctgttt

SEQ ID NO: 797409 - DNA, 22 bp, Homo sapiens
tggtaaaaagatccagggatgg

SEQ ID NO: 797410 - DNA, 18 bp, Homo sapiens
tggtaaaaatgctgctct

SEQ ID NO: 797411 - DNA, 21 bp, Homo sapiens
tggtaaaagggatacacagga

SEQ ID NO: 797412 - DNA, 12 bp, Homo sapiens
tggtaaaccaag

SEQ ID NO: 797413 - DNA, 19 bp, Homo sapiens
tggtaaaccaagcctccca

SEQ ID NO: 797414 - DNA, 21 bp, Homo sapiens
tggtaaactatttgtctttca

SEQ ID NO: 797415 - DNA, 14 bp, Homo sapiens
tggtaaatttttga

SEQ ID NO: 797416 - DNA, 19 bp, Homo sapiens
tggtaaatttttgaaaaat

SEQ ID NO: 797417 - DNA, 22 bp, Homo sapiens
tggtaactgctttctgttccaa

SEQ ID NO: 797418 - DNA, 21 bp, Homo sapiens
tggtaactggaaggccttcca

SEQ ID NO: 797419 - DNA, 20 bp, Homo sapiens
tggtaactttgcaggcggcc

SEQ ID NO: 797420 - DNA, 22 bp, Homo sapiens
tggtaactttgcaggcggccct

SEQ ID NO: 797421 - DNA, 14 bp, Homo sapiens
tggtaacttttgtg

SEQ ID NO: 797422 - DNA, 22 bp, Homo sapiens
tggtaagagacagaatgtatct

SEQ ID NO: 797423 - DNA, 12 bp, Homo sapiens
tggtaagattgt

SEQ ID NO: 797424 - DNA, 14 bp, Homo sapiens
tggtaagattgtta

SEQ ID NO: 797425 - DNA, 18 bp, Homo sapiens
tggtaagcgatttgaaac

SEQ ID NO: 797426 - DNA, 18 bp, Homo sapiens
tggtaataacaaacgtgt

SEQ ID NO: 797427 - DNA, 14 bp, Homo sapiens
tggtaatgacagat

SEQ ID NO: 797428 - DNA, 15 bp, Homo sapiens
tggtaatgacagatg

SEQ ID NO: 797429 - DNA, 17 bp, Homo sapiens
tggtaatgacagatgca

SEQ ID NO: 797430 - DNA, 19 bp, Homo sapiens
tggtaatgatgttgataat

SEQ ID NO: 797431 - DNA, 22 bp, Homo sapiens
tggtacaaacctgcatggtgtt

SEQ ID NO: 797432 - DNA, 13 bp, Homo sapiens
tggtacaggaagg

SEQ ID NO: 797433 - DNA, 19 bp, Homo sapiens
tggtacataggcttctatt

SEQ ID NO: 797434 - DNA, 16 bp, Homo sapiens
tggtacatggccagtg

SEQ ID NO: 797435 - DNA, 17 bp, Homo sapiens
tggtacatgtcttccat

SEQ ID NO: 797436 - DNA, 13 bp, Homo sapiens
tggtacccagcca

SEQ ID NO: 797437 - DNA, 19 bp, Homo sapiens
tggtacccccaaaccccca

SEQ ID NO: 797438 - DNA, 14 bp, Homo sapiens
tggtaccctctgga

SEQ ID NO: 797439 - DNA, 15 bp, Homo sapiens
tggtaccttcagccc

SEQ ID NO: 797440 - DNA, 17 bp, Homo sapiens
tggtacctttctagcct

SEQ ID NO: 797441 - DNA, 18 bp, Homo sapiens
tggtactcaagccagcct

SEQ ID NO: 797442 - DNA, 17 bp, Homo sapiens
tggtactctcctagaga

SEQ ID NO: 797443 - DNA, 13 bp, Homo sapiens
tggtactgctgag

SEQ ID NO: 797444 - DNA, 16 bp, Homo sapiens
tggtacttcctttctc

SEQ ID NO: 797445 - DNA, 23 bp, Homo sapiens
tggtacttttatgatgtatattt

SEQ ID NO: 797446 - DNA, 17 bp, Homo sapiens
tggtacttttgagtgtg

SEQ ID NO: 797447 - DNA, 21 bp, Homo sapiens
tggtagaaaaaggggcctgag

SEQ ID NO: 797448 - DNA, 13 bp, Homo sapiens
tggtagagaggtt

SEQ ID NO: 797449 - DNA, 20 bp, Homo sapiens
tggtagatcttcaatttgga

SEQ ID NO: 797450 - DNA, 15 bp, Homo sapiens
tggtagcagcctggg

SEQ ID NO: 797451 - DNA, 21 bp, Homo sapiens
tggtagcataaataaaactga

SEQ ID NO: 797452 - DNA, 23 bp, Homo sapiens
tggtagcataaataaaactgaat

SEQ ID NO: 797453 - DNA, 18 bp, Homo sapiens
tggtagcattttaaacaa

SEQ ID NO: 797454 - DNA, 23 bp, Homo sapiens
tggtagctcatgcctgtaaccct

SEQ ID NO: 797455 - DNA, 16 bp, Homo sapiens
tggtaggaccaagcat

SEQ ID NO: 797456 - DNA, 16 bp, Homo sapiens
tggtaggcatttccta

SEQ ID NO: 797457 - DNA, 22 bp, Homo sapiens
tggtaggggagggcaggcttgg

SEQ ID NO: 797458 - DNA, 14 bp, Homo sapiens
tggtaggggcaggg

SEQ ID NO: 797459 - DNA, 14 bp, Homo sapiens
tggtaggttgggac

SEQ ID NO: 797460 - DNA, 22 bp, Homo sapiens
tggtagtaatcacagttggcct

SEQ ID NO: 797461 - DNA, 21 bp, Homo sapiens
tggtagtgtagctgtgtggct

SEQ ID NO: 797462 - DNA, 20 bp, Homo sapiens
tggtagttagtagcatgttg

SEQ ID NO: 797463 - DNA, 21 bp, Homo sapiens
tggtagttctgtgcctccccc

SEQ ID NO: 797464 - DNA, 16 bp, Homo sapiens
tggtataattgaaact

SEQ ID NO: 797465 - DNA, 21 bp, Homo sapiens
tggtatacattgaattcatta

SEQ ID NO: 797466 - DNA, 22 bp, Homo sapiens
tggtatatccaaaagcttttta

SEQ ID NO: 797467 - DNA, 22 bp, Homo sapiens
tggtatatggcttcaagttgta

SEQ ID NO: 797468 - DNA, 21 bp, Homo sapiens
tggtatcctcatcatgatgga

SEQ ID NO: 797469 - DNA, 14 bp, Homo sapiens
tggtatgagctgag

SEQ ID NO: 797470 - DNA, 15 bp, Homo sapiens
tggtatgatgtatat

SEQ ID NO: 797471 - DNA, 19 bp, Homo sapiens
tggtatggaactctctcca

SEQ ID NO: 797472 - DNA, 17 bp, Homo sapiens
tggtatgtgccaggctt

SEQ ID NO: 797473 - DNA, 24 bp, Homo sapiens
tggtattaactttatacacttgga

SEQ ID NO: 797474 - DNA, 20 bp, Homo sapiens
tggtattaatcttgtgtagt

SEQ ID NO: 797475 - DNA, 15 bp, Homo sapiens
tggtattacaaaaca

SEQ ID NO: 797476 - DNA, 20 bp, Homo sapiens
tggtattagttaaaacacat

SEQ ID NO: 797477 - DNA, 19 bp, Homo sapiens
tggtattcaggattacatg

SEQ ID NO: 797478 - DNA, 17 bp, Homo sapiens
tggtattctggtaggga

SEQ ID NO: 797479 - DNA, 12 bp, Homo sapiens
tggtattctgtc

SEQ ID NO: 797480 - DNA, 14 bp, Homo sapiens
tggtattctgtcat

SEQ ID NO: 797481 - DNA, 17 bp, Homo sapiens
tggtattgtaaaacatt

SEQ ID NO: 797482 - DNA, 21 bp, Homo sapiens
tggtattgtaaaacattcaca

SEQ ID NO: 797483 - DNA, 14 bp, Homo sapiens
tggtatttatgtaa

SEQ ID NO: 797484 - DNA, 17 bp, Homo sapiens
tggccgagctcctgggg

SEQ ID NO: 797485 - DNA, 21 bp, Homo sapiens
tggccgagctcctggggagct

SEQ ID NO: 797486 - DNA, 18 bp, Homo sapiens
tggccgagggtcctggct

SEQ ID NO: 797487 - DNA, 17 bp, Homo sapiens
tggccgccatctgcgca

SEQ ID NO: 797488 - DNA, 23 bp, Homo sapiens
tggccgccccctgccccccagcc

SEQ ID NO: 797489 - DNA, 18 bp, Homo sapiens
tggccgcgctccgggctt

SEQ ID NO: 797490 - DNA, 18 bp, Homo sapiens
tggccgcttctagagcct

SEQ ID NO: 797491 - DNA, 22 bp, Homo sapiens
tggccggagcaaactctgctgt

SEQ ID NO: 797492 - DNA, 12 bp, Homo sapiens
tggccgggcagg

SEQ ID NO: 797493 - DNA, 19 bp, Homo sapiens
tggccgggtaaagcaaggg

SEQ ID NO: 797494 - DNA, 17 bp, Homo sapiens
tggccgggtcaccctgt

SEQ ID NO: 797495 - DNA, 17 bp, Homo sapiens
tggccgggtgcggtggc

SEQ ID NO: 797496 - DNA, 14 bp, Homo sapiens
tggccgtctcctcc

SEQ ID NO: 797497 - DNA, 18 bp, Homo sapiens
tggcctaaaactggcctg

SEQ ID NO: 797498 - DNA, 16 bp, Homo sapiens
tggcctaaatttcttc

SEQ ID NO: 797499 - DNA, 18 bp, Homo sapiens
tggcctaatcactctgag

SEQ ID NO: 797500 - DNA, 20 bp, Homo sapiens
tggcctacattctttattct

SEQ ID NO: 797501 - DNA, 21 bp, Homo sapiens
tggcctagaccagcagacaga

SEQ ID NO: 797502 - DNA, 19 bp, Homo sapiens
tggcctatccgctgccagc

SEQ ID NO: 797503 - DNA, 21 bp, Homo sapiens
tggcctatccgctgccagcct

SEQ ID NO: 797504 - DNA, 21 bp, Homo sapiens
tggcctattatattaaaatat

SEQ ID NO: 797505 - DNA, 15 bp, Homo sapiens
tggcctcaaccctcc

SEQ ID NO: 797506 - DNA, 17 bp, Homo sapiens
tggcctcaaccctccct

SEQ ID NO: 797507 - DNA, 15 bp, Homo sapiens
tggcctcactggctg

SEQ ID NO: 797508 - DNA, 17 bp, Homo sapiens
tggcctcagaattcaca

SEQ ID NO: 797509 - DNA, 17 bp, Homo sapiens
tggcctcagccctcaga

SEQ ID NO: 797510 - DNA, 18 bp, Homo sapiens
tggcctcagctgaatgcc

SEQ ID NO: 797511 - DNA, 16 bp, Homo sapiens
tggcctcagctgcctc

SEQ ID NO: 797512 - DNA, 15 bp, Homo sapiens
tggcctcatgtggct

SEQ ID NO: 797513 - DNA, 17 bp, Homo sapiens
tggcctcatgtggctgg

SEQ ID NO: 797514 - DNA, 13 bp, Homo sapiens
tggcctcatttca

SEQ ID NO: 797515 - DNA, 20 bp, Homo sapiens
tggcctccaaaatattaaca

SEQ ID NO: 797516 - DNA, 13 bp, Homo sapiens
tggcctccagcct

SEQ ID NO: 797517 - DNA, 13 bp, Homo sapiens
tggcctcccaccc

SEQ ID NO: 797518 - DNA, 21 bp, Homo sapiens
tggcctcccacccgatgctgc

SEQ ID NO: 797519 - DNA, 23 bp, Homo sapiens
tggcctccccatgggcacagtgg

SEQ ID NO: 797520 - DNA, 22 bp, Homo sapiens
tggcctcccccaacacctgctg

SEQ ID NO: 797521 - DNA, 15 bp, Homo sapiens
tggcctcccctgcca

SEQ ID NO: 797522 - DNA, 19 bp, Homo sapiens
tggcctcccctgccaccag

SEQ ID NO: 797523 - DNA, 14 bp, Homo sapiens
tggcctccctggct

SEQ ID NO: 797524 - DNA, 16 bp, Homo sapiens
tggcctccctggctcc

SEQ ID NO: 797525 - DNA, 23 bp, Homo sapiens
tggcctccctggctcctccgtct

SEQ ID NO: 797526 - DNA, 19 bp, Homo sapiens
tggcctccgatgcctggcc

SEQ ID NO: 797527 - DNA, 20 bp, Homo sapiens
tggcctccgatgcctggcct

SEQ ID NO: 797528 - DNA, 17 bp, Homo sapiens
tggcctccgcagtgtct

SEQ ID NO: 797529 - DNA, 18 bp, Homo sapiens
tggcctccggcctcccct

SEQ ID NO: 797530 - DNA, 20 bp, Homo sapiens
tggcctcctaaggctcccca

SEQ ID NO: 797531 - DNA, 17 bp, Homo sapiens
tggcctccttttgctgt

SEQ ID NO: 797532 - DNA, 13 bp, Homo sapiens
tggcctctctagc

SEQ ID NO: 797533 - DNA, 17 bp, Homo sapiens
tggcctctctatcctct

SEQ ID NO: 797534 - DNA, 18 bp, Homo sapiens
tggcctctgcaaaggaaa

SEQ ID NO: 797535 - DNA, 19 bp, Homo sapiens
tggcctctgtgattacata

SEQ ID NO: 797536 - DNA, 19 bp, Homo sapiens
tggcctcttgagcagtggc

SEQ ID NO: 797537 - DNA, 22 bp, Homo sapiens
tggcctcttgagcagtggctgg

SEQ ID NO: 797538 - DNA, 22 bp, Homo sapiens
tggcctcttgagttcctctgca

SEQ ID NO: 797539 - DNA, 21 bp, Homo sapiens
tggcctcttggataccagctc

SEQ ID NO: 797540 - DNA, 23 bp, Homo sapiens
tggcctcttggataccagctcag

SEQ ID NO: 797541 - DNA, 16 bp, Homo sapiens
tggcctgaactgagga

SEQ ID NO: 797542 - DNA, 14 bp, Homo sapiens
tggcctgcactaat

SEQ ID NO: 797543 - DNA, 15 bp, Homo sapiens
tggcctgcccagcct

SEQ ID NO: 797544 - DNA, 16 bp, Homo sapiens
tggcctgcccagcctc

SEQ ID NO: 797545 - DNA, 13 bp, Homo sapiens
tggcctgctggga

SEQ ID NO: 797546 - DNA, 21 bp, Homo sapiens
tggcctgctgggctctccacc

SEQ ID NO: 797547 - DNA, 15 bp, Homo sapiens
tggcctggacagtat

SEQ ID NO: 797548 - DNA, 23 bp, Homo sapiens
tggcctggaccattcctgtccct

SEQ ID NO: 797549 - DNA, 18 bp, Homo sapiens
tggcctggagggactttt

SEQ ID NO: 797550 - DNA, 19 bp, Homo sapiens
tggcctggagggactttta

SEQ ID NO: 797551 - DNA, 21 bp, Homo sapiens
tggcctggatctccccactct

SEQ ID NO: 797552 - DNA, 21 bp, Homo sapiens
tggcctggattcacgccctct

SEQ ID NO: 797553 - DNA, 16 bp, Homo sapiens
tggcctggccctcctg

SEQ ID NO: 797554 - DNA, 13 bp, Homo sapiens
tggcctggccggc

SEQ ID NO: 797555 - DNA, 11 bp, Homo sapiens
tggcctggctc

SEQ ID NO: 797556 - DNA, 12 bp, Homo sapiens
tggcctggctcc

SEQ ID NO: 797557 - DNA, 17 bp, Homo sapiens
tggcctggctgcctggt

SEQ ID NO: 797558 - DNA, 13 bp, Homo sapiens
tggcctgggccac

SEQ ID NO: 797559 - DNA, 17 bp, Homo sapiens
tggcctgggccacacct

SEQ ID NO: 797560 - DNA, 17 bp, Homo sapiens
tggcctgggcttggccc

SEQ ID NO: 797561 - DNA, 17 bp, Homo sapiens
tggcctggtgggtcagg

SEQ ID NO: 797562 - DNA, 15 bp, Homo sapiens
tggcctgtagagttg

SEQ ID NO: 797563 - DNA, 18 bp, Homo sapiens
tggcctgtagagttgctg

SEQ ID NO: 797564 - DNA, 22 bp, Homo sapiens
tggcctgtccacctgtgctgct

SEQ ID NO: 797565 - DNA, 22 bp, Homo sapiens
tggcctgtctctattagctggg

SEQ ID NO: 797566 - DNA, 16 bp, Homo sapiens
tggcctgtctgcgtgg

SEQ ID NO: 797567 - DNA, 15 bp, Homo sapiens
tggcctgtgagtctc

SEQ ID NO: 797568 - DNA, 15 bp, Homo sapiens
tggcctgtggcctgt

SEQ ID NO: 797569 - DNA, 18 bp, Homo sapiens
tggcctgtgtccagcagc

SEQ ID NO: 797570 - DNA, 20 bp, Homo sapiens
tggcctgtgtcccatgaccc

SEQ ID NO: 797571 - DNA, 20 bp, Homo sapiens
tggcctgtttctgcagccct

SEQ ID NO: 797572 - DNA, 21 bp, Homo sapiens
tggcctgtttctgcagccctt

SEQ ID NO: 797573 - DNA, 19 bp, Homo sapiens
tggccttaaaaggggccca

SEQ ID NO: 797574 - DNA, 17 bp, Homo sapiens
tggccttaaagagggac

SEQ ID NO: 797575 - DNA, 13 bp, Homo sapiens
tggccttaagaac

SEQ ID NO: 797576 - DNA, 14 bp, Homo sapiens
tggccttaagaact

SEQ ID NO: 797577 - DNA, 16 bp, Homo sapiens
tggccttaatttcctt

SEQ ID NO: 797578 - DNA, 15 bp, Homo sapiens
tggccttccccagca

SEQ ID NO: 797579 - DNA, 21 bp, Homo sapiens
tggtatttatgtaaaaggatt

SEQ ID NO: 797580 - DNA, 12 bp, Homo sapiens
tggtatttctaa

SEQ ID NO: 797581 - DNA, 14 bp, Homo sapiens
tggtatttctaatt

SEQ ID NO: 797582 - DNA, 20 bp, Homo sapiens
tggtatttgcaccaacatag

SEQ ID NO: 797583 - DNA, 21 bp, Homo sapiens
tggtatttgcaccaacatagt

SEQ ID NO: 797584 - DNA, 14 bp, Homo sapiens
tggtattttatttt

SEQ ID NO: 797585 - DNA, 15 bp, Homo sapiens
tggtattttcaacca

SEQ ID NO: 797586 - DNA, 20 bp, Homo sapiens
tggtattttcaatagccact

SEQ ID NO: 797587 - DNA, 20 bp, Homo sapiens
tggtcaaaccgcactcaccc

SEQ ID NO: 797588 - DNA, 14 bp, Homo sapiens
tggtcaacacttaa

SEQ ID NO: 797589 - DNA, 14 bp, Homo sapiens
tggtcaacctcctg

SEQ ID NO: 797590 - DNA, 18 bp, Homo sapiens
tggtcaacctcctggaca

SEQ ID NO: 797591 - DNA, 22 bp, Homo sapiens
tggtcaagattttgaatgcttc

SEQ ID NO: 797592 - DNA, 16 bp, Homo sapiens
tggtcaagttcccaac

SEQ ID NO: 797593 - DNA, 22 bp, Homo sapiens
tggtcaatccgaagtatgaggg

SEQ ID NO: 797594 - DNA, 14 bp, Homo sapiens
tggtcacacactga

SEQ ID NO: 797595 - DNA, 16 bp, Homo sapiens
tggtcacacactgatg

SEQ ID NO: 797596 - DNA, 19 bp, Homo sapiens
tggtcacaggactctgcct

SEQ ID NO: 797597 - DNA, 21 bp, Homo sapiens
tggtcacagtcctatgtacag

SEQ ID NO: 797598 - DNA, 20 bp, Homo sapiens
tggtcaccaaatcagctgct

SEQ ID NO: 797599 - DNA, 18 bp, Homo sapiens
tggtcaccaaggcagtgc

SEQ ID NO: 797600 - DNA, 23 bp, Homo sapiens
tggtcaccaaggcagtgcatgca

SEQ ID NO: 797601 - DNA, 14 bp, Homo sapiens
tggtcaccagctcc

SEQ ID NO: 797602 - DNA, 16 bp, Homo sapiens
tggtcaccatgaaact

SEQ ID NO: 797603 - DNA, 17 bp, Homo sapiens
tggtcaccctggggctg

SEQ ID NO: 797604 - DNA, 21 bp, Homo sapiens
tggtcactaaccaacaaggtt

SEQ ID NO: 797605 - DNA, 22 bp, Homo sapiens
tggtcactccagtagctcctgg

SEQ ID NO: 797606 - DNA, 15 bp, Homo sapiens
tggtcactctgccct

SEQ ID NO: 797607 - DNA, 17 bp, Homo sapiens
tggtcactggtcagggc

SEQ ID NO: 797608 - DNA, 19 bp, Homo sapiens
tggtcactggtcagggcag

SEQ ID NO: 797609 - DNA, 19 bp, Homo sapiens
tggtcagaactgcagggcc

SEQ ID NO: 797610 - DNA, 14 bp, Homo sapiens
tggtcagagcccag

SEQ ID NO: 797611 - DNA, 12 bp, Homo sapiens
tggtcagaggag

SEQ ID NO: 797612 - DNA, 16 bp, Homo sapiens
tggtcagatttgaact

SEQ ID NO: 797613 - DNA, 22 bp, Homo sapiens
tggtcagatttgaactcttcaa

SEQ ID NO: 797614 - DNA, 20 bp, Homo sapiens
tggtcagccctaggataaaa

SEQ ID NO: 797615 - DNA, 19 bp, Homo sapiens
tggtcagctcccttctctg

SEQ ID NO: 797616 - DNA, 17 bp, Homo sapiens
tggtcaggctggtctca

SEQ ID NO: 797617 - DNA, 12 bp, Homo sapiens
tggtcagggcag

SEQ ID NO: 797618 - DNA, 21 bp, Homo sapiens
tggtcaggtatttcagttctt

SEQ ID NO: 797619 - DNA, 16 bp, Homo sapiens
tggtcagtattatcta

SEQ ID NO: 797620 - DNA, 15 bp, Homo sapiens
tggtcagtctttgct

SEQ ID NO: 797621 - DNA, 21 bp, Homo sapiens
tggtcataaaatagaataatt

SEQ ID NO: 797622 - DNA, 13 bp, Homo sapiens
tggtcatggaggc

SEQ ID NO: 797623 - DNA, 20 bp, Homo sapiens
tggtcatgtgggtcttccag

SEQ ID NO: 797624 - DNA, 18 bp, Homo sapiens
tggtcattatttcagtgt

SEQ ID NO: 797625 - DNA, 20 bp, Homo sapiens
tggtccaaaaaaaggaaaaa

SEQ ID NO: 797626 - DNA, 21 bp, Homo sapiens
tggtccaaaagattgctgaaa

SEQ ID NO: 797627 - DNA, 18 bp, Homo sapiens
tggtccaattagtttcct

SEQ ID NO: 797628 - DNA, 13 bp, Homo sapiens
tggtccagaaact

SEQ ID NO: 797629 - DNA, 14 bp, Homo sapiens
tggtccagcctggt

SEQ ID NO: 797630 - DNA, 12 bp, Homo sapiens
tggtccagctct

SEQ ID NO: 797631 - DNA, 13 bp, Homo sapiens
tggtccagctctg

SEQ ID NO: 797632 - DNA, 15 bp, Homo sapiens
tggtccagctctgac

SEQ ID NO: 797633 - DNA, 17 bp, Homo sapiens
tggtccagggaagctgg

SEQ ID NO: 797634 - DNA, 19 bp, Homo sapiens
tggtccagggaagctggcc

SEQ ID NO: 797635 - DNA, 15 bp, Homo sapiens
tggtccatgcagggg

SEQ ID NO: 797636 - DNA, 17 bp, Homo sapiens
tggtccatttgttcctg

SEQ ID NO: 797637 - DNA, 14 bp, Homo sapiens
tggtcccaagcctg

SEQ ID NO: 797638 - DNA, 16 bp, Homo sapiens
tggtcccatccaggca

SEQ ID NO: 797639 - DNA, 19 bp, Homo sapiens
tggtcccatggctgaagct

SEQ ID NO: 797640 - DNA, 17 bp, Homo sapiens
tggtccccagcattgca

SEQ ID NO: 797641 - DNA, 17 bp, Homo sapiens
tggtccccgttccaccc

SEQ ID NO: 797642 - DNA, 21 bp, Homo sapiens
tggtcccctccctcgtgggct

SEQ ID NO: 797643 - DNA, 23 bp, Homo sapiens
tggtcccctccctcgtgggcttg

SEQ ID NO: 797644 - DNA, 13 bp, Homo sapiens
tggtccctcgtcc

SEQ ID NO: 797645 - DNA, 20 bp, Homo sapiens
tggtccctcttctctcctca

SEQ ID NO: 797646 - DNA, 22 bp, Homo sapiens
tggtccctcttctctcctcagt

SEQ ID NO: 797647 - DNA, 14 bp, Homo sapiens
tggtccctggaagc

SEQ ID NO: 797648 - DNA, 15 bp, Homo sapiens
tggtccctggaagct

SEQ ID NO: 797649 - DNA, 16 bp, Homo sapiens
tggtccctggaagctt

SEQ ID NO: 797650 - DNA, 20 bp, Homo sapiens
tggtccgtgcccaggccctt

SEQ ID NO: 797651 - DNA, 21 bp, Homo sapiens
tggtcctccactttgctggtt

SEQ ID NO: 797652 - DNA, 14 bp, Homo sapiens
tggtcctctctctg

SEQ ID NO: 797653 - DNA, 12 bp, Homo sapiens
tggtcctgactc

SEQ ID NO: 797654 - DNA, 10 bp, Homo sapiens
tggtcctgga

SEQ ID NO: 797655 - DNA, 16 bp, Homo sapiens
tggtcctggacacctc

SEQ ID NO: 797656 - DNA, 17 bp, Homo sapiens
tggtcctggctgcactc

SEQ ID NO: 797657 - DNA, 14 bp, Homo sapiens
tggtcctggggctc

SEQ ID NO: 797658 - DNA, 19 bp, Homo sapiens
tggtcctggggctctgtgc

SEQ ID NO: 797659 - DNA, 16 bp, Homo sapiens
tggtccttatttattt

SEQ ID NO: 797660 - DNA, 19 bp, Homo sapiens
tggtccttccctgatggcc

SEQ ID NO: 797661 - DNA, 21 bp, Homo sapiens
tggtccttccctgatggcctt

SEQ ID NO: 797662 - DNA, 19 bp, Homo sapiens
tggtccttctgaccccact

SEQ ID NO: 797663 - DNA, 14 bp, Homo sapiens
tggtcctttacact

SEQ ID NO: 797664 - DNA, 13 bp, Homo sapiens
tggtcctttctcc

SEQ ID NO: 797665 - DNA, 16 bp, Homo sapiens
tggtcctttctccaca

SEQ ID NO: 797666 - DNA, 13 bp, Homo sapiens
tggtcgctcctgc

SEQ ID NO: 797667 - DNA, 15 bp, Homo sapiens
tggtcgctcctgccc

SEQ ID NO: 797668 - DNA, 16 bp, Homo sapiens
tggtcggatctcacag

SEQ ID NO: 797669 - DNA, 22 bp, Homo sapiens
tggtcggatctcacaggctgag

SEQ ID NO: 797670 - DNA, 14 bp, Homo sapiens
tggtctaaagtgtt

SEQ ID NO: 797671 - DNA, 16 bp, Homo sapiens
tggtctaaagtgttta

SEQ ID NO: 797672 - DNA, 17 bp, Homo sapiens
tggtctaaagtgtttag

SEQ ID NO: 797673 - DNA, 17 bp, Homo sapiens
tggtctaacactggcat

SEQ ID NO: 797674 - DNA, 18 bp, Homo sapiens
tggtctaaggttcagcct

SEQ ID NO: 797675 - DNA, 16 bp, Homo sapiens
tggtctataaaataaa

SEQ ID NO: 797676 - DNA, 12 bp, Homo sapiens
tggtctattttc

SEQ ID NO: 797677 - DNA, 17 bp, Homo sapiens
tggtctattttctgcag

SEQ ID NO: 797678 - DNA, 17 bp, Homo sapiens
tggtctattttgatttt

SEQ ID NO: 797679 - DNA, 16 bp, Homo sapiens
tggtctcaaactcctg

SEQ ID NO: 797680 - DNA, 18 bp, Homo sapiens
tggtctcacctggaggca

SEQ ID NO: 797681 - DNA, 12 bp, Homo sapiens
tggtctcaggat

SEQ ID NO: 797682 - DNA, 14 bp, Homo sapiens
tggtctcaggcagc

SEQ ID NO: 797683 - DNA, 23 bp, Homo sapiens
tggtctcccatatgcagaaatag

SEQ ID NO: 797684 - DNA, 22 bp, Homo sapiens
tggtctcgtcttccgtctcccc

SEQ ID NO: 797685 - DNA, 14 bp, Homo sapiens
tggtctctctccct

SEQ ID NO: 797686 - DNA, 22 bp, Homo sapiens
tggtctctctccctctgtcttt

SEQ ID NO: 797687 - DNA, 13 bp, Homo sapiens
tggtctgaatgtt

SEQ ID NO: 797688 - DNA, 14 bp, Homo sapiens
tggtctgaatgttc

SEQ ID NO: 797689 - DNA, 15 bp, Homo sapiens
tggtctgaatgttct

SEQ ID NO: 797690 - DNA, 16 bp, Homo sapiens
tggtctgaatgttctg

SEQ ID NO: 797691 - DNA, 22 bp, Homo sapiens
tggtctgaatgttctgacatta

SEQ ID NO: 797692 - DNA, 13 bp, Homo sapiens
tggtctgccagaa

SEQ ID NO: 797693 - DNA, 13 bp, Homo sapiens
tggtctggaaaca

SEQ ID NO: 797694 - DNA, 16 bp, Homo sapiens
tggtctggactgacag

SEQ ID NO: 797695 - DNA, 22 bp, Homo sapiens
tggtctgggtgtagctcttaga

SEQ ID NO: 797696 - DNA, 20 bp, Homo sapiens
tggtcttaaatgctcatttt

SEQ ID NO: 797697 - DNA, 20 bp, Homo sapiens
tggtcttaatgttgaatgta

SEQ ID NO: 797698 - DNA, 21 bp, Homo sapiens
tggtcttatgattttattaca

SEQ ID NO: 797699 - DNA, 14 bp, Homo sapiens
tggtcttctctaca

SEQ ID NO: 797700 - DNA, 22 bp, Homo sapiens
tggtcttgagccagtaatcttt

SEQ ID NO: 797701 - DNA, 19 bp, Homo sapiens
tggtcttgtttccaggagc

SEQ ID NO: 797702 - DNA, 14 bp, Homo sapiens
tggtctttctgtgc

SEQ ID NO: 797703 - DNA, 15 bp, Homo sapiens
tggtctttgctccag

SEQ ID NO: 797704 - DNA, 23 bp, Homo sapiens
tggtgtctcttctttagaacagg

SEQ ID NO: 797705 - DNA, 21 bp, Homo sapiens
tggtgtctcttttatgttcag

SEQ ID NO: 797706 - DNA, 17 bp, Homo sapiens
tggtgtgaacccgggag

SEQ ID NO: 797707 - DNA, 12 bp, Homo sapiens
tggtgtgaaggt

SEQ ID NO: 797708 - DNA, 13 bp, Homo sapiens
tggtgtgaccatg

SEQ ID NO: 797709 - DNA, 16 bp, Homo sapiens
tggtgtgatcgtctga

SEQ ID NO: 797710 - DNA, 18 bp, Homo sapiens
tggtgtgatcgtctgact

SEQ ID NO: 797711 - DNA, 16 bp, Homo sapiens
tggtgtgcggaggcag

SEQ ID NO: 797712 - DNA, 17 bp, Homo sapiens
tggtgtgcggaggcagg

SEQ ID NO: 797713 - DNA, 17 bp, Homo sapiens
tggtgtggggcgtggat

SEQ ID NO: 797714 - DNA, 15 bp, Homo sapiens
tggtgtgggtgtcct

SEQ ID NO: 797715 - DNA, 16 bp, Homo sapiens
tggtgtgggtgtcctg

SEQ ID NO: 797716 - DNA, 19 bp, Homo sapiens
tggtgtgtccccctctgtc

SEQ ID NO: 797717 - DNA, 14 bp, Homo sapiens
tggtgtgttggaca

SEQ ID NO: 797718 - DNA, 11 bp, Homo sapiens
tggtgtgtttc

SEQ ID NO: 797719 - DNA, 18 bp, Homo sapiens
tggtgttaaagctgtaca

SEQ ID NO: 797720 - DNA, 20 bp, Homo sapiens
tggtgttaaagctgtacacc

SEQ ID NO: 797721 - DNA, 21 bp, Homo sapiens
tggtgttacacagcccaagag

SEQ ID NO: 797722 - DNA, 16 bp, Homo sapiens
tggtgttcctggaagc

SEQ ID NO: 797723 - DNA, 20 bp, Homo sapiens
tggtgttcctggaagcaggt

SEQ ID NO: 797724 - DNA, 15 bp, Homo sapiens
tggtgttgggaaggg

SEQ ID NO: 797725 - DNA, 21 bp, Homo sapiens
tggtgttggggaaaccttcat

SEQ ID NO: 797726 - DNA, 16 bp, Homo sapiens
tggtgttgtatgcctt

SEQ ID NO: 797727 - DNA, 15 bp, Homo sapiens
tggtgtttgtctgtg

SEQ ID NO: 797728 - DNA, 20 bp, Homo sapiens
tggtgttttggggatgagag

SEQ ID NO: 797729 - DNA, 13 bp, Homo sapiens
tggtgttttgtca

SEQ ID NO: 797730 - DNA, 15 bp, Homo sapiens
tggtgtttttacaga

SEQ ID NO: 797731 - DNA, 17 bp, Homo sapiens
tggtgtttttcccccgc

SEQ ID NO: 797732 - DNA, 17 bp, Homo sapiens
tggtgttttttgttact

SEQ ID NO: 797733 - DNA, 20 bp, Homo sapiens
tggtgttttttgttactgtt

SEQ ID NO: 797734 - DNA, 14 bp, Homo sapiens
tggttaaaaaggcc

SEQ ID NO: 797735 - DNA, 17 bp, Homo sapiens
tggttaaaaaggccaaa

SEQ ID NO: 797736 - DNA, 22 bp, Homo sapiens
tggttaaaactgtacatttaaa

SEQ ID NO: 797737 - DNA, 14 bp, Homo sapiens
tggttaaaatgtga

SEQ ID NO: 797738 - DNA, 16 bp, Homo sapiens
tggttaaattttacat

SEQ ID NO: 797739 - DNA, 18 bp, Homo sapiens
tggttaaccctctcttga

SEQ ID NO: 797740 - DNA, 20 bp, Homo sapiens
tggttaaggccagggcctct

SEQ ID NO: 797741 - DNA, 17 bp, Homo sapiens
tggttaagggctcccta

SEQ ID NO: 797742 - DNA, 13 bp, Homo sapiens
tggttaataaaac

SEQ ID NO: 797743 - DNA, 17 bp, Homo sapiens
tggttaataaaactgca

SEQ ID NO: 797744 - DNA, 17 bp, Homo sapiens
tggttaatctttcctga

SEQ ID NO: 797745 - DNA, 16 bp, Homo sapiens
tggttaatgtagtatg

SEQ ID NO: 797746 - DNA, 15 bp, Homo sapiens
tggttaatttttcct

SEQ ID NO: 797747 - DNA, 20 bp, Homo sapiens
tggttaatttttcctgcatg

SEQ ID NO: 797748 - DNA, 17 bp, Homo sapiens
tggttacagtgcagaca

SEQ ID NO: 797749 - DNA, 20 bp, Homo sapiens
tggttactggtgatgttgaa

SEQ ID NO: 797750 - DNA, 15 bp, Homo sapiens
tggttacttcttctc

SEQ ID NO: 797751 - DNA, 18 bp, Homo sapiens
tggttacttcttctctta

SEQ ID NO: 797752 - DNA, 21 bp, Homo sapiens
tggttacttcttctcttagat

SEQ ID NO: 797753 - DNA, 12 bp, Homo sapiens
tggttactttgt

SEQ ID NO: 797754 - DNA, 14 bp, Homo sapiens
tggttagaaatgca

SEQ ID NO: 797755 - DNA, 16 bp, Homo sapiens
tggttagaatcttgtt

SEQ ID NO: 797756 - DNA, 17 bp, Homo sapiens
tggttatgaatactttg

SEQ ID NO: 797757 - DNA, 13 bp, Homo sapiens
tggttatgttttt

SEQ ID NO: 797758 - DNA, 13 bp, Homo sapiens
tggttattctaag

SEQ ID NO: 797759 - DNA, 21 bp, Homo sapiens
tggttatttttctcttgtacc

SEQ ID NO: 797760 - DNA, 24 bp, Homo sapiens
tggttatttttctcttgtaccata

SEQ ID NO: 797761 - DNA, 16 bp, Homo sapiens
tggttcagtcactgct

SEQ ID NO: 797762 - DNA, 23 bp, Homo sapiens
tggttcagtttttttttttccag

SEQ ID NO: 797763 - DNA, 14 bp, Homo sapiens
tggttccaagaaag

SEQ ID NO: 797764 - DNA, 20 bp, Homo sapiens
tggttccatgcagccttggg

SEQ ID NO: 797765 - DNA, 13 bp, Homo sapiens
tggttccatgcct

SEQ ID NO: 797766 - DNA, 21 bp, Homo sapiens
tggttcccaataaaagtgact

SEQ ID NO: 797767 - DNA, 15 bp, Homo sapiens
tggttcccaatgtgt

SEQ ID NO: 797768 - DNA, 16 bp, Homo sapiens
tggttccccagtagag

SEQ ID NO: 797769 - DNA, 11 bp, Homo sapiens
tggttcccctg

SEQ ID NO: 797770 - DNA, 20 bp, Homo sapiens
tggttcccctgttcactcta

SEQ ID NO: 797771 - DNA, 14 bp, Homo sapiens
tggttcctctctcc

SEQ ID NO: 797772 - DNA, 21 bp, Homo sapiens
tggttcctctctcccacccta

SEQ ID NO: 797773 - DNA, 18 bp, Homo sapiens
tggttcctgtttgaaact

SEQ ID NO: 797774 - DNA, 13 bp, Homo sapiens
tggttccttctct

SEQ ID NO: 797775 - DNA, 12 bp, Homo sapiens
tggttctatttt

SEQ ID NO: 797776 - DNA, 15 bp, Homo sapiens
tggttctcaatgaaa

SEQ ID NO: 797777 - DNA, 21 bp, Homo sapiens
tggttctccttcctcagcctc

SEQ ID NO: 797778 - DNA, 21 bp, Homo sapiens
tggttctcttcatccatttgt

SEQ ID NO: 797779 - DNA, 15 bp, Homo sapiens
tggttctgcttcaat

SEQ ID NO: 797780 - DNA, 12 bp, Homo sapiens
tggttctggggc

SEQ ID NO: 797781 - DNA, 19 bp, Homo sapiens
tggttcttagttctcactg

SEQ ID NO: 797782 - DNA, 22 bp, Homo sapiens
tggttcttcctttccctggagc

SEQ ID NO: 797783 - DNA, 14 bp, Homo sapiens
tggttcttttttca

SEQ ID NO: 797784 - DNA, 16 bp, Homo sapiens
tggttgaaaataaaaa

SEQ ID NO: 797785 - DNA, 23 bp, Homo sapiens
tggttgaactctggtggcacagg

SEQ ID NO: 797786 - DNA, 18 bp, Homo sapiens
tggttgaataaactagat

SEQ ID NO: 797787 - DNA, 12 bp, Homo sapiens
tggttgatggaa

SEQ ID NO: 797788 - DNA, 17 bp, Homo sapiens
tggttgatggaaaataa

SEQ ID NO: 797789 - DNA, 14 bp, Homo sapiens
tggttgatggtttt

SEQ ID NO: 797790 - DNA, 16 bp, Homo sapiens
tggttgattgtttaag

SEQ ID NO: 797791 - DNA, 20 bp, Homo sapiens
tggttgatttgtaacacagt

SEQ ID NO: 797792 - DNA, 19 bp, Homo sapiens
tggttgccaccccaaccca

SEQ ID NO: 797793 - DNA, 17 bp, Homo sapiens
tggttgcctcccccgcc

SEQ ID NO: 797794 - DNA, 17 bp, Homo sapiens
tggttgccttaaagaaa

SEQ ID NO: 797795 - DNA, 18 bp, Homo sapiens
tggttgccttaaagaaag

SEQ ID NO: 797796 - DNA, 16 bp, Homo sapiens
tggttggagaatttag

SEQ ID NO: 797797 - DNA, 18 bp, Homo sapiens
tggttggagagccctgga

SEQ ID NO: 797798 - DNA, 19 bp, Homo sapiens
tggttggagagccctggat

SEQ ID NO: 797799 - DNA, 20 bp, Homo sapiens
tggttgggacaatggcaata

SEQ ID NO: 797800 - DNA, 22 bp, Homo sapiens
tggttggtaacacaaattttca

SEQ ID NO: 797801 - DNA, 17 bp, Homo sapiens
tggttggttttatttgt

SEQ ID NO: 797802 - DNA, 15 bp, Homo sapiens
tggttgtcaatatta

SEQ ID NO: 797803 - DNA, 17 bp, Homo sapiens
tggttgtcaatattaaa

SEQ ID NO: 797804 - DNA, 12 bp, Homo sapiens
tggttgtcagaa

SEQ ID NO: 797805 - DNA, 14 bp, Homo sapiens
tggttgtcagaatg

SEQ ID NO: 797806 - DNA, 16 bp, Homo sapiens
tggttgtgaaatgtaa

SEQ ID NO: 797807 - DNA, 18 bp, Homo sapiens
tggttgtgaaatgtaaca

SEQ ID NO: 797808 - DNA, 12 bp, Homo sapiens
tggttgtgcctt

SEQ ID NO: 797809 - DNA, 16 bp, Homo sapiens
tggtttaaagaaagtg

SEQ ID NO: 797810 - DNA, 17 bp, Homo sapiens
tggtttaaagaaagtgt

SEQ ID NO: 797811 - DNA, 21 bp, Homo sapiens
tggtttaaagaaagtgtattt

SEQ ID NO: 797812 - DNA, 11 bp, Homo sapiens
tggtttataga

SEQ ID NO: 797813 - DNA, 17 bp, Homo sapiens
tggtttatataagacca

SEQ ID NO: 797814 - DNA, 15 bp, Homo sapiens
tggtttattcccaag

SEQ ID NO: 797815 - DNA, 21 bp, Homo sapiens
tggtttcaagttattcaaatt

SEQ ID NO: 797816 - DNA, 16 bp, Homo sapiens
tggtttcaattcagat

SEQ ID NO: 797817 - DNA, 16 bp, Homo sapiens
tggtttcaccttccct

SEQ ID NO: 797818 - DNA, 14 bp, Homo sapiens
tggtttcagaaatg

SEQ ID NO: 797819 - DNA, 15 bp, Homo sapiens
tggtttcagaaatgt

SEQ ID NO: 797820 - DNA, 11 bp, Homo sapiens
tggtttcagtg

SEQ ID NO: 797821 - DNA, 22 bp, Homo sapiens
tggtttcataacttcctgtact

SEQ ID NO: 797822 - DNA, 12 bp, Homo sapiens
tggtttcatgtt

SEQ ID NO: 797823 - DNA, 14 bp, Homo sapiens
tggtttccaatgtg

SEQ ID NO: 797824 - DNA, 21 bp, Homo sapiens
tggtttccacgatgaaaaact

SEQ ID NO: 797825 - DNA, 17 bp, Homo sapiens
tgtacagaccgagaggc

SEQ ID NO: 797826 - DNA, 21 bp, Homo sapiens
tgtacagaccgagaggccagt

SEQ ID NO: 797827 - DNA, 13 bp, Homo sapiens
tgtacagagactc

SEQ ID NO: 797828 - DNA, 17 bp, Homo sapiens
tgtacagagactctatt

SEQ ID NO: 797829 - DNA, 19 bp, Homo sapiens
tgtacagagtgcttttctg

SEQ ID NO: 797830 - DNA, 19 bp, Homo sapiens
tgtacagatgaatgataaa

SEQ ID NO: 797831 - DNA, 20 bp, Homo sapiens
tgtacagattgctgcttctg

SEQ ID NO: 797832 - DNA, 22 bp, Homo sapiens
tgtacagcaaggagatttacaa

SEQ ID NO: 797833 - DNA, 13 bp, Homo sapiens
tgtacagcacaga

SEQ ID NO: 797834 - DNA, 14 bp, Homo sapiens
tgtacagcacagaa

SEQ ID NO: 797835 - DNA, 12 bp, Homo sapiens
tgtacagctctc

SEQ ID NO: 797836 - DNA, 17 bp, Homo sapiens
tgtacaggaaaaaccga

SEQ ID NO: 797837 - DNA, 21 bp, Homo sapiens
tgtacaggaaggtgcctggcc

SEQ ID NO: 797838 - DNA, 19 bp, Homo sapiens
tgtacaggaagtagttcta

SEQ ID NO: 797839 - DNA, 17 bp, Homo sapiens
tgtacaggactgtaaag

SEQ ID NO: 797840 - DNA, 22 bp, Homo sapiens
tgtacagtaatatgtttaatgt

SEQ ID NO: 797841 - DNA, 18 bp, Homo sapiens
tgtacagtagattttcca

SEQ ID NO: 797842 - DNA, 20 bp, Homo sapiens
tgtacagtagattttccaaa

SEQ ID NO: 797843 - DNA, 15 bp, Homo sapiens
tgtacagtctgtcat

SEQ ID NO: 797844 - DNA, 18 bp, Homo sapiens
tgtacagtctgtcatgaa

SEQ ID NO: 797845 - DNA, 12 bp, Homo sapiens
tgtacagtcttg

SEQ ID NO: 797846 - DNA, 17 bp, Homo sapiens
tgtacagtcttgtatta

SEQ ID NO: 797847 - DNA, 22 bp, Homo sapiens
tgtacagtgtctgtgccatgga

SEQ ID NO: 797848 - DNA, 19 bp, Homo sapiens
tgtacagtgtgtaaagtgt

SEQ ID NO: 797849 - DNA, 12 bp, Homo sapiens
tgtacagtgtta

SEQ ID NO: 797850 - DNA, 13 bp, Homo sapiens
tgtacagtgttac

SEQ ID NO: 797851 - DNA, 17 bp, Homo sapiens
tgtacagttatctaagt

SEQ ID NO: 797852 - DNA, 22 bp, Homo sapiens
tgtacagttatctaagttaatt

SEQ ID NO: 797853 - DNA, 16 bp, Homo sapiens
tgtacataaaagaatt

SEQ ID NO: 797854 - DNA, 18 bp, Homo sapiens
tgtacataaaagaatttt

SEQ ID NO: 797855 - DNA, 13 bp, Homo sapiens
tgtacataactga

SEQ ID NO: 797856 - DNA, 14 bp, Homo sapiens
tgtacataactgaa

SEQ ID NO: 797857 - DNA, 15 bp, Homo sapiens
tgtacataactgaaa

SEQ ID NO: 797858 - DNA, 14 bp, Homo sapiens
tgtacatacattgt

SEQ ID NO: 797859 - DNA, 18 bp, Homo sapiens
tgtacatacattgtatag

SEQ ID NO: 797860 - DNA, 14 bp, Homo sapiens
tgtacatactggcc

SEQ ID NO: 797861 - DNA, 18 bp, Homo sapiens
tgtacatactggcctctg

SEQ ID NO: 797862 - DNA, 19 bp, Homo sapiens
tgtacatactggcctctgt

SEQ ID NO: 797863 - DNA, 20 bp, Homo sapiens
tgtacatactggcctctgtg

SEQ ID NO: 797864 - DNA, 22 bp, Homo sapiens
tgtacatagttatttttctctt

SEQ ID NO: 797865 - DNA, 18 bp, Homo sapiens
tgtacatatgtaaaataa

SEQ ID NO: 797866 - DNA, 17 bp, Homo sapiens
tgtacatatgtgctgga

SEQ ID NO: 797867 - DNA, 15 bp, Homo sapiens
tgtacatattactgt

SEQ ID NO: 797868 - DNA, 19 bp, Homo sapiens
tgtacatatttgtggaata

SEQ ID NO: 797869 - DNA, 17 bp, Homo sapiens
tgtacatcatgttattt

SEQ ID NO: 797870 - DNA, 16 bp, Homo sapiens
tgtacatcccaaagga

SEQ ID NO: 797871 - DNA, 21 bp, Homo sapiens
tgtacatcgtttactttttaa

SEQ ID NO: 797872 - DNA, 20 bp, Homo sapiens
tgtacatctattttggattg

SEQ ID NO: 797873 - DNA, 19 bp, Homo sapiens
tgtacatgaaaacacattt

SEQ ID NO: 797874 - DNA, 20 bp, Homo sapiens
tgtacatgaaaacacatttt

SEQ ID NO: 797875 - DNA, 22 bp, Homo sapiens
tgtacatgtgtagggaaagtta

SEQ ID NO: 797876 - DNA, 14 bp, Homo sapiens
tgtacattaattac

SEQ ID NO: 797877 - DNA, 14 bp, Homo sapiens
tgtacattcttcca

SEQ ID NO: 797878 - DNA, 23 bp, Homo sapiens
tgtacattcttccatcatcactg

SEQ ID NO: 797879 - DNA, 24 bp, Homo sapiens
tgtacattgtgagctctggttatt

SEQ ID NO: 797880 - DNA, 17 bp, Homo sapiens
tgtacatttaataatat

SEQ ID NO: 797881 - DNA, 20 bp, Homo sapiens
tgtacatttatgttccttta

SEQ ID NO: 797882 - DNA, 17 bp, Homo sapiens
tgtacatttattcatag

SEQ ID NO: 797883 - DNA, 18 bp, Homo sapiens
tgtacatttccaaattca

SEQ ID NO: 797884 - DNA, 21 bp, Homo sapiens
tgtacatttccaaattcacaa

SEQ ID NO: 797885 - DNA, 16 bp, Homo sapiens
tgtacatttgggagtt

SEQ ID NO: 797886 - DNA, 17 bp, Homo sapiens
tgtacattttttttcaa

SEQ ID NO: 797887 - DNA, 18 bp, Homo sapiens
tgtaccacatctgctcta

SEQ ID NO: 797888 - DNA, 19 bp, Homo sapiens
tgtaccacttctgtgggca

SEQ ID NO: 797889 - DNA, 16 bp, Homo sapiens
tgtaccacttttgcaa

SEQ ID NO: 797890 - DNA, 11 bp, Homo sapiens
tgtaccagtta

SEQ ID NO: 797891 - DNA, 21 bp, Homo sapiens
tgtaccatgaaacaaagctgc

SEQ ID NO: 797892 - DNA, 19 bp, Homo sapiens
tgtaccattccttcaaata

SEQ ID NO: 797893 - DNA, 14 bp, Homo sapiens
tgtaccatttgcct

SEQ ID NO: 797894 - DNA, 13 bp, Homo sapiens
tgtacccacccca

SEQ ID NO: 797895 - DNA, 15 bp, Homo sapiens
tgtacccaccccagc

SEQ ID NO: 797896 - DNA, 19 bp, Homo sapiens
tgtacccaccccagcacag

SEQ ID NO: 797897 - DNA, 14 bp, Homo sapiens
tgtacccagctcct

SEQ ID NO: 797898 - DNA, 15 bp, Homo sapiens
tgtacctcagtggat

SEQ ID NO: 797899 - DNA, 22 bp, Homo sapiens
tgtacctcagtggatcttcaga

SEQ ID NO: 797900 - DNA, 18 bp, Homo sapiens
tgtacctcccctgccttg

SEQ ID NO: 797901 - DNA, 18 bp, Homo sapiens
tgtacctctaagtacata

SEQ ID NO: 797902 - DNA, 22 bp, Homo sapiens
tgtacctcttgagccttgaact

SEQ ID NO: 797903 - DNA, 16 bp, Homo sapiens
tgtacctgtgtacata

SEQ ID NO: 797904 - DNA, 17 bp, Homo sapiens
tgtacctgttccttaga

SEQ ID NO: 797905 - DNA, 18 bp, Homo sapiens
tgtaccttctttcactct

SEQ ID NO: 797906 - DNA, 22 bp, Homo sapiens
tgtaccttttgaggagccccag

SEQ ID NO: 797907 - DNA, 21 bp, Homo sapiens
tgtaccttttttgttttttca

SEQ ID NO: 797908 - DNA, 21 bp, Homo sapiens
tgtacggattttcagttactt

SEQ ID NO: 797909 - DNA, 14 bp, Homo sapiens
tgtacgtactgcat

SEQ ID NO: 797910 - DNA, 20 bp, Homo sapiens
tgtacgtttgtatgtgtgta

SEQ ID NO: 797911 - DNA, 15 bp, Homo sapiens
tgtactaaggagcat

SEQ ID NO: 797912 - DNA, 22 bp, Homo sapiens
tgtactaatctgagattgtgtt

SEQ ID NO: 797913 - DNA, 21 bp, Homo sapiens
tgtactacgtgccagctctag

SEQ ID NO: 797914 - DNA, 18 bp, Homo sapiens
tgtactagtcctctagaa

SEQ ID NO: 797915 - DNA, 15 bp, Homo sapiens
tgtactatgtctgaa

SEQ ID NO: 797916 - DNA, 17 bp, Homo sapiens
tgtactcaaagcccaga

SEQ ID NO: 797917 - DNA, 19 bp, Homo sapiens
tgtactcaaagcccagaat

SEQ ID NO: 797918 - DNA, 20 bp, Homo sapiens
tgtactcaaagcccagaatc

SEQ ID NO: 797919 - DNA, 15 bp, Homo sapiens
tgtactcagagcaga

SEQ ID NO: 797920 - DNA, 16 bp, Homo sapiens
tgtactccagcctggg

SEQ ID NO: 797921 - DNA, 16 bp, Homo sapiens
tgtactcccagcactt

SEQ ID NO: 797922 - DNA, 13 bp, Homo sapiens
tgtactcctccca

SEQ ID NO: 797923 - DNA, 13 bp, Homo sapiens
tgtactcttccga

SEQ ID NO: 797924 - DNA, 13 bp, Homo sapiens
tgtactcttgctg

SEQ ID NO: 797925 - DNA, 12 bp, Homo sapiens
tgtactgaaaaa

SEQ ID NO: 797926 - DNA, 23 bp, Homo sapiens
tgtactgaatttttttgtaataa

SEQ ID NO: 797927 - DNA, 20 bp, Homo sapiens
tgtactgagccttgtaattc

SEQ ID NO: 797928 - DNA, 18 bp, Homo sapiens
tgtactgcatgtgacttc

SEQ ID NO: 797929 - DNA, 16 bp, Homo sapiens
tgtactgctcaggctg

SEQ ID NO: 797930 - DNA, 17 bp, Homo sapiens
tgtactgctcaggctgc

SEQ ID NO: 797931 - DNA, 20 bp, Homo sapiens
tgtactggaggctctgttct

SEQ ID NO: 797932 - DNA, 13 bp, Homo sapiens
tgtactgtacata

SEQ ID NO: 797933 - DNA, 16 bp, Homo sapiens
tgtactgtctgttatg

SEQ ID NO: 797934 - DNA, 14 bp, Homo sapiens
tgtactgtgcctgg

SEQ ID NO: 797935 - DNA, 16 bp, Homo sapiens
tgtactgttctgtgtc

SEQ ID NO: 797936 - DNA, 19 bp, Homo sapiens
tgtactgttgctttaatat

SEQ ID NO: 797937 - DNA, 19 bp, Homo sapiens
tgtacttaaatgagttact

SEQ ID NO: 797938 - DNA, 20 bp, Homo sapiens
tgtacttaaatgagttactt

SEQ ID NO: 797939 - DNA, 16 bp, Homo sapiens
tgtacttagctgtact

SEQ ID NO: 797940 - DNA, 18 bp, Homo sapiens
tgtacttagctgtactat

SEQ ID NO: 797941 - DNA, 18 bp, Homo sapiens
tgtacttcccgggccagg

SEQ ID NO: 797942 - DNA, 22 bp, Homo sapiens
tgtacttcccgggccagggctg

SEQ ID NO: 797943 - DNA, 15 bp, Homo sapiens
tgtacttcctgtgta

SEQ ID NO: 797944 - DNA, 16 bp, Homo sapiens
tgtacttcctgtgtac

SEQ ID NO: 797945 - DNA, 17 bp, Homo sapiens
tgtacttctgtgttcat

SEQ ID NO: 797946 - DNA, 17 bp, Homo sapiens
tgtagaacactaattca

SEQ ID NO: 797947 - DNA, 19 bp, Homo sapiens
tgtagaacactaattcata

SEQ ID NO: 797948 - DNA, 20 bp, Homo sapiens
tgtagaacactaattcataa

SEQ ID NO: 797949 - DNA, 17 bp, Homo sapiens
tgtagaactcactctgg

SEQ ID NO: 797950 - DNA, 14 bp, Homo sapiens
tgtagaagaaaata

SEQ ID NO: 797951 - DNA, 13 bp, Homo sapiens
tgtagaaggcaca

SEQ ID NO: 797952 - DNA, 14 bp, Homo sapiens
tgtagaataaatgg

SEQ ID NO: 797953 - DNA, 15 bp, Homo sapiens
tgtagaatattcaga

SEQ ID NO: 797954 - DNA, 18 bp, Homo sapiens
tgtagaatgatttcatgc

SEQ ID NO: 797955 - DNA, 17 bp, Homo sapiens
tgtagaattgaaaatgc

SEQ ID NO: 797956 - DNA, 18 bp, Homo sapiens
tgtagaattgaaaatgca

SEQ ID NO: 797957 - DNA, 21 bp, Homo sapiens
tgtagacatgcccaaaactta

SEQ ID NO: 797958 - DNA, 15 bp, Homo sapiens
tgtagacctgagctg

SEQ ID NO: 797959 - DNA, 18 bp, Homo sapiens
tgtagacctgagctggga

SEQ ID NO: 797960 - DNA, 11 bp, Homo sapiens
tgtagactagt

SEQ ID NO: 797961 - DNA, 20 bp, Homo sapiens
tgtagactctaagatacact

SEQ ID NO: 797962 - DNA, 22 bp, Homo sapiens
tgtagactgtaactttttttca

SEQ ID NO: 797963 - DNA, 14 bp, Homo sapiens
tgtagactgtttca

SEQ ID NO: 797964 - DNA, 21 bp, Homo sapiens
tgtagacttctggttgtattt

SEQ ID NO: 797965 - DNA, 21 bp, Homo sapiens
tgtagatagttaaaagactgc

SEQ ID NO: 797966 - DNA, 21 bp, Homo sapiens
tgtagatattgtgaagtacat

SEQ ID NO: 797967 - DNA, 22 bp, Homo sapiens
tgtagatattgtgaagtacata

SEQ ID NO: 797968 - DNA, 24 bp, Homo sapiens
tgtagatattgttttctgtaaata

SEQ ID NO: 797969 - DNA, 13 bp, Homo sapiens
tgtagatcccaag

SEQ ID NO: 797970 - DNA, 20 bp, Homo sapiens
tgtagatgggggaactgtga

SEQ ID NO: 797971 - DNA, 18 bp, Homo sapiens
tgtagatggtgacctggg

SEQ ID NO: 797972 - DNA, 14 bp, Homo sapiens
tgtagatgtagcat

SEQ ID NO: 797973 - DNA, 17 bp, Homo sapiens
tgtagatgtagcattgt

SEQ ID NO: 797974 - DNA, 22 bp, Homo sapiens
tgtagatgtagcattgttccac

SEQ ID NO: 797975 - DNA, 14 bp, Homo sapiens
tgtagattgattgt

SEQ ID NO: 797976 - DNA, 15 bp, Homo sapiens
tgtagatttatttca

SEQ ID NO: 797977 - DNA, 20 bp, Homo sapiens
tgtagcaaccttctgcattc

SEQ ID NO: 797978 - DNA, 21 bp, Homo sapiens
tgtagcaatggccagagcctc

SEQ ID NO: 797979 - DNA, 13 bp, Homo sapiens
tgtagcagaaagg

SEQ ID NO: 797980 - DNA, 22 bp, Homo sapiens
tgtagcaggggaattccctccc

SEQ ID NO: 797981 - DNA, 17 bp, Homo sapiens
tgtagcaggtgtaaccg

SEQ ID NO: 797982 - DNA, 11 bp, Homo sapiens
tgtagcagtga

SEQ ID NO: 797983 - DNA, 14 bp, Homo sapiens
tgtagcataactgt

SEQ ID NO: 797984 - DNA, 15 bp, Homo sapiens
tgtagcataactgta

SEQ ID NO: 797985 - DNA, 20 bp, Homo sapiens
tgtagcataactgtagctca

SEQ ID NO: 797986 - DNA, 16 bp, Homo sapiens
tgtagcatcttctgga

SEQ ID NO: 797987 - DNA, 16 bp, Homo sapiens
tgtagcattgttccac

SEQ ID NO: 797988 - DNA, 22 bp, Homo sapiens
tgtagcatttaaaatggaaaat

SEQ ID NO: 797989 - DNA, 13 bp, Homo sapiens
tgtagccacagct

SEQ ID NO: 797990 - DNA, 22 bp, Homo sapiens
tgtagccacagctgctgttctc

SEQ ID NO: 797991 - DNA, 23 bp, Homo sapiens
tgtagccacagctgctgttctca

SEQ ID NO: 797992 - DNA, 18 bp, Homo sapiens
tgtagccagctgtgcact

SEQ ID NO: 797993 - DNA, 21 bp, Homo sapiens
tgtagccaggtatggctctgc

SEQ ID NO: 797994 - DNA, 14 bp, Homo sapiens
tgtagccatggctc

SEQ ID NO: 797995 - DNA, 16 bp, Homo sapiens
tgtagccatggctggg

SEQ ID NO: 797996 - DNA, 20 bp, Homo sapiens
tgtagccatggctgggcgtg

SEQ ID NO: 797997 - DNA, 21 bp, Homo sapiens
tgtagccccagtgacagctag

SEQ ID NO: 797998 - DNA, 19 bp, Homo sapiens
tgtagccccctggcctctg

SEQ ID NO: 797999 - DNA, 20 bp, Homo sapiens
tgtagccccctggcctctgt

SEQ ID NO: 798000 - DNA, 15 bp, Homo sapiens
tgtagccgccctgag

SEQ ID NO: 798001 - DNA, 16 bp, Homo sapiens
tgtagcctaaagggca

SEQ ID NO: 798002 - DNA, 17 bp, Homo sapiens
tgtagcctaaagggcag

SEQ ID NO: 798003 - DNA, 15 bp, Homo sapiens
tgtagcctcagatga

SEQ ID NO: 798004 - DNA, 21 bp, Homo sapiens
tgtagccttcctccacatcct

SEQ ID NO: 798005 - DNA, 14 bp, Homo sapiens
tgtagccttctccc

SEQ ID NO: 798006 - DNA, 19 bp, Homo sapiens
tgtagcgaccccagactgt

SEQ ID NO: 798007 - DNA, 14 bp, Homo sapiens
tgtagcgggaggaa

SEQ ID NO: 798008 - DNA, 19 bp, Homo sapiens
tgtagcgtcctgaggaata

SEQ ID NO: 798009 - DNA, 15 bp, Homo sapiens
tgtagctaaaaataa

SEQ ID NO: 798010 - DNA, 21 bp, Homo sapiens
tgtagctagaacttctctaag

SEQ ID NO: 798011 - DNA, 22 bp, Homo sapiens
tgtagctattagcggctcctcg

SEQ ID NO: 798012 - DNA, 15 bp, Homo sapiens
tgtagctcaagttta

SEQ ID NO: 798013 - DNA, 13 bp, Homo sapiens
tgtagctcagtca

SEQ ID NO: 798014 - DNA, 17 bp, Homo sapiens
tgtagctcagtcatcaa

SEQ ID NO: 798015 - DNA, 14 bp, Homo sapiens
tgtagctctgcctc

SEQ ID NO: 798016 - DNA, 15 bp, Homo sapiens
tgtagctgaggaggc

SEQ ID NO: 798017 - DNA, 14 bp, Homo sapiens
tgtagctgatgaaa

SEQ ID NO: 798018 - DNA, 15 bp, Homo sapiens
tgtagctgtaagggc

SEQ ID NO: 798019 - DNA, 17 bp, Homo sapiens
tgtagctgtaagggcag

SEQ ID NO: 798020 - DNA, 22 bp, Homo sapiens
tgtagctgtaagggcagtgccc

SEQ ID NO: 798021 - DNA, 16 bp, Homo sapiens
tgtagcttccacctca

SEQ ID NO: 798022 - DNA, 16 bp, Homo sapiens
tgtagctttaaaacca

SEQ ID NO: 798023 - DNA, 14 bp, Homo sapiens
tgtagctttctgga

SEQ ID NO: 798024 - DNA, 13 bp, Homo sapiens
tgtagctttgctc

SEQ ID NO: 798025 - DNA, 13 bp, Homo sapiens
tgtaggagaaact

SEQ ID NO: 798026 - DNA, 18 bp, Homo sapiens
tgtaggagaaactcccat

SEQ ID NO: 798027 - DNA, 11 bp, Homo sapiens
tgtaggagaat

SEQ ID NO: 798028 - DNA, 17 bp, Homo sapiens
tgtaggagctgaggttt

SEQ ID NO: 798029 - DNA, 12 bp, Homo sapiens
tgtaggcagaca

SEQ ID NO: 798030 - DNA, 16 bp, Homo sapiens
tgtaggcagacacagg

SEQ ID NO: 798031 - DNA, 14 bp, Homo sapiens
tgtaggcagggaac

SEQ ID NO: 798032 - DNA, 19 bp, Homo sapiens
tgtaggctgttccctttgc

SEQ ID NO: 798033 - DNA, 11 bp, Homo sapiens
tgtagggacca

SEQ ID NO: 798034 - DNA, 17 bp, Homo sapiens
tgtagggagaagcttta

SEQ ID NO: 798035 - DNA, 13 bp, Homo sapiens
tgtagggcaaggg

SEQ ID NO: 798036 - DNA, 24 bp, Homo sapiens
tgtagggcacccaaaactcaagca

SEQ ID NO: 798037 - DNA, 14 bp, Homo sapiens
tgtaggggccacct

SEQ ID NO: 798038 - DNA, 15 bp, Homo sapiens
tgtaggggccacctc

SEQ ID NO: 798039 - DNA, 18 bp, Homo sapiens
tgtaggggccacctcctc

SEQ ID NO: 798040 - DNA, 18 bp, Homo sapiens
tgtagggtaaggtgcctt

SEQ ID NO: 798041 - DNA, 23 bp, Homo sapiens
tgtagggtagcggaaaagttgtc

SEQ ID NO: 798042 - DNA, 16 bp, Homo sapiens
tgtagggttacagaga

SEQ ID NO: 798043 - DNA, 17 bp, Homo sapiens
tgtagggttataataat

SEQ ID NO: 798044 - DNA, 14 bp, Homo sapiens
tgtaggtgagcctg

SEQ ID NO: 798045 - DNA, 15 bp, Homo sapiens
tgtaggtgagcctgg

SEQ ID NO: 798046 - DNA, 19 bp, Homo sapiens
tgtaggtgtctctgggcct

SEQ ID NO: 798047 - DNA, 20 bp, Homo sapiens
tgtaggtgtctctgggcctg

SEQ ID NO: 798048 - DNA, 16 bp, Homo sapiens
tgtaggtgtctgcctt

SEQ ID NO: 798049 - DNA, 15 bp, Homo sapiens
tgtagtaaagaaatt

SEQ ID NO: 798050 - DNA, 15 bp, Homo sapiens
tgtagtaacactaat

SEQ ID NO: 798051 - DNA, 22 bp, Homo sapiens
tgtagtagcgttttttaaatgt

SEQ ID NO: 798052 - DNA, 13 bp, Homo sapiens
tgtagtcccagct

SEQ ID NO: 798053 - DNA, 14 bp, Homo sapiens
tgtagtcccagcta

SEQ ID NO: 798054 - DNA, 21 bp, Homo sapiens
tgtagtcctcataaaaagcaa

SEQ ID NO: 798055 - DNA, 22 bp, Homo sapiens
tgtagtgaatcacgtaaagcta

SEQ ID NO: 798056 - DNA, 21 bp, Homo sapiens
tgtagtgagatagcattgtga

SEQ ID NO: 798057 - DNA, 17 bp, Homo sapiens
tgtagtgattaaatata

SEQ ID NO: 798058 - DNA, 19 bp, Homo sapiens
tgtagtgcatttttaaact

SEQ ID NO: 798059 - DNA, 20 bp, Homo sapiens
tgtagtgctcgagtcacatt

SEQ ID NO: 798060 - DNA, 18 bp, Homo sapiens
tgtagtggaagagcagcc

SEQ ID NO: 798061 - DNA, 22 bp, Homo sapiens
tgtagtgtattaatctctgtgt

SEQ ID NO: 798062 - DNA, 13 bp, Homo sapiens
tgtagttaatgat

SEQ ID NO: 798063 - DNA, 18 bp, Homo sapiens
tgtagttacctactgagt

SEQ ID NO: 798064 - DNA, 14 bp, Homo sapiens
tgtagttaggaaat

SEQ ID NO: 798065 - DNA, 15 bp, Homo sapiens
tgtagttaggaaata

SEQ ID NO: 798066 - DNA, 16 bp, Homo sapiens
tgtagttctgccaggc

SEQ ID NO: 798067 - DNA, 17 bp, Homo sapiens
tgtagttctgtgtactt

SEQ ID NO: 798068 - DNA, 19 bp, Homo sapiens
tgtagtttttatatgttgt

SEQ ID NO: 798069 - DNA, 20 bp, Homo sapiens
tgtagtttttatatgttgta

SEQ ID NO: 798070 - DNA, 17 bp, Homo sapiens
tgtataaaaaggaaatt

SEQ ID NO: 798071 - DNA, 23 bp, Homo sapiens
tgtataaaaattatcaaaaagct

SEQ ID NO: 798072 - DNA, 13 bp, Homo sapiens
tgtataaaataga

SEQ ID NO: 798073 - DNA, 21 bp, Homo sapiens
tgtataaaatccaaaatgaat

SEQ ID NO: 798074 - DNA, 13 bp, Homo sapiens
tgtataaagaaca

SEQ ID NO: 798075 - DNA, 15 bp, Homo sapiens
tgtataaagattgta

SEQ ID NO: 798076 - DNA, 19 bp, Homo sapiens
tgtataaagattgtactta

SEQ ID NO: 798077 - DNA, 12 bp, Homo sapiens
tgtataaataag

SEQ ID NO: 798078 - DNA, 14 bp, Homo sapiens
tgtataaataagag

SEQ ID NO: 798079 - DNA, 17 bp, Homo sapiens
tgtataaataagagcat

SEQ ID NO: 798080 - DNA, 21 bp, Homo sapiens
tgtataaatccaatatcatgt

SEQ ID NO: 798081 - DNA, 19 bp, Homo sapiens
tgtataaatggacctttta

SEQ ID NO: 798082 - DNA, 18 bp, Homo sapiens
tgtataaatgtacatttc

SEQ ID NO: 798083 - DNA, 19 bp, Homo sapiens
tgtataaattaaataaact

SEQ ID NO: 798084 - DNA, 13 bp, Homo sapiens
tgtataaattaat

SEQ ID NO: 798085 - DNA, 20 bp, Homo sapiens
tgtataaattaatacagagt

SEQ ID NO: 798086 - DNA, 15 bp, Homo sapiens
tgtataaattgtctt

SEQ ID NO: 798087 - DNA, 15 bp, Homo sapiens
tgtataaccaagtgt

SEQ ID NO: 798088 - DNA, 18 bp, Homo sapiens
tgtataaccaagtgtgct

SEQ ID NO: 798089 - DNA, 20 bp, Homo sapiens
tgtataaccaagtgtgctct

SEQ ID NO: 798090 - DNA, 18 bp, Homo sapiens
tgtataagcactgaaaaa

SEQ ID NO: 798091 - DNA, 18 bp, Homo sapiens
tgtataagtaagaaaata

SEQ ID NO: 798092 - DNA, 16 bp, Homo sapiens
tgtataagtcaagcac

SEQ ID NO: 798093 - DNA, 17 bp, Homo sapiens
tgtataagtcaagcaca

SEQ ID NO: 798094 - DNA, 22 bp, Homo sapiens
tgtataagtcaagcacatgtaa

SEQ ID NO: 798095 - DNA, 16 bp, Homo sapiens
tgtataagtggaggca

SEQ ID NO: 798096 - DNA, 23 bp, Homo sapiens
tgtataagtggaggcactttagg

SEQ ID NO: 798097 - DNA, 19 bp, Homo sapiens
tgtataagtgtaaatataa

SEQ ID NO: 798098 - DNA, 20 bp, Homo sapiens
tgtataatactttgtataca

SEQ ID NO: 798099 - DNA, 18 bp, Homo sapiens
tgtataatagagataagt

SEQ ID NO: 798100 - DNA, 21 bp, Homo sapiens
tgtataatattgaaaattgaa

SEQ ID NO: 798101 - DNA, 21 bp, Homo sapiens
tgtataattaacttaactgaa

SEQ ID NO: 798102 - DNA, 17 bp, Homo sapiens
tgtataattaatgctta

SEQ ID NO: 798103 - DNA, 14 bp, Homo sapiens
tgtataattggatt

SEQ ID NO: 798104 - DNA, 19 bp, Homo sapiens
tgtatacacacatatacat

SEQ ID NO: 798105 - DNA, 13 bp, Homo sapiens
tgtatacagtgca

SEQ ID NO: 798106 - DNA, 13 bp, Homo sapiens
tgtatacatacat

SEQ ID NO: 798107 - DNA, 15 bp, Homo sapiens
tgtatacatacatgt

SEQ ID NO: 798108 - DNA, 13 bp, Homo sapiens
tgtatacatgcca

SEQ ID NO: 798109 - DNA, 14 bp, Homo sapiens
tgtatacatgtgtg

SEQ ID NO: 798110 - DNA, 15 bp, Homo sapiens
tgtataccacctgta

SEQ ID NO: 798111 - DNA, 20 bp, Homo sapiens
tgtataccagcctactgtac

SEQ ID NO: 798112 - DNA, 16 bp, Homo sapiens
tgtatactgtaaaagt

SEQ ID NO: 798113 - DNA, 18 bp, Homo sapiens
tgtatactgtaaaagtta

SEQ ID NO: 798114 - DNA, 23 bp, Homo sapiens
tgtatacttatcttgctccattg

SEQ ID NO: 798115 - DNA, 14 bp, Homo sapiens
tgtatagaaatcta

SEQ ID NO: 798116 - DNA, 12 bp, Homo sapiens
tgtatagaccaa

SEQ ID NO: 798117 - DNA, 19 bp, Homo sapiens
tgtatagatgcaagatatt

SEQ ID NO: 798118 - DNA, 13 bp, Homo sapiens
tgtatagcatgaa

SEQ ID NO: 798119 - DNA, 14 bp, Homo sapiens
tgtataggccatct

SEQ ID NO: 798120 - DNA, 15 bp, Homo sapiens
tgtataggccatctg

SEQ ID NO: 798121 - DNA, 20 bp, Homo sapiens
tgtataggccatctgtaaat

SEQ ID NO: 798122 - DNA, 21 bp, Homo sapiens
tgtataggccatctgtaaata

SEQ ID NO: 798123 - DNA, 19 bp, Homo sapiens
tgtataggtagatccagat

SEQ ID NO: 798124 - DNA, 20 bp, Homo sapiens
tgtatagtattggaaaataa

SEQ ID NO: 798125 - DNA, 14 bp, Homo sapiens
tgtatagtgttcac

SEQ ID NO: 798126 - DNA, 16 bp, Homo sapiens
tgtatagttgcttgcc

SEQ ID NO: 798127 - DNA, 17 bp, Homo sapiens
tgtatagttttccctat

SEQ ID NO: 798128 - DNA, 12 bp, Homo sapiens
tgtatataaaaa

SEQ ID NO: 798129 - DNA, 21 bp, Homo sapiens
tgtatataatcatgctcatgt

SEQ ID NO: 798130 - DNA, 14 bp, Homo sapiens
tgtatataatttta

SEQ ID NO: 798131 - DNA, 15 bp, Homo sapiens
tgtatatacaataac

SEQ ID NO: 798132 - DNA, 17 bp, Homo sapiens
tgtatatacaataacat

SEQ ID NO: 798133 - DNA, 12 bp, Homo sapiens
tgtatatacatt

SEQ ID NO: 798134 - DNA, 17 bp, Homo sapiens
tgtatatacgcatctat

SEQ ID NO: 798135 - DNA, 14 bp, Homo sapiens
tgtatatagttttt

SEQ ID NO: 798136 - DNA, 14 bp, Homo sapiens
tgtatatatacatg

SEQ ID NO: 798137 - DNA, 18 bp, Homo sapiens
tgtatatatcttataact

SEQ ID NO: 798138 - DNA, 22 bp, Homo sapiens
tgtatatatcttataactgttt

SEQ ID NO: 798139 - DNA, 14 bp, Homo sapiens
tgtatatatgtgtg

SEQ ID NO: 798140 - DNA, 15 bp, Homo sapiens
tgtatatatgtgtgt

SEQ ID NO: 798141 - DNA, 22 bp, Homo sapiens
tgtatatatttcctatattgtt

SEQ ID NO: 798142 - DNA, 21 bp, Homo sapiens
tgtatatattttatatgttca

SEQ ID NO: 798143 - DNA, 13 bp, Homo sapiens
tgtatatcagaaa

SEQ ID NO: 798144 - DNA, 17 bp, Homo sapiens
tgtatatcattctacag

SEQ ID NO: 798145 - DNA, 16 bp, Homo sapiens
tgtatatgtagatgta

SEQ ID NO: 798146 - DNA, 17 bp, Homo sapiens
tgtatatgtataaatta

SEQ ID NO: 798147 - DNA, 14 bp, Homo sapiens
tgtatatgttgtaa

SEQ ID NO: 798148 - DNA, 16 bp, Homo sapiens
tgtatatgttgtaata

SEQ ID NO: 798149 - DNA, 13 bp, Homo sapiens
tgtatatgtttat

SEQ ID NO: 798150 - DNA, 13 bp, Homo sapiens
tgtatattaaaat

SEQ ID NO: 798151 - DNA, 21 bp, Homo sapiens
tgtatattaagaagcaataac

SEQ ID NO: 798152 - DNA, 15 bp, Homo sapiens
tgtatattccaccat

SEQ ID NO: 798153 - DNA, 21 bp, Homo sapiens
tgtatattggtgtatattata

SEQ ID NO: 798154 - DNA, 13 bp, Homo sapiens
tgtatattgtaat

SEQ ID NO: 798155 - DNA, 13 bp, Homo sapiens
tgtatatttattc

SEQ ID NO: 798156 - DNA, 16 bp, Homo sapiens
tgtcactactcacagt

SEQ ID NO: 798157 - DNA, 12 bp, Homo sapiens
tgtcactcactg

SEQ ID NO: 798158 - DNA, 16 bp, Homo sapiens
tgtcactcattgctga

SEQ ID NO: 798159 - DNA, 21 bp, Homo sapiens
tgtcactcattgctgagcctc

SEQ ID NO: 798160 - DNA, 23 bp, Homo sapiens
tgtcactcattgctgagcctctg

SEQ ID NO: 798161 - DNA, 16 bp, Homo sapiens
tgtcactctaggaaga

SEQ ID NO: 798162 - DNA, 17 bp, Homo sapiens
tgtcactctaggaagaa

SEQ ID NO: 798163 - DNA, 14 bp, Homo sapiens
tgtcactgatggaa

SEQ ID NO: 798164 - DNA, 15 bp, Homo sapiens
tgtcactggcagagc

SEQ ID NO: 798165 - DNA, 17 bp, Homo sapiens
tgtcactggcagagcac

SEQ ID NO: 798166 - DNA, 13 bp, Homo sapiens
tgtcactgtttct

SEQ ID NO: 798167 - DNA, 14 bp, Homo sapiens
tgtcactgttttta

SEQ ID NO: 798168 - DNA, 14 bp, Homo sapiens
tgtcacttgtgctt

SEQ ID NO: 798169 - DNA, 15 bp, Homo sapiens
tgtcacttgtgcttt

SEQ ID NO: 798170 - DNA, 17 bp, Homo sapiens
tgtcacttgtgctttgc

SEQ ID NO: 798171 - DNA, 20 bp, Homo sapiens
tgtcacttgtgctttgctct

SEQ ID NO: 798172 - DNA, 21 bp, Homo sapiens
tgtcagaaaataacagatgct

SEQ ID NO: 798173 - DNA, 23 bp, Homo sapiens
tgtcagaaacaatgacatccaga

SEQ ID NO: 798174 - DNA, 18 bp, Homo sapiens
tgtcagaagcctccaagc

SEQ ID NO: 798175 - DNA, 11 bp, Homo sapiens
tgtcagaagct

SEQ ID NO: 798176 - DNA, 17 bp, Homo sapiens
tgtcagaataggaaaac

SEQ ID NO: 798177 - DNA, 22 bp, Homo sapiens
tgtcagaatcagaatcatggag

SEQ ID NO: 798178 - DNA, 21 bp, Homo sapiens
tgtcagaatggaatccatctg

SEQ ID NO: 798179 - DNA, 23 bp, Homo sapiens
tgtcagaatggaatccatctgtc

SEQ ID NO: 798180 - DNA, 18 bp, Homo sapiens
tgtcagaatttctttgtc

SEQ ID NO: 798181 - DNA, 18 bp, Homo sapiens
tgtcagacaataccactg

SEQ ID NO: 798182 - DNA, 14 bp, Homo sapiens
tgtcagacacagat

SEQ ID NO: 798183 - DNA, 21 bp, Homo sapiens
tgtcagacttccaaatcctgg

SEQ ID NO: 798184 - DNA, 19 bp, Homo sapiens
tgtcagagaaaatgaattt

SEQ ID NO: 798185 - DNA, 11 bp, Homo sapiens
tgtcagagcta

SEQ ID NO: 798186 - DNA, 21 bp, Homo sapiens
tgtcagagctatgttccctcc

SEQ ID NO: 798187 - DNA, 13 bp, Homo sapiens
tgtcagagctggg

SEQ ID NO: 798188 - DNA, 16 bp, Homo sapiens
tgtcagagctgggagt

SEQ ID NO: 798189 - DNA, 17 bp, Homo sapiens
tgtcagaggaccccagg

SEQ ID NO: 798190 - DNA, 18 bp, Homo sapiens
tgtcagaggaccccaggg

SEQ ID NO: 798191 - DNA, 15 bp, Homo sapiens
tgtcagagtgttgtt

SEQ ID NO: 798192 - DNA, 19 bp, Homo sapiens
tgtcagataagtgtaaata

SEQ ID NO: 798193 - DNA, 17 bp, Homo sapiens
tgtcagatcgttcattg

SEQ ID NO: 798194 - DNA, 16 bp, Homo sapiens
tgtcagatgagaacaa

SEQ ID NO: 798195 - DNA, 18 bp, Homo sapiens
tgtcagatgagaacaaag

SEQ ID NO: 798196 - DNA, 19 bp, Homo sapiens
tgtcagatgagaacaaagc

SEQ ID NO: 798197 - DNA, 13 bp, Homo sapiens
tgtcagcaaaaag

SEQ ID NO: 798198 - DNA, 15 bp, Homo sapiens
tgtcagccacctccc

SEQ ID NO: 798199 - DNA, 22 bp, Homo sapiens
tgtcagccagccgccctgggct

SEQ ID NO: 798200 - DNA, 23 bp, Homo sapiens
tgtcagccatcgtcctgggactc

SEQ ID NO: 798201 - DNA, 19 bp, Homo sapiens
tgtcagcccctcttccctt

SEQ ID NO: 798202 - DNA, 22 bp, Homo sapiens
tgtcagccgagccgggcctggg

SEQ ID NO: 798203 - DNA, 21 bp, Homo sapiens
tgtcagccgggccctgagtaa

SEQ ID NO: 798204 - DNA, 11 bp, Homo sapiens
tgtcagccttg

SEQ ID NO: 798205 - DNA, 12 bp, Homo sapiens
tgtcagcctttg

SEQ ID NO: 798206 - DNA, 23 bp, Homo sapiens
tgtcagcgttctaccaggcaaat

SEQ ID NO: 798207 - DNA, 19 bp, Homo sapiens
tgtcagctactaatgatgt

SEQ ID NO: 798208 - DNA, 19 bp, Homo sapiens
tgtcagctcaggcagctcg

SEQ ID NO: 798209 - DNA, 19 bp, Homo sapiens
tgtcagctgaacctgggta

SEQ ID NO: 798210 - DNA, 24 bp, Homo sapiens
tgtcagctgaggctgggggagagc

SEQ ID NO: 798211 - DNA, 23 bp, Homo sapiens
tgtcagctgcaaggtactctggt

SEQ ID NO: 798212 - DNA, 19 bp, Homo sapiens
tgtcagcttggctgtagga

SEQ ID NO: 798213 - DNA, 17 bp, Homo sapiens
tgtcaggaagaaatcac

SEQ ID NO: 798214 - DNA, 12 bp, Homo sapiens
tgtcaggaatgg

SEQ ID NO: 798215 - DNA, 14 bp, Homo sapiens
tgtcaggcatggct

SEQ ID NO: 798216 - DNA, 20 bp, Homo sapiens
tgtcaggccagcctgtccct

SEQ ID NO: 798217 - DNA, 19 bp, Homo sapiens
tgtcaggcccgtcggagct

SEQ ID NO: 798218 - DNA, 20 bp, Homo sapiens
tgtcaggcccgtcggagctg

SEQ ID NO: 798219 - DNA, 16 bp, Homo sapiens
tgtcaggccctctgcc

SEQ ID NO: 798220 - DNA, 18 bp, Homo sapiens
tgtcaggccctctgcctg

SEQ ID NO: 798221 - DNA, 20 bp, Homo sapiens
tgtcaggccctctgcctgca

SEQ ID NO: 798222 - DNA, 21 bp, Homo sapiens
tgtcaggccctctgcctgcac

SEQ ID NO: 798223 - DNA, 23 bp, Homo sapiens
tgtcaggccctctgcctgcactc

SEQ ID NO: 798224 - DNA, 19 bp, Homo sapiens
tgtcagggagggccaggga

SEQ ID NO: 798225 - DNA, 21 bp, Homo sapiens
tgtcagggagggccagggagg

SEQ ID NO: 798226 - DNA, 15 bp, Homo sapiens
tgtcagggccaggtg

SEQ ID NO: 798227 - DNA, 22 bp, Homo sapiens
tgtcaggggcggggagggtgac

SEQ ID NO: 798228 - DNA, 24 bp, Homo sapiens
tgtcagggtccaggagagcctggg

SEQ ID NO: 798229 - DNA, 15 bp, Homo sapiens
tgtcagtatccaggc

SEQ ID NO: 798230 - DNA, 20 bp, Homo sapiens
tgtcagtatctgtatctctc

SEQ ID NO: 798231 - DNA, 14 bp, Homo sapiens
tgtcagtcacagcc

SEQ ID NO: 798232 - DNA, 14 bp, Homo sapiens
tgtcagtcactaaa

SEQ ID NO: 798233 - DNA, 20 bp, Homo sapiens
tgtcagtctgcttagaaata

SEQ ID NO: 798234 - DNA, 14 bp, Homo sapiens
tgtcagtgcagccc

SEQ ID NO: 798235 - DNA, 14 bp, Homo sapiens
tgtcagtggtttct

SEQ ID NO: 798236 - DNA, 17 bp, Homo sapiens
tgtcagtggtttctact

SEQ ID NO: 798237 - DNA, 22 bp, Homo sapiens
tgtcagtggtttctacttcccc

SEQ ID NO: 798238 - DNA, 17 bp, Homo sapiens
tgtcagttcaactttca

SEQ ID NO: 798239 - DNA, 15 bp, Homo sapiens
tgtcagttgtacttc

SEQ ID NO: 798240 - DNA, 19 bp, Homo sapiens
tgtcagttgtacttctgct

SEQ ID NO: 798241 - DNA, 14 bp, Homo sapiens
tgtcagttttcata

SEQ ID NO: 798242 - DNA, 20 bp, Homo sapiens
tgtcataaaatgcatactgt

SEQ ID NO: 798243 - DNA, 12 bp, Homo sapiens
tgtcataacatt

SEQ ID NO: 798244 - DNA, 18 bp, Homo sapiens
tgtcataacatttaaaga

SEQ ID NO: 798245 - DNA, 21 bp, Homo sapiens
tgtcataacatttaaagagat

SEQ ID NO: 798246 - DNA, 17 bp, Homo sapiens
tgtcataagaatgaata

SEQ ID NO: 798247 - DNA, 16 bp, Homo sapiens
tgtcataaggttttta

SEQ ID NO: 798248 - DNA, 15 bp, Homo sapiens
tgtcatagaaattac

SEQ ID NO: 798249 - DNA, 19 bp, Homo sapiens
tgtcatagactcctttgct

SEQ ID NO: 798250 - DNA, 18 bp, Homo sapiens
tgtcatagggattgtccc

SEQ ID NO: 798251 - DNA, 21 bp, Homo sapiens
tgtcatataaactcatttatc

SEQ ID NO: 798252 - DNA, 20 bp, Homo sapiens
tgtcatatatggggggccaa

SEQ ID NO: 798253 - DNA, 13 bp, Homo sapiens
tgtcatcactccc

SEQ ID NO: 798254 - DNA, 17 bp, Homo sapiens
tgtcatcactccctgga

SEQ ID NO: 798255 - DNA, 20 bp, Homo sapiens
tgtcatcactccctggatgt

SEQ ID NO: 798256 - DNA, 16 bp, Homo sapiens
tgtcatcagaagataa

SEQ ID NO: 798257 - DNA, 19 bp, Homo sapiens
tgtcatcattgtatatatg

SEQ ID NO: 798258 - DNA, 22 bp, Homo sapiens
tgtcatcattgtatatatgtgt

SEQ ID NO: 798259 - DNA, 22 bp, Homo sapiens
tgtcatcctcaaagaaagtgta

SEQ ID NO: 798260 - DNA, 14 bp, Homo sapiens
tgtcatcctcacag

SEQ ID NO: 798261 - DNA, 15 bp, Homo sapiens
tgtcatcctcccttg

SEQ ID NO: 798262 - DNA, 18 bp, Homo sapiens
tgtcatcctcccttgccc

SEQ ID NO: 798263 - DNA, 23 bp, Homo sapiens
tgtcatcctcccttgccccaggc

SEQ ID NO: 798264 - DNA, 19 bp, Homo sapiens
tgtcatcgttccccacccc

SEQ ID NO: 798265 - DNA, 21 bp, Homo sapiens
tgtcatcgttccccacccctt

SEQ ID NO: 798266 - DNA, 13 bp, Homo sapiens
tgtcatctgagga

SEQ ID NO: 798267 - DNA, 14 bp, Homo sapiens
tgtcatctgaggag

SEQ ID NO: 798268 - DNA, 14 bp, Homo sapiens
tgtcatcttttcaa

SEQ ID NO: 798269 - DNA, 16 bp, Homo sapiens
tgtcatgaacatgttc

SEQ ID NO: 798270 - DNA, 15 bp, Homo sapiens
tgtcatgaagaatgt

SEQ ID NO: 798271 - DNA, 16 bp, Homo sapiens
tgtcatgaattcttat

SEQ ID NO: 798272 - DNA, 22 bp, Homo sapiens
tgtcatgacagtgcttgcatcc

SEQ ID NO: 798273 - DNA, 14 bp, Homo sapiens
tgtcatgcccccct

SEQ ID NO: 798274 - DNA, 22 bp, Homo sapiens
tgtcatgcctcactttcttcta

SEQ ID NO: 798275 - DNA, 19 bp, Homo sapiens
tgtcatggaaaatgtcctg

SEQ ID NO: 798276 - DNA, 14 bp, Homo sapiens
tgtcatggctgaag

SEQ ID NO: 798277 - DNA, 15 bp, Homo sapiens
tgtcatggctgaagt

SEQ ID NO: 798278 - DNA, 22 bp, Homo sapiens
tgtcatggtgaccaccccctgt

SEQ ID NO: 798279 - DNA, 15 bp, Homo sapiens
tgtcatgtaccatca

SEQ ID NO: 798280 - DNA, 18 bp, Homo sapiens
tgtcatgtacttcctgtg

SEQ ID NO: 798281 - DNA, 14 bp, Homo sapiens
tgtcatgtgcagat

SEQ ID NO: 798282 - DNA, 17 bp, Homo sapiens
tgtcattaaaggtatca

SEQ ID NO: 798283 - DNA, 20 bp, Homo sapiens
tgtcattatttattgttaaa

SEQ ID NO: 798284 - DNA, 20 bp, Homo sapiens
tgtcattcaagcctgtgaat

SEQ ID NO: 798285 - DNA, 16 bp, Homo sapiens
tgtcattccagagtgc

SEQ ID NO: 798286 - DNA, 14 bp, Homo sapiens
tgtcattctgcctg

SEQ ID NO: 798287 - DNA, 18 bp, Homo sapiens
tgtcattctgcctgctcc

SEQ ID NO: 798288 - DNA, 17 bp, Homo sapiens
tgtcattggaagccatc

SEQ ID NO: 798289 - DNA, 17 bp, Homo sapiens
tgtcattgtccagctgg

SEQ ID NO: 798290 - DNA, 13 bp, Homo sapiens
tgtcattgtctac

SEQ ID NO: 798291 - DNA, 12 bp, Homo sapiens
tgtcatttgctt

SEQ ID NO: 798292 - DNA, 23 bp, Homo sapiens
tgtcatttttaatattactgtct

SEQ ID NO: 798293 - DNA, 15 bp, Homo sapiens
tgtcatttttaatgt

SEQ ID NO: 798294 - DNA, 18 bp, Homo sapiens
tgtcatttttaatgtatc

SEQ ID NO: 798295 - DNA, 15 bp, Homo sapiens
tgtccaaaactgcct

SEQ ID NO: 798296 - DNA, 17 bp, Homo sapiens
tgtccaaagaggctgcc

SEQ ID NO: 798297 - DNA, 13 bp, Homo sapiens
tgtccaacaataa

SEQ ID NO: 798298 - DNA, 18 bp, Homo sapiens
tgtccaacaataaacagg

SEQ ID NO: 798299 - DNA, 19 bp, Homo sapiens
tgtccaacaataaacagga

SEQ ID NO: 798300 - DNA, 23 bp, Homo sapiens
tgtccaagacacatgctgaggtt

SEQ ID NO: 798301 - DNA, 21 bp, Homo sapiens
tgtccaagggccgtgcccttg

SEQ ID NO: 798302 - DNA, 17 bp, Homo sapiens
tgtccaagtgtgtgtgc

SEQ ID NO: 798303 - DNA, 20 bp, Homo sapiens
tgtccaagttcttcacctct

SEQ ID NO: 798304 - DNA, 22 bp, Homo sapiens
tgtccaagttcttcacctctat

SEQ ID NO: 798305 - DNA, 13 bp, Homo sapiens
tgtccaatgtggt

SEQ ID NO: 798306 - DNA, 15 bp, Homo sapiens
tgtccacacccagct

SEQ ID NO: 798307 - DNA, 17 bp, Homo sapiens
tgtccacatccccagag

SEQ ID NO: 798308 - DNA, 22 bp, Homo sapiens
tgtccacatccccagagcccag

SEQ ID NO: 798309 - DNA, 18 bp, Homo sapiens
tgtccacatctgcctcct

SEQ ID NO: 798310 - DNA, 15 bp, Homo sapiens
tgtccaccagaccca

SEQ ID NO: 798311 - DNA, 22 bp, Homo sapiens
tgtccaccagtttatacagaac

SEQ ID NO: 798312 - DNA, 12 bp, Homo sapiens
tgtccacctggc

SEQ ID NO: 798313 - DNA, 21 bp, Homo sapiens
tgtccactctcggggcccttg

SEQ ID NO: 798314 - DNA, 13 bp, Homo sapiens
tgtccactgtgta

SEQ ID NO: 798315 - DNA, 21 bp, Homo sapiens
tgtccagagagcaactctgag

SEQ ID NO: 798316 - DNA, 22 bp, Homo sapiens
tgtccagcagctgcgggtctga

SEQ ID NO: 798317 - DNA, 17 bp, Homo sapiens
tgtccagcccccagtgc

SEQ ID NO: 798318 - DNA, 19 bp, Homo sapiens
tgtccagccttaatagact

SEQ ID NO: 798319 - DNA, 20 bp, Homo sapiens
tgtccagctgggacctaatg

SEQ ID NO: 798320 - DNA, 21 bp, Homo sapiens
tgtccagcttccaaagcctag

SEQ ID NO: 798321 - DNA, 14 bp, Homo sapiens
tgtccaggatggag

SEQ ID NO: 798322 - DNA, 18 bp, Homo sapiens
tgtccaggatggagggtc

SEQ ID NO: 798323 - DNA, 21 bp, Homo sapiens
tgtccaggcactgctgcccag

SEQ ID NO: 798324 - DNA, 16 bp, Homo sapiens
tgtccaggccactgtg

SEQ ID NO: 798325 - DNA, 16 bp, Homo sapiens
tgtccaggcccttagg

SEQ ID NO: 798326 - DNA, 14 bp, Homo sapiens
tgtccaggctctgg

SEQ ID NO: 798327 - DNA, 15 bp, Homo sapiens
tgtccaggctctggg

SEQ ID NO: 798328 - DNA, 19 bp, Homo sapiens
tgtccaggctctgggcaca

SEQ ID NO: 798329 - DNA, 21 bp, Homo sapiens
tgtccaggctctgggcacagt

SEQ ID NO: 798330 - DNA, 17 bp, Homo sapiens
tgtccagggccctgagc

SEQ ID NO: 798331 - DNA, 20 bp, Homo sapiens
tgtccaggtgagtgtgaggg

SEQ ID NO: 798332 - DNA, 21 bp, Homo sapiens
tgtccagtcatcctgccctgc

SEQ ID NO: 798333 - DNA, 13 bp, Homo sapiens
tgtccagttataa

SEQ ID NO: 798334 - DNA, 13 bp, Homo sapiens
tgtccatacactt

SEQ ID NO: 798335 - DNA, 14 bp, Homo sapiens
tgtccatcctgacc

SEQ ID NO: 798336 - DNA, 20 bp, Homo sapiens
tgtccatgcgctcagggcca

SEQ ID NO: 798337 - DNA, 11 bp, Homo sapiens
tgtccatgtgt

SEQ ID NO: 798338 - DNA, 15 bp, Homo sapiens
tgtccatgtgtgtgc

SEQ ID NO: 798339 - DNA, 16 bp, Homo sapiens
tgtccattacttgcca

SEQ ID NO: 798340 - DNA, 14 bp, Homo sapiens
tgtccattgtaaat

SEQ ID NO: 798341 - DNA, 22 bp, Homo sapiens
tgtccattgtaaatctgaagaa

SEQ ID NO: 798342 - DNA, 20 bp, Homo sapiens
tgtccattttgcaaacccaa

SEQ ID NO: 798343 - DNA, 20 bp, Homo sapiens
tgtcccaaaatcccctcagc

SEQ ID NO: 798344 - DNA, 22 bp, Homo sapiens
tgtcccaaaatcccctcagcct

SEQ ID NO: 798345 - DNA, 23 bp, Homo sapiens
tgtcccaatcttaccagatgcta

SEQ ID NO: 798346 - DNA, 16 bp, Homo sapiens
tgtcccaccaactctg

SEQ ID NO: 798347 - DNA, 11 bp, Homo sapiens
tgtcccaccca

SEQ ID NO: 798348 - DNA, 14 bp, Homo sapiens
tgtcccacccacac

SEQ ID NO: 798349 - DNA, 19 bp, Homo sapiens
tgtcccacccacacagctg

SEQ ID NO: 798350 - DNA, 21 bp, Homo sapiens
tgtcccacccacacagctgcc

SEQ ID NO: 798351 - DNA, 23 bp, Homo sapiens
tgtcccacccacacagctgccct

SEQ ID NO: 798352 - DNA, 12 bp, Homo sapiens
tgtcccacctct

SEQ ID NO: 798353 - DNA, 13 bp, Homo sapiens
tgtcccacctctt

SEQ ID NO: 798354 - DNA, 21 bp, Homo sapiens
tgtcccacctcttctcttcct

SEQ ID NO: 798355 - DNA, 22 bp, Homo sapiens
tgtcccacctcttctcttcctg

SEQ ID NO: 798356 - DNA, 21 bp, Homo sapiens
tgtcccacgtgtcttccactt

SEQ ID NO: 798357 - DNA, 16 bp, Homo sapiens
tgtcccactatctggg

SEQ ID NO: 798358 - DNA, 22 bp, Homo sapiens
tgtcccagagcttattggccac

SEQ ID NO: 798359 - DNA, 23 bp, Homo sapiens
tgtcccagaggttatctgcctgg

SEQ ID NO: 798360 - DNA, 22 bp, Homo sapiens
tgtcccagatgctgtcattagt

SEQ ID NO: 798361 - DNA, 13 bp, Homo sapiens
tgtcccagccagt

SEQ ID NO: 798362 - DNA, 12 bp, Homo sapiens
tgtcccagcccc

SEQ ID NO: 798363 - DNA, 18 bp, Homo sapiens
tgtcccaggactcaccct

SEQ ID NO: 798364 - DNA, 13 bp, Homo sapiens
tgtcccaggcatg

SEQ ID NO: 798365 - DNA, 22 bp, Homo sapiens
tgtcccaggcatgcagctgcct

SEQ ID NO: 798366 - DNA, 13 bp, Homo sapiens
tgtcccaggccgg

SEQ ID NO: 798367 - DNA, 17 bp, Homo sapiens
tgtcccaggccggccca

SEQ ID NO: 798368 - DNA, 14 bp, Homo sapiens
tgtcccagggccct

SEQ ID NO: 798369 - DNA, 18 bp, Homo sapiens
tgtcccagggccctccca

SEQ ID NO: 798370 - DNA, 16 bp, Homo sapiens
tgtcccaggtcctcac

SEQ ID NO: 798371 - DNA, 17 bp, Homo sapiens
tgtcccagtcagaaata

SEQ ID NO: 798372 - DNA, 16 bp, Homo sapiens
tgtcccatctgccctc

SEQ ID NO: 798373 - DNA, 19 bp, Homo sapiens
tgtcccatctggtcatttg

SEQ ID NO: 798374 - DNA, 14 bp, Homo sapiens
tgtcccatgaccca

SEQ ID NO: 798375 - DNA, 17 bp, Homo sapiens
tgtcccatgatccctgt

SEQ ID NO: 798376 - DNA, 22 bp, Homo sapiens
tgtcccatggacactccagtgc

SEQ ID NO: 798377 - DNA, 15 bp, Homo sapiens
tgtcccattccctgg

SEQ ID NO: 798378 - DNA, 22 bp, Homo sapiens
tgtccccaagacacttcccctt

SEQ ID NO: 798379 - DNA, 18 bp, Homo sapiens
tgtccccacacagcctct

SEQ ID NO: 798380 - DNA, 19 bp, Homo sapiens
tgtccccacacagcctcta

SEQ ID NO: 798381 - DNA, 18 bp, Homo sapiens
tgtccccaccctccactc

SEQ ID NO: 798382 - DNA, 22 bp, Homo sapiens
tgtccccaccctccactcagct

SEQ ID NO: 798383 - DNA, 13 bp, Homo sapiens
tgtccccagacca

SEQ ID NO: 798384 - DNA, 23 bp, Homo sapiens
tgtccccagaccaaccctgggac

SEQ ID NO: 798385 - DNA, 15 bp, Homo sapiens
tgtccccagccctgt

SEQ ID NO: 798386 - DNA, 16 bp, Homo sapiens
tgtccccaggcctggc

SEQ ID NO: 798387 - DNA, 13 bp, Homo sapiens
tgtccccagggcc

SEQ ID NO: 798388 - DNA, 20 bp, Homo sapiens
tgtccccaggtcctgtctct

SEQ ID NO: 798389 - DNA, 23 bp, Homo sapiens
tgtccccagtccccagccctggg

SEQ ID NO: 798390 - DNA, 19 bp, Homo sapiens
tgtccccagtttgcagaaa

SEQ ID NO: 798391 - DNA, 21 bp, Homo sapiens
tgtccccatgggctcccactg

SEQ ID NO: 798392 - DNA, 16 bp, Homo sapiens
tgtcccccaacttgag

SEQ ID NO: 798393 - DNA, 13 bp, Homo sapiens
tgtcccccaaggt

SEQ ID NO: 798394 - DNA, 23 bp, Homo sapiens
tgtcccccaaggttttggagtca

SEQ ID NO: 798395 - DNA, 23 bp, Homo sapiens
tgtcccccactctctcacccacc

SEQ ID NO: 798396 - DNA, 15 bp, Homo sapiens
tgtcccccagctctg

SEQ ID NO: 798397 - DNA, 17 bp, Homo sapiens
tgtcccccagctctggt

SEQ ID NO: 798398 - DNA, 13 bp, Homo sapiens
tgtcccccaggct

SEQ ID NO: 798399 - DNA, 16 bp, Homo sapiens
tgtcccccatcatgtg

SEQ ID NO: 798400 - DNA, 13 bp, Homo sapiens
tgtccccccttga

SEQ ID NO: 798401 - DNA, 14 bp, Homo sapiens
tgtcccccggggca

SEQ ID NO: 798402 - DNA, 20 bp, Homo sapiens
tgtccccctaatattaggga

SEQ ID NO: 798403 - DNA, 23 bp, Homo sapiens
tgtccccgccttccctcactctt

SEQ ID NO: 798404 - DNA, 16 bp, Homo sapiens
tgtcaagcatattgga

SEQ ID NO: 798405 - DNA, 20 bp, Homo sapiens
tgtcaagcctgtgcaaaaaa

SEQ ID NO: 798406 - DNA, 19 bp, Homo sapiens
tgtcaaggctgcttagaat

SEQ ID NO: 798407 - DNA, 19 bp, Homo sapiens
tgtcaagttaacaaggaat

SEQ ID NO: 798408 - DNA, 14 bp, Homo sapiens
tgtcaagttgtgct

SEQ ID NO: 798409 - DNA, 17 bp, Homo sapiens
tgtcaagttgtgcttgt

SEQ ID NO: 798410 - DNA, 18 bp, Homo sapiens
tgtcaataaacaacagct

SEQ ID NO: 798411 - DNA, 21 bp, Homo sapiens
tgtcaataaacagcttcatgc

SEQ ID NO: 798412 - DNA, 18 bp, Homo sapiens
tgtcaataaacctgtcat

SEQ ID NO: 798413 - DNA, 13 bp, Homo sapiens
tgtcaatactgag

SEQ ID NO: 798414 - DNA, 17 bp, Homo sapiens
tgtcaatactgagccat

SEQ ID NO: 798415 - DNA, 13 bp, Homo sapiens
tgtcaatattaaa

SEQ ID NO: 798416 - DNA, 17 bp, Homo sapiens
tgtcaatattaaataca

SEQ ID NO: 798417 - DNA, 17 bp, Homo sapiens
tgtcaatttatgaatat

SEQ ID NO: 798418 - DNA, 16 bp, Homo sapiens
tgtcaatttctgtgtt

SEQ ID NO: 798419 - DNA, 19 bp, Homo sapiens
tgtcacaaattgatcaaga

SEQ ID NO: 798420 - DNA, 17 bp, Homo sapiens
tgtcacaataaagttta

SEQ ID NO: 798421 - DNA, 13 bp, Homo sapiens
tgtcacaataaat

SEQ ID NO: 798422 - DNA, 19 bp, Homo sapiens
tgtcacaatcctaacacat

SEQ ID NO: 798423 - DNA, 21 bp, Homo sapiens
tgtcacaatcctaacacatta

SEQ ID NO: 798424 - DNA, 15 bp, Homo sapiens
tgtcacacactggac

SEQ ID NO: 798425 - DNA, 16 bp, Homo sapiens
tgtcacacactggacc

SEQ ID NO: 798426 - DNA, 17 bp, Homo sapiens
tgtcacacactggaccc

SEQ ID NO: 798427 - DNA, 21 bp, Homo sapiens
tgtcacactggtgctgagtga

SEQ ID NO: 798428 - DNA, 13 bp, Homo sapiens
tgtcacaggctgg

SEQ ID NO: 798429 - DNA, 15 bp, Homo sapiens
tgtcacaggctgggt

SEQ ID NO: 798430 - DNA, 23 bp, Homo sapiens
tgtcacagtaaaaataaaatact

SEQ ID NO: 798431 - DNA, 15 bp, Homo sapiens
tgtcacagtaatgca

SEQ ID NO: 798432 - DNA, 17 bp, Homo sapiens
tgtcacatttgaattct

SEQ ID NO: 798433 - DNA, 15 bp, Homo sapiens
tgtcaccaaggaaac

SEQ ID NO: 798434 - DNA, 21 bp, Homo sapiens
tgtcaccaccttcccagctct

SEQ ID NO: 798435 - DNA, 23 bp, Homo sapiens
tgtcaccaccttcccagctctcc

SEQ ID NO: 798436 - DNA, 17 bp, Homo sapiens
tgtcaccagtcctgccc

SEQ ID NO: 798437 - DNA, 14 bp, Homo sapiens
tgtcaccagttaaa

SEQ ID NO: 798438 - DNA, 22 bp, Homo sapiens
tgtcacccaaagcctgtcccag

SEQ ID NO: 798439 - DNA, 21 bp, Homo sapiens
tgtcaccctccaccgagccac

SEQ ID NO: 798440 - DNA, 18 bp, Homo sapiens
tgtcaccctccacctctt

SEQ ID NO: 798441 - DNA, 17 bp, Homo sapiens
tgtcaccctgcaggact

SEQ ID NO: 798442 - DNA, 18 bp, Homo sapiens
tgtcacctagaacgtgca

SEQ ID NO: 798443 - DNA, 15 bp, Homo sapiens
tgtcacctcagctga

SEQ ID NO: 798444 - DNA, 20 bp, Homo sapiens
tgtcacctgctcacagggat

SEQ ID NO: 798445 - DNA, 20 bp, Homo sapiens
tgtcacctggctgctaggcc

SEQ ID NO: 798446 - DNA, 21 bp, Homo sapiens
tgtcacctggctgctaggcca

SEQ ID NO: 798447 - DNA, 22 bp, Homo sapiens
tgtcacctgggagggtgggacc

SEQ ID NO: 798448 - DNA, 18 bp, Homo sapiens
tgtcacggggttccctcc

SEQ ID NO: 798449 - DNA, 19 bp, Homo sapiens
tgtcacgtgaaatatttaa

SEQ ID NO: 798450 - DNA, 24 bp, Homo sapiens
tgtcttccaaggagaccaagtcct

SEQ ID NO: 798451 - DNA, 13 bp, Homo sapiens
tgtcttccataat

SEQ ID NO: 798452 - DNA, 14 bp, Homo sapiens
tgtcttccataatg

SEQ ID NO: 798453 - DNA, 17 bp, Homo sapiens
tgtcttccataatgtat

SEQ ID NO: 798454 - DNA, 13 bp, Homo sapiens
tgtcttcccccct

SEQ ID NO: 798455 - DNA, 12 bp, Homo sapiens
tgtcttcccctg

SEQ ID NO: 798456 - DNA, 20 bp, Homo sapiens
tgtcttcccgatgagggaag

SEQ ID NO: 798457 - DNA, 16 bp, Homo sapiens
tgtcttccctgggctg

SEQ ID NO: 798458 - DNA, 18 bp, Homo sapiens
tgtcttccgatcaacatt

SEQ ID NO: 798459 - DNA, 20 bp, Homo sapiens
tgtcttccgatcaacattta

SEQ ID NO: 798460 - DNA, 23 bp, Homo sapiens
tgtcttccgatcaacatttatga

SEQ ID NO: 798461 - DNA, 16 bp, Homo sapiens
tgtcttcctcaaaata

SEQ ID NO: 798462 - DNA, 14 bp, Homo sapiens
tgtcttctcctaat

SEQ ID NO: 798463 - DNA, 15 bp, Homo sapiens
tgtcttctgcctgtt

SEQ ID NO: 798464 - DNA, 18 bp, Homo sapiens
tgtcttctgcctgttata

SEQ ID NO: 798465 - DNA, 17 bp, Homo sapiens
tgtcttctgctgttctt

SEQ ID NO: 798466 - DNA, 13 bp, Homo sapiens
tgtcttctgggca

SEQ ID NO: 798467 - DNA, 16 bp, Homo sapiens
tgtcttctgggcacag

SEQ ID NO: 798468 - DNA, 14 bp, Homo sapiens
tgtcttctgttccc

SEQ ID NO: 798469 - DNA, 15 bp, Homo sapiens
tgtcttgaaagtggc

SEQ ID NO: 798470 - DNA, 18 bp, Homo sapiens
tgtcttgatgactgctga

SEQ ID NO: 798471 - DNA, 22 bp, Homo sapiens
tgtcttgatgcatgcactgttc

SEQ ID NO: 798472 - DNA, 15 bp, Homo sapiens
tgtcttgcaacttca

SEQ ID NO: 798473 - DNA, 22 bp, Homo sapiens
tgtcttgcactggccttctgat

SEQ ID NO: 798474 - DNA, 17 bp, Homo sapiens
tgtcttgccccagtttg

SEQ ID NO: 798475 - DNA, 12 bp, Homo sapiens
tgtcttggcatt

SEQ ID NO: 798476 - DNA, 15 bp, Homo sapiens
tgtcttggcattaaa

SEQ ID NO: 798477 - DNA, 21 bp, Homo sapiens
tgtcttgggcagagctggctc

SEQ ID NO: 798478 - DNA, 18 bp, Homo sapiens
tgtcttgtgtttctttag

SEQ ID NO: 798479 - DNA, 17 bp, Homo sapiens
tgtcttgttatgtacaa

SEQ ID NO: 798480 - DNA, 20 bp, Homo sapiens
tgtcttgttatgtacaaact

SEQ ID NO: 798481 - DNA, 12 bp, Homo sapiens
tgtcttgttcat

SEQ ID NO: 798482 - DNA, 22 bp, Homo sapiens
tgtctttaaaaactgttttaga

SEQ ID NO: 798483 - DNA, 15 bp, Homo sapiens
tgtctttaaaagaga

SEQ ID NO: 798484 - DNA, 19 bp, Homo sapiens
tgtctttaaatagatacaa

SEQ ID NO: 798485 - DNA, 15 bp, Homo sapiens
tgtctttaaggaaaa

SEQ ID NO: 798486 - DNA, 17 bp, Homo sapiens
tgtctttagatagccct

SEQ ID NO: 798487 - DNA, 16 bp, Homo sapiens
tgtctttcagatacat

SEQ ID NO: 798488 - DNA, 20 bp, Homo sapiens
tgtctttcagatacatggtt

SEQ ID NO: 798489 - DNA, 12 bp, Homo sapiens
tgtctttcctcc

SEQ ID NO: 798490 - DNA, 14 bp, Homo sapiens
tgtctttctagcca

SEQ ID NO: 798491 - DNA, 23 bp, Homo sapiens
tgtctttctagccataataaaat

SEQ ID NO: 798492 - DNA, 21 bp, Homo sapiens
tgtctttggataataggaatt

SEQ ID NO: 798493 - DNA, 23 bp, Homo sapiens
tgtctttggataataggaattca

SEQ ID NO: 798494 - DNA, 19 bp, Homo sapiens
tgtctttgttggaaaagaa

SEQ ID NO: 798495 - DNA, 15 bp, Homo sapiens
tgtcttttaaaatgc

SEQ ID NO: 798496 - DNA, 15 bp, Homo sapiens
tgtcttttcaagtaa

SEQ ID NO: 798497 - DNA, 21 bp, Homo sapiens
tgtcttttcaagtaattttca

SEQ ID NO: 798498 - DNA, 16 bp, Homo sapiens
tgtcttttcagaagca

SEQ ID NO: 798499 - DNA, 21 bp, Homo sapiens
tgtcttttcagaagcaagcca

SEQ ID NO: 798500 - DNA, 16 bp, Homo sapiens
tgtcttttccactcct

SEQ ID NO: 798501 - DNA, 14 bp, Homo sapiens
tgtcttttctcctc

SEQ ID NO: 798502 - DNA, 17 bp, Homo sapiens
tgtcttttctcctccgc

SEQ ID NO: 798503 - DNA, 19 bp, Homo sapiens
tgtcttttctcctccgcct

SEQ ID NO: 798504 - DNA, 13 bp, Homo sapiens
tgtcttttgaata

SEQ ID NO: 798505 - DNA, 14 bp, Homo sapiens
tgtcttttgaatat

SEQ ID NO: 798506 - DNA, 12 bp, Homo sapiens
tgtcttttgaca

SEQ ID NO: 798507 - DNA, 17 bp, Homo sapiens
tgtcttttgttctctga

SEQ ID NO: 798508 - DNA, 14 bp, Homo sapiens
tgtctttttcctac

SEQ ID NO: 798509 - DNA, 23 bp, Homo sapiens
tgtctttttctggactgaagcct

SEQ ID NO: 798510 - DNA, 16 bp, Homo sapiens
tgtcttttttttcatc

SEQ ID NO: 798511 - DNA, 17 bp, Homo sapiens
tgtgaaaaaaaaaatgc

SEQ ID NO: 798512 - DNA, 19 bp, Homo sapiens
tgtgaaaaaaatgagactt

SEQ ID NO: 798513 - DNA, 13 bp, Homo sapiens
tgtgaaaaattaa

SEQ ID NO: 798514 - DNA, 23 bp, Homo sapiens
tgtgaaaagaaaaatgagcctgg

SEQ ID NO: 798515 - DNA, 19 bp, Homo sapiens
tgtgaaaagcacagctgta

SEQ ID NO: 798516 - DNA, 21 bp, Homo sapiens
tgtgaaaatagtgtaagaact

SEQ ID NO: 798517 - DNA, 19 bp, Homo sapiens
tgtgaaaatcatgaaaaga

SEQ ID NO: 798518 - DNA, 14 bp, Homo sapiens
tgtgaaaatgggtt

SEQ ID NO: 798519 - DNA, 22 bp, Homo sapiens
tgtgaaaatggtccaggagaag

SEQ ID NO: 798520 - DNA, 16 bp, Homo sapiens
tgtgaaacggaagctc

SEQ ID NO: 798521 - DNA, 14 bp, Homo sapiens
tgtgaaagaaaata

SEQ ID NO: 798522 - DNA, 22 bp, Homo sapiens
tgtgaaagaaagctgagaagaa

SEQ ID NO: 798523 - DNA, 20 bp, Homo sapiens
tgtgaaagaatgtgctttga

SEQ ID NO: 798524 - DNA, 12 bp, Homo sapiens
tgtgaaatgctt

SEQ ID NO: 798525 - DNA, 14 bp, Homo sapiens
tgtgaaatgtaact

SEQ ID NO: 798526 - DNA, 19 bp, Homo sapiens
tgtgaaatttcatgattgg

SEQ ID NO: 798527 - DNA, 20 bp, Homo sapiens
tgtgaacaaaagatgctctt

SEQ ID NO: 798528 - DNA, 23 bp, Homo sapiens
tgtgaacaagcttcagtaagtta

SEQ ID NO: 798529 - DNA, 23 bp, Homo sapiens
tgtgaacagagagacccttgtgg

SEQ ID NO: 798530 - DNA, 20 bp, Homo sapiens
tgtgaaccctagctgtgtca

SEQ ID NO: 798531 - DNA, 22 bp, Homo sapiens
tgtgaaccctggggcctgactg

SEQ ID NO: 798532 - DNA, 21 bp, Homo sapiens
tgtgaacgatttagaaagaag

SEQ ID NO: 798533 - DNA, 20 bp, Homo sapiens
tgtgaactagggaagctcag

SEQ ID NO: 798534 - DNA, 22 bp, Homo sapiens
tgtgaactatatcagtagtgta

SEQ ID NO: 798535 - DNA, 20 bp, Homo sapiens
tgtgaactcaatctccaggg

SEQ ID NO: 798536 - DNA, 16 bp, Homo sapiens
tgtgaactccatcatt

SEQ ID NO: 798537 - DNA, 18 bp, Homo sapiens
tgtgaactccatcattca

SEQ ID NO: 798538 - DNA, 17 bp, Homo sapiens
tgtgaactgggcacaga

SEQ ID NO: 798539 - DNA, 15 bp, Homo sapiens
tgtgaactgggcatt

SEQ ID NO: 798540 - DNA, 18 bp, Homo sapiens
tgtgaactttattaaata

SEQ ID NO: 798541 - DNA, 10 bp, Homo sapiens
tgtgaagaat

SEQ ID NO: 798542 - DNA, 14 bp, Homo sapiens
tgtgaagacatttt

SEQ ID NO: 798543 - DNA, 18 bp, Homo sapiens
tgtgaagagggagaagca

SEQ ID NO: 798544 - DNA, 19 bp, Homo sapiens
tgtgaagataatttgcata

SEQ ID NO: 798545 - DNA, 13 bp, Homo sapiens
tgtgaagcatgct

SEQ ID NO: 798546 - DNA, 20 bp, Homo sapiens
tgtgaagccaattcagacag

SEQ ID NO: 798547 - DNA, 21 bp, Homo sapiens
tgtgaagccaattcagacagg

SEQ ID NO: 798548 - DNA, 20 bp, Homo sapiens
tgtgaagccgccagttcatc

SEQ ID NO: 798549 - DNA, 13 bp, Homo sapiens
tgtgaagctattt

SEQ ID NO: 798550 - DNA, 23 bp, Homo sapiens
tgtgaaggattatggaaaaataa

SEQ ID NO: 798551 - DNA, 23 bp, Homo sapiens
tgtgaagtccttcacctcactga

SEQ ID NO: 798552 - DNA, 19 bp, Homo sapiens
tgtgaatacaattaaaggt

SEQ ID NO: 798553 - DNA, 20 bp, Homo sapiens
tgtgaatacaattaaaggtc

SEQ ID NO: 798554 - DNA, 15 bp, Homo sapiens
tgtgaatataaatgt

SEQ ID NO: 798555 - DNA, 17 bp, Homo sapiens
tgtgaatataaatgtgt

SEQ ID NO: 798556 - DNA, 20 bp, Homo sapiens
tgtgaatataaatgtgtgta

SEQ ID NO: 798557 - DNA, 23 bp, Homo sapiens
tgtgaatatccagaaataaaaca

SEQ ID NO: 798558 - DNA, 23 bp, Homo sapiens
tgtgaatatttccatatggattt

SEQ ID NO: 798559 - DNA, 14 bp, Homo sapiens
tgtgaatcagaccc

SEQ ID NO: 798560 - DNA, 18 bp, Homo sapiens
tgtgaatcagaccctacc

SEQ ID NO: 798561 - DNA, 14 bp, Homo sapiens
tgtgaatcctggca

SEQ ID NO: 798562 - DNA, 17 bp, Homo sapiens
tgtgaatcgcagctgtg

SEQ ID NO: 798563 - DNA, 23 bp, Homo sapiens
tgtgaatgaacactcttttgctt

SEQ ID NO: 798564 - DNA, 17 bp, Homo sapiens
tgtgaatgccactgcct

SEQ ID NO: 798565 - DNA, 13 bp, Homo sapiens
tgtgaatggaggc

SEQ ID NO: 798566 - DNA, 16 bp, Homo sapiens
tgtgaatggaggcaga

SEQ ID NO: 798567 - DNA, 22 bp, Homo sapiens
tgtgaatggaggcagagacctc

SEQ ID NO: 798568 - DNA, 11 bp, Homo sapiens
tgtgaatgtag

SEQ ID NO: 798569 - DNA, 22 bp, Homo sapiens
tgtgaatgtagcttccacctca

SEQ ID NO: 798570 - DNA, 18 bp, Homo sapiens
tgtgaatgtgggcactgg

SEQ ID NO: 798571 - DNA, 22 bp, Homo sapiens
tgtgaattaggctgtaactact

SEQ ID NO: 798572 - DNA, 15 bp, Homo sapiens
tgtgaattattgaca

SEQ ID NO: 798573 - DNA, 16 bp, Homo sapiens
tgtgaattattgacac

SEQ ID NO: 798574 - DNA, 19 bp, Homo sapiens
tgtgaattattgacactga

SEQ ID NO: 798575 - DNA, 20 bp, Homo sapiens
tgtgaattattgacactgaa

SEQ ID NO: 798576 - DNA, 21 bp, Homo sapiens
tgtgaattattgacactgaac

SEQ ID NO: 798577 - DNA, 18 bp, Homo sapiens
tgtgaattcccagactct

SEQ ID NO: 798578 - DNA, 14 bp, Homo sapiens
tgtgaatttcaaaa

SEQ ID NO: 798579 - DNA, 16 bp, Homo sapiens
tgtgaatttcaaaaaa

SEQ ID NO: 798580 - DNA, 16 bp, Homo sapiens
tgtgaatttttaagct

SEQ ID NO: 798581 - DNA, 19 bp, Homo sapiens
tgtgacaaaggatgaagaa

SEQ ID NO: 798582 - DNA, 15 bp, Homo sapiens
tgtgacaaccctggc

SEQ ID NO: 798583 - DNA, 14 bp, Homo sapiens
tgtgacaagaataa

SEQ ID NO: 798584 - DNA, 12 bp, Homo sapiens
tgtgacactctc

SEQ ID NO: 798585 - DNA, 23 bp, Homo sapiens
tgtgacactctcgtggtatgtat

SEQ ID NO: 798586 - DNA, 16 bp, Homo sapiens
tgtgacagaatcttgt

SEQ ID NO: 798587 - DNA, 20 bp, Homo sapiens
tgtgacagcgatggcaggcc

SEQ ID NO: 798588 - DNA, 22 bp, Homo sapiens
tgtgacagcgatggcaggcctg

SEQ ID NO: 798589 - DNA, 18 bp, Homo sapiens
tgtgacaggaaagccctc

SEQ ID NO: 798590 - DNA, 14 bp, Homo sapiens
tgtgacagggccag

SEQ ID NO: 798591 - DNA, 22 bp, Homo sapiens
tgtgacagggccagtggggcct

SEQ ID NO: 798592 - DNA, 15 bp, Homo sapiens
tgtgacagtgcctct

SEQ ID NO: 798593 - DNA, 20 bp, Homo sapiens
tgtgacagtgcctcttccag

SEQ ID NO: 798594 - DNA, 21 bp, Homo sapiens
tgtgacagtgcctcttccagt

SEQ ID NO: 798595 - DNA, 15 bp, Homo sapiens
tgtgacagtttccaa

SEQ ID NO: 798596 - DNA, 18 bp, Homo sapiens
tgtgacatattatgtctt

SEQ ID NO: 798597 - DNA, 18 bp, Homo sapiens
tgtgacatggtgcctgag

SEQ ID NO: 798598 - DNA, 22 bp, Homo sapiens
tgtgacatggtgcctgagaggc

SEQ ID NO: 798599 - DNA, 18 bp, Homo sapiens
tgtgacattccatgacga

SEQ ID NO: 798600 - DNA, 12 bp, Homo sapiens
tgtgacattgct

SEQ ID NO: 798601 - DNA, 18 bp, Homo sapiens
tgtgacatttatatattg

SEQ ID NO: 798602 - DNA, 14 bp, Homo sapiens
tgtgatttatcttt

SEQ ID NO: 798603 - DNA, 12 bp, Homo sapiens
tgtgatttccat

SEQ ID NO: 798604 - DNA, 14 bp, Homo sapiens
tgtgatttcctaaa

SEQ ID NO: 798605 - DNA, 21 bp, Homo sapiens
tgtgatttcctaaacataatt

SEQ ID NO: 798606 - DNA, 15 bp, Homo sapiens
tgtgatttcctacag

SEQ ID NO: 798607 - DNA, 14 bp, Homo sapiens
tgtgatttctttaa

SEQ ID NO: 798608 - DNA, 18 bp, Homo sapiens
tgtgatttggttgcactt

SEQ ID NO: 798609 - DNA, 23 bp, Homo sapiens
tgtgatttggttgcactttagac

SEQ ID NO: 798610 - DNA, 19 bp, Homo sapiens
tgtgattttgccctcctgc

SEQ ID NO: 798611 - DNA, 16 bp, Homo sapiens
tgtgcaaacagtaacg

SEQ ID NO: 798612 - DNA, 14 bp, Homo sapiens
tgtgcaaacataat

SEQ ID NO: 798613 - DNA, 12 bp, Homo sapiens
tgtgcaaatcct

SEQ ID NO: 798614 - DNA, 19 bp, Homo sapiens
tgtgcaaattttgcattta

SEQ ID NO: 798615 - DNA, 14 bp, Homo sapiens
tgtgcaacagacaa

SEQ ID NO: 798616 - DNA, 21 bp, Homo sapiens
tgtgcaacctgtggctcaggg

SEQ ID NO: 798617 - DNA, 13 bp, Homo sapiens
tgtgcaacttttt

SEQ ID NO: 798618 - DNA, 18 bp, Homo sapiens
tgtgcaaggtggcctttg

SEQ ID NO: 798619 - DNA, 19 bp, Homo sapiens
tgtgcaataatttgtacaa

SEQ ID NO: 798620 - DNA, 22 bp, Homo sapiens
tgtgcacacacaccacacatac

SEQ ID NO: 798621 - DNA, 20 bp, Homo sapiens
tgtgcacacgtgtgtatgag

SEQ ID NO: 798622 - DNA, 13 bp, Homo sapiens
tgtgcacagaaaa

SEQ ID NO: 798623 - DNA, 15 bp, Homo sapiens
tgtgcacagtggctt

SEQ ID NO: 798624 - DNA, 19 bp, Homo sapiens
tgtgcacagtggcttcttt

SEQ ID NO: 798625 - DNA, 23 bp, Homo sapiens
tgtgcacctaccccttggaaatg

SEQ ID NO: 798626 - DNA, 22 bp, Homo sapiens
tgtgcaccttaccaactttctg

SEQ ID NO: 798627 - DNA, 21 bp, Homo sapiens
tgtgcacgagtgggaaggact

SEQ ID NO: 798628 - DNA, 16 bp, Homo sapiens
tgtgcactaaggggcc

SEQ ID NO: 798629 - DNA, 17 bp, Homo sapiens
tgtgcactagcctgtga

SEQ ID NO: 798630 - DNA, 18 bp, Homo sapiens
tgtgcactagcctgtgat

SEQ ID NO: 798631 - DNA, 24 bp, Homo sapiens
tgtgcactgtataccaagttctta

SEQ ID NO: 798632 - DNA, 17 bp, Homo sapiens
tgtgcacttatttatga

SEQ ID NO: 798633 - DNA, 13 bp, Homo sapiens
tgtgcagaataat

SEQ ID NO: 798634 - DNA, 17 bp, Homo sapiens
tgtgcagaataatggaa

SEQ ID NO: 798635 - DNA, 20 bp, Homo sapiens
tgtgcagaataatggaaaca

SEQ ID NO: 798636 - DNA, 22 bp, Homo sapiens
tgtgcagaataatggaaacatt

SEQ ID NO: 798637 - DNA, 13 bp, Homo sapiens
tgtgcagacagcc

SEQ ID NO: 798638 - DNA, 12 bp, Homo sapiens
tgtgcagactga

SEQ ID NO: 798639 - DNA, 19 bp, Homo sapiens
tgtgcagccgctgagcgag

SEQ ID NO: 798640 - DNA, 17 bp, Homo sapiens
tgtgcaggagcctccct

SEQ ID NO: 798641 - DNA, 15 bp, Homo sapiens
tgtgcagggatattg

SEQ ID NO: 798642 - DNA, 14 bp, Homo sapiens
tgtgcagtgtagcc

SEQ ID NO: 798643 - DNA, 18 bp, Homo sapiens
tgtgcagtgttagtattc

SEQ ID NO: 798644 - DNA, 12 bp, Homo sapiens
tgtgcagtgttg

SEQ ID NO: 798645 - DNA, 21 bp, Homo sapiens
tgtgcataatgataaaataaa

SEQ ID NO: 798646 - DNA, 17 bp, Homo sapiens
tgtgcatagcgtcctgc

SEQ ID NO: 798647 - DNA, 19 bp, Homo sapiens
tgtgcatagcgtcctgccc

SEQ ID NO: 798648 - DNA, 21 bp, Homo sapiens
tgtgcatagcgtcctgccctg

SEQ ID NO: 798649 - DNA, 22 bp, Homo sapiens
tgtgcatagcgtcctgccctgc

SEQ ID NO: 798650 - DNA, 23 bp, Homo sapiens
tgtgcatagcgtcctgccctgcc

SEQ ID NO: 798651 - DNA, 15 bp, Homo sapiens
tgtgcatagtgctgg

SEQ ID NO: 798652 - DNA, 20 bp, Homo sapiens
tgtgcatatttagcatccct

SEQ ID NO: 798653 - DNA, 18 bp, Homo sapiens
tgtgcatatttgttactt

SEQ ID NO: 798654 - DNA, 13 bp, Homo sapiens
tgtgcatgggtga

SEQ ID NO: 798655 - DNA, 13 bp, Homo sapiens
tgtgcatgggtta

SEQ ID NO: 798656 - DNA, 17 bp, Homo sapiens
tgtgcatgtgtgtgtct

SEQ ID NO: 798657 - DNA, 22 bp, Homo sapiens
tgtgcatgtgtgtgtctgtctt

SEQ ID NO: 798658 - DNA, 20 bp, Homo sapiens
tgtgcattatctagatactg

SEQ ID NO: 798659 - DNA, 21 bp, Homo sapiens
tgtgcattattcataaaaaat

SEQ ID NO: 798660 - DNA, 16 bp, Homo sapiens
tgtgcattctttggta

SEQ ID NO: 798661 - DNA, 19 bp, Homo sapiens
tgtgcatttggcaaaatgt

SEQ ID NO: 798662 - DNA, 22 bp, Homo sapiens
tgtgcatttttgtgaaatgaaa

SEQ ID NO: 798663 - DNA, 20 bp, Homo sapiens
tgtgccaagattctactctt

SEQ ID NO: 798664 - DNA, 14 bp, Homo sapiens
tgtgccaagccttc

SEQ ID NO: 798665 - DNA, 16 bp, Homo sapiens
tgtgccaagccttctg

SEQ ID NO: 798666 - DNA, 17 bp, Homo sapiens
tgtgccaatatgtattg

SEQ ID NO: 798667 - DNA, 23 bp, Homo sapiens
tgtgccaatcaatagcaccccta

SEQ ID NO: 798668 - DNA, 17 bp, Homo sapiens
tgtgccacaccccatgc

SEQ ID NO: 798669 - DNA, 13 bp, Homo sapiens
tgtgccacacgca

SEQ ID NO: 798670 - DNA, 19 bp, Homo sapiens
tgtgccacacgcatgggca

SEQ ID NO: 798671 - DNA, 12 bp, Homo sapiens
tgtgccacaggc

SEQ ID NO: 798672 - DNA, 16 bp, Homo sapiens
tgtgccacaggcttag

SEQ ID NO: 798673 - DNA, 16 bp, Homo sapiens
tgtgccacccaccagg

SEQ ID NO: 798674 - DNA, 20 bp, Homo sapiens
tgtgccacccaccagggcga

SEQ ID NO: 798675 - DNA, 14 bp, Homo sapiens
tgtgccacctgtcc

SEQ ID NO: 798676 - DNA, 21 bp, Homo sapiens
tgtgccagaggaatcctggca

SEQ ID NO: 798677 - DNA, 23 bp, Homo sapiens
tgtgccagaggaatcctggcagc

SEQ ID NO: 798678 - DNA, 15 bp, Homo sapiens
tgtgccagcaccaca

SEQ ID NO: 798679 - DNA, 18 bp, Homo sapiens
tgtgccagcaccacagcc

SEQ ID NO: 798680 - DNA, 16 bp, Homo sapiens
tgtgccaggcttgcct

SEQ ID NO: 798681 - DNA, 20 bp, Homo sapiens
tgtgccaggcttgcctgggc

SEQ ID NO: 798682 - DNA, 18 bp, Homo sapiens
tgtgccatagagtttaac

SEQ ID NO: 798683 - DNA, 21 bp, Homo sapiens
tgtgccatagagtttaacaca

SEQ ID NO: 798684 - DNA, 14 bp, Homo sapiens
tgtgccatgcccaa

SEQ ID NO: 798685 - DNA, 17 bp, Homo sapiens
tgtgccatggatctgat

SEQ ID NO: 798686 - DNA, 20 bp, Homo sapiens
tgtgccatggccccccactc

SEQ ID NO: 798687 - DNA, 16 bp, Homo sapiens
tgtgccatgtcaaaca

SEQ ID NO: 798688 - DNA, 21 bp, Homo sapiens
tgtgccatgtcaaacaaatag

SEQ ID NO: 798689 - DNA, 15 bp, Homo sapiens
tgtgccattatattt

SEQ ID NO: 798690 - DNA, 20 bp, Homo sapiens
tgtgccattatatttgcatt

SEQ ID NO: 798691 - DNA, 15 bp, Homo sapiens
tgtgcccaaaagcca

SEQ ID NO: 798692 - DNA, 18 bp, Homo sapiens
tgtgcccaaaagccatgt

SEQ ID NO: 798693 - DNA, 17 bp, Homo sapiens
tgtgcccacatcccagg

SEQ ID NO: 798694 - DNA, 20 bp, Homo sapiens
tgtgcccacccgtcttcaat

SEQ ID NO: 798695 - DNA, 18 bp, Homo sapiens
tgtgcccagcaggcccag

SEQ ID NO: 798696 - DNA, 20 bp, Homo sapiens
tgtgcccagcaggcccagca

SEQ ID NO: 798697 - DNA, 15 bp, Homo sapiens
tgtgcccagggtggc

SEQ ID NO: 798698 - DNA, 13 bp, Homo sapiens
tgtgccccaccac

SEQ ID NO: 798699 - DNA, 17 bp, Homo sapiens
tgtgccccagctgccag

SEQ ID NO: 798700 - DNA, 16 bp, Homo sapiens
tgtgcctctgggactg

SEQ ID NO: 798701 - DNA, 14 bp, Homo sapiens
tgtgcctgcttctg

SEQ ID NO: 798702 - DNA, 14 bp, Homo sapiens
tgtgcctgggccct

SEQ ID NO: 798703 - DNA, 22 bp, Homo sapiens
tgtgcctgggggagttttcctc

SEQ ID NO: 798704 - DNA, 15 bp, Homo sapiens
tgtgcctggtagaaa

SEQ ID NO: 798705 - DNA, 18 bp, Homo sapiens
tgtgcctggtttgatttt

SEQ ID NO: 798706 - DNA, 22 bp, Homo sapiens
tgtgcctgtaatctttttctcc

SEQ ID NO: 798707 - DNA, 15 bp, Homo sapiens
tgtgcctgtggcaga

SEQ ID NO: 798708 - DNA, 20 bp, Homo sapiens
tgtgcctgtgggagggggag

SEQ ID NO: 798709 - DNA, 18 bp, Homo sapiens
tgtgccttaaaaggagag

SEQ ID NO: 798710 - DNA, 21 bp, Homo sapiens
tgtgccttaaaaggagagaag

SEQ ID NO: 798711 - DNA, 15 bp, Homo sapiens
tgtgccttatgttga

SEQ ID NO: 798712 - DNA, 15 bp, Homo sapiens
tgtgccttctttgta

SEQ ID NO: 798713 - DNA, 16 bp, Homo sapiens
tgtgccttgtccagga

SEQ ID NO: 798714 - DNA, 18 bp, Homo sapiens
tgtgcctttgcaaatcag

SEQ ID NO: 798715 - DNA, 15 bp, Homo sapiens
tgtgccttttctgaa

SEQ ID NO: 798716 - DNA, 13 bp, Homo sapiens
tgtgcgctgctct

SEQ ID NO: 798717 - DNA, 21 bp, Homo sapiens
tgtgcggagcgggaggcggtg

SEQ ID NO: 798718 - DNA, 20 bp, Homo sapiens
tgtgcgtatgcagtgtagat

SEQ ID NO: 798719 - DNA, 18 bp, Homo sapiens
tgtgcgtctctctttctc

SEQ ID NO: 798720 - DNA, 22 bp, Homo sapiens
tgtgcgtgaaacacaccaggct

SEQ ID NO: 798721 - DNA, 22 bp, Homo sapiens
tgtgcgtgcgtgttagtgtgtg

SEQ ID NO: 798722 - DNA, 23 bp, Homo sapiens
tgtgcgtgcgtgttagtgtgtgt

SEQ ID NO: 798723 - DNA, 17 bp, Homo sapiens
tgtgcgtggtccgtgtg

SEQ ID NO: 798724 - DNA, 18 bp, Homo sapiens
tgtgctaagtctttccca

SEQ ID NO: 798725 - DNA, 17 bp, Homo sapiens
tgtgctactgattgttt

SEQ ID NO: 798726 - DNA, 22 bp, Homo sapiens
tgtgctacttagtaaaaattga

SEQ ID NO: 798727 - DNA, 14 bp, Homo sapiens
tgtgctagaatact

SEQ ID NO: 798728 - DNA, 16 bp, Homo sapiens
tgtgctagaatacttt

SEQ ID NO: 798729 - DNA, 18 bp, Homo sapiens
tgtgctatagtatttgat

SEQ ID NO: 798730 - DNA, 13 bp, Homo sapiens
tgtgctatagtgt

SEQ ID NO: 798731 - DNA, 19 bp, Homo sapiens
tgtgctatagtgtatacca

SEQ ID NO: 798732 - DNA, 14 bp, Homo sapiens
tgtgctatgaattt

SEQ ID NO: 798733 - DNA, 21 bp, Homo sapiens
tgtgctcacgctcccccgcag

SEQ ID NO: 798734 - DNA, 12 bp, Homo sapiens
tgtgctcagaga

SEQ ID NO: 798735 - DNA, 22 bp, Homo sapiens
tgtgctccatatttgatttcta

SEQ ID NO: 798736 - DNA, 23 bp, Homo sapiens
tgtgctcgggatcaaacctttct

SEQ ID NO: 798737 - DNA, 17 bp, Homo sapiens
tgtgctctccccggcag

SEQ ID NO: 798738 - DNA, 13 bp, Homo sapiens
tgtgctctgggga

SEQ ID NO: 798739 - DNA, 13 bp, Homo sapiens
tgtgctgaagaca

SEQ ID NO: 798740 - DNA, 21 bp, Homo sapiens
tgtgctgacaacttagctcag

SEQ ID NO: 798741 - DNA, 14 bp, Homo sapiens
tgtgctgaggcctt

SEQ ID NO: 798742 - DNA, 16 bp, Homo sapiens
tgtgctgccatttgat

SEQ ID NO: 798743 - DNA, 23 bp, Homo sapiens
tgtgctgccatttgatttttcta

SEQ ID NO: 798744 - DNA, 22 bp, Homo sapiens
tgtgctgcgcctgcaggcagag

SEQ ID NO: 798745 - DNA, 11 bp, Homo sapiens
tgtgctgctgc

SEQ ID NO: 798746 - DNA, 14 bp, Homo sapiens
tgtgctgctgctgc

SEQ ID NO: 798747 - DNA, 20 bp, Homo sapiens
tgtgctggaccagctggcct

SEQ ID NO: 798748 - DNA, 17 bp, Homo sapiens
tgtgctggccatggacg

SEQ ID NO: 798749 - DNA, 14 bp, Homo sapiens
tgtgctgggaaatg

SEQ ID NO: 798750 - DNA, 20 bp, Homo sapiens
tgtgctgggaaatgcagaaa

SEQ ID NO: 798751 - DNA, 21 bp, Homo sapiens
tgtgctgggaaatgcagaaat

SEQ ID NO: 798752 - DNA, 17 bp, Homo sapiens
tgtgctgggagctccac

SEQ ID NO: 798753 - DNA, 21 bp, Homo sapiens
tgtgctgggagctccactctg

SEQ ID NO: 798754 - DNA, 16 bp, Homo sapiens
tgtgctgggtcccagc

SEQ ID NO: 798755 - DNA, 20 bp, Homo sapiens
tgtgctgggtcccagcctgg

SEQ ID NO: 798756 - DNA, 21 bp, Homo sapiens
tgtgctgggtgagctcttcca

SEQ ID NO: 798757 - DNA, 14 bp, Homo sapiens
tgtgctgggtgcct

SEQ ID NO: 798758 - DNA, 18 bp, Homo sapiens
tgtgctggtgaacactgt

SEQ ID NO: 798759 - DNA, 19 bp, Homo sapiens
tgtgctggtgtcctgacca

SEQ ID NO: 798760 - DNA, 23 bp, Homo sapiens
tgtgctggtgtcctgaccaccct

SEQ ID NO: 798761 - DNA, 20 bp, Homo sapiens
tgtgctgtctccatgctgga

SEQ ID NO: 798762 - DNA, 13 bp, Homo sapiens
tgtgctgtgcctg

SEQ ID NO: 798763 - DNA, 13 bp, Homo sapiens
tgtgctgtggaga

SEQ ID NO: 798764 - DNA, 19 bp, Homo sapiens
tgtgctgtggccaggcctg

SEQ ID NO: 798765 - DNA, 21 bp, Homo sapiens
tgtgctgtgggcagcaccctc

SEQ ID NO: 798766 - DNA, 22 bp, Homo sapiens
tgtgctgtgggcagcaccctcc

SEQ ID NO: 798767 - DNA, 14 bp, Homo sapiens
tgtgctgtttgaaa

SEQ ID NO: 798768 - DNA, 23 bp, Homo sapiens
tgtgcttacagtaactaattttg

SEQ ID NO: 798769 - DNA, 23 bp, Homo sapiens
tgtgcttcacagtagagccagct

SEQ ID NO: 798770 - DNA, 19 bp, Homo sapiens
tgtgcttcgggcccttccc

SEQ ID NO: 798771 - DNA, 16 bp, Homo sapiens
tgtgcttctaatatta

SEQ ID NO: 798772 - DNA, 23 bp, Homo sapiens
tgtgcttctcttctttattgcac

SEQ ID NO: 798773 - DNA, 13 bp, Homo sapiens
tgtgcttctgctc

SEQ ID NO: 798774 - DNA, 15 bp, Homo sapiens
tgtgcttgaaggccc

SEQ ID NO: 798775 - DNA, 21 bp, Homo sapiens
tgtgcttgaaggccctgctga

SEQ ID NO: 798776 - DNA, 22 bp, Homo sapiens
tgtgcttgaaggccctgctgag

SEQ ID NO: 798777 - DNA, 21 bp, Homo sapiens
tgtgcttgcttagagtgccca

SEQ ID NO: 798778 - DNA, 14 bp, Homo sapiens
tgtgcttggggcta

SEQ ID NO: 798779 - DNA, 18 bp, Homo sapiens
tgtgcttggtctgtttga

SEQ ID NO: 798780 - DNA, 14 bp, Homo sapiens
tgtgcttgtttaca

SEQ ID NO: 798781 - DNA, 23 bp, Homo sapiens
tgtgcttgtttacagcactactc

SEQ ID NO: 798782 - DNA, 14 bp, Homo sapiens
tgtgcttgttttat

SEQ ID NO: 798783 - DNA, 14 bp, Homo sapiens
tgtgctttagcttg

SEQ ID NO: 798784 - DNA, 21 bp, Homo sapiens
tgtgctttattgaattagaaa

SEQ ID NO: 798785 - DNA, 22 bp, Homo sapiens
tgtgctttattgaattagaaaa

SEQ ID NO: 798786 - DNA, 14 bp, Homo sapiens
tgtgctttctgcat

SEQ ID NO: 798787 - DNA, 14 bp, Homo sapiens
tgtgctttgagaag

SEQ ID NO: 798788 - DNA, 17 bp, Homo sapiens
tgtgctttgcattccta

SEQ ID NO: 798789 - DNA, 17 bp, Homo sapiens
tgtgctttgcattttct

SEQ ID NO: 798790 - DNA, 18 bp, Homo sapiens
tgtgctttgcattttctg

SEQ ID NO: 798791 - DNA, 16 bp, Homo sapiens
tgtgctttgctcttgt

SEQ ID NO: 798792 - DNA, 18 bp, Homo sapiens
tgtgctttgctcttgtcc

SEQ ID NO: 798793 - DNA, 14 bp, Homo sapiens
tgtgctttggttaa

SEQ ID NO: 798794 - DNA, 16 bp, Homo sapiens
tgtgcttttcctattt

SEQ ID NO: 798795 - DNA, 21 bp, Homo sapiens
tgtgcttttcctgataaagca

SEQ ID NO: 798796 - DNA, 15 bp, Homo sapiens
tgtgcttttctccaa

SEQ ID NO: 798797 - DNA, 22 bp, Homo sapiens
tgtgcttttttaaccaaggagg

SEQ ID NO: 798798 - DNA, 16 bp, Homo sapiens
tgtgctttttttgtgt

SEQ ID NO: 798799 - DNA, 22 bp, Homo sapiens
tgtggaaaaaaaaaaaaactac

SEQ ID NO: 798800 - DNA, 18 bp, Homo sapiens
tgtggaaaaatagctctg

SEQ ID NO: 798801 - DNA, 13 bp, Homo sapiens
tgtggaaaacaga

SEQ ID NO: 798802 - DNA, 18 bp, Homo sapiens
tgtggaaaaccaggaaaa

SEQ ID NO: 798803 - DNA, 15 bp, Homo sapiens
tgtggaaaagaaaca

SEQ ID NO: 798804 - DNA, 17 bp, Homo sapiens
tgtggaaaatgaaaatt

SEQ ID NO: 798805 - DNA, 12 bp, Homo sapiens
tgtggaaagcct

SEQ ID NO: 798806 - DNA, 14 bp, Homo sapiens
tgtggaaagcctct

SEQ ID NO: 798807 - DNA, 20 bp, Homo sapiens
tgtggaaagcctctgctgcc

SEQ ID NO: 798808 - DNA, 19 bp, Homo sapiens
tgtggaaagtgaatttgaa

SEQ ID NO: 798809 - DNA, 21 bp, Homo sapiens
tgtggaacataaaaaggacat

SEQ ID NO: 798810 - DNA, 21 bp, Homo sapiens
tgtggaagcatggctgtctgc

SEQ ID NO: 798811 - DNA, 21 bp, Homo sapiens
tgtggaaggaaaatatttcat

SEQ ID NO: 798812 - DNA, 18 bp, Homo sapiens
tgtggaaggcctccctct

SEQ ID NO: 798813 - DNA, 15 bp, Homo sapiens
tgtggaagggactag

SEQ ID NO: 798814 - DNA, 16 bp, Homo sapiens
tgtggaatgcagtcct

SEQ ID NO: 798815 - DNA, 12 bp, Homo sapiens
tgtggacatatg

SEQ ID NO: 798816 - DNA, 15 bp, Homo sapiens
tgtggacctggacaa

SEQ ID NO: 798817 - DNA, 14 bp, Homo sapiens
tgtggacggcgctg

SEQ ID NO: 798818 - DNA, 20 bp, Homo sapiens
tgtggacgtgcactgacagc

SEQ ID NO: 798819 - DNA, 14 bp, Homo sapiens
tgtggactaaatat

SEQ ID NO: 798820 - DNA, 17 bp, Homo sapiens
tgtggagaaaaagatat

SEQ ID NO: 798821 - DNA, 21 bp, Homo sapiens
tgtggagaagcggctggcagc

SEQ ID NO: 798822 - DNA, 23 bp, Homo sapiens
tgtggagaggggtgcacccactc

SEQ ID NO: 798823 - DNA, 14 bp, Homo sapiens
tgtggggggaagct

SEQ ID NO: 798824 - DNA, 19 bp, Homo sapiens
tgtggggggtaatccctgc

SEQ ID NO: 798825 - DNA, 22 bp, Homo sapiens
tgtggggggtaatccctgcttt

SEQ ID NO: 798826 - DNA, 19 bp, Homo sapiens
tgtggggtgcagctgggtg

SEQ ID NO: 798827 - DNA, 16 bp, Homo sapiens
tgtgggtagtcattct

SEQ ID NO: 798828 - DNA, 12 bp, Homo sapiens
tgtgggtctctg

SEQ ID NO: 798829 - DNA, 14 bp, Homo sapiens
tgtgggtctctgaa

SEQ ID NO: 798830 - DNA, 14 bp, Homo sapiens
tgtgggtctctgga

SEQ ID NO: 798831 - DNA, 13 bp, Homo sapiens
tgtgggtgggaga

SEQ ID NO: 798832 - DNA, 13 bp, Homo sapiens
tgtgggtgtcctg

SEQ ID NO: 798833 - DNA, 14 bp, Homo sapiens
tgtgggtgtcctgc

SEQ ID NO: 798834 - DNA, 21 bp, Homo sapiens
tgtgggtgtcctgcctgtctg

SEQ ID NO: 798835 - DNA, 23 bp, Homo sapiens
tgtgggtgtcctgcctgtctgcc

SEQ ID NO: 798836 - DNA, 21 bp, Homo sapiens
tgtgggtgttctttcctgccc

SEQ ID NO: 798837 - DNA, 18 bp, Homo sapiens
tgtgttggaaactgtaaa

SEQ ID NO: 798838 - DNA, 22 bp, Homo sapiens
tgtgttgggattgagtctgtgc

SEQ ID NO: 798839 - DNA, 14 bp, Homo sapiens
tgtgttggtgcttt

SEQ ID NO: 798840 - DNA, 13 bp, Homo sapiens
tgtgttgtctcta

SEQ ID NO: 798841 - DNA, 18 bp, Homo sapiens
tgtgttgtcttgaaagat

SEQ ID NO: 798842 - DNA, 19 bp, Homo sapiens
tgtgttgtcttttttatgt

SEQ ID NO: 798843 - DNA, 13 bp, Homo sapiens
tgtgttgtgatag

SEQ ID NO: 798844 - DNA, 12 bp, Homo sapiens
tgtgttgtgtga

SEQ ID NO: 798845 - DNA, 20 bp, Homo sapiens
tgtgttgttttttgttcaat

SEQ ID NO: 798846 - DNA, 13 bp, Homo sapiens
tgtgtttaaataa

SEQ ID NO: 798847 - DNA, 15 bp, Homo sapiens
tgtgtttaaataaag

SEQ ID NO: 798848 - DNA, 15 bp, Homo sapiens
tgtgtttaacattca

SEQ ID NO: 798849 - DNA, 15 bp, Homo sapiens
tgtgtttatatggaa

SEQ ID NO: 798850 - DNA, 18 bp, Homo sapiens
tgtgtttccaaaggttcc

SEQ ID NO: 798851 - DNA, 18 bp, Homo sapiens
tgtgtttctaaaactatg

SEQ ID NO: 798852 - DNA, 20 bp, Homo sapiens
tgtgtttctatgtgacaatt

SEQ ID NO: 798853 - DNA, 14 bp, Homo sapiens
tgtgtttctgtaac

SEQ ID NO: 798854 - DNA, 17 bp, Homo sapiens
tgtgtttgaaagtgaaa

SEQ ID NO: 798855 - DNA, 17 bp, Homo sapiens
tgtgtttgacatgtgaa

SEQ ID NO: 798856 - DNA, 12 bp, Homo sapiens
tgtgtttgagaa

SEQ ID NO: 798857 - DNA, 15 bp, Homo sapiens
tgtgtttgcttaaac

SEQ ID NO: 798858 - DNA, 17 bp, Homo sapiens
tgtgtttggaagactat

SEQ ID NO: 798859 - DNA, 21 bp, Homo sapiens
tgtgtttggatacatctgctg

SEQ ID NO: 798860 - DNA, 14 bp, Homo sapiens
tgtgtttgtgagca

SEQ ID NO: 798861 - DNA, 19 bp, Homo sapiens
tgtgttttaaaaaaactga

SEQ ID NO: 798862 - DNA, 20 bp, Homo sapiens
tgtgttttaaaaaaactgaa

SEQ ID NO: 798863 - DNA, 16 bp, Homo sapiens
tgtgttttaattttct

SEQ ID NO: 798864 - DNA, 17 bp, Homo sapiens
tgtgttttcataataaa

SEQ ID NO: 798865 - DNA, 17 bp, Homo sapiens
tgtgttttcatcatttc

SEQ ID NO: 798866 - DNA, 19 bp, Homo sapiens
tgtgttttcccaaagcact

SEQ ID NO: 798867 - DNA, 18 bp, Homo sapiens
tgtgttttcttgtaaatg

SEQ ID NO: 798868 - DNA, 20 bp, Homo sapiens
tgtgttttcttgtaaatgtt

SEQ ID NO: 798869 - DNA, 19 bp, Homo sapiens
tgtgtttttattgttaact

SEQ ID NO: 798870 - DNA, 14 bp, Homo sapiens
tgtgtttttctttt

SEQ ID NO: 798871 - DNA, 16 bp, Homo sapiens
tgtgtttttctttttc

SEQ ID NO: 798872 - DNA, 21 bp, Homo sapiens
tgtgtttttgctatcacacag

SEQ ID NO: 798873 - DNA, 16 bp, Homo sapiens
tgtgttttttaagata

SEQ ID NO: 798874 - DNA, 23 bp, Homo sapiens
tgttaaaaaaaaaatccatttta

SEQ ID NO: 798875 - DNA, 22 bp, Homo sapiens
tgttaaaaaaataagaagaatg

SEQ ID NO: 798876 - DNA, 20 bp, Homo sapiens
tgttaaaaaagaaatctgtt

SEQ ID NO: 798877 - DNA, 14 bp, Homo sapiens
tgttaaaaatgtca

SEQ ID NO: 798878 - DNA, 12 bp, Homo sapiens
tgttaaaacaac

SEQ ID NO: 798879 - DNA, 22 bp, Homo sapiens
tgttaaaaccaaactggttcac

SEQ ID NO: 798880 - DNA, 19 bp, Homo sapiens
tgttaaaactggcatctga

SEQ ID NO: 798881 - DNA, 17 bp, Homo sapiens
tgttaaaatgtacactg

SEQ ID NO: 798882 - DNA, 18 bp, Homo sapiens
tgttaaacacgtgtctat

SEQ ID NO: 798883 - DNA, 16 bp, Homo sapiens
tgttaaactagcacag

SEQ ID NO: 798884 - DNA, 13 bp, Homo sapiens
tgttaaactctgt

SEQ ID NO: 798885 - DNA, 12 bp, Homo sapiens
tgttaaactgtt

SEQ ID NO: 798886 - DNA, 14 bp, Homo sapiens
tgttaaactgttag

SEQ ID NO: 798887 - DNA, 22 bp, Homo sapiens
tgttaaactgttagcactgttg

SEQ ID NO: 798888 - DNA, 22 bp, Homo sapiens
tgttaaagctggaacatttgat

SEQ ID NO: 798889 - DNA, 12 bp, Homo sapiens
tgttaaagctgt

SEQ ID NO: 798890 - DNA, 16 bp, Homo sapiens
tgttaaagctgtacac

SEQ ID NO: 798891 - DNA, 13 bp, Homo sapiens
tgttaaatactgt

SEQ ID NO: 798892 - DNA, 15 bp, Homo sapiens
tgttaaatactgtgc

SEQ ID NO: 798893 - DNA, 18 bp, Homo sapiens
tgttaaatactgtgcaga

SEQ ID NO: 798894 - DNA, 20 bp, Homo sapiens
tgttaaatactgtgcagaat

SEQ ID NO: 798895 - DNA, 18 bp, Homo sapiens
tgttaaatgaaattgtaa

SEQ ID NO: 798896 - DNA, 13 bp, Homo sapiens
tgttaaatgactt

SEQ ID NO: 798897 - DNA, 15 bp, Homo sapiens
tgttaaatgacttga

SEQ ID NO: 798898 - DNA, 23 bp, Homo sapiens
tgttaacaatgcctattgtaata

SEQ ID NO: 798899 - DNA, 14 bp, Homo sapiens
tgttaacagtattt

SEQ ID NO: 798900 - DNA, 16 bp, Homo sapiens
tgttaaccagaataaa

SEQ ID NO: 798901 - DNA, 18 bp, Homo sapiens
tgttaacccattccagta

SEQ ID NO: 798902 - DNA, 17 bp, Homo sapiens
tgttaacctcagtgtca

SEQ ID NO: 798903 - DNA, 15 bp, Homo sapiens
tgttaaccttaaata

SEQ ID NO: 798904 - DNA, 19 bp, Homo sapiens
tgttaaccttaaatacact

SEQ ID NO: 798905 - DNA, 19 bp, Homo sapiens
tgttaacgtgatgtgccac

SEQ ID NO: 798906 - DNA, 15 bp, Homo sapiens
tgttaactacatatt

SEQ ID NO: 798907 - DNA, 17 bp, Homo sapiens
tgttaactcttgtctat

SEQ ID NO: 798908 - DNA, 17 bp, Homo sapiens
tgttaactgaataccac

SEQ ID NO: 798909 - DNA, 18 bp, Homo sapiens
tgttaactgaataccact

SEQ ID NO: 798910 - DNA, 20 bp, Homo sapiens
tgttaactgccaagcttgga

SEQ ID NO: 798911 - DNA, 22 bp, Homo sapiens
tgttaacttaatagtatttatg

SEQ ID NO: 798912 - DNA, 21 bp, Homo sapiens
tgttaagaaaggatataaaag

SEQ ID NO: 798913 - DNA, 22 bp, Homo sapiens
tgttaagaaaggatataaaagg

SEQ ID NO: 798914 - DNA, 20 bp, Homo sapiens
tgttaagacttgacagtgga

SEQ ID NO: 798915 - DNA, 15 bp, Homo sapiens
tgttaagataactta

SEQ ID NO: 798916 - DNA, 19 bp, Homo sapiens
tgttaagataacttactgt

SEQ ID NO: 798917 - DNA, 22 bp, Homo sapiens
tgttaagataacttactgtata

SEQ ID NO: 798918 - DNA, 15 bp, Homo sapiens
tgttaagcatttatt

SEQ ID NO: 798919 - DNA, 15 bp, Homo sapiens
tgttaagcttctatt

SEQ ID NO: 798920 - DNA, 17 bp, Homo sapiens
tgttaaggcaacattcc

SEQ ID NO: 798921 - DNA, 20 bp, Homo sapiens
tgttaagggaagaattccag

SEQ ID NO: 798922 - DNA, 18 bp, Homo sapiens
tgttaagtcctccctgac

SEQ ID NO: 798923 - DNA, 22 bp, Homo sapiens
tgttaagtcctccctgactttt

SEQ ID NO: 798924 - DNA, 22 bp, Homo sapiens
tgttaagtgccattactactgt

SEQ ID NO: 798925 - DNA, 17 bp, Homo sapiens
tgttaagttatagtgaa

SEQ ID NO: 798926 - DNA, 13 bp, Homo sapiens
tgttaatacacag

SEQ ID NO: 798927 - DNA, 15 bp, Homo sapiens
tgttaatacacagta

SEQ ID NO: 798928 - DNA, 12 bp, Homo sapiens
tgttaatatcac

SEQ ID NO: 798929 - DNA, 19 bp, Homo sapiens
tgttaatatcactcattaa

SEQ ID NO: 798930 - DNA, 23 bp, Homo sapiens
tgttaatcttaggggagagcttt

SEQ ID NO: 798931 - DNA, 18 bp, Homo sapiens
tgttaatgactctttctg

SEQ ID NO: 798932 - DNA, 23 bp, Homo sapiens
tgttaatggatttcagaagccta

SEQ ID NO: 798933 - DNA, 22 bp, Homo sapiens
tgttaatggtagcattcttctt

SEQ ID NO: 798934 - DNA, 13 bp, Homo sapiens
tgttaatgtcatt

SEQ ID NO: 798935 - DNA, 18 bp, Homo sapiens
tgttaatgtcattgctaa

SEQ ID NO: 798936 - DNA, 12 bp, Homo sapiens
tgttaatgtgat

SEQ ID NO: 798937 - DNA, 17 bp, Homo sapiens
tgttaatgtgatggatg

SEQ ID NO: 798938 - DNA, 15 bp, Homo sapiens
tgttaattacaccat

SEQ ID NO: 798939 - DNA, 15 bp, Homo sapiens
tgttaattcagcact

SEQ ID NO: 798940 - DNA, 20 bp, Homo sapiens
tgttaattcagcactgattt

SEQ ID NO: 798941 - DNA, 22 bp, Homo sapiens
tgttaatttagaaaactttaaa

SEQ ID NO: 798942 - DNA, 23 bp, Homo sapiens
tgttaatttataggcgttttttg

SEQ ID NO: 798943 - DNA, 22 bp, Homo sapiens
tgttaatttattttgctccctc

SEQ ID NO: 798944 - DNA, 15 bp, Homo sapiens
tgttaatttttgata

SEQ ID NO: 798945 - DNA, 16 bp, Homo sapiens
tgttacaacaactatt

SEQ ID NO: 798946 - DNA, 15 bp, Homo sapiens
tgttacaagaggcca

SEQ ID NO: 798947 - DNA, 17 bp, Homo sapiens
tgttacaatagaattta

SEQ ID NO: 798948 - DNA, 23 bp, Homo sapiens
tgttacaggcaccgagaatgttg

SEQ ID NO: 798949 - DNA, 12 bp, Homo sapiens
tgttacatcaca

SEQ ID NO: 798950 - DNA, 22 bp, Homo sapiens
tgttacattaaagccctgtgtt

SEQ ID NO: 798951 - DNA, 12 bp, Homo sapiens
tgttacattatt

SEQ ID NO: 798952 - DNA, 23 bp, Homo sapiens
tgttaccaaaaataaatatatct

SEQ ID NO: 798953 - DNA, 21 bp, Homo sapiens
tgttaccagagcctctttgct

SEQ ID NO: 798954 - DNA, 16 bp, Homo sapiens
tgttacctgaaaacac

SEQ ID NO: 798955 - DNA, 15 bp, Homo sapiens
tgttacctgtgtgct

SEQ ID NO: 798956 - DNA, 17 bp, Homo sapiens
tgttacctgtgtgcttg

SEQ ID NO: 798957 - DNA, 19 bp, Homo sapiens
tgttacctgttagctccct

SEQ ID NO: 798958 - DNA, 21 bp, Homo sapiens
tgttacggcatcacacttata

SEQ ID NO: 798959 - DNA, 22 bp, Homo sapiens
tgttacgtgaagaaataaatga

SEQ ID NO: 798960 - DNA, 20 bp, Homo sapiens
tgttactaaaaaaaagatga

SEQ ID NO: 798961 - DNA, 20 bp, Homo sapiens
tgttactaaatccttttgtt

SEQ ID NO: 798962 - DNA, 23 bp, Homo sapiens
tgttactaaatggtgttacatta

SEQ ID NO: 798963 - DNA, 13 bp, Homo sapiens
tgttactaactaa

SEQ ID NO: 798964 - DNA, 14 bp, Homo sapiens
tgttactaactaaa

SEQ ID NO: 798965 - DNA, 14 bp, Homo sapiens
tgttactaagtttt

SEQ ID NO: 798966 - DNA, 19 bp, Homo sapiens
tgttcacttttcctccctc

SEQ ID NO: 798967 - DNA, 16 bp, Homo sapiens
tgttcagaaagcaata

SEQ ID NO: 798968 - DNA, 18 bp, Homo sapiens
tgttcagaaggttgctct

SEQ ID NO: 798969 - DNA, 20 bp, Homo sapiens
tgttcagagtggctcactgg

SEQ ID NO: 798970 - DNA, 15 bp, Homo sapiens
tgtttatgaggaaac

SEQ ID NO: 798971 - DNA, 23 bp, Homo sapiens
tgtttatgatatttcttgctttc

SEQ ID NO: 798972 - DNA, 21 bp, Homo sapiens
tgtttatgcaaggaaggaaag

SEQ ID NO: 798973 - DNA, 13 bp, Homo sapiens
tgtttatggtaaa

SEQ ID NO: 798974 - DNA, 14 bp, Homo sapiens
tgtttattaaatag

SEQ ID NO: 798975 - DNA, 15 bp, Homo sapiens
tgtttattaaatgct

SEQ ID NO: 798976 - DNA, 12 bp, Homo sapiens
tgtttgtgtatt

SEQ ID NO: 798977 - DNA, 17 bp, Homo sapiens
tgtttgtgtgatttcct

SEQ ID NO: 798978 - DNA, 11 bp, Homo sapiens
tgtttgtgtgt

SEQ ID NO: 798979 - DNA, 15 bp, Homo sapiens
tgtttgttcatctgt

SEQ ID NO: 798980 - DNA, 22 bp, Homo sapiens
tgtttgttggttgattgtttaa

SEQ ID NO: 798981 - DNA, 11 bp, Homo sapiens
tgtttgtttaa

SEQ ID NO: 798982 - DNA, 14 bp, Homo sapiens
tgtttgtttaattt

SEQ ID NO: 798983 - DNA, 15 bp, Homo sapiens
tgtttgtttcaagaa

SEQ ID NO: 798984 - DNA, 14 bp, Homo sapiens
tgtttgtttcagtg

SEQ ID NO: 798985 - DNA, 17 bp, Homo sapiens
tgtttgtttcctttgtt

SEQ ID NO: 798986 - DNA, 22 bp, Homo sapiens
tgtttgtttctccccctgggct

SEQ ID NO: 798987 - DNA, 20 bp, Homo sapiens
tgtttgtttcttcttttcct

SEQ ID NO: 798988 - DNA, 23 bp, Homo sapiens
tgtttgtttcttcttttccttta

SEQ ID NO: 798989 - DNA, 16 bp, Homo sapiens
tgtttgtttgtctgtt

SEQ ID NO: 798990 - DNA, 19 bp, Homo sapiens
tgttttaaaaaaactgaag

SEQ ID NO: 798991 - DNA, 21 bp, Homo sapiens
tgttttaaaaaaactgaaggt

SEQ ID NO: 798992 - DNA, 18 bp, Homo sapiens
tgttttaaaaaaatttga

SEQ ID NO: 798993 - DNA, 19 bp, Homo sapiens
tgttttaaaataagttaaa

SEQ ID NO: 798994 - DNA, 12 bp, Homo sapiens
tgttttaaagaa

SEQ ID NO: 798995 - DNA, 22 bp, Homo sapiens
tgttttaaagaatatgactttt

SEQ ID NO: 798996 - DNA, 15 bp, Homo sapiens
tgttttaaatgtaca

SEQ ID NO: 798997 - DNA, 20 bp, Homo sapiens
tgttttaataaaagatttac

SEQ ID NO: 798998 - DNA, 18 bp, Homo sapiens
tgttttaattgtagttct

SEQ ID NO: 798999 - DNA, 17 bp, Homo sapiens
tgttttacaatagttct

SEQ ID NO: 799000 - DNA, 22 bp, Homo sapiens
tgttttacaatagttctgtggg

SEQ ID NO: 799001 - DNA, 14 bp, Homo sapiens
tgttttaccagctc

SEQ ID NO: 799002 - DNA, 16 bp, Homo sapiens
tgttttacgtgcaaac

SEQ ID NO: 799003 - DNA, 15 bp, Homo sapiens
tgttttactgtgaaa

SEQ ID NO: 799004 - DNA, 18 bp, Homo sapiens
tgttttactgtgaaactg

SEQ ID NO: 799005 - DNA, 16 bp, Homo sapiens
tgttttagaaccagcc

SEQ ID NO: 799006 - DNA, 17 bp, Homo sapiens
tgttttagatgttacta

SEQ ID NO: 799007 - DNA, 15 bp, Homo sapiens
tgttttatatacctg

SEQ ID NO: 799008 - DNA, 15 bp, Homo sapiens
tgttttatatcaaat

SEQ ID NO: 799009 - DNA, 12 bp, Homo sapiens
tgttttatcatg

SEQ ID NO: 799010 - DNA, 20 bp, Homo sapiens
tgttttatggcctaaattta

SEQ ID NO: 799011 - DNA, 15 bp, Homo sapiens
tgttttatttatcaa

SEQ ID NO: 799012 - DNA, 12 bp, Homo sapiens
tgttttcaagga

SEQ ID NO: 799013 - DNA, 16 bp, Homo sapiens
tgttttcaagtgtaaa

SEQ ID NO: 799014 - DNA, 21 bp, Homo sapiens
tgttttcaattttaaacatat

SEQ ID NO: 799015 - DNA, 12 bp, Homo sapiens
tgttttcacact

SEQ ID NO: 799016 - DNA, 21 bp, Homo sapiens
tgttttcacttgtattgactt

SEQ ID NO: 799017 - DNA, 15 bp, Homo sapiens
tgttttcagactcag

SEQ ID NO: 799018 - DNA, 15 bp, Homo sapiens
tgttttcataataaa

SEQ ID NO: 799019 - DNA, 16 bp, Homo sapiens
tgttttcatcatttca

SEQ ID NO: 799020 - DNA, 17 bp, Homo sapiens
tgttttcatcatttcag

SEQ ID NO: 799021 - DNA, 18 bp, Homo sapiens
tgttttcatcatttcagc

SEQ ID NO: 799022 - DNA, 15 bp, Homo sapiens
tgttttccactgtgc

SEQ ID NO: 799023 - DNA, 20 bp, Homo sapiens
tgttttcccaagtgtaatta

SEQ ID NO: 799024 - DNA, 21 bp, Homo sapiens
tgttttccctggctaacagtc

SEQ ID NO: 799025 - DNA, 16 bp, Homo sapiens
tgttttccgtgaaaac

SEQ ID NO: 799026 - DNA, 19 bp, Homo sapiens
tgttttccgtgaaaacgga

SEQ ID NO: 799027 - DNA, 21 bp, Homo sapiens
tgttttcctcccttctgctac

SEQ ID NO: 799028 - DNA, 17 bp, Homo sapiens
tgttttctaagatgttc

SEQ ID NO: 799029 - DNA, 14 bp, Homo sapiens
tgttttctccctct

SEQ ID NO: 799030 - DNA, 17 bp, Homo sapiens
tgttttctgaaacacac

SEQ ID NO: 799031 - DNA, 17 bp, Homo sapiens
tgttttctgaataacat

SEQ ID NO: 799032 - DNA, 17 bp, Homo sapiens
tgttttctgactaatta

SEQ ID NO: 799033 - DNA, 23 bp, Homo sapiens
tgttttctgagcccgggctgcct

SEQ ID NO: 799034 - DNA, 13 bp, Homo sapiens
tgttttctgtaga

SEQ ID NO: 799035 - DNA, 17 bp, Homo sapiens
tgttttcttgtaaatgt

SEQ ID NO: 799036 - DNA, 19 bp, Homo sapiens
tgttttcttgtctgtgtga

SEQ ID NO: 799037 - DNA, 23 bp, Homo sapiens
tgttttgaaagtttaacaaatga

SEQ ID NO: 799038 - DNA, 21 bp, Homo sapiens
tgttttgatatttatttcctg

SEQ ID NO: 799039 - DNA, 23 bp, Homo sapiens
tgttttgcttttgtttttttcct

SEQ ID NO: 799040 - DNA, 19 bp, Homo sapiens
tgttttggactccatctct

SEQ ID NO: 799041 - DNA, 14 bp, Homo sapiens
tgttttggagaaaa

SEQ ID NO: 799042 - DNA, 20 bp, Homo sapiens
tgttttgggatcaggagccc

SEQ ID NO: 799043 - DNA, 22 bp, Homo sapiens
tgttttggtcccctccctcgtg

SEQ ID NO: 799044 - DNA, 13 bp, Homo sapiens
tgttttgtaaaca

SEQ ID NO: 799045 - DNA, 18 bp, Homo sapiens
tgttttgtaaacatttat

SEQ ID NO: 799046 - DNA, 19 bp, Homo sapiens
tgttttgtggtttggaata

SEQ ID NO: 799047 - DNA, 13 bp, Homo sapiens
tgttttgtgtata

SEQ ID NO: 799048 - DNA, 16 bp, Homo sapiens
tgttttgttctgtggt

SEQ ID NO: 799049 - DNA, 17 bp, Homo sapiens
tgttttgttctttaaag

SEQ ID NO: 799050 - DNA, 14 bp, Homo sapiens
tgttttgttgacat

SEQ ID NO: 799051 - DNA, 16 bp, Homo sapiens
tgttttgttgtttgat

SEQ ID NO: 799052 - DNA, 15 bp, Homo sapiens
tgttttgttttgtag

SEQ ID NO: 799053 - DNA, 19 bp, Homo sapiens
tgtttttaaaagtttcaat

SEQ ID NO: 799054 - DNA, 14 bp, Homo sapiens
tgtttttaaactgt

SEQ ID NO: 799055 - DNA, 15 bp, Homo sapiens
tgtttttaaactgta

SEQ ID NO: 799056 - DNA, 19 bp, Homo sapiens
tgtttttaacatgtcaatc

SEQ ID NO: 799057 - DNA, 14 bp, Homo sapiens
tgtttttaagctgt

SEQ ID NO: 799058 - DNA, 20 bp, Homo sapiens
tgtttttaagctgtttccat

SEQ ID NO: 799059 - DNA, 17 bp, Homo sapiens
tgtttttaagtcctgta

SEQ ID NO: 799060 - DNA, 18 bp, Homo sapiens
tgtttttaatctcctgtt

SEQ ID NO: 799061 - DNA, 14 bp, Homo sapiens
tgtttttacagagg

SEQ ID NO: 799062 - DNA, 13 bp, Homo sapiens
tgtttttcatgaa

SEQ ID NO: 799063 - DNA, 16 bp, Homo sapiens
tgtttttcctttctta

SEQ ID NO: 799064 - DNA, 22 bp, Homo sapiens
tgtttttctgtgtgtcagtttt

SEQ ID NO: 799065 - DNA, 20 bp, Homo sapiens
tgtttttgaatttaaataaa

SEQ ID NO: 799066 - DNA, 16 bp, Homo sapiens
tgtttttgcacatgtt

SEQ ID NO: 799067 - DNA, 16 bp, Homo sapiens
tgtttttgcatgaaat

SEQ ID NO: 799068 - DNA, 18 bp, Homo sapiens
tgtttttgcatgaaattg

SEQ ID NO: 799069 - DNA, 23 bp, Homo sapiens
tgtttttgcgtgggagtgtgtgc

SEQ ID NO: 799070 - DNA, 16 bp, Homo sapiens
tgtttttggtctttta

SEQ ID NO: 799071 - DNA, 17 bp, Homo sapiens
tgtttttgtaatgcact

SEQ ID NO: 799072 - DNA, 23 bp, Homo sapiens
tgtttttgtatattgggtgtaga

SEQ ID NO: 799073 - DNA, 20 bp, Homo sapiens
tgtttttgtcaactgcttgt

SEQ ID NO: 799074 - DNA, 14 bp, Homo sapiens
tgtttttgttgtgt

SEQ ID NO: 799075 - DNA, 18 bp, Homo sapiens
tgttttttaaaaaagcct

SEQ ID NO: 799076 - DNA, 15 bp, Homo sapiens
tgttttttaaagcaa

SEQ ID NO: 799077 - DNA, 11 bp, Homo sapiens
tgttttttaag

SEQ ID NO: 799078 - DNA, 18 bp, Homo sapiens
tgttttttaattctctgt

SEQ ID NO: 799079 - DNA, 22 bp, Homo sapiens
tgttttttaattctctgttcct

SEQ ID NO: 799080 - DNA, 17 bp, Homo sapiens
tgttttttagatcaaat

SEQ ID NO: 799081 - DNA, 14 bp, Homo sapiens
tgttttttcaaaat

SEQ ID NO: 799082 - DNA, 16 bp, Homo sapiens
tgttttttcaaaatag

SEQ ID NO: 799083 - DNA, 13 bp, Homo sapiens
tgttttttcatgc

SEQ ID NO: 799084 - DNA, 13 bp, Homo sapiens
tgttttttcatgt

SEQ ID NO: 799085 - DNA, 14 bp, Homo sapiens
tgttttttcatgtg

SEQ ID NO: 799086 - DNA, 14 bp, Homo sapiens
tgttttttcatttg

SEQ ID NO: 799087 - DNA, 18 bp, Homo sapiens
tgttttttcatttgtaaa

SEQ ID NO: 799088 - DNA, 19 bp, Homo sapiens
tgttttttcatttgtaaaa

SEQ ID NO: 799089 - DNA, 17 bp, Homo sapiens
tgttttttcctgagctt

SEQ ID NO: 799090 - DNA, 13 bp, Homo sapiens
tgttttttccttt

SEQ ID NO: 799091 - DNA, 22 bp, Homo sapiens
tgttttttctttttttttaagt

SEQ ID NO: 799092 - DNA, 16 bp, Homo sapiens
tgttttttgaaaacat

SEQ ID NO: 799093 - DNA, 15 bp, Homo sapiens
tgttttttgccacag

SEQ ID NO: 799094 - DNA, 18 bp, Homo sapiens
tgttttttttttccactt

SEQ ID NO: 799095 - DNA, 16 bp, Homo sapiens
ttaaaaaaaaaggcat

SEQ ID NO: 799096 - DNA, 22 bp, Homo sapiens
ttaaaaaaaaagtcagagacag

SEQ ID NO: 799097 - DNA, 15 bp, Homo sapiens
ttaaaaaaaacaaaa

SEQ ID NO: 799098 - DNA, 19 bp, Homo sapiens
ttaaaaaaaacaaaaagaa

SEQ ID NO: 799099 - DNA, 22 bp, Homo sapiens
ttaaaaaaaacaaaaagaacaa

SEQ ID NO: 799100 - DNA, 19 bp, Homo sapiens
ttaaaaaaaatttgtgtgc

SEQ ID NO: 799101 - DNA, 12 bp, Homo sapiens
ttaaaaaaactg

SEQ ID NO: 799102 - DNA, 12 bp, Homo sapiens
ttaaaaaaataa

SEQ ID NO: 799103 - DNA, 18 bp, Homo sapiens
ttaaaaaaatcaaaacaa

SEQ ID NO: 799104 - DNA, 20 bp, Homo sapiens
ttaaaaaaatttttataaat

SEQ ID NO: 799105 - DNA, 19 bp, Homo sapiens
ttaaaaaacaaaaaaagac

SEQ ID NO: 799106 - DNA, 22 bp, Homo sapiens
ttaaaaaagactgaacatgttt

SEQ ID NO: 799107 - DNA, 15 bp, Homo sapiens
ttaaaaaagcaaagg

SEQ ID NO: 799108 - DNA, 21 bp, Homo sapiens
ttaaaaaagcctggtttttct

SEQ ID NO: 799109 - DNA, 23 bp, Homo sapiens
ttaaaaaagcctggtttttctca

SEQ ID NO: 799110 - DNA, 11 bp, Homo sapiens
ttaaaaaatac

SEQ ID NO: 799111 - DNA, 15 bp, Homo sapiens
ttaaaaaataccatt

SEQ ID NO: 799112 - DNA, 13 bp, Homo sapiens
ttaaaaaatactt

SEQ ID NO: 799113 - DNA, 18 bp, Homo sapiens
ttaaaaaatattttaaga

SEQ ID NO: 799114 - DNA, 19 bp, Homo sapiens
ttaaaaaatattttaagaa

SEQ ID NO: 799115 - DNA, 12 bp, Homo sapiens
ttaaaaaatcaa

SEQ ID NO: 799116 - DNA, 14 bp, Homo sapiens
ttaaaaaatcaatc

SEQ ID NO: 799117 - DNA, 13 bp, Homo sapiens
ttaaaaaatttgt

SEQ ID NO: 799118 - DNA, 14 bp, Homo sapiens
ttaaaaaatttgta

SEQ ID NO: 799119 - DNA, 22 bp, Homo sapiens
ttaaaaacaacgaaagaaggca

SEQ ID NO: 799120 - DNA, 14 bp, Homo sapiens
ttaaaaacatgaat

SEQ ID NO: 799121 - DNA, 10 bp, Homo sapiens
ttaaaaactt

SEQ ID NO: 799122 - DNA, 12 bp, Homo sapiens
ttaaaaacttta

SEQ ID NO: 799123 - DNA, 14 bp, Homo sapiens
ttaaaaactttatt

SEQ ID NO: 799124 - DNA, 12 bp, Homo sapiens
ttaaaaagaaat

SEQ ID NO: 799125 - DNA, 17 bp, Homo sapiens
ttaaaaagaaatccagt

SEQ ID NO: 799126 - DNA, 12 bp, Homo sapiens
ttaaaaagcaaa

SEQ ID NO: 799127 - DNA, 13 bp, Homo sapiens
ttaaaaagcaaat

SEQ ID NO: 799128 - DNA, 17 bp, Homo sapiens
ttaaaaagcagctgcat

SEQ ID NO: 799129 - DNA, 22 bp, Homo sapiens
ttaaaaaggcagtttgcaaaaa

SEQ ID NO: 799130 - DNA, 13 bp, Homo sapiens
ttaaaaaggccaa

SEQ ID NO: 799131 - DNA, 17 bp, Homo sapiens
ttaaaaaggccaaagat

SEQ ID NO: 799132 - DNA, 19 bp, Homo sapiens
ttaaaaaggccaaagataa

SEQ ID NO: 799133 - DNA, 22 bp, Homo sapiens
ttaaaaagggagaaagaaaact

SEQ ID NO: 799134 - DNA, 18 bp, Homo sapiens
ttaaaaagtggaaaaata

SEQ ID NO: 799135 - DNA, 16 bp, Homo sapiens
ttaaaaatctcaaatt

SEQ ID NO: 799136 - DNA, 17 bp, Homo sapiens
ttaaaaatctcaaattt

SEQ ID NO: 799137 - DNA, 19 bp, Homo sapiens
ttaaaaatctcaaatttct

SEQ ID NO: 799138 - DNA, 22 bp, Homo sapiens
ttaaaaatggtatcaaaattac

SEQ ID NO: 799139 - DNA, 23 bp, Homo sapiens
ttaaaaatggtatcaaaattaca

SEQ ID NO: 799140 - DNA, 13 bp, Homo sapiens
ttaaaaatgttct

SEQ ID NO: 799141 - DNA, 22 bp, Homo sapiens
ttaaaacaaaagggtgtatagt

SEQ ID NO: 799142 - DNA, 16 bp, Homo sapiens
ttaaaacaaatataca

SEQ ID NO: 799143 - DNA, 20 bp, Homo sapiens
ttaaaacaatattgtttcta

SEQ ID NO: 799144 - DNA, 13 bp, Homo sapiens
ttaaaacacatat

SEQ ID NO: 799145 - DNA, 16 bp, Homo sapiens
ttaaaacacctttcct

SEQ ID NO: 799146 - DNA, 14 bp, Homo sapiens
ttaaaacagacact

SEQ ID NO: 799147 - DNA, 12 bp, Homo sapiens
ttaaaacagctg

SEQ ID NO: 799148 - DNA, 22 bp, Homo sapiens
ttaaaacatatttcattttaac

SEQ ID NO: 799149 - DNA, 22 bp, Homo sapiens
ttaaaaccattgtcctaagaac

SEQ ID NO: 799150 - DNA, 16 bp, Homo sapiens
ttaaaacgaaaataaa

SEQ ID NO: 799151 - DNA, 22 bp, Homo sapiens
ttaaaactagttagattcactt

SEQ ID NO: 799152 - DNA, 11 bp, Homo sapiens
ttaaaactcat

SEQ ID NO: 799153 - DNA, 19 bp, Homo sapiens
ttaaaactgtatttaagga

SEQ ID NO: 799154 - DNA, 15 bp, Homo sapiens
ttaaaacttgtaatt

SEQ ID NO: 799155 - DNA, 16 bp, Homo sapiens
ttaaaagaaaaaatga

SEQ ID NO: 799156 - DNA, 18 bp, Homo sapiens
ttaaaagaaaaaatgaca

SEQ ID NO: 799157 - DNA, 12 bp, Homo sapiens
ttaaaagaatat

SEQ ID NO: 799158 - DNA, 17 bp, Homo sapiens
ttaaaagacaagacttc

SEQ ID NO: 799159 - DNA, 14 bp, Homo sapiens
ttaaaagatacagt

SEQ ID NO: 799160 - DNA, 18 bp, Homo sapiens
ttaaaagcaaatcatttg

SEQ ID NO: 799161 - DNA, 17 bp, Homo sapiens
ttaaaagcacaatcact

SEQ ID NO: 799162 - DNA, 13 bp, Homo sapiens
ttaaaagcatgaa

SEQ ID NO: 799163 - DNA, 17 bp, Homo sapiens
ttaaaagcatgaaacat

SEQ ID NO: 799164 - DNA, 12 bp, Homo sapiens
ttaaaagccatg

SEQ ID NO: 799165 - DNA, 15 bp, Homo sapiens
ttaaaagggaacaca

SEQ ID NO: 799166 - DNA, 17 bp, Homo sapiens
ttaaaagtaaaatgtct

SEQ ID NO: 799167 - DNA, 18 bp, Homo sapiens
ttaaaagtaaaatgtctt

SEQ ID NO: 799168 - DNA, 21 bp, Homo sapiens
ttaaaagtactttaaaaagga

SEQ ID NO: 799169 - DNA, 16 bp, Homo sapiens
ttaaaagtatctttaa

SEQ ID NO: 799170 - DNA, 12 bp, Homo sapiens
ttaaaagtattc

SEQ ID NO: 799171 - DNA, 14 bp, Homo sapiens
ttaaaagtattcat

SEQ ID NO: 799172 - DNA, 15 bp, Homo sapiens
ttaaaagtattcata

SEQ ID NO: 799173 - DNA, 15 bp, Homo sapiens
ttaaaagttgcattt

SEQ ID NO: 799174 - DNA, 19 bp, Homo sapiens
ttaaaagtttcaatgtgat

SEQ ID NO: 799175 - DNA, 16 bp, Homo sapiens
ttaaaataaaacaagc

SEQ ID NO: 799176 - DNA, 13 bp, Homo sapiens
ttaaaataaattc

SEQ ID NO: 799177 - DNA, 22 bp, Homo sapiens
ttaaaataagctttctcagaat

SEQ ID NO: 799178 - DNA, 17 bp, Homo sapiens
ttaaaataagtctgatt

SEQ ID NO: 799179 - DNA, 13 bp, Homo sapiens
ttaaaatacaaga

SEQ ID NO: 799180 - DNA, 17 bp, Homo sapiens
ttaaaatagaaattttg

SEQ ID NO: 799181 - DNA, 21 bp, Homo sapiens
ttaaaatagcaaaagaagaag

SEQ ID NO: 799182 - DNA, 23 bp, Homo sapiens
ttaaaatagcaaaagaagaagtt

SEQ ID NO: 799183 - DNA, 22 bp, Homo sapiens
ttaaaatagcaacactctatat

SEQ ID NO: 799184 - DNA, 20 bp, Homo sapiens
ttaaaatagcatactgtgta

SEQ ID NO: 799185 - DNA, 22 bp, Homo sapiens
ttaaaatagcatactgtgtatg

SEQ ID NO: 799186 - DNA, 21 bp, Homo sapiens
ttaaaatagcgttcttgtaat

SEQ ID NO: 799187 - DNA, 18 bp, Homo sapiens
ttaaaataggggatattt

SEQ ID NO: 799188 - DNA, 23 bp, Homo sapiens
ttaaaataggggatatttaaggt

SEQ ID NO: 799189 - DNA, 11 bp, Homo sapiens
ttaaaatatat

SEQ ID NO: 799190 - DNA, 14 bp, Homo sapiens
ttaaaatatatagt

SEQ ID NO: 799191 - DNA, 21 bp, Homo sapiens
ttaaaatatatagtgaaaaat

SEQ ID NO: 799192 - DNA, 13 bp, Homo sapiens
ttaaaatatatgt

SEQ ID NO: 799193 - DNA, 19 bp, Homo sapiens
ttaaaatatcctgtaacta

SEQ ID NO: 799194 - DNA, 14 bp, Homo sapiens
ttaaaatatggcta

SEQ ID NO: 799195 - DNA, 20 bp, Homo sapiens
ttaaaatatgtatgtctaat

SEQ ID NO: 799196 - DNA, 13 bp, Homo sapiens
ttaaaatatgtga

SEQ ID NO: 799197 - DNA, 20 bp, Homo sapiens
ttaaaatatgtgaagttttc

SEQ ID NO: 799198 - DNA, 16 bp, Homo sapiens
ttaaaatattatttga

SEQ ID NO: 799199 - DNA, 12 bp, Homo sapiens
ttaaaatattta

SEQ ID NO: 799200 - DNA, 17 bp, Homo sapiens
ttaaaatatttatttat

SEQ ID NO: 799201 - DNA, 22 bp, Homo sapiens
ttaaaatatttgtctttaaaca

SEQ ID NO: 799202 - DNA, 14 bp, Homo sapiens
ttaaaatattttat

SEQ ID NO: 799203 - DNA, 14 bp, Homo sapiens
ttaaaatattttgg

SEQ ID NO: 799204 - DNA, 14 bp, Homo sapiens
ttaaaatccagtat

SEQ ID NO: 799205 - DNA, 15 bp, Homo sapiens
ttaaaatccagtatt

SEQ ID NO: 799206 - DNA, 18 bp, Homo sapiens
ttaaaatctgagggaaat

SEQ ID NO: 799207 - DNA, 22 bp, Homo sapiens
ttaaaatctgagggaaatgttt

SEQ ID NO: 799208 - DNA, 19 bp, Homo sapiens
ttaagaggctttggcccaa

SEQ ID NO: 799209 - DNA, 20 bp, Homo sapiens
ttaagagtagcaagttctag

SEQ ID NO: 799210 - DNA, 18 bp, Homo sapiens
ttaagagtccaactcact

SEQ ID NO: 799211 - DNA, 22 bp, Homo sapiens
ttaagagtccaactcacttcca

SEQ ID NO: 799212 - DNA, 21 bp, Homo sapiens
ttaagagtgggggagagcagg

SEQ ID NO: 799213 - DNA, 17 bp, Homo sapiens
ttaagataacttactgt

SEQ ID NO: 799214 - DNA, 17 bp, Homo sapiens
ttaagatagtgtaactt

SEQ ID NO: 799215 - DNA, 22 bp, Homo sapiens
ttaagatatccatctttttctt

SEQ ID NO: 799216 - DNA, 15 bp, Homo sapiens
ttaagatcctaaact

SEQ ID NO: 799217 - DNA, 16 bp, Homo sapiens
ttaagatcctaaactc

SEQ ID NO: 799218 - DNA, 18 bp, Homo sapiens
ttaagatggattctcaga

SEQ ID NO: 799219 - DNA, 21 bp, Homo sapiens
ttaagatggcaattactttgg

SEQ ID NO: 799220 - DNA, 16 bp, Homo sapiens
ttaagatgtccagggc

SEQ ID NO: 799221 - DNA, 22 bp, Homo sapiens
ttaagatgtttattaatagaat

SEQ ID NO: 799222 - DNA, 16 bp, Homo sapiens
ttaagattggaaatgt

SEQ ID NO: 799223 - DNA, 22 bp, Homo sapiens
ttaagcaaacgtctattttgta

SEQ ID NO: 799224 - DNA, 16 bp, Homo sapiens
ttaagcaaaggggaca

SEQ ID NO: 799225 - DNA, 11 bp, Homo sapiens
ttaagcacaca

SEQ ID NO: 799226 - DNA, 23 bp, Homo sapiens
ttaagcacacacatctggccctg

SEQ ID NO: 799227 - DNA, 17 bp, Homo sapiens
ttaagcactacataaac

SEQ ID NO: 799228 - DNA, 14 bp, Homo sapiens
ttaagcactttgaa

SEQ ID NO: 799229 - DNA, 18 bp, Homo sapiens
ttaagcagaacaaatgtg

SEQ ID NO: 799230 - DNA, 15 bp, Homo sapiens
ttaagcagcatggaa

SEQ ID NO: 799231 - DNA, 19 bp, Homo sapiens
ttaagcagcatggaaaaat

SEQ ID NO: 799232 - DNA, 14 bp, Homo sapiens
ttaagcattgtttg

SEQ ID NO: 799233 - DNA, 23 bp, Homo sapiens
ttaagcattgtttgcttattgtt

SEQ ID NO: 799234 - DNA, 13 bp, Homo sapiens
ttaagcatttgta

SEQ ID NO: 799235 - DNA, 17 bp, Homo sapiens
ttaagcatttgtatatt

SEQ ID NO: 799236 - DNA, 16 bp, Homo sapiens
ttaagccaaaacaatg

SEQ ID NO: 799237 - DNA, 21 bp, Homo sapiens
ttaagccacttaaaatgttca

SEQ ID NO: 799238 - DNA, 20 bp, Homo sapiens
ttaagcccagtgcactgaaa

SEQ ID NO: 799239 - DNA, 18 bp, Homo sapiens
ttaagccctttgctctgg

SEQ ID NO: 799240 - DNA, 16 bp, Homo sapiens
ttaagccttcatttgc

SEQ ID NO: 799241 - DNA, 14 bp, Homo sapiens
ttaagcgttcatat

SEQ ID NO: 799242 - DNA, 15 bp, Homo sapiens
ttaagctccagcttt

SEQ ID NO: 799243 - DNA, 17 bp, Homo sapiens
ttaagctccatgtgcat

SEQ ID NO: 799244 - DNA, 19 bp, Homo sapiens
ttaagctccatgtgcatat

SEQ ID NO: 799245 - DNA, 20 bp, Homo sapiens
ttaagctccatgtgcatata

SEQ ID NO: 799246 - DNA, 19 bp, Homo sapiens
ttaagctgcaaatctgatg

SEQ ID NO: 799247 - DNA, 17 bp, Homo sapiens
ttaagctgttactgtct

SEQ ID NO: 799248 - DNA, 14 bp, Homo sapiens
ttaagctgtttcca

SEQ ID NO: 799249 - DNA, 16 bp, Homo sapiens
ttaagctttattgtga

SEQ ID NO: 799250 - DNA, 13 bp, Homo sapiens
ttaagcttttatt

SEQ ID NO: 799251 - DNA, 13 bp, Homo sapiens
ttaagctttttgg

SEQ ID NO: 799252 - DNA, 16 bp, Homo sapiens
ttaagctttttggaat

SEQ ID NO: 799253 - DNA, 23 bp, Homo sapiens
ttaaggaaagttggacttgagaa

SEQ ID NO: 799254 - DNA, 17 bp, Homo sapiens
ttaaggagcaaaaatct

SEQ ID NO: 799255 - DNA, 14 bp, Homo sapiens
ttaaggagcctaat

SEQ ID NO: 799256 - DNA, 18 bp, Homo sapiens
ttaaggatgcttgtacat

SEQ ID NO: 799257 - DNA, 22 bp, Homo sapiens
ttaaggatgcttgtacataatg

SEQ ID NO: 799258 - DNA, 13 bp, Homo sapiens
ttaaggcaaaaaa

SEQ ID NO: 799259 - DNA, 18 bp, Homo sapiens
ttaaggcccaacattaaa

SEQ ID NO: 799260 - DNA, 17 bp, Homo sapiens
ttaagggacgggggtgg

SEQ ID NO: 799261 - DNA, 15 bp, Homo sapiens
ttaaggggaagataa

SEQ ID NO: 799262 - DNA, 24 bp, Homo sapiens
ttaaggggaggaaccagagtgctg

SEQ ID NO: 799263 - DNA, 15 bp, Homo sapiens
ttaagggggaaaact

SEQ ID NO: 799264 - DNA, 23 bp, Homo sapiens
ttaaggggtgggtcagaacatgt

SEQ ID NO: 799265 - DNA, 19 bp, Homo sapiens
ttaagggtaggatgttgct

SEQ ID NO: 799266 - DNA, 23 bp, Homo sapiens
ttaagggttttttttttttcctt

SEQ ID NO: 799267 - DNA, 17 bp, Homo sapiens
ttaaggtcccccgacca

SEQ ID NO: 799268 - DNA, 16 bp, Homo sapiens
ttaaggtctttcagta

SEQ ID NO: 799269 - DNA, 17 bp, Homo sapiens
ttaaggtgggtccagga

SEQ ID NO: 799270 - DNA, 14 bp, Homo sapiens
ttaagtaaaagtct

SEQ ID NO: 799271 - DNA, 12 bp, Homo sapiens
ttaagtaagttt

SEQ ID NO: 799272 - DNA, 20 bp, Homo sapiens
ttaagtaccaatgggaagca

SEQ ID NO: 799273 - DNA, 16 bp, Homo sapiens
ttaagtagaacaaaaa

SEQ ID NO: 799274 - DNA, 12 bp, Homo sapiens
ttaagtagattt

SEQ ID NO: 799275 - DNA, 18 bp, Homo sapiens
ttaagtatacaacaggag

SEQ ID NO: 799276 - DNA, 19 bp, Homo sapiens
ttaagtatatagtatattt

SEQ ID NO: 799277 - DNA, 19 bp, Homo sapiens
ttaagtatcttgtgcttct

SEQ ID NO: 799278 - DNA, 20 bp, Homo sapiens
ttaagtattgcatctgtata

SEQ ID NO: 799279 - DNA, 17 bp, Homo sapiens
ttaagtatttatatatt

SEQ ID NO: 799280 - DNA, 22 bp, Homo sapiens
ttaagtcattttgtaatatttg

SEQ ID NO: 799281 - DNA, 23 bp, Homo sapiens
ttaagtctcagactgatttcttg

SEQ ID NO: 799282 - DNA, 21 bp, Homo sapiens
ttaagtcttccttaaatgact

SEQ ID NO: 799283 - DNA, 18 bp, Homo sapiens
ttaagtgagcagaacagg

SEQ ID NO: 799284 - DNA, 19 bp, Homo sapiens
ttaagtgcaacatttctgt

SEQ ID NO: 799285 - DNA, 24 bp, Homo sapiens
ttaagtgcaacatttctgtatact

SEQ ID NO: 799286 - DNA, 14 bp, Homo sapiens
ttaagtgctgcagc

SEQ ID NO: 799287 - DNA, 14 bp, Homo sapiens
ttaagtgctgcatt

SEQ ID NO: 799288 - DNA, 15 bp, Homo sapiens
ttaagtgctgcattt

SEQ ID NO: 799289 - DNA, 17 bp, Homo sapiens
ttaagtgcttacatttt

SEQ ID NO: 799290 - DNA, 18 bp, Homo sapiens
ttaagtgttggaaaaaat

SEQ ID NO: 799291 - DNA, 12 bp, Homo sapiens
ttaagttcttat

SEQ ID NO: 799292 - DNA, 22 bp, Homo sapiens
ttaagttgagatagttttcatc

SEQ ID NO: 799293 - DNA, 18 bp, Homo sapiens
ttaagttgctgatgaact

SEQ ID NO: 799294 - DNA, 18 bp, Homo sapiens
ttaagttgtcaaagaagc

SEQ ID NO: 799295 - DNA, 15 bp, Homo sapiens
ttaagtttcaggata

SEQ ID NO: 799296 - DNA, 12 bp, Homo sapiens
ttaagtttgttg

SEQ ID NO: 799297 - DNA, 18 bp, Homo sapiens
ttaagtttttcactttgg

SEQ ID NO: 799298 - DNA, 20 bp, Homo sapiens
ttaataaaaaaacaatcatt

SEQ ID NO: 799299 - DNA, 14 bp, Homo sapiens
ttaataaaaatcaa

SEQ ID NO: 799300 - DNA, 12 bp, Homo sapiens
ttaataaaactg

SEQ ID NO: 799301 - DNA, 16 bp, Homo sapiens
ttaataaaactgcaca

SEQ ID NO: 799302 - DNA, 18 bp, Homo sapiens
ttaatgtaattcaggact

SEQ ID NO: 799303 - DNA, 21 bp, Homo sapiens
ttaatgtacaagttttgtata

SEQ ID NO: 799304 - DNA, 14 bp, Homo sapiens
ttaatgtatataaa

SEQ ID NO: 799305 - DNA, 19 bp, Homo sapiens
ttaatgtatatttgctgca

SEQ ID NO: 799306 - DNA, 20 bp, Homo sapiens
ttaatgtatatttgctgcaa

SEQ ID NO: 799307 - DNA, 21 bp, Homo sapiens
ttaatgtatatttgctgcaaa

SEQ ID NO: 799308 - DNA, 22 bp, Homo sapiens
ttaatgtatatttgctgcaaag

SEQ ID NO: 799309 - DNA, 16 bp, Homo sapiens
ttaatgtatctatttg

SEQ ID NO: 799310 - DNA, 19 bp, Homo sapiens
ttaatgtattcccttcagg

SEQ ID NO: 799311 - DNA, 18 bp, Homo sapiens
ttaatgtcattgctaaaa

SEQ ID NO: 799312 - DNA, 11 bp, Homo sapiens
ttaatgtgaag

SEQ ID NO: 799313 - DNA, 12 bp, Homo sapiens
ttaatgtgaaga

SEQ ID NO: 799314 - DNA, 14 bp, Homo sapiens
ttaatgtgaatttt

SEQ ID NO: 799315 - DNA, 16 bp, Homo sapiens
ttaatgttcattttct

SEQ ID NO: 799316 - DNA, 22 bp, Homo sapiens
ttaatgttcattttctctgtat

SEQ ID NO: 799317 - DNA, 14 bp, Homo sapiens
ttaatgttctgtga

SEQ ID NO: 799318 - DNA, 22 bp, Homo sapiens
ttaatgttgattttaatcctgt

SEQ ID NO: 799319 - DNA, 17 bp, Homo sapiens
ttaatgtttattattta

SEQ ID NO: 799320 - DNA, 20 bp, Homo sapiens
ttaatgtttattatttacat

SEQ ID NO: 799321 - DNA, 14 bp, Homo sapiens
ttaatgtttcttaa

SEQ ID NO: 799322 - DNA, 18 bp, Homo sapiens
ttaatgtttgatttagta

SEQ ID NO: 799323 - DNA, 16 bp, Homo sapiens
ttaatgttttaaatgt

SEQ ID NO: 799324 - DNA, 12 bp, Homo sapiens
ttaatgttttca

SEQ ID NO: 799325 - DNA, 22 bp, Homo sapiens
ttaatgttttcattatgttcat

SEQ ID NO: 799326 - DNA, 16 bp, Homo sapiens
ttaatgttttctgctg

SEQ ID NO: 799327 - DNA, 14 bp, Homo sapiens
ttaattaaaaactt

SEQ ID NO: 799328 - DNA, 16 bp, Homo sapiens
ttaattaaatgtattt

SEQ ID NO: 799329 - DNA, 20 bp, Homo sapiens
ttaattaatttggagcacaa

SEQ ID NO: 799330 - DNA, 15 bp, Homo sapiens
ttaattacatacaga

SEQ ID NO: 799331 - DNA, 23 bp, Homo sapiens
ttaattataggagccttaatttt

SEQ ID NO: 799332 - DNA, 19 bp, Homo sapiens
ttaattattataaaaatat

SEQ ID NO: 799333 - DNA, 14 bp, Homo sapiens
ttaattattatttg

SEQ ID NO: 799334 - DNA, 17 bp, Homo sapiens
ttaacaattgtcttaaa

SEQ ID NO: 799335 - DNA, 18 bp, Homo sapiens
ttaacaattgtcttaaaa

SEQ ID NO: 799336 - DNA, 23 bp, Homo sapiens
ttaacaatttctgtccttcagat

SEQ ID NO: 799337 - DNA, 16 bp, Homo sapiens
ttaacacaagtcctgt

SEQ ID NO: 799338 - DNA, 21 bp, Homo sapiens
ttaacacagccttccttctgc

SEQ ID NO: 799339 - DNA, 20 bp, Homo sapiens
ttaacacgctgcctggtctg

SEQ ID NO: 799340 - DNA, 15 bp, Homo sapiens
ttaacactatactct

SEQ ID NO: 799341 - DNA, 21 bp, Homo sapiens
ttaacactttgtattacttag

SEQ ID NO: 799342 - DNA, 13 bp, Homo sapiens
ttaacagaaatgt

SEQ ID NO: 799343 - DNA, 19 bp, Homo sapiens
ttaacagaaatgtacagca

SEQ ID NO: 799344 - DNA, 17 bp, Homo sapiens
ttaacagaaattgtata

SEQ ID NO: 799345 - DNA, 18 bp, Homo sapiens
ttaacagcagtcctttgt

SEQ ID NO: 799346 - DNA, 13 bp, Homo sapiens
ttaacagggaggg

SEQ ID NO: 799347 - DNA, 22 bp, Homo sapiens
ttaacagtatttctcttttatt

SEQ ID NO: 799348 - DNA, 15 bp, Homo sapiens
ttaacagtcatttaa

SEQ ID NO: 799349 - DNA, 16 bp, Homo sapiens
ttaacagtcatttaaa

SEQ ID NO: 799350 - DNA, 13 bp, Homo sapiens
ttaacagttgtat

SEQ ID NO: 799351 - DNA, 16 bp, Homo sapiens
ttaacagttttccatg

SEQ ID NO: 799352 - DNA, 19 bp, Homo sapiens
ttaacagttttccatgaaa

SEQ ID NO: 799353 - DNA, 20 bp, Homo sapiens
ttaacagttttccatgaaaa

SEQ ID NO: 799354 - DNA, 11 bp, Homo sapiens
ttaacataatg

SEQ ID NO: 799355 - DNA, 18 bp, Homo sapiens
ttaacataatggttgtga

SEQ ID NO: 799356 - DNA, 16 bp, Homo sapiens
ttaacatacaagaaaa

SEQ ID NO: 799357 - DNA, 21 bp, Homo sapiens
ttaacatacaagaaaatgtat

SEQ ID NO: 799358 - DNA, 12 bp, Homo sapiens
ttaacatatata

SEQ ID NO: 799359 - DNA, 14 bp, Homo sapiens
ttaacatatatatt

SEQ ID NO: 799360 - DNA, 19 bp, Homo sapiens
ttaacatcagtgtctgttt

SEQ ID NO: 799361 - DNA, 14 bp, Homo sapiens
ttaacatccctcct

SEQ ID NO: 799362 - DNA, 10 bp, Homo sapiens
ttaacatctt

SEQ ID NO: 799363 - DNA, 13 bp, Homo sapiens
ttaacatctttgt

SEQ ID NO: 799364 - DNA, 19 bp, Homo sapiens
ttaacatgggctcttcact

SEQ ID NO: 799365 - DNA, 20 bp, Homo sapiens
ttaacatgggctcttcacta

SEQ ID NO: 799366 - DNA, 19 bp, Homo sapiens
ttaacattagatgtcatga

SEQ ID NO: 799367 - DNA, 20 bp, Homo sapiens
ttaacattgaccaagaactg

SEQ ID NO: 799368 - DNA, 23 bp, Homo sapiens
ttaacatttgccttgcagaactg

SEQ ID NO: 799369 - DNA, 12 bp, Homo sapiens
ttaacattttcc

SEQ ID NO: 799370 - DNA, 18 bp, Homo sapiens
ttaaccaaaggtgaagga

SEQ ID NO: 799371 - DNA, 19 bp, Homo sapiens
ttaaccaccgcatatgcat

SEQ ID NO: 799372 - DNA, 17 bp, Homo sapiens
ttaaccactctacagac

SEQ ID NO: 799373 - DNA, 17 bp, Homo sapiens
ttaaccacttcagctga

SEQ ID NO: 799374 - DNA, 16 bp, Homo sapiens
ttaaccagtctgaagt

SEQ ID NO: 799375 - DNA, 21 bp, Homo sapiens
ttaaccccgggatgcaaggta

SEQ ID NO: 799376 - DNA, 16 bp, Homo sapiens
ttaacctagatgttta

SEQ ID NO: 799377 - DNA, 22 bp, Homo sapiens
ttaacctagatgtttaacaaat

SEQ ID NO: 799378 - DNA, 15 bp, Homo sapiens
ttaacctcagtgtca

SEQ ID NO: 799379 - DNA, 19 bp, Homo sapiens
ttaacctcagtgtcattta

SEQ ID NO: 799380 - DNA, 18 bp, Homo sapiens
ttaaccttaaatacactg

SEQ ID NO: 799381 - DNA, 21 bp, Homo sapiens
ttaaccttactaattatacta

SEQ ID NO: 799382 - DNA, 19 bp, Homo sapiens
ttaacctttccgctgtcgc

SEQ ID NO: 799383 - DNA, 14 bp, Homo sapiens
ttaacctttttgta

SEQ ID NO: 799384 - DNA, 18 bp, Homo sapiens
ttaacctttttgtaaata

SEQ ID NO: 799385 - DNA, 17 bp, Homo sapiens
ttaacggctccaggatt

SEQ ID NO: 799386 - DNA, 15 bp, Homo sapiens
ttaacggtgctaaaa

SEQ ID NO: 799387 - DNA, 13 bp, Homo sapiens
ttaactaaatgct

SEQ ID NO: 799388 - DNA, 20 bp, Homo sapiens
ttaactactatattgattgt

SEQ ID NO: 799389 - DNA, 14 bp, Homo sapiens
ttaactagaattta

SEQ ID NO: 799390 - DNA, 15 bp, Homo sapiens
ttaactagaatttat

SEQ ID NO: 799391 - DNA, 16 bp, Homo sapiens
ttaactagaatttatt

SEQ ID NO: 799392 - DNA, 14 bp, Homo sapiens
ttaactattgcatt

SEQ ID NO: 799393 - DNA, 16 bp, Homo sapiens
ttaactcattagactg

SEQ ID NO: 799394 - DNA, 15 bp, Homo sapiens
ttaactccctccacc

SEQ ID NO: 799395 - DNA, 16 bp, Homo sapiens
ttaactctaaccctgt

SEQ ID NO: 799396 - DNA, 17 bp, Homo sapiens
ttaactctctttatgtc

SEQ ID NO: 799397 - DNA, 14 bp, Homo sapiens
ttaactctggattt

SEQ ID NO: 799398 - DNA, 15 bp, Homo sapiens
ttaactgaaaatgta

SEQ ID NO: 799399 - DNA, 13 bp, Homo sapiens
ttaactgaagaaa

SEQ ID NO: 799400 - DNA, 13 bp, Homo sapiens
ttaactgacatgg

SEQ ID NO: 799401 - DNA, 14 bp, Homo sapiens
ttaactgcactcat

SEQ ID NO: 799402 - DNA, 24 bp, Homo sapiens
ttaactggcatggattaatagagt

SEQ ID NO: 799403 - DNA, 17 bp, Homo sapiens
ttaactgggtaatgaaa

SEQ ID NO: 799404 - DNA, 22 bp, Homo sapiens
ttaactggtaagcgatttgaaa

SEQ ID NO: 799405 - DNA, 21 bp, Homo sapiens
ttaactggtgcactttgtaaa

SEQ ID NO: 799406 - DNA, 19 bp, Homo sapiens
ttaactgtatttcagtatt

SEQ ID NO: 799407 - DNA, 22 bp, Homo sapiens
ttaactgtccgtaagcagtata

SEQ ID NO: 799408 - DNA, 12 bp, Homo sapiens
ttaactgtggat

SEQ ID NO: 799409 - DNA, 13 bp, Homo sapiens
ttaactgtggata

SEQ ID NO: 799410 - DNA, 13 bp, Homo sapiens
ttaacttaaatag

SEQ ID NO: 799411 - DNA, 16 bp, Homo sapiens
ttaacttaactgaaga

SEQ ID NO: 799412 - DNA, 17 bp, Homo sapiens
ttaacttaactgaagaa

SEQ ID NO: 799413 - DNA, 11 bp, Homo sapiens
ttaacttgtat

SEQ ID NO: 799414 - DNA, 13 bp, Homo sapiens
ttaacttgtatat

SEQ ID NO: 799415 - DNA, 16 bp, Homo sapiens
ttaacttgtcaaaaaa

SEQ ID NO: 799416 - DNA, 23 bp, Homo sapiens
ttaactttgtggtctaaagtgtt

SEQ ID NO: 799417 - DNA, 12 bp, Homo sapiens
ttaacttttaat

SEQ ID NO: 799418 - DNA, 19 bp, Homo sapiens
ttaacttttaatggtgatg

SEQ ID NO: 799419 - DNA, 13 bp, Homo sapiens
ttaacttttataa

SEQ ID NO: 799420 - DNA, 16 bp, Homo sapiens
ttaacttttataaact

SEQ ID NO: 799421 - DNA, 18 bp, Homo sapiens
ttaacttttataaacttt

SEQ ID NO: 799422 - DNA, 22 bp, Homo sapiens
ttaacttttataaactttacct

SEQ ID NO: 799423 - DNA, 15 bp, Homo sapiens
ttaacttttggaatc

SEQ ID NO: 799424 - DNA, 18 bp, Homo sapiens
ttaagaaaaaagtgttga

SEQ ID NO: 799425 - DNA, 21 bp, Homo sapiens
ttaagaaaaaataacacacat

SEQ ID NO: 799426 - DNA, 16 bp, Homo sapiens
ttaagaaaaacaaagt

SEQ ID NO: 799427 - DNA, 11 bp, Homo sapiens
ttaagaaaaat

SEQ ID NO: 799428 - DNA, 19 bp, Homo sapiens
ttaagaaaatacaataaac

SEQ ID NO: 799429 - DNA, 11 bp, Homo sapiens
ttaagaaaatc

SEQ ID NO: 799430 - DNA, 22 bp, Homo sapiens
ttaagaaagactatctaaatgt

SEQ ID NO: 799431 - DNA, 21 bp, Homo sapiens
ttaagaaagagaatgaactgt

SEQ ID NO: 799432 - DNA, 22 bp, Homo sapiens
ttaagaaagagaatgaactgtg

SEQ ID NO: 799433 - DNA, 20 bp, Homo sapiens
ttaagaaattccatacttct

SEQ ID NO: 799434 - DNA, 22 bp, Homo sapiens
ttcccaaaatgttgaaatatga

SEQ ID NO: 799435 - DNA, 18 bp, Homo sapiens
ttcccaaagtcctctgct

SEQ ID NO: 799436 - DNA, 16 bp, Homo sapiens
ttcccaacatttctta

SEQ ID NO: 799437 - DNA, 11 bp, Homo sapiens
ttcccaagctc

SEQ ID NO: 799438 - DNA, 19 bp, Homo sapiens
ttcccaaggaagctccttc

SEQ ID NO: 799439 - DNA, 17 bp, Homo sapiens
ttcccaaggacatgagt

SEQ ID NO: 799440 - DNA, 15 bp, Homo sapiens
ttcccaagtatgcct

SEQ ID NO: 799441 - DNA, 16 bp, Homo sapiens
ttcccaagtatgcctt

SEQ ID NO: 799442 - DNA, 15 bp, Homo sapiens
ttcccaataaaagtg

SEQ ID NO: 799443 - DNA, 20 bp, Homo sapiens
ttcccaatagcaacgtagct

SEQ ID NO: 799444 - DNA, 23 bp, Homo sapiens
ttcccaatagcaacgtagcttct

SEQ ID NO: 799445 - DNA, 14 bp, Homo sapiens
ttcccaattaggaa

SEQ ID NO: 799446 - DNA, 14 bp, Homo sapiens
ttcccaattcacat

SEQ ID NO: 799447 - DNA, 21 bp, Homo sapiens
ttcccacaaaagacagaccca

SEQ ID NO: 799448 - DNA, 22 bp, Homo sapiens
ttcccacaaaagacagacccag

SEQ ID NO: 799449 - DNA, 22 bp, Homo sapiens
ttcccacagcacaaccggtccc

SEQ ID NO: 799450 - DNA, 21 bp, Homo sapiens
ttcccacaggagggccagcgc

SEQ ID NO: 799451 - DNA, 13 bp, Homo sapiens
ttcccacatcttt

SEQ ID NO: 799452 - DNA, 18 bp, Homo sapiens
ttcccacatctttcctca

SEQ ID NO: 799453 - DNA, 22 bp, Homo sapiens
ttcccacccccaggcaaggctg

SEQ ID NO: 799454 - DNA, 12 bp, Homo sapiens
ttcccaccctcc

SEQ ID NO: 799455 - DNA, 14 bp, Homo sapiens
ttcccacctactgc

SEQ ID NO: 799456 - DNA, 17 bp, Homo sapiens
ttcccacctactgcact

SEQ ID NO: 799457 - DNA, 15 bp, Homo sapiens
ttcccacgacaaaaa

SEQ ID NO: 799458 - DNA, 20 bp, Homo sapiens
ttcccacggcctttctagcc

SEQ ID NO: 799459 - DNA, 15 bp, Homo sapiens
ttcccactcaccagc

SEQ ID NO: 799460 - DNA, 10 bp, Homo sapiens
ttcccactgc

SEQ ID NO: 799461 - DNA, 15 bp, Homo sapiens
ttcccactgtttaag

SEQ ID NO: 799462 - DNA, 22 bp, Homo sapiens
ttcccagaagtggctactgact

SEQ ID NO: 799463 - DNA, 18 bp, Homo sapiens
ttcccagagcaaaataat

SEQ ID NO: 799464 - DNA, 15 bp, Homo sapiens
ttcccagaggcaggc

SEQ ID NO: 799465 - DNA, 20 bp, Homo sapiens
ttcccagcaacactccggtc

SEQ ID NO: 799466 - DNA, 21 bp, Homo sapiens
ttcccagcactatgctttcct

SEQ ID NO: 799467 - DNA, 22 bp, Homo sapiens
ttcccagcactatgctttcctt

SEQ ID NO: 799468 - DNA, 18 bp, Homo sapiens
ttcccagccctcatccca

SEQ ID NO: 799469 - DNA, 15 bp, Homo sapiens
ttcccagctcccccc

SEQ ID NO: 799470 - DNA, 18 bp, Homo sapiens
ttcccagctccccccgcc

SEQ ID NO: 799471 - DNA, 22 bp, Homo sapiens
ttcccagctccccccgcccacc

SEQ ID NO: 799472 - DNA, 14 bp, Homo sapiens
ttcccagctctccc

SEQ ID NO: 799473 - DNA, 23 bp, Homo sapiens
ttcccagctctccctctggccct

SEQ ID NO: 799474 - DNA, 19 bp, Homo sapiens
ttcccaggaaagaagcatt

SEQ ID NO: 799475 - DNA, 16 bp, Homo sapiens
ttcccaggagaccatt

SEQ ID NO: 799476 - DNA, 21 bp, Homo sapiens
ttcccaggagatgggtccagg

SEQ ID NO: 799477 - DNA, 19 bp, Homo sapiens
ttcccaggcccactgtgcc

SEQ ID NO: 799478 - DNA, 22 bp, Homo sapiens
ttcccaggcccactgtgcctca

SEQ ID NO: 799479 - DNA, 21 bp, Homo sapiens
ttcccaggcctttggagggga

SEQ ID NO: 799480 - DNA, 16 bp, Homo sapiens
ttcccagggctggaga

SEQ ID NO: 799481 - DNA, 18 bp, Homo sapiens
ttcccaggtaatttaaat

SEQ ID NO: 799482 - DNA, 22 bp, Homo sapiens
ttcccaggtaatttaaattggt

SEQ ID NO: 799483 - DNA, 16 bp, Homo sapiens
ttcccataattttctt

SEQ ID NO: 799484 - DNA, 18 bp, Homo sapiens
ttcccatacttgcataca

SEQ ID NO: 799485 - DNA, 14 bp, Homo sapiens
ttcccatctccagg

SEQ ID NO: 799486 - DNA, 14 bp, Homo sapiens
ttcccatctgcacc

SEQ ID NO: 799487 - DNA, 19 bp, Homo sapiens
ttcccatgactgcacccag

SEQ ID NO: 799488 - DNA, 22 bp, Homo sapiens
ttcccatgactgcacccagctc

SEQ ID NO: 799489 - DNA, 14 bp, Homo sapiens
ttcccatggggagg

SEQ ID NO: 799490 - DNA, 19 bp, Homo sapiens
ttcccatggtggcctcaag

SEQ ID NO: 799491 - DNA, 15 bp, Homo sapiens
ttcccatttatctaa

SEQ ID NO: 799492 - DNA, 16 bp, Homo sapiens
ttccccaaaccataaa

SEQ ID NO: 799493 - DNA, 14 bp, Homo sapiens
ttccccaaatacaa

SEQ ID NO: 799494 - DNA, 21 bp, Homo sapiens
ttccccaacccctcagatttt

SEQ ID NO: 799495 - DNA, 18 bp, Homo sapiens
ttccccaacggggtgggg

SEQ ID NO: 799496 - DNA, 19 bp, Homo sapiens
ttccccaacggggtgggga

SEQ ID NO: 799497 - DNA, 17 bp, Homo sapiens
ttccccaagggccaaac

SEQ ID NO: 799498 - DNA, 23 bp, Homo sapiens
ttccccaattacagggtgactca

SEQ ID NO: 799499 - DNA, 17 bp, Homo sapiens
ttccccacattctatag

SEQ ID NO: 799500 - DNA, 22 bp, Homo sapiens
ttccccaccccagctcatgccc

SEQ ID NO: 799501 - DNA, 23 bp, Homo sapiens
ttccccacccccctctctttctc

SEQ ID NO: 799502 - DNA, 21 bp, Homo sapiens
ttccccactgacagcctccca

SEQ ID NO: 799503 - DNA, 13 bp, Homo sapiens
ttccccagactca

SEQ ID NO: 799504 - DNA, 22 bp, Homo sapiens
ttccccagactcagctccagaa

SEQ ID NO: 799505 - DNA, 12 bp, Homo sapiens
ttccccagagag

SEQ ID NO: 799506 - DNA, 19 bp, Homo sapiens
ttccccagagagcaggcag

SEQ ID NO: 799507 - DNA, 20 bp, Homo sapiens
ttccccagagagcaggcagg

SEQ ID NO: 799508 - DNA, 18 bp, Homo sapiens
ttccccagaggctcccaa

SEQ ID NO: 799509 - DNA, 17 bp, Homo sapiens
ttccccagagtgggatc

SEQ ID NO: 799510 - DNA, 15 bp, Homo sapiens
ttccccaggcccacc

SEQ ID NO: 799511 - DNA, 19 bp, Homo sapiens
ttccccatccctgtcattt

SEQ ID NO: 799512 - DNA, 16 bp, Homo sapiens
ttccccatctctgtct

SEQ ID NO: 799513 - DNA, 22 bp, Homo sapiens
ttccccatctctgtctggggct

SEQ ID NO: 799514 - DNA, 17 bp, Homo sapiens
ttcccccacttcccctc

SEQ ID NO: 799515 - DNA, 20 bp, Homo sapiens
ttcccccagcaacgcccctc

SEQ ID NO: 799516 - DNA, 13 bp, Homo sapiens
ttcccccagccct

SEQ ID NO: 799517 - DNA, 20 bp, Homo sapiens
ttcccccagccctgtggaag

SEQ ID NO: 799518 - DNA, 17 bp, Homo sapiens
ttcccccatgtggctga

SEQ ID NO: 799519 - DNA, 19 bp, Homo sapiens
ttcccccccctttcctaaa

SEQ ID NO: 799520 - DNA, 17 bp, Homo sapiens
ttcccccctctcctccc

SEQ ID NO: 799521 - DNA, 21 bp, Homo sapiens
ttcccccctctcctcccagct

SEQ ID NO: 799522 - DNA, 22 bp, Homo sapiens
ttcccccttgaggattgtggaa

SEQ ID NO: 799523 - DNA, 19 bp, Homo sapiens
ttcccctcactggatgaaa

SEQ ID NO: 799524 - DNA, 17 bp, Homo sapiens
ttcccctccaagaccct

SEQ ID NO: 799525 - DNA, 17 bp, Homo sapiens
ttcccctccctcccaca

SEQ ID NO: 799526 - DNA, 18 bp, Homo sapiens
ttcccctccttctccctt

SEQ ID NO: 799527 - DNA, 13 bp, Homo sapiens
ttcccctgcacct

SEQ ID NO: 799528 - DNA, 18 bp, Homo sapiens
ttcccctgcacctggcct

SEQ ID NO: 799529 - DNA, 12 bp, Homo sapiens
ttcccctgctga

SEQ ID NO: 799530 - DNA, 19 bp, Homo sapiens
ttcccctgctgaccttgga

SEQ ID NO: 799531 - DNA, 12 bp, Homo sapiens
ttcccctggcct

SEQ ID NO: 799532 - DNA, 22 bp, Homo sapiens
ttcccctgggatgctgacccag

SEQ ID NO: 799533 - DNA, 11 bp, Homo sapiens
ttcccctgtgt

SEQ ID NO: 799534 - DNA, 12 bp, Homo sapiens
ttcccctgtgtc

SEQ ID NO: 799535 - DNA, 14 bp, Homo sapiens
ttccccttccactg

SEQ ID NO: 799536 - DNA, 11 bp, Homo sapiens
ttccccttcct

SEQ ID NO: 799537 - DNA, 12 bp, Homo sapiens
ttccccttcctg

SEQ ID NO: 799538 - DNA, 13 bp, Homo sapiens
ttccccttgccct

SEQ ID NO: 799539 - DNA, 22 bp, Homo sapiens
ttccccttgcccttgccctgac

SEQ ID NO: 799540 - DNA, 14 bp, Homo sapiens
ttccccttggcttc

SEQ ID NO: 799541 - DNA, 15 bp, Homo sapiens
ttcccctttcctgtc

SEQ ID NO: 799542 - DNA, 17 bp, Homo sapiens
ttccccttttgcctggc

SEQ ID NO: 799543 - DNA, 16 bp, Homo sapiens
ttcccgacccagccag

SEQ ID NO: 799544 - DNA, 21 bp, Homo sapiens
ttcccgacccagccagctgca

SEQ ID NO: 799545 - DNA, 13 bp, Homo sapiens
ttcccgcacatgg

SEQ ID NO: 799546 - DNA, 23 bp, Homo sapiens
ttcccgccccacctcccatttct

SEQ ID NO: 799547 - DNA, 14 bp, Homo sapiens
ttcccgccttccaa

SEQ ID NO: 799548 - DNA, 22 bp, Homo sapiens
ttcccgcgggttccgcaggcag

SEQ ID NO: 799549 - DNA, 12 bp, Homo sapiens
ttcccgctcagc

SEQ ID NO: 799550 - DNA, 21 bp, Homo sapiens
ttcccgctcagccctccctgc

SEQ ID NO: 799551 - DNA, 22 bp, Homo sapiens
ttcccgctcagccctccctgcc

SEQ ID NO: 799552 - DNA, 17 bp, Homo sapiens
ttcccggagcacagccc

SEQ ID NO: 799553 - DNA, 20 bp, Homo sapiens
ttcccggagcacagccctgg

SEQ ID NO: 799554 - DNA, 17 bp, Homo sapiens
ttcccggttcaggacca

SEQ ID NO: 799555 - DNA, 20 bp, Homo sapiens
ttcccgtcccatatcctgcc

SEQ ID NO: 799556 - DNA, 14 bp, Homo sapiens
ttcccgtctcagaa

SEQ ID NO: 799557 - DNA, 14 bp, Homo sapiens
ttcccgtttctcca

SEQ ID NO: 799558 - DNA, 15 bp, Homo sapiens
ttcccgtttctccac

SEQ ID NO: 799559 - DNA, 15 bp, Homo sapiens
ttccctaaactgcag

SEQ ID NO: 799560 - DNA, 17 bp, Homo sapiens
ttccctaaactgcagcc

SEQ ID NO: 799561 - DNA, 19 bp, Homo sapiens
ttccctacagcctagggca

SEQ ID NO: 799562 - DNA, 14 bp, Homo sapiens
ttccctacctcagg

SEQ ID NO: 799563 - DNA, 17 bp, Homo sapiens
ttccctacttcctgtga

SEQ ID NO: 799564 - DNA, 19 bp, Homo sapiens
ttccctacttgataatatt

SEQ ID NO: 799565 - DNA, 14 bp, Homo sapiens
ttccctacttgcag

SEQ ID NO: 799566 - DNA, 18 bp, Homo sapiens
ttccctagaaagccatat

SEQ ID NO: 799567 - DNA, 18 bp, Homo sapiens
ttccctaggggacacttc

SEQ ID NO: 799568 - DNA, 21 bp, Homo sapiens
ttccctaggggacacttccct

SEQ ID NO: 799569 - DNA, 13 bp, Homo sapiens
ttccctatctttt

SEQ ID NO: 799570 - DNA, 21 bp, Homo sapiens
ttccctattatttccgggtgg

SEQ ID NO: 799571 - DNA, 12 bp, Homo sapiens
ttccctcacccc

SEQ ID NO: 799572 - DNA, 17 bp, Homo sapiens
ttccctcactcttcctc

SEQ ID NO: 799573 - DNA, 18 bp, Homo sapiens
ttccctcactcttcctca

SEQ ID NO: 799574 - DNA, 13 bp, Homo sapiens
ttccctccccaga

SEQ ID NO: 799575 - DNA, 16 bp, Homo sapiens
ttccctccgggcaggg

SEQ ID NO: 799576 - DNA, 23 bp, Homo sapiens
ttccctccgggcaggggagccag

SEQ ID NO: 799577 - DNA, 17 bp, Homo sapiens
ttccctcctagctctcc

SEQ ID NO: 799578 - DNA, 12 bp, Homo sapiens
ttccctcctccc

SEQ ID NO: 799579 - DNA, 13 bp, Homo sapiens
ttccctcctccca

SEQ ID NO: 799580 - DNA, 15 bp, Homo sapiens
ttccctcctgtgccc

SEQ ID NO: 799581 - DNA, 16 bp, Homo sapiens
ttccctctcagctgct

SEQ ID NO: 799582 - DNA, 19 bp, Homo sapiens
ttccctctcagctgctggg

SEQ ID NO: 799583 - DNA, 16 bp, Homo sapiens
ttccctctcctgccca

SEQ ID NO: 799584 - DNA, 16 bp, Homo sapiens
ttccctctcctgtcct

SEQ ID NO: 799585 - DNA, 22 bp, Homo sapiens
ttccctctgagaattccaagga

SEQ ID NO: 799586 - DNA, 22 bp, Homo sapiens
ttccctctgggcacgcctgctg

SEQ ID NO: 799587 - DNA, 20 bp, Homo sapiens
ttccctctttcttataatac

SEQ ID NO: 799588 - DNA, 14 bp, Homo sapiens
ttccctctttggct

SEQ ID NO: 799589 - DNA, 15 bp, Homo sapiens
ttccctcttttctta

SEQ ID NO: 799590 - DNA, 23 bp, Homo sapiens
ttccctgaaacacgaaacttgtt

SEQ ID NO: 799591 - DNA, 21 bp, Homo sapiens
ttccctgaagagacaggcacc

SEQ ID NO: 799592 - DNA, 20 bp, Homo sapiens
ttccctgacctcccaactct

SEQ ID NO: 799593 - DNA, 17 bp, Homo sapiens
ttccctgacttgcttta

SEQ ID NO: 799594 - DNA, 12 bp, Homo sapiens
ttccctgaggaa

SEQ ID NO: 799595 - DNA, 16 bp, Homo sapiens
ttccctgagtcaccag

SEQ ID NO: 799596 - DNA, 15 bp, Homo sapiens
ttccctgatggcctt

SEQ ID NO: 799597 - DNA, 16 bp, Homo sapiens
ttccctgcaccctgga

SEQ ID NO: 799598 - DNA, 13 bp, Homo sapiens
ttccctgccccac

SEQ ID NO: 799599 - DNA, 15 bp, Homo sapiens
ttccctgctcttgca

SEQ ID NO: 799600 - DNA, 18 bp, Homo sapiens
ttccctggacaggcagcc

SEQ ID NO: 799601 - DNA, 15 bp, Homo sapiens
ttccctggcggcccc

SEQ ID NO: 799602 - DNA, 23 bp, Homo sapiens
ttccctgggctgccaccagcccc

SEQ ID NO: 799603 - DNA, 17 bp, Homo sapiens
ttccctgggctgtgcta

SEQ ID NO: 799604 - DNA, 19 bp, Homo sapiens
ttccctggggagccctcag

SEQ ID NO: 799605 - DNA, 20 bp, Homo sapiens
ttccctggggagccctcagg

SEQ ID NO: 799606 - DNA, 21 bp, Homo sapiens
ttccctggggagccctcaggc

SEQ ID NO: 799607 - DNA, 15 bp, Homo sapiens
ttccctggtcaccaa

SEQ ID NO: 799608 - DNA, 16 bp, Homo sapiens
ttccctgtcagaggct

SEQ ID NO: 799609 - DNA, 15 bp, Homo sapiens
ttccctgtcagcctg

SEQ ID NO: 799610 - DNA, 15 bp, Homo sapiens
ttccctgttctccct

SEQ ID NO: 799611 - DNA, 16 bp, Homo sapiens
ttccctgttcttcctc

SEQ ID NO: 799612 - DNA, 17 bp, Homo sapiens
ttcccttagcctctccc

SEQ ID NO: 799613 - DNA, 18 bp, Homo sapiens
ttcccttagcctctccca

SEQ ID NO: 799614 - DNA, 15 bp, Homo sapiens
ttcccttattgcctc

SEQ ID NO: 799615 - DNA, 23 bp, Homo sapiens
ttcccttcagtaccctctcagct

SEQ ID NO: 799616 - DNA, 15 bp, Homo sapiens
ttcccttcctccatt

SEQ ID NO: 799617 - DNA, 17 bp, Homo sapiens
ttcccttcctccattgc

SEQ ID NO: 799618 - DNA, 12 bp, Homo sapiens
ttcccttcctct

SEQ ID NO: 799619 - DNA, 17 bp, Homo sapiens
ttcccttcctcttcggc

SEQ ID NO: 799620 - DNA, 11 bp, Homo sapiens
ttcccttctcc

SEQ ID NO: 799621 - DNA, 15 bp, Homo sapiens
ttcccttctccccct

SEQ ID NO: 799622 - DNA, 23 bp, Homo sapiens
ttcccttctcccccttgtcttcc

SEQ ID NO: 799623 - DNA, 12 bp, Homo sapiens
ttcccttgacca

SEQ ID NO: 799624 - DNA, 13 bp, Homo sapiens
ttcccttgaccat

SEQ ID NO: 799625 - DNA, 20 bp, Homo sapiens
ttcccttgcaggggtccccc

SEQ ID NO: 799626 - DNA, 14 bp, Homo sapiens
ttcccttgctttgt

SEQ ID NO: 799627 - DNA, 19 bp, Homo sapiens
ttcccttgcttttccctct

SEQ ID NO: 799628 - DNA, 20 bp, Homo sapiens
ttcccttgcttttccctctt

SEQ ID NO: 799629 - DNA, 12 bp, Homo sapiens
ttcccttggcct

SEQ ID NO: 799630 - DNA, 16 bp, Homo sapiens
ttcccttggcctcaga

SEQ ID NO: 799631 - DNA, 12 bp, Homo sapiens
ttcccttgtatt

SEQ ID NO: 799632 - DNA, 17 bp, Homo sapiens
ttccctttaaagccttt

SEQ ID NO: 799633 - DNA, 15 bp, Homo sapiens
ttccctttccttcca

SEQ ID NO: 799634 - DNA, 14 bp, Homo sapiens
ttccctttgacttc

SEQ ID NO: 799635 - DNA, 18 bp, Homo sapiens
ttcccttttacatactgc

SEQ ID NO: 799636 - DNA, 14 bp, Homo sapiens
ttcccttttctgtt

SEQ ID NO: 799637 - DNA, 16 bp, Homo sapiens
ttcccttttgactctt

SEQ ID NO: 799638 - DNA, 15 bp, Homo sapiens
ttccctttttaaaaa

SEQ ID NO: 799639 - DNA, 20 bp, Homo sapiens
ttccctttttaaaaaatacc

SEQ ID NO: 799640 - DNA, 23 bp, Homo sapiens
ttccgaagagggaatggatgggg

SEQ ID NO: 799641 - DNA, 12 bp, Homo sapiens
ttccgacatccc

SEQ ID NO: 799642 - DNA, 20 bp, Homo sapiens
ttccgagacaccacaaggca

SEQ ID NO: 799643 - DNA, 21 bp, Homo sapiens
ttccgagatccccagggcagc

SEQ ID NO: 799644 - DNA, 13 bp, Homo sapiens
ttccgcactttcc

SEQ ID NO: 799645 - DNA, 13 bp, Homo sapiens
ttccgctccctgg

SEQ ID NO: 799646 - DNA, 16 bp, Homo sapiens
ttccgctgtccgtcag

SEQ ID NO: 799647 - DNA, 22 bp, Homo sapiens
ttccggccacatcattctgtgt

SEQ ID NO: 799648 - DNA, 17 bp, Homo sapiens
ttccgtatttaaagttg

SEQ ID NO: 799649 - DNA, 18 bp, Homo sapiens
ttccgtatttaaagttgt

SEQ ID NO: 799650 - DNA, 14 bp, Homo sapiens
ttccgttaaaatac

SEQ ID NO: 799651 - DNA, 23 bp, Homo sapiens
ttccgttaacctttttgtaaata

SEQ ID NO: 799652 - DNA, 17 bp, Homo sapiens
ttccgtttgcttttgtt

SEQ ID NO: 799653 - DNA, 15 bp, Homo sapiens
ttcctaaacataatt

SEQ ID NO: 799654 - DNA, 16 bp, Homo sapiens
ttcctaaacataattg

SEQ ID NO: 799655 - DNA, 16 bp, Homo sapiens
ttcctaaacccaatga

SEQ ID NO: 799656 - DNA, 13 bp, Homo sapiens
ttcctaaagaaaa

SEQ ID NO: 799657 - DNA, 13 bp, Homo sapiens
ttcctaaatgcag

SEQ ID NO: 799658 - DNA, 21 bp, Homo sapiens
ttcctaactagaattagtatg

SEQ ID NO: 799659 - DNA, 15 bp, Homo sapiens
ttcctaaggcatgtg

SEQ ID NO: 799660 - DNA, 14 bp, Homo sapiens
ttcctaaggctgca

SEQ ID NO: 799661 - DNA, 19 bp, Homo sapiens
ttcctaagtctgtcatcct

SEQ ID NO: 799662 - DNA, 15 bp, Homo sapiens
ttcctaataaagttc

SEQ ID NO: 799663 - DNA, 22 bp, Homo sapiens
ttcctaataaagttctgtactc

SEQ ID NO: 799664 - DNA, 18 bp, Homo sapiens
ttcctaattccacagctg

SEQ ID NO: 799665 - DNA, 17 bp, Homo sapiens
ttcctacaactaaaaat

SEQ ID NO: 799666 - DNA, 21 bp, Homo sapiens
ttcctacaactaaaaataaat

SEQ ID NO: 799667 - DNA, 22 bp, Homo sapiens
ttcctacaagagcagcctgtgg

SEQ ID NO: 799668 - DNA, 23 bp, Homo sapiens
ttcctacagaaatactgctctga

SEQ ID NO: 799669 - DNA, 20 bp, Homo sapiens
ttcctacagcactactgggt

SEQ ID NO: 799670 - DNA, 17 bp, Homo sapiens
ttcctacccaaccactc

SEQ ID NO: 799671 - DNA, 14 bp, Homo sapiens
ttcctacccccgtc

SEQ ID NO: 799672 - DNA, 22 bp, Homo sapiens
ttcctacccctcttccagcttc

SEQ ID NO: 799673 - DNA, 22 bp, Homo sapiens
ttcctaccctccttccacatgt

SEQ ID NO: 799674 - DNA, 19 bp, Homo sapiens
ttcctaccgtactccctgc

SEQ ID NO: 799675 - DNA, 13 bp, Homo sapiens
ttcctacctccct

SEQ ID NO: 799676 - DNA, 15 bp, Homo sapiens
ttcctacctccctgc

SEQ ID NO: 799677 - DNA, 21 bp, Homo sapiens
ttcctactccgttcctggcat

SEQ ID NO: 799678 - DNA, 19 bp, Homo sapiens
ttcctactgacaacattat

SEQ ID NO: 799679 - DNA, 16 bp, Homo sapiens
ttcctactgtcctgga

SEQ ID NO: 799680 - DNA, 16 bp, Homo sapiens
ttcctagaagcccctg

SEQ ID NO: 799681 - DNA, 18 bp, Homo sapiens
ttcctagataaaaagatg

SEQ ID NO: 799682 - DNA, 22 bp, Homo sapiens
ttcctagcaaatttctctcttt

SEQ ID NO: 799683 - DNA, 19 bp, Homo sapiens
ttcctaggcattgcaggac

SEQ ID NO: 799684 - DNA, 17 bp, Homo sapiens
ttcctaggcccaggcct

SEQ ID NO: 799685 - DNA, 17 bp, Homo sapiens
ttcctagtctttccagt

SEQ ID NO: 799686 - DNA, 17 bp, Homo sapiens
ttcctagtggatgactg

SEQ ID NO: 799687 - DNA, 15 bp, Homo sapiens
ttcctagttttctcc

SEQ ID NO: 799688 - DNA, 18 bp, Homo sapiens
ttcctagttttctcctcc

SEQ ID NO: 799689 - DNA, 11 bp, Homo sapiens
ttcctataagg

SEQ ID NO: 799690 - DNA, 19 bp, Homo sapiens
ttcctatacgcagcgtgct

SEQ ID NO: 799691 - DNA, 22 bp, Homo sapiens
ttcctatatagtttattgacaa

SEQ ID NO: 799692 - DNA, 20 bp, Homo sapiens
ttcctatgaagttggcacat

SEQ ID NO: 799693 - DNA, 18 bp, Homo sapiens
ttcctatgacacagttat

SEQ ID NO: 799694 - DNA, 13 bp, Homo sapiens
ttcctatgatgga

SEQ ID NO: 799695 - DNA, 13 bp, Homo sapiens
ttcctatgcccag

SEQ ID NO: 799696 - DNA, 14 bp, Homo sapiens
ttcctatggaaaca

SEQ ID NO: 799697 - DNA, 17 bp, Homo sapiens
ttcctatggaaacattt

SEQ ID NO: 799698 - DNA, 20 bp, Homo sapiens
ttcctattgtcattaaaggt

SEQ ID NO: 799699 - DNA, 21 bp, Homo sapiens
ttcctatttgttttcatggtg

SEQ ID NO: 799700 - DNA, 19 bp, Homo sapiens
ttcctattttctatccccc

SEQ ID NO: 799701 - DNA, 16 bp, Homo sapiens
ttcctatttttaaata

SEQ ID NO: 799702 - DNA, 22 bp, Homo sapiens
ttcctatttttaaataatttcc

SEQ ID NO: 799703 - DNA, 18 bp, Homo sapiens
ttcctcaaagcttggatt

SEQ ID NO: 799704 - DNA, 22 bp, Homo sapiens
ttcctcaaattttttgactttt

SEQ ID NO: 799705 - DNA, 22 bp, Homo sapiens
ttcctcaagtatcttctatttt

SEQ ID NO: 799706 - DNA, 15 bp, Homo sapiens
ttcctcacacccctg

SEQ ID NO: 799707 - DNA, 22 bp, Homo sapiens
ttcctcacacccctgtcccacc

SEQ ID NO: 799708 - DNA, 23 bp, Homo sapiens
ttcctcacacccctgtcccaccc

SEQ ID NO: 799709 - DNA, 16 bp, Homo sapiens
ttcctcacactgctgt

SEQ ID NO: 799710 - DNA, 13 bp, Homo sapiens
ttcctcacttcca

SEQ ID NO: 799711 - DNA, 14 bp, Homo sapiens
ttcctcagctgcca

SEQ ID NO: 799712 - DNA, 19 bp, Homo sapiens
ttcctcagcttatctcttt

SEQ ID NO: 799713 - DNA, 23 bp, Homo sapiens
ttcctcatcaccatcgtgtttgc

SEQ ID NO: 799714 - DNA, 16 bp, Homo sapiens
ttcctcatcctgcttc

SEQ ID NO: 799715 - DNA, 14 bp, Homo sapiens
ttcctcattaaatt

SEQ ID NO: 799716 - DNA, 17 bp, Homo sapiens
ttcctcattaaattacc

SEQ ID NO: 799717 - DNA, 12 bp, Homo sapiens
ttcctccacagt

SEQ ID NO: 799718 - DNA, 22 bp, Homo sapiens
ttcctccacagtcccccaccca

SEQ ID NO: 799719 - DNA, 17 bp, Homo sapiens
ttcctccacatcctttc

SEQ ID NO: 799720 - DNA, 16 bp, Homo sapiens
ttcctccactctgtat

SEQ ID NO: 799721 - DNA, 15 bp, Homo sapiens
ttcctccagaggagg

SEQ ID NO: 799722 - DNA, 20 bp, Homo sapiens
ttcctccagcctcccctccc

SEQ ID NO: 799723 - DNA, 17 bp, Homo sapiens
ttcctccagctgcacca

SEQ ID NO: 799724 - DNA, 16 bp, Homo sapiens
ttcctccattttctta

SEQ ID NO: 799725 - DNA, 14 bp, Homo sapiens
ttcctccattttta

SEQ ID NO: 799726 - DNA, 11 bp, Homo sapiens
ttcctcccaat

SEQ ID NO: 799727 - DNA, 23 bp, Homo sapiens
ttcctcccagtgagactgcccca

SEQ ID NO: 799728 - DNA, 22 bp, Homo sapiens
ttcctcccagttctacaagcat

SEQ ID NO: 799729 - DNA, 19 bp, Homo sapiens
ttcctccccacactccact

SEQ ID NO: 799730 - DNA, 22 bp, Homo sapiens
ttcctccccacactccactctg

SEQ ID NO: 799731 - DNA, 19 bp, Homo sapiens
ttcctccccaccttcccca

SEQ ID NO: 799732 - DNA, 23 bp, Homo sapiens
ttcctccccaccttccccagact

SEQ ID NO: 799733 - DNA, 16 bp, Homo sapiens
ttcctccccatacaca

SEQ ID NO: 799734 - DNA, 20 bp, Homo sapiens
ttcctccccatacacacaca

SEQ ID NO: 799735 - DNA, 13 bp, Homo sapiens
ttcctcccccagc

SEQ ID NO: 799736 - DNA, 13 bp, Homo sapiens
ttcctcccctcaa

SEQ ID NO: 799737 - DNA, 14 bp, Homo sapiens
ttcctcccctcaac

SEQ ID NO: 799738 - DNA, 15 bp, Homo sapiens
ttcctcccctctcat

SEQ ID NO: 799739 - DNA, 10 bp, Homo sapiens
ttcctccctc

SEQ ID NO: 799740 - DNA, 15 bp, Homo sapiens
ttcctccctgggggc

SEQ ID NO: 799741 - DNA, 14 bp, Homo sapiens
ttcctcccttctgc

SEQ ID NO: 799742 - DNA, 18 bp, Homo sapiens
ttcctcccttctgctact

SEQ ID NO: 799743 - DNA, 14 bp, Homo sapiens
ttcctccgtccacc

SEQ ID NO: 799744 - DNA, 19 bp, Homo sapiens
ttcctccgtccacccaggc

SEQ ID NO: 799745 - DNA, 22 bp, Homo sapiens
ttcctcctaccttttgtctctt

SEQ ID NO: 799746 - DNA, 21 bp, Homo sapiens
ttcctcctccacagtgctgct

SEQ ID NO: 799747 - DNA, 19 bp, Homo sapiens
ttcctcctccatcacctga

SEQ ID NO: 799748 - DNA, 15 bp, Homo sapiens
ttcctcctccctcct

SEQ ID NO: 799749 - DNA, 15 bp, Homo sapiens
ttcctcctctgccta

SEQ ID NO: 799750 - DNA, 20 bp, Homo sapiens
ttcctcctctgcctacagcc

SEQ ID NO: 799751 - DNA, 18 bp, Homo sapiens
ttcctcctgaagcctctg

SEQ ID NO: 799752 - DNA, 15 bp, Homo sapiens
ttcctcctgctcata

SEQ ID NO: 799753 - DNA, 15 bp, Homo sapiens
ttcctcctgggccct

SEQ ID NO: 799754 - DNA, 18 bp, Homo sapiens
ttcctccttcatttcagc

SEQ ID NO: 799755 - DNA, 13 bp, Homo sapiens
ttcctccttcccc

SEQ ID NO: 799756 - DNA, 14 bp, Homo sapiens
ttcctccttccccc

SEQ ID NO: 799757 - DNA, 15 bp, Homo sapiens
ttcctcctttacctt

SEQ ID NO: 799758 - DNA, 14 bp, Homo sapiens
ttcctcgccctggg

SEQ ID NO: 799759 - DNA, 16 bp, Homo sapiens
ttcctcgcctaggcct

SEQ ID NO: 799760 - DNA, 16 bp, Homo sapiens
ttcctcggtctccctt

SEQ ID NO: 799761 - DNA, 17 bp, Homo sapiens
ttcctcggtggctctgg

SEQ ID NO: 799762 - DNA, 18 bp, Homo sapiens
ttcctcggtgggccagag

SEQ ID NO: 799763 - DNA, 16 bp, Homo sapiens
ttcctcgtgcagagct

SEQ ID NO: 799764 - DNA, 18 bp, Homo sapiens
ttcctcgttgggccgctc

SEQ ID NO: 799765 - DNA, 21 bp, Homo sapiens
ttcctctaactcactgcctag

SEQ ID NO: 799766 - DNA, 20 bp, Homo sapiens
ttcctctatacatctctccc

SEQ ID NO: 799767 - DNA, 22 bp, Homo sapiens
ttcctctatacatctctcccca

SEQ ID NO: 799768 - DNA, 17 bp, Homo sapiens
ttcctctattgatgtac

SEQ ID NO: 799769 - DNA, 18 bp, Homo sapiens
ttcctctcaagctagcca

SEQ ID NO: 799770 - DNA, 17 bp, Homo sapiens
ttcctctcactaaactt

SEQ ID NO: 799771 - DNA, 12 bp, Homo sapiens
ttcctctccact

SEQ ID NO: 799772 - DNA, 16 bp, Homo sapiens
ttcctctccactgcct

SEQ ID NO: 799773 - DNA, 19 bp, Homo sapiens
ttcctctccactgccttcg

SEQ ID NO: 799774 - DNA, 14 bp, Homo sapiens
ttcctctccatacc

SEQ ID NO: 799775 - DNA, 16 bp, Homo sapiens
ttcctctccctcaggg

SEQ ID NO: 799776 - DNA, 14 bp, Homo sapiens
ttcctctcccttcc

SEQ ID NO: 799777 - DNA, 14 bp, Homo sapiens
ttcctctccttccc

SEQ ID NO: 799778 - DNA, 13 bp, Homo sapiens
ttcctgaatccaa

SEQ ID NO: 799779 - DNA, 22 bp, Homo sapiens
ttcctgaatctaaaataaaaat

SEQ ID NO: 799780 - DNA, 20 bp, Homo sapiens
ttcctgaattctatttgctg

SEQ ID NO: 799781 - DNA, 13 bp, Homo sapiens
ttcctgacacttt

SEQ ID NO: 799782 - DNA, 22 bp, Homo sapiens
ttcctgacactttaattaccaa

SEQ ID NO: 799783 - DNA, 13 bp, Homo sapiens
ttcctgacccagg

SEQ ID NO: 799784 - DNA, 20 bp, Homo sapiens
ttcctgacctccgccatcca

SEQ ID NO: 799785 - DNA, 18 bp, Homo sapiens
ttcctgacttgagtgttc

SEQ ID NO: 799786 - DNA, 19 bp, Homo sapiens
ttcctgagaaagcccacct

SEQ ID NO: 799787 - DNA, 19 bp, Homo sapiens
ttcctgataataattgatc

SEQ ID NO: 799788 - DNA, 19 bp, Homo sapiens
ttcctgatggtacaggaaa

SEQ ID NO: 799789 - DNA, 22 bp, Homo sapiens
ttcctgatggtacaggaaagct

SEQ ID NO: 799790 - DNA, 21 bp, Homo sapiens
ttcctgattaccagtctgatt

SEQ ID NO: 799791 - DNA, 23 bp, Homo sapiens
ttcctgattaccagtctgattat

SEQ ID NO: 799792 - DNA, 18 bp, Homo sapiens
ttcctgattgtttacagt

SEQ ID NO: 799793 - DNA, 20 bp, Homo sapiens
ttcctgcaactcaaggactt

SEQ ID NO: 799794 - DNA, 21 bp, Homo sapiens
ttcctgcagccccagaagaaa

SEQ ID NO: 799795 - DNA, 17 bp, Homo sapiens
ttcctgccaccagtcac

SEQ ID NO: 799796 - DNA, 18 bp, Homo sapiens
ttcctgccaccagtcact

SEQ ID NO: 799797 - DNA, 18 bp, Homo sapiens
ttcctgccatgtttagtg

SEQ ID NO: 799798 - DNA, 13 bp, Homo sapiens
ttcctgccccagg

SEQ ID NO: 799799 - DNA, 15 bp, Homo sapiens
ttcctgcccctcttt

SEQ ID NO: 799800 - DNA, 20 bp, Homo sapiens
ttcctgcccctctttctctt

SEQ ID NO: 799801 - DNA, 22 bp, Homo sapiens
ttcctgcccctctttctctttc

SEQ ID NO: 799802 - DNA, 13 bp, Homo sapiens
ttcctgccctgtc

SEQ ID NO: 799803 - DNA, 16 bp, Homo sapiens
ttcctgccctgtccaa

SEQ ID NO: 799804 - DNA, 18 bp, Homo sapiens
ttcctgcccttcctcagt

SEQ ID NO: 799805 - DNA, 15 bp, Homo sapiens
ttcctgcctttaagc

SEQ ID NO: 799806 - DNA, 17 bp, Homo sapiens
ttcctgcctttaagcca

SEQ ID NO: 799807 - DNA, 21 bp, Homo sapiens
ttcctgcgggcttttccccgg

SEQ ID NO: 799808 - DNA, 20 bp, Homo sapiens
ttcctgctacaagtgtttta

SEQ ID NO: 799809 - DNA, 14 bp, Homo sapiens
ttcctgctccagtg

SEQ ID NO: 799810 - DNA, 11 bp, Homo sapiens
ttcctgctccg

SEQ ID NO: 799811 - DNA, 9 bp, Homo sapiens
ttcctgctg

SEQ ID NO: 799812 - DNA, 22 bp, Homo sapiens
ttcctgctgaacgtttccccga

SEQ ID NO: 799813 - DNA, 14 bp, Homo sapiens
ttcctgctgcaccc

SEQ ID NO: 799814 - DNA, 24 bp, Homo sapiens
ttcctgctgctgtaactgctgagc

SEQ ID NO: 799815 - DNA, 14 bp, Homo sapiens
ttcctgctgggact

SEQ ID NO: 799816 - DNA, 10 bp, Homo sapiens
ttcctgctgt

SEQ ID NO: 799817 - DNA, 19 bp, Homo sapiens
ttcctgcttaaacttgacc

SEQ ID NO: 799818 - DNA, 17 bp, Homo sapiens
ttcctggaaaagaagaa

SEQ ID NO: 799819 - DNA, 19 bp, Homo sapiens
ttcctggacactcagacct

SEQ ID NO: 799820 - DNA, 15 bp, Homo sapiens
ttcctggacatcacc

SEQ ID NO: 799821 - DNA, 21 bp, Homo sapiens
ttcctggacatcaccagtcct

SEQ ID NO: 799822 - DNA, 19 bp, Homo sapiens
ttcctggaggtcagcattt

SEQ ID NO: 799823 - DNA, 18 bp, Homo sapiens
ttcctggcaatagtgtgt

SEQ ID NO: 799824 - DNA, 20 bp, Homo sapiens
ttcctggcaatagtgtgttc

SEQ ID NO: 799825 - DNA, 15 bp, Homo sapiens
ttcctggcagctgct

SEQ ID NO: 799826 - DNA, 10 bp, Homo sapiens
ttcctggcat

SEQ ID NO: 799827 - DNA, 11 bp, Homo sapiens
ttcctggccca

SEQ ID NO: 799828 - DNA, 17 bp, Homo sapiens
ttcctggcccactctgt

SEQ ID NO: 799829 - DNA, 22 bp, Homo sapiens
ttcctggcctcactggctgggg

SEQ ID NO: 799830 - DNA, 13 bp, Homo sapiens
ttcctggcctctt

SEQ ID NO: 799831 - DNA, 20 bp, Homo sapiens
ttcctggcctcttctgggct

SEQ ID NO: 799832 - DNA, 13 bp, Homo sapiens
ttcctggctctgg

SEQ ID NO: 799833 - DNA, 14 bp, Homo sapiens
ttcctggctctggg

SEQ ID NO: 799834 - DNA, 17 bp, Homo sapiens
ttcctggctctggggga

SEQ ID NO: 799835 - DNA, 21 bp, Homo sapiens
ttcctggctgatgatccagaa

SEQ ID NO: 799836 - DNA, 14 bp, Homo sapiens
ttcctggctgtaaa

SEQ ID NO: 799837 - DNA, 18 bp, Homo sapiens
ttcctgggaatggaataa

SEQ ID NO: 799838 - DNA, 15 bp, Homo sapiens
ttcctgggaccccct

SEQ ID NO: 799839 - DNA, 23 bp, Homo sapiens
ttcctgggaccccctcgccagct

SEQ ID NO: 799840 - DNA, 22 bp, Homo sapiens
ttcctgggaggacaggcaggcc

SEQ ID NO: 799841 - DNA, 22 bp, Homo sapiens
ttcctgggcagcctttccagcc

SEQ ID NO: 799842 - DNA, 14 bp, Homo sapiens
ttcctgggcctgtc

SEQ ID NO: 799843 - DNA, 16 bp, Homo sapiens
ttcctgggcctgtccc

SEQ ID NO: 799844 - DNA, 17 bp, Homo sapiens
ttcctggggatgtcata

SEQ ID NO: 799845 - DNA, 15 bp, Homo sapiens
ttcctggggccccgc

SEQ ID NO: 799846 - DNA, 16 bp, Homo sapiens
ttcctggggccccgct

SEQ ID NO: 799847 - DNA, 17 bp, Homo sapiens
ttcctggggccgcctgc

SEQ ID NO: 799848 - DNA, 21 bp, Homo sapiens
ttcctggggccgcctgccctg

SEQ ID NO: 799849 - DNA, 22 bp, Homo sapiens
ttcctggggccgcctgccctgc

SEQ ID NO: 799850 - DNA, 15 bp, Homo sapiens
ttcctggtacccagc

SEQ ID NO: 799851 - DNA, 16 bp, Homo sapiens
ttcctggtacccagcc

SEQ ID NO: 799852 - DNA, 12 bp, Homo sapiens
ttcctggtgagg

SEQ ID NO: 799853 - DNA, 19 bp, Homo sapiens
ttcctggtgaggcccagcc

SEQ ID NO: 799854 - DNA, 22 bp, Homo sapiens
ttcctggtgaggcccagcctgt

SEQ ID NO: 799855 - DNA, 19 bp, Homo sapiens
ttcctggtgccaatttcaa

SEQ ID NO: 799856 - DNA, 17 bp, Homo sapiens
ttcctggtttgactcag

SEQ ID NO: 799857 - DNA, 14 bp, Homo sapiens
ttcctgtaaataag

SEQ ID NO: 799858 - DNA, 18 bp, Homo sapiens
ttcctgtaaataagagtt

SEQ ID NO: 799859 - DNA, 11 bp, Homo sapiens
ttcctgtaaca

SEQ ID NO: 799860 - DNA, 15 bp, Homo sapiens
ttcctgtagcatctt

SEQ ID NO: 799861 - DNA, 22 bp, Homo sapiens
ttcctgtagccttctgtaggaa

SEQ ID NO: 799862 - DNA, 17 bp, Homo sapiens
ttccttttgtgtacagt

SEQ ID NO: 799863 - DNA, 17 bp, Homo sapiens
ttcctttttaaatgtga

SEQ ID NO: 799864 - DNA, 19 bp, Homo sapiens
ttcctttttaaatgtgaat

SEQ ID NO: 799865 - DNA, 23 bp, Homo sapiens
ttcctttttaaatgtgaattttt

SEQ ID NO: 799866 - DNA, 21 bp, Homo sapiens
ttcctttttcaaaaaccagcc

SEQ ID NO: 799867 - DNA, 14 bp, Homo sapiens
ttcctttttctaaa

SEQ ID NO: 799868 - DNA, 16 bp, Homo sapiens
ttcctttttctatgaa

SEQ ID NO: 799869 - DNA, 16 bp, Homo sapiens
ttcctttttggggagt

SEQ ID NO: 799870 - DNA, 19 bp, Homo sapiens
ttccttttttcaatatgca

SEQ ID NO: 799871 - DNA, 23 bp, Homo sapiens
ttccttttttcaatatgcaagca

SEQ ID NO: 799872 - DNA, 19 bp, Homo sapiens
ttccttttttcccataaga

SEQ ID NO: 799873 - DNA, 16 bp, Homo sapiens
ttccttttttgtctat

SEQ ID NO: 799874 - DNA, 18 bp, Homo sapiens
ttccttttttgtctatga

SEQ ID NO: 799875 - DNA, 16 bp, Homo sapiens
ttcctttttttgtacc

SEQ ID NO: 799876 - DNA, 12 bp, Homo sapiens
ttcgaaactgcc

SEQ ID NO: 799877 - DNA, 13 bp, Homo sapiens
ttcgaaactgcca

SEQ ID NO: 799878 - DNA, 21 bp, Homo sapiens
ttcgaagaaacccttgctgct

SEQ ID NO: 799879 - DNA, 14 bp, Homo sapiens
ttcgaagctcagcc

SEQ ID NO: 799880 - DNA, 20 bp, Homo sapiens
ttcgaagggtcttaaagaat

SEQ ID NO: 799881 - DNA, 18 bp, Homo sapiens
ttcgaatggggtagaaac

SEQ ID NO: 799882 - DNA, 12 bp, Homo sapiens
ttcgactggtcc

SEQ ID NO: 799883 - DNA, 20 bp, Homo sapiens
ttcgactggtccagctctga

SEQ ID NO: 799884 - DNA, 22 bp, Homo sapiens
ttcgactggtccagctctgaca

SEQ ID NO: 799885 - DNA, 19 bp, Homo sapiens
ttcgactgtgacctgtggg

SEQ ID NO: 799886 - DNA, 14 bp, Homo sapiens
ttcgagaccagcct

SEQ ID NO: 799887 - DNA, 23 bp, Homo sapiens
ttcgagattatcgttttcttaaa

SEQ ID NO: 799888 - DNA, 21 bp, Homo sapiens
ttcgagcatgcggagccagca

SEQ ID NO: 799889 - DNA, 12 bp, Homo sapiens
ttcgaggcctga

SEQ ID NO: 799890 - DNA, 16 bp, Homo sapiens
ttcgaggtgtcaccct

SEQ ID NO: 799891 - DNA, 18 bp, Homo sapiens
ttcgagtaaacttgaaaa

SEQ ID NO: 799892 - DNA, 12 bp, Homo sapiens
ttcgagtagaga

SEQ ID NO: 799893 - DNA, 23 bp, Homo sapiens
ttcgatacccaggaccaagccac

SEQ ID NO: 799894 - DNA, 18 bp, Homo sapiens
ttcgatctcattcagtat

SEQ ID NO: 799895 - DNA, 15 bp, Homo sapiens
ttcgatttctgactc

SEQ ID NO: 799896 - DNA, 19 bp, Homo sapiens
ttcgcaccttgctgtgtga

SEQ ID NO: 799897 - DNA, 20 bp, Homo sapiens
ttcgcagagcttttcagatt

SEQ ID NO: 799898 - DNA, 16 bp, Homo sapiens
ttcgcatggtcacaca

SEQ ID NO: 799899 - DNA, 14 bp, Homo sapiens
ttcgccttaaactc

SEQ ID NO: 799900 - DNA, 21 bp, Homo sapiens
ttcgcctttgtcttgtacttc

SEQ ID NO: 799901 - DNA, 15 bp, Homo sapiens
ttcgctgaaattgct

SEQ ID NO: 799902 - DNA, 20 bp, Homo sapiens
ttcggaaaaaaaaaaagaaa

SEQ ID NO: 799903 - DNA, 20 bp, Homo sapiens
ttcggagggccgcagggccc

SEQ ID NO: 799904 - DNA, 12 bp, Homo sapiens
ttcggcatttga

SEQ ID NO: 799905 - DNA, 17 bp, Homo sapiens
ttcggccccatgtatct

SEQ ID NO: 799906 - DNA, 13 bp, Homo sapiens
ttcgggctgtgcc

SEQ ID NO: 799907 - DNA, 18 bp, Homo sapiens
ttcggggaagctgcacat

SEQ ID NO: 799908 - DNA, 13 bp, Homo sapiens
ttcggggcctcct

SEQ ID NO: 799909 - DNA, 12 bp, Homo sapiens
ttcggggcctgc

SEQ ID NO: 799910 - DNA, 16 bp, Homo sapiens
ttcgggttaagtgatg

SEQ ID NO: 799911 - DNA, 14 bp, Homo sapiens
ttcggtttctgagc

SEQ ID NO: 799912 - DNA, 15 bp, Homo sapiens
ttcgtaccttcccac

SEQ ID NO: 799913 - DNA, 12 bp, Homo sapiens
ttcgtctgttgt

SEQ ID NO: 799914 - DNA, 19 bp, Homo sapiens
ttcgtcttcgccctctgaa

SEQ ID NO: 799915 - DNA, 21 bp, Homo sapiens
ttcgtcttcgccctctgaaat

SEQ ID NO: 799916 - DNA, 15 bp, Homo sapiens
ttcgtgctggaggaa

SEQ ID NO: 799917 - DNA, 17 bp, Homo sapiens
ttcgtgtctctcccacc

SEQ ID NO: 799918 - DNA, 13 bp, Homo sapiens
ttcgtgtgctgct

SEQ ID NO: 799919 - DNA, 15 bp, Homo sapiens
ttcgtgtttgattcc

SEQ ID NO: 799920 - DNA, 21 bp, Homo sapiens
ttcgttaatagattatttcat

SEQ ID NO: 799921 - DNA, 17 bp, Homo sapiens
ttcgttcgcagagcttt

SEQ ID NO: 799922 - DNA, 18 bp, Homo sapiens
ttcgttggggacatgaga

SEQ ID NO: 799923 - DNA, 20 bp, Homo sapiens
ttcgttgtgttttttaagat

SEQ ID NO: 799924 - DNA, 16 bp, Homo sapiens
ttcgtttccatcatgt

SEQ ID NO: 799925 - DNA, 13 bp, Homo sapiens
ttctaaaaaacag

SEQ ID NO: 799926 - DNA, 14 bp, Homo sapiens
ttctaaaaacttct

SEQ ID NO: 799927 - DNA, 12 bp, Homo sapiens
ttctaaaagcca

SEQ ID NO: 799928 - DNA, 17 bp, Homo sapiens
ttctaaaagctttcatg

SEQ ID NO: 799929 - DNA, 15 bp, Homo sapiens
ttctaaaatctaaaa

SEQ ID NO: 799930 - DNA, 13 bp, Homo sapiens
ttctaaagatgga

SEQ ID NO: 799931 - DNA, 10 bp, Homo sapiens
ttctccctct

SEQ ID NO: 799932 - DNA, 21 bp, Homo sapiens
ttctccctctcatgtccctcc

SEQ ID NO: 799933 - DNA, 13 bp, Homo sapiens
ttctccctctgga

SEQ ID NO: 799934 - DNA, 15 bp, Homo sapiens
ttctccctgcagcct

SEQ ID NO: 799935 - DNA, 12 bp, Homo sapiens
ttctcccttctt

SEQ ID NO: 799936 - DNA, 17 bp, Homo sapiens
ttctcccttcttgggtc

SEQ ID NO: 799937 - DNA, 24 bp, Homo sapiens
ttctccctttctctctcctctctg

SEQ ID NO: 799938 - DNA, 17 bp, Homo sapiens
ttctccgccagcctcct

SEQ ID NO: 799939 - DNA, 20 bp, Homo sapiens
ttctccgccagcctcctctg

SEQ ID NO: 799940 - DNA, 18 bp, Homo sapiens
ttctccggggtctgtgct

SEQ ID NO: 799941 - DNA, 13 bp, Homo sapiens
ttctccgggtcct

SEQ ID NO: 799942 - DNA, 16 bp, Homo sapiens
ttctccgggtcctcct

SEQ ID NO: 799943 - DNA, 17 bp, Homo sapiens
ttctccgggtgtggcct

SEQ ID NO: 799944 - DNA, 15 bp, Homo sapiens
ttctcctatgtgtaa

SEQ ID NO: 799945 - DNA, 20 bp, Homo sapiens
ttctcctcaggacaaggcct

SEQ ID NO: 799946 - DNA, 22 bp, Homo sapiens
ttctcctccccacctgtagctg

SEQ ID NO: 799947 - DNA, 13 bp, Homo sapiens
ttctcctccgcct

SEQ ID NO: 799948 - DNA, 19 bp, Homo sapiens
ttctcctcttgtaaataaa

SEQ ID NO: 799949 - DNA, 15 bp, Homo sapiens
ttctcctgaatgcat

SEQ ID NO: 799950 - DNA, 14 bp, Homo sapiens
ttctcctgcctcag

SEQ ID NO: 799951 - DNA, 18 bp, Homo sapiens
ttctcctggtgactcaaa

SEQ ID NO: 799952 - DNA, 22 bp, Homo sapiens
ttctcctgtgaccccaccttga

SEQ ID NO: 799953 - DNA, 12 bp, Homo sapiens
ttctccttccca

SEQ ID NO: 799954 - DNA, 22 bp, Homo sapiens
ttctccttccccatttccactg

SEQ ID NO: 799955 - DNA, 14 bp, Homo sapiens
ttctccttctcctt

SEQ ID NO: 799956 - DNA, 19 bp, Homo sapiens
ttctccttggtttgctagt

SEQ ID NO: 799957 - DNA, 17 bp, Homo sapiens
ttctcctttcacaacct

SEQ ID NO: 799958 - DNA, 23 bp, Homo sapiens
ttctcgcaaaaacgtatctccta

SEQ ID NO: 799959 - DNA, 16 bp, Homo sapiens
ttctcggccagcccgt

SEQ ID NO: 799960 - DNA, 23 bp, Homo sapiens
ttctcgtccccctccctgcccaa

SEQ ID NO: 799961 - DNA, 23 bp, Homo sapiens
ttctcgtttttatagtcaatggc

SEQ ID NO: 799962 - DNA, 21 bp, Homo sapiens
ttctctaacttcaaggcccat

SEQ ID NO: 799963 - DNA, 15 bp, Homo sapiens
ttctctaataataaa

SEQ ID NO: 799964 - DNA, 20 bp, Homo sapiens
ttctctaataataaatagtt

SEQ ID NO: 799965 - DNA, 19 bp, Homo sapiens
ttctctacttgtcatatca

SEQ ID NO: 799966 - DNA, 17 bp, Homo sapiens
ttctctagtttgattaa

SEQ ID NO: 799967 - DNA, 16 bp, Homo sapiens
ttctctataaaaaata

SEQ ID NO: 799968 - DNA, 21 bp, Homo sapiens
ttctctataaaaaatatgtat

SEQ ID NO: 799969 - DNA, 17 bp, Homo sapiens
ttctctatgtttattct

SEQ ID NO: 799970 - DNA, 18 bp, Homo sapiens
ttctctattttcataatc

SEQ ID NO: 799971 - DNA, 20 bp, Homo sapiens
ttctctcatctgatcacttc

SEQ ID NO: 799972 - DNA, 14 bp, Homo sapiens
ttctctccccaacc

SEQ ID NO: 799973 - DNA, 15 bp, Homo sapiens
ttctctccccaaccc

SEQ ID NO: 799974 - DNA, 23 bp, Homo sapiens
ttctctccccaacccccattctc

SEQ ID NO: 799975 - DNA, 11 bp, Homo sapiens
ttctctcctgg

SEQ ID NO: 799976 - DNA, 14 bp, Homo sapiens
ttctctcctgtacc

SEQ ID NO: 799977 - DNA, 19 bp, Homo sapiens
ttctgcagtcatctcccct

SEQ ID NO: 799978 - DNA, 22 bp, Homo sapiens
ttctgcatatgttgaatacttt

SEQ ID NO: 799979 - DNA, 20 bp, Homo sapiens
ttctgcatcatctgtagata

SEQ ID NO: 799980 - DNA, 18 bp, Homo sapiens
ttctgcatgcttagagca

SEQ ID NO: 799981 - DNA, 14 bp, Homo sapiens
ttctgcatgtacta

SEQ ID NO: 799982 - DNA, 13 bp, Homo sapiens
ttctgcattgcta

SEQ ID NO: 799983 - DNA, 23 bp, Homo sapiens
ttctgcattttattctggatgga

SEQ ID NO: 799984 - DNA, 18 bp, Homo sapiens
ttctgcattttgctattg

SEQ ID NO: 799985 - DNA, 20 bp, Homo sapiens
ttctgccaacgcctcctgtc

SEQ ID NO: 799986 - DNA, 23 bp, Homo sapiens
ttctgcccacgatcccctccccc

SEQ ID NO: 799987 - DNA, 13 bp, Homo sapiens
ttctgcccccagc

SEQ ID NO: 799988 - DNA, 15 bp, Homo sapiens
ttctgcccccagccc

SEQ ID NO: 799989 - DNA, 14 bp, Homo sapiens
ttctgccctggctg

SEQ ID NO: 799990 - DNA, 13 bp, Homo sapiens
ttctgccgctgtc

SEQ ID NO: 799991 - DNA, 18 bp, Homo sapiens
ttctgcctaacagaaatt

SEQ ID NO: 799992 - DNA, 15 bp, Homo sapiens
ttctgcctagagtgt

SEQ ID NO: 799993 - DNA, 12 bp, Homo sapiens
ttctgcctctcc

SEQ ID NO: 799994 - DNA, 13 bp, Homo sapiens
ttctgcctctcct

SEQ ID NO: 799995 - DNA, 12 bp, Homo sapiens
ttctgcctgctc

SEQ ID NO: 799996 - DNA, 20 bp, Homo sapiens
ttctgcctgttataactctg

SEQ ID NO: 799997 - DNA, 24 bp, Homo sapiens
ttctgcctgttataactctgcact

SEQ ID NO: 799998 - DNA, 21 bp, Homo sapiens
ttctgccttagcctaccatgt

SEQ ID NO: 799999 - DNA, 10 bp, Homo sapiens
ttctgccttt

SEQ ID NO: 800000 - DNA, 21 bp, Homo sapiens
ttctgcctttcccccctcaca

SEQ ID NO: 800001 - DNA, 23 bp, Homo sapiens
ttctgcctttgatgttacagatt

SEQ ID NO: 800002 - DNA, 16 bp, Homo sapiens
ttctgcgggctccctc

SEQ ID NO: 800003 - DNA, 19 bp, Homo sapiens
ttctgcgggctccctcctc

SEQ ID NO: 800004 - DNA, 21 bp, Homo sapiens
ttctgcgggctccctcctctg

SEQ ID NO: 800005 - DNA, 24 bp, Homo sapiens
ttctgcgtccaccaggcctcactg

SEQ ID NO: 800006 - DNA, 21 bp, Homo sapiens
ttctgctacctcactggggtc

SEQ ID NO: 800007 - DNA, 15 bp, Homo sapiens
ttctgctacttcact

SEQ ID NO: 800008 - DNA, 17 bp, Homo sapiens
ttctgctacttcactgt

SEQ ID NO: 800009 - DNA, 14 bp, Homo sapiens
ttctgctcatcatt

SEQ ID NO: 800010 - DNA, 9 bp, Homo sapiens
ttctgctcc

SEQ ID NO: 800011 - DNA, 17 bp, Homo sapiens
ttctgctccacccttgg

SEQ ID NO: 800012 - DNA, 18 bp, Homo sapiens
ttctgctccacccttggc

SEQ ID NO: 800013 - DNA, 15 bp, Homo sapiens
ttctgctccagcccc

SEQ ID NO: 800014 - DNA, 11 bp, Homo sapiens
ttctgctcctc

SEQ ID NO: 800015 - DNA, 17 bp, Homo sapiens
ttctgctcctctccagg

SEQ ID NO: 800016 - DNA, 14 bp, Homo sapiens
ttctgctcctgctt

SEQ ID NO: 800017 - DNA, 14 bp, Homo sapiens
ttctgctctggaat

SEQ ID NO: 800018 - DNA, 23 bp, Homo sapiens
ttctgctctggttgtttctgttc

SEQ ID NO: 800019 - DNA, 21 bp, Homo sapiens
ttctgctcttccaaagctcct

SEQ ID NO: 800020 - DNA, 20 bp, Homo sapiens
ttctgctgcctctacacagg

SEQ ID NO: 800021 - DNA, 12 bp, Homo sapiens
ttctgctggaag

SEQ ID NO: 800022 - DNA, 12 bp, Homo sapiens
ttctgctggcct

SEQ ID NO: 800023 - DNA, 15 bp, Homo sapiens
ttctgctggcctgga

SEQ ID NO: 800024 - DNA, 18 bp, Homo sapiens
ttctgctggcctggatct

SEQ ID NO: 800025 - DNA, 23 bp, Homo sapiens
ttctgctgtggtctataaaataa

SEQ ID NO: 800026 - DNA, 13 bp, Homo sapiens
ttctgctgtttaa

SEQ ID NO: 800027 - DNA, 15 bp, Homo sapiens
ttctgctttcatctt

SEQ ID NO: 800028 - DNA, 21 bp, Homo sapiens
ttctgcttttaccatgcccct

SEQ ID NO: 800029 - DNA, 17 bp, Homo sapiens
ttctgcttttctgccct

SEQ ID NO: 800030 - DNA, 19 bp, Homo sapiens
ttctgcttttctgccctgg

SEQ ID NO: 800031 - DNA, 10 bp, Homo sapiens
ttctggaaaa

SEQ ID NO: 800032 - DNA, 21 bp, Homo sapiens
ttctggaaaaaaaatatatat

SEQ ID NO: 800033 - DNA, 14 bp, Homo sapiens
ttctggaaaggaaa

SEQ ID NO: 800034 - DNA, 15 bp, Homo sapiens
ttctggaaattttgt

SEQ ID NO: 800035 - DNA, 18 bp, Homo sapiens
ttctggaaggctggctga

SEQ ID NO: 800036 - DNA, 16 bp, Homo sapiens
ttctggaatgtaatca

SEQ ID NO: 800037 - DNA, 17 bp, Homo sapiens
ttctggaatttgttcaa

SEQ ID NO: 800038 - DNA, 19 bp, Homo sapiens
ttctggaatttgttcaagt

SEQ ID NO: 800039 - DNA, 16 bp, Homo sapiens
ttctggactctgcccc

SEQ ID NO: 800040 - DNA, 15 bp, Homo sapiens
ttctggactctggac

SEQ ID NO: 800041 - DNA, 21 bp, Homo sapiens
ttctggactggcgttcacctc

SEQ ID NO: 800042 - DNA, 22 bp, Homo sapiens
ttctggagctgggagacaaagg

SEQ ID NO: 800043 - DNA, 19 bp, Homo sapiens
ttctggaggaaagggagga

SEQ ID NO: 800044 - DNA, 16 bp, Homo sapiens
ttctggagtttctcta

SEQ ID NO: 800045 - DNA, 23 bp, Homo sapiens
ttctggataaaccaccctctggg

SEQ ID NO: 800046 - DNA, 15 bp, Homo sapiens
ttctggatatagcta

SEQ ID NO: 800047 - DNA, 20 bp, Homo sapiens
ttctggatctcctgctgcct

SEQ ID NO: 800048 - DNA, 22 bp, Homo sapiens
ttctggcagatgtaggtaaaga

SEQ ID NO: 800049 - DNA, 13 bp, Homo sapiens
ttctggcaggacc

SEQ ID NO: 800050 - DNA, 14 bp, Homo sapiens
ttctggcaggacct

SEQ ID NO: 800051 - DNA, 13 bp, Homo sapiens
ttctggcctccag

SEQ ID NO: 800052 - DNA, 16 bp, Homo sapiens
ttctggcctccagcct

SEQ ID NO: 800053 - DNA, 22 bp, Homo sapiens
ttctggcctccagcctttgctc

SEQ ID NO: 800054 - DNA, 12 bp, Homo sapiens
ttctggcctcct

SEQ ID NO: 800055 - DNA, 20 bp, Homo sapiens
ttctggcctgccttcgttaa

SEQ ID NO: 800056 - DNA, 12 bp, Homo sapiens
ttctggcctgtt

SEQ ID NO: 800057 - DNA, 13 bp, Homo sapiens
ttctggcctgtta

SEQ ID NO: 800058 - DNA, 17 bp, Homo sapiens
ttctggccttgtaagac

SEQ ID NO: 800059 - DNA, 13 bp, Homo sapiens
ttcttagtgtcac

SEQ ID NO: 800060 - DNA, 18 bp, Homo sapiens
ttcttagttctcactgtt

SEQ ID NO: 800061 - DNA, 19 bp, Homo sapiens
ttcttagttctcactgttc

SEQ ID NO: 800062 - DNA, 21 bp, Homo sapiens
ttcttagttgacaacctagaa

SEQ ID NO: 800063 - DNA, 12 bp, Homo sapiens
ttcttataatac

SEQ ID NO: 800064 - DNA, 21 bp, Homo sapiens
ttcttatacagataaaacatg

SEQ ID NO: 800065 - DNA, 14 bp, Homo sapiens
ttcttatattattc

SEQ ID NO: 800066 - DNA, 14 bp, Homo sapiens
ttcttatcacataa

SEQ ID NO: 800067 - DNA, 22 bp, Homo sapiens
ttcttatcacataagagagatg

SEQ ID NO: 800068 - DNA, 15 bp, Homo sapiens
ttcttatcttctgca

SEQ ID NO: 800069 - DNA, 14 bp, Homo sapiens
ttcttatgaggagg

SEQ ID NO: 800070 - DNA, 13 bp, Homo sapiens
ttcttatgatttt

SEQ ID NO: 800071 - DNA, 17 bp, Homo sapiens
ttcttatggaattgatt

SEQ ID NO: 800072 - DNA, 22 bp, Homo sapiens
ttcttatggaattgatttgcat

SEQ ID NO: 800073 - DNA, 13 bp, Homo sapiens
ttcttatgtgaca

SEQ ID NO: 800074 - DNA, 16 bp, Homo sapiens
ttcttatgtgacatta

SEQ ID NO: 800075 - DNA, 19 bp, Homo sapiens
ttcttatgtgacattaaca

SEQ ID NO: 800076 - DNA, 20 bp, Homo sapiens
ttcttatgtgacattaacaa

SEQ ID NO: 800077 - DNA, 21 bp, Homo sapiens
ttcttatgtgacattaacaaa

SEQ ID NO: 800078 - DNA, 23 bp, Homo sapiens
ttcttatttaagtatggaatatt

SEQ ID NO: 800079 - DNA, 23 bp, Homo sapiens
ttcttatttaatgaaagactgta

SEQ ID NO: 800080 - DNA, 15 bp, Homo sapiens
ttcttattttagtat

SEQ ID NO: 800081 - DNA, 14 bp, Homo sapiens
ttcttattttgcat

SEQ ID NO: 800082 - DNA, 20 bp, Homo sapiens
ttcttattttgcattccaga

SEQ ID NO: 800083 - DNA, 14 bp, Homo sapiens
ttcttatttttgtc

SEQ ID NO: 800084 - DNA, 15 bp, Homo sapiens
ttcttcacaggcact

SEQ ID NO: 800085 - DNA, 18 bp, Homo sapiens
ttcttcaccaagtgcaat

SEQ ID NO: 800086 - DNA, 14 bp, Homo sapiens
ttcttcacccagct

SEQ ID NO: 800087 - DNA, 21 bp, Homo sapiens
ttcttcacccagctaatctgt

SEQ ID NO: 800088 - DNA, 21 bp, Homo sapiens
ttcttcacctaagtctctgtg

SEQ ID NO: 800089 - DNA, 13 bp, Homo sapiens
ttcttcacctcta

SEQ ID NO: 800090 - DNA, 21 bp, Homo sapiens
ttcttcacctgttatgtatga

SEQ ID NO: 800091 - DNA, 22 bp, Homo sapiens
ttcttcacctgttatgtatgaa

SEQ ID NO: 800092 - DNA, 22 bp, Homo sapiens
ttcttcactgtcctccaagcca

SEQ ID NO: 800093 - DNA, 14 bp, Homo sapiens
ttcttcagaagaca

SEQ ID NO: 800094 - DNA, 17 bp, Homo sapiens
ttcttcagaattatcca

SEQ ID NO: 800095 - DNA, 21 bp, Homo sapiens
ttcttcagagtgaagaatctt

SEQ ID NO: 800096 - DNA, 18 bp, Homo sapiens
ttcttcagcttgatcctg

SEQ ID NO: 800097 - DNA, 17 bp, Homo sapiens
ttcttcaggtaacacta

SEQ ID NO: 800098 - DNA, 15 bp, Homo sapiens
ttcttcatattctaa

SEQ ID NO: 800099 - DNA, 15 bp, Homo sapiens
ttcttcatttctctg

SEQ ID NO: 800100 - DNA, 16 bp, Homo sapiens
ttcttcatttctctgc

SEQ ID NO: 800101 - DNA, 17 bp, Homo sapiens
ttcttccaaacttttgc

SEQ ID NO: 800102 - DNA, 18 bp, Homo sapiens
ttcttccatcatcactgt

SEQ ID NO: 800103 - DNA, 23 bp, Homo sapiens
ttcttccatcatcactgtaaaga

SEQ ID NO: 800104 - DNA, 16 bp, Homo sapiens
ttcttcccgtgtgtat

SEQ ID NO: 800105 - DNA, 20 bp, Homo sapiens
ttcttcccttttacatactg

SEQ ID NO: 800106 - DNA, 21 bp, Homo sapiens
ttcttcccttttacatactgc

SEQ ID NO: 800107 - DNA, 16 bp, Homo sapiens
ttcttcctccagctgc

SEQ ID NO: 800108 - DNA, 12 bp, Homo sapiens
ttcttcctcctc

SEQ ID NO: 800109 - DNA, 13 bp, Homo sapiens
ttcttcctcctct

SEQ ID NO: 800110 - DNA, 20 bp, Homo sapiens
ttcttcctctccttcccaca

SEQ ID NO: 800111 - DNA, 11 bp, Homo sapiens
ttcttcctctg

SEQ ID NO: 800112 - DNA, 13 bp, Homo sapiens
ttcttcctctgca

SEQ ID NO: 800113 - DNA, 15 bp, Homo sapiens
ttcttcctcttcttt

SEQ ID NO: 800114 - DNA, 13 bp, Homo sapiens
ttcttcctttcta

SEQ ID NO: 800115 - DNA, 14 bp, Homo sapiens
ttcttcgctgctct

SEQ ID NO: 800116 - DNA, 17 bp, Homo sapiens
ttcttctaagaagacat

SEQ ID NO: 800117 - DNA, 17 bp, Homo sapiens
ttcttctaggggtagct

SEQ ID NO: 800118 - DNA, 18 bp, Homo sapiens
ttcttctaggttctaaaa

SEQ ID NO: 800119 - DNA, 15 bp, Homo sapiens
ttcttctcctatgtg

SEQ ID NO: 800120 - DNA, 17 bp, Homo sapiens
ttcttctcctatgtgta

SEQ ID NO: 800121 - DNA, 13 bp, Homo sapiens
ttcttctctctgt

SEQ ID NO: 800122 - DNA, 14 bp, Homo sapiens
ttcttctcttgtga

SEQ ID NO: 800123 - DNA, 14 bp, Homo sapiens
ttcttctgccactt

SEQ ID NO: 800124 - DNA, 20 bp, Homo sapiens
ttcttctgtcctgagaagca

SEQ ID NO: 800125 - DNA, 13 bp, Homo sapiens
ttcttcttcagaa

SEQ ID NO: 800126 - DNA, 14 bp, Homo sapiens
ttcttctttccctg

SEQ ID NO: 800127 - DNA, 14 bp, Homo sapiens
ttcttctttctaga

SEQ ID NO: 800128 - DNA, 20 bp, Homo sapiens
ttcttgaaaagccttggaga

SEQ ID NO: 800129 - DNA, 22 bp, Homo sapiens
ttcttgaagctgggctgtctct

SEQ ID NO: 800130 - DNA, 13 bp, Homo sapiens
ttcttgaattgtt

SEQ ID NO: 800131 - DNA, 13 bp, Homo sapiens
ttcttgacaagct

SEQ ID NO: 800132 - DNA, 19 bp, Homo sapiens
ttcttgacaagctgacttg

SEQ ID NO: 800133 - DNA, 17 bp, Homo sapiens
ttcttgatctctaatga

SEQ ID NO: 800134 - DNA, 16 bp, Homo sapiens
ttcttgatcttaaaga

SEQ ID NO: 800135 - DNA, 17 bp, Homo sapiens
ttcttgatcttaaagat

SEQ ID NO: 800136 - DNA, 14 bp, Homo sapiens
ttcttgatgtcatg

SEQ ID NO: 800137 - DNA, 14 bp, Homo sapiens
ttcttgcagattct

SEQ ID NO: 800138 - DNA, 18 bp, Homo sapiens
ttcttgccaccctctggg

SEQ ID NO: 800139 - DNA, 19 bp, Homo sapiens
ttcttgccaccctctggga

SEQ ID NO: 800140 - DNA, 17 bp, Homo sapiens
ttcttgcctctgtgctg

SEQ ID NO: 800141 - DNA, 16 bp, Homo sapiens
ttcttgctctctctcc

SEQ ID NO: 800142 - DNA, 19 bp, Homo sapiens
ttcttgctctctctccctg

SEQ ID NO: 800143 - DNA, 21 bp, Homo sapiens
ttcttgctgccatgatgtata

SEQ ID NO: 800144 - DNA, 16 bp, Homo sapiens
ttcttgctgttcagtg

SEQ ID NO: 800145 - DNA, 15 bp, Homo sapiens
ttcttgctttcaatt

SEQ ID NO: 800146 - DNA, 18 bp, Homo sapiens
ttcttggagctttggaat

SEQ ID NO: 800147 - DNA, 17 bp, Homo sapiens
ttcttggggtcccaggg

SEQ ID NO: 800148 - DNA, 16 bp, Homo sapiens
ttcttgggtagggcag

SEQ ID NO: 800149 - DNA, 19 bp, Homo sapiens
ttcttgggtggttcctaag

SEQ ID NO: 800150 - DNA, 14 bp, Homo sapiens
ttcttggtagagat

SEQ ID NO: 800151 - DNA, 16 bp, Homo sapiens
ttcttggtagagattc

SEQ ID NO: 800152 - DNA, 17 bp, Homo sapiens
ttcttggttcctgtttg

SEQ ID NO: 800153 - DNA, 15 bp, Homo sapiens
ttcttggttcttatt

SEQ ID NO: 800154 - DNA, 16 bp, Homo sapiens
ttcttggttgaggaaa

SEQ ID NO: 800155 - DNA, 15 bp, Homo sapiens
ttcttggttgttaat

SEQ ID NO: 800156 - DNA, 16 bp, Homo sapiens
ttctggttgcttcaga

SEQ ID NO: 800157 - DNA, 13 bp, Homo sapiens
ttctggttgtatt

SEQ ID NO: 800158 - DNA, 17 bp, Homo sapiens
ttctggttgtatttcta

SEQ ID NO: 800159 - DNA, 20 bp, Homo sapiens
ttctggttgtttttgttctt

SEQ ID NO: 800160 - DNA, 14 bp, Homo sapiens
ttctggtttggcat

SEQ ID NO: 800161 - DNA, 23 bp, Homo sapiens
ttctgtaaactcaaaacttaaca

SEQ ID NO: 800162 - DNA, 13 bp, Homo sapiens
ttctgtaaataac

SEQ ID NO: 800163 - DNA, 21 bp, Homo sapiens
ttctgtaatcaatatcccaac

SEQ ID NO: 800164 - DNA, 14 bp, Homo sapiens
ttctgtaattacat

SEQ ID NO: 800165 - DNA, 22 bp, Homo sapiens
ttctgtaattacatatttgact

SEQ ID NO: 800166 - DNA, 18 bp, Homo sapiens
ttctgtaatttaaaagct

SEQ ID NO: 800167 - DNA, 18 bp, Homo sapiens
ttctgtactcaaatgtag

SEQ ID NO: 800168 - DNA, 13 bp, Homo sapiens
ttctgtagattct

SEQ ID NO: 800169 - DNA, 14 bp, Homo sapiens
ttctgtagctcagt

SEQ ID NO: 800170 - DNA, 21 bp, Homo sapiens
ttctgtagtactccttaagaa

SEQ ID NO: 800171 - DNA, 21 bp, Homo sapiens
ttctgtagtttttaattaaaa

SEQ ID NO: 800172 - DNA, 13 bp, Homo sapiens
ttctgtatactgt

SEQ ID NO: 800173 - DNA, 14 bp, Homo sapiens
ttctgtatactgta

SEQ ID NO: 800174 - DNA, 19 bp, Homo sapiens
ttctgtatactgtaaaagt

SEQ ID NO: 800175 - DNA, 15 bp, Homo sapiens
ttctgtatatacttt

SEQ ID NO: 800176 - DNA, 17 bp, Homo sapiens
ttctgtatatacttttt

SEQ ID NO: 800177 - DNA, 16 bp, Homo sapiens
ttctgtatatttgtca

SEQ ID NO: 800178 - DNA, 17 bp, Homo sapiens
ttctgtatatttgtcat

SEQ ID NO: 800179 - DNA, 21 bp, Homo sapiens
ttctgtatatttgtcatgaca

SEQ ID NO: 800180 - DNA, 13 bp, Homo sapiens
ttctgtatgcatc

SEQ ID NO: 800181 - DNA, 17 bp, Homo sapiens
ttctgtatgcatcagat

SEQ ID NO: 800182 - DNA, 13 bp, Homo sapiens
ttctgtattttaa

SEQ ID NO: 800183 - DNA, 19 bp, Homo sapiens
ttctgtcagatgagaacaa

SEQ ID NO: 800184 - DNA, 17 bp, Homo sapiens
ttctgtccaccagaccc

SEQ ID NO: 800185 - DNA, 13 bp, Homo sapiens
ttctgtccccagc

SEQ ID NO: 800186 - DNA, 16 bp, Homo sapiens
ttctgtcccctcttcc

SEQ ID NO: 800187 - DNA, 11 bp, Homo sapiens
ttctgtccctg

SEQ ID NO: 800188 - DNA, 15 bp, Homo sapiens
ttctgtcctgtaact

SEQ ID NO: 800189 - DNA, 18 bp, Homo sapiens
ttctgtctactaagtgat

SEQ ID NO: 800190 - DNA, 21 bp, Homo sapiens
ttctgtctctgcctccctcac

SEQ ID NO: 800191 - DNA, 15 bp, Homo sapiens
ttctgtctgaattat

SEQ ID NO: 800192 - DNA, 17 bp, Homo sapiens
ttctgtctgaattattc

SEQ ID NO: 800193 - DNA, 14 bp, Homo sapiens
ttctgtcttcccaa

SEQ ID NO: 800194 - DNA, 20 bp, Homo sapiens
ttctgtgaaatataattgta

SEQ ID NO: 800195 - DNA, 13 bp, Homo sapiens
ttctgtgacattt

SEQ ID NO: 800196 - DNA, 14 bp, Homo sapiens
ttctgtgcctcccc

SEQ ID NO: 800197 - DNA, 21 bp, Homo sapiens
ttctgtgcctccccccagacc

SEQ ID NO: 800198 - DNA, 18 bp, Homo sapiens
ttctgtggatacagtgcc

SEQ ID NO: 800199 - DNA, 14 bp, Homo sapiens
ttctgtggctggct

SEQ ID NO: 800200 - DNA, 23 bp, Homo sapiens
ttctgtggctggctctaccttcc

SEQ ID NO: 800201 - DNA, 15 bp, Homo sapiens
ttctgtggggctggg

SEQ ID NO: 800202 - DNA, 22 bp, Homo sapiens
ttctgtggtttcatgttagtta

SEQ ID NO: 800203 - DNA, 18 bp, Homo sapiens
ttctgtggttttcccctc

SEQ ID NO: 800204 - DNA, 15 bp, Homo sapiens
ttctgtgtacttttt

SEQ ID NO: 800205 - DNA, 14 bp, Homo sapiens
ttctgtgtatctct

SEQ ID NO: 800206 - DNA, 12 bp, Homo sapiens
ttctgtgtcttt

SEQ ID NO: 800207 - DNA, 23 bp, Homo sapiens
ttctgtgtctttcacagctcctc

SEQ ID NO: 800208 - DNA, 16 bp, Homo sapiens
ttctgtgtgtcagttt

SEQ ID NO: 800209 - DNA, 21 bp, Homo sapiens
ttctgtgtgtcagttttcata

SEQ ID NO: 800210 - DNA, 13 bp, Homo sapiens
ttctgtgttcatt

SEQ ID NO: 800211 - DNA, 16 bp, Homo sapiens
ttctgtgttcattttt

SEQ ID NO: 800212 - DNA, 17 bp, Homo sapiens
ttctgttaactgaatac

SEQ ID NO: 800213 - DNA, 14 bp, Homo sapiens
ttctgttaagaaag

SEQ ID NO: 800214 - DNA, 15 bp, Homo sapiens
ttctgttattgtatt

SEQ ID NO: 800215 - DNA, 19 bp, Homo sapiens
ttctgttatttttaagctt

SEQ ID NO: 800216 - DNA, 17 bp, Homo sapiens
ttctgttccaaattcag

SEQ ID NO: 800217 - DNA, 12 bp, Homo sapiens
ttctgttcccaa

SEQ ID NO: 800218 - DNA, 16 bp, Homo sapiens
ttctgttctccctggg

SEQ ID NO: 800219 - DNA, 16 bp, Homo sapiens
ttctgttctctgctga

SEQ ID NO: 800220 - DNA, 16 bp, Homo sapiens
ttctgttctggaggaa

SEQ ID NO: 800221 - DNA, 13 bp, Homo sapiens
ttctgttctgggg

SEQ ID NO: 800222 - DNA, 14 bp, Homo sapiens
ttctgttctgttga

SEQ ID NO: 800223 - DNA, 14 bp, Homo sapiens
ttctgttgctggag

SEQ ID NO: 800224 - DNA, 16 bp, Homo sapiens
ttctgttgtaatagtc

SEQ ID NO: 800225 - DNA, 15 bp, Homo sapiens
ttctgttgttccatt

SEQ ID NO: 800226 - DNA, 18 bp, Homo sapiens
ttctgttgttccatttta

SEQ ID NO: 800227 - DNA, 18 bp, Homo sapiens
ttctgtttagataataca

SEQ ID NO: 800228 - DNA, 19 bp, Homo sapiens
ttctgtttattcttccaga

SEQ ID NO: 800229 - DNA, 17 bp, Homo sapiens
ttctgtttcaaagcaca

SEQ ID NO: 800230 - DNA, 18 bp, Homo sapiens
ttctgtttcagagcataa

SEQ ID NO: 800231 - DNA, 13 bp, Homo sapiens
ttctgtttcctct

SEQ ID NO: 800232 - DNA, 17 bp, Homo sapiens
ttctgtttcttcttgtg

SEQ ID NO: 800233 - DNA, 14 bp, Homo sapiens
ttctgtttgattct

SEQ ID NO: 800234 - DNA, 19 bp, Homo sapiens
ttctgtttgcgtacttgta

SEQ ID NO: 800235 - DNA, 19 bp, Homo sapiens
ttctgtttggcacttgtat

SEQ ID NO: 800236 - DNA, 13 bp, Homo sapiens
ttctgtttgtaaa

SEQ ID NO: 800237 - DNA, 23 bp, Homo sapiens
ttctgtttgtaaattatttgcta

SEQ ID NO: 800238 - DNA, 12 bp, Homo sapiens
ttctgtttgtta

SEQ ID NO: 800239 - DNA, 23 bp, Homo sapiens
ttctgtttgtttaagctgagcca

SEQ ID NO: 800240 - DNA, 12 bp, Homo sapiens
ttctgttttctg

SEQ ID NO: 800241 - DNA, 13 bp, Homo sapiens
ttctgttttgtta

SEQ ID NO: 800242 - DNA, 20 bp, Homo sapiens
ttctgtttttctaggcctgg

SEQ ID NO: 800243 - DNA, 16 bp, Homo sapiens
ttcttaaaaactgtgt

SEQ ID NO: 800244 - DNA, 15 bp, Homo sapiens
ttcttaaaggcctgg

SEQ ID NO: 800245 - DNA, 20 bp, Homo sapiens
ttcttaaagtgccagtattt

SEQ ID NO: 800246 - DNA, 19 bp, Homo sapiens
ttcttaaataagaaacttt

SEQ ID NO: 800247 - DNA, 12 bp, Homo sapiens
ttcttaaatatg

SEQ ID NO: 800248 - DNA, 20 bp, Homo sapiens
ttcttaaatggaattatttt

SEQ ID NO: 800249 - DNA, 15 bp, Homo sapiens
ttcttggtttgggga

SEQ ID NO: 800250 - DNA, 16 bp, Homo sapiens
ttcttggtttgtaaat

SEQ ID NO: 800251 - DNA, 18 bp, Homo sapiens
ttcttgtaaatctttttg

SEQ ID NO: 800252 - DNA, 15 bp, Homo sapiens
ttcttgtaaatgttt

SEQ ID NO: 800253 - DNA, 12 bp, Homo sapiens
ttcttgtaattt

SEQ ID NO: 800254 - DNA, 13 bp, Homo sapiens
ttcttgtcaaaaa

SEQ ID NO: 800255 - DNA, 19 bp, Homo sapiens
ttcttgtcataaaatgcat

SEQ ID NO: 800256 - DNA, 20 bp, Homo sapiens
ttcttgtccacattctactt

SEQ ID NO: 800257 - DNA, 16 bp, Homo sapiens
ttcttgtctataaagc

SEQ ID NO: 800258 - DNA, 22 bp, Homo sapiens
ttcttgtctataaagcatttaa

SEQ ID NO: 800259 - DNA, 14 bp, Homo sapiens
ttcttgtctgtgtg

SEQ ID NO: 800260 - DNA, 15 bp, Homo sapiens
ttcttgtgcatgttt

SEQ ID NO: 800261 - DNA, 14 bp, Homo sapiens
ttcttgtgcttttc

SEQ ID NO: 800262 - DNA, 18 bp, Homo sapiens
ttcttgtgtagatttgaa

SEQ ID NO: 800263 - DNA, 19 bp, Homo sapiens
ttcttgtgtagatttgaaa

SEQ ID NO: 800264 - DNA, 13 bp, Homo sapiens
ttcttgtttgaat

SEQ ID NO: 800265 - DNA, 13 bp, Homo sapiens
ttctttaaaagaa

SEQ ID NO: 800266 - DNA, 18 bp, Homo sapiens
ttctttaaaagaatgact

SEQ ID NO: 800267 - DNA, 19 bp, Homo sapiens
ttctttaaaagaatgacta

SEQ ID NO: 800268 - DNA, 23 bp, Homo sapiens
ttctttaaaataaaaaagcaaaa

SEQ ID NO: 800269 - DNA, 22 bp, Homo sapiens
ttctttaaagaagttgaagttt

SEQ ID NO: 800270 - DNA, 13 bp, Homo sapiens
ttctttaaagatg

SEQ ID NO: 800271 - DNA, 20 bp, Homo sapiens
ttctttaaagttcttctaag

SEQ ID NO: 800272 - DNA, 14 bp, Homo sapiens
ttctttaaatatga

SEQ ID NO: 800273 - DNA, 18 bp, Homo sapiens
ttgccaacttgccatgtt

SEQ ID NO: 800274 - DNA, 15 bp, Homo sapiens
ttgccaagaaaatga

SEQ ID NO: 800275 - DNA, 24 bp, Homo sapiens
ttgccaagacaaatcaacagaagc

SEQ ID NO: 800276 - DNA, 19 bp, Homo sapiens
ttgccaagctaatctgcct

SEQ ID NO: 800277 - DNA, 21 bp, Homo sapiens
ttgccaagctaatctgcctgg

SEQ ID NO: 800278 - DNA, 16 bp, Homo sapiens
ttgccaagctgaagct

SEQ ID NO: 800279 - DNA, 17 bp, Homo sapiens
ttgccaaggcaaaaaac

SEQ ID NO: 800280 - DNA, 17 bp, Homo sapiens
ttgccaaggctctcccc

SEQ ID NO: 800281 - DNA, 18 bp, Homo sapiens
ttgccaaggctctcccct

SEQ ID NO: 800282 - DNA, 21 bp, Homo sapiens
ttgccaagttgctgtcactgt

SEQ ID NO: 800283 - DNA, 22 bp, Homo sapiens
ttgccaagttgctgtcactgtt

SEQ ID NO: 800284 - DNA, 18 bp, Homo sapiens
ttgccaatagtgtcatcc

SEQ ID NO: 800285 - DNA, 14 bp, Homo sapiens
ttgccaattttcct

SEQ ID NO: 800286 - DNA, 18 bp, Homo sapiens
ttgccacagctgtatttt

SEQ ID NO: 800287 - DNA, 13 bp, Homo sapiens
ttgccacagcttt

SEQ ID NO: 800288 - DNA, 17 bp, Homo sapiens
ttgccacagtagaactg

SEQ ID NO: 800289 - DNA, 19 bp, Homo sapiens
ttgccaccactagagctga

SEQ ID NO: 800290 - DNA, 14 bp, Homo sapiens
ttgccaccaggaga

SEQ ID NO: 800291 - DNA, 16 bp, Homo sapiens
ttgccaccaggagaac

SEQ ID NO: 800292 - DNA, 15 bp, Homo sapiens
ttgccaccccaaccc

SEQ ID NO: 800293 - DNA, 14 bp, Homo sapiens
ttgccaccctctgg

SEQ ID NO: 800294 - DNA, 15 bp, Homo sapiens
ttgccaccctctggg

SEQ ID NO: 800295 - DNA, 16 bp, Homo sapiens
ttgccaccctctggga

SEQ ID NO: 800296 - DNA, 16 bp, Homo sapiens
ttgccactaattttag

SEQ ID NO: 800297 - DNA, 18 bp, Homo sapiens
ttgccactcccctaaact

SEQ ID NO: 800298 - DNA, 21 bp, Homo sapiens
ttgccactcccctaaactcca

SEQ ID NO: 800299 - DNA, 10 bp, Homo sapiens
ttgccacttg

SEQ ID NO: 800300 - DNA, 16 bp, Homo sapiens
ttgccactttgcacga

SEQ ID NO: 800301 - DNA, 21 bp, Homo sapiens
ttgccactttggcttctcctg

SEQ ID NO: 800302 - DNA, 15 bp, Homo sapiens
ttgccagaaagcata

SEQ ID NO: 800303 - DNA, 17 bp, Homo sapiens
ttgccagaaagcataaa

SEQ ID NO: 800304 - DNA, 11 bp, Homo sapiens
ttgccagagca

SEQ ID NO: 800305 - DNA, 21 bp, Homo sapiens
ttgccagcctccttgctgacc

SEQ ID NO: 800306 - DNA, 23 bp, Homo sapiens
ttgccagcctccttgctgacccc

SEQ ID NO: 800307 - DNA, 19 bp, Homo sapiens
ttgccagtattatgcatat

SEQ ID NO: 800308 - DNA, 14 bp, Homo sapiens
ttgccagttggaca

SEQ ID NO: 800309 - DNA, 22 bp, Homo sapiens
ttgccatactttgtctgaaaaa

SEQ ID NO: 800310 - DNA, 19 bp, Homo sapiens
ttgccatattttcaccatt

SEQ ID NO: 800311 - DNA, 22 bp, Homo sapiens
ttgccatcctgatggacctgcc

SEQ ID NO: 800312 - DNA, 23 bp, Homo sapiens
ttgccatctgcgtgacaataaaa

SEQ ID NO: 800313 - DNA, 14 bp, Homo sapiens
ttgccatctgtgat

SEQ ID NO: 800314 - DNA, 16 bp, Homo sapiens
ttgccatgaatttcta

SEQ ID NO: 800315 - DNA, 22 bp, Homo sapiens
ttgccatgacatttcatctggg

SEQ ID NO: 800316 - DNA, 15 bp, Homo sapiens
ttgccatgggcctgc

SEQ ID NO: 800317 - DNA, 17 bp, Homo sapiens
ttgccatgggcctgctg

SEQ ID NO: 800318 - DNA, 22 bp, Homo sapiens
ttgccattcaaggcttatttat

SEQ ID NO: 800319 - DNA, 16 bp, Homo sapiens
ttgccattgccaggag

SEQ ID NO: 800320 - DNA, 17 bp, Homo sapiens
ttgccattgccaggaga

SEQ ID NO: 800321 - DNA, 14 bp, Homo sapiens
ttgcccacaggtgc

SEQ ID NO: 800322 - DNA, 13 bp, Homo sapiens
ttgcccacccctc

SEQ ID NO: 800323 - DNA, 19 bp, Homo sapiens
ttgcccacccctcactccc

SEQ ID NO: 800324 - DNA, 12 bp, Homo sapiens
ttgcccagagat

SEQ ID NO: 800325 - DNA, 18 bp, Homo sapiens
ttgcccagagatgcctcc

SEQ ID NO: 800326 - DNA, 14 bp, Homo sapiens
ttgcccaggctgga

SEQ ID NO: 800327 - DNA, 18 bp, Homo sapiens
ttgcccagggctcagcct

SEQ ID NO: 800328 - DNA, 19 bp, Homo sapiens
ttgcccagggctcagcctg

SEQ ID NO: 800329 - DNA, 11 bp, Homo sapiens
ttgcccagtcc

SEQ ID NO: 800330 - DNA, 15 bp, Homo sapiens
ttgcccatccatctg

SEQ ID NO: 800331 - DNA, 18 bp, Homo sapiens
ttgccccagacctggaag

SEQ ID NO: 800332 - DNA, 13 bp, Homo sapiens
ttgccccagagcc

SEQ ID NO: 800333 - DNA, 18 bp, Homo sapiens
ttgccccagagccccact

SEQ ID NO: 800334 - DNA, 20 bp, Homo sapiens
ttgccccagagccccactcc

SEQ ID NO: 800335 - DNA, 18 bp, Homo sapiens
ttgccccaggactctggc

SEQ ID NO: 800336 - DNA, 20 bp, Homo sapiens
ttgccccaggactctggcac

SEQ ID NO: 800337 - DNA, 14 bp, Homo sapiens
ttgccccaggccag

SEQ ID NO: 800338 - DNA, 16 bp, Homo sapiens
ttgccccaggccaggt

SEQ ID NO: 800339 - DNA, 13 bp, Homo sapiens
ttgcccccatccc

SEQ ID NO: 800340 - DNA, 20 bp, Homo sapiens
ttgcccccatggggtccttg

SEQ ID NO: 800341 - DNA, 13 bp, Homo sapiens
ttgccccccaccc

SEQ ID NO: 800342 - DNA, 19 bp, Homo sapiens
ttgccccccaccccagcct

SEQ ID NO: 800343 - DNA, 16 bp, Homo sapiens
ttgccccccgccctca

SEQ ID NO: 800344 - DNA, 15 bp, Homo sapiens
ttgcccccttgccca

SEQ ID NO: 800345 - DNA, 17 bp, Homo sapiens
ttgcccccttgcccatc

SEQ ID NO: 800346 - DNA, 19 bp, Homo sapiens
ttgcccctttctcttttcc

SEQ ID NO: 800347 - DNA, 19 bp, Homo sapiens
ttgcccgaaactaagccag

SEQ ID NO: 800348 - DNA, 21 bp, Homo sapiens
ttgcccgaaactaagccaggc

SEQ ID NO: 800349 - DNA, 21 bp, Homo sapiens
ttgcccgcacccctccctgct

SEQ ID NO: 800350 - DNA, 16 bp, Homo sapiens
ttgcccgccagcctca

SEQ ID NO: 800351 - DNA, 23 bp, Homo sapiens
ttgcccgctcccacagcttcctg

SEQ ID NO: 800352 - DNA, 19 bp, Homo sapiens
ttgcccggattctgggagg

SEQ ID NO: 800353 - DNA, 17 bp, Homo sapiens
ttgcccgtcggccctgc

SEQ ID NO: 800354 - DNA, 20 bp, Homo sapiens
ttgcccgtcggccctgcgtc

SEQ ID NO: 800355 - DNA, 16 bp, Homo sapiens
ttgccctatgctgtgc

SEQ ID NO: 800356 - DNA, 15 bp, Homo sapiens
ttgccctccgcctgg

SEQ ID NO: 800357 - DNA, 12 bp, Homo sapiens
ttgccctcctgc

SEQ ID NO: 800358 - DNA, 12 bp, Homo sapiens
ttgccctgacct

SEQ ID NO: 800359 - DNA, 10 bp, Homo sapiens
ttgccctggt

SEQ ID NO: 800360 - DNA, 14 bp, Homo sapiens
ttgcccttccctgt

SEQ ID NO: 800361 - DNA, 17 bp, Homo sapiens
ttgcccttccctgtccc

SEQ ID NO: 800362 - DNA, 18 bp, Homo sapiens
ttgccgcgtcgccctccc

SEQ ID NO: 800363 - DNA, 18 bp, Homo sapiens
ttgccgtggcatcttaaa

SEQ ID NO: 800364 - DNA, 14 bp, Homo sapiens
ttgccgttattaaa

SEQ ID NO: 800365 - DNA, 18 bp, Homo sapiens
ttgcctaagtattccttt

SEQ ID NO: 800366 - DNA, 20 bp, Homo sapiens
ttgcctacaataaaaagaaa

SEQ ID NO: 800367 - DNA, 17 bp, Homo sapiens
ttgcctagaaatatctt

SEQ ID NO: 800368 - DNA, 23 bp, Homo sapiens
ttgcctataatacttgcaactaa

SEQ ID NO: 800369 - DNA, 15 bp, Homo sapiens
ttgcctatctttaaa

SEQ ID NO: 800370 - DNA, 21 bp, Homo sapiens
ttgcctcagtcccccaacaga

SEQ ID NO: 800371 - DNA, 21 bp, Homo sapiens
ttgcctcatttccctatcttc

SEQ ID NO: 800372 - DNA, 21 bp, Homo sapiens
ttgcctccccatttcccatct

SEQ ID NO: 800373 - DNA, 22 bp, Homo sapiens
ttgcctccccatttcccatctg

SEQ ID NO: 800374 - DNA, 14 bp, Homo sapiens
ttgcctctctcagg

SEQ ID NO: 800375 - DNA, 11 bp, Homo sapiens
ttgcctctctt

SEQ ID NO: 800376 - DNA, 17 bp, Homo sapiens
ttgcctctcttgcccct

SEQ ID NO: 800377 - DNA, 15 bp, Homo sapiens
ttgcctctgcccaac

SEQ ID NO: 800378 - DNA, 12 bp, Homo sapiens
ttgcctctgtcc

SEQ ID NO: 800379 - DNA, 23 bp, Homo sapiens
ttgcctcttctacttgtaaaatg

SEQ ID NO: 800380 - DNA, 20 bp, Homo sapiens
ttgctgccaaaaccacatgg

SEQ ID NO: 800381 - DNA, 23 bp, Homo sapiens
ttgctgccaaaaccacatgggct

SEQ ID NO: 800382 - DNA, 13 bp, Homo sapiens
ttgctgcccctgt

SEQ ID NO: 800383 - DNA, 18 bp, Homo sapiens
ttgctgcctttgtcccca

SEQ ID NO: 800384 - DNA, 19 bp, Homo sapiens
ttgctgcctttgtccccac

SEQ ID NO: 800385 - DNA, 15 bp, Homo sapiens
ttgctgcgcttgcat

SEQ ID NO: 800386 - DNA, 20 bp, Homo sapiens
ttgctgctaccgccctgggc

SEQ ID NO: 800387 - DNA, 23 bp, Homo sapiens
ttgctgctaccgccctgggctgg

SEQ ID NO: 800388 - DNA, 12 bp, Homo sapiens
ttgctgctgctt

SEQ ID NO: 800389 - DNA, 14 bp, Homo sapiens
ttgctgcttgaggc

SEQ ID NO: 800390 - DNA, 12 bp, Homo sapiens
ttgctgcttgga

SEQ ID NO: 800391 - DNA, 21 bp, Homo sapiens
ttgctggaaaccaagtcaggc

SEQ ID NO: 800392 - DNA, 21 bp, Homo sapiens
ttgctggaataagttcaaatt

SEQ ID NO: 800393 - DNA, 23 bp, Homo sapiens
ttgctggacggggactggggatg

SEQ ID NO: 800394 - DNA, 19 bp, Homo sapiens
ttgctggagggaagatctt

SEQ ID NO: 800395 - DNA, 19 bp, Homo sapiens
ttgctggaggggctgtcct

SEQ ID NO: 800396 - DNA, 15 bp, Homo sapiens
ttgctgggagctgaa

SEQ ID NO: 800397 - DNA, 23 bp, Homo sapiens
ttgctgggcatactttctctcta

SEQ ID NO: 800398 - DNA, 16 bp, Homo sapiens
ttgctggtcaggtccc

SEQ ID NO: 800399 - DNA, 20 bp, Homo sapiens
ttgctggtgtctgagcttca

SEQ ID NO: 800400 - DNA, 13 bp, Homo sapiens
ttgctgtacaaaa

SEQ ID NO: 800401 - DNA, 17 bp, Homo sapiens
ttgctgtactcttgctg

SEQ ID NO: 800402 - DNA, 12 bp, Homo sapiens
ttgctgtcactg

SEQ ID NO: 800403 - DNA, 14 bp, Homo sapiens
ttgctgtcacttct

SEQ ID NO: 800404 - DNA, 15 bp, Homo sapiens
ttgctgtcacttctt

SEQ ID NO: 800405 - DNA, 19 bp, Homo sapiens
ttgctgtccaggcagctcc

SEQ ID NO: 800406 - DNA, 15 bp, Homo sapiens
ttgctgtcctaggcc

SEQ ID NO: 800407 - DNA, 11 bp, Homo sapiens
ttgctgtctct

SEQ ID NO: 800408 - DNA, 14 bp, Homo sapiens
ttgctgtctctgct

SEQ ID NO: 800409 - DNA, 17 bp, Homo sapiens
ttgctgtcttgccccag

SEQ ID NO: 800410 - DNA, 16 bp, Homo sapiens
ttgctgtgactagata

SEQ ID NO: 800411 - DNA, 20 bp, Homo sapiens
ttgctgtgaggaatgctctg

SEQ ID NO: 800412 - DNA, 18 bp, Homo sapiens
ttgctgtgaggctgtcct

SEQ ID NO: 800413 - DNA, 20 bp, Homo sapiens
ttgctgtgaggctgtcctgt

SEQ ID NO: 800414 - DNA, 15 bp, Homo sapiens
ttgctgtgccaggag

SEQ ID NO: 800415 - DNA, 16 bp, Homo sapiens
ttgctgtgccaggagg

SEQ ID NO: 800416 - DNA, 14 bp, Homo sapiens
ttgctgtgccgtgt

SEQ ID NO: 800417 - DNA, 16 bp, Homo sapiens
ttgctgtgcctcccaa

SEQ ID NO: 800418 - DNA, 19 bp, Homo sapiens
ttgctgtgcctcccaaaat

SEQ ID NO: 800419 - DNA, 15 bp, Homo sapiens
ttgctgttactgctt

SEQ ID NO: 800420 - DNA, 13 bp, Homo sapiens
ttgctgttattat

SEQ ID NO: 800421 - DNA, 21 bp, Homo sapiens
ttgctgttattatatttgaca

SEQ ID NO: 800422 - DNA, 23 bp, Homo sapiens
ttgctgttattatatttgacatg

SEQ ID NO: 800423 - DNA, 12 bp, Homo sapiens
ttgctgttcagt

SEQ ID NO: 800424 - DNA, 21 bp, Homo sapiens
ttgctgttcagtgctttttcc

SEQ ID NO: 800425 - DNA, 12 bp, Homo sapiens
ttgctgttgaca

SEQ ID NO: 800426 - DNA, 16 bp, Homo sapiens
ttgctgttttcctccc

SEQ ID NO: 800427 - DNA, 21 bp, Homo sapiens
ttgctgttttgttctgtggtt

SEQ ID NO: 800428 - DNA, 17 bp, Homo sapiens
ttgctgtttttcttgtc

SEQ ID NO: 800429 - DNA, 14 bp, Homo sapiens
ttgcttaaaatatg

SEQ ID NO: 800430 - DNA, 15 bp, Homo sapiens
ttgcttaaaatatgt

SEQ ID NO: 800431 - DNA, 18 bp, Homo sapiens
ttgcttaaaatatgtgaa

SEQ ID NO: 800432 - DNA, 22 bp, Homo sapiens
ttgcttaaaatatgtgaagttt

SEQ ID NO: 800433 - DNA, 21 bp, Homo sapiens
ttgcttaaactaatgaacaaa

SEQ ID NO: 800434 - DNA, 23 bp, Homo sapiens
ttgcttaatttccttctgttaag

SEQ ID NO: 800435 - DNA, 18 bp, Homo sapiens
ttgcttaatttctgcctt

SEQ ID NO: 800436 - DNA, 13 bp, Homo sapiens
ttgcttacatttt

SEQ ID NO: 800437 - DNA, 15 bp, Homo sapiens
ttgcttaccttttcc

SEQ ID NO: 800438 - DNA, 18 bp, Homo sapiens
ttgcttactgatattatc

SEQ ID NO: 800439 - DNA, 16 bp, Homo sapiens
ttgcttattgtgtgtt

SEQ ID NO: 800440 - DNA, 15 bp, Homo sapiens
ttgcttattgttcca

SEQ ID NO: 800441 - DNA, 18 bp, Homo sapiens
ttgcttattgttccaaga

SEQ ID NO: 800442 - DNA, 20 bp, Homo sapiens
ttgcttattgttccaagaca

SEQ ID NO: 800443 - DNA, 15 bp, Homo sapiens
ttgcttcaattaaaa

SEQ ID NO: 800444 - DNA, 22 bp, Homo sapiens
ttgcttcaccatggccttatga

SEQ ID NO: 800445 - DNA, 21 bp, Homo sapiens
ttgcttcagtcatcagccagc

SEQ ID NO: 800446 - DNA, 13 bp, Homo sapiens
ttgcttcagtgga

SEQ ID NO: 800447 - DNA, 14 bp, Homo sapiens
ttgcttcataaatg

SEQ ID NO: 800448 - DNA, 20 bp, Homo sapiens
ttgcttcataaatgaagcag

SEQ ID NO: 800449 - DNA, 16 bp, Homo sapiens
ttgcttctaaatgccc

SEQ ID NO: 800450 - DNA, 17 bp, Homo sapiens
ttgcttctacatgatgc

SEQ ID NO: 800451 - DNA, 19 bp, Homo sapiens
ttgcttctcccatttcctg

SEQ ID NO: 800452 - DNA, 14 bp, Homo sapiens
ttgcttctgaatca

SEQ ID NO: 800453 - DNA, 17 bp, Homo sapiens
ttgcttctgaatcactg

SEQ ID NO: 800454 - DNA, 12 bp, Homo sapiens
ttgcttctgtag

SEQ ID NO: 800455 - DNA, 14 bp, Homo sapiens
ttgcttctgtagta

SEQ ID NO: 800456 - DNA, 13 bp, Homo sapiens
ttgcttctgtgta

SEQ ID NO: 800457 - DNA, 20 bp, Homo sapiens
ttgcttctttctagaaagag

SEQ ID NO: 800458 - DNA, 16 bp, Homo sapiens
ttgcttgagcccagga

SEQ ID NO: 800459 - DNA, 18 bp, Homo sapiens
ttgcttgagcccaggagt

SEQ ID NO: 800460 - DNA, 21 bp, Homo sapiens
ttgcttgagcctggctgtcca

SEQ ID NO: 800461 - DNA, 23 bp, Homo sapiens
ttgcttgcaatctaatctgaact

SEQ ID NO: 800462 - DNA, 16 bp, Homo sapiens
ttgcttgcctgatata

SEQ ID NO: 800463 - DNA, 16 bp, Homo sapiens
ttgcttggactattat

SEQ ID NO: 800464 - DNA, 15 bp, Homo sapiens
ttgcttgtattgtaa

SEQ ID NO: 800465 - DNA, 20 bp, Homo sapiens
ttgcttgtattgtaaatgtg

SEQ ID NO: 800466 - DNA, 19 bp, Homo sapiens
ttgctttaacctgaacctt

SEQ ID NO: 800467 - DNA, 21 bp, Homo sapiens
ttgctttatactgagcttttg

SEQ ID NO: 800468 - DNA, 20 bp, Homo sapiens
ttgctttatgccttcttatt

SEQ ID NO: 800469 - DNA, 12 bp, Homo sapiens
ttgctttcaatt

SEQ ID NO: 800470 - DNA, 15 bp, Homo sapiens
ttgctttctgaaatt

SEQ ID NO: 800471 - DNA, 15 bp, Homo sapiens
ttgctttctgctcag

SEQ ID NO: 800472 - DNA, 12 bp, Homo sapiens
ttgctttctggt

SEQ ID NO: 800473 - DNA, 18 bp, Homo sapiens
ttgctttcttcctgcata

SEQ ID NO: 800474 - DNA, 15 bp, Homo sapiens
ttgctttgaagcagt

SEQ ID NO: 800475 - DNA, 16 bp, Homo sapiens
ttgctttgaagcagtt

SEQ ID NO: 800476 - DNA, 21 bp, Homo sapiens
ttgctttgaagtagctctttt

SEQ ID NO: 800477 - DNA, 18 bp, Homo sapiens
ttgctttgccagagcagg

SEQ ID NO: 800478 - DNA, 13 bp, Homo sapiens
ttgctttgctgca

SEQ ID NO: 800479 - DNA, 20 bp, Homo sapiens
ttgctttgggctttgcaggc

SEQ ID NO: 800480 - DNA, 14 bp, Homo sapiens
ttgctttggggggt

SEQ ID NO: 800481 - DNA, 13 bp, Homo sapiens
ttgctttgtatgc

SEQ ID NO: 800482 - DNA, 20 bp, Homo sapiens
ttgctttgtattgtatatta

SEQ ID NO: 800483 - DNA, 14 bp, Homo sapiens
ttgctttgtctttc

SEQ ID NO: 800484 - DNA, 20 bp, Homo sapiens
ttgctttgtgatttttgtaa

SEQ ID NO: 800485 - DNA, 12 bp, Homo sapiens
ttgcttttaatt

SEQ ID NO: 800486 - DNA, 14 bp, Homo sapiens
ttgcttttaattaa

SEQ ID NO: 800487 - DNA, 16 bp, Homo sapiens
ttgcttttccctcttt

SEQ ID NO: 800488 - DNA, 14 bp, Homo sapiens
ttgcttttgcctct

SEQ ID NO: 800489 - DNA, 13 bp, Homo sapiens
ttgcttttgcttc

SEQ ID NO: 800490 - DNA, 15 bp, Homo sapiens
ttgctttttctaatg

SEQ ID NO: 800491 - DNA, 13 bp, Homo sapiens
ttgcttttttgta

SEQ ID NO: 800492 - DNA, 17 bp, Homo sapiens
ttgcttttttttccttc

SEQ ID NO: 800493 - DNA, 15 bp, Homo sapiens
ttggaaaatgtgtct

SEQ ID NO: 800494 - DNA, 20 bp, Homo sapiens
ttggaaacggtatcctccct

SEQ ID NO: 800495 - DNA, 21 bp, Homo sapiens
ttggaaagcaggtggcatctc

SEQ ID NO: 800496 - DNA, 20 bp, Homo sapiens
ttggaaagcatcacctcagg

SEQ ID NO: 800497 - DNA, 16 bp, Homo sapiens
ttggaaagctgatgat

SEQ ID NO: 800498 - DNA, 22 bp, Homo sapiens
ttggaaagtacactctgctgtt

SEQ ID NO: 800499 - DNA, 21 bp, Homo sapiens
ttggaaataaagtcagatgga

SEQ ID NO: 800500 - DNA, 23 bp, Homo sapiens
ttggaaatagaaagaagccatat

SEQ ID NO: 800501 - DNA, 22 bp, Homo sapiens
ttggaaatagaaatttccagag

SEQ ID NO: 800502 - DNA, 23 bp, Homo sapiens
ttggaaatagaaatttccagaga

SEQ ID NO: 800503 - DNA, 19 bp, Homo sapiens
ttggaaatcctagtttcct

SEQ ID NO: 800504 - DNA, 24 bp, Homo sapiens
ttggaaatcctagtttcctctcct

SEQ ID NO: 800505 - DNA, 14 bp, Homo sapiens
ttggctgtgtctaa

SEQ ID NO: 800506 - DNA, 16 bp, Homo sapiens
ttggcttaaagtgaag

SEQ ID NO: 800507 - DNA, 16 bp, Homo sapiens
ttggcttaatcatttt

SEQ ID NO: 800508 - DNA, 23 bp, Homo sapiens
ttggcttcacggaagagccttgc

SEQ ID NO: 800509 - DNA, 17 bp, Homo sapiens
ttggcttcatttcaatc

SEQ ID NO: 800510 - DNA, 17 bp, Homo sapiens
ttggcttctcagcccct

SEQ ID NO: 800511 - DNA, 14 bp, Homo sapiens
ttggcttctcctgt

SEQ ID NO: 800512 - DNA, 17 bp, Homo sapiens
ttggcttctcctgtgac

SEQ ID NO: 800513 - DNA, 18 bp, Homo sapiens
ttggcttctcctgtgacc

SEQ ID NO: 800514 - DNA, 17 bp, Homo sapiens
ttggcttcttaaaaact

SEQ ID NO: 800515 - DNA, 22 bp, Homo sapiens
ttggcttcttaaaaactgtgta

SEQ ID NO: 800516 - DNA, 13 bp, Homo sapiens
ttggcttgctgtt

SEQ ID NO: 800517 - DNA, 22 bp, Homo sapiens
ttggctttaaacacccttcaca

SEQ ID NO: 800518 - DNA, 19 bp, Homo sapiens
ttggctttcagagccagcc

SEQ ID NO: 800519 - DNA, 23 bp, Homo sapiens
ttggctttcagagccagcctggc

SEQ ID NO: 800520 - DNA, 15 bp, Homo sapiens
ttggctttcataaat

SEQ ID NO: 800521 - DNA, 15 bp, Homo sapiens
ttggctttctccctc

SEQ ID NO: 800522 - DNA, 21 bp, Homo sapiens
ttggctttgcccacccctcac

SEQ ID NO: 800523 - DNA, 16 bp, Homo sapiens
ttgggaaacttggctc

SEQ ID NO: 800524 - DNA, 10 bp, Homo sapiens
ttgggaagac

SEQ ID NO: 800525 - DNA, 15 bp, Homo sapiens
ttgggaaggacacag

SEQ ID NO: 800526 - DNA, 23 bp, Homo sapiens
ttgggaaggacacagcagtattg

SEQ ID NO: 800527 - DNA, 19 bp, Homo sapiens
ttgggaaggggtcctgcag

SEQ ID NO: 800528 - DNA, 18 bp, Homo sapiens
ttgggaatggatcctgga

SEQ ID NO: 800529 - DNA, 19 bp, Homo sapiens
ttgggacaacagtgctttg

SEQ ID NO: 800530 - DNA, 20 bp, Homo sapiens
ttgggaccagaagtgtttca

SEQ ID NO: 800531 - DNA, 21 bp, Homo sapiens
ttgggacgtgtacagcacaga

SEQ ID NO: 800532 - DNA, 19 bp, Homo sapiens
ttgggagacaattagcaga

SEQ ID NO: 800533 - DNA, 19 bp, Homo sapiens
ttgggagacatggaccagc

SEQ ID NO: 800534 - DNA, 19 bp, Homo sapiens
ttgggagagcaggaatgaa

SEQ ID NO: 800535 - DNA, 22 bp, Homo sapiens
ttgggagcaaactagtagagtt

SEQ ID NO: 800536 - DNA, 15 bp, Homo sapiens
ttgggagcactggag

SEQ ID NO: 800537 - DNA, 19 bp, Homo sapiens
ttgggagcttgggaatgga

SEQ ID NO: 800538 - DNA, 15 bp, Homo sapiens
ttgggaggccaaggc

SEQ ID NO: 800539 - DNA, 12 bp, Homo sapiens
ttgggaggctga

SEQ ID NO: 800540 - DNA, 11 bp, Homo sapiens
ttgggaggtgc

SEQ ID NO: 800541 - DNA, 12 bp, Homo sapiens
ttgggagtccag

SEQ ID NO: 800542 - DNA, 17 bp, Homo sapiens
ttgggataagagtgtga

SEQ ID NO: 800543 - DNA, 22 bp, Homo sapiens
ttgggatgttccttttttcaat

SEQ ID NO: 800544 - DNA, 16 bp, Homo sapiens
ttgggattcctgaccc

SEQ ID NO: 800545 - DNA, 21 bp, Homo sapiens
ttgggattcctgacccaggcc

SEQ ID NO: 800546 - DNA, 14 bp, Homo sapiens
ttgggatttgctgt

SEQ ID NO: 800547 - DNA, 17 bp, Homo sapiens
ttgggcacagtccagac

SEQ ID NO: 800548 - DNA, 19 bp, Homo sapiens
ttgggcagaagggagaagg

SEQ ID NO: 800549 - DNA, 20 bp, Homo sapiens
ttgggcagaagggagaagga

SEQ ID NO: 800550 - DNA, 22 bp, Homo sapiens
ttgggcagagctggctctgagc

SEQ ID NO: 800551 - DNA, 19 bp, Homo sapiens
ttgggcagcaatttaaatg

SEQ ID NO: 800552 - DNA, 23 bp, Homo sapiens
ttgggcagccagaccagcaggct

SEQ ID NO: 800553 - DNA, 13 bp, Homo sapiens
ttgggcagccagg

SEQ ID NO: 800554 - DNA, 17 bp, Homo sapiens
ttgggcaggcagagagt

SEQ ID NO: 800555 - DNA, 17 bp, Homo sapiens
ttgggcagtgccccagg

SEQ ID NO: 800556 - DNA, 16 bp, Homo sapiens
ttgggcatccacccag

SEQ ID NO: 800557 - DNA, 20 bp, Homo sapiens
ttgggcatttatattccact

SEQ ID NO: 800558 - DNA, 22 bp, Homo sapiens
ttgggccaaatccgctctcttc

SEQ ID NO: 800559 - DNA, 14 bp, Homo sapiens
ttgggccataatta

SEQ ID NO: 800560 - DNA, 21 bp, Homo sapiens
ttgggccataattatgaaaac

SEQ ID NO: 800561 - DNA, 19 bp, Homo sapiens
ttgggcccaagaactgcag

SEQ ID NO: 800562 - DNA, 12 bp, Homo sapiens
ttgggcccagct

SEQ ID NO: 800563 - DNA, 17 bp, Homo sapiens
ttgggcccagctgggct

SEQ ID NO: 800564 - DNA, 18 bp, Homo sapiens
ttgggcccctcagagccc

SEQ ID NO: 800565 - DNA, 12 bp, Homo sapiens
ttgggccctcct

SEQ ID NO: 800566 - DNA, 11 bp, Homo sapiens
ttgggccctgg

SEQ ID NO: 800567 - DNA, 15 bp, Homo sapiens
ttgggccgaaagaga

SEQ ID NO: 800568 - DNA, 23 bp, Homo sapiens
ttgggccggtgctgggggcacag

SEQ ID NO: 800569 - DNA, 15 bp, Homo sapiens
ttgggcctccatgcc

SEQ ID NO: 800570 - DNA, 14 bp, Homo sapiens
ttgggcctctcctg

SEQ ID NO: 800571 - DNA, 16 bp, Homo sapiens
ttgggcctctcctgcc

SEQ ID NO: 800572 - DNA, 17 bp, Homo sapiens
ttgggcgatttgggggc

SEQ ID NO: 800573 - DNA, 17 bp, Homo sapiens
ttgggcgtctcccccag

SEQ ID NO: 800574 - DNA, 20 bp, Homo sapiens
ttgggctaccctaaagggag

SEQ ID NO: 800575 - DNA, 19 bp, Homo sapiens
ttgggctactggcagctcc

SEQ ID NO: 800576 - DNA, 15 bp, Homo sapiens
ttgggctcctggctg

SEQ ID NO: 800577 - DNA, 16 bp, Homo sapiens
ttgggctcctttttct

SEQ ID NO: 800578 - DNA, 16 bp, Homo sapiens
ttgggctgacacctac

SEQ ID NO: 800579 - DNA, 23 bp, Homo sapiens
ttgggctgacacctaccatgctg

SEQ ID NO: 800580 - DNA, 14 bp, Homo sapiens
ttgggctgacccag

SEQ ID NO: 800581 - DNA, 13 bp, Homo sapiens
ttgggctgagact

SEQ ID NO: 800582 - DNA, 17 bp, Homo sapiens
ttgggctgagtgcagcc

SEQ ID NO: 800583 - DNA, 14 bp, Homo sapiens
ttgggctggtcaga

SEQ ID NO: 800584 - DNA, 14 bp, Homo sapiens
ttgggcttcttcct

SEQ ID NO: 800585 - DNA, 18 bp, Homo sapiens
ttgggctttgcaggctct

SEQ ID NO: 800586 - DNA, 19 bp, Homo sapiens
ttgggctttgcaggctctg

SEQ ID NO: 800587 - DNA, 22 bp, Homo sapiens
ttggggagacttggggccagcg

SEQ ID NO: 800588 - DNA, 22 bp, Homo sapiens
ttggggaggagggggccgggcg

SEQ ID NO: 800589 - DNA, 12 bp, Homo sapiens
ttggggaggcaa

SEQ ID NO: 800590 - DNA, 14 bp, Homo sapiens
ttggggagggaggg

SEQ ID NO: 800591 - DNA, 14 bp, Homo sapiens
ttggggatattttt

SEQ ID NO: 800592 - DNA, 15 bp, Homo sapiens
ttggggcaaaaatcc

SEQ ID NO: 800593 - DNA, 16 bp, Homo sapiens
ttggggcatcctggat

SEQ ID NO: 800594 - DNA, 13 bp, Homo sapiens
ttggggccctctt

SEQ ID NO: 800595 - DNA, 22 bp, Homo sapiens
ttggggccctcttgccagcctc

SEQ ID NO: 800596 - DNA, 12 bp, Homo sapiens
ttggggcctggc

SEQ ID NO: 800597 - DNA, 14 bp, Homo sapiens
ttggggcctggctt

SEQ ID NO: 800598 - DNA, 15 bp, Homo sapiens
ttggggcctggcttg

SEQ ID NO: 800599 - DNA, 16 bp, Homo sapiens
ttggggctatttgtgt

SEQ ID NO: 800600 - DNA, 15 bp, Homo sapiens
ttgggggaaccagca

SEQ ID NO: 800601 - DNA, 16 bp, Homo sapiens
ttgggggaatgcacct

SEQ ID NO: 800602 - DNA, 16 bp, Homo sapiens
ttgggggctggtgcca

SEQ ID NO: 800603 - DNA, 19 bp, Homo sapiens
ttggggggaaagagggagc

SEQ ID NO: 800604 - DNA, 20 bp, Homo sapiens
ttggggggaaagagggagca

SEQ ID NO: 800605 - DNA, 22 bp, Homo sapiens
ttggggggaaagagggagcaac

SEQ ID NO: 800606 - DNA, 12 bp, Homo sapiens
ttggggggagag

SEQ ID NO: 800607 - DNA, 20 bp, Homo sapiens
ttgggggggtggccgctgag

SEQ ID NO: 800608 - DNA, 17 bp, Homo sapiens
ttggggggtgtgctgac

SEQ ID NO: 800609 - DNA, 15 bp, Homo sapiens
ttgggggtttttaat

SEQ ID NO: 800610 - DNA, 19 bp, Homo sapiens
ttggggtactcttgatgtg

SEQ ID NO: 800611 - DNA, 21 bp, Homo sapiens
ttggggtataggtctcatctc

SEQ ID NO: 800612 - DNA, 15 bp, Homo sapiens
ttggggtcccaggga

SEQ ID NO: 800613 - DNA, 22 bp, Homo sapiens
ttggggtccctcaggttccttt

SEQ ID NO: 800614 - DNA, 14 bp, Homo sapiens
ttggggtctgaccc

SEQ ID NO: 800615 - DNA, 13 bp, Homo sapiens
ttggggtgataag

SEQ ID NO: 800616 - DNA, 18 bp, Homo sapiens
ttggggtggttgaggcta

SEQ ID NO: 800617 - DNA, 19 bp, Homo sapiens
ttggggttctacagtcgta

SEQ ID NO: 800618 - DNA, 22 bp, Homo sapiens
ttggggttttttttttctgaat

SEQ ID NO: 800619 - DNA, 17 bp, Homo sapiens
ttgggtaaaatactttt

SEQ ID NO: 800620 - DNA, 21 bp, Homo sapiens
ttgggtatcctgcccagtgtt

SEQ ID NO: 800621 - DNA, 16 bp, Homo sapiens
ttgggtcaaggacagg

SEQ ID NO: 800622 - DNA, 17 bp, Homo sapiens
ttgggtccattcagatg

SEQ ID NO: 800623 - DNA, 19 bp, Homo sapiens
ttgggtgtaacaggtctcc

SEQ ID NO: 800624 - DNA, 16 bp, Homo sapiens
ttggagctgaagacct

SEQ ID NO: 800625 - DNA, 20 bp, Homo sapiens
ttggagctttggaatatttt

SEQ ID NO: 800626 - DNA, 21 bp, Homo sapiens
ttggaggcaatcctaccttgc

SEQ ID NO: 800627 - DNA, 11 bp, Homo sapiens
ttggagggaga

SEQ ID NO: 800628 - DNA, 19 bp, Homo sapiens
ttggaggggaaatggggaa

SEQ ID NO: 800629 - DNA, 20 bp, Homo sapiens
ttggaggggaaatggggaaa

SEQ ID NO: 800630 - DNA, 23 bp, Homo sapiens
ttggagggtgggagagcccagcc

SEQ ID NO: 800631 - DNA, 15 bp, Homo sapiens
ttggagtcactgcca

SEQ ID NO: 800632 - DNA, 20 bp, Homo sapiens
ttggagtgagtgtggctccc

SEQ ID NO: 800633 - DNA, 22 bp, Homo sapiens
ttggagtgagtgtggctcccct

SEQ ID NO: 800634 - DNA, 16 bp, Homo sapiens
ttggagtgttatgtat

SEQ ID NO: 800635 - DNA, 14 bp, Homo sapiens
ttggagtgtttcta

SEQ ID NO: 800636 - DNA, 13 bp, Homo sapiens
ttggagttaaaat

SEQ ID NO: 800637 - DNA, 12 bp, Homo sapiens
ttggataagtag

SEQ ID NO: 800638 - DNA, 18 bp, Homo sapiens
ttggataataggaattca

SEQ ID NO: 800639 - DNA, 13 bp, Homo sapiens
ttggatacatctg

SEQ ID NO: 800640 - DNA, 19 bp, Homo sapiens
ttggatacatctgctgtgt

SEQ ID NO: 800641 - DNA, 23 bp, Homo sapiens
ttggatacatctgctgtgtggaa

SEQ ID NO: 800642 - DNA, 19 bp, Homo sapiens
ttggatatgtaaaacattt

SEQ ID NO: 800643 - DNA, 13 bp, Homo sapiens
ttggatatttttg

SEQ ID NO: 800644 - DNA, 19 bp, Homo sapiens
ttggatatttttgtacttg

SEQ ID NO: 800645 - DNA, 19 bp, Homo sapiens
ttggatattttttacttta

SEQ ID NO: 800646 - DNA, 20 bp, Homo sapiens
ttggatgggagtgagacaga

SEQ ID NO: 800647 - DNA, 12 bp, Homo sapiens
ttggatgtctgt

SEQ ID NO: 800648 - DNA, 16 bp, Homo sapiens
ttggattaaatacata

SEQ ID NO: 800649 - DNA, 21 bp, Homo sapiens
ttggattaaatacatatggat

SEQ ID NO: 800650 - DNA, 20 bp, Homo sapiens
ttggattaaattctgggtga

SEQ ID NO: 800651 - DNA, 14 bp, Homo sapiens
ttggattgtatatt

SEQ ID NO: 800652 - DNA, 19 bp, Homo sapiens
ttggatttaaaagcctgct

SEQ ID NO: 800653 - DNA, 16 bp, Homo sapiens
ttggatttagtttcag

SEQ ID NO: 800654 - DNA, 18 bp, Homo sapiens
ttggatttttgtcttgtg

SEQ ID NO: 800655 - DNA, 17 bp, Homo sapiens
ttggcaaaaaggcagga

SEQ ID NO: 800656 - DNA, 16 bp, Homo sapiens
ttggcaaattcctagt

SEQ ID NO: 800657 - DNA, 17 bp, Homo sapiens
ttggcaagatgaaataa

SEQ ID NO: 800658 - DNA, 20 bp, Homo sapiens
ttggcaatagtttgcataga

SEQ ID NO: 800659 - DNA, 14 bp, Homo sapiens
ttggcaatgctaat

SEQ ID NO: 800660 - DNA, 15 bp, Homo sapiens
ttggcaatgctaatt

SEQ ID NO: 800661 - DNA, 19 bp, Homo sapiens
ttggcaatgggccgtcccc

SEQ ID NO: 800662 - DNA, 12 bp, Homo sapiens
ttggcaattttg

SEQ ID NO: 800663 - DNA, 18 bp, Homo sapiens
ttggcacccccatgctgc

SEQ ID NO: 800664 - DNA, 14 bp, Homo sapiens
ttggcactcacaga

SEQ ID NO: 800665 - DNA, 19 bp, Homo sapiens
ttggcactggatggacttg

SEQ ID NO: 800666 - DNA, 13 bp, Homo sapiens
ttggcagagaagg

SEQ ID NO: 800667 - DNA, 11 bp, Homo sapiens
ttggcagctct

SEQ ID NO: 800668 - DNA, 11 bp, Homo sapiens
ttggcagctga

SEQ ID NO: 800669 - DNA, 12 bp, Homo sapiens
ttggcagctgac

SEQ ID NO: 800670 - DNA, 13 bp, Homo sapiens
ttggcaggcccac

SEQ ID NO: 800671 - DNA, 19 bp, Homo sapiens
ttggcagtggactcagaaa

SEQ ID NO: 800672 - DNA, 12 bp, Homo sapiens
ttggcagtgttt

SEQ ID NO: 800673 - DNA, 14 bp, Homo sapiens
ttggcatctgtgtg

SEQ ID NO: 800674 - DNA, 16 bp, Homo sapiens
ttggcatggaaattta

SEQ ID NO: 800675 - DNA, 22 bp, Homo sapiens
ttggcatggaaatttaaagcag

SEQ ID NO: 800676 - DNA, 18 bp, Homo sapiens
ttgtgttttaaaaaaact

SEQ ID NO: 800677 - DNA, 20 bp, Homo sapiens
ttgttaaaactggcatctga

SEQ ID NO: 800678 - DNA, 21 bp, Homo sapiens
ttgttaaagctggaacatttg

SEQ ID NO: 800679 - DNA, 15 bp, Homo sapiens
ttgttaaattacatt

SEQ ID NO: 800680 - DNA, 18 bp, Homo sapiens
ttgttaaattacattttt

SEQ ID NO: 800681 - DNA, 19 bp, Homo sapiens
ttgttaacagtatttctct

SEQ ID NO: 800682 - DNA, 22 bp, Homo sapiens
ttgttaagtctaaatatttcct

SEQ ID NO: 800683 - DNA, 23 bp, Homo sapiens
ttgttaatataccccaaattgtg

SEQ ID NO: 800684 - DNA, 18 bp, Homo sapiens
ttgttaatatcactcatt

SEQ ID NO: 800685 - DNA, 21 bp, Homo sapiens
ttgttaatattaaaaagtctg

SEQ ID NO: 800686 - DNA, 17 bp, Homo sapiens
ttgttaatattcatttt

SEQ ID NO: 800687 - DNA, 20 bp, Homo sapiens
ttgttaatgctctatgtttg

SEQ ID NO: 800688 - DNA, 22 bp, Homo sapiens
ttgttaatgctctatgtttgta

SEQ ID NO: 800689 - DNA, 13 bp, Homo sapiens
ttgttaatgtcat

SEQ ID NO: 800690 - DNA, 17 bp, Homo sapiens
ttgttaatgtgatggat

SEQ ID NO: 800691 - DNA, 15 bp, Homo sapiens
ttgttacaggaagtc

SEQ ID NO: 800692 - DNA, 21 bp, Homo sapiens
ttgttacaggcaccgagaatg

SEQ ID NO: 800693 - DNA, 17 bp, Homo sapiens
ttgttactaactaaact

SEQ ID NO: 800694 - DNA, 18 bp, Homo sapiens
ttgttactgattcaatta

SEQ ID NO: 800695 - DNA, 24 bp, Homo sapiens
ttgttactgctgattcttgtaaat

SEQ ID NO: 800696 - DNA, 22 bp, Homo sapiens
ttgttagaaaacaaaattttat

SEQ ID NO: 800697 - DNA, 12 bp, Homo sapiens
ttgttagatgtt

SEQ ID NO: 800698 - DNA, 19 bp, Homo sapiens
ttgttaggaaaaaattgaa

SEQ ID NO: 800699 - DNA, 17 bp, Homo sapiens
ttgttagtttagtgtgt

SEQ ID NO: 800700 - DNA, 14 bp, Homo sapiens
ttgttataaagaca

SEQ ID NO: 800701 - DNA, 12 bp, Homo sapiens
ttgttataaata

SEQ ID NO: 800702 - DNA, 19 bp, Homo sapiens
ttgttatattataattgga

SEQ ID NO: 800703 - DNA, 22 bp, Homo sapiens
ttgttatcagtcaatattttta

SEQ ID NO: 800704 - DNA, 20 bp, Homo sapiens
ttgttatcctcttgtatact

SEQ ID NO: 800705 - DNA, 14 bp, Homo sapiens
ttgttatggcttaa

SEQ ID NO: 800706 - DNA, 16 bp, Homo sapiens
ttgttatgtacaaact

SEQ ID NO: 800707 - DNA, 15 bp, Homo sapiens
ttgttattgaagtgt

SEQ ID NO: 800708 - DNA, 23 bp, Homo sapiens
ttgttattgggcaagtgattgaa

SEQ ID NO: 800709 - DNA, 11 bp, Homo sapiens
ttgttattgtg

SEQ ID NO: 800710 - DNA, 17 bp, Homo sapiens
ttgttattgtggaagat

SEQ ID NO: 800711 - DNA, 23 bp, Homo sapiens
ttgttatttgaaaacatgtttat

SEQ ID NO: 800712 - DNA, 22 bp, Homo sapiens
ttgttattttgcaacctcgctg

SEQ ID NO: 800713 - DNA, 13 bp, Homo sapiens
ttgttcaagtttt

SEQ ID NO: 800714 - DNA, 16 bp, Homo sapiens
ttgttcaatgttccat

SEQ ID NO: 800715 - DNA, 18 bp, Homo sapiens
ttgttcacttaaattctt

SEQ ID NO: 800716 - DNA, 15 bp, Homo sapiens
ttgttcatagcccag

SEQ ID NO: 800717 - DNA, 15 bp, Homo sapiens
ttgttcatctgtaac

SEQ ID NO: 800718 - DNA, 17 bp, Homo sapiens
ttgttcattttgagtat

SEQ ID NO: 800719 - DNA, 17 bp, Homo sapiens
ttgttccaagacattgt

SEQ ID NO: 800720 - DNA, 21 bp, Homo sapiens
ttgttccaagacattgtcaat

SEQ ID NO: 800721 - DNA, 21 bp, Homo sapiens
ttgttccacaagttaaataaa

SEQ ID NO: 800722 - DNA, 12 bp, Homo sapiens
ttgttccagctc

SEQ ID NO: 800723 - DNA, 17 bp, Homo sapiens
ttgttccattttatgca

SEQ ID NO: 800724 - DNA, 22 bp, Homo sapiens
ttgttcccgatggtctctctcc

SEQ ID NO: 800725 - DNA, 13 bp, Homo sapiens
ttgttcctggagt

SEQ ID NO: 800726 - DNA, 22 bp, Homo sapiens
ttgttctagacttccccatccc

SEQ ID NO: 800727 - DNA, 16 bp, Homo sapiens
ttgttctatttttcaa

SEQ ID NO: 800728 - DNA, 17 bp, Homo sapiens
ttgttctatttttcaat

SEQ ID NO: 800729 - DNA, 20 bp, Homo sapiens
ttgttctctgaattttcaga

SEQ ID NO: 800730 - DNA, 14 bp, Homo sapiens
ttgttctctggaac

SEQ ID NO: 800731 - DNA, 20 bp, Homo sapiens
ttgttctctgggagaaaatc

SEQ ID NO: 800732 - DNA, 13 bp, Homo sapiens
ttgttctcttctg

SEQ ID NO: 800733 - DNA, 23 bp, Homo sapiens
ttgttctgaaatgtcagttctga

SEQ ID NO: 800734 - DNA, 16 bp, Homo sapiens
ttgttctgcctggaga

SEQ ID NO: 800735 - DNA, 23 bp, Homo sapiens
ttgttctgctacccactgccaga

SEQ ID NO: 800736 - DNA, 18 bp, Homo sapiens
ttgttctgtggtcacagt

SEQ ID NO: 800737 - DNA, 19 bp, Homo sapiens
ttgttctgttttgtgagaa

SEQ ID NO: 800738 - DNA, 11 bp, Homo sapiens
ttgttcttggt

SEQ ID NO: 800739 - DNA, 19 bp, Homo sapiens
ttgttcttggtttgtaaat

SEQ ID NO: 800740 - DNA, 20 bp, Homo sapiens
ttgttcttggtttgtaaatt

SEQ ID NO: 800741 - DNA, 19 bp, Homo sapiens
ttgttgaagtttgaaccac

SEQ ID NO: 800742 - DNA, 17 bp, Homo sapiens
ttgttgacattctgaat

SEQ ID NO: 800743 - DNA, 20 bp, Homo sapiens
ttgttgacattctgaatgct

SEQ ID NO: 800744 - DNA, 21 bp, Homo sapiens
ttgttgacccttttttgaacc

SEQ ID NO: 800745 - DNA, 24 bp, Homo sapiens
ttgttgactgtgattagatcacat

SEQ ID NO: 800746 - DNA, 17 bp, Homo sapiens
ttgttgacttattttct

SEQ ID NO: 800747 - DNA, 22 bp, Homo sapiens
ttgttgaggtggtctgaatgtt

SEQ ID NO: 800748 - DNA, 15 bp, Homo sapiens
ttgttgattaatttg

SEQ ID NO: 800749 - DNA, 19 bp, Homo sapiens
ttgttgattaatttgagaa

SEQ ID NO: 800750 - DNA, 12 bp, Homo sapiens
ttgttgcactgc

SEQ ID NO: 800751 - DNA, 14 bp, Homo sapiens
ttgttgcactgccc

SEQ ID NO: 800752 - DNA, 12 bp, Homo sapiens
ttgttgccaact

SEQ ID NO: 800753 - DNA, 20 bp, Homo sapiens
ttgttgccccattcctaaga

SEQ ID NO: 800754 - DNA, 12 bp, Homo sapiens
ttgttgcctttt

SEQ ID NO: 800755 - DNA, 21 bp, Homo sapiens
ttgttggaaaagaatacagaa

SEQ ID NO: 800756 - DNA, 15 bp, Homo sapiens
ttgttggagtattta

SEQ ID NO: 800757 - DNA, 16 bp, Homo sapiens
ttgttggcatagctct

SEQ ID NO: 800758 - DNA, 12 bp, Homo sapiens
ttgttggcctcc

SEQ ID NO: 800759 - DNA, 22 bp, Homo sapiens
ttgttggtacctttctagcctt

SEQ ID NO: 800760 - DNA, 21 bp, Homo sapiens
ttgttgtaaaacaaaatttga

SEQ ID NO: 800761 - DNA, 15 bp, Homo sapiens
ttgttgtaacctgct

SEQ ID NO: 800762 - DNA, 18 bp, Homo sapiens
ttgttgtaacctgctgtg

SEQ ID NO: 800763 - DNA, 16 bp, Homo sapiens
ttgttgtcattgtcca

SEQ ID NO: 800764 - DNA, 21 bp, Homo sapiens
ttgttgtccttgccccactcc

SEQ ID NO: 800765 - DNA, 12 bp, Homo sapiens
ttgttgtctcca

SEQ ID NO: 800766 - DNA, 20 bp, Homo sapiens
ttgttgtgacacatcaagct

SEQ ID NO: 800767 - DNA, 14 bp, Homo sapiens
ttgttgtgttctgt

SEQ ID NO: 800768 - DNA, 21 bp, Homo sapiens
ttgttgttaatgaaaatgtca

SEQ ID NO: 800769 - DNA, 21 bp, Homo sapiens
tttaaaagttttgaaggaaac

SEQ ID NO: 800770 - DNA, 16 bp, Homo sapiens
tttaaaataaaatgaa

SEQ ID NO: 800771 - DNA, 17 bp, Homo sapiens
tttaaaataaaatgaaa

SEQ ID NO: 800772 - DNA, 19 bp, Homo sapiens
tttaaaataagctttctca

SEQ ID NO: 800773 - DNA, 22 bp, Homo sapiens
tttaaaataaggataataatca

SEQ ID NO: 800774 - DNA, 16 bp, Homo sapiens
tttaaaataagtctga

SEQ ID NO: 800775 - DNA, 17 bp, Homo sapiens
tttaaaataagttaaag

SEQ ID NO: 800776 - DNA, 17 bp, Homo sapiens
tttaaaatacttattaa

SEQ ID NO: 800777 - DNA, 23 bp, Homo sapiens
tttaaaatagaaattttgtaaga

SEQ ID NO: 800778 - DNA, 12 bp, Homo sapiens
tttaaaatagca

SEQ ID NO: 800779 - DNA, 23 bp, Homo sapiens
tttaaaatatatgtctatataca

SEQ ID NO: 800780 - DNA, 17 bp, Homo sapiens
tttaaaatatcctgtaa

SEQ ID NO: 800781 - DNA, 19 bp, Homo sapiens
tttaaaatatcctgtaact

SEQ ID NO: 800782 - DNA, 20 bp, Homo sapiens
tttaaaatatttgtctttaa

SEQ ID NO: 800783 - DNA, 15 bp, Homo sapiens
tttaaaatcaactta

SEQ ID NO: 800784 - DNA, 18 bp, Homo sapiens
tttaaaatctcctaaatg

SEQ ID NO: 800785 - DNA, 15 bp, Homo sapiens
tttaaaatctgtcac

SEQ ID NO: 800786 - DNA, 14 bp, Homo sapiens
tttaaaatgattag

SEQ ID NO: 800787 - DNA, 21 bp, Homo sapiens
tttaaaatgcaggtgaacttt

SEQ ID NO: 800788 - DNA, 11 bp, Homo sapiens
tttaaaatgcg

SEQ ID NO: 800789 - DNA, 13 bp, Homo sapiens
tttaaaatgcgaa

SEQ ID NO: 800790 - DNA, 20 bp, Homo sapiens
tttaaaatgcgaaattattg

SEQ ID NO: 800791 - DNA, 15 bp, Homo sapiens
tttaaaatgctgctt

SEQ ID NO: 800792 - DNA, 13 bp, Homo sapiens
tttaaaattcagt

SEQ ID NO: 800793 - DNA, 18 bp, Homo sapiens
tttaaaattgctatgtta

SEQ ID NO: 800794 - DNA, 23 bp, Homo sapiens
tttaaaattgctatgttactatt

SEQ ID NO: 800795 - DNA, 21 bp, Homo sapiens
tttaaaattttggaatatttg

SEQ ID NO: 800796 - DNA, 12 bp, Homo sapiens
tttaaacaaatt

SEQ ID NO: 800797 - DNA, 14 bp, Homo sapiens
tttaaacaatcttt

SEQ ID NO: 800798 - DNA, 13 bp, Homo sapiens
tttaaacacacag

SEQ ID NO: 800799 - DNA, 13 bp, Homo sapiens
tttaaacatatcc

SEQ ID NO: 800800 - DNA, 12 bp, Homo sapiens
tttaaacatcta

SEQ ID NO: 800801 - DNA, 20 bp, Homo sapiens
tttaaacatggttacaatca

SEQ ID NO: 800802 - DNA, 17 bp, Homo sapiens
tttaaacccaagtgctg

SEQ ID NO: 800803 - DNA, 16 bp, Homo sapiens
tttaaacctttcataa

SEQ ID NO: 800804 - DNA, 20 bp, Homo sapiens
tttaaactaaattactgttt

SEQ ID NO: 800805 - DNA, 19 bp, Homo sapiens
tttaaactacatcttgaaa

SEQ ID NO: 800806 - DNA, 21 bp, Homo sapiens
tttaaactaccctccagagtg

SEQ ID NO: 800807 - DNA, 15 bp, Homo sapiens
tttaaactataagca

SEQ ID NO: 800808 - DNA, 13 bp, Homo sapiens
tttaaactctgcc

SEQ ID NO: 800809 - DNA, 13 bp, Homo sapiens
tttaaactgtaca

SEQ ID NO: 800810 - DNA, 18 bp, Homo sapiens
tttaaactgtacagtgtc

SEQ ID NO: 800811 - DNA, 17 bp, Homo sapiens
tttaaacttgaaatata

SEQ ID NO: 800812 - DNA, 11 bp, Homo sapiens
tttaaactttc

SEQ ID NO: 800813 - DNA, 14 bp, Homo sapiens
tttaaactttttaa

SEQ ID NO: 800814 - DNA, 18 bp, Homo sapiens
tttaaagaaaagatgaaa

SEQ ID NO: 800815 - DNA, 13 bp, Homo sapiens
tttaaagaaagtg

SEQ ID NO: 800816 - DNA, 13 bp, Homo sapiens
tttaaagaataaa

SEQ ID NO: 800817 - DNA, 14 bp, Homo sapiens
tttaaagaataaag

SEQ ID NO: 800818 - DNA, 18 bp, Homo sapiens
tttaaagaatatgacttt

SEQ ID NO: 800819 - DNA, 10 bp, Homo sapiens
tttaaagaca

SEQ ID NO: 800820 - DNA, 16 bp, Homo sapiens
tttaaagactgtgaaa

SEQ ID NO: 800821 - DNA, 16 bp, Homo sapiens
tttaaagcaggttctt

SEQ ID NO: 800822 - DNA, 19 bp, Homo sapiens
tttaaagcaggttcttgtt

SEQ ID NO: 800823 - DNA, 22 bp, Homo sapiens
tttaaagctgagagaccctggc

SEQ ID NO: 800824 - DNA, 21 bp, Homo sapiens
tttaaaggaaaaaatgttgga

SEQ ID NO: 800825 - DNA, 16 bp, Homo sapiens
tttaaaggaaacacta

SEQ ID NO: 800826 - DNA, 17 bp, Homo sapiens
tttaaaggaatgtgaaa

SEQ ID NO: 800827 - DNA, 18 bp, Homo sapiens
tttaaaggcattagagtc

SEQ ID NO: 800828 - DNA, 18 bp, Homo sapiens
tttaaagtaaattattaa

SEQ ID NO: 800829 - DNA, 23 bp, Homo sapiens
tttaaagtatgaatctatgccaa

SEQ ID NO: 800830 - DNA, 18 bp, Homo sapiens
tttaaagtctcagtttct

SEQ ID NO: 800831 - DNA, 22 bp, Homo sapiens
tttaaagttagtatcttttgat

SEQ ID NO: 800832 - DNA, 21 bp, Homo sapiens
tttaaagttcttattttagta

SEQ ID NO: 800833 - DNA, 18 bp, Homo sapiens
tttaaagtttggtattgt

SEQ ID NO: 800834 - DNA, 15 bp, Homo sapiens
tttaaataaaagcac

SEQ ID NO: 800835 - DNA, 12 bp, Homo sapiens
tttaaataaaat

SEQ ID NO: 800836 - DNA, 14 bp, Homo sapiens
tttaaataaaccta

SEQ ID NO: 800837 - DNA, 21 bp, Homo sapiens
tttaaataaagtatcatgcat

SEQ ID NO: 800838 - DNA, 22 bp, Homo sapiens
tttaaataaagtatcatgcatt

SEQ ID NO: 800839 - DNA, 17 bp, Homo sapiens
tttaaataatagacata

SEQ ID NO: 800840 - DNA, 20 bp, Homo sapiens
tttaaatacgcactacatgt

SEQ ID NO: 800841 - DNA, 13 bp, Homo sapiens
tttaaatagccta

SEQ ID NO: 800842 - DNA, 17 bp, Homo sapiens
tttaaatataaatgttt

SEQ ID NO: 800843 - DNA, 16 bp, Homo sapiens
tttaaatatatatttt

SEQ ID NO: 800844 - DNA, 13 bp, Homo sapiens
tttaaatcaagga

SEQ ID NO: 800845 - DNA, 15 bp, Homo sapiens
tttaaatcaaggaaa

SEQ ID NO: 800846 - DNA, 18 bp, Homo sapiens
tttaaatcaaggaaaggc

SEQ ID NO: 800847 - DNA, 14 bp, Homo sapiens
tttaaatcattaga

SEQ ID NO: 800848 - DNA, 19 bp, Homo sapiens
tttaaatctaaatctattt

SEQ ID NO: 800849 - DNA, 22 bp, Homo sapiens
tttaaatctaaatctatttatt

SEQ ID NO: 800850 - DNA, 12 bp, Homo sapiens
tttaaatctgtt

SEQ ID NO: 800851 - DNA, 20 bp, Homo sapiens
tttaaatctgtttttctaac

SEQ ID NO: 800852 - DNA, 12 bp, Homo sapiens
tttaaatgaaag

SEQ ID NO: 800853 - DNA, 15 bp, Homo sapiens
tttaaatgattccaa

SEQ ID NO: 800854 - DNA, 17 bp, Homo sapiens
tttaaatgattccaaat

SEQ ID NO: 800855 - DNA, 11 bp, Homo sapiens
tttaaatgcac

SEQ ID NO: 800856 - DNA, 18 bp, Homo sapiens
tttaaatgccaaaatgta

SEQ ID NO: 800857 - DNA, 15 bp, Homo sapiens
tttaaatgtaaagat

SEQ ID NO: 800858 - DNA, 18 bp, Homo sapiens
tttaaatgtaaagatatt

SEQ ID NO: 800859 - DNA, 11 bp, Homo sapiens
tttaaatgtac

SEQ ID NO: 800860 - DNA, 20 bp, Homo sapiens
tttaaatgtacagacatatt

SEQ ID NO: 800861 - DNA, 12 bp, Homo sapiens
tttaaatgtata

SEQ ID NO: 800862 - DNA, 11 bp, Homo sapiens
tttaaatgtga

SEQ ID NO: 800863 - DNA, 17 bp, Homo sapiens
tttaaatgtgaattttt

SEQ ID NO: 800864 - DNA, 14 bp, Homo sapiens
tttaaatgtgtaca

SEQ ID NO: 800865 - DNA, 18 bp, Homo sapiens
tttaaatgtgtacaatgt

SEQ ID NO: 800866 - DNA, 19 bp, Homo sapiens
tttaaattaagtcattttg

SEQ ID NO: 800867 - DNA, 15 bp, Homo sapiens
tttaaattagaaaat

SEQ ID NO: 800868 - DNA, 19 bp, Homo sapiens
tttaaattatactgtagct

SEQ ID NO: 800869 - DNA, 18 bp, Homo sapiens
tttaaattccactgaaaa

SEQ ID NO: 800870 - DNA, 19 bp, Homo sapiens
tttaaattccactgaaaat

SEQ ID NO: 800871 - DNA, 20 bp, Homo sapiens
tttaaattgtaaattttaga

SEQ ID NO: 800872 - DNA, 11 bp, Homo sapiens
tttaaattgtg

SEQ ID NO: 800873 - DNA, 12 bp, Homo sapiens
tttaaattgtgt

SEQ ID NO: 800874 - DNA, 14 bp, Homo sapiens
tttaaattgtttca

SEQ ID NO: 800875 - DNA, 11 bp, Homo sapiens
tttaaatttgg

SEQ ID NO: 800876 - DNA, 22 bp, Homo sapiens
tttaaattttaccctttagact

SEQ ID NO: 800877 - DNA, 16 bp, Homo sapiens
tttaaatttttatttt

SEQ ID NO: 800878 - DNA, 18 bp, Homo sapiens
tttaaatttttttcctta

SEQ ID NO: 800879 - DNA, 12 bp, Homo sapiens
tttaacaaaaaa

SEQ ID NO: 800880 - DNA, 18 bp, Homo sapiens
tttaacaaaaagtgcttc

SEQ ID NO: 800881 - DNA, 19 bp, Homo sapiens
tttaacaaaaagtgcttca

SEQ ID NO: 800882 - DNA, 16 bp, Homo sapiens
tttaacaaaagcaaga

SEQ ID NO: 800883 - DNA, 14 bp, Homo sapiens
tttaacaaatctaa

SEQ ID NO: 800884 - DNA, 17 bp, Homo sapiens
tttaacaaatctaatct

SEQ ID NO: 800885 - DNA, 23 bp, Homo sapiens
tttaacaaatctaatctcttatt

SEQ ID NO: 800886 - DNA, 18 bp, Homo sapiens
tttaacaattgtcttaaa

SEQ ID NO: 800887 - DNA, 18 bp, Homo sapiens
tttaacacattctttata

SEQ ID NO: 800888 - DNA, 21 bp, Homo sapiens
tttaacaccttttttgtgggg

SEQ ID NO: 800889 - DNA, 20 bp, Homo sapiens
tttaacacttaaatttcttg

SEQ ID NO: 800890 - DNA, 14 bp, Homo sapiens
tttaacactttgta

SEQ ID NO: 800891 - DNA, 18 bp, Homo sapiens
tttacattgtcctgtagc

SEQ ID NO: 800892 - DNA, 16 bp, Homo sapiens
tttacattgttgagct

SEQ ID NO: 800893 - DNA, 10 bp, Homo sapiens
tttacatttc

SEQ ID NO: 800894 - DNA, 22 bp, Homo sapiens
tttacattttatatttttgtac

SEQ ID NO: 800895 - DNA, 20 bp, Homo sapiens
tttaccaaagagatattgat

SEQ ID NO: 800896 - DNA, 17 bp, Homo sapiens
tttaccaaattgcttga

SEQ ID NO: 800897 - DNA, 18 bp, Homo sapiens
tttaccaagagtaacttt

SEQ ID NO: 800898 - DNA, 17 bp, Homo sapiens
tttaccagttgcctttt

SEQ ID NO: 800899 - DNA, 20 bp, Homo sapiens
tttaccatgcccctgagcaa

SEQ ID NO: 800900 - DNA, 14 bp, Homo sapiens
tttaccatttgtaa

SEQ ID NO: 800901 - DNA, 16 bp, Homo sapiens
tttaccatttgtaata

SEQ ID NO: 800902 - DNA, 13 bp, Homo sapiens
tttaccctcttgg

SEQ ID NO: 800903 - DNA, 13 bp, Homo sapiens
tttaccctgtgtc

SEQ ID NO: 800904 - DNA, 22 bp, Homo sapiens
tttaccctttggccccactttg

SEQ ID NO: 800905 - DNA, 15 bp, Homo sapiens
tttacctaagattac

SEQ ID NO: 800906 - DNA, 23 bp, Homo sapiens
tttacctaagtgttgattgtgcc

SEQ ID NO: 800907 - DNA, 22 bp, Homo sapiens
tttacctagctggtagcataaa

SEQ ID NO: 800908 - DNA, 13 bp, Homo sapiens
tttacctataaaa

SEQ ID NO: 800909 - DNA, 22 bp, Homo sapiens
tttacctcatccatgcacttta

SEQ ID NO: 800910 - DNA, 16 bp, Homo sapiens
tttacctctctctggg

SEQ ID NO: 800911 - DNA, 13 bp, Homo sapiens
tttacctgagacc

SEQ ID NO: 800912 - DNA, 17 bp, Homo sapiens
tttacctggtactaaac

SEQ ID NO: 800913 - DNA, 16 bp, Homo sapiens
tttacctgtgaaatag

SEQ ID NO: 800914 - DNA, 21 bp, Homo sapiens
tttacctgtgcgttactaatt

SEQ ID NO: 800915 - DNA, 23 bp, Homo sapiens
tttacctgttctgaaatgttctt

SEQ ID NO: 800916 - DNA, 13 bp, Homo sapiens
tttacctgtttaa

SEQ ID NO: 800917 - DNA, 13 bp, Homo sapiens
tttaccttgaaaa

SEQ ID NO: 800918 - DNA, 13 bp, Homo sapiens
tttacctttatct

SEQ ID NO: 800919 - DNA, 17 bp, Homo sapiens
tttacctttcagtgcag

SEQ ID NO: 800920 - DNA, 13 bp, Homo sapiens
tttacgctttgat

SEQ ID NO: 800921 - DNA, 18 bp, Homo sapiens
tttacgctttgattcata

SEQ ID NO: 800922 - DNA, 17 bp, Homo sapiens
tttacgtactgtaactg

SEQ ID NO: 800923 - DNA, 15 bp, Homo sapiens
tttacgtgcaaacaa

SEQ ID NO: 800924 - DNA, 14 bp, Homo sapiens
tttacgttcatcac

SEQ ID NO: 800925 - DNA, 17 bp, Homo sapiens
tttactaaagaaagatt

SEQ ID NO: 800926 - DNA, 11 bp, Homo sapiens
tttactactgt

SEQ ID NO: 800927 - DNA, 18 bp, Homo sapiens
tttactactgtggaaaga

SEQ ID NO: 800928 - DNA, 17 bp, Homo sapiens
tttactatcattctcag

SEQ ID NO: 800929 - DNA, 13 bp, Homo sapiens
tttactcattatc

SEQ ID NO: 800930 - DNA, 12 bp, Homo sapiens
tttactcccctt

SEQ ID NO: 800931 - DNA, 19 bp, Homo sapiens
tttactcccttcctggcct

SEQ ID NO: 800932 - DNA, 17 bp, Homo sapiens
tttactccgtaacagat

SEQ ID NO: 800933 - DNA, 18 bp, Homo sapiens
tttactctgacttcccca

SEQ ID NO: 800934 - DNA, 17 bp, Homo sapiens
tttactctggtaggaat

SEQ ID NO: 800935 - DNA, 13 bp, Homo sapiens
tttactctgtgta

SEQ ID NO: 800936 - DNA, 14 bp, Homo sapiens
tttactctgtgtaa

SEQ ID NO: 800937 - DNA, 15 bp, Homo sapiens
tttactcttaaatca

SEQ ID NO: 800938 - DNA, 13 bp, Homo sapiens
tttactcttatga

SEQ ID NO: 800939 - DNA, 14 bp, Homo sapiens
tttactgagcttct

SEQ ID NO: 800940 - DNA, 17 bp, Homo sapiens
tttactgagcttctctg

SEQ ID NO: 800941 - DNA, 22 bp, Homo sapiens
tttactgccaaagggaaatatc

SEQ ID NO: 800942 - DNA, 22 bp, Homo sapiens
tttactgcctgaataaagagcc

SEQ ID NO: 800943 - DNA, 12 bp, Homo sapiens
tttactgcctgt

SEQ ID NO: 800944 - DNA, 13 bp, Homo sapiens
tttactgcctgta

SEQ ID NO: 800945 - DNA, 19 bp, Homo sapiens
tttactgccttcctcctta

SEQ ID NO: 800946 - DNA, 21 bp, Homo sapiens
tttactgctctagaaagtata

SEQ ID NO: 800947 - DNA, 19 bp, Homo sapiens
tttactggacaaagaattc

SEQ ID NO: 800948 - DNA, 19 bp, Homo sapiens
tttactggccatacaaaat

SEQ ID NO: 800949 - DNA, 14 bp, Homo sapiens
tttactgttagaat

SEQ ID NO: 800950 - DNA, 22 bp, Homo sapiens
tttactgtttgatataccaaat

SEQ ID NO: 800951 - DNA, 11 bp, Homo sapiens
tttacttaaac

SEQ ID NO: 800952 - DNA, 16 bp, Homo sapiens
tttacttatcttatgc

SEQ ID NO: 800953 - DNA, 23 bp, Homo sapiens
tttacttcaatgggctcttccaa

SEQ ID NO: 800954 - DNA, 16 bp, Homo sapiens
tttacttcacttcaaa

SEQ ID NO: 800955 - DNA, 14 bp, Homo sapiens
tttacttcttatac

SEQ ID NO: 800956 - DNA, 19 bp, Homo sapiens
tttacttcttatacatttg

SEQ ID NO: 800957 - DNA, 18 bp, Homo sapiens
tttacttgaatagtattg

SEQ ID NO: 800958 - DNA, 21 bp, Homo sapiens
tttacttgcattgaatatatt

SEQ ID NO: 800959 - DNA, 20 bp, Homo sapiens
tttacttgtggtgtgaccat

SEQ ID NO: 800960 - DNA, 16 bp, Homo sapiens
tttactttcccttgct

SEQ ID NO: 800961 - DNA, 15 bp, Homo sapiens
tttacttttaaacag

SEQ ID NO: 800962 - DNA, 23 bp, Homo sapiens
tttactttttttctgtgacattt

SEQ ID NO: 800963 - DNA, 15 bp, Homo sapiens
tttagaaaaaaaact

SEQ ID NO: 800964 - DNA, 23 bp, Homo sapiens
tttagaaaaacatttaaactttt

SEQ ID NO: 800965 - DNA, 12 bp, Homo sapiens
tttagaaaactt

SEQ ID NO: 800966 - DNA, 13 bp, Homo sapiens
tttagaaaacttt

SEQ ID NO: 800967 - DNA, 15 bp, Homo sapiens
tttagaaaactttaa

SEQ ID NO: 800968 - DNA, 16 bp, Homo sapiens
tttagaaaactttaaa

SEQ ID NO: 800969 - DNA, 11 bp, Homo sapiens
tttagaaaata

SEQ ID NO: 800970 - DNA, 20 bp, Homo sapiens
tttagaaatactgcaagaaa

SEQ ID NO: 800971 - DNA, 16 bp, Homo sapiens
tttagaaatcattttg

SEQ ID NO: 800972 - DNA, 18 bp, Homo sapiens
tttagaaatcattttgca

SEQ ID NO: 800973 - DNA, 15 bp, Homo sapiens
tttagaaatgcatat

SEQ ID NO: 800974 - DNA, 13 bp, Homo sapiens
tttagaacagagg

SEQ ID NO: 800975 - DNA, 19 bp, Homo sapiens
tttagaagatattatttgt

SEQ ID NO: 800976 - DNA, 20 bp, Homo sapiens
tttagaagcaaagatttcag

SEQ ID NO: 800977 - DNA, 22 bp, Homo sapiens
tttagaagccaactatgattat

SEQ ID NO: 800978 - DNA, 14 bp, Homo sapiens
tttagaagcctgca

SEQ ID NO: 800979 - DNA, 17 bp, Homo sapiens
tttagaagtgagagaaa

SEQ ID NO: 800980 - DNA, 15 bp, Homo sapiens
tttagaataagaatt

SEQ ID NO: 800981 - DNA, 21 bp, Homo sapiens
tttagaataagaatttgcata

SEQ ID NO: 800982 - DNA, 11 bp, Homo sapiens
tttagaataat

SEQ ID NO: 800983 - DNA, 12 bp, Homo sapiens
tttagaatatct

SEQ ID NO: 800984 - DNA, 19 bp, Homo sapiens
tttagaatcttttaaatac

SEQ ID NO: 800985 - DNA, 14 bp, Homo sapiens
tttagacaactaga

SEQ ID NO: 800986 - DNA, 15 bp, Homo sapiens
tttagacaactagat

SEQ ID NO: 800987 - DNA, 11 bp, Homo sapiens
tttagacagta

SEQ ID NO: 800988 - DNA, 19 bp, Homo sapiens
tttagaccctattgctgct

SEQ ID NO: 800989 - DNA, 15 bp, Homo sapiens
tttagactgtagcct

SEQ ID NO: 800990 - DNA, 15 bp, Homo sapiens
tttagacttcaagca

SEQ ID NO: 800991 - DNA, 21 bp, Homo sapiens
tttagacttggattctttcca

SEQ ID NO: 800992 - DNA, 18 bp, Homo sapiens
tttagagaactgtggccg

SEQ ID NO: 800993 - DNA, 21 bp, Homo sapiens
tttagagccattagagcacag

SEQ ID NO: 800994 - DNA, 19 bp, Homo sapiens
tttagagcgtttggttaaa

SEQ ID NO: 800995 - DNA, 18 bp, Homo sapiens
tttagaggcattgttagt

SEQ ID NO: 800996 - DNA, 12 bp, Homo sapiens
tttagagtattt

SEQ ID NO: 800997 - DNA, 19 bp, Homo sapiens
tttagagtcaatttgctga

SEQ ID NO: 800998 - DNA, 15 bp, Homo sapiens
tttagataatttgaa

SEQ ID NO: 800999 - DNA, 18 bp, Homo sapiens
tttagatagccctgtcct

SEQ ID NO: 801000 - DNA, 15 bp, Homo sapiens
tttagatatctagac

SEQ ID NO: 801001 - DNA, 16 bp, Homo sapiens
tttagatcaaatactt

SEQ ID NO: 801002 - DNA, 17 bp, Homo sapiens
tttagatcaaatacttt

SEQ ID NO: 801003 - DNA, 21 bp, Homo sapiens
tttagatcccatgtcacctca

SEQ ID NO: 801004 - DNA, 13 bp, Homo sapiens
tttagatgctgat

SEQ ID NO: 801005 - DNA, 17 bp, Homo sapiens
tttagatgtaattttgt

SEQ ID NO: 801006 - DNA, 17 bp, Homo sapiens
tttagattggttctgtt

SEQ ID NO: 801007 - DNA, 22 bp, Homo sapiens
tttagattttcttttttatctt

SEQ ID NO: 801008 - DNA, 13 bp, Homo sapiens
tttagcaccccca

SEQ ID NO: 801009 - DNA, 22 bp, Homo sapiens
tttagcagcagcctttaatgca

SEQ ID NO: 801010 - DNA, 14 bp, Homo sapiens
tttagcagttctgc

SEQ ID NO: 801011 - DNA, 15 bp, Homo sapiens
tttagcagttctgca

SEQ ID NO: 801012 - DNA, 23 bp, Homo sapiens
tttagcagttctgcaaatagaaa

SEQ ID NO: 801013 - DNA, 22 bp, Homo sapiens
tttagcatgttcctccttttct

SEQ ID NO: 801014 - DNA, 18 bp, Homo sapiens
tttagccaaacccttgtc

SEQ ID NO: 801015 - DNA, 17 bp, Homo sapiens
tttagcccagtgttttc

SEQ ID NO: 801016 - DNA, 22 bp, Homo sapiens
tttagcccagtgttttctttga

SEQ ID NO: 801017 - DNA, 16 bp, Homo sapiens
tttagccctttaaaac

SEQ ID NO: 801018 - DNA, 20 bp, Homo sapiens
tttagcgcacccagagaaaa

SEQ ID NO: 801019 - DNA, 16 bp, Homo sapiens
tttagcgggactcagt

SEQ ID NO: 801020 - DNA, 19 bp, Homo sapiens
tttagctaccaacggccag

SEQ ID NO: 801021 - DNA, 18 bp, Homo sapiens
tttagctagtatcttcaa

SEQ ID NO: 801022 - DNA, 13 bp, Homo sapiens
tttagctggtgtc

SEQ ID NO: 801023 - DNA, 22 bp, Homo sapiens
tttagctggtgtcagcccctct

SEQ ID NO: 801024 - DNA, 14 bp, Homo sapiens
tttagcttcagttg

SEQ ID NO: 801025 - DNA, 17 bp, Homo sapiens
tttagcttcctccagag

SEQ ID NO: 801026 - DNA, 15 bp, Homo sapiens
tttagctttgtgttt

SEQ ID NO: 801027 - DNA, 13 bp, Homo sapiens
tttagcttttcct

SEQ ID NO: 801028 - DNA, 14 bp, Homo sapiens
tttagcttttttat

SEQ ID NO: 801029 - DNA, 22 bp, Homo sapiens
tttaggaaaatcactttgtcta

SEQ ID NO: 801030 - DNA, 12 bp, Homo sapiens
tttaggaaacac

SEQ ID NO: 801031 - DNA, 21 bp, Homo sapiens
tttaggaaacaccattataaa

SEQ ID NO: 801032 - DNA, 19 bp, Homo sapiens
tttaggaataataaattca

SEQ ID NO: 801033 - DNA, 16 bp, Homo sapiens
tttaggaatatgttca

SEQ ID NO: 801034 - DNA, 13 bp, Homo sapiens
tttaggagatttt

SEQ ID NO: 801035 - DNA, 20 bp, Homo sapiens
tttaggcactcttaaatgat

SEQ ID NO: 801036 - DNA, 22 bp, Homo sapiens
tttaggcactcttaaatgatct

SEQ ID NO: 801037 - DNA, 18 bp, Homo sapiens
tttaggcctcatttcttt

SEQ ID NO: 801038 - DNA, 17 bp, Homo sapiens
tttagggaacaatttgg

SEQ ID NO: 801039 - DNA, 13 bp, Homo sapiens
tttagggaagcag

SEQ ID NO: 801040 - DNA, 20 bp, Homo sapiens
tttagggagcagatgactga

SEQ ID NO: 801041 - DNA, 15 bp, Homo sapiens
tttagggcagcttgc

SEQ ID NO: 801042 - DNA, 14 bp, Homo sapiens
tttagggccaggca

SEQ ID NO: 801043 - DNA, 17 bp, Homo sapiens
tttagggttctgcctct

SEQ ID NO: 801044 - DNA, 17 bp, Homo sapiens
tttagtaaatgttatct

SEQ ID NO: 801045 - DNA, 18 bp, Homo sapiens
tttagtaatattttactt

SEQ ID NO: 801046 - DNA, 15 bp, Homo sapiens
tttagtaatttccta

SEQ ID NO: 801047 - DNA, 13 bp, Homo sapiens
tttagtaatttct

SEQ ID NO: 801048 - DNA, 15 bp, Homo sapiens
tttagtaatttcttt

SEQ ID NO: 801049 - DNA, 13 bp, Homo sapiens
tttagtattcatt

SEQ ID NO: 801050 - DNA, 15 bp, Homo sapiens
tttagtattcattct

SEQ ID NO: 801051 - DNA, 21 bp, Homo sapiens
tttagtccacggacccccaga

SEQ ID NO: 801052 - DNA, 18 bp, Homo sapiens
tttagtctgcaaaatgag

SEQ ID NO: 801053 - DNA, 18 bp, Homo sapiens
tttagtcttgatgtggaa

SEQ ID NO: 801054 - DNA, 17 bp, Homo sapiens
tttagtgaaacataata

SEQ ID NO: 801055 - DNA, 17 bp, Homo sapiens
tttagtgctttgtgata

SEQ ID NO: 801056 - DNA, 15 bp, Homo sapiens
tttagtgtgaatatt

SEQ ID NO: 801057 - DNA, 18 bp, Homo sapiens
tttagtgtttatgtttaa

SEQ ID NO: 801058 - DNA, 16 bp, Homo sapiens
tttagttacgtataat

SEQ ID NO: 801059 - DNA, 15 bp, Homo sapiens
tttagttatagtttc

SEQ ID NO: 801060 - DNA, 23 bp, Homo sapiens
tttagttcaatatttgttactgt

SEQ ID NO: 801061 - DNA, 15 bp, Homo sapiens
tttagttccacaaat

SEQ ID NO: 801062 - DNA, 17 bp, Homo sapiens
tttagttgtatctcttt

SEQ ID NO: 801063 - DNA, 18 bp, Homo sapiens
tttagttttacattttaa

SEQ ID NO: 801064 - DNA, 13 bp, Homo sapiens
tttagttttctct

SEQ ID NO: 801065 - DNA, 16 bp, Homo sapiens
tttataaaaatataaa

SEQ ID NO: 801066 - DNA, 22 bp, Homo sapiens
tttataaaacaatgacttttaa

SEQ ID NO: 801067 - DNA, 19 bp, Homo sapiens
tttataaactaggtaaaat

SEQ ID NO: 801068 - DNA, 17 bp, Homo sapiens
tttataaactgagaggt

SEQ ID NO: 801069 - DNA, 16 bp, Homo sapiens
tttataaactttacct

SEQ ID NO: 801070 - DNA, 21 bp, Homo sapiens
tttataaagcaaattactcca

SEQ ID NO: 801071 - DNA, 12 bp, Homo sapiens
tttataaagcag

SEQ ID NO: 801072 - DNA, 13 bp, Homo sapiens
tttataaaggtct

SEQ ID NO: 801073 - DNA, 24 bp, Homo sapiens
tttataaagtacccatctagtact

SEQ ID NO: 801074 - DNA, 21 bp, Homo sapiens
tttataaatatattcaggagt

SEQ ID NO: 801075 - DNA, 13 bp, Homo sapiens
tttataaatgcta

SEQ ID NO: 801076 - DNA, 14 bp, Homo sapiens
tttataaatgctat

SEQ ID NO: 801077 - DNA, 15 bp, Homo sapiens
tttataaatgctatt

SEQ ID NO: 801078 - DNA, 16 bp, Homo sapiens
tttataaatgctattt

SEQ ID NO: 801079 - DNA, 15 bp, Homo sapiens
tttataaattaaata

SEQ ID NO: 801080 - DNA, 15 bp, Homo sapiens
tttataaattactat

SEQ ID NO: 801081 - DNA, 14 bp, Homo sapiens
tttataactaacat

SEQ ID NO: 801082 - DNA, 18 bp, Homo sapiens
tttataactcatcataaa

SEQ ID NO: 801083 - DNA, 19 bp, Homo sapiens
tttataactcatcataaaa

SEQ ID NO: 801084 - DNA, 22 bp, Homo sapiens
tttataactcatcataaaataa

SEQ ID NO: 801085 - DNA, 12 bp, Homo sapiens
tttataagaaaa

SEQ ID NO: 801086 - DNA, 20 bp, Homo sapiens
tttataagcagatttaacaa

SEQ ID NO: 801087 - DNA, 21 bp, Homo sapiens
tttataagcatttgtattatt

SEQ ID NO: 801088 - DNA, 17 bp, Homo sapiens
tttataagtcattgtat

SEQ ID NO: 801089 - DNA, 14 bp, Homo sapiens
tttataataaaaat

SEQ ID NO: 801090 - DNA, 21 bp, Homo sapiens
tttataatacagaatcttgtt

SEQ ID NO: 801091 - DNA, 20 bp, Homo sapiens
tttataataggaatttgtat

SEQ ID NO: 801092 - DNA, 15 bp, Homo sapiens
tttataatctgaaga

SEQ ID NO: 801093 - DNA, 13 bp, Homo sapiens
tttataatgattc

SEQ ID NO: 801094 - DNA, 13 bp, Homo sapiens
tttataatgtatt

SEQ ID NO: 801095 - DNA, 20 bp, Homo sapiens
tttataattctcattaaaag

SEQ ID NO: 801096 - DNA, 22 bp, Homo sapiens
tttataattggtgctatttgaa

SEQ ID NO: 801097 - DNA, 21 bp, Homo sapiens
tttataatttaataaaaagga

SEQ ID NO: 801098 - DNA, 15 bp, Homo sapiens
tttatacaaattaga

SEQ ID NO: 801099 - DNA, 18 bp, Homo sapiens
tttatacaatggaataaa

SEQ ID NO: 801100 - DNA, 23 bp, Homo sapiens
tttatacaatggaataaattatg

SEQ ID NO: 801101 - DNA, 21 bp, Homo sapiens
tttatacacaactttgcaaat

SEQ ID NO: 801102 - DNA, 16 bp, Homo sapiens
tttatacaccagcaat

SEQ ID NO: 801103 - DNA, 19 bp, Homo sapiens
tttatacacttctggctca

SEQ ID NO: 801104 - DNA, 21 bp, Homo sapiens
tttatacacttggatttcatt

SEQ ID NO: 801105 - DNA, 12 bp, Homo sapiens
tttatacagctg

SEQ ID NO: 801106 - DNA, 21 bp, Homo sapiens
tttatacagctgtattgtctg

SEQ ID NO: 801107 - DNA, 18 bp, Homo sapiens
tttatactctttctgtat

SEQ ID NO: 801108 - DNA, 16 bp, Homo sapiens
tttatactgtttactg

SEQ ID NO: 801109 - DNA, 22 bp, Homo sapiens
tttatacttgagaccaactttt

SEQ ID NO: 801110 - DNA, 13 bp, Homo sapiens
tttatactttatt

SEQ ID NO: 801111 - DNA, 23 bp, Homo sapiens
tttatagaaggaatttgtacttc

SEQ ID NO: 801112 - DNA, 16 bp, Homo sapiens
tttatagacattatgt

SEQ ID NO: 801113 - DNA, 18 bp, Homo sapiens
tttatagcaacaacaatt

SEQ ID NO: 801114 - DNA, 23 bp, Homo sapiens
tttatagcaagatattgatcaaa

SEQ ID NO: 801115 - DNA, 17 bp, Homo sapiens
tttatagctattactgt

SEQ ID NO: 801116 - DNA, 17 bp, Homo sapiens
tttatagtatgtgactt

SEQ ID NO: 801117 - DNA, 22 bp, Homo sapiens
tttatagtatgtgacttttctg

SEQ ID NO: 801118 - DNA, 17 bp, Homo sapiens
tttatagtttgtacatg

SEQ ID NO: 801119 - DNA, 12 bp, Homo sapiens
tttatataaaaa

SEQ ID NO: 801120 - DNA, 17 bp, Homo sapiens
tttatataaagtattct

SEQ ID NO: 801121 - DNA, 22 bp, Homo sapiens
tttatataaataaatgtttcta

SEQ ID NO: 801122 - DNA, 12 bp, Homo sapiens
tttatataataa

SEQ ID NO: 801123 - DNA, 14 bp, Homo sapiens
tttatatacttttt

SEQ ID NO: 801124 - DNA, 19 bp, Homo sapiens
tttatatagtctacagttg

SEQ ID NO: 801125 - DNA, 15 bp, Homo sapiens
tttatatatacagta

SEQ ID NO: 801126 - DNA, 21 bp, Homo sapiens
tttatatatacagtaacttta

SEQ ID NO: 801127 - DNA, 19 bp, Homo sapiens
tttatatatatatgtatat

SEQ ID NO: 801128 - DNA, 20 bp, Homo sapiens
tttatatatatatgtatatg

SEQ ID NO: 801129 - DNA, 16 bp, Homo sapiens
tttatatatgaagttg

SEQ ID NO: 801130 - DNA, 15 bp, Homo sapiens
tttatatatggcata

SEQ ID NO: 801131 - DNA, 21 bp, Homo sapiens
tttatatattgaaagttgctt

SEQ ID NO: 801132 - DNA, 12 bp, Homo sapiens
tttatatattta

SEQ ID NO: 801133 - DNA, 13 bp, Homo sapiens
tttatatatttat

SEQ ID NO: 801134 - DNA, 15 bp, Homo sapiens
tttatatatttataa

SEQ ID NO: 801135 - DNA, 12 bp, Homo sapiens
tttatatcaaat

SEQ ID NO: 801136 - DNA, 12 bp, Homo sapiens
tttatatctaat

SEQ ID NO: 801137 - DNA, 17 bp, Homo sapiens
tttatatcttgtttaca

SEQ ID NO: 801138 - DNA, 18 bp, Homo sapiens
tttatatcttgtttacaa

SEQ ID NO: 801139 - DNA, 14 bp, Homo sapiens
tttatatgaagaaa

SEQ ID NO: 801140 - DNA, 21 bp, Homo sapiens
tttatatgaagaaaatcactt

SEQ ID NO: 801141 - DNA, 20 bp, Homo sapiens
tttatatgcttactgatata

SEQ ID NO: 801142 - DNA, 16 bp, Homo sapiens
tttatatgtaaatgtg

SEQ ID NO: 801143 - DNA, 17 bp, Homo sapiens
tttatatgtacatgaga

SEQ ID NO: 801144 - DNA, 14 bp, Homo sapiens
tttatatgtcaaag

SEQ ID NO: 801145 - DNA, 16 bp, Homo sapiens
tttatattaatgtact

SEQ ID NO: 801146 - DNA, 19 bp, Homo sapiens
tttatattacttttgtaaa

SEQ ID NO: 801147 - DNA, 22 bp, Homo sapiens
tttatattacttttgtaaatat

SEQ ID NO: 801148 - DNA, 23 bp, Homo sapiens
tttatattataactctgtataat

SEQ ID NO: 801149 - DNA, 14 bp, Homo sapiens
tttatattatccat

SEQ ID NO: 801150 - DNA, 22 bp, Homo sapiens
tttatattatccataggtttct

SEQ ID NO: 801151 - DNA, 21 bp, Homo sapiens
tttatattctaagccagtttt

SEQ ID NO: 801152 - DNA, 21 bp, Homo sapiens
tttatattctaatagtttttc

SEQ ID NO: 801153 - DNA, 19 bp, Homo sapiens
tttatattgtaaatattgt

SEQ ID NO: 801154 - DNA, 15 bp, Homo sapiens
tttatattgtatatt

SEQ ID NO: 801155 - DNA, 19 bp, Homo sapiens
tttatattgtggaataaat

SEQ ID NO: 801156 - DNA, 12 bp, Homo sapiens
tttatatttaaa

SEQ ID NO: 801157 - DNA, 14 bp, Homo sapiens
tttatatttagtta

SEQ ID NO: 801158 - DNA, 13 bp, Homo sapiens
tttatatttcctt

SEQ ID NO: 801159 - DNA, 23 bp, Homo sapiens
tttatatttttgtacatattgtt

SEQ ID NO: 801160 - DNA, 22 bp, Homo sapiens
tttatcaaacagaattttaaag

SEQ ID NO: 801161 - DNA, 22 bp, Homo sapiens
tttatcaaaccctagccttgct

SEQ ID NO: 801162 - DNA, 15 bp, Homo sapiens
tttatcacacttctg

SEQ ID NO: 801163 - DNA, 13 bp, Homo sapiens
tttatcacttaaa

SEQ ID NO: 801164 - DNA, 14 bp, Homo sapiens
tttatcagaattct

SEQ ID NO: 801165 - DNA, 16 bp, Homo sapiens
tttatcagatacatca

SEQ ID NO: 801166 - DNA, 16 bp, Homo sapiens
tttatcatgcatgtcc

SEQ ID NO: 801167 - DNA, 14 bp, Homo sapiens
tttatcattcaagt

SEQ ID NO: 801168 - DNA, 15 bp, Homo sapiens
tttatcattcaagtg

SEQ ID NO: 801169 - DNA, 17 bp, Homo sapiens
tttatcattcaagtgta

SEQ ID NO: 801170 - DNA, 12 bp, Homo sapiens
tttatcattttc

SEQ ID NO: 801171 - DNA, 20 bp, Homo sapiens
tttatccacaggaaagtgtt

SEQ ID NO: 801172 - DNA, 21 bp, Homo sapiens
tttatccattcaactgaaaat

SEQ ID NO: 801173 - DNA, 13 bp, Homo sapiens
tttatccatttct

SEQ ID NO: 801174 - DNA, 17 bp, Homo sapiens
tttatccatttctttta

SEQ ID NO: 801175 - DNA, 18 bp, Homo sapiens
tttatcccaaagttgttg

SEQ ID NO: 801176 - DNA, 18 bp, Homo sapiens
tttatcctgaaatttcag

SEQ ID NO: 801177 - DNA, 20 bp, Homo sapiens
tttatcctggccttgtactt

SEQ ID NO: 801178 - DNA, 14 bp, Homo sapiens
tttatccttaggaa

SEQ ID NO: 801179 - DNA, 19 bp, Homo sapiens
tttatctataatttaccta

SEQ ID NO: 801180 - DNA, 12 bp, Homo sapiens
tttatctatata

SEQ ID NO: 801181 - DNA, 15 bp, Homo sapiens
tttatctgcagaaca

SEQ ID NO: 801182 - DNA, 15 bp, Homo sapiens
tttatctgtggagtt

SEQ ID NO: 801183 - DNA, 16 bp, Homo sapiens
tttatctttaccaaaa

SEQ ID NO: 801184 - DNA, 18 bp, Homo sapiens
tttatctttatatgaaga

SEQ ID NO: 801185 - DNA, 19 bp, Homo sapiens
tttatgaaaaagaagaatc

SEQ ID NO: 801186 - DNA, 13 bp, Homo sapiens
tttatgaaaagag

SEQ ID NO: 801187 - DNA, 18 bp, Homo sapiens
tttatgaaaggtttacat

SEQ ID NO: 801188 - DNA, 14 bp, Homo sapiens
tttatgaacattgt

SEQ ID NO: 801189 - DNA, 20 bp, Homo sapiens
tttatgaatgaaaaaacagt

SEQ ID NO: 801190 - DNA, 17 bp, Homo sapiens
tttatgaattgtctaaa

SEQ ID NO: 801191 - DNA, 17 bp, Homo sapiens
tttatgagatttactgc

SEQ ID NO: 801192 - DNA, 12 bp, Homo sapiens
tttatgagccag

SEQ ID NO: 801193 - DNA, 14 bp, Homo sapiens
tttatgatcagtgt

SEQ ID NO: 801194 - DNA, 21 bp, Homo sapiens
tttatgatcagtgttgttgct

SEQ ID NO: 801195 - DNA, 14 bp, Homo sapiens
tttatgatgtatat

SEQ ID NO: 801196 - DNA, 20 bp, Homo sapiens
tttatgcatttgcatttgct

SEQ ID NO: 801197 - DNA, 18 bp, Homo sapiens
tttatgccggatgtgctt

SEQ ID NO: 801198 - DNA, 19 bp, Homo sapiens
tttatgcttaaaatatgta

SEQ ID NO: 801199 - DNA, 16 bp, Homo sapiens
tttatgcttgcttggg

SEQ ID NO: 801200 - DNA, 20 bp, Homo sapiens
tttatggaaaaattgacaaa

SEQ ID NO: 801201 - DNA, 20 bp, Homo sapiens
tttatggaattaaccattta

SEQ ID NO: 801202 - DNA, 21 bp, Homo sapiens
tttatggcatgatttatatat

SEQ ID NO: 801203 - DNA, 22 bp, Homo sapiens
tttatggcatgatttatatatg

SEQ ID NO: 801204 - DNA, 12 bp, Homo sapiens
tttatggcctca

SEQ ID NO: 801205 - DNA, 22 bp, Homo sapiens
tttatggcctcagctgcctcac

SEQ ID NO: 801206 - DNA, 16 bp, Homo sapiens
tttatggctagacagg

SEQ ID NO: 801207 - DNA, 12 bp, Homo sapiens
tttatgggagaa

SEQ ID NO: 801208 - DNA, 13 bp, Homo sapiens
tttatgggagaat

SEQ ID NO: 801209 - DNA, 19 bp, Homo sapiens
tttatggtaaaaaatttat

SEQ ID NO: 801210 - DNA, 21 bp, Homo sapiens
tttatggttacttcttctctt

SEQ ID NO: 801211 - DNA, 15 bp, Homo sapiens
tttatggttatgttt

SEQ ID NO: 801212 - DNA, 21 bp, Homo sapiens
tttatggttatgtttttctgt

SEQ ID NO: 801213 - DNA, 22 bp, Homo sapiens
tttatgtatcagctctctgctg

SEQ ID NO: 801214 - DNA, 16 bp, Homo sapiens
tttatgtgaattttta

SEQ ID NO: 801215 - DNA, 16 bp, Homo sapiens
tttatgtgcagcgacc

SEQ ID NO: 801216 - DNA, 18 bp, Homo sapiens
tttatgtgtgaggagctg

SEQ ID NO: 801217 - DNA, 18 bp, Homo sapiens
tttatgtgttatgaacat

SEQ ID NO: 801218 - DNA, 22 bp, Homo sapiens
tttatgtgtttggatacatctg

SEQ ID NO: 801219 - DNA, 18 bp, Homo sapiens
tttatgtttaaaagaaat

SEQ ID NO: 801220 - DNA, 14 bp, Homo sapiens
tttatgtttgtctt

SEQ ID NO: 801221 - DNA, 22 bp, Homo sapiens
tttatgtttgtcttttaatgct

SEQ ID NO: 801222 - DNA, 12 bp, Homo sapiens
tttatgttttgt

SEQ ID NO: 801223 - DNA, 18 bp, Homo sapiens
tttattaaaaactgagtg

SEQ ID NO: 801224 - DNA, 17 bp, Homo sapiens
tttattaaaaatgttct

SEQ ID NO: 801225 - DNA, 21 bp, Homo sapiens
tttattaaaatatttcaggtt

SEQ ID NO: 801226 - DNA, 14 bp, Homo sapiens
tttattaaaatctt

SEQ ID NO: 801227 - DNA, 15 bp, Homo sapiens
tttattaaaatctta

SEQ ID NO: 801228 - DNA, 14 bp, Homo sapiens
tttattaaaatgat

SEQ ID NO: 801229 - DNA, 17 bp, Homo sapiens
tttattaaacaattttg

SEQ ID NO: 801230 - DNA, 23 bp, Homo sapiens
tttattaaacagatttttacaaa

SEQ ID NO: 801231 - DNA, 12 bp, Homo sapiens
tttattaaataa

SEQ ID NO: 801232 - DNA, 13 bp, Homo sapiens
tttattaaatgta

SEQ ID NO: 801233 - DNA, 22 bp, Homo sapiens
tttattaagatggattctcaga

SEQ ID NO: 801234 - DNA, 12 bp, Homo sapiens
tttattaatgca

SEQ ID NO: 801235 - DNA, 16 bp, Homo sapiens
tttattaatttatatg

SEQ ID NO: 801236 - DNA, 14 bp, Homo sapiens
tttattacaagtgg

SEQ ID NO: 801237 - DNA, 12 bp, Homo sapiens
tttattaccccc

SEQ ID NO: 801238 - DNA, 16 bp, Homo sapiens
tttattacttccatga

SEQ ID NO: 801239 - DNA, 20 bp, Homo sapiens
tttattagtattgttgtcct

SEQ ID NO: 801240 - DNA, 13 bp, Homo sapiens
tttattatgcatg

SEQ ID NO: 801241 - DNA, 17 bp, Homo sapiens
tttattatgcattatat

SEQ ID NO: 801242 - DNA, 14 bp, Homo sapiens
tttattattgaaga

SEQ ID NO: 801243 - DNA, 19 bp, Homo sapiens
tttcagtcccctctctctg

SEQ ID NO: 801244 - DNA, 17 bp, Homo sapiens
tttcagtgcatcattac

SEQ ID NO: 801245 - DNA, 19 bp, Homo sapiens
tttcagtgtagcgggagga

SEQ ID NO: 801246 - DNA, 11 bp, Homo sapiens
tttcagtgtga

SEQ ID NO: 801247 - DNA, 13 bp, Homo sapiens
tttcagttccaag

SEQ ID NO: 801248 - DNA, 15 bp, Homo sapiens
tttcagttccctcct

SEQ ID NO: 801249 - DNA, 20 bp, Homo sapiens
tttcagttccctcctgccca

SEQ ID NO: 801250 - DNA, 15 bp, Homo sapiens
tttcagttttcagga

SEQ ID NO: 801251 - DNA, 12 bp, Homo sapiens
tttcagtttttt

SEQ ID NO: 801252 - DNA, 18 bp, Homo sapiens
tttcataaattatttgat

SEQ ID NO: 801253 - DNA, 17 bp, Homo sapiens
tttcataagtatttcaa

SEQ ID NO: 801254 - DNA, 15 bp, Homo sapiens
tttcataattctgaa

SEQ ID NO: 801255 - DNA, 15 bp, Homo sapiens
tttcatacatatata

SEQ ID NO: 801256 - DNA, 20 bp, Homo sapiens
tttcatagatttgaaaaact

SEQ ID NO: 801257 - DNA, 14 bp, Homo sapiens
tttcataggaagac

SEQ ID NO: 801258 - DNA, 19 bp, Homo sapiens
tttcataggaagacacatt

SEQ ID NO: 801259 - DNA, 16 bp, Homo sapiens
tttcataggtctgaaa

SEQ ID NO: 801260 - DNA, 20 bp, Homo sapiens
tttcatagtgacctgtgttt

SEQ ID NO: 801261 - DNA, 22 bp, Homo sapiens
tttcatagtgcctttttcctta

SEQ ID NO: 801262 - DNA, 23 bp, Homo sapiens
tttcatagtgtcaagaaggaaga

SEQ ID NO: 801263 - DNA, 15 bp, Homo sapiens
tttcatagttcagaa

SEQ ID NO: 801264 - DNA, 15 bp, Homo sapiens
tttcatatgttgctc

SEQ ID NO: 801265 - DNA, 19 bp, Homo sapiens
tttcatattaaacaaaaac

SEQ ID NO: 801266 - DNA, 14 bp, Homo sapiens
tttcatattttaaa

SEQ ID NO: 801267 - DNA, 17 bp, Homo sapiens
tttcatattttaaacag

SEQ ID NO: 801268 - DNA, 15 bp, Homo sapiens
tttcatattttaaat

SEQ ID NO: 801269 - DNA, 12 bp, Homo sapiens
tttcatcaaaaa

SEQ ID NO: 801270 - DNA, 16 bp, Homo sapiens
tttcatcaaaaagcct

SEQ ID NO: 801271 - DNA, 13 bp, Homo sapiens
tttcatcactggg

SEQ ID NO: 801272 - DNA, 17 bp, Homo sapiens
tttcatcatattataca

SEQ ID NO: 801273 - DNA, 13 bp, Homo sapiens
tttcatcattttt

SEQ ID NO: 801274 - DNA, 20 bp, Homo sapiens
tttcatccactagtgcaaat

SEQ ID NO: 801275 - DNA, 15 bp, Homo sapiens
tttcatcctggcctc

SEQ ID NO: 801276 - DNA, 16 bp, Homo sapiens
tttcatcctgtgtccc

SEQ ID NO: 801277 - DNA, 19 bp, Homo sapiens
tttcatctcagagtccact

SEQ ID NO: 801278 - DNA, 23 bp, Homo sapiens
tttcatctcatttaagggaaaaa

SEQ ID NO: 801279 - DNA, 16 bp, Homo sapiens
tttcatctgggaaaga

SEQ ID NO: 801280 - DNA, 14 bp, Homo sapiens
tttcatctgggtgg

SEQ ID NO: 801281 - DNA, 12 bp, Homo sapiens
tttcatctgttg

SEQ ID NO: 801282 - DNA, 13 bp, Homo sapiens
tttcatctgttgt

SEQ ID NO: 801283 - DNA, 15 bp, Homo sapiens
tttcatcttcagttg

SEQ ID NO: 801284 - DNA, 16 bp, Homo sapiens
tttcatcttctggaat

SEQ ID NO: 801285 - DNA, 16 bp, Homo sapiens
tttcatcttgaagttt

SEQ ID NO: 801286 - DNA, 20 bp, Homo sapiens
tttcatgaccactgggcctg

SEQ ID NO: 801287 - DNA, 19 bp, Homo sapiens
tttcatgataatgaacaga

SEQ ID NO: 801288 - DNA, 16 bp, Homo sapiens
tttcatgctatctctg

SEQ ID NO: 801289 - DNA, 19 bp, Homo sapiens
tttcatgctatctctgtgt

SEQ ID NO: 801290 - DNA, 12 bp, Homo sapiens
tttcatggaagt

SEQ ID NO: 801291 - DNA, 19 bp, Homo sapiens
tttcatggcccttcaaatt

SEQ ID NO: 801292 - DNA, 22 bp, Homo sapiens
tttcatggtgaaaatgtactga

SEQ ID NO: 801293 - DNA, 12 bp, Homo sapiens
tttcatgtacaa

SEQ ID NO: 801294 - DNA, 13 bp, Homo sapiens
tttcatgtacagc

SEQ ID NO: 801295 - DNA, 19 bp, Homo sapiens
tttcatgttagttacctta

SEQ ID NO: 801296 - DNA, 19 bp, Homo sapiens
tttcatgttcactgtgagt

SEQ ID NO: 801297 - DNA, 20 bp, Homo sapiens
tttcatgttgatgactcgaa

SEQ ID NO: 801298 - DNA, 15 bp, Homo sapiens
tttcatgtttttgat

SEQ ID NO: 801299 - DNA, 14 bp, Homo sapiens
tttcattaaacttg

SEQ ID NO: 801300 - DNA, 21 bp, Homo sapiens
tttcattaaacttgaagcagt

SEQ ID NO: 801301 - DNA, 15 bp, Homo sapiens
tttcattaaataaat

SEQ ID NO: 801302 - DNA, 22 bp, Homo sapiens
tttcattaaataaatttgactt

SEQ ID NO: 801303 - DNA, 13 bp, Homo sapiens
tttcattaaatgg

SEQ ID NO: 801304 - DNA, 16 bp, Homo sapiens
tttcattacatttctg

SEQ ID NO: 801305 - DNA, 15 bp, Homo sapiens
tttcattaggcaaag

SEQ ID NO: 801306 - DNA, 16 bp, Homo sapiens
tttcattatgctttga

SEQ ID NO: 801307 - DNA, 13 bp, Homo sapiens
tttcattccctgt

SEQ ID NO: 801308 - DNA, 17 bp, Homo sapiens
tttcattggttaatttt

SEQ ID NO: 801309 - DNA, 15 bp, Homo sapiens
tttcattgtatgatg

SEQ ID NO: 801310 - DNA, 16 bp, Homo sapiens
tttcattgtatgatgt

SEQ ID NO: 801311 - DNA, 17 bp, Homo sapiens
tttcattgtatgatgtg

SEQ ID NO: 801312 - DNA, 20 bp, Homo sapiens
tttcatttagtgctaaacaa

SEQ ID NO: 801313 - DNA, 19 bp, Homo sapiens
tttcatttatgatacaaaa

SEQ ID NO: 801314 - DNA, 14 bp, Homo sapiens
tttcatttcaactg

SEQ ID NO: 801315 - DNA, 11 bp, Homo sapiens
tttcatttctt

SEQ ID NO: 801316 - DNA, 13 bp, Homo sapiens
tttcatttgtaaa

SEQ ID NO: 801317 - DNA, 19 bp, Homo sapiens
tttcatttgtacaaggtaa

SEQ ID NO: 801318 - DNA, 20 bp, Homo sapiens
tttcattttgcagaaggaaa

SEQ ID NO: 801319 - DNA, 20 bp, Homo sapiens
tttcatttttttctctctgg

SEQ ID NO: 801320 - DNA, 21 bp, Homo sapiens
tttccaaaacaatttcttttt

SEQ ID NO: 801321 - DNA, 12 bp, Homo sapiens
tttccaaaacat

SEQ ID NO: 801322 - DNA, 17 bp, Homo sapiens
tttccaaacatccaaaa

SEQ ID NO: 801323 - DNA, 11 bp, Homo sapiens
tttccaaagag

SEQ ID NO: 801324 - DNA, 15 bp, Homo sapiens
tttccaaataaaatg

SEQ ID NO: 801325 - DNA, 13 bp, Homo sapiens
tttccaaatgaac

SEQ ID NO: 801326 - DNA, 23 bp, Homo sapiens
tttccaaatgtggcctccatgtg

SEQ ID NO: 801327 - DNA, 13 bp, Homo sapiens
tttccaaattatt

SEQ ID NO: 801328 - DNA, 21 bp, Homo sapiens
tttccaacaccacagacacac

SEQ ID NO: 801329 - DNA, 19 bp, Homo sapiens
tttccaactactaatagaa

SEQ ID NO: 801330 - DNA, 15 bp, Homo sapiens
tttccaacttgtctg

SEQ ID NO: 801331 - DNA, 18 bp, Homo sapiens
tttccaacttgtctggga

SEQ ID NO: 801332 - DNA, 14 bp, Homo sapiens
tttccaagctcctt

SEQ ID NO: 801333 - DNA, 19 bp, Homo sapiens
tttccaatgcttcttataa

SEQ ID NO: 801334 - DNA, 14 bp, Homo sapiens
tttccaatgtgttc

SEQ ID NO: 801335 - DNA, 20 bp, Homo sapiens
tttccacaagattcccagag

SEQ ID NO: 801336 - DNA, 14 bp, Homo sapiens
tttccacacgcatt

SEQ ID NO: 801337 - DNA, 18 bp, Homo sapiens
tttccacacgcattaata

SEQ ID NO: 801338 - DNA, 20 bp, Homo sapiens
tttccacagttgctgctcct

SEQ ID NO: 801339 - DNA, 15 bp, Homo sapiens
tttccaccccctccc

SEQ ID NO: 801340 - DNA, 15 bp, Homo sapiens
tttccactactgcta

SEQ ID NO: 801341 - DNA, 20 bp, Homo sapiens
tttccactattttcaaagaa

SEQ ID NO: 801342 - DNA, 14 bp, Homo sapiens
tttccactctggat

SEQ ID NO: 801343 - DNA, 15 bp, Homo sapiens
tttccactgaacaaa

SEQ ID NO: 801344 - DNA, 20 bp, Homo sapiens
tttccactgaacaaaaccta

SEQ ID NO: 801345 - DNA, 15 bp, Homo sapiens
tttccacttcttcct

SEQ ID NO: 801346 - DNA, 16 bp, Homo sapiens
tttccacttcttcctt

SEQ ID NO: 801347 - DNA, 14 bp, Homo sapiens
tttccagagaactg

SEQ ID NO: 801348 - DNA, 23 bp, Homo sapiens
tttccagcagaagacaaaaagac

SEQ ID NO: 801349 - DNA, 13 bp, Homo sapiens
tttccagcctatc

SEQ ID NO: 801350 - DNA, 11 bp, Homo sapiens
tttccagcctc

SEQ ID NO: 801351 - DNA, 17 bp, Homo sapiens
tttccagccttatgtgt

SEQ ID NO: 801352 - DNA, 14 bp, Homo sapiens
tttccaggaaaaaa

SEQ ID NO: 801353 - DNA, 14 bp, Homo sapiens
tttccaggactctt

SEQ ID NO: 801354 - DNA, 15 bp, Homo sapiens
tttccagtacctttg

SEQ ID NO: 801355 - DNA, 19 bp, Homo sapiens
tttccagtattgaaaactt

SEQ ID NO: 801356 - DNA, 23 bp, Homo sapiens
tttccagtattgaaaacttcaaa

SEQ ID NO: 801357 - DNA, 12 bp, Homo sapiens
tttccagtgcaa

SEQ ID NO: 801358 - DNA, 15 bp, Homo sapiens
tttccagttctgaca

SEQ ID NO: 801359 - DNA, 17 bp, Homo sapiens
tttccagttgctgtgga

SEQ ID NO: 801360 - DNA, 15 bp, Homo sapiens
tttccataaggaatg

SEQ ID NO: 801361 - DNA, 12 bp, Homo sapiens
tttccatatgtt

SEQ ID NO: 801362 - DNA, 12 bp, Homo sapiens
tttccatcatgt

SEQ ID NO: 801363 - DNA, 19 bp, Homo sapiens
tttccatgactgcatttta

SEQ ID NO: 801364 - DNA, 18 bp, Homo sapiens
tttccatgggagccagct

SEQ ID NO: 801365 - DNA, 18 bp, Homo sapiens
tttccattacaagtattt

SEQ ID NO: 801366 - DNA, 22 bp, Homo sapiens
tttctccctctcatgtccctcc

SEQ ID NO: 801367 - DNA, 13 bp, Homo sapiens
tttctccctctgg

SEQ ID NO: 801368 - DNA, 17 bp, Homo sapiens
tttctccgggtcctcct

SEQ ID NO: 801369 - DNA, 20 bp, Homo sapiens
tttctcctcatccatttctt

SEQ ID NO: 801370 - DNA, 12 bp, Homo sapiens
tttctcctcccc

SEQ ID NO: 801371 - DNA, 16 bp, Homo sapiens
tttctcctcccttcct

SEQ ID NO: 801372 - DNA, 11 bp, Homo sapiens
tttctcctggt

SEQ ID NO: 801373 - DNA, 14 bp, Homo sapiens
tttctcctgtgaat

SEQ ID NO: 801374 - DNA, 21 bp, Homo sapiens
tttctcctgtttattcccatc

SEQ ID NO: 801375 - DNA, 20 bp, Homo sapiens
tttctccttagtcttctcat

SEQ ID NO: 801376 - DNA, 22 bp, Homo sapiens
tttctccttgaaatgagtaaaa

SEQ ID NO: 801377 - DNA, 16 bp, Homo sapiens
tttctccttggtttgc

SEQ ID NO: 801378 - DNA, 15 bp, Homo sapiens
tttctcgtccccctc

SEQ ID NO: 801379 - DNA, 19 bp, Homo sapiens
tttctcgtccccctccctg

SEQ ID NO: 801380 - DNA, 23 bp, Homo sapiens
tttctcgtccccctccctgccca

SEQ ID NO: 801381 - DNA, 22 bp, Homo sapiens
tttctctaacttcaaggcccat

SEQ ID NO: 801382 - DNA, 15 bp, Homo sapiens
tttctctaataataa

SEQ ID NO: 801383 - DNA, 14 bp, Homo sapiens
tttctctcagaaat

SEQ ID NO: 801384 - DNA, 14 bp, Homo sapiens
tttctctcagtgaa

SEQ ID NO: 801385 - DNA, 16 bp, Homo sapiens
tttctctctacagtgc

SEQ ID NO: 801386 - DNA, 12 bp, Homo sapiens
tttctctctcct

SEQ ID NO: 801387 - DNA, 13 bp, Homo sapiens
tttctctctggat

SEQ ID NO: 801388 - DNA, 13 bp, Homo sapiens
tttctctcttccc

SEQ ID NO: 801389 - DNA, 20 bp, Homo sapiens
tttctctctttatacagctg

SEQ ID NO: 801390 - DNA, 20 bp, Homo sapiens
tttctctgatttgcaaaaaa

SEQ ID NO: 801391 - DNA, 15 bp, Homo sapiens
tttctctgtactttt

SEQ ID NO: 801392 - DNA, 17 bp, Homo sapiens
tttctctgtatagtact

SEQ ID NO: 801393 - DNA, 18 bp, Homo sapiens
tttctctgtgtttgttcc

SEQ ID NO: 801394 - DNA, 21 bp, Homo sapiens
tttctcttagaacattgtatt

SEQ ID NO: 801395 - DNA, 16 bp, Homo sapiens
tttctcttcatacttt

SEQ ID NO: 801396 - DNA, 14 bp, Homo sapiens
tttctcttctgtcc

SEQ ID NO: 801397 - DNA, 16 bp, Homo sapiens
tttctcttgagctggc

SEQ ID NO: 801398 - DNA, 14 bp, Homo sapiens
tttctctttaaact

SEQ ID NO: 801399 - DNA, 20 bp, Homo sapiens
tttctctttcttcctttact

SEQ ID NO: 801400 - DNA, 15 bp, Homo sapiens
tttctctttgtctgc

SEQ ID NO: 801401 - DNA, 23 bp, Homo sapiens
tttctgaaagatgagtaatttct

SEQ ID NO: 801402 - DNA, 19 bp, Homo sapiens
tttctgaagtacttaaact

SEQ ID NO: 801403 - DNA, 20 bp, Homo sapiens
tttctgaataaaaaagattc

SEQ ID NO: 801404 - DNA, 21 bp, Homo sapiens
tttctgaattatgcttccaca

SEQ ID NO: 801405 - DNA, 12 bp, Homo sapiens
tttctgactgtc

SEQ ID NO: 801406 - DNA, 16 bp, Homo sapiens
tttctgactgtccctg

SEQ ID NO: 801407 - DNA, 21 bp, Homo sapiens
tttctgagagttggctcaggc

SEQ ID NO: 801408 - DNA, 17 bp, Homo sapiens
tttctgagatgctcact

SEQ ID NO: 801409 - DNA, 20 bp, Homo sapiens
tttctgagatgctcacttta

SEQ ID NO: 801410 - DNA, 23 bp, Homo sapiens
tttctgagatttttgatatctca

SEQ ID NO: 801411 - DNA, 11 bp, Homo sapiens
tttctgagccc

SEQ ID NO: 801412 - DNA, 12 bp, Homo sapiens
tttctgagcccg

SEQ ID NO: 801413 - DNA, 15 bp, Homo sapiens
tttctgagcccgggc

SEQ ID NO: 801414 - DNA, 21 bp, Homo sapiens
tttctgagcccgggctgcctg

SEQ ID NO: 801415 - DNA, 18 bp, Homo sapiens
tttctgatcgtctcggcc

SEQ ID NO: 801416 - DNA, 11 bp, Homo sapiens
tttctgatctg

SEQ ID NO: 801417 - DNA, 19 bp, Homo sapiens
tttctgatctgtactttgt

SEQ ID NO: 801418 - DNA, 23 bp, Homo sapiens
tttctgatgatgtcggtcttgca

SEQ ID NO: 801419 - DNA, 18 bp, Homo sapiens
tttctgatggtataaaca

SEQ ID NO: 801420 - DNA, 13 bp, Homo sapiens
tttctgattaata

SEQ ID NO: 801421 - DNA, 15 bp, Homo sapiens
tttctgattactgtc

SEQ ID NO: 801422 - DNA, 12 bp, Homo sapiens
tttctgattctt

SEQ ID NO: 801423 - DNA, 15 bp, Homo sapiens
tttctgatttcataa

SEQ ID NO: 801424 - DNA, 22 bp, Homo sapiens
tttctgcagaaatttgcaactc

SEQ ID NO: 801425 - DNA, 14 bp, Homo sapiens
tttctgcagccctt

SEQ ID NO: 801426 - DNA, 21 bp, Homo sapiens
tttctgcagcccttgggcagt

SEQ ID NO: 801427 - DNA, 16 bp, Homo sapiens
tttctgcatgaccaaa

SEQ ID NO: 801428 - DNA, 20 bp, Homo sapiens
tttctgccatgatgtttaca

SEQ ID NO: 801429 - DNA, 21 bp, Homo sapiens
tttctgccatgatgtttacaa

SEQ ID NO: 801430 - DNA, 21 bp, Homo sapiens
tttctgcccaaaaagggaaaa

SEQ ID NO: 801431 - DNA, 20 bp, Homo sapiens
tttctgccctggctgctgcc

SEQ ID NO: 801432 - DNA, 14 bp, Homo sapiens
tttctgcctggagt

SEQ ID NO: 801433 - DNA, 15 bp, Homo sapiens
tttctgctctgccat

SEQ ID NO: 801434 - DNA, 19 bp, Homo sapiens
tttctggaaaggaaacatt

SEQ ID NO: 801435 - DNA, 21 bp, Homo sapiens
tttctggaagactgctcccgg

SEQ ID NO: 801436 - DNA, 21 bp, Homo sapiens
tttctggactgaagcctgcag

SEQ ID NO: 801437 - DNA, 11 bp, Homo sapiens
tttctggagtc

SEQ ID NO: 801438 - DNA, 17 bp, Homo sapiens
tttctggccaaaagcag

SEQ ID NO: 801439 - DNA, 16 bp, Homo sapiens
tttctggcgcccctgc

SEQ ID NO: 801440 - DNA, 16 bp, Homo sapiens
tttctggctatgcatt

SEQ ID NO: 801441 - DNA, 16 bp, Homo sapiens
tttctgggataagtaa

SEQ ID NO: 801442 - DNA, 17 bp, Homo sapiens
tttctgggctttctcct

SEQ ID NO: 801443 - DNA, 18 bp, Homo sapiens
tttctgggctttctcctg

SEQ ID NO: 801444 - DNA, 23 bp, Homo sapiens
tttctggggaaaaaaaagagact

SEQ ID NO: 801445 - DNA, 21 bp, Homo sapiens
tttctggggggatatttccta

SEQ ID NO: 801446 - DNA, 21 bp, Homo sapiens
tttctgggtccctgctcccct

SEQ ID NO: 801447 - DNA, 17 bp, Homo sapiens
tttctggtagatagaaa

SEQ ID NO: 801448 - DNA, 19 bp, Homo sapiens
tttctggtagatagaaata

SEQ ID NO: 801449 - DNA, 20 bp, Homo sapiens
tttctggtggtctgttggca

SEQ ID NO: 801450 - DNA, 15 bp, Homo sapiens
tttctggttgatttg

SEQ ID NO: 801451 - DNA, 21 bp, Homo sapiens
tttctggttgttatgtgatca

SEQ ID NO: 801452 - DNA, 13 bp, Homo sapiens
tttctgtaaataa

SEQ ID NO: 801453 - DNA, 16 bp, Homo sapiens
tttctgtaaataacct

SEQ ID NO: 801454 - DNA, 15 bp, Homo sapiens
tttctgtaacaaatt

SEQ ID NO: 801455 - DNA, 14 bp, Homo sapiens
tttctgtaccagtt

SEQ ID NO: 801456 - DNA, 12 bp, Homo sapiens
tttctgtagaaa

SEQ ID NO: 801457 - DNA, 13 bp, Homo sapiens
tttctgtagaaaa

SEQ ID NO: 801458 - DNA, 14 bp, Homo sapiens
tttctgtagaaaag

SEQ ID NO: 801459 - DNA, 16 bp, Homo sapiens
tttctgtagactctaa

SEQ ID NO: 801460 - DNA, 13 bp, Homo sapiens
tttctgtagccta

SEQ ID NO: 801461 - DNA, 18 bp, Homo sapiens
tttctgtagcctaaaacg

SEQ ID NO: 801462 - DNA, 12 bp, Homo sapiens
tttctgtatact

SEQ ID NO: 801463 - DNA, 14 bp, Homo sapiens
tttctgtatactgt

SEQ ID NO: 801464 - DNA, 17 bp, Homo sapiens
tttctgtatatactttt

SEQ ID NO: 801465 - DNA, 14 bp, Homo sapiens
tttctgtcctgggc

SEQ ID NO: 801466 - DNA, 21 bp, Homo sapiens
tttctgtctaggttaaagcta

SEQ ID NO: 801467 - DNA, 13 bp, Homo sapiens
tttctgtgcccta

SEQ ID NO: 801468 - DNA, 11 bp, Homo sapiens
tttctgtgtgc

SEQ ID NO: 801469 - DNA, 20 bp, Homo sapiens
tttctgtgtgcaccttacca

SEQ ID NO: 801470 - DNA, 22 bp, Homo sapiens
tttctgtgtgcaccttaccaac

SEQ ID NO: 801471 - DNA, 18 bp, Homo sapiens
tttctgtgtgtcagtttt

SEQ ID NO: 801472 - DNA, 22 bp, Homo sapiens
tttctgtgtgtcagttttcata

SEQ ID NO: 801473 - DNA, 9 bp, Homo sapiens
tttctgttc

SEQ ID NO: 801474 - DNA, 13 bp, Homo sapiens
tttgacaactaaa

SEQ ID NO: 801475 - DNA, 17 bp, Homo sapiens
tttgacaaggaaaatct

SEQ ID NO: 801476 - DNA, 20 bp, Homo sapiens
tttgacaattcctagataaa

SEQ ID NO: 801477 - DNA, 17 bp, Homo sapiens
tttgacactgaaagttt

SEQ ID NO: 801478 - DNA, 19 bp, Homo sapiens
tttgacactgaaagttttg

SEQ ID NO: 801479 - DNA, 18 bp, Homo sapiens
tttgacacttcccagtgg

SEQ ID NO: 801480 - DNA, 17 bp, Homo sapiens
tttgacatgggtatttt

SEQ ID NO: 801481 - DNA, 17 bp, Homo sapiens
tttgacatgtggaaagt

SEQ ID NO: 801482 - DNA, 20 bp, Homo sapiens
tttgacattgcgtttgacct

SEQ ID NO: 801483 - DNA, 12 bp, Homo sapiens
tttgacctctgc

SEQ ID NO: 801484 - DNA, 18 bp, Homo sapiens
tttgacctctgcagcaat

SEQ ID NO: 801485 - DNA, 21 bp, Homo sapiens
tttgacctctgcagcaataaa

SEQ ID NO: 801486 - DNA, 18 bp, Homo sapiens
tttgaccttcatttcatg

SEQ ID NO: 801487 - DNA, 12 bp, Homo sapiens
tttgaccttccc

SEQ ID NO: 801488 - DNA, 13 bp, Homo sapiens
tttgaccttttat

SEQ ID NO: 801489 - DNA, 20 bp, Homo sapiens
tttgactaaagctatgttac

SEQ ID NO: 801490 - DNA, 21 bp, Homo sapiens
tttgactcagttccaggcctg

SEQ ID NO: 801491 - DNA, 20 bp, Homo sapiens
tttgactctggcaaagcttt

SEQ ID NO: 801492 - DNA, 13 bp, Homo sapiens
tttgactctttca

SEQ ID NO: 801493 - DNA, 12 bp, Homo sapiens
tttgacttcagc

SEQ ID NO: 801494 - DNA, 14 bp, Homo sapiens
tttgacttcagctg

SEQ ID NO: 801495 - DNA, 13 bp, Homo sapiens
tttgactttaatt

SEQ ID NO: 801496 - DNA, 14 bp, Homo sapiens
tttgactttaattt

SEQ ID NO: 801497 - DNA, 15 bp, Homo sapiens
tttgactttaattta

SEQ ID NO: 801498 - DNA, 18 bp, Homo sapiens
tttgactttcttctgaat

SEQ ID NO: 801499 - DNA, 13 bp, Homo sapiens
tttgagaaaatat

SEQ ID NO: 801500 - DNA, 17 bp, Homo sapiens
tttgagaaaatataata

SEQ ID NO: 801501 - DNA, 18 bp, Homo sapiens
tttgagaagataatcatt

SEQ ID NO: 801502 - DNA, 14 bp, Homo sapiens
tttgagaatgtgat

SEQ ID NO: 801503 - DNA, 15 bp, Homo sapiens
tttgagacaagccct

SEQ ID NO: 801504 - DNA, 19 bp, Homo sapiens
tttgagacaagccctggca

SEQ ID NO: 801505 - DNA, 23 bp, Homo sapiens
tttgagacgcaccatgtgggcac

SEQ ID NO: 801506 - DNA, 14 bp, Homo sapiens
tttgagactgaaat

SEQ ID NO: 801507 - DNA, 22 bp, Homo sapiens
tttgagagacgccactccctgg

SEQ ID NO: 801508 - DNA, 22 bp, Homo sapiens
tttgagatactattttcatttt

SEQ ID NO: 801509 - DNA, 17 bp, Homo sapiens
tttgagatctggggagg

SEQ ID NO: 801510 - DNA, 23 bp, Homo sapiens
tttgagattaagaatgccaggaa

SEQ ID NO: 801511 - DNA, 18 bp, Homo sapiens
tttgagatttttttttct

SEQ ID NO: 801512 - DNA, 13 bp, Homo sapiens
tttgagcatgcac

SEQ ID NO: 801513 - DNA, 21 bp, Homo sapiens
tttgagcccattcttctgggt

SEQ ID NO: 801514 - DNA, 17 bp, Homo sapiens
tttgagcctttattggt

SEQ ID NO: 801515 - DNA, 18 bp, Homo sapiens
tttgagctactggattct

SEQ ID NO: 801516 - DNA, 14 bp, Homo sapiens
tttgagctcagccc

SEQ ID NO: 801517 - DNA, 12 bp, Homo sapiens
tttgagctgcct

SEQ ID NO: 801518 - DNA, 17 bp, Homo sapiens
tttgagctgccttccct

SEQ ID NO: 801519 - DNA, 19 bp, Homo sapiens
tttgagcttagtgaaatta

SEQ ID NO: 801520 - DNA, 15 bp, Homo sapiens
tttgaggaagttttg

SEQ ID NO: 801521 - DNA, 19 bp, Homo sapiens
tttgaggaagttttgtcta

SEQ ID NO: 801522 - DNA, 20 bp, Homo sapiens
tttgaggaattatcatggga

SEQ ID NO: 801523 - DNA, 22 bp, Homo sapiens
tttgaggagaagggggtctctg

SEQ ID NO: 801524 - DNA, 20 bp, Homo sapiens
tttgaggatatattttcact

SEQ ID NO: 801525 - DNA, 21 bp, Homo sapiens
tttgaggggccaggggcaggc

SEQ ID NO: 801526 - DNA, 22 bp, Homo sapiens
tttgaggtctgttctttccaaa

SEQ ID NO: 801527 - DNA, 19 bp, Homo sapiens
tttgagtcaaagacttaaa

SEQ ID NO: 801528 - DNA, 20 bp, Homo sapiens
tttgagtgaattagaccttt

SEQ ID NO: 801529 - DNA, 13 bp, Homo sapiens
tttgagtgacagc

SEQ ID NO: 801530 - DNA, 22 bp, Homo sapiens
tttgagtgacagctttctggga

SEQ ID NO: 801531 - DNA, 13 bp, Homo sapiens
tttgagtgctctg

SEQ ID NO: 801532 - DNA, 16 bp, Homo sapiens
tttgagtggatgatgt

SEQ ID NO: 801533 - DNA, 20 bp, Homo sapiens
tttgagtgtactgtgcctgg

SEQ ID NO: 801534 - DNA, 18 bp, Homo sapiens
tttgagtgtgtgtgtgca

SEQ ID NO: 801535 - DNA, 14 bp, Homo sapiens
tttgagtgttttaa

SEQ ID NO: 801536 - DNA, 19 bp, Homo sapiens
tttgagttattttaattat

SEQ ID NO: 801537 - DNA, 18 bp, Homo sapiens
tttgataaagtaataatg

SEQ ID NO: 801538 - DNA, 23 bp, Homo sapiens
tttgatacataataaaaaattat

SEQ ID NO: 801539 - DNA, 16 bp, Homo sapiens
tttgatactaagcatt

SEQ ID NO: 801540 - DNA, 15 bp, Homo sapiens
tttgatacttgttca

SEQ ID NO: 801541 - DNA, 18 bp, Homo sapiens
tttgataggaaggaaact

SEQ ID NO: 801542 - DNA, 15 bp, Homo sapiens
tttgatataatcttg

SEQ ID NO: 801543 - DNA, 13 bp, Homo sapiens
tttgatatacatt

SEQ ID NO: 801544 - DNA, 17 bp, Homo sapiens
tttgatatccaaagctg

SEQ ID NO: 801545 - DNA, 20 bp, Homo sapiens
tttgatatgcatatttgttt

SEQ ID NO: 801546 - DNA, 14 bp, Homo sapiens
tttgatcagacagc

SEQ ID NO: 801547 - DNA, 13 bp, Homo sapiens
tttgatcatttct

SEQ ID NO: 801548 - DNA, 16 bp, Homo sapiens
tttgatccttggaaac

SEQ ID NO: 801549 - DNA, 20 bp, Homo sapiens
tttgatctttgtttaaatgc

SEQ ID NO: 801550 - DNA, 21 bp, Homo sapiens
tttgatctttgtttaaatgcc

SEQ ID NO: 801551 - DNA, 22 bp, Homo sapiens
tttgatctttgtttaaatgcca

SEQ ID NO: 801552 - DNA, 21 bp, Homo sapiens
tttgatgaattcttcctctcc

SEQ ID NO: 801553 - DNA, 15 bp, Homo sapiens
tttgatgagttgtga

SEQ ID NO: 801554 - DNA, 23 bp, Homo sapiens
tttgatgatgtctacagaaaatg

SEQ ID NO: 801555 - DNA, 17 bp, Homo sapiens
tttgatgcatgtctttt

SEQ ID NO: 801556 - DNA, 22 bp, Homo sapiens
tttgatgcatgtcttttaaaat

SEQ ID NO: 801557 - DNA, 16 bp, Homo sapiens
tttgatgccaagaaag

SEQ ID NO: 801558 - DNA, 20 bp, Homo sapiens
tttgatgctatttatgcaag

SEQ ID NO: 801559 - DNA, 19 bp, Homo sapiens
tttgatgctggagaggtta

SEQ ID NO: 801560 - DNA, 14 bp, Homo sapiens
tttgatgtacatgt

SEQ ID NO: 801561 - DNA, 14 bp, Homo sapiens
tttgatgtatatat

SEQ ID NO: 801562 - DNA, 16 bp, Homo sapiens
tttgatgtatgtgtga

SEQ ID NO: 801563 - DNA, 15 bp, Homo sapiens
tttgatgtcagcctt

SEQ ID NO: 801564 - DNA, 16 bp, Homo sapiens
tttgatgtcagccttg

SEQ ID NO: 801565 - DNA, 13 bp, Homo sapiens
tttgattaaattc

SEQ ID NO: 801566 - DNA, 13 bp, Homo sapiens
tttgattaatgtt

SEQ ID NO: 801567 - DNA, 20 bp, Homo sapiens
tttgattaatgtttcttaaa

SEQ ID NO: 801568 - DNA, 15 bp, Homo sapiens
tttgattattatgtt

SEQ ID NO: 801569 - DNA, 14 bp, Homo sapiens
tttgattatttgca

SEQ ID NO: 801570 - DNA, 13 bp, Homo sapiens
tttgctccctctg

SEQ ID NO: 801571 - DNA, 16 bp, Homo sapiens
tttgctccctctgtta

SEQ ID NO: 801572 - DNA, 20 bp, Homo sapiens
tttgctccgctcccaccgcc

SEQ ID NO: 801573 - DNA, 19 bp, Homo sapiens
tttgctctaaattaagaca

SEQ ID NO: 801574 - DNA, 20 bp, Homo sapiens
tttgctctcccggttcttcc

SEQ ID NO: 801575 - DNA, 12 bp, Homo sapiens
tttgctctgccc

SEQ ID NO: 801576 - DNA, 17 bp, Homo sapiens
tttgctcttgtcccacg

SEQ ID NO: 801577 - DNA, 19 bp, Homo sapiens
tttgctgaaaacattacat

SEQ ID NO: 801578 - DNA, 12 bp, Homo sapiens
tttgctgacagg

SEQ ID NO: 801579 - DNA, 19 bp, Homo sapiens
tttgctgagcatgtactga

SEQ ID NO: 801580 - DNA, 18 bp, Homo sapiens
tttgctgagttgttctaa

SEQ ID NO: 801581 - DNA, 13 bp, Homo sapiens
tttgctgatttct

SEQ ID NO: 801582 - DNA, 15 bp, Homo sapiens
tttgctgatttctag

SEQ ID NO: 801583 - DNA, 13 bp, Homo sapiens
tttgctgcatttt

SEQ ID NO: 801584 - DNA, 18 bp, Homo sapiens
tttgctgcccctgtctgg

SEQ ID NO: 801585 - DNA, 12 bp, Homo sapiens
tttgctgcctta

SEQ ID NO: 801586 - DNA, 22 bp, Homo sapiens
tttgctgctatgaaaatgagca

SEQ ID NO: 801587 - DNA, 22 bp, Homo sapiens
tttgctgctgcccatgtttcaa

SEQ ID NO: 801588 - DNA, 17 bp, Homo sapiens
tttgctgctgctctcag

SEQ ID NO: 801589 - DNA, 16 bp, Homo sapiens
tttgctggaagaaact

SEQ ID NO: 801590 - DNA, 12 bp, Homo sapiens
tttgctggttat

SEQ ID NO: 801591 - DNA, 20 bp, Homo sapiens
tttgctggttgtaaatactt

SEQ ID NO: 801592 - DNA, 18 bp, Homo sapiens
tttgctgtactcttgctg

SEQ ID NO: 801593 - DNA, 19 bp, Homo sapiens
tttgctgtgaggctgtcct

SEQ ID NO: 801594 - DNA, 13 bp, Homo sapiens
tttgctgttactg

SEQ ID NO: 801595 - DNA, 15 bp, Homo sapiens
tttgctgttgggttt

SEQ ID NO: 801596 - DNA, 21 bp, Homo sapiens
tttgctgttttaaacattaat

SEQ ID NO: 801597 - DNA, 20 bp, Homo sapiens
tttgcttaaaatatgtgaag

SEQ ID NO: 801598 - DNA, 13 bp, Homo sapiens
tttgcttaatttc

SEQ ID NO: 801599 - DNA, 18 bp, Homo sapiens
tttgcttaccttttccta

SEQ ID NO: 801600 - DNA, 14 bp, Homo sapiens
tttgcttattgtgt

SEQ ID NO: 801601 - DNA, 16 bp, Homo sapiens
tttgcttattgttcca

SEQ ID NO: 801602 - DNA, 11 bp, Homo sapiens
aaaaaacatac

SEQ ID NO: 801603 - DNA, 10 bp, Homo sapiens
aaaaaactac

SEQ ID NO: 801604 - DNA, 22 bp, Homo sapiens
aaaaaactacaaaaaccctaat

SEQ ID NO: 801605 - DNA, 11 bp, Homo sapiens
aaaaaactgaa

SEQ ID NO: 801606 - DNA, 12 bp, Homo sapiens
aaaaaagaaaaa

SEQ ID NO: 801607 - DNA, 12 bp, Homo sapiens
aaaaaagaaaat

SEQ ID NO: 801608 - DNA, 12 bp, Homo sapiens
aaaaaagaaacg

SEQ ID NO: 801609 - DNA, 11 bp, Homo sapiens
aaaaaagaaag

SEQ ID NO: 801610 - DNA, 13 bp, Homo sapiens
aaaaaagatatat

SEQ ID NO: 801611 - DNA, 16 bp, Homo sapiens
aaaaaagattctacta

SEQ ID NO: 801612 - DNA, 14 bp, Homo sapiens
aaaaaagcaaaaat

SEQ ID NO: 801613 - DNA, 12 bp, Homo sapiens
aaaaaagcctcc

SEQ ID NO: 801614 - DNA, 16 bp, Homo sapiens
aaaaaagtcaccaaat

SEQ ID NO: 801615 - DNA, 13 bp, Homo sapiens
aaaaaagtcagag

SEQ ID NO: 801616 - DNA, 18 bp, Homo sapiens
aaaaaagttttgatgaaa

SEQ ID NO: 801617 - DNA, 12 bp, Homo sapiens
aaaaaataacac

SEQ ID NO: 801618 - DNA, 20 bp, Homo sapiens
aaaaaataatctatttctat

SEQ ID NO: 801619 - DNA, 13 bp, Homo sapiens
aaaaaatatatat

SEQ ID NO: 801620 - DNA, 13 bp, Homo sapiens
aaaaaatatcaga

SEQ ID NO: 801621 - DNA, 15 bp, Homo sapiens
aaaaaatattttcct

SEQ ID NO: 801622 - DNA, 13 bp, Homo sapiens
aaaaaatctgcag

SEQ ID NO: 801623 - DNA, 15 bp, Homo sapiens
aaaaaatctgcagaa

SEQ ID NO: 801624 - DNA, 12 bp, Homo sapiens
aaaaaatgaatt

SEQ ID NO: 801625 - DNA, 18 bp, Homo sapiens
aaaaaatgagacttactg

SEQ ID NO: 801626 - DNA, 11 bp, Homo sapiens
aaaaaatgatg

SEQ ID NO: 801627 - DNA, 12 bp, Homo sapiens
aaaaaatggttc

SEQ ID NO: 801628 - DNA, 13 bp, Homo sapiens
aaaaaatgttgtt

SEQ ID NO: 801629 - DNA, 12 bp, Homo sapiens
aaaaaatgtttc

SEQ ID NO: 801630 - DNA, 13 bp, Homo sapiens
aaaaaattcttta

SEQ ID NO: 801631 - DNA, 21 bp, Homo sapiens
aaaaaattctttcacttgatg

SEQ ID NO: 801632 - DNA, 11 bp, Homo sapiens
aaaaaattggt

SEQ ID NO: 801633 - DNA, 21 bp, Homo sapiens
aaaaaatttaaaattacgttt

SEQ ID NO: 801634 - DNA, 22 bp, Homo sapiens
aaaaaatttgagaaagccttca

SEQ ID NO: 801635 - DNA, 13 bp, Homo sapiens
aaaaacaaagaaa

SEQ ID NO: 801636 - DNA, 13 bp, Homo sapiens
aaaaacaaagctg

SEQ ID NO: 801637 - DNA, 16 bp, Homo sapiens
aaaaacaaatgttcat

SEQ ID NO: 801638 - DNA, 16 bp, Homo sapiens
aaaaacacggcagctg

SEQ ID NO: 801639 - DNA, 18 bp, Homo sapiens
aaaaacacggcagctgta

SEQ ID NO: 801640 - DNA, 22 bp, Homo sapiens
aaaaacagattctgattccctt

SEQ ID NO: 801641 - DNA, 18 bp, Homo sapiens
aaaaacagatttggaaag

SEQ ID NO: 801642 - DNA, 15 bp, Homo sapiens
aaaaacagcagtttg

SEQ ID NO: 801643 - DNA, 15 bp, Homo sapiens
aaaaacagcattgct

SEQ ID NO: 801644 - DNA, 19 bp, Homo sapiens
aaaaacagcattgctttct

SEQ ID NO: 801645 - DNA, 20 bp, Homo sapiens
aaaaacagcattgctttctg

SEQ ID NO: 801646 - DNA, 18 bp, Homo sapiens
aaaaacagccaccgtttc

SEQ ID NO: 801647 - DNA, 20 bp, Homo sapiens
aaaaacatacttacatttca

SEQ ID NO: 801648 - DNA, 16 bp, Homo sapiens
aaaaacatagaaaaat

SEQ ID NO: 801649 - DNA, 17 bp, Homo sapiens
aaaaacatcccaaactt

SEQ ID NO: 801650 - DNA, 19 bp, Homo sapiens
aaaaacatcccaaacttta

SEQ ID NO: 801651 - DNA, 22 bp, Homo sapiens
aaaaacatcccaaactttaaaa

SEQ ID NO: 801652 - DNA, 21 bp, Homo sapiens
aaaaacatgaatttagaaata

SEQ ID NO: 801653 - DNA, 13 bp, Homo sapiens
aaaaacatgtatg

SEQ ID NO: 801654 - DNA, 20 bp, Homo sapiens
aaaaacatgtatgtgcattt

SEQ ID NO: 801655 - DNA, 11 bp, Homo sapiens
aaaaacattta

SEQ ID NO: 801656 - DNA, 13 bp, Homo sapiens
aaaaacatttaaa

SEQ ID NO: 801657 - DNA, 16 bp, Homo sapiens
aaaaacattttgaagt

SEQ ID NO: 801658 - DNA, 18 bp, Homo sapiens
aaaaaccaacaggtttat

SEQ ID NO: 801659 - DNA, 11 bp, Homo sapiens
aaaaaccacaa

SEQ ID NO: 801660 - DNA, 19 bp, Homo sapiens
aaaaacccagcaacagaaa

SEQ ID NO: 801661 - DNA, 17 bp, Homo sapiens
aaaaaccctaattttgt

SEQ ID NO: 801662 - DNA, 20 bp, Homo sapiens
aaaaactaaatctctaatat

SEQ ID NO: 801663 - DNA, 19 bp, Homo sapiens
aaaaactataaaaaagaaa

SEQ ID NO: 801664 - DNA, 12 bp, Homo sapiens
aaaaactcacag

SEQ ID NO: 801665 - DNA, 14 bp, Homo sapiens
aaaaactcctgggc

SEQ ID NO: 801666 - DNA, 23 bp, Homo sapiens
aaaaactcctgtgtcggtcagaa

SEQ ID NO: 801667 - DNA, 20 bp, Homo sapiens
aaaaactctgggaaataaga

SEQ ID NO: 801668 - DNA, 10 bp, Homo sapiens
aaaaactgaa

SEQ ID NO: 801669 - DNA, 12 bp, Homo sapiens
aaaaactgaatg

SEQ ID NO: 801670 - DNA, 23 bp, Homo sapiens
aaaaactgcctttgatacaggca

SEQ ID NO: 801671 - DNA, 18 bp, Homo sapiens
aaaaactggccttttgat

SEQ ID NO: 801672 - DNA, 16 bp, Homo sapiens
aaaaactgtactgtgt

SEQ ID NO: 801673 - DNA, 12 bp, Homo sapiens
aaaaactgtgta

SEQ ID NO: 801674 - DNA, 17 bp, Homo sapiens
aaaaacttaaagcaaaa

SEQ ID NO: 801675 - DNA, 20 bp, Homo sapiens
aaaaacttaaagcaaaatag

SEQ ID NO: 801676 - DNA, 21 bp, Homo sapiens
aaaaacttagtgacaaaatag

SEQ ID NO: 801677 - DNA, 15 bp, Homo sapiens
aaaaacttattttat

SEQ ID NO: 801678 - DNA, 15 bp, Homo sapiens
aaaaacttgaaaata

SEQ ID NO: 801679 - DNA, 12 bp, Homo sapiens
aaaaacttgtaa

SEQ ID NO: 801680 - DNA, 22 bp, Homo sapiens
aaaaacttgtgctataaagcta

SEQ ID NO: 801681 - DNA, 12 bp, Homo sapiens
aaaaactttatt

SEQ ID NO: 801682 - DNA, 20 bp, Homo sapiens
aaaaactttggaaccagact

SEQ ID NO: 801683 - DNA, 20 bp, Homo sapiens
aaaaacttttaggttgttac

SEQ ID NO: 801684 - DNA, 12 bp, Homo sapiens
aaaaacttttat

SEQ ID NO: 801685 - DNA, 23 bp, Homo sapiens
aaaaacttttataaattaaatat

SEQ ID NO: 801686 - DNA, 11 bp, Homo sapiens
aaaaagaaaag

SEQ ID NO: 801687 - DNA, 20 bp, Homo sapiens
aaaaagaaaatggctaataa

SEQ ID NO: 801688 - DNA, 15 bp, Homo sapiens
aaaaagaaaatgtct

SEQ ID NO: 801689 - DNA, 13 bp, Homo sapiens
aaaaagaaagaaa

SEQ ID NO: 801690 - DNA, 14 bp, Homo sapiens
aaaaagaaatcttg

SEQ ID NO: 801691 - DNA, 11 bp, Homo sapiens
aaaaagaacca

SEQ ID NO: 801692 - DNA, 14 bp, Homo sapiens
aaaaagaagaatct

SEQ ID NO: 801693 - DNA, 16 bp, Homo sapiens
aaaaagacctggcctt

SEQ ID NO: 801694 - DNA, 14 bp, Homo sapiens
aaaaagactgaaca

SEQ ID NO: 801695 - DNA, 18 bp, Homo sapiens
aaaaagactgaacatgtt

SEQ ID NO: 801696 - DNA, 21 bp, Homo sapiens
aaaaagactgaacatgtttac

SEQ ID NO: 801697 - DNA, 11 bp, Homo sapiens
aaaaagactgt

SEQ ID NO: 801698 - DNA, 23 bp, Homo sapiens
aaaaagactgtcaaatgaacttt

SEQ ID NO: 801699 - DNA, 12 bp, Homo sapiens
aaaaagagacat

SEQ ID NO: 801700 - DNA, 23 bp, Homo sapiens
aaaaagagctcaggcttttccag

SEQ ID NO: 801701 - DNA, 17 bp, Homo sapiens
aaaaagatatattaaaa

SEQ ID NO: 801702 - DNA, 16 bp, Homo sapiens
aaaaagattctactaa

SEQ ID NO: 801703 - DNA, 16 bp, Homo sapiens
aaaaagattgccaatt

SEQ ID NO: 801704 - DNA, 13 bp, Homo sapiens
aaaaagatttttt

SEQ ID NO: 801705 - DNA, 20 bp, Homo sapiens
aaaaagcataaaaacatttt

SEQ ID NO: 801706 - DNA, 20 bp, Homo sapiens
aaaaagcatgatgggaaaat

SEQ ID NO: 801707 - DNA, 17 bp, Homo sapiens
aaaaagccagtttgggt

SEQ ID NO: 801708 - DNA, 16 bp, Homo sapiens
aaaaagcctacattct

SEQ ID NO: 801709 - DNA, 12 bp, Homo sapiens
aaaaagcctcca

SEQ ID NO: 801710 - DNA, 18 bp, Homo sapiens
aaaaagcctggtttttct

SEQ ID NO: 801711 - DNA, 20 bp, Homo sapiens
aaaaagcctggtttttctca

SEQ ID NO: 801712 - DNA, 23 bp, Homo sapiens
aaaaagccttgaagaaaatgact

SEQ ID NO: 801713 - DNA, 18 bp, Homo sapiens
aaaaagcgaaaaaatcag

SEQ ID NO: 801714 - DNA, 22 bp, Homo sapiens
aaaaagctaatgtgcagggata

SEQ ID NO: 801715 - DNA, 17 bp, Homo sapiens
aaaaagctcactgctga

SEQ ID NO: 801716 - DNA, 18 bp, Homo sapiens
aaaaagctcactgctgat

SEQ ID NO: 801717 - DNA, 19 bp, Homo sapiens
aaaaaggaaaaaaaacaca

SEQ ID NO: 801718 - DNA, 17 bp, Homo sapiens
aaaaaggaaaagttaaa

SEQ ID NO: 801719 - DNA, 17 bp, Homo sapiens
aaaaaggaaacttcctt

SEQ ID NO: 801720 - DNA, 13 bp, Homo sapiens
aaaaaggaaatat

SEQ ID NO: 801721 - DNA, 15 bp, Homo sapiens
aaaaaggaaatattc

SEQ ID NO: 801722 - DNA, 24 bp, Homo sapiens
aaaaaggaaatattctttctcata

SEQ ID NO: 801723 - DNA, 15 bp, Homo sapiens
aaaaaggaaatttgt

SEQ ID NO: 801724 - DNA, 13 bp, Homo sapiens
aaaaaggaaggag

SEQ ID NO: 801725 - DNA, 19 bp, Homo sapiens
aaaaaggaaggagagatga

SEQ ID NO: 801726 - DNA, 14 bp, Homo sapiens
aaaactttcctcgc

SEQ ID NO: 801727 - DNA, 20 bp, Homo sapiens
aaaactttcctcgcctgaca

SEQ ID NO: 801728 - DNA, 16 bp, Homo sapiens
aaaactttggaaccag

SEQ ID NO: 801729 - DNA, 17 bp, Homo sapiens
aaaacttttataaatta

SEQ ID NO: 801730 - DNA, 16 bp, Homo sapiens
aaaacttttgtaaatt

SEQ ID NO: 801731 - DNA, 21 bp, Homo sapiens
aaaacttttgtaaattattga

SEQ ID NO: 801732 - DNA, 18 bp, Homo sapiens
aaaacttttgttttttgg

SEQ ID NO: 801733 - DNA, 10 bp, Homo sapiens
aaaagaaaaa

SEQ ID NO: 801734 - DNA, 11 bp, Homo sapiens
aaaagaaaaaa

SEQ ID NO: 801735 - DNA, 16 bp, Homo sapiens
aaaagaaaaaaaaaga

SEQ ID NO: 801736 - DNA, 17 bp, Homo sapiens
aaaagaaaaaaaaagaa

SEQ ID NO: 801737 - DNA, 18 bp, Homo sapiens
aaaagaaaaaaaaagaaa

SEQ ID NO: 801738 - DNA, 17 bp, Homo sapiens
aaaagaaaaaaagaaaa

SEQ ID NO: 801739 - DNA, 22 bp, Homo sapiens
aaaagaaaacatttaacataat

SEQ ID NO: 801740 - DNA, 13 bp, Homo sapiens
aaaagaaaatctt

SEQ ID NO: 801741 - DNA, 12 bp, Homo sapiens
aaaagaaactta

SEQ ID NO: 801742 - DNA, 11 bp, Homo sapiens
aaaagaaagaa

SEQ ID NO: 801743 - DNA, 20 bp, Homo sapiens
aaaagaaagaagttattttc

SEQ ID NO: 801744 - DNA, 18 bp, Homo sapiens
aaaagaaaggctgttaaa

SEQ ID NO: 801745 - DNA, 14 bp, Homo sapiens
aaaagaaatatatt

SEQ ID NO: 801746 - DNA, 13 bp, Homo sapiens
aaaagaaatccag

SEQ ID NO: 801747 - DNA, 12 bp, Homo sapiens
aaaagaaatctt

SEQ ID NO: 801748 - DNA, 14 bp, Homo sapiens
aaaagaaatgtcaa

SEQ ID NO: 801749 - DNA, 22 bp, Homo sapiens
aaaagaaatttagagtcaattt

SEQ ID NO: 801750 - DNA, 17 bp, Homo sapiens
aaaagaacaaagctgga

SEQ ID NO: 801751 - DNA, 11 bp, Homo sapiens
aaaagaacaat

SEQ ID NO: 801752 - DNA, 17 bp, Homo sapiens
aaaagaacactagagtc

SEQ ID NO: 801753 - DNA, 21 bp, Homo sapiens
aaaagaagaagagatgacaaa

SEQ ID NO: 801754 - DNA, 12 bp, Homo sapiens
aaaagaagaagt

SEQ ID NO: 801755 - DNA, 14 bp, Homo sapiens
aaaagaagaagttt

SEQ ID NO: 801756 - DNA, 13 bp, Homo sapiens
aaaagaaggaaaa

SEQ ID NO: 801757 - DNA, 14 bp, Homo sapiens
aaaagaaggaaaga

SEQ ID NO: 801758 - DNA, 11 bp, Homo sapiens
aaaagaagttt

SEQ ID NO: 801759 - DNA, 16 bp, Homo sapiens
aaaagaagtttcagtt

SEQ ID NO: 801760 - DNA, 13 bp, Homo sapiens
aaaagacagggct

SEQ ID NO: 801761 - DNA, 15 bp, Homo sapiens
aaaagaccaagactt

SEQ ID NO: 801762 - DNA, 23 bp, Homo sapiens
aaaagactattttctattttccc

SEQ ID NO: 801763 - DNA, 21 bp, Homo sapiens
aaaagactggtttgtttgctt

SEQ ID NO: 801764 - DNA, 22 bp, Homo sapiens
aaaagactgtcaaatgaacttt

SEQ ID NO: 801765 - DNA, 20 bp, Homo sapiens
aaaagacttttgttgaaata

SEQ ID NO: 801766 - DNA, 16 bp, Homo sapiens
aaaagagaaaagaaaa

SEQ ID NO: 801767 - DNA, 11 bp, Homo sapiens
aaaagagaaac

SEQ ID NO: 801768 - DNA, 13 bp, Homo sapiens
aaaagagaatgat

SEQ ID NO: 801769 - DNA, 21 bp, Homo sapiens
aaaagagacttctctgtaagt

SEQ ID NO: 801770 - DNA, 19 bp, Homo sapiens
aaaagagataataagatta

SEQ ID NO: 801771 - DNA, 14 bp, Homo sapiens
aaaagagatatttt

SEQ ID NO: 801772 - DNA, 18 bp, Homo sapiens
aaaagagcatatactggt

SEQ ID NO: 801773 - DNA, 15 bp, Homo sapiens
aaaagagccctggct

SEQ ID NO: 801774 - DNA, 20 bp, Homo sapiens
aaaagagctactcagaaatg

SEQ ID NO: 801775 - DNA, 14 bp, Homo sapiens
aaaagataaagatg

SEQ ID NO: 801776 - DNA, 17 bp, Homo sapiens
aaaagataaagatgatc

SEQ ID NO: 801777 - DNA, 22 bp, Homo sapiens
aaaagataatattttacataca

SEQ ID NO: 801778 - DNA, 21 bp, Homo sapiens
aaaagatatattaaaaatata

SEQ ID NO: 801779 - DNA, 22 bp, Homo sapiens
aaaagatccccaagaccccctg

SEQ ID NO: 801780 - DNA, 13 bp, Homo sapiens
aaaagatcgcagt

SEQ ID NO: 801781 - DNA, 23 bp, Homo sapiens
aaaagatctgttttgaaggcaaa

SEQ ID NO: 801782 - DNA, 14 bp, Homo sapiens
aaaagatgaatttg

SEQ ID NO: 801783 - DNA, 19 bp, Homo sapiens
aaaagatggcttatgtcat

SEQ ID NO: 801784 - DNA, 21 bp, Homo sapiens
aaaagattgaagtattttgct

SEQ ID NO: 801785 - DNA, 17 bp, Homo sapiens
aaaagatttgttttgtc

SEQ ID NO: 801786 - DNA, 22 bp, Homo sapiens
aaaagcaaatggaaaatgtata

SEQ ID NO: 801787 - DNA, 13 bp, Homo sapiens
aaaagcaacttca

SEQ ID NO: 801788 - DNA, 16 bp, Homo sapiens
aaaagcacaatcacta

SEQ ID NO: 801789 - DNA, 17 bp, Homo sapiens
aaaagcacaatcactaa

SEQ ID NO: 801790 - DNA, 22 bp, Homo sapiens
aaaagcacagaggatttcttta

SEQ ID NO: 801791 - DNA, 20 bp, Homo sapiens
aaaagcagaattttaatgtg

SEQ ID NO: 801792 - DNA, 13 bp, Homo sapiens
aaaagcagacatt

SEQ ID NO: 801793 - DNA, 14 bp, Homo sapiens
aaaagcagacattt

SEQ ID NO: 801794 - DNA, 18 bp, Homo sapiens
aaaagcagcacaaggaat

SEQ ID NO: 801795 - DNA, 14 bp, Homo sapiens
aaaagcagctacca

SEQ ID NO: 801796 - DNA, 16 bp, Homo sapiens
aaaagcagctctcccc

SEQ ID NO: 801797 - DNA, 13 bp, Homo sapiens
aaaagcataaatg

SEQ ID NO: 801798 - DNA, 14 bp, Homo sapiens
aaaagcatgaaaca

SEQ ID NO: 801799 - DNA, 20 bp, Homo sapiens
aaaagcattgtccaaaatcc

SEQ ID NO: 801800 - DNA, 10 bp, Homo sapiens
aaaagcattt

SEQ ID NO: 801801 - DNA, 15 bp, Homo sapiens
aaaagcattttgtaa

SEQ ID NO: 801802 - DNA, 12 bp, Homo sapiens
aaaagcattttt

SEQ ID NO: 801803 - DNA, 22 bp, Homo sapiens
aaaagccagccaagctttaaat

SEQ ID NO: 801804 - DNA, 23 bp, Homo sapiens
aaaagccaggttccacagaggac

SEQ ID NO: 801805 - DNA, 18 bp, Homo sapiens
aaaagccattattatgat

SEQ ID NO: 801806 - DNA, 21 bp, Homo sapiens
aaaagcctcaactagtcattt

SEQ ID NO: 801807 - DNA, 13 bp, Homo sapiens
aaaagccttattt

SEQ ID NO: 801808 - DNA, 21 bp, Homo sapiens
aaaagcgggtaaaaaacctgg

SEQ ID NO: 801809 - DNA, 14 bp, Homo sapiens
aaaagctagaattg

SEQ ID NO: 801810 - DNA, 17 bp, Homo sapiens
aaaagctataaagcagt

SEQ ID NO: 801811 - DNA, 14 bp, Homo sapiens
aaaagctattaaag

SEQ ID NO: 801812 - DNA, 13 bp, Homo sapiens
aaaagctcactgc

SEQ ID NO: 801813 - DNA, 16 bp, Homo sapiens
aaaagctcactgctga

SEQ ID NO: 801814 - DNA, 12 bp, Homo sapiens
aaaagctcagag

SEQ ID NO: 801815 - DNA, 18 bp, Homo sapiens
aaaagctcatattttgta

SEQ ID NO: 801816 - DNA, 14 bp, Homo sapiens
aaaagctctgaaaa

SEQ ID NO: 801817 - DNA, 15 bp, Homo sapiens
aaaagctcttttaat

SEQ ID NO: 801818 - DNA, 21 bp, Homo sapiens
aaaagctgtaaattactatgg

SEQ ID NO: 801819 - DNA, 13 bp, Homo sapiens
aaaagcttttgtc

SEQ ID NO: 801820 - DNA, 21 bp, Homo sapiens
aaaaggaaacttcagttgatc

SEQ ID NO: 801821 - DNA, 22 bp, Homo sapiens
aaaaggaaatattctttctcat

SEQ ID NO: 801822 - DNA, 23 bp, Homo sapiens
aaaaggaaatattctttctcata

SEQ ID NO: 801823 - DNA, 20 bp, Homo sapiens
aaaaggaaattagtcttttt

SEQ ID NO: 801824 - DNA, 13 bp, Homo sapiens
aaaaggaaatttg

SEQ ID NO: 801825 - DNA, 20 bp, Homo sapiens
aaaaggaaatttgtttgtat

SEQ ID NO: 801826 - DNA, 18 bp, Homo sapiens
aaaaggaagccaaagagt

SEQ ID NO: 801827 - DNA, 21 bp, Homo sapiens
aaaaggaagtttccagaaaag

SEQ ID NO: 801828 - DNA, 16 bp, Homo sapiens
aaaaggacacctttta

SEQ ID NO: 801829 - DNA, 17 bp, Homo sapiens
aaaaggacgtaaaattt

SEQ ID NO: 801830 - DNA, 18 bp, Homo sapiens
aaaaggagagaagaaagt

SEQ ID NO: 801831 - DNA, 16 bp, Homo sapiens
aaaaggagcgggcagg

SEQ ID NO: 801832 - DNA, 17 bp, Homo sapiens
aaaaggagcgggcaggg

SEQ ID NO: 801833 - DNA, 19 bp, Homo sapiens
aaaaggatattatctacct

SEQ ID NO: 801834 - DNA, 13 bp, Homo sapiens
aaaaggatgcaca

SEQ ID NO: 801835 - DNA, 15 bp, Homo sapiens
aaaaggatgcacaga

SEQ ID NO: 801836 - DNA, 19 bp, Homo sapiens
aaaaggatgcacagagttg

SEQ ID NO: 801837 - DNA, 22 bp, Homo sapiens
aaaaggatgcacagagttgtta

SEQ ID NO: 801838 - DNA, 20 bp, Homo sapiens
aaaaggatggtggttatttt

SEQ ID NO: 801839 - DNA, 16 bp, Homo sapiens
aaaaggatgttacaag

SEQ ID NO: 801840 - DNA, 14 bp, Homo sapiens
aaaaggcaaatatt

SEQ ID NO: 801841 - DNA, 16 bp, Homo sapiens
aaaaggccaaagataa

SEQ ID NO: 801842 - DNA, 18 bp, Homo sapiens
aaaaggccaaagataaaa

SEQ ID NO: 801843 - DNA, 21 bp, Homo sapiens
aaaaggcctcttgtaaagact

SEQ ID NO: 801844 - DNA, 20 bp, Homo sapiens
aaaaggcgcatctaacgcgt

SEQ ID NO: 801845 - DNA, 20 bp, Homo sapiens
aaaaggctaggtacacagct

SEQ ID NO: 801846 - DNA, 14 bp, Homo sapiens
aaaaggcttgaagc

SEQ ID NO: 801847 - DNA, 16 bp, Homo sapiens
aaaagggaaaaaagaa

SEQ ID NO: 801848 - DNA, 20 bp, Homo sapiens
aaaagggaaaaaagaaagaa

SEQ ID NO: 801849 - DNA, 19 bp, Homo sapiens
aaaatgaaagcatgtctca

SEQ ID NO: 801850 - DNA, 15 bp, Homo sapiens
aaaatgaaatatttt

SEQ ID NO: 801851 - DNA, 14 bp, Homo sapiens
aaaatgaaatgcat

SEQ ID NO: 801852 - DNA, 16 bp, Homo sapiens
aaaatgaacattttgt

SEQ ID NO: 801853 - DNA, 18 bp, Homo sapiens
aaaatgaacctgatcact

SEQ ID NO: 801854 - DNA, 18 bp, Homo sapiens
aaaatgaaggaattacat

SEQ ID NO: 801855 - DNA, 13 bp, Homo sapiens
aaaatgaagggat

SEQ ID NO: 801856 - DNA, 20 bp, Homo sapiens
aaaatgaatagcttgtttct

SEQ ID NO: 801857 - DNA, 18 bp, Homo sapiens
aaaatgaatatctattaa

SEQ ID NO: 801858 - DNA, 21 bp, Homo sapiens
aaaatgaatgcaaaattgttt

SEQ ID NO: 801859 - DNA, 14 bp, Homo sapiens
aaaatgaattttgt

SEQ ID NO: 801860 - DNA, 16 bp, Homo sapiens
aaaatgacaaagccat

SEQ ID NO: 801861 - DNA, 17 bp, Homo sapiens
aaaatgacaacagaaaa

SEQ ID NO: 801862 - DNA, 13 bp, Homo sapiens
aaaatgacaatga

SEQ ID NO: 801863 - DNA, 19 bp, Homo sapiens
aaaatgacaccatctttta

SEQ ID NO: 801864 - DNA, 13 bp, Homo sapiens
aaaatgacagatg

SEQ ID NO: 801865 - DNA, 15 bp, Homo sapiens
aaaatgacagtttca

SEQ ID NO: 801866 - DNA, 21 bp, Homo sapiens
aaaatgactaaaaatattata

SEQ ID NO: 801867 - DNA, 16 bp, Homo sapiens
aaaatgactttgaact

SEQ ID NO: 801868 - DNA, 19 bp, Homo sapiens
aaaatgactttgaactgaa

SEQ ID NO: 801869 - DNA, 18 bp, Homo sapiens
aaaatgagcatacatctt

SEQ ID NO: 801870 - DNA, 14 bp, Homo sapiens
aaaatgagcctggc

SEQ ID NO: 801871 - DNA, 21 bp, Homo sapiens
aaaatgagcctggcaagaatg

SEQ ID NO: 801872 - DNA, 18 bp, Homo sapiens
aaaatgaggttcaactgt

SEQ ID NO: 801873 - DNA, 18 bp, Homo sapiens
aaaatgagtcatttgttt

SEQ ID NO: 801874 - DNA, 23 bp, Homo sapiens
aaaatgatgtgtacccaaacgtg

SEQ ID NO: 801875 - DNA, 16 bp, Homo sapiens
aaaatgcaaaatgaaa

SEQ ID NO: 801876 - DNA, 14 bp, Homo sapiens
aaaatgcaaatgaa

SEQ ID NO: 801877 - DNA, 15 bp, Homo sapiens
aaaatgcaaatgaat

SEQ ID NO: 801878 - DNA, 16 bp, Homo sapiens
aaaatgcaaatgaatc

SEQ ID NO: 801879 - DNA, 18 bp, Homo sapiens
aaaatgcaaatgaatcat

SEQ ID NO: 801880 - DNA, 23 bp, Homo sapiens
aaaatgcaatcaggattttaaac

SEQ ID NO: 801881 - DNA, 14 bp, Homo sapiens
aaaatgcacatagc

SEQ ID NO: 801882 - DNA, 15 bp, Homo sapiens
aaaatgcatactgtt

SEQ ID NO: 801883 - DNA, 20 bp, Homo sapiens
aaaatgcattgaaagaatta

SEQ ID NO: 801884 - DNA, 23 bp, Homo sapiens
aaaatgccaagggggtgactgga

SEQ ID NO: 801885 - DNA, 16 bp, Homo sapiens
aaaatgcctcagtgta

SEQ ID NO: 801886 - DNA, 22 bp, Homo sapiens
aaaatgcctcagtgtatttgta

SEQ ID NO: 801887 - DNA, 18 bp, Homo sapiens
aaaatgcggttataaaaa

SEQ ID NO: 801888 - DNA, 22 bp, Homo sapiens
aaaatgcggttataaaaaatgg

SEQ ID NO: 801889 - DNA, 21 bp, Homo sapiens
aaaatgctcttaaaatatctt

SEQ ID NO: 801890 - DNA, 20 bp, Homo sapiens
aaaatgctgaacattgcata

SEQ ID NO: 801891 - DNA, 18 bp, Homo sapiens
aaaatggaaaaaaacata

SEQ ID NO: 801892 - DNA, 12 bp, Homo sapiens
aaaatggaaaga

SEQ ID NO: 801893 - DNA, 13 bp, Homo sapiens
aaaatggaaattt

SEQ ID NO: 801894 - DNA, 14 bp, Homo sapiens
aaaatggaagcaaa

SEQ ID NO: 801895 - DNA, 19 bp, Homo sapiens
aaaatggaagcaaagacaa

SEQ ID NO: 801896 - DNA, 20 bp, Homo sapiens
aaaatggaagcaaagacaaa

SEQ ID NO: 801897 - DNA, 14 bp, Homo sapiens
aaaatggaataaaa

SEQ ID NO: 801898 - DNA, 21 bp, Homo sapiens
aaaatggatattattagaaat

SEQ ID NO: 801899 - DNA, 21 bp, Homo sapiens
aaaatggatgccttgaataat

SEQ ID NO: 801900 - DNA, 21 bp, Homo sapiens
aaaatggcagggggtggaatt

SEQ ID NO: 801901 - DNA, 21 bp, Homo sapiens
aaaatggctaactgatgaatt

SEQ ID NO: 801902 - DNA, 19 bp, Homo sapiens
aaaatggctaataaactgt

SEQ ID NO: 801903 - DNA, 22 bp, Homo sapiens
aaaatggctaataaactgtatt

SEQ ID NO: 801904 - DNA, 19 bp, Homo sapiens
aaaatgggaagactgagct

SEQ ID NO: 801905 - DNA, 13 bp, Homo sapiens
aaaatgggaggag

SEQ ID NO: 801906 - DNA, 13 bp, Homo sapiens
aaaatggtatcaa

SEQ ID NO: 801907 - DNA, 22 bp, Homo sapiens
aaaatggtgagcgatcatttat

SEQ ID NO: 801908 - DNA, 17 bp, Homo sapiens
aaaatggtgttttcatg

SEQ ID NO: 801909 - DNA, 22 bp, Homo sapiens
aaaatggttgatggaaaataaa

SEQ ID NO: 801910 - DNA, 11 bp, Homo sapiens
aaaatgtaaca

SEQ ID NO: 801911 - DNA, 16 bp, Homo sapiens
aaaatgtaatttagaa

SEQ ID NO: 801912 - DNA, 21 bp, Homo sapiens
aaaatgtacactggatatgtt

SEQ ID NO: 801913 - DNA, 10 bp, Homo sapiens
aaaatgtact

SEQ ID NO: 801914 - DNA, 21 bp, Homo sapiens
aaaatgtaggcttagtttgtg

SEQ ID NO: 801915 - DNA, 20 bp, Homo sapiens
aaaatgtataaaaattatca

SEQ ID NO: 801916 - DNA, 17 bp, Homo sapiens
aaaatgtatatgcactt

SEQ ID NO: 801917 - DNA, 15 bp, Homo sapiens
aaaatgtatgtctgg

SEQ ID NO: 801918 - DNA, 17 bp, Homo sapiens
aaaatgtattcaagcaa

SEQ ID NO: 801919 - DNA, 16 bp, Homo sapiens
aaaatgtattgattca

SEQ ID NO: 801920 - DNA, 19 bp, Homo sapiens
aaaatgtatttaactcaga

SEQ ID NO: 801921 - DNA, 20 bp, Homo sapiens
aaaatgtccagccaccccca

SEQ ID NO: 801922 - DNA, 18 bp, Homo sapiens
aaaatgtctgtaataata

SEQ ID NO: 801923 - DNA, 18 bp, Homo sapiens
aaaatgtcttgtgttacc

SEQ ID NO: 801924 - DNA, 21 bp, Homo sapiens
aaaatgtgaaatgcttttata

SEQ ID NO: 801925 - DNA, 16 bp, Homo sapiens
aaaatgtgacccagat

SEQ ID NO: 801926 - DNA, 13 bp, Homo sapiens
aaaatgtgaccct

SEQ ID NO: 801927 - DNA, 18 bp, Homo sapiens
aaaatgtgatttttctga

SEQ ID NO: 801928 - DNA, 20 bp, Homo sapiens
aaaatgtgctatactgcata

SEQ ID NO: 801929 - DNA, 16 bp, Homo sapiens
aaaatgtgtaattttg

SEQ ID NO: 801930 - DNA, 17 bp, Homo sapiens
aaaatgtgtaattttgt

SEQ ID NO: 801931 - DNA, 12 bp, Homo sapiens
aaaatgtgtaca

SEQ ID NO: 801932 - DNA, 19 bp, Homo sapiens
aaaatgtgtacagtgaatt

SEQ ID NO: 801933 - DNA, 20 bp, Homo sapiens
aaaatgtgtatttttcaagg

SEQ ID NO: 801934 - DNA, 23 bp, Homo sapiens
aaaatgttacggcatcacactta

SEQ ID NO: 801935 - DNA, 16 bp, Homo sapiens
aaaatgttatttaaca

SEQ ID NO: 801936 - DNA, 18 bp, Homo sapiens
aaaatgttcccttgacca

SEQ ID NO: 801937 - DNA, 20 bp, Homo sapiens
aaaatgttctatttaacaac

SEQ ID NO: 801938 - DNA, 16 bp, Homo sapiens
aaaatgttctcaaata

SEQ ID NO: 801939 - DNA, 15 bp, Homo sapiens
aaaatgttctgtttg

SEQ ID NO: 801940 - DNA, 13 bp, Homo sapiens
aaaatgttgaaaa

SEQ ID NO: 801941 - DNA, 13 bp, Homo sapiens
aaaatgttgaaat

SEQ ID NO: 801942 - DNA, 17 bp, Homo sapiens
aaaatgttgaaatatga

SEQ ID NO: 801943 - DNA, 14 bp, Homo sapiens
aaaatgttgagaat

SEQ ID NO: 801944 - DNA, 20 bp, Homo sapiens
aaaatgttggatttataaat

SEQ ID NO: 801945 - DNA, 12 bp, Homo sapiens
aaaatgttttaa

SEQ ID NO: 801946 - DNA, 15 bp, Homo sapiens
aaaatgttttttcat

SEQ ID NO: 801947 - DNA, 21 bp, Homo sapiens
aaaatgttttttcatgtgttt

SEQ ID NO: 801948 - DNA, 15 bp, Homo sapiens
aaaattaaaaaatga

SEQ ID NO: 801949 - DNA, 18 bp, Homo sapiens
aaaattaaaaaatgaaat

SEQ ID NO: 801950 - DNA, 13 bp, Homo sapiens
aaaattaaaagaa

SEQ ID NO: 801951 - DNA, 18 bp, Homo sapiens
aaaattaaatctagacat

SEQ ID NO: 801952 - DNA, 14 bp, Homo sapiens
aaaattaaatgcct

SEQ ID NO: 801953 - DNA, 19 bp, Homo sapiens
aaaattaaatgccttgtat

SEQ ID NO: 801954 - DNA, 22 bp, Homo sapiens
aaaattaaatgccttgtataaa

SEQ ID NO: 801955 - DNA, 12 bp, Homo sapiens
aaaattaacttt

SEQ ID NO: 801956 - DNA, 16 bp, Homo sapiens
aaaattaatacattct

SEQ ID NO: 801957 - DNA, 14 bp, Homo sapiens
aaaattaatagctt

SEQ ID NO: 801958 - DNA, 19 bp, Homo sapiens
aaaattacctttaatttta

SEQ ID NO: 801959 - DNA, 22 bp, Homo sapiens
aaaattacgttcttacaagctt

SEQ ID NO: 801960 - DNA, 17 bp, Homo sapiens
aaaattacgtttgttat

SEQ ID NO: 801961 - DNA, 17 bp, Homo sapiens
aaaattagaaaggacaa

SEQ ID NO: 801962 - DNA, 21 bp, Homo sapiens
aaaattatactaacttattta

SEQ ID NO: 801963 - DNA, 18 bp, Homo sapiens
aaaattatactgtgtgtg

SEQ ID NO: 801964 - DNA, 16 bp, Homo sapiens
aaaattatcaaaaagc

SEQ ID NO: 801965 - DNA, 18 bp, Homo sapiens
aaaattatggaaacagat

SEQ ID NO: 801966 - DNA, 14 bp, Homo sapiens
aaaattatttgcat

SEQ ID NO: 801967 - DNA, 19 bp, Homo sapiens
aaaattattttaaacaaaa

SEQ ID NO: 801968 - DNA, 18 bp, Homo sapiens
aaaattcaaaaagtgttt

SEQ ID NO: 801969 - DNA, 22 bp, Homo sapiens
aaaattcaagcatttaggaatg

SEQ ID NO: 801970 - DNA, 14 bp, Homo sapiens
aaaattcaattgta

SEQ ID NO: 801971 - DNA, 13 bp, Homo sapiens
aaacattcccctc

SEQ ID NO: 801972 - DNA, 19 bp, Homo sapiens
aaacattcctccagcctcc

SEQ ID NO: 801973 - DNA, 21 bp, Homo sapiens
aaacattctatctactgattt

SEQ ID NO: 801974 - DNA, 16 bp, Homo sapiens
aaacattgaagtaatg

SEQ ID NO: 801975 - DNA, 23 bp, Homo sapiens
aaacattgccatgtaactatgta

SEQ ID NO: 801976 - DNA, 17 bp, Homo sapiens
aaacattgctgcctttg

SEQ ID NO: 801977 - DNA, 13 bp, Homo sapiens
aaacatttaacat

SEQ ID NO: 801978 - DNA, 17 bp, Homo sapiens
aaacatttaacataatg

SEQ ID NO: 801979 - DNA, 23 bp, Homo sapiens
aaacatttaacataatggttgtg

SEQ ID NO: 801980 - DNA, 18 bp, Homo sapiens
aaacatttattttgacat

SEQ ID NO: 801981 - DNA, 20 bp, Homo sapiens
aaacatttattttgacataa

SEQ ID NO: 801982 - DNA, 22 bp, Homo sapiens
aaacatttcaatgtcagccttt

SEQ ID NO: 801983 - DNA, 23 bp, Homo sapiens
aaacatttcataatttgtttcca

SEQ ID NO: 801984 - DNA, 15 bp, Homo sapiens
aaacatttgttcctg

SEQ ID NO: 801985 - DNA, 17 bp, Homo sapiens
aaacatttgttcctgga

SEQ ID NO: 801986 - DNA, 14 bp, Homo sapiens
aaacattttatact

SEQ ID NO: 801987 - DNA, 18 bp, Homo sapiens
aaacattttatactgtac

SEQ ID NO: 801988 - DNA, 21 bp, Homo sapiens
aaacattttatactgtacatg

SEQ ID NO: 801989 - DNA, 16 bp, Homo sapiens
aaacattttatcatta

SEQ ID NO: 801990 - DNA, 18 bp, Homo sapiens
aaacattttctttctttt

SEQ ID NO: 801991 - DNA, 17 bp, Homo sapiens
aaacattttgaagtgtg

SEQ ID NO: 801992 - DNA, 14 bp, Homo sapiens
aaacattttttagt

SEQ ID NO: 801993 - DNA, 13 bp, Homo sapiens
aaaccaaaacaga

SEQ ID NO: 801994 - DNA, 14 bp, Homo sapiens
aaaccaaaatgata

SEQ ID NO: 801995 - DNA, 22 bp, Homo sapiens
aaaccaaactggttcacctgaa

SEQ ID NO: 801996 - DNA, 21 bp, Homo sapiens
aaaccaaacttgttcatttag

SEQ ID NO: 801997 - DNA, 15 bp, Homo sapiens
aaaccaaagaagaaa

SEQ ID NO: 801998 - DNA, 20 bp, Homo sapiens
aaaccaaagagggcttcctc

SEQ ID NO: 801999 - DNA, 14 bp, Homo sapiens
aaaccaaagctgcc

SEQ ID NO: 802000 - DNA, 11 bp, Homo sapiens
aaaccaacagg

SEQ ID NO: 802001 - DNA, 14 bp, Homo sapiens
aaaccaacatcttt

SEQ ID NO: 802002 - DNA, 22 bp, Homo sapiens
aaaccaagattttgaaggaaat

SEQ ID NO: 802003 - DNA, 14 bp, Homo sapiens
aaaccaagcagctt

SEQ ID NO: 802004 - DNA, 14 bp, Homo sapiens
aaaccaagccgtgg

SEQ ID NO: 802005 - DNA, 17 bp, Homo sapiens
aaaccaagtcaggccag

SEQ ID NO: 802006 - DNA, 16 bp, Homo sapiens
aaaccaagtgggctgg

SEQ ID NO: 802007 - DNA, 19 bp, Homo sapiens
aaaccaatggtgatcctct

SEQ ID NO: 802008 - DNA, 20 bp, Homo sapiens
aaaccaatttcttccttcca

SEQ ID NO: 802009 - DNA, 13 bp, Homo sapiens
aaaccacagctgg

SEQ ID NO: 802010 - DNA, 23 bp, Homo sapiens
aaaccacataatttttgtacatc

SEQ ID NO: 802011 - DNA, 11 bp, Homo sapiens
aaaccacatgg

SEQ ID NO: 802012 - DNA, 16 bp, Homo sapiens
aaaccacatgggctgg

SEQ ID NO: 802013 - DNA, 18 bp, Homo sapiens
aaaccacatgggctgggg

SEQ ID NO: 802014 - DNA, 17 bp, Homo sapiens
aaaccactgaaaaaata

SEQ ID NO: 802015 - DNA, 18 bp, Homo sapiens
aaaccactgaaaaaatat

SEQ ID NO: 802016 - DNA, 18 bp, Homo sapiens
aaaccacttctccatgct

SEQ ID NO: 802017 - DNA, 14 bp, Homo sapiens
aaaccacttgcctg

SEQ ID NO: 802018 - DNA, 12 bp, Homo sapiens
aaaccagccttc

SEQ ID NO: 802019 - DNA, 12 bp, Homo sapiens
aaaccagggagc

SEQ ID NO: 802020 - DNA, 23 bp, Homo sapiens
aaaccagtaacgtgctgctcaag

SEQ ID NO: 802021 - DNA, 15 bp, Homo sapiens
aaaccagtatcgtta

SEQ ID NO: 802022 - DNA, 19 bp, Homo sapiens
aaaccagtgtagccttgcc

SEQ ID NO: 802023 - DNA, 17 bp, Homo sapiens
aaaccagtttattctgt

SEQ ID NO: 802024 - DNA, 16 bp, Homo sapiens
aaaccataatgtcttt

SEQ ID NO: 802025 - DNA, 22 bp, Homo sapiens
aaaccatcaagttgtgccaaat

SEQ ID NO: 802026 - DNA, 16 bp, Homo sapiens
aaaccatcagatattt

SEQ ID NO: 802027 - DNA, 20 bp, Homo sapiens
aaaccatcagatatttctta

SEQ ID NO: 802028 - DNA, 13 bp, Homo sapiens
aaaccatgacaaa

SEQ ID NO: 802029 - DNA, 21 bp, Homo sapiens
aaaccatgactgtgaccacct

SEQ ID NO: 802030 - DNA, 15 bp, Homo sapiens
aaaccatgcaaatgc

SEQ ID NO: 802031 - DNA, 19 bp, Homo sapiens
aaaccattactgaggggat

SEQ ID NO: 802032 - DNA, 15 bp, Homo sapiens
aaaccattgctctta

SEQ ID NO: 802033 - DNA, 14 bp, Homo sapiens
aaaccattgcttca

SEQ ID NO: 802034 - DNA, 16 bp, Homo sapiens
aaaccattgcttcact

SEQ ID NO: 802035 - DNA, 14 bp, Homo sapiens
aaaccattgtaact

SEQ ID NO: 802036 - DNA, 18 bp, Homo sapiens
aaaccattgtaactatta

SEQ ID NO: 802037 - DNA, 22 bp, Homo sapiens
aaaccattgtaactattaacct

SEQ ID NO: 802038 - DNA, 20 bp, Homo sapiens
aaaccattttcccatcatcc

SEQ ID NO: 802039 - DNA, 18 bp, Homo sapiens
aaaccatttttgttactc

SEQ ID NO: 802040 - DNA, 17 bp, Homo sapiens
aaacccaatacttttgt

SEQ ID NO: 802041 - DNA, 14 bp, Homo sapiens
aaacccacaagctg

SEQ ID NO: 802042 - DNA, 17 bp, Homo sapiens
aaacccacttctggcct

SEQ ID NO: 802043 - DNA, 11 bp, Homo sapiens
aaacccagaga

SEQ ID NO: 802044 - DNA, 13 bp, Homo sapiens
aaacccagccact

SEQ ID NO: 802045 - DNA, 21 bp, Homo sapiens
aaacccagcggcttagccaag

SEQ ID NO: 802046 - DNA, 17 bp, Homo sapiens
aaacccagttgccatct

SEQ ID NO: 802047 - DNA, 13 bp, Homo sapiens
aaacccatacaat

SEQ ID NO: 802048 - DNA, 22 bp, Homo sapiens
aaacccatattgtaaaacaggt

SEQ ID NO: 802049 - DNA, 15 bp, Homo sapiens
aaaccccagccccaa

SEQ ID NO: 802050 - DNA, 18 bp, Homo sapiens
aaaccccagccccaactc

SEQ ID NO: 802051 - DNA, 21 bp, Homo sapiens
aaacccccaaaatccaaaact

SEQ ID NO: 802052 - DNA, 18 bp, Homo sapiens
aaacccctgtaggcctca

SEQ ID NO: 802053 - DNA, 13 bp, Homo sapiens
aaaccccttccca

SEQ ID NO: 802054 - DNA, 20 bp, Homo sapiens
aaacccgtctctactaaaaa

SEQ ID NO: 802055 - DNA, 20 bp, Homo sapiens
aaaccctaattttgtacata

SEQ ID NO: 802056 - DNA, 16 bp, Homo sapiens
aaaccctagccttgct

SEQ ID NO: 802057 - DNA, 17 bp, Homo sapiens
aaaccctatctgtgatt

SEQ ID NO: 802058 - DNA, 20 bp, Homo sapiens
aaaccctcccagaaacatct

SEQ ID NO: 802059 - DNA, 21 bp, Homo sapiens
aaaccctggtggtattttatt

SEQ ID NO: 802060 - DNA, 19 bp, Homo sapiens
aaacccttcaactcctggc

SEQ ID NO: 802061 - DNA, 22 bp, Homo sapiens
aaacccttcaactcctggctcc

SEQ ID NO: 802062 - DNA, 12 bp, Homo sapiens
aaaccctttgta

SEQ ID NO: 802063 - DNA, 15 bp, Homo sapiens
aaaccctttgtatta

SEQ ID NO: 802064 - DNA, 13 bp, Homo sapiens
aaaccgaataaat

SEQ ID NO: 802065 - DNA, 14 bp, Homo sapiens
aaaccgaataaatg

SEQ ID NO: 802066 - DNA, 15 bp, Homo sapiens
aaaccgccaaggctg

SEQ ID NO: 802067 - DNA, 18 bp, Homo sapiens
aaaccgctaaaagaaact

SEQ ID NO: 802068 - DNA, 21 bp, Homo sapiens
aaaccgctaaaagaaactttc

SEQ ID NO: 802069 - DNA, 23 bp, Homo sapiens
aaaccgctaaaagaaactttctt

SEQ ID NO: 802070 - DNA, 14 bp, Homo sapiens
aaaccgcttttggt

SEQ ID NO: 802071 - DNA, 16 bp, Homo sapiens
aaaccgcttttggttt

SEQ ID NO: 802072 - DNA, 19 bp, Homo sapiens
aaaccgtcctgtgtacaca

SEQ ID NO: 802073 - DNA, 15 bp, Homo sapiens
aaacctaaaaaagat

SEQ ID NO: 802074 - DNA, 18 bp, Homo sapiens
aaacctacacactgtcat

SEQ ID NO: 802075 - DNA, 14 bp, Homo sapiens
aaacctactgccca

SEQ ID NO: 802076 - DNA, 17 bp, Homo sapiens
aaacctactgcccacat

SEQ ID NO: 802077 - DNA, 18 bp, Homo sapiens
aaacctactgcccacatt

SEQ ID NO: 802078 - DNA, 16 bp, Homo sapiens
aaacctagaattttct

SEQ ID NO: 802079 - DNA, 16 bp, Homo sapiens
aaacctagcttttaaa

SEQ ID NO: 802080 - DNA, 18 bp, Homo sapiens
aaacctagcttttaaaaa

SEQ ID NO: 802081 - DNA, 20 bp, Homo sapiens
aaacctagcttttaaaaaat

SEQ ID NO: 802082 - DNA, 21 bp, Homo sapiens
aaacctagcttttaaaaaata

SEQ ID NO: 802083 - DNA, 16 bp, Homo sapiens
aaacctagtactgccc

SEQ ID NO: 802084 - DNA, 18 bp, Homo sapiens
aaacctatctcagggagg

SEQ ID NO: 802085 - DNA, 20 bp, Homo sapiens
aaacctcagggctgtcccag

SEQ ID NO: 802086 - DNA, 23 bp, Homo sapiens
aaacctcagggctgtcccagccc

SEQ ID NO: 802087 - DNA, 22 bp, Homo sapiens
aaacctctcctcatgttctgct

SEQ ID NO: 802088 - DNA, 22 bp, Homo sapiens
aaacctgaaaaaaagtttacaa

SEQ ID NO: 802089 - DNA, 18 bp, Homo sapiens
aaacctgacccctgctca

SEQ ID NO: 802090 - DNA, 13 bp, Homo sapiens
aaacctgcactga

SEQ ID NO: 802091 - DNA, 22 bp, Homo sapiens
aaacctgcagttaacaggatat

SEQ ID NO: 802092 - DNA, 12 bp, Homo sapiens
aaacctgccctg

SEQ ID NO: 802093 - DNA, 14 bp, Homo sapiens
aaactttttccagc

SEQ ID NO: 802094 - DNA, 18 bp, Homo sapiens
aaacttttttatatcttt

SEQ ID NO: 802095 - DNA, 20 bp, Homo sapiens
aaacttttttatatcttttg

SEQ ID NO: 802096 - DNA, 15 bp, Homo sapiens
aaacttttttttcct

SEQ ID NO: 802097 - DNA, 9 bp, Homo sapiens
aaagaaaaa

SEQ ID NO: 802098 - DNA, 22 bp, Homo sapiens
aaagaaaaaaaaaaaagccagc

SEQ ID NO: 802099 - DNA, 13 bp, Homo sapiens
aaagaaaaaaaat

SEQ ID NO: 802100 - DNA, 16 bp, Homo sapiens
aaagaaaaaaattgaa

SEQ ID NO: 802101 - DNA, 12 bp, Homo sapiens
aaagaaaaagaa

SEQ ID NO: 802102 - DNA, 12 bp, Homo sapiens
aaagaaaaatgc

SEQ ID NO: 802103 - DNA, 19 bp, Homo sapiens
aaagaaaacaaaaaacgaa

SEQ ID NO: 802104 - DNA, 15 bp, Homo sapiens
aaagaaaacatttaa

SEQ ID NO: 802105 - DNA, 17 bp, Homo sapiens
aaagaaaagacatttta

SEQ ID NO: 802106 - DNA, 14 bp, Homo sapiens
aaagaaaagataaa

SEQ ID NO: 802107 - DNA, 23 bp, Homo sapiens
aaagaaaagataaagatgatcta

SEQ ID NO: 802108 - DNA, 13 bp, Homo sapiens
aaagaaaaggcaa

SEQ ID NO: 802109 - DNA, 12 bp, Homo sapiens
aaagaaaataaa

SEQ ID NO: 802110 - DNA, 13 bp, Homo sapiens
aaagaaaatgtct

SEQ ID NO: 802111 - DNA, 13 bp, Homo sapiens
aaagaaaattcct

SEQ ID NO: 802112 - DNA, 21 bp, Homo sapiens
aaagaaaattgcatgaaacta

SEQ ID NO: 802113 - DNA, 19 bp, Homo sapiens
aaagaaaatttttgtagta

SEQ ID NO: 802114 - DNA, 13 bp, Homo sapiens
aaagaaacaagct

SEQ ID NO: 802115 - DNA, 14 bp, Homo sapiens
aaagaaacaagctg

SEQ ID NO: 802116 - DNA, 17 bp, Homo sapiens
aaagaaacaagctgtgc

SEQ ID NO: 802117 - DNA, 20 bp, Homo sapiens
aaagaaacaagctgtgcagg

SEQ ID NO: 802118 - DNA, 13 bp, Homo sapiens
aaagaaacagctt

SEQ ID NO: 802119 - DNA, 17 bp, Homo sapiens
aaagaaaccatgacaaa

SEQ ID NO: 802120 - DNA, 20 bp, Homo sapiens
aaagaaacctggggtgaata

SEQ ID NO: 802121 - DNA, 22 bp, Homo sapiens
aaagaaactgacatgccctccc

SEQ ID NO: 802122 - DNA, 20 bp, Homo sapiens
aaagaaacttggctggaatt

SEQ ID NO: 802123 - DNA, 13 bp, Homo sapiens
aaagaaagcagaa

SEQ ID NO: 802124 - DNA, 12 bp, Homo sapiens
aaagaaaggaaa

SEQ ID NO: 802125 - DNA, 13 bp, Homo sapiens
aaagaaagggaaa

SEQ ID NO: 802126 - DNA, 15 bp, Homo sapiens
aaagaaagggaaaag

SEQ ID NO: 802127 - DNA, 13 bp, Homo sapiens
aaagaaagtgaaa

SEQ ID NO: 802128 - DNA, 13 bp, Homo sapiens
aaagaaatattta

SEQ ID NO: 802129 - DNA, 14 bp, Homo sapiens
aaagaaatatttac

SEQ ID NO: 802130 - DNA, 23 bp, Homo sapiens
aaagaaatccatatcttaaagaa

SEQ ID NO: 802131 - DNA, 20 bp, Homo sapiens
aaagaaatccggagaagctg

SEQ ID NO: 802132 - DNA, 13 bp, Homo sapiens
aaagaaatctgtt

SEQ ID NO: 802133 - DNA, 14 bp, Homo sapiens
aaagaaatgcaaaa

SEQ ID NO: 802134 - DNA, 19 bp, Homo sapiens
aaagaaatgtctattaagg

SEQ ID NO: 802135 - DNA, 15 bp, Homo sapiens
aaagaaatttggtac

SEQ ID NO: 802136 - DNA, 12 bp, Homo sapiens
aaagaacagatg

SEQ ID NO: 802137 - DNA, 15 bp, Homo sapiens
aaagaacagtaaaca

SEQ ID NO: 802138 - DNA, 22 bp, Homo sapiens
aaagaacatggacttgtatatt

SEQ ID NO: 802139 - DNA, 14 bp, Homo sapiens
aaagaacattttgc

SEQ ID NO: 802140 - DNA, 14 bp, Homo sapiens
aaagaaccaaaact

SEQ ID NO: 802141 - DNA, 23 bp, Homo sapiens
aaagaacgtggtcagagtagaac

SEQ ID NO: 802142 - DNA, 14 bp, Homo sapiens
aaagaactgtactg

SEQ ID NO: 802143 - DNA, 18 bp, Homo sapiens
aaagaacttaaattatgt

SEQ ID NO: 802144 - DNA, 19 bp, Homo sapiens
aaagaacttgatttgcatg

SEQ ID NO: 802145 - DNA, 18 bp, Homo sapiens
aaagaactttaaagctca

SEQ ID NO: 802146 - DNA, 14 bp, Homo sapiens
aaagaagaaacttt

SEQ ID NO: 802147 - DNA, 13 bp, Homo sapiens
aaagaagaacagc

SEQ ID NO: 802148 - DNA, 15 bp, Homo sapiens
aaagaagaacagctg

SEQ ID NO: 802149 - DNA, 10 bp, Homo sapiens
aaagaagaca

SEQ ID NO: 802150 - DNA, 19 bp, Homo sapiens
aaagaagacaacattaaaa

SEQ ID NO: 802151 - DNA, 15 bp, Homo sapiens
aaagaagacacagaa

SEQ ID NO: 802152 - DNA, 14 bp, Homo sapiens
aaagaagacctgag

SEQ ID NO: 802153 - DNA, 21 bp, Homo sapiens
aaagaagagaggggaagaatt

SEQ ID NO: 802154 - DNA, 22 bp, Homo sapiens
aaagaagagtgacttattttgt

SEQ ID NO: 802155 - DNA, 12 bp, Homo sapiens
aaagaagctgca

SEQ ID NO: 802156 - DNA, 18 bp, Homo sapiens
aaagaaggaaaatgatct

SEQ ID NO: 802157 - DNA, 15 bp, Homo sapiens
aaagaaggacccaga

SEQ ID NO: 802158 - DNA, 18 bp, Homo sapiens
aaagaaggtatttttcca

SEQ ID NO: 802159 - DNA, 22 bp, Homo sapiens
aaagaaggtttgtgtttttctg

SEQ ID NO: 802160 - DNA, 16 bp, Homo sapiens
aaagaagtatttttag

SEQ ID NO: 802161 - DNA, 15 bp, Homo sapiens
aaagaagtggagaca

SEQ ID NO: 802162 - DNA, 18 bp, Homo sapiens
aaagaagttattttccag

SEQ ID NO: 802163 - DNA, 21 bp, Homo sapiens
aaagaataagtgtctttctgg

SEQ ID NO: 802164 - DNA, 18 bp, Homo sapiens
aaagaatactatttccaa

SEQ ID NO: 802165 - DNA, 21 bp, Homo sapiens
aaagaatatttaaataaacgt

SEQ ID NO: 802166 - DNA, 23 bp, Homo sapiens
aaagaatatttagaaaaacatcc

SEQ ID NO: 802167 - DNA, 15 bp, Homo sapiens
aaagaatattttgat

SEQ ID NO: 802168 - DNA, 20 bp, Homo sapiens
aaagaatattttgatgcaga

SEQ ID NO: 802169 - DNA, 15 bp, Homo sapiens
aaagaatccctgcag

SEQ ID NO: 802170 - DNA, 14 bp, Homo sapiens
aaagaatctatcac

SEQ ID NO: 802171 - DNA, 14 bp, Homo sapiens
aaagaattacagta

SEQ ID NO: 802172 - DNA, 22 bp, Homo sapiens
aaagaattcacacaactacttt

SEQ ID NO: 802173 - DNA, 13 bp, Homo sapiens
aaagaattttcat

SEQ ID NO: 802174 - DNA, 17 bp, Homo sapiens
aaagacaaattctgttt

SEQ ID NO: 802175 - DNA, 16 bp, Homo sapiens
aaagacagcagacaaa

SEQ ID NO: 802176 - DNA, 14 bp, Homo sapiens
aaagacaggaagac

SEQ ID NO: 802177 - DNA, 19 bp, Homo sapiens
aaagacatccataaagaag

SEQ ID NO: 802178 - DNA, 14 bp, Homo sapiens
aaagacatctgcct

SEQ ID NO: 802179 - DNA, 17 bp, Homo sapiens
aaagaccaaatctcagt

SEQ ID NO: 802180 - DNA, 15 bp, Homo sapiens
aaagaccaagacttt

SEQ ID NO: 802181 - DNA, 19 bp, Homo sapiens
aaagaccacctccaaccca

SEQ ID NO: 802182 - DNA, 14 bp, Homo sapiens
aaagaccaggccaa

SEQ ID NO: 802183 - DNA, 13 bp, Homo sapiens
aaagaccagggct

SEQ ID NO: 802184 - DNA, 14 bp, Homo sapiens
aaagaccatgcatt

SEQ ID NO: 802185 - DNA, 21 bp, Homo sapiens
aaagaccatgcatttaaagta

SEQ ID NO: 802186 - DNA, 15 bp, Homo sapiens
aaagacccaggggga

SEQ ID NO: 802187 - DNA, 20 bp, Homo sapiens
aaagacggatggcaggatcc

SEQ ID NO: 802188 - DNA, 14 bp, Homo sapiens
aaagacggattcta

SEQ ID NO: 802189 - DNA, 14 bp, Homo sapiens
aaagactaatttaa

SEQ ID NO: 802190 - DNA, 15 bp, Homo sapiens
aaagactattctgtt

SEQ ID NO: 802191 - DNA, 19 bp, Homo sapiens
aaagactatttcaaaatgt

SEQ ID NO: 802192 - DNA, 14 bp, Homo sapiens
aaagactattttct

SEQ ID NO: 802193 - DNA, 14 bp, Homo sapiens
aaagactcagccaa

SEQ ID NO: 802194 - DNA, 23 bp, Homo sapiens
aaagactcctcctgggggctggc

SEQ ID NO: 802195 - DNA, 14 bp, Homo sapiens
aaagactcctctgg

SEQ ID NO: 802196 - DNA, 18 bp, Homo sapiens
aaagactgaacatgttta

SEQ ID NO: 802197 - DNA, 13 bp, Homo sapiens
aaagactgcagct

SEQ ID NO: 802198 - DNA, 17 bp, Homo sapiens
aaagactgcagctgctg

SEQ ID NO: 802199 - DNA, 21 bp, Homo sapiens
aaagactggcttttattaatg

SEQ ID NO: 802200 - DNA, 12 bp, Homo sapiens
aaagactggttt

SEQ ID NO: 802201 - DNA, 22 bp, Homo sapiens
aaagactggtttgtttgcttaa

SEQ ID NO: 802202 - DNA, 17 bp, Homo sapiens
aaagacttgagacaatg

SEQ ID NO: 802203 - DNA, 18 bp, Homo sapiens
aaagacttggttggtagg

SEQ ID NO: 802204 - DNA, 12 bp, Homo sapiens
aaagacttttgt

SEQ ID NO: 802205 - DNA, 18 bp, Homo sapiens
aaagagaaaaaaagtttg

SEQ ID NO: 802206 - DNA, 14 bp, Homo sapiens
aaagagaaaagaaa

SEQ ID NO: 802207 - DNA, 16 bp, Homo sapiens
aaagagaaaagggaaa

SEQ ID NO: 802208 - DNA, 15 bp, Homo sapiens
aaagagaatgaactg

SEQ ID NO: 802209 - DNA, 21 bp, Homo sapiens
aaagagaatgaactgtggaat

SEQ ID NO: 802210 - DNA, 11 bp, Homo sapiens
aaagagacaga

SEQ ID NO: 802211 - DNA, 21 bp, Homo sapiens
aaagagacagtgatattggaa

SEQ ID NO: 802212 - DNA, 15 bp, Homo sapiens
aaagagactggagca

SEQ ID NO: 802213 - DNA, 13 bp, Homo sapiens
aaagagagaatgt

SEQ ID NO: 802214 - DNA, 18 bp, Homo sapiens
aaagagagaatgtagata

SEQ ID NO: 802215 - DNA, 12 bp, Homo sapiens
aaagagaggtta

SEQ ID NO: 802216 - DNA, 18 bp, Homo sapiens
aaagagataataagatta

SEQ ID NO: 802217 - DNA, 14 bp, Homo sapiens
aaaggaggctggca

SEQ ID NO: 802218 - DNA, 18 bp, Homo sapiens
aaaggaggggaaacaatg

SEQ ID NO: 802219 - DNA, 16 bp, Homo sapiens
aaaggagtcaaaacta

SEQ ID NO: 802220 - DNA, 13 bp, Homo sapiens
aaaggataaagaa

SEQ ID NO: 802221 - DNA, 14 bp, Homo sapiens
aaaggataaagaag

SEQ ID NO: 802222 - DNA, 23 bp, Homo sapiens
aaaggatataaaaggatgttaca

SEQ ID NO: 802223 - DNA, 18 bp, Homo sapiens
aaaggatattatctacct

SEQ ID NO: 802224 - DNA, 13 bp, Homo sapiens
aaaggatatttaa

SEQ ID NO: 802225 - DNA, 19 bp, Homo sapiens
aaaggatatttaagaaaat

SEQ ID NO: 802226 - DNA, 17 bp, Homo sapiens
aaaggatctaagggaag

SEQ ID NO: 802227 - DNA, 13 bp, Homo sapiens
aaaggatgaagaa

SEQ ID NO: 802228 - DNA, 15 bp, Homo sapiens
aaaggatgaagaaca

SEQ ID NO: 802229 - DNA, 19 bp, Homo sapiens
aaaggatgaagaacacagc

SEQ ID NO: 802230 - DNA, 16 bp, Homo sapiens
aaaggatgagaatgtg

SEQ ID NO: 802231 - DNA, 20 bp, Homo sapiens
aaaggatgtaaacagtgcct

SEQ ID NO: 802232 - DNA, 21 bp, Homo sapiens
aaaggatgtaaacagtgcctg

SEQ ID NO: 802233 - DNA, 18 bp, Homo sapiens
aaaggatgtataaatttt

SEQ ID NO: 802234 - DNA, 17 bp, Homo sapiens
aaaggatgtgatatata

SEQ ID NO: 802235 - DNA, 13 bp, Homo sapiens
aaaggatgttaca

SEQ ID NO: 802236 - DNA, 18 bp, Homo sapiens
aaaggatgttacaagttt

SEQ ID NO: 802237 - DNA, 21 bp, Homo sapiens
aaaggatgttacaagtttgct

SEQ ID NO: 802238 - DNA, 16 bp, Homo sapiens
aaaggattttaccaaa

SEQ ID NO: 802239 - DNA, 14 bp, Homo sapiens
aaaggcaaaagact

SEQ ID NO: 802240 - DNA, 14 bp, Homo sapiens
aaaggcaaatattg

SEQ ID NO: 802241 - DNA, 16 bp, Homo sapiens
aaaggcaaatgtgtac

SEQ ID NO: 802242 - DNA, 17 bp, Homo sapiens
aaaggcaaatgtgtaca

SEQ ID NO: 802243 - DNA, 18 bp, Homo sapiens
aaaggcaatggtttgtgt

SEQ ID NO: 802244 - DNA, 12 bp, Homo sapiens
aaaggcagagga

SEQ ID NO: 802245 - DNA, 16 bp, Homo sapiens
aaaggcagccctcacc

SEQ ID NO: 802246 - DNA, 20 bp, Homo sapiens
aaaggcagggccacttttga

SEQ ID NO: 802247 - DNA, 20 bp, Homo sapiens
aaaggcaggtttcatttctt

SEQ ID NO: 802248 - DNA, 18 bp, Homo sapiens
aaaggcagtattttgtgt

SEQ ID NO: 802249 - DNA, 21 bp, Homo sapiens
aaaggcatccttgtcttttga

SEQ ID NO: 802250 - DNA, 16 bp, Homo sapiens
aaaggcattctctgaa

SEQ ID NO: 802251 - DNA, 18 bp, Homo sapiens
aaaggcattctctgaaga

SEQ ID NO: 802252 - DNA, 19 bp, Homo sapiens
aaaggccagtggaagaaac

SEQ ID NO: 802253 - DNA, 16 bp, Homo sapiens
aaaggcccagccccta

SEQ ID NO: 802254 - DNA, 21 bp, Homo sapiens
aaaggcctaattctatgcctg

SEQ ID NO: 802255 - DNA, 13 bp, Homo sapiens
aaaggcctggcgt

SEQ ID NO: 802256 - DNA, 19 bp, Homo sapiens
aaaggctaagaatagtggg

SEQ ID NO: 802257 - DNA, 19 bp, Homo sapiens
aaaggctcagtctcaggag

SEQ ID NO: 802258 - DNA, 14 bp, Homo sapiens
aaaggctcatttaa

SEQ ID NO: 802259 - DNA, 15 bp, Homo sapiens
aaaggctcatttaaa

SEQ ID NO: 802260 - DNA, 18 bp, Homo sapiens
aaaggctcatttaaaaca

SEQ ID NO: 802261 - DNA, 21 bp, Homo sapiens
aaaggctcatttaaaacaggc

SEQ ID NO: 802262 - DNA, 16 bp, Homo sapiens
aaaggctgattactga

SEQ ID NO: 802263 - DNA, 16 bp, Homo sapiens
aaaggcttgaagctgt

SEQ ID NO: 802264 - DNA, 17 bp, Homo sapiens
aaaggcttgaagctgtg

SEQ ID NO: 802265 - DNA, 19 bp, Homo sapiens
aaagggaacaagatgctga

SEQ ID NO: 802266 - DNA, 16 bp, Homo sapiens
aaagggaactgaacat

SEQ ID NO: 802267 - DNA, 21 bp, Homo sapiens
aaagggaactgaacattccag

SEQ ID NO: 802268 - DNA, 18 bp, Homo sapiens
aaagggaagttgtgcctt

SEQ ID NO: 802269 - DNA, 22 bp, Homo sapiens
aaagggaatcatttttcactgt

SEQ ID NO: 802270 - DNA, 18 bp, Homo sapiens
aaagggaatgggtctgca

SEQ ID NO: 802271 - DNA, 16 bp, Homo sapiens
aaagggagaaatgcca

SEQ ID NO: 802272 - DNA, 21 bp, Homo sapiens
aaagggagaaggaagggcaga

SEQ ID NO: 802273 - DNA, 20 bp, Homo sapiens
aaagggagaatggtgctgtt

SEQ ID NO: 802274 - DNA, 15 bp, Homo sapiens
aaagggagaggaaga

SEQ ID NO: 802275 - DNA, 23 bp, Homo sapiens
aaagggagcactgggttgacttt

SEQ ID NO: 802276 - DNA, 18 bp, Homo sapiens
aaagggagctatcaggaa

SEQ ID NO: 802277 - DNA, 15 bp, Homo sapiens
aaagggattgaggag

SEQ ID NO: 802278 - DNA, 20 bp, Homo sapiens
aaagggcacttaatttgtaa

SEQ ID NO: 802279 - DNA, 13 bp, Homo sapiens
aaagggcagggcc

SEQ ID NO: 802280 - DNA, 20 bp, Homo sapiens
aaagggcagggcccacgtgt

SEQ ID NO: 802281 - DNA, 13 bp, Homo sapiens
aaagggccaggag

SEQ ID NO: 802282 - DNA, 22 bp, Homo sapiens
aaagggcttcggccacaggcag

SEQ ID NO: 802283 - DNA, 15 bp, Homo sapiens
aaaggggacaggcct

SEQ ID NO: 802284 - DNA, 23 bp, Homo sapiens
aaaggggagaaactgaaagtgtt

SEQ ID NO: 802285 - DNA, 13 bp, Homo sapiens
aaaggggaggaga

SEQ ID NO: 802286 - DNA, 14 bp, Homo sapiens
aaaggggaggagaa

SEQ ID NO: 802287 - DNA, 19 bp, Homo sapiens
aaaggggagttgagtcaca

SEQ ID NO: 802288 - DNA, 19 bp, Homo sapiens
aaaggggcgagcacccacg

SEQ ID NO: 802289 - DNA, 13 bp, Homo sapiens
aaagggggctgca

SEQ ID NO: 802290 - DNA, 13 bp, Homo sapiens
aaaggggggaggg

SEQ ID NO: 802291 - DNA, 18 bp, Homo sapiens
aaaggggggagggggagg

SEQ ID NO: 802292 - DNA, 21 bp, Homo sapiens
aaagggggtcccagtgggagg

SEQ ID NO: 802293 - DNA, 20 bp, Homo sapiens
aaaggggttggggtgacagt

SEQ ID NO: 802294 - DNA, 22 bp, Homo sapiens
aaaggggttggggtgacagtca

SEQ ID NO: 802295 - DNA, 21 bp, Homo sapiens
aaagggtaatttcctttgctt

SEQ ID NO: 802296 - DNA, 21 bp, Homo sapiens
aaagggtgaagctatttatct

SEQ ID NO: 802297 - DNA, 18 bp, Homo sapiens
aaagggtgtatagtgttc

SEQ ID NO: 802298 - DNA, 18 bp, Homo sapiens
aaagggttaatagccaga

SEQ ID NO: 802299 - DNA, 23 bp, Homo sapiens
aaagggttgaaaatgtgtttgct

SEQ ID NO: 802300 - DNA, 20 bp, Homo sapiens
aaagggtttgtaatacttta

SEQ ID NO: 802301 - DNA, 13 bp, Homo sapiens
aaaggtaaaatca

SEQ ID NO: 802302 - DNA, 15 bp, Homo sapiens
aaaggtaaaatcact

SEQ ID NO: 802303 - DNA, 23 bp, Homo sapiens
aaaggtaaaatcacttcagatct

SEQ ID NO: 802304 - DNA, 21 bp, Homo sapiens
aaaggtacactggtatttata

SEQ ID NO: 802305 - DNA, 18 bp, Homo sapiens
aaaggtattttgaatacc

SEQ ID NO: 802306 - DNA, 14 bp, Homo sapiens
aaaggtcagcccgt

SEQ ID NO: 802307 - DNA, 15 bp, Homo sapiens
aaaggtcctgccctc

SEQ ID NO: 802308 - DNA, 14 bp, Homo sapiens
aaaggtccttgcct

SEQ ID NO: 802309 - DNA, 22 bp, Homo sapiens
aaaggtccttgcctcctggaag

SEQ ID NO: 802310 - DNA, 16 bp, Homo sapiens
aaaggtcttaaataat

SEQ ID NO: 802311 - DNA, 15 bp, Homo sapiens
aaaggtgaaggaata

SEQ ID NO: 802312 - DNA, 21 bp, Homo sapiens
aaaggtgaaggaatatatggc

SEQ ID NO: 802313 - DNA, 24 bp, Homo sapiens
aaaggtgaaggaatatatggcaga

SEQ ID NO: 802314 - DNA, 23 bp, Homo sapiens
aaaggtgacatcggaaaaataat

SEQ ID NO: 802315 - DNA, 21 bp, Homo sapiens
aaaggtgagtttgagctgcct

SEQ ID NO: 802316 - DNA, 15 bp, Homo sapiens
aaaggtgcctcatag

SEQ ID NO: 802317 - DNA, 22 bp, Homo sapiens
aaaggtgcctcatagcatagcc

SEQ ID NO: 802318 - DNA, 21 bp, Homo sapiens
aaaggtgcctgtgaggcaggg

SEQ ID NO: 802319 - DNA, 18 bp, Homo sapiens
aaaggtggaataaacatt

SEQ ID NO: 802320 - DNA, 21 bp, Homo sapiens
aaaggtggaataaacattaat

SEQ ID NO: 802321 - DNA, 22 bp, Homo sapiens
aaaggtggagagggagatgtgt

SEQ ID NO: 802322 - DNA, 18 bp, Homo sapiens
aaaggtggtgaggcaata

SEQ ID NO: 802323 - DNA, 15 bp, Homo sapiens
aaaggtgtaggctgg

SEQ ID NO: 802324 - DNA, 20 bp, Homo sapiens
aaaggtgtgcttcctgctgt

SEQ ID NO: 802325 - DNA, 15 bp, Homo sapiens
aaaggttatgaaaca

SEQ ID NO: 802326 - DNA, 19 bp, Homo sapiens
aaaggttgaataatatatg

SEQ ID NO: 802327 - DNA, 16 bp, Homo sapiens
aaaggtttatttttct

SEQ ID NO: 802328 - DNA, 13 bp, Homo sapiens
aaaggttttgtat

SEQ ID NO: 802329 - DNA, 12 bp, Homo sapiens
aaaggtttttaa

SEQ ID NO: 802330 - DNA, 19 bp, Homo sapiens
aaaggtttttaaattgttt

SEQ ID NO: 802331 - DNA, 14 bp, Homo sapiens
aaaggtttttgaaa

SEQ ID NO: 802332 - DNA, 18 bp, Homo sapiens
aaagtaaaaattgaactg

SEQ ID NO: 802333 - DNA, 11 bp, Homo sapiens
aaagtaaaatt

SEQ ID NO: 802334 - DNA, 12 bp, Homo sapiens
aaagtaaagcta

SEQ ID NO: 802335 - DNA, 23 bp, Homo sapiens
aaagtaaagctaaaatgatttta

SEQ ID NO: 802336 - DNA, 22 bp, Homo sapiens
aaagtaaaggcctcatctcctt

SEQ ID NO: 802337 - DNA, 14 bp, Homo sapiens
aaagtaaatgggag

SEQ ID NO: 802338 - DNA, 13 bp, Homo sapiens
aaagtaaattatt

SEQ ID NO: 802339 - DNA, 19 bp, Homo sapiens
aaagtaacaaggtgtcttt

SEQ ID NO: 802340 - DNA, 22 bp, Homo sapiens
aaagtaactcatttgttaaaat

SEQ ID NO: 802341 - DNA, 18 bp, Homo sapiens
aaagtaagcatttccagc

SEQ ID NO: 802342 - DNA, 15 bp, Homo sapiens
aaagtaagttaataa

SEQ ID NO: 802343 - DNA, 23 bp, Homo sapiens
aaagtaagttaataatgtattgt

SEQ ID NO: 802344 - DNA, 20 bp, Homo sapiens
aaagtaatcagcatatgtgt

SEQ ID NO: 802345 - DNA, 16 bp, Homo sapiens
aaagtaatctactgta

SEQ ID NO: 802346 - DNA, 21 bp, Homo sapiens
aaagtaatgaagaatcacgat

SEQ ID NO: 802347 - DNA, 21 bp, Homo sapiens
aaagtaatgacttagaaactg

SEQ ID NO: 802348 - DNA, 17 bp, Homo sapiens
aaagtacaaatgaagaa

SEQ ID NO: 802349 - DNA, 15 bp, Homo sapiens
aaagtacactctgct

SEQ ID NO: 802350 - DNA, 19 bp, Homo sapiens
aaagtacagaaaaatactt

SEQ ID NO: 802351 - DNA, 15 bp, Homo sapiens
aaagtacagaatttg

SEQ ID NO: 802352 - DNA, 13 bp, Homo sapiens
aaagtacatttaa

SEQ ID NO: 802353 - DNA, 14 bp, Homo sapiens
aaagtacatttaat

SEQ ID NO: 802354 - DNA, 18 bp, Homo sapiens
aaagtaccacactgagtt

SEQ ID NO: 802355 - DNA, 16 bp, Homo sapiens
aaagtaccctctttta

SEQ ID NO: 802356 - DNA, 19 bp, Homo sapiens
aaagtactcctcacttttc

SEQ ID NO: 802357 - DNA, 16 bp, Homo sapiens
aaagtactctttaaca

SEQ ID NO: 802358 - DNA, 18 bp, Homo sapiens
aaagtactttaaaaagga

SEQ ID NO: 802359 - DNA, 20 bp, Homo sapiens
aaagtactttaaaaaggaaa

SEQ ID NO: 802360 - DNA, 20 bp, Homo sapiens
aaagtagagctagctgccac

SEQ ID NO: 802361 - DNA, 14 bp, Homo sapiens
aaagtagattaaga

SEQ ID NO: 802362 - DNA, 15 bp, Homo sapiens
aaagtagcaaaacaa

SEQ ID NO: 802363 - DNA, 22 bp, Homo sapiens
aaagtagcaaaacaaattcaaa

SEQ ID NO: 802364 - DNA, 23 bp, Homo sapiens
aaagtagcaaaacaaattcaaat

SEQ ID NO: 802365 - DNA, 13 bp, Homo sapiens
aaagtataatgtt

SEQ ID NO: 802366 - DNA, 14 bp, Homo sapiens
aaagtataatgttt

SEQ ID NO: 802367 - DNA, 14 bp, Homo sapiens
aaagtatagaaata

SEQ ID NO: 802368 - DNA, 13 bp, Homo sapiens
aaagtatatatag

SEQ ID NO: 802369 - DNA, 15 bp, Homo sapiens
aaagtatatatttat

SEQ ID NO: 802370 - DNA, 14 bp, Homo sapiens
aaagtatatgttag

SEQ ID NO: 802371 - DNA, 13 bp, Homo sapiens
aaagtatctttaa

SEQ ID NO: 802372 - DNA, 18 bp, Homo sapiens
aaagtatgcattattaaa

SEQ ID NO: 802373 - DNA, 19 bp, Homo sapiens
aaagtatgcattattaaat

SEQ ID NO: 802374 - DNA, 16 bp, Homo sapiens
aaagtatgtccttcag

SEQ ID NO: 802375 - DNA, 16 bp, Homo sapiens
aaagtatgtttttaca

SEQ ID NO: 802376 - DNA, 18 bp, Homo sapiens
aaagtatgtttttacatt

SEQ ID NO: 802377 - DNA, 21 bp, Homo sapiens
aaagtatgtttttacattatg

SEQ ID NO: 802378 - DNA, 21 bp, Homo sapiens
aaagtattcaacaatttcaat

SEQ ID NO: 802379 - DNA, 13 bp, Homo sapiens
aaagtattcagaa

SEQ ID NO: 802380 - DNA, 21 bp, Homo sapiens
aaagtattcagaaattaaaat

SEQ ID NO: 802381 - DNA, 21 bp, Homo sapiens
aaagtattcgttacatcttgt

SEQ ID NO: 802382 - DNA, 16 bp, Homo sapiens
aaagtattctccatcc

SEQ ID NO: 802383 - DNA, 13 bp, Homo sapiens
aaagtattctgat

SEQ ID NO: 802384 - DNA, 18 bp, Homo sapiens
aaagtattctttttcttt

SEQ ID NO: 802385 - DNA, 18 bp, Homo sapiens
aaagtattgaaagccaac

SEQ ID NO: 802386 - DNA, 23 bp, Homo sapiens
aaagtattgaaagccaacaactc

SEQ ID NO: 802387 - DNA, 14 bp, Homo sapiens
aaagtattggttac

SEQ ID NO: 802388 - DNA, 15 bp, Homo sapiens
aaagtattgtaaatt

SEQ ID NO: 802389 - DNA, 20 bp, Homo sapiens
aaagtattgtaaattatatt

SEQ ID NO: 802390 - DNA, 19 bp, Homo sapiens
aaagtatttataaaaatat

SEQ ID NO: 802391 - DNA, 23 bp, Homo sapiens
aaagtatttataaaaatataaat

SEQ ID NO: 802392 - DNA, 16 bp, Homo sapiens
aaagtcaaaaaattat

SEQ ID NO: 802393 - DNA, 23 bp, Homo sapiens
aaagtcaaaaaattatttgctat

SEQ ID NO: 802394 - DNA, 22 bp, Homo sapiens
aaagtcaataaaagagctgtct

SEQ ID NO: 802395 - DNA, 17 bp, Homo sapiens
aaagtcacccaaacact

SEQ ID NO: 802396 - DNA, 23 bp, Homo sapiens
aaagtcacccaaacacttctgct

SEQ ID NO: 802397 - DNA, 15 bp, Homo sapiens
aaagtcagaagtttt

SEQ ID NO: 802398 - DNA, 16 bp, Homo sapiens
aaagtcaggtccaatt

SEQ ID NO: 802399 - DNA, 23 bp, Homo sapiens
aaagtcagttgctcaaaaagaaa

SEQ ID NO: 802400 - DNA, 16 bp, Homo sapiens
aaagtcattaaagaca

SEQ ID NO: 802401 - DNA, 15 bp, Homo sapiens
aaagtccaagtctgt

SEQ ID NO: 802402 - DNA, 14 bp, Homo sapiens
aaagtccctccctg

SEQ ID NO: 802403 - DNA, 15 bp, Homo sapiens
aaagtcctgctttcc

SEQ ID NO: 802404 - DNA, 16 bp, Homo sapiens
aaagtcctttttttcc

SEQ ID NO: 802405 - DNA, 12 bp, Homo sapiens
aaagtctatttt

SEQ ID NO: 802406 - DNA, 19 bp, Homo sapiens
aaagtctatttttttaact

SEQ ID NO: 802407 - DNA, 21 bp, Homo sapiens
aaagtctatttttttaactga

SEQ ID NO: 802408 - DNA, 14 bp, Homo sapiens
aaagtctgagaaat

SEQ ID NO: 802409 - DNA, 16 bp, Homo sapiens
aaagtctgagaaatag

SEQ ID NO: 802410 - DNA, 23 bp, Homo sapiens
aaagtctgtgtgatgaactttct

SEQ ID NO: 802411 - DNA, 23 bp, Homo sapiens
aaagtgaaaaaaagaaacgaaaa

SEQ ID NO: 802412 - DNA, 15 bp, Homo sapiens
aaagtgaacttttgt

SEQ ID NO: 802413 - DNA, 18 bp, Homo sapiens
aaagtgaacttttgtaat

SEQ ID NO: 802414 - DNA, 23 bp, Homo sapiens
aaagtgaagcaaatcagaaactt

SEQ ID NO: 802415 - DNA, 13 bp, Homo sapiens
aaagtgaaggaaa

SEQ ID NO: 802416 - DNA, 12 bp, Homo sapiens
aaagtgaatttg

SEQ ID NO: 802417 - DNA, 20 bp, Homo sapiens
aaagtgaatttgaatgaaaa

SEQ ID NO: 802418 - DNA, 21 bp, Homo sapiens
aaagtgaatttgaatgaaaaa

SEQ ID NO: 802419 - DNA, 13 bp, Homo sapiens
aaagtgacacagc

SEQ ID NO: 802420 - DNA, 13 bp, Homo sapiens
aaagtgacatttg

SEQ ID NO: 802421 - DNA, 20 bp, Homo sapiens
aaagtgactgtttggcttat

SEQ ID NO: 802422 - DNA, 15 bp, Homo sapiens
aaagtgataagtgca

SEQ ID NO: 802423 - DNA, 15 bp, Homo sapiens
aaagtgatagaaatg

SEQ ID NO: 802424 - DNA, 21 bp, Homo sapiens
aaagtgatcttaggtttgttt

SEQ ID NO: 802425 - DNA, 19 bp, Homo sapiens
aaagtgatgtattttcata

SEQ ID NO: 802426 - DNA, 10 bp, Homo sapiens
aaagtgatta

SEQ ID NO: 802427 - DNA, 22 bp, Homo sapiens
aaagtgattttagcaattaaac

SEQ ID NO: 802428 - DNA, 17 bp, Homo sapiens
aaagtgcagcccttcct

SEQ ID NO: 802429 - DNA, 16 bp, Homo sapiens
aaagtgcagtcatttg

SEQ ID NO: 802430 - DNA, 18 bp, Homo sapiens
aaagtgcatatttatcca

SEQ ID NO: 802431 - DNA, 15 bp, Homo sapiens
aaagtgccactcatt

SEQ ID NO: 802432 - DNA, 20 bp, Homo sapiens
aaagtgcctgagctggggaa

SEQ ID NO: 802433 - DNA, 23 bp, Homo sapiens
aaagtgctttgacttcttgcttc

SEQ ID NO: 802434 - DNA, 13 bp, Homo sapiens
aaagtggaaaaat

SEQ ID NO: 802435 - DNA, 13 bp, Homo sapiens
aaagtggaacgaa

SEQ ID NO: 802436 - DNA, 19 bp, Homo sapiens
aaagtggcaagaccaaaat

SEQ ID NO: 802437 - DNA, 22 bp, Homo sapiens
aaagtggcgtgggagccagcct

SEQ ID NO: 802438 - DNA, 16 bp, Homo sapiens
aaagtggctgcggtgt

SEQ ID NO: 802439 - DNA, 18 bp, Homo sapiens
aaagtggctgcggtgttt

SEQ ID NO: 802440 - DNA, 20 bp, Homo sapiens
aaagtggggctaaatgaagt

SEQ ID NO: 802441 - DNA, 16 bp, Homo sapiens
aaagtggtaaatactg

SEQ ID NO: 802442 - DNA, 16 bp, Homo sapiens
aaagtggtatagaaat

SEQ ID NO: 802443 - DNA, 20 bp, Homo sapiens
aaagtggtatagaaatgctg

SEQ ID NO: 802444 - DNA, 14 bp, Homo sapiens
aaagtggttgttag

SEQ ID NO: 802445 - DNA, 20 bp, Homo sapiens
aaagtgtaaatcctttttct

SEQ ID NO: 802446 - DNA, 17 bp, Homo sapiens
aaagtgtatatttattc

SEQ ID NO: 802447 - DNA, 18 bp, Homo sapiens
aaagtgtattttattcag

SEQ ID NO: 802448 - DNA, 14 bp, Homo sapiens
aaagtgtatttttt

SEQ ID NO: 802449 - DNA, 21 bp, Homo sapiens
aaagtgtatttttttactaat

SEQ ID NO: 802450 - DNA, 19 bp, Homo sapiens
aaagtgtctagacatattt

SEQ ID NO: 802451 - DNA, 21 bp, Homo sapiens
aaagtgtgaaataaatttttt

SEQ ID NO: 802452 - DNA, 18 bp, Homo sapiens
aaagtgtgagcaaactaa

SEQ ID NO: 802453 - DNA, 22 bp, Homo sapiens
aaagtgtgagcagtgagttaca

SEQ ID NO: 802454 - DNA, 13 bp, Homo sapiens
aaagtgtgtatta

SEQ ID NO: 802455 - DNA, 22 bp, Homo sapiens
aaagtgtgtattaaaaaaaaca

SEQ ID NO: 802456 - DNA, 14 bp, Homo sapiens
aaagtgtgttgttg

SEQ ID NO: 802457 - DNA, 14 bp, Homo sapiens
aaagtgttactttt

SEQ ID NO: 802458 - DNA, 19 bp, Homo sapiens
aaagtgttgaaaatgtatt

SEQ ID NO: 802459 - DNA, 19 bp, Homo sapiens
aaagtgttgtgttcctggc

SEQ ID NO: 802460 - DNA, 16 bp, Homo sapiens
aaatataaattgtaca

SEQ ID NO: 802461 - DNA, 19 bp, Homo sapiens
aaatataaattgtacattt

SEQ ID NO: 802462 - DNA, 20 bp, Homo sapiens
aaatataaattgtacatttt

SEQ ID NO: 802463 - DNA, 18 bp, Homo sapiens
aaatataacaggtgcttc

SEQ ID NO: 802464 - DNA, 20 bp, Homo sapiens
aaatataaccattacatgtt

SEQ ID NO: 802465 - DNA, 14 bp, Homo sapiens
aaatataagacatt

SEQ ID NO: 802466 - DNA, 20 bp, Homo sapiens
aaatataagtctatactaat

SEQ ID NO: 802467 - DNA, 22 bp, Homo sapiens
aaatataatgttgataatatat

SEQ ID NO: 802468 - DNA, 11 bp, Homo sapiens
aaatataattc

SEQ ID NO: 802469 - DNA, 12 bp, Homo sapiens
aaatataattct

SEQ ID NO: 802470 - DNA, 16 bp, Homo sapiens
aaatataattctgtaa

SEQ ID NO: 802471 - DNA, 18 bp, Homo sapiens
aaatatacattttctaaa

SEQ ID NO: 802472 - DNA, 16 bp, Homo sapiens
aaatataccactcttt

SEQ ID NO: 802473 - DNA, 21 bp, Homo sapiens
aaatatactcaagtttcaggt

SEQ ID NO: 802474 - DNA, 24 bp, Homo sapiens
aaatatagaaagttgatattcaac

SEQ ID NO: 802475 - DNA, 17 bp, Homo sapiens
aaatatagctgtacaaa

SEQ ID NO: 802476 - DNA, 16 bp, Homo sapiens
aaatatagggtttttt

SEQ ID NO: 802477 - DNA, 15 bp, Homo sapiens
aaatatagtgcaata

SEQ ID NO: 802478 - DNA, 15 bp, Homo sapiens
aaatatataaatata

SEQ ID NO: 802479 - DNA, 17 bp, Homo sapiens
aaatatataaatatata

SEQ ID NO: 802480 - DNA, 14 bp, Homo sapiens
aaatatataatatt

SEQ ID NO: 802481 - DNA, 16 bp, Homo sapiens
aaatatatataaacct

SEQ ID NO: 802482 - DNA, 22 bp, Homo sapiens
aaatatatatagatatgtatat

SEQ ID NO: 802483 - DNA, 14 bp, Homo sapiens
aaatatatatatat

SEQ ID NO: 802484 - DNA, 19 bp, Homo sapiens
aaatatatatatatataaa

SEQ ID NO: 802485 - DNA, 15 bp, Homo sapiens
aaatatatatgtcaa

SEQ ID NO: 802486 - DNA, 17 bp, Homo sapiens
aaatatatatttttcaa

SEQ ID NO: 802487 - DNA, 13 bp, Homo sapiens
aaatatatgtatt

SEQ ID NO: 802488 - DNA, 14 bp, Homo sapiens
aaatatatgtattt

SEQ ID NO: 802489 - DNA, 18 bp, Homo sapiens
aaatatatgttctgcaag

SEQ ID NO: 802490 - DNA, 22 bp, Homo sapiens
aaatatatgttctgcaagaatt

SEQ ID NO: 802491 - DNA, 23 bp, Homo sapiens
aaatatatgttctgcaagaatta

SEQ ID NO: 802492 - DNA, 22 bp, Homo sapiens
aaatatattatatatggatgtg

SEQ ID NO: 802493 - DNA, 19 bp, Homo sapiens
aaatatattcaaattatgt

SEQ ID NO: 802494 - DNA, 16 bp, Homo sapiens
aaatatattcaggagt

SEQ ID NO: 802495 - DNA, 13 bp, Homo sapiens
aaatatattgctg

SEQ ID NO: 802496 - DNA, 22 bp, Homo sapiens
aaatatcagacaagcactattt

SEQ ID NO: 802497 - DNA, 18 bp, Homo sapiens
aaatatcagttactcagc

SEQ ID NO: 802498 - DNA, 20 bp, Homo sapiens
aaatatcagttactcagccc

SEQ ID NO: 802499 - DNA, 13 bp, Homo sapiens
aaatatcataaag

SEQ ID NO: 802500 - DNA, 17 bp, Homo sapiens
aaatatcataaagcatt

SEQ ID NO: 802501 - DNA, 12 bp, Homo sapiens
aaatatcatgtt

SEQ ID NO: 802502 - DNA, 18 bp, Homo sapiens
aaatatcatgttaaatta

SEQ ID NO: 802503 - DNA, 16 bp, Homo sapiens
aaatatcatttactct

SEQ ID NO: 802504 - DNA, 18 bp, Homo sapiens
aaatatccaaagactgta

SEQ ID NO: 802505 - DNA, 21 bp, Homo sapiens
aaatatcccagagaacaatca

SEQ ID NO: 802506 - DNA, 14 bp, Homo sapiens
aaatatcctcaggg

SEQ ID NO: 802507 - DNA, 22 bp, Homo sapiens
aaatatctcctccaatgtcctg

SEQ ID NO: 802508 - DNA, 16 bp, Homo sapiens
aaatatctctatttaa

SEQ ID NO: 802509 - DNA, 23 bp, Homo sapiens
aaatatctgaaaatgtatgtgta

SEQ ID NO: 802510 - DNA, 13 bp, Homo sapiens
aaatatctttctc

SEQ ID NO: 802511 - DNA, 21 bp, Homo sapiens
aaatatctttctcttacctgt

SEQ ID NO: 802512 - DNA, 19 bp, Homo sapiens
aaatatgaaaaatgtaaat

SEQ ID NO: 802513 - DNA, 19 bp, Homo sapiens
aaatatgaacctattttca

SEQ ID NO: 802514 - DNA, 22 bp, Homo sapiens
aaatatgaagagtttttttctg

SEQ ID NO: 802515 - DNA, 12 bp, Homo sapiens
aaatatgcactt

SEQ ID NO: 802516 - DNA, 19 bp, Homo sapiens
aaatatgcactttccctag

SEQ ID NO: 802517 - DNA, 11 bp, Homo sapiens
aaatatgcata

SEQ ID NO: 802518 - DNA, 12 bp, Homo sapiens
aaatatgcatac

SEQ ID NO: 802519 - DNA, 16 bp, Homo sapiens
aaatatggaacttaca

SEQ ID NO: 802520 - DNA, 18 bp, Homo sapiens
aaatatggaacttacatt

SEQ ID NO: 802521 - DNA, 19 bp, Homo sapiens
aaatatggaacttctaata

SEQ ID NO: 802522 - DNA, 20 bp, Homo sapiens
aaatatggaacttctaatat

SEQ ID NO: 802523 - DNA, 16 bp, Homo sapiens
aaatatggacacttaa

SEQ ID NO: 802524 - DNA, 19 bp, Homo sapiens
aaatatggctataaatata

SEQ ID NO: 802525 - DNA, 19 bp, Homo sapiens
aaatatggtcttttggtta

SEQ ID NO: 802526 - DNA, 19 bp, Homo sapiens
aaatatggtttggtttttc

SEQ ID NO: 802527 - DNA, 15 bp, Homo sapiens
aaatatgtaaaacta

SEQ ID NO: 802528 - DNA, 12 bp, Homo sapiens
aaatatgtaata

SEQ ID NO: 802529 - DNA, 23 bp, Homo sapiens
aaatatgtaatataaatttaagc

SEQ ID NO: 802530 - DNA, 17 bp, Homo sapiens
aaatatgtaatttcaaa

SEQ ID NO: 802531 - DNA, 20 bp, Homo sapiens
aaatatgtaatttcaaaata

SEQ ID NO: 802532 - DNA, 13 bp, Homo sapiens
aaatatgtattta

SEQ ID NO: 802533 - DNA, 19 bp, Homo sapiens
aaatatgtctgcaggtttc

SEQ ID NO: 802534 - DNA, 22 bp, Homo sapiens
aaatatgtgaaaggaacatttt

SEQ ID NO: 802535 - DNA, 20 bp, Homo sapiens
aaatatgttagcaaagagtt

SEQ ID NO: 802536 - DNA, 15 bp, Homo sapiens
aaatatgtttgtgcc

SEQ ID NO: 802537 - DNA, 21 bp, Homo sapiens
aaatatgttttttagatcaaa

SEQ ID NO: 802538 - DNA, 13 bp, Homo sapiens
aaatattaaagat

SEQ ID NO: 802539 - DNA, 12 bp, Homo sapiens
aaatattaagac

SEQ ID NO: 802540 - DNA, 19 bp, Homo sapiens
aaatattaatatcctgtaa

SEQ ID NO: 802541 - DNA, 23 bp, Homo sapiens
aaatattattgtggaaatgaata

SEQ ID NO: 802542 - DNA, 15 bp, Homo sapiens
aaatattatttgata

SEQ ID NO: 802543 - DNA, 17 bp, Homo sapiens
aaatattatttgatatc

SEQ ID NO: 802544 - DNA, 16 bp, Homo sapiens
aaatattcacatcttc

SEQ ID NO: 802545 - DNA, 14 bp, Homo sapiens
aaatattcatatta

SEQ ID NO: 802546 - DNA, 16 bp, Homo sapiens
aaatattcatgcttct

SEQ ID NO: 802547 - DNA, 23 bp, Homo sapiens
aaatattccatccatatactttg

SEQ ID NO: 802548 - DNA, 18 bp, Homo sapiens
aaatattccctagaaact

SEQ ID NO: 802549 - DNA, 15 bp, Homo sapiens
aaatattcctgcatt

SEQ ID NO: 802550 - DNA, 22 bp, Homo sapiens
aaatattctacacatgtaaaat

SEQ ID NO: 802551 - DNA, 18 bp, Homo sapiens
aaatattctatatgaatt

SEQ ID NO: 802552 - DNA, 13 bp, Homo sapiens
aaatattctctct

SEQ ID NO: 802553 - DNA, 11 bp, Homo sapiens
aaatattcttg

SEQ ID NO: 802554 - DNA, 17 bp, Homo sapiens
aaatattcttgtccaca

SEQ ID NO: 802555 - DNA, 21 bp, Homo sapiens
aaatattcttgtccacattct

SEQ ID NO: 802556 - DNA, 17 bp, Homo sapiens
aaatattctttctcata

SEQ ID NO: 802557 - DNA, 22 bp, Homo sapiens
aaatattgaagttgtttatcaa

SEQ ID NO: 802558 - DNA, 18 bp, Homo sapiens
aaatattgctaaaagtgc

SEQ ID NO: 802559 - DNA, 20 bp, Homo sapiens
aaatattggtgttgtcagta

SEQ ID NO: 802560 - DNA, 22 bp, Homo sapiens
aaatattgttttacaatagttc

SEQ ID NO: 802561 - DNA, 13 bp, Homo sapiens
aaatatttaactt

SEQ ID NO: 802562 - DNA, 16 bp, Homo sapiens
aaatatttaagtgaag

SEQ ID NO: 802563 - DNA, 14 bp, Homo sapiens
aaatatttacctaa

SEQ ID NO: 802564 - DNA, 18 bp, Homo sapiens
aaatatttaccttgaaaa

SEQ ID NO: 802565 - DNA, 22 bp, Homo sapiens
aaatatttagatgtaattttgt

SEQ ID NO: 802566 - DNA, 16 bp, Homo sapiens
aaatatttagcaaata

SEQ ID NO: 802567 - DNA, 19 bp, Homo sapiens
aaatatttataaaacttct

SEQ ID NO: 802568 - DNA, 12 bp, Homo sapiens
aaatatttatct

SEQ ID NO: 802569 - DNA, 15 bp, Homo sapiens
aaatatttatgtaaa

SEQ ID NO: 802570 - DNA, 15 bp, Homo sapiens
aaatatttcagatat

SEQ ID NO: 802571 - DNA, 14 bp, Homo sapiens
aaatatttccttaa

SEQ ID NO: 802572 - DNA, 18 bp, Homo sapiens
aaatatttctatgtaaat

SEQ ID NO: 802573 - DNA, 20 bp, Homo sapiens
aaatatttgacttgcatgaa

SEQ ID NO: 802574 - DNA, 14 bp, Homo sapiens
aaatatttgtacat

SEQ ID NO: 802575 - DNA, 16 bp, Homo sapiens
aaatattttaaagaat

SEQ ID NO: 802576 - DNA, 17 bp, Homo sapiens
aaatattttaaagaatt

SEQ ID NO: 802577 - DNA, 19 bp, Homo sapiens
aaatattttaaagaattgt

SEQ ID NO: 802578 - DNA, 16 bp, Homo sapiens
aaatattttagatgtt

SEQ ID NO: 802579 - DNA, 12 bp, Homo sapiens
aaatattttagc

SEQ ID NO: 802580 - DNA, 15 bp, Homo sapiens
aaatattttcaagaa

SEQ ID NO: 802581 - DNA, 19 bp, Homo sapiens
aaatattttctattttaag

SEQ ID NO: 802582 - DNA, 15 bp, Homo sapiens
aaatattttgaatca

SEQ ID NO: 802583 - DNA, 22 bp, Homo sapiens
aaatattttgtctaaaatgcct

SEQ ID NO: 802584 - DNA, 15 bp, Homo sapiens
aaatatttttccctc

SEQ ID NO: 802585 - DNA, 12 bp, Homo sapiens
aaatatttttgg

SEQ ID NO: 802586 - DNA, 23 bp, Homo sapiens
aaatatttttggggcatcctgga

SEQ ID NO: 802587 - DNA, 15 bp, Homo sapiens
aaatattttttgcaa

SEQ ID NO: 802588 - DNA, 20 bp, Homo sapiens
aaatcaaatggtatcttttg

SEQ ID NO: 802589 - DNA, 13 bp, Homo sapiens
aaatcaaatttga

SEQ ID NO: 802590 - DNA, 17 bp, Homo sapiens
aaatcaacagaagcatt

SEQ ID NO: 802591 - DNA, 12 bp, Homo sapiens
aaatcaacatga

SEQ ID NO: 802592 - DNA, 23 bp, Homo sapiens
aaatcaaccctgcaatcactttt

SEQ ID NO: 802593 - DNA, 16 bp, Homo sapiens
aaatcaaggaaaggct

SEQ ID NO: 802594 - DNA, 20 bp, Homo sapiens
aaatcaaggaaaggctcatt

SEQ ID NO: 802595 - DNA, 17 bp, Homo sapiens
aaatcaatacactagtt

SEQ ID NO: 802596 - DNA, 22 bp, Homo sapiens
aaatcaatcaatggtgcaaaaa

SEQ ID NO: 802597 - DNA, 14 bp, Homo sapiens
aaatcacaaaaaca

SEQ ID NO: 802598 - DNA, 18 bp, Homo sapiens
aaatcacaaaaacaaaaa

SEQ ID NO: 802599 - DNA, 16 bp, Homo sapiens
aaatcacacctctggg

SEQ ID NO: 802600 - DNA, 17 bp, Homo sapiens
aaatcacagaaaattta

SEQ ID NO: 802601 - DNA, 13 bp, Homo sapiens
aaatcactgtgaa

SEQ ID NO: 802602 - DNA, 14 bp, Homo sapiens
aaatcactgtgaaa

SEQ ID NO: 802603 - DNA, 12 bp, Homo sapiens
aaatcacttcag

SEQ ID NO: 802604 - DNA, 16 bp, Homo sapiens
aaatcacttcagatct

SEQ ID NO: 802605 - DNA, 12 bp, Homo sapiens
aaatcagaagtc

SEQ ID NO: 802606 - DNA, 18 bp, Homo sapiens
aaatcagaagtcatcttg

SEQ ID NO: 802607 - DNA, 20 bp, Homo sapiens
aaatcagcatgacaaaaata

SEQ ID NO: 802608 - DNA, 17 bp, Homo sapiens
aaatcagcccccagcct

SEQ ID NO: 802609 - DNA, 12 bp, Homo sapiens
aaatcagcctgc

SEQ ID NO: 802610 - DNA, 19 bp, Homo sapiens
aaatcagcctgctccagct

SEQ ID NO: 802611 - DNA, 21 bp, Homo sapiens
aaatcagcctgctccagctgt

SEQ ID NO: 802612 - DNA, 23 bp, Homo sapiens
aaatcaggcttttgtttcctttt

SEQ ID NO: 802613 - DNA, 16 bp, Homo sapiens
aaatcaggggccagag

SEQ ID NO: 802614 - DNA, 20 bp, Homo sapiens
aaatcaggtgttttaagact

SEQ ID NO: 802615 - DNA, 12 bp, Homo sapiens
aaatcagtattt

SEQ ID NO: 802616 - DNA, 17 bp, Homo sapiens
aaatcagtgaggtgaga

SEQ ID NO: 802617 - DNA, 21 bp, Homo sapiens
aaatcagtgatctatgtttgt

SEQ ID NO: 802618 - DNA, 18 bp, Homo sapiens
aaatcagtgtttaaataa

SEQ ID NO: 802619 - DNA, 16 bp, Homo sapiens
aaatcagttactaaga

SEQ ID NO: 802620 - DNA, 21 bp, Homo sapiens
aaatcagttactaagaagaaa

SEQ ID NO: 802621 - DNA, 23 bp, Homo sapiens
aaatcataataaagtttccatta

SEQ ID NO: 802622 - DNA, 11 bp, Homo sapiens
aaatcatcaag

SEQ ID NO: 802623 - DNA, 12 bp, Homo sapiens
aaatcatcaaga

SEQ ID NO: 802624 - DNA, 18 bp, Homo sapiens
aaatcatcctcatgtcct

SEQ ID NO: 802625 - DNA, 14 bp, Homo sapiens
aaatcatcctgaat

SEQ ID NO: 802626 - DNA, 20 bp, Homo sapiens
aaatcatcctgaatctgatc

SEQ ID NO: 802627 - DNA, 15 bp, Homo sapiens
aaatcatcctgtttt

SEQ ID NO: 802628 - DNA, 20 bp, Homo sapiens
aaatcatctgcattcctgat

SEQ ID NO: 802629 - DNA, 13 bp, Homo sapiens
aaatcatgtatgt

SEQ ID NO: 802630 - DNA, 23 bp, Homo sapiens
aaatcatgttgatcatgtacttt

SEQ ID NO: 802631 - DNA, 12 bp, Homo sapiens
aaatcatgtttg

SEQ ID NO: 802632 - DNA, 14 bp, Homo sapiens
aaatcatgttttga

SEQ ID NO: 802633 - DNA, 14 bp, Homo sapiens
aaatcattccttag

SEQ ID NO: 802634 - DNA, 19 bp, Homo sapiens
aaatcattcttactaaaaa

SEQ ID NO: 802635 - DNA, 12 bp, Homo sapiens
aaatcatttcag

SEQ ID NO: 802636 - DNA, 16 bp, Homo sapiens
aaatccaaggaaacat

SEQ ID NO: 802637 - DNA, 15 bp, Homo sapiens
aaatccaatattgta

SEQ ID NO: 802638 - DNA, 15 bp, Homo sapiens
aaatccagaaagaaa

SEQ ID NO: 802639 - DNA, 22 bp, Homo sapiens
aaatccagtattatattatcat

SEQ ID NO: 802640 - DNA, 18 bp, Homo sapiens
aaatccatagatttattt

SEQ ID NO: 802641 - DNA, 23 bp, Homo sapiens
aaatccatatcttaaagaaacag

SEQ ID NO: 802642 - DNA, 20 bp, Homo sapiens
aaatccatgtgaccattctg

SEQ ID NO: 802643 - DNA, 23 bp, Homo sapiens
aaatcccatttcttgaaaagcct

SEQ ID NO: 802644 - DNA, 22 bp, Homo sapiens
aaatcccctcagcctcttctct

SEQ ID NO: 802645 - DNA, 17 bp, Homo sapiens
aaatccctgtttaatat

SEQ ID NO: 802646 - DNA, 22 bp, Homo sapiens
aaatccctttcatgtctttcca

SEQ ID NO: 802647 - DNA, 22 bp, Homo sapiens
aaatccgacttgaatattcctg

SEQ ID NO: 802648 - DNA, 16 bp, Homo sapiens
aaatccggagaagctg

SEQ ID NO: 802649 - DNA, 17 bp, Homo sapiens
aaatcctatatctgttt

SEQ ID NO: 802650 - DNA, 12 bp, Homo sapiens
aaatcctctggc

SEQ ID NO: 802651 - DNA, 14 bp, Homo sapiens
aaatcctcttcctc

SEQ ID NO: 802652 - DNA, 18 bp, Homo sapiens
aaatcctcttcctctgag

SEQ ID NO: 802653 - DNA, 22 bp, Homo sapiens
aaatcctgcaatgaaaggtact

SEQ ID NO: 802654 - DNA, 16 bp, Homo sapiens
aaatcctgccatttaa

SEQ ID NO: 802655 - DNA, 22 bp, Homo sapiens
aaatcctggaaggacacagtga

SEQ ID NO: 802656 - DNA, 21 bp, Homo sapiens
aaatccttgtgacttacaatt

SEQ ID NO: 802657 - DNA, 17 bp, Homo sapiens
aaatcctttttctttat

SEQ ID NO: 802658 - DNA, 19 bp, Homo sapiens
aaatcctttttctttataa

SEQ ID NO: 802659 - DNA, 13 bp, Homo sapiens
aaatcgaatgaaa

SEQ ID NO: 802660 - DNA, 18 bp, Homo sapiens
aaatcgccataggccaag

SEQ ID NO: 802661 - DNA, 21 bp, Homo sapiens
aaatctaaaacaaaatctgaa

SEQ ID NO: 802662 - DNA, 17 bp, Homo sapiens
aaatctaaaatttcata

SEQ ID NO: 802663 - DNA, 15 bp, Homo sapiens
aaatctaaatctatt

SEQ ID NO: 802664 - DNA, 16 bp, Homo sapiens
aaatctaaatctattt

SEQ ID NO: 802665 - DNA, 17 bp, Homo sapiens
aaatctaatattaaaaa

SEQ ID NO: 802666 - DNA, 13 bp, Homo sapiens
aaatctaatctct

SEQ ID NO: 802667 - DNA, 17 bp, Homo sapiens
aaatctaatctcttatt

SEQ ID NO: 802668 - DNA, 18 bp, Homo sapiens
aaatctagaagagtctat

SEQ ID NO: 802669 - DNA, 21 bp, Homo sapiens
aaatctagacattcttttaat

SEQ ID NO: 802670 - DNA, 14 bp, Homo sapiens
aaatctataaatat

SEQ ID NO: 802671 - DNA, 11 bp, Homo sapiens
aaatctatatt

SEQ ID NO: 802672 - DNA, 17 bp, Homo sapiens
aaatctatttattaata

SEQ ID NO: 802673 - DNA, 19 bp, Homo sapiens
aaatctatttattaatatt

SEQ ID NO: 802674 - DNA, 16 bp, Homo sapiens
aaatctcaaatttcta

SEQ ID NO: 802675 - DNA, 17 bp, Homo sapiens
aaatctcaccccatccc

SEQ ID NO: 802676 - DNA, 12 bp, Homo sapiens
aaatctcagcaa

SEQ ID NO: 802677 - DNA, 15 bp, Homo sapiens
aaatctcagcaatga

SEQ ID NO: 802678 - DNA, 15 bp, Homo sapiens
aaatctcagttgttt

SEQ ID NO: 802679 - DNA, 12 bp, Homo sapiens
aaatctcattcc

SEQ ID NO: 802680 - DNA, 12 bp, Homo sapiens
aaatctccatta

SEQ ID NO: 802681 - DNA, 20 bp, Homo sapiens
aaatctcccattttggaatt

SEQ ID NO: 802682 - DNA, 21 bp, Homo sapiens
aaatctcccattttggaattt

SEQ ID NO: 802683 - DNA, 17 bp, Homo sapiens
aaatctcttctttgctg

SEQ ID NO: 802684 - DNA, 15 bp, Homo sapiens
aaatctgaactctca

SEQ ID NO: 802685 - DNA, 15 bp, Homo sapiens
aaatctgagaggtaa

SEQ ID NO: 802686 - DNA, 21 bp, Homo sapiens
aaatctgagggaaatgttttg

SEQ ID NO: 802687 - DNA, 16 bp, Homo sapiens
aaatctgattagaagt

SEQ ID NO: 802688 - DNA, 16 bp, Homo sapiens
aaatctgatttaatgt

SEQ ID NO: 802689 - DNA, 23 bp, Homo sapiens
aaatctgcagaaggaaaaatgtg

SEQ ID NO: 802690 - DNA, 18 bp, Homo sapiens
aaatctgctttttaaaga

SEQ ID NO: 802691 - DNA, 12 bp, Homo sapiens
aaatctggaaat

SEQ ID NO: 802692 - DNA, 19 bp, Homo sapiens
aaatctggggaagaggttt

SEQ ID NO: 802693 - DNA, 23 bp, Homo sapiens
aaatctggggaagaggttttatt

SEQ ID NO: 802694 - DNA, 22 bp, Homo sapiens
aaatctggtctaatttattaat

SEQ ID NO: 802695 - DNA, 17 bp, Homo sapiens
aaatctgtaaagccagt

SEQ ID NO: 802696 - DNA, 16 bp, Homo sapiens
aaatctgtatatgttg

SEQ ID NO: 802697 - DNA, 22 bp, Homo sapiens
aaatctgtatatgttgtaataa

SEQ ID NO: 802698 - DNA, 16 bp, Homo sapiens
aaatctgtcaagagta

SEQ ID NO: 802699 - DNA, 21 bp, Homo sapiens
aaatctgtccaaaggaggctg

SEQ ID NO: 802700 - DNA, 12 bp, Homo sapiens
aaatctgtcctc

SEQ ID NO: 802701 - DNA, 14 bp, Homo sapiens
aaatctgtcctctg

SEQ ID NO: 802702 - DNA, 19 bp, Homo sapiens
aaatctgtcctctgtagta

SEQ ID NO: 802703 - DNA, 19 bp, Homo sapiens
aaatctgttttgtatatga

SEQ ID NO: 802704 - DNA, 15 bp, Homo sapiens
aaatgtggcaaaaaa

SEQ ID NO: 802705 - DNA, 16 bp, Homo sapiens
aaatgtgtacagtgaa

SEQ ID NO: 802706 - DNA, 19 bp, Homo sapiens
aaatgtgtatttttcaagg

SEQ ID NO: 802707 - DNA, 14 bp, Homo sapiens
aaatgtgtcagaat

SEQ ID NO: 802708 - DNA, 21 bp, Homo sapiens
aaatgtgttagcactgatagt

SEQ ID NO: 802709 - DNA, 13 bp, Homo sapiens
aaatgtgtttctg

SEQ ID NO: 802710 - DNA, 22 bp, Homo sapiens
aaatgtgttttgtttattaaat

SEQ ID NO: 802711 - DNA, 18 bp, Homo sapiens
aaatgttaactacatatt

SEQ ID NO: 802712 - DNA, 13 bp, Homo sapiens
aaatgttaagaaa

SEQ ID NO: 802713 - DNA, 13 bp, Homo sapiens
aaatgttacagtt

SEQ ID NO: 802714 - DNA, 18 bp, Homo sapiens
aaatgttagtcattgtta

SEQ ID NO: 802715 - DNA, 21 bp, Homo sapiens
aaatgttatcttatactgtac

SEQ ID NO: 802716 - DNA, 13 bp, Homo sapiens
aaatgttattatt

SEQ ID NO: 802717 - DNA, 18 bp, Homo sapiens
aaatgttattattcttga

SEQ ID NO: 802718 - DNA, 15 bp, Homo sapiens
aaatgttcagaaggt

SEQ ID NO: 802719 - DNA, 21 bp, Homo sapiens
aaatgttcagaaggttgctct

SEQ ID NO: 802720 - DNA, 21 bp, Homo sapiens
aaatgttctatttaacaactg

SEQ ID NO: 802721 - DNA, 13 bp, Homo sapiens
aaatgttctcaaa

SEQ ID NO: 802722 - DNA, 14 bp, Homo sapiens
aaatgttctcaaat

SEQ ID NO: 802723 - DNA, 15 bp, Homo sapiens
aaatgttctgtttgc

SEQ ID NO: 802724 - DNA, 15 bp, Homo sapiens
aaatgttctttgggg

SEQ ID NO: 802725 - DNA, 21 bp, Homo sapiens
aaatgttgaaaagtcaaactg

SEQ ID NO: 802726 - DNA, 23 bp, Homo sapiens
aaatgttgaataaaaatatgtac

SEQ ID NO: 802727 - DNA, 16 bp, Homo sapiens
aaatgttgagaagcgt

SEQ ID NO: 802728 - DNA, 22 bp, Homo sapiens
aaatgttgagaagcgtttttaa

SEQ ID NO: 802729 - DNA, 19 bp, Homo sapiens
aaatgttgagaatcccaaa

SEQ ID NO: 802730 - DNA, 18 bp, Homo sapiens
aaatgttgctttaacctg

SEQ ID NO: 802731 - DNA, 17 bp, Homo sapiens
aaatgttggaatgttat

SEQ ID NO: 802732 - DNA, 18 bp, Homo sapiens
aaatgttggaatgttatg

SEQ ID NO: 802733 - DNA, 19 bp, Homo sapiens
aaatgttggatttataaat

SEQ ID NO: 802734 - DNA, 19 bp, Homo sapiens
aaatgttggtcattttatg

SEQ ID NO: 802735 - DNA, 16 bp, Homo sapiens
aaatgttgtcctgtta

SEQ ID NO: 802736 - DNA, 23 bp, Homo sapiens
aaatgttgttcattattggaggg

SEQ ID NO: 802737 - DNA, 14 bp, Homo sapiens
aaatgtttaaagaa

SEQ ID NO: 802738 - DNA, 16 bp, Homo sapiens
aaatgtttcaaatgca

SEQ ID NO: 802739 - DNA, 23 bp, Homo sapiens
aaatgtttcattatgcactttta

SEQ ID NO: 802740 - DNA, 10 bp, Homo sapiens
aaatgtttcc

SEQ ID NO: 802741 - DNA, 14 bp, Homo sapiens
aaatgtttccttaa

SEQ ID NO: 802742 - DNA, 19 bp, Homo sapiens
aaatgtttccttaaacatg

SEQ ID NO: 802743 - DNA, 19 bp, Homo sapiens
aaatgtttccttgtgcctg

SEQ ID NO: 802744 - DNA, 23 bp, Homo sapiens
aaatgtttctgcagtagtctctg

SEQ ID NO: 802745 - DNA, 18 bp, Homo sapiens
aaatgtttcttttccctt

SEQ ID NO: 802746 - DNA, 19 bp, Homo sapiens
aaatgtttggatggtttgt

SEQ ID NO: 802747 - DNA, 23 bp, Homo sapiens
aaatgttttaaagtttaatgcct

SEQ ID NO: 802748 - DNA, 18 bp, Homo sapiens
aaatgttttgtaaacatt

SEQ ID NO: 802749 - DNA, 21 bp, Homo sapiens
aaatgtttttaacactatact

SEQ ID NO: 802750 - DNA, 16 bp, Homo sapiens
aaatgtttttctgcca

SEQ ID NO: 802751 - DNA, 23 bp, Homo sapiens
aaatgtttttggtcttttataat

SEQ ID NO: 802752 - DNA, 18 bp, Homo sapiens
aaatgttttttaaaatgg

SEQ ID NO: 802753 - DNA, 14 bp, Homo sapiens
aaattaaaaaatga

SEQ ID NO: 802754 - DNA, 14 bp, Homo sapiens
aaattaaaaataaa

SEQ ID NO: 802755 - DNA, 21 bp, Homo sapiens
aaattaaaacgaaaataaagt

SEQ ID NO: 802756 - DNA, 23 bp, Homo sapiens
aaattaaaagaaatatacagttt

SEQ ID NO: 802757 - DNA, 14 bp, Homo sapiens
aaattaaaatatta

SEQ ID NO: 802758 - DNA, 17 bp, Homo sapiens
aaattaaaatattattt

SEQ ID NO: 802759 - DNA, 14 bp, Homo sapiens
aaattaaaatggat

SEQ ID NO: 802760 - DNA, 16 bp, Homo sapiens
aaattaaacacaaagt

SEQ ID NO: 802761 - DNA, 18 bp, Homo sapiens
aaattaaacatgctgtta

SEQ ID NO: 802762 - DNA, 20 bp, Homo sapiens
aaattaaacatgctgttacc

SEQ ID NO: 802763 - DNA, 16 bp, Homo sapiens
aaattaaacatttttc

SEQ ID NO: 802764 - DNA, 19 bp, Homo sapiens
aaattaaacttatttacaa

SEQ ID NO: 802765 - DNA, 12 bp, Homo sapiens
aaattaaagccc

SEQ ID NO: 802766 - DNA, 21 bp, Homo sapiens
aaattaaagtatgcaaaataa

SEQ ID NO: 802767 - DNA, 12 bp, Homo sapiens
aaattaaataaa

SEQ ID NO: 802768 - DNA, 12 bp, Homo sapiens
aaattaaatata

SEQ ID NO: 802769 - DNA, 19 bp, Homo sapiens
aaattaaatatatgtatgt

SEQ ID NO: 802770 - DNA, 22 bp, Homo sapiens
aaattaaatctagacattcttt

SEQ ID NO: 802771 - DNA, 14 bp, Homo sapiens
aaattaaatgaatt

SEQ ID NO: 802772 - DNA, 18 bp, Homo sapiens
aaattaaatgccttgtat

SEQ ID NO: 802773 - DNA, 20 bp, Homo sapiens
aaattaaatgccttgtataa

SEQ ID NO: 802774 - DNA, 22 bp, Homo sapiens
aaattaactgctccaaatttaa

SEQ ID NO: 802775 - DNA, 20 bp, Homo sapiens
aaattaactgggtaatgaaa

SEQ ID NO: 802776 - DNA, 15 bp, Homo sapiens
aaattaactgtatgt

SEQ ID NO: 802777 - DNA, 23 bp, Homo sapiens
aaattaacttttataaactttac

SEQ ID NO: 802778 - DNA, 12 bp, Homo sapiens
aaattaagacat

SEQ ID NO: 802779 - DNA, 18 bp, Homo sapiens
aaattaagatcctaaact

SEQ ID NO: 802780 - DNA, 21 bp, Homo sapiens
aaattaagatcctaaactctc

SEQ ID NO: 802781 - DNA, 12 bp, Homo sapiens
aaattaagcatt

SEQ ID NO: 802782 - DNA, 17 bp, Homo sapiens
aaattaagggttaagaa

SEQ ID NO: 802783 - DNA, 16 bp, Homo sapiens
aaattaagtcattttg

SEQ ID NO: 802784 - DNA, 16 bp, Homo sapiens
aaattaatacttcatt

SEQ ID NO: 802785 - DNA, 16 bp, Homo sapiens
aaattaatcctcacag

SEQ ID NO: 802786 - DNA, 13 bp, Homo sapiens
aaattaatttgtg

SEQ ID NO: 802787 - DNA, 20 bp, Homo sapiens
aaattaatttgtgaatttgc

SEQ ID NO: 802788 - DNA, 15 bp, Homo sapiens
aaattacaaaagaga

SEQ ID NO: 802789 - DNA, 14 bp, Homo sapiens
aaattacaatttta

SEQ ID NO: 802790 - DNA, 22 bp, Homo sapiens
aaattacacaataaagcagtcc

SEQ ID NO: 802791 - DNA, 16 bp, Homo sapiens
aaattacagtgcagtt

SEQ ID NO: 802792 - DNA, 18 bp, Homo sapiens
aaattacatgttttttca

SEQ ID NO: 802793 - DNA, 14 bp, Homo sapiens
aaattacattttta

SEQ ID NO: 802794 - DNA, 18 bp, Homo sapiens
aaattacatttttaagct

SEQ ID NO: 802795 - DNA, 15 bp, Homo sapiens
aaattactatagcaa

SEQ ID NO: 802796 - DNA, 19 bp, Homo sapiens
aaattactatagcaaagta

SEQ ID NO: 802797 - DNA, 19 bp, Homo sapiens
aaattactatctgttgaaa

SEQ ID NO: 802798 - DNA, 21 bp, Homo sapiens
aaattactccaaggtttataa

SEQ ID NO: 802799 - DNA, 14 bp, Homo sapiens
aaattactgtttta

SEQ ID NO: 802800 - DNA, 15 bp, Homo sapiens
aaattactgttttat

SEQ ID NO: 802801 - DNA, 20 bp, Homo sapiens
aaattactgttttatgttga

SEQ ID NO: 802802 - DNA, 20 bp, Homo sapiens
aaattagaaaaatatatgct

SEQ ID NO: 802803 - DNA, 15 bp, Homo sapiens
aaattagaaaacaaa

SEQ ID NO: 802804 - DNA, 12 bp, Homo sapiens
aaattagaaaat

SEQ ID NO: 802805 - DNA, 17 bp, Homo sapiens
aaattagaaaatattct

SEQ ID NO: 802806 - DNA, 20 bp, Homo sapiens
aaattagaaaatgttattta

SEQ ID NO: 802807 - DNA, 14 bp, Homo sapiens
aaattagaaaggac

SEQ ID NO: 802808 - DNA, 15 bp, Homo sapiens
aaattagaaaggaca

SEQ ID NO: 802809 - DNA, 16 bp, Homo sapiens
aaattagaaaggacaa

SEQ ID NO: 802810 - DNA, 18 bp, Homo sapiens
aaattagaatgaatttat

SEQ ID NO: 802811 - DNA, 13 bp, Homo sapiens
aaattagaggaga

SEQ ID NO: 802812 - DNA, 19 bp, Homo sapiens
aaattagatcctaagatgt

SEQ ID NO: 802813 - DNA, 12 bp, Homo sapiens
aaattagcatgc

SEQ ID NO: 802814 - DNA, 14 bp, Homo sapiens
aaattagcatgcaa

SEQ ID NO: 802815 - DNA, 17 bp, Homo sapiens
aaattagcatgcaagct

SEQ ID NO: 802816 - DNA, 22 bp, Homo sapiens
aaattagctgggcatggtggtg

SEQ ID NO: 802817 - DNA, 18 bp, Homo sapiens
aaattagctgtgtgaaat

SEQ ID NO: 802818 - DNA, 16 bp, Homo sapiens
aaattaggactgtata

SEQ ID NO: 802819 - DNA, 18 bp, Homo sapiens
aaattaggatttcatgat

SEQ ID NO: 802820 - DNA, 17 bp, Homo sapiens
aaattaggttgaaacat

SEQ ID NO: 802821 - DNA, 19 bp, Homo sapiens
aaattaggttgaaacatat

SEQ ID NO: 802822 - DNA, 17 bp, Homo sapiens
aaattagtctttttctt

SEQ ID NO: 802823 - DNA, 14 bp, Homo sapiens
aaattagtttacct

SEQ ID NO: 802824 - DNA, 14 bp, Homo sapiens
aaattatagaaaca

SEQ ID NO: 802825 - DNA, 15 bp, Homo sapiens
aaattatagaaacaa

SEQ ID NO: 802826 - DNA, 13 bp, Homo sapiens
aacaagaagccca

SEQ ID NO: 802827 - DNA, 19 bp, Homo sapiens
aacaagaagggactgagag

SEQ ID NO: 802828 - DNA, 12 bp, Homo sapiens
aacaagaattgg

SEQ ID NO: 802829 - DNA, 13 bp, Homo sapiens
aacaagacagcct

SEQ ID NO: 802830 - DNA, 15 bp, Homo sapiens
aacaagactgcctcc

SEQ ID NO: 802831 - DNA, 17 bp, Homo sapiens
aacaagatctttcagga

SEQ ID NO: 802832 - DNA, 19 bp, Homo sapiens
aacaagatctttcaggaaa

SEQ ID NO: 802833 - DNA, 22 bp, Homo sapiens
aacaagcaaggatatcagagct

SEQ ID NO: 802834 - DNA, 11 bp, Homo sapiens
aacaagcctta

SEQ ID NO: 802835 - DNA, 14 bp, Homo sapiens
aacaagctgtgcag

SEQ ID NO: 802836 - DNA, 14 bp, Homo sapiens
aacaaggaagccaa

SEQ ID NO: 802837 - DNA, 16 bp, Homo sapiens
aacaaggaagccaaag

SEQ ID NO: 802838 - DNA, 14 bp, Homo sapiens
aacaaggaagtcaa

SEQ ID NO: 802839 - DNA, 21 bp, Homo sapiens
aacaaggagctcaccctgccc

SEQ ID NO: 802840 - DNA, 17 bp, Homo sapiens
aacaagggaaggggcct

SEQ ID NO: 802841 - DNA, 19 bp, Homo sapiens
aacaagggtggcatcccag

SEQ ID NO: 802842 - DNA, 19 bp, Homo sapiens
aacaaggttatatgaatat

SEQ ID NO: 802843 - DNA, 20 bp, Homo sapiens
aacaaggttatatgaatata

SEQ ID NO: 802844 - DNA, 20 bp, Homo sapiens
aacaagtatttgttaattta

SEQ ID NO: 802845 - DNA, 19 bp, Homo sapiens
aacaagtcacagctgcagc

SEQ ID NO: 802846 - DNA, 23 bp, Homo sapiens
aacaagtgaccccagggcctgtc

SEQ ID NO: 802847 - DNA, 17 bp, Homo sapiens
aacaagtgcctcctgga

SEQ ID NO: 802848 - DNA, 15 bp, Homo sapiens
aacaataactactgt

SEQ ID NO: 802849 - DNA, 20 bp, Homo sapiens
aacaataactactgtgttcc

SEQ ID NO: 802850 - DNA, 21 bp, Homo sapiens
aacaataactactgtgttcct

SEQ ID NO: 802851 - DNA, 17 bp, Homo sapiens
aacaataagacatgctt

SEQ ID NO: 802852 - DNA, 13 bp, Homo sapiens
aacaatacaaatg

SEQ ID NO: 802853 - DNA, 15 bp, Homo sapiens
aacaatacaaatgga

SEQ ID NO: 802854 - DNA, 15 bp, Homo sapiens
aacaatatctgcagc

SEQ ID NO: 802855 - DNA, 16 bp, Homo sapiens
aacaatatctgcagcg

SEQ ID NO: 802856 - DNA, 18 bp, Homo sapiens
aacaatattgtatactac

SEQ ID NO: 802857 - DNA, 23 bp, Homo sapiens
aacaatccatgtgattaatgttt

SEQ ID NO: 802858 - DNA, 20 bp, Homo sapiens
aacaatcccaatctttctat

SEQ ID NO: 802859 - DNA, 21 bp, Homo sapiens
aacaatcccaatctttctata

SEQ ID NO: 802860 - DNA, 18 bp, Homo sapiens
aacaatctttcatgtctt

SEQ ID NO: 802861 - DNA, 15 bp, Homo sapiens
aacaatgaaattgac

SEQ ID NO: 802862 - DNA, 19 bp, Homo sapiens
aacaatgacactagaaaac

SEQ ID NO: 802863 - DNA, 20 bp, Homo sapiens
aacaatgacactagaaaact

SEQ ID NO: 802864 - DNA, 17 bp, Homo sapiens
aacaatgcctattgtaa

SEQ ID NO: 802865 - DNA, 23 bp, Homo sapiens
aacaatgcctattgtaatataga

SEQ ID NO: 802866 - DNA, 16 bp, Homo sapiens
aacaatgtataaagat

SEQ ID NO: 802867 - DNA, 20 bp, Homo sapiens
aacaatgtataaagattgta

SEQ ID NO: 802868 - DNA, 19 bp, Homo sapiens
aacaattcaagctgagaaa

SEQ ID NO: 802869 - DNA, 12 bp, Homo sapiens
aacaattcagtg

SEQ ID NO: 802870 - DNA, 18 bp, Homo sapiens
aacaattcccttcttttt

SEQ ID NO: 802871 - DNA, 22 bp, Homo sapiens
aacaattcccttctttttcatc

SEQ ID NO: 802872 - DNA, 23 bp, Homo sapiens
aacaattgaagtaaactttttgt

SEQ ID NO: 802873 - DNA, 20 bp, Homo sapiens
aacaattgcaacagaagcaa

SEQ ID NO: 802874 - DNA, 16 bp, Homo sapiens
aacaattggtaaaact

SEQ ID NO: 802875 - DNA, 24 bp, Homo sapiens
aacaattggtaaaactcactgtga

SEQ ID NO: 802876 - DNA, 14 bp, Homo sapiens
aacaattgtcttaa

SEQ ID NO: 802877 - DNA, 23 bp, Homo sapiens
aacaattgtgtagcctttttgta

SEQ ID NO: 802878 - DNA, 16 bp, Homo sapiens
aacaattgtgtgaatt

SEQ ID NO: 802879 - DNA, 22 bp, Homo sapiens
aacaatttcctttatatttagt

SEQ ID NO: 802880 - DNA, 19 bp, Homo sapiens
aacaatttggcaattttgt

SEQ ID NO: 802881 - DNA, 13 bp, Homo sapiens
aacaattttaatg

SEQ ID NO: 802882 - DNA, 23 bp, Homo sapiens
aacaattttaggaggaccagagc

SEQ ID NO: 802883 - DNA, 15 bp, Homo sapiens
aacacaaaacaacaa

SEQ ID NO: 802884 - DNA, 21 bp, Homo sapiens
aacacaaaacattcatgtaac

SEQ ID NO: 802885 - DNA, 14 bp, Homo sapiens
aacacaaaacattt

SEQ ID NO: 802886 - DNA, 16 bp, Homo sapiens
aacacaaaacttgaaa

SEQ ID NO: 802887 - DNA, 18 bp, Homo sapiens
aacacaaaacttgaaaga

SEQ ID NO: 802888 - DNA, 17 bp, Homo sapiens
aacacaaacccccactc

SEQ ID NO: 802889 - DNA, 15 bp, Homo sapiens
aacacaaactgtaaa

SEQ ID NO: 802890 - DNA, 19 bp, Homo sapiens
aacacaaactgtaaataaa

SEQ ID NO: 802891 - DNA, 21 bp, Homo sapiens
aacacaaatgaaaatgaatag

SEQ ID NO: 802892 - DNA, 17 bp, Homo sapiens
aacacaaatgtctagtt

SEQ ID NO: 802893 - DNA, 16 bp, Homo sapiens
aacacaagtcctgtga

SEQ ID NO: 802894 - DNA, 14 bp, Homo sapiens
aacacacaaaggta

SEQ ID NO: 802895 - DNA, 18 bp, Homo sapiens
aacacacacgccagctcc

SEQ ID NO: 802896 - DNA, 20 bp, Homo sapiens
aacacacacgccagctcctc

SEQ ID NO: 802897 - DNA, 12 bp, Homo sapiens
aacacacagaca

SEQ ID NO: 802898 - DNA, 15 bp, Homo sapiens
aacacaccaggctgt

SEQ ID NO: 802899 - DNA, 20 bp, Homo sapiens
aacacacgagcaaacccaga

SEQ ID NO: 802900 - DNA, 16 bp, Homo sapiens
aacacactgtgtcctg

SEQ ID NO: 802901 - DNA, 19 bp, Homo sapiens
aacacagaaacctttttaa

SEQ ID NO: 802902 - DNA, 12 bp, Homo sapiens
aacacagagaaa

SEQ ID NO: 802903 - DNA, 19 bp, Homo sapiens
aacacagcatgtgccaaga

SEQ ID NO: 802904 - DNA, 17 bp, Homo sapiens
aacacagcctccctgag

SEQ ID NO: 802905 - DNA, 17 bp, Homo sapiens
aacacagccttccttct

SEQ ID NO: 802906 - DNA, 17 bp, Homo sapiens
aacacagggttttgtat

SEQ ID NO: 802907 - DNA, 19 bp, Homo sapiens
aacacagtttagtgcttta

SEQ ID NO: 802908 - DNA, 19 bp, Homo sapiens
aacacatacaaaagaatta

SEQ ID NO: 802909 - DNA, 17 bp, Homo sapiens
aacacatagattcacct

SEQ ID NO: 802910 - DNA, 21 bp, Homo sapiens
aacacatctagtagttgttct

SEQ ID NO: 802911 - DNA, 15 bp, Homo sapiens
aacacatctggctgc

SEQ ID NO: 802912 - DNA, 22 bp, Homo sapiens
aacacatctggctgcacaggct

SEQ ID NO: 802913 - DNA, 14 bp, Homo sapiens
aacacatgggggag

SEQ ID NO: 802914 - DNA, 16 bp, Homo sapiens
aacacatgggggagag

SEQ ID NO: 802915 - DNA, 20 bp, Homo sapiens
aacacatgggggagagagac

SEQ ID NO: 802916 - DNA, 17 bp, Homo sapiens
aacacattctttataaa

SEQ ID NO: 802917 - DNA, 20 bp, Homo sapiens
aacacattctttataaaatg

SEQ ID NO: 802918 - DNA, 13 bp, Homo sapiens
aacacatttctct

SEQ ID NO: 802919 - DNA, 15 bp, Homo sapiens
aacaccaacataaaa

SEQ ID NO: 802920 - DNA, 14 bp, Homo sapiens
aacaccaagcacag

SEQ ID NO: 802921 - DNA, 16 bp, Homo sapiens
aacaccacagacacac

SEQ ID NO: 802922 - DNA, 17 bp, Homo sapiens
aacaccacagacacaca

SEQ ID NO: 802923 - DNA, 19 bp, Homo sapiens
aacaccattataaaaacac

SEQ ID NO: 802924 - DNA, 12 bp, Homo sapiens
aacacccaaaaa

SEQ ID NO: 802925 - DNA, 15 bp, Homo sapiens
aacacccctctgtct

SEQ ID NO: 802926 - DNA, 21 bp, Homo sapiens
aacacccgccccccccatgtt

SEQ ID NO: 802927 - DNA, 15 bp, Homo sapiens
aacacccttagaaaa

SEQ ID NO: 802928 - DNA, 20 bp, Homo sapiens
aacacccttagaaaatgtgt

SEQ ID NO: 802929 - DNA, 13 bp, Homo sapiens
aacaccggcagaa

SEQ ID NO: 802930 - DNA, 11 bp, Homo sapiens
aacacctgcct

SEQ ID NO: 802931 - DNA, 21 bp, Homo sapiens
aacacctgccttctaccctct

SEQ ID NO: 802932 - DNA, 14 bp, Homo sapiens
aacaccttaatatg

SEQ ID NO: 802933 - DNA, 17 bp, Homo sapiens
aacaccttcctcctgca

SEQ ID NO: 802934 - DNA, 13 bp, Homo sapiens
aacaccttctctg

SEQ ID NO: 802935 - DNA, 16 bp, Homo sapiens
aacacgattttcaaga

SEQ ID NO: 802936 - DNA, 17 bp, Homo sapiens
aacacgattttcaagat

SEQ ID NO: 802937 - DNA, 20 bp, Homo sapiens
aacacgcctaaaactcaaaa

SEQ ID NO: 802938 - DNA, 22 bp, Homo sapiens
aacacgccttgttcctgctctt

SEQ ID NO: 802939 - DNA, 15 bp, Homo sapiens
aacacgctgcctggt

SEQ ID NO: 802940 - DNA, 21 bp, Homo sapiens
aacacgtatcccacctgacat

SEQ ID NO: 802941 - DNA, 14 bp, Homo sapiens
aacacgttgccagg

SEQ ID NO: 802942 - DNA, 17 bp, Homo sapiens
aacactaactcaccagc

SEQ ID NO: 802943 - DNA, 14 bp, Homo sapiens
aacactaatatatt

SEQ ID NO: 802944 - DNA, 22 bp, Homo sapiens
aacactaatatatttaaaaata

SEQ ID NO: 802945 - DNA, 23 bp, Homo sapiens
aacactaatatatttaaaaataa

SEQ ID NO: 802946 - DNA, 14 bp, Homo sapiens
aacactaattcata

SEQ ID NO: 802947 - DNA, 15 bp, Homo sapiens
aacactaattcataa

SEQ ID NO: 802948 - DNA, 15 bp, Homo sapiens
aacatgagactgtaa

SEQ ID NO: 802949 - DNA, 18 bp, Homo sapiens
aacatgagactgtaaaac

SEQ ID NO: 802950 - DNA, 21 bp, Homo sapiens
aacatgaggggacattttggt

SEQ ID NO: 802951 - DNA, 15 bp, Homo sapiens
aacatgatttcaaaa

SEQ ID NO: 802952 - DNA, 14 bp, Homo sapiens
aacatgcacattta

SEQ ID NO: 802953 - DNA, 14 bp, Homo sapiens
aacatgcactgatg

SEQ ID NO: 802954 - DNA, 16 bp, Homo sapiens
aacatgcactgatgtt

SEQ ID NO: 802955 - DNA, 20 bp, Homo sapiens
aacatgcagttcattatttt

SEQ ID NO: 802956 - DNA, 14 bp, Homo sapiens
aacatgcatacttt

SEQ ID NO: 802957 - DNA, 14 bp, Homo sapiens
aacatgccccctgc

SEQ ID NO: 802958 - DNA, 13 bp, Homo sapiens
aacatgcctgcca

SEQ ID NO: 802959 - DNA, 20 bp, Homo sapiens
aacatggacttgtatatttg

SEQ ID NO: 802960 - DNA, 21 bp, Homo sapiens
aacatgggagggatcagcccc

SEQ ID NO: 802961 - DNA, 21 bp, Homo sapiens
aacatgggcattgggttctaa

SEQ ID NO: 802962 - DNA, 20 bp, Homo sapiens
aacatggtttaaaagaaaaa

SEQ ID NO: 802963 - DNA, 20 bp, Homo sapiens
aacatggttttgaaatgctt

SEQ ID NO: 802964 - DNA, 16 bp, Homo sapiens
aacatgtatgtgcatt

SEQ ID NO: 802965 - DNA, 18 bp, Homo sapiens
aacatgtgccttttctga

SEQ ID NO: 802966 - DNA, 19 bp, Homo sapiens
aacatgtgccttttctgaa

SEQ ID NO: 802967 - DNA, 16 bp, Homo sapiens
aacatgtggctcctcc

SEQ ID NO: 802968 - DNA, 20 bp, Homo sapiens
aacatgtgttttcatcattt

SEQ ID NO: 802969 - DNA, 22 bp, Homo sapiens
aacatgtgttttcatcatttca

SEQ ID NO: 802970 - DNA, 12 bp, Homo sapiens
aacatgttaaga

SEQ ID NO: 802971 - DNA, 16 bp, Homo sapiens
aacatgttactgacca

SEQ ID NO: 802972 - DNA, 22 bp, Homo sapiens
aacatgtttaaatagcctaaat

SEQ ID NO: 802973 - DNA, 18 bp, Homo sapiens
aacatgtttctgttttgt

SEQ ID NO: 802974 - DNA, 19 bp, Homo sapiens
aacattaaaactcataatt

SEQ ID NO: 802975 - DNA, 13 bp, Homo sapiens
aacattaaacact

SEQ ID NO: 802976 - DNA, 14 bp, Homo sapiens
aacattaagaaaat

SEQ ID NO: 802977 - DNA, 16 bp, Homo sapiens
aacattaagaaaatca

SEQ ID NO: 802978 - DNA, 14 bp, Homo sapiens
aacattaaggaatt

SEQ ID NO: 802979 - DNA, 22 bp, Homo sapiens
aacattaattttgtgcattctt

SEQ ID NO: 802980 - DNA, 22 bp, Homo sapiens
aacattacaaaaaaattttatg

SEQ ID NO: 802981 - DNA, 17 bp, Homo sapiens
aacattacagttcataa

SEQ ID NO: 802982 - DNA, 20 bp, Homo sapiens
aacattacagttcataatag

SEQ ID NO: 802983 - DNA, 18 bp, Homo sapiens
aacattacttatttaact

SEQ ID NO: 802984 - DNA, 22 bp, Homo sapiens
aacattagatgtcatgaggaaa

SEQ ID NO: 802985 - DNA, 13 bp, Homo sapiens
aacattaggaatt

SEQ ID NO: 802986 - DNA, 21 bp, Homo sapiens
aacattaggaattgtttatac

SEQ ID NO: 802987 - DNA, 19 bp, Homo sapiens
aacattaggaccttagaat

SEQ ID NO: 802988 - DNA, 13 bp, Homo sapiens
aacattagtgaaa

SEQ ID NO: 802989 - DNA, 12 bp, Homo sapiens
aacattatttat

SEQ ID NO: 802990 - DNA, 17 bp, Homo sapiens
aacattatttttagatt

SEQ ID NO: 802991 - DNA, 11 bp, Homo sapiens
aacattcacac

SEQ ID NO: 802992 - DNA, 20 bp, Homo sapiens
aacattcacacagggctctt

SEQ ID NO: 802993 - DNA, 22 bp, Homo sapiens
aacattcacttttgttaacagt

SEQ ID NO: 802994 - DNA, 16 bp, Homo sapiens
aacattcatagtcttt

SEQ ID NO: 802995 - DNA, 17 bp, Homo sapiens
aacattcccagcccagc

SEQ ID NO: 802996 - DNA, 14 bp, Homo sapiens
aacattcccctccc

SEQ ID NO: 802997 - DNA, 21 bp, Homo sapiens
aacattcccctccccactcct

SEQ ID NO: 802998 - DNA, 13 bp, Homo sapiens
aacattcctccag

SEQ ID NO: 802999 - DNA, 20 bp, Homo sapiens
aacattcctccagcctcccc

SEQ ID NO: 803000 - DNA, 21 bp, Homo sapiens
aacattcctccagcctcccct

SEQ ID NO: 803001 - DNA, 22 bp, Homo sapiens
aacattcctccagcctcccctc

SEQ ID NO: 803002 - DNA, 18 bp, Homo sapiens
aacattcgtgagctgggg

SEQ ID NO: 803003 - DNA, 14 bp, Homo sapiens
aacattctttttct

SEQ ID NO: 803004 - DNA, 17 bp, Homo sapiens
aacattgaccaagaact

SEQ ID NO: 803005 - DNA, 19 bp, Homo sapiens
aacattgacttcttggttt

SEQ ID NO: 803006 - DNA, 22 bp, Homo sapiens
aacattgcatataacttatatt

SEQ ID NO: 803007 - DNA, 22 bp, Homo sapiens
aacattgcctttgaatgttaat

SEQ ID NO: 803008 - DNA, 13 bp, Homo sapiens
aacattgctttgt

SEQ ID NO: 803009 - DNA, 16 bp, Homo sapiens
aacattggaatgttct

SEQ ID NO: 803010 - DNA, 21 bp, Homo sapiens
aacattggaatgttctcagat

SEQ ID NO: 803011 - DNA, 22 bp, Homo sapiens
aacattggggattgaaaatcat

SEQ ID NO: 803012 - DNA, 17 bp, Homo sapiens
aacattgtaaagtatgt

SEQ ID NO: 803013 - DNA, 18 bp, Homo sapiens
aacattgtactgttgctt

SEQ ID NO: 803014 - DNA, 13 bp, Homo sapiens
aacattgtgttcc

SEQ ID NO: 803015 - DNA, 17 bp, Homo sapiens
aacatttaaacttttta

SEQ ID NO: 803016 - DNA, 18 bp, Homo sapiens
aacatttaaactttttaa

SEQ ID NO: 803017 - DNA, 14 bp, Homo sapiens
aacatttaacataa

SEQ ID NO: 803018 - DNA, 21 bp, Homo sapiens
aacatttacaataaatattct

SEQ ID NO: 803019 - DNA, 15 bp, Homo sapiens
aacatttagtttaaa

SEQ ID NO: 803020 - DNA, 13 bp, Homo sapiens
aacatttatgacc

SEQ ID NO: 803021 - DNA, 14 bp, Homo sapiens
aacatttatgacct

SEQ ID NO: 803022 - DNA, 22 bp, Homo sapiens
aacatttatgacctaagtcagg

SEQ ID NO: 803023 - DNA, 23 bp, Homo sapiens
aacatttattttttttaaagaaa

SEQ ID NO: 803024 - DNA, 21 bp, Homo sapiens
aacatttcaatgtcagccttt

SEQ ID NO: 803025 - DNA, 21 bp, Homo sapiens
aacatttcagaaggtatcagt

SEQ ID NO: 803026 - DNA, 22 bp, Homo sapiens
aacatttctatagccaaaaata

SEQ ID NO: 803027 - DNA, 17 bp, Homo sapiens
aacatttctgtatactg

SEQ ID NO: 803028 - DNA, 19 bp, Homo sapiens
aacatttctgtatactgta

SEQ ID NO: 803029 - DNA, 13 bp, Homo sapiens
aacatttctgttc

SEQ ID NO: 803030 - DNA, 12 bp, Homo sapiens
aacatttgatat

SEQ ID NO: 803031 - DNA, 12 bp, Homo sapiens
aacatttgcctt

SEQ ID NO: 803032 - DNA, 22 bp, Homo sapiens
aacatttgccttgcagaactgc

SEQ ID NO: 803033 - DNA, 16 bp, Homo sapiens
aacatttgctgtttta

SEQ ID NO: 803034 - DNA, 19 bp, Homo sapiens
aacatttgggttactattt

SEQ ID NO: 803035 - DNA, 15 bp, Homo sapiens
aacattttaaataaa

SEQ ID NO: 803036 - DNA, 16 bp, Homo sapiens
aacattttaaatgaaa

SEQ ID NO: 803037 - DNA, 20 bp, Homo sapiens
aacattttatactgtacatg

SEQ ID NO: 803038 - DNA, 22 bp, Homo sapiens
aacattttctttctttttctgg

SEQ ID NO: 803039 - DNA, 14 bp, Homo sapiens
aacattttgtggag

SEQ ID NO: 803040 - DNA, 20 bp, Homo sapiens
aacatttttttttctccata

SEQ ID NO: 803041 - DNA, 21 bp, Homo sapiens
aacatttttttttctccataa

SEQ ID NO: 803042 - DNA, 11 bp, Homo sapiens
aaccaaaacag

SEQ ID NO: 803043 - DNA, 12 bp, Homo sapiens
aaccaaaacata

SEQ ID NO: 803044 - DNA, 22 bp, Homo sapiens
aaccaaaagggaggctctctgt

SEQ ID NO: 803045 - DNA, 21 bp, Homo sapiens
aaccaaacaacaggcccttgg

SEQ ID NO: 803046 - DNA, 14 bp, Homo sapiens
aaccaaacccagcc

SEQ ID NO: 803047 - DNA, 16 bp, Homo sapiens
aaccaaacccagccac

SEQ ID NO: 803048 - DNA, 18 bp, Homo sapiens
aaccaaacttgttcattt

SEQ ID NO: 803049 - DNA, 13 bp, Homo sapiens
aaccaaagaagaa

SEQ ID NO: 803050 - DNA, 23 bp, Homo sapiens
aaccaaagagactggagcatctg

SEQ ID NO: 803051 - DNA, 18 bp, Homo sapiens
aaccaaagcctcttcaaa

SEQ ID NO: 803052 - DNA, 14 bp, Homo sapiens
aaccaaagctgcct

SEQ ID NO: 803053 - DNA, 16 bp, Homo sapiens
aaccaaaggtgaagga

SEQ ID NO: 803054 - DNA, 23 bp, Homo sapiens
aaccaaaggtgaaggaatatatg

SEQ ID NO: 803055 - DNA, 15 bp, Homo sapiens
aaccaaagtctaaac

SEQ ID NO: 803056 - DNA, 14 bp, Homo sapiens
aaccaaatacctca

SEQ ID NO: 803057 - DNA, 13 bp, Homo sapiens
aaccaacatcttt

SEQ ID NO: 803058 - DNA, 14 bp, Homo sapiens
aaccaactatccaa

SEQ ID NO: 803059 - DNA, 18 bp, Homo sapiens
aaccaactatccaagtgt

SEQ ID NO: 803060 - DNA, 16 bp, Homo sapiens
aaccaactgccccagg

SEQ ID NO: 803061 - DNA, 22 bp, Homo sapiens
aaccaagagttaagatatccct

SEQ ID NO: 803062 - DNA, 16 bp, Homo sapiens
aaccaagattatgtga

SEQ ID NO: 803063 - DNA, 15 bp, Homo sapiens
aaccaagctctctgc

SEQ ID NO: 803064 - DNA, 11 bp, Homo sapiens
aaccaagctgt

SEQ ID NO: 803065 - DNA, 13 bp, Homo sapiens
aaccaaggaagga

SEQ ID NO: 803066 - DNA, 23 bp, Homo sapiens
aaccaaggaaggagcccctgagt

SEQ ID NO: 803067 - DNA, 13 bp, Homo sapiens
aaccaaggcagcc

SEQ ID NO: 803068 - DNA, 22 bp, Homo sapiens
aaccaaggcagcctccagagcc

SEQ ID NO: 803069 - DNA, 16 bp, Homo sapiens
aaccaagtcatgtgca

SEQ ID NO: 803070 - DNA, 19 bp, Homo sapiens
aacccccagaggtggccct

SEQ ID NO: 803071 - DNA, 16 bp, Homo sapiens
aacccccattctcatc

SEQ ID NO: 803072 - DNA, 14 bp, Homo sapiens
aacccccctcctgc

SEQ ID NO: 803073 - DNA, 17 bp, Homo sapiens
aacccccctcctgctcc

SEQ ID NO: 803074 - DNA, 15 bp, Homo sapiens
aacccccctgtacac

SEQ ID NO: 803075 - DNA, 18 bp, Homo sapiens
aacccccgccacctcagg

SEQ ID NO: 803076 - DNA, 18 bp, Homo sapiens
aaccccctccctgtccca

SEQ ID NO: 803077 - DNA, 15 bp, Homo sapiens
aaccccgcagcccgt

SEQ ID NO: 803078 - DNA, 19 bp, Homo sapiens
aaccccgcggtgctctggc

SEQ ID NO: 803079 - DNA, 17 bp, Homo sapiens
aaccccgggatgcaagg

SEQ ID NO: 803080 - DNA, 17 bp, Homo sapiens
aaccccgggcccgggcc

SEQ ID NO: 803081 - DNA, 23 bp, Homo sapiens
aacccctaagactgccttcagta

SEQ ID NO: 803082 - DNA, 12 bp, Homo sapiens
aacccctcctgg

SEQ ID NO: 803083 - DNA, 20 bp, Homo sapiens
aacccctcttggattaagga

SEQ ID NO: 803084 - DNA, 12 bp, Homo sapiens
aacccctggcca

SEQ ID NO: 803085 - DNA, 17 bp, Homo sapiens
aacccctgtaggcctca

SEQ ID NO: 803086 - DNA, 13 bp, Homo sapiens
aacccctgtggag

SEQ ID NO: 803087 - DNA, 11 bp, Homo sapiens
aacccctttcc

SEQ ID NO: 803088 - DNA, 13 bp, Homo sapiens
aacccgctggagc

SEQ ID NO: 803089 - DNA, 21 bp, Homo sapiens
aacccggcccaacccagccca

SEQ ID NO: 803090 - DNA, 23 bp, Homo sapiens
aacccgggagcggaggttgcagt

SEQ ID NO: 803091 - DNA, 14 bp, Homo sapiens
aacccgggaggcag

SEQ ID NO: 803092 - DNA, 22 bp, Homo sapiens
aaccctaatctttcacttgaaa

SEQ ID NO: 803093 - DNA, 20 bp, Homo sapiens
aaccctactttgcttccgcc

SEQ ID NO: 803094 - DNA, 16 bp, Homo sapiens
aaccctagccttgctt

SEQ ID NO: 803095 - DNA, 18 bp, Homo sapiens
aaccctagccttgcttgt

SEQ ID NO: 803096 - DNA, 19 bp, Homo sapiens
aaccctagccttgcttgtt

SEQ ID NO: 803097 - DNA, 14 bp, Homo sapiens
aaccctagctgtgt

SEQ ID NO: 803098 - DNA, 17 bp, Homo sapiens
aaccctaggaatttaga

SEQ ID NO: 803099 - DNA, 20 bp, Homo sapiens
aaccctaggttcccggtccc

SEQ ID NO: 803100 - DNA, 21 bp, Homo sapiens
aaccctcaggccaccctccac

SEQ ID NO: 803101 - DNA, 22 bp, Homo sapiens
aaccctcattgctgtcttgccc

SEQ ID NO: 803102 - DNA, 16 bp, Homo sapiens
aaccctcccagaaaca

SEQ ID NO: 803103 - DNA, 13 bp, Homo sapiens
aaccctccctcag

SEQ ID NO: 803104 - DNA, 15 bp, Homo sapiens
aaccctccctcagcc

SEQ ID NO: 803105 - DNA, 19 bp, Homo sapiens
aaccctccctcagcccctc

SEQ ID NO: 803106 - DNA, 23 bp, Homo sapiens
aaccctccctcagcccctcttgc

SEQ ID NO: 803107 - DNA, 19 bp, Homo sapiens
aaccctcctatcacctccc

SEQ ID NO: 803108 - DNA, 12 bp, Homo sapiens
aaccctcctcct

SEQ ID NO: 803109 - DNA, 13 bp, Homo sapiens
aaccctctcttcc

SEQ ID NO: 803110 - DNA, 16 bp, Homo sapiens
aaccctctcttcccta

SEQ ID NO: 803111 - DNA, 18 bp, Homo sapiens
aaccctcttgccatcctg

SEQ ID NO: 803112 - DNA, 19 bp, Homo sapiens
aaccctgatctctcagccc

SEQ ID NO: 803113 - DNA, 19 bp, Homo sapiens
aaccctgattcatactcct

SEQ ID NO: 803114 - DNA, 21 bp, Homo sapiens
aaccctgcaatcactttttgg

SEQ ID NO: 803115 - DNA, 15 bp, Homo sapiens
aaccctgccagtgcc

SEQ ID NO: 803116 - DNA, 11 bp, Homo sapiens
aaccctgcccc

SEQ ID NO: 803117 - DNA, 14 bp, Homo sapiens
aaccctgcccctgc

SEQ ID NO: 803118 - DNA, 20 bp, Homo sapiens
aaccctgccgtcaccaccac

SEQ ID NO: 803119 - DNA, 22 bp, Homo sapiens
aaccctgccgtcaccaccaccc

SEQ ID NO: 803120 - DNA, 19 bp, Homo sapiens
aaccctgcctcttgtgtcc

SEQ ID NO: 803121 - DNA, 20 bp, Homo sapiens
aaccctgcctgccgctgcac

SEQ ID NO: 803122 - DNA, 21 bp, Homo sapiens
aaccctgcctgccgctgcacc

SEQ ID NO: 803123 - DNA, 22 bp, Homo sapiens
aaccctgcctgccgctgcacct

SEQ ID NO: 803124 - DNA, 14 bp, Homo sapiens
aaccctgctgaaca

SEQ ID NO: 803125 - DNA, 19 bp, Homo sapiens
aaccctggagccatccctt

SEQ ID NO: 803126 - DNA, 11 bp, Homo sapiens
aaccctgggac

SEQ ID NO: 803127 - DNA, 12 bp, Homo sapiens
aaccctgggctg

SEQ ID NO: 803128 - DNA, 16 bp, Homo sapiens
aaccctgggctgtcca

SEQ ID NO: 803129 - DNA, 20 bp, Homo sapiens
aaccctggggaaggagccag

SEQ ID NO: 803130 - DNA, 19 bp, Homo sapiens
aaccctgtgctggtgtcct

SEQ ID NO: 803131 - DNA, 13 bp, Homo sapiens
aaccctgtggttg

SEQ ID NO: 803132 - DNA, 22 bp, Homo sapiens
aaccctgttttatactgtactt

SEQ ID NO: 803133 - DNA, 20 bp, Homo sapiens
aacccttcaactcctggctc

SEQ ID NO: 803134 - DNA, 16 bp, Homo sapiens
aacccttcatcttcct

SEQ ID NO: 803135 - DNA, 22 bp, Homo sapiens
aacccttcatcttcctgtgtcc

SEQ ID NO: 803136 - DNA, 20 bp, Homo sapiens
aacccttccccactgcacac

SEQ ID NO: 803137 - DNA, 13 bp, Homo sapiens
aacccttctttta

SEQ ID NO: 803138 - DNA, 21 bp, Homo sapiens
aacccttgaatttctagacag

SEQ ID NO: 803139 - DNA, 16 bp, Homo sapiens
aacccttgctgcttta

SEQ ID NO: 803140 - DNA, 14 bp, Homo sapiens
aacccttgggccag

SEQ ID NO: 803141 - DNA, 18 bp, Homo sapiens
aacccttgggccagaagt

SEQ ID NO: 803142 - DNA, 20 bp, Homo sapiens
aacccttgggccagaagtac

SEQ ID NO: 803143 - DNA, 21 bp, Homo sapiens
aacccttgtcagtgacagtat

SEQ ID NO: 803144 - DNA, 17 bp, Homo sapiens
aaccgagcaaagatcaa

SEQ ID NO: 803145 - DNA, 22 bp, Homo sapiens
aaccgagcaaagatcaaaataa

SEQ ID NO: 803146 - DNA, 17 bp, Homo sapiens
aaccgagtagaaaatgt

SEQ ID NO: 803147 - DNA, 19 bp, Homo sapiens
aaccgagtagaaaatgtga

SEQ ID NO: 803148 - DNA, 14 bp, Homo sapiens
aaccgcacagctca

SEQ ID NO: 803149 - DNA, 15 bp, Homo sapiens
aaccgcacagctcag

SEQ ID NO: 803150 - DNA, 16 bp, Homo sapiens
aaccgctaaaagaaac

SEQ ID NO: 803151 - DNA, 23 bp, Homo sapiens
aaccggaaggaggccaaccagcc

SEQ ID NO: 803152 - DNA, 23 bp, Homo sapiens
aaccggggagcccccgccccgcc

SEQ ID NO: 803153 - DNA, 22 bp, Homo sapiens
aaccgtaaaggtttatttttct

SEQ ID NO: 803154 - DNA, 19 bp, Homo sapiens
aaccgtaacccacccccaa

SEQ ID NO: 803155 - DNA, 22 bp, Homo sapiens
aaccgtcctgctgtccctgtca

SEQ ID NO: 803156 - DNA, 16 bp, Homo sapiens
aaccgtctgttatgct

SEQ ID NO: 803157 - DNA, 14 bp, Homo sapiens
aacctaaaaaagat

SEQ ID NO: 803158 - DNA, 20 bp, Homo sapiens
aacctaaaataattggttct

SEQ ID NO: 803159 - DNA, 22 bp, Homo sapiens
aacctaaataaacacatagatt

SEQ ID NO: 803160 - DNA, 14 bp, Homo sapiens
aacctaattaatat

SEQ ID NO: 803161 - DNA, 18 bp, Homo sapiens
aacctacacactgtcatg

SEQ ID NO: 803162 - DNA, 19 bp, Homo sapiens
aacctaccaccccttcctg

SEQ ID NO: 803163 - DNA, 16 bp, Homo sapiens
aacctacgcacatacc

SEQ ID NO: 803164 - DNA, 20 bp, Homo sapiens
aacctactgcccacatttgg

SEQ ID NO: 803165 - DNA, 15 bp, Homo sapiens
aacctactgttcctt

SEQ ID NO: 803166 - DNA, 20 bp, Homo sapiens
aacctagatgtttaacaaat

SEQ ID NO: 803167 - DNA, 20 bp, Homo sapiens
aacctagcttttaaaaaata

SEQ ID NO: 803168 - DNA, 19 bp, Homo sapiens
aacctaggagtgccccatt

SEQ ID NO: 803169 - DNA, 16 bp, Homo sapiens
aacctagtaaaacctt

SEQ ID NO: 803170 - DNA, 17 bp, Homo sapiens
aacctagtaaaaccttg

SEQ ID NO: 803171 - DNA, 15 bp, Homo sapiens
aacctataagcatga

SEQ ID NO: 803172 - DNA, 15 bp, Homo sapiens
aacctatctcaggga

SEQ ID NO: 803173 - DNA, 18 bp, Homo sapiens
aacctatctcagggaggg

SEQ ID NO: 803174 - DNA, 21 bp, Homo sapiens
aacctatgaagcaatggatat

SEQ ID NO: 803175 - DNA, 22 bp, Homo sapiens
aacctatgatattttctgtgcc

SEQ ID NO: 803176 - DNA, 21 bp, Homo sapiens
aacctattgggacagcatgac

SEQ ID NO: 803177 - DNA, 19 bp, Homo sapiens
aacctattttcatttgtac

SEQ ID NO: 803178 - DNA, 15 bp, Homo sapiens
aacctcaaagtgact

SEQ ID NO: 803179 - DNA, 23 bp, Homo sapiens
aacctcaccattgtgaagcacct

SEQ ID NO: 803180 - DNA, 23 bp, Homo sapiens
aacctcactatggtatgctggcc

SEQ ID NO: 803181 - DNA, 22 bp, Homo sapiens
aacctcactgagaggcctggag

SEQ ID NO: 803182 - DNA, 20 bp, Homo sapiens
aacctcactgccctccctcg

SEQ ID NO: 803183 - DNA, 23 bp, Homo sapiens
aacctcactgggcctttccagag

SEQ ID NO: 803184 - DNA, 15 bp, Homo sapiens
aacctcagctctggg

SEQ ID NO: 803185 - DNA, 17 bp, Homo sapiens
aacctcagggctcccag

SEQ ID NO: 803186 - DNA, 19 bp, Homo sapiens
aacctcagggctcccaggg

SEQ ID NO: 803187 - DNA, 23 bp, Homo sapiens
aacctcagggctgtcccagcccc

SEQ ID NO: 803188 - DNA, 18 bp, Homo sapiens
aacctcagtaatttagaa

SEQ ID NO: 803189 - DNA, 22 bp, Homo sapiens
aacctcagtatttatgtaattt

SEQ ID NO: 803190 - DNA, 16 bp, Homo sapiens
aacctcatcttcttca

SEQ ID NO: 803191 - DNA, 17 bp, Homo sapiens
aacgcgtctgcctgggc

SEQ ID NO: 803192 - DNA, 16 bp, Homo sapiens
aacgcgtgtgtacacg

SEQ ID NO: 803193 - DNA, 17 bp, Homo sapiens
aacgctaaagagccctt

SEQ ID NO: 803194 - DNA, 16 bp, Homo sapiens
aacgctatctgggaag

SEQ ID NO: 803195 - DNA, 20 bp, Homo sapiens
aacgctctaggtacgatgac

SEQ ID NO: 803196 - DNA, 12 bp, Homo sapiens
aacgctctcctc

SEQ ID NO: 803197 - DNA, 20 bp, Homo sapiens
aacgctcttagctttctcag

SEQ ID NO: 803198 - DNA, 15 bp, Homo sapiens
aacgctgatttaaag

SEQ ID NO: 803199 - DNA, 16 bp, Homo sapiens
aacgctgtgatgctgt

SEQ ID NO: 803200 - DNA, 14 bp, Homo sapiens
aacggaccaaagca

SEQ ID NO: 803201 - DNA, 14 bp, Homo sapiens
aacggagggagtgg

SEQ ID NO: 803202 - DNA, 21 bp, Homo sapiens
aacggatgctccgaggactgg

SEQ ID NO: 803203 - DNA, 18 bp, Homo sapiens
aacggcaaaaaaaaattt

SEQ ID NO: 803204 - DNA, 14 bp, Homo sapiens
aacggcaacagcat

SEQ ID NO: 803205 - DNA, 19 bp, Homo sapiens
aacggcaacgtagcctggg

SEQ ID NO: 803206 - DNA, 17 bp, Homo sapiens
aacggcccatagccttg

SEQ ID NO: 803207 - DNA, 23 bp, Homo sapiens
aacggctaacctggacctggaac

SEQ ID NO: 803208 - DNA, 22 bp, Homo sapiens
aacggcttgctttcctgcatct

SEQ ID NO: 803209 - DNA, 19 bp, Homo sapiens
aacgggaacatgccccctg

SEQ ID NO: 803210 - DNA, 19 bp, Homo sapiens
aacgggcagtctgctctgc

SEQ ID NO: 803211 - DNA, 16 bp, Homo sapiens
aacgggcccatggcct

SEQ ID NO: 803212 - DNA, 21 bp, Homo sapiens
aacgggcgtcaggggtgcaca

SEQ ID NO: 803213 - DNA, 13 bp, Homo sapiens
aacgggctccttc

SEQ ID NO: 803214 - DNA, 17 bp, Homo sapiens
aacgggctgccctgcca

SEQ ID NO: 803215 - DNA, 12 bp, Homo sapiens
aacggggagaaa

SEQ ID NO: 803216 - DNA, 20 bp, Homo sapiens
aacgggggccttctggtttt

SEQ ID NO: 803217 - DNA, 19 bp, Homo sapiens
aacgggttactaagatgaa

SEQ ID NO: 803218 - DNA, 18 bp, Homo sapiens
aacggtatcctccctgcc

SEQ ID NO: 803219 - DNA, 20 bp, Homo sapiens
aacggtgctgtgagggaggg

SEQ ID NO: 803220 - DNA, 19 bp, Homo sapiens
aacggtttaattctgtctt

SEQ ID NO: 803221 - DNA, 13 bp, Homo sapiens
aacgtagcctggg

SEQ ID NO: 803222 - DNA, 16 bp, Homo sapiens
aacgtatttctccaga

SEQ ID NO: 803223 - DNA, 23 bp, Homo sapiens
aacgtccttccttgactgtctag

SEQ ID NO: 803224 - DNA, 15 bp, Homo sapiens
aacgtgatgatcagc

SEQ ID NO: 803225 - DNA, 17 bp, Homo sapiens
aacgtgatgtgccacta

SEQ ID NO: 803226 - DNA, 22 bp, Homo sapiens
aacgtgatgttttgaatgtgga

SEQ ID NO: 803227 - DNA, 17 bp, Homo sapiens
aacgtgcagactatgca

SEQ ID NO: 803228 - DNA, 11 bp, Homo sapiens
aacgtgccccc

SEQ ID NO: 803229 - DNA, 13 bp, Homo sapiens
aacgtgctgctca

SEQ ID NO: 803230 - DNA, 13 bp, Homo sapiens
aacgtggtcacct

SEQ ID NO: 803231 - DNA, 13 bp, Homo sapiens
aacgttggacttt

SEQ ID NO: 803232 - DNA, 14 bp, Homo sapiens
aacgtttctcatta

SEQ ID NO: 803233 - DNA, 18 bp, Homo sapiens
aacgtttctcattaaaat

SEQ ID NO: 803234 - DNA, 15 bp, Homo sapiens
aacgttttaataatt

SEQ ID NO: 803235 - DNA, 11 bp, Homo sapiens
aacgttttctt

SEQ ID NO: 803236 - DNA, 22 bp, Homo sapiens
aacgttttcttctttccctgga

SEQ ID NO: 803237 - DNA, 14 bp, Homo sapiens
aactaaaacattat

SEQ ID NO: 803238 - DNA, 15 bp, Homo sapiens
aactaaaataatttt

SEQ ID NO: 803239 - DNA, 16 bp, Homo sapiens
aactaaactctctttg

SEQ ID NO: 803240 - DNA, 16 bp, Homo sapiens
aactaaattttaaagc

SEQ ID NO: 803241 - DNA, 15 bp, Homo sapiens
aactaacatgtcctg

SEQ ID NO: 803242 - DNA, 20 bp, Homo sapiens
aactaactgactctgttatt

SEQ ID NO: 803243 - DNA, 23 bp, Homo sapiens
aactaagaaatatgcacaatagc

SEQ ID NO: 803244 - DNA, 18 bp, Homo sapiens
aactaagagattcttcta

SEQ ID NO: 803245 - DNA, 15 bp, Homo sapiens
aactaagatctgtta

SEQ ID NO: 803246 - DNA, 20 bp, Homo sapiens
aactaagatctgttaaaaaa

SEQ ID NO: 803247 - DNA, 12 bp, Homo sapiens
aactaagcattg

SEQ ID NO: 803248 - DNA, 20 bp, Homo sapiens
aactaagccaggcctggctg

SEQ ID NO: 803249 - DNA, 16 bp, Homo sapiens
aactaagctctttgag

SEQ ID NO: 803250 - DNA, 17 bp, Homo sapiens
aactaagctctttgaga

SEQ ID NO: 803251 - DNA, 16 bp, Homo sapiens
aactaaggacaaatta

SEQ ID NO: 803252 - DNA, 18 bp, Homo sapiens
aactaaggacaaattagc

SEQ ID NO: 803253 - DNA, 19 bp, Homo sapiens
aactaaggactccaatgtc

SEQ ID NO: 803254 - DNA, 15 bp, Homo sapiens
aactaataaaagcat

SEQ ID NO: 803255 - DNA, 22 bp, Homo sapiens
aactaatacgtgccagatataa

SEQ ID NO: 803256 - DNA, 12 bp, Homo sapiens
aactaatgcctt

SEQ ID NO: 803257 - DNA, 15 bp, Homo sapiens
aactaatgtactgta

SEQ ID NO: 803258 - DNA, 18 bp, Homo sapiens
aactaatgtactgtacat

SEQ ID NO: 803259 - DNA, 22 bp, Homo sapiens
aactaatgtactgtacataaat

SEQ ID NO: 803260 - DNA, 20 bp, Homo sapiens
aactaatgtttgaacaaagc

SEQ ID NO: 803261 - DNA, 18 bp, Homo sapiens
aactaattgactttagaa

SEQ ID NO: 803262 - DNA, 20 bp, Homo sapiens
aactaattgactttagaaag

SEQ ID NO: 803263 - DNA, 12 bp, Homo sapiens
aactaattttgt

SEQ ID NO: 803264 - DNA, 14 bp, Homo sapiens
aactaattttgtac

SEQ ID NO: 803265 - DNA, 23 bp, Homo sapiens
aactaatttttatttttgctgag

SEQ ID NO: 803266 - DNA, 18 bp, Homo sapiens
aactacaaagctttgcta

SEQ ID NO: 803267 - DNA, 21 bp, Homo sapiens
aactacaaagctttgctacaa

SEQ ID NO: 803268 - DNA, 14 bp, Homo sapiens
aactacaatgatgg

SEQ ID NO: 803269 - DNA, 14 bp, Homo sapiens
aactacataaaaat

SEQ ID NO: 803270 - DNA, 17 bp, Homo sapiens
aactacataaaaataga

SEQ ID NO: 803271 - DNA, 13 bp, Homo sapiens
aactacatgagaa

SEQ ID NO: 803272 - DNA, 13 bp, Homo sapiens
aactaccaggtgg

SEQ ID NO: 803273 - DNA, 15 bp, Homo sapiens
aactaccaggtggca

SEQ ID NO: 803274 - DNA, 22 bp, Homo sapiens
aactaccaggtgtgcctggaag

SEQ ID NO: 803275 - DNA, 15 bp, Homo sapiens
aactacgtgacctct

SEQ ID NO: 803276 - DNA, 18 bp, Homo sapiens
aactactaaagtgcctac

SEQ ID NO: 803277 - DNA, 13 bp, Homo sapiens
aactactctttga

SEQ ID NO: 803278 - DNA, 14 bp, Homo sapiens
aactactctttgat

SEQ ID NO: 803279 - DNA, 16 bp, Homo sapiens
aactactctttgattt

SEQ ID NO: 803280 - DNA, 17 bp, Homo sapiens
aactactgacagggagc

SEQ ID NO: 803281 - DNA, 20 bp, Homo sapiens
aactactgcctttagaaaat

SEQ ID NO: 803282 - DNA, 16 bp, Homo sapiens
aactactgctaatgtt

SEQ ID NO: 803283 - DNA, 15 bp, Homo sapiens
aactactgtacattt

SEQ ID NO: 803284 - DNA, 16 bp, Homo sapiens
aactactgtactttgc

SEQ ID NO: 803285 - DNA, 16 bp, Homo sapiens
aactactgtgttcctg

SEQ ID NO: 803286 - DNA, 20 bp, Homo sapiens
aactacttcattttctcaaa

SEQ ID NO: 803287 - DNA, 22 bp, Homo sapiens
aactacttcattttctcaaagg

SEQ ID NO: 803288 - DNA, 22 bp, Homo sapiens
aactacttctcttgttaggtaa

SEQ ID NO: 803289 - DNA, 15 bp, Homo sapiens
aactactttataact

SEQ ID NO: 803290 - DNA, 15 bp, Homo sapiens
aactacttttctaaa

SEQ ID NO: 803291 - DNA, 20 bp, Homo sapiens
aactagagatgactgagtcc

SEQ ID NO: 803292 - DNA, 22 bp, Homo sapiens
aactagaggtgttacagaggac

SEQ ID NO: 803293 - DNA, 13 bp, Homo sapiens
aactagatttgtc

SEQ ID NO: 803294 - DNA, 15 bp, Homo sapiens
aactagcattgtaaa

SEQ ID NO: 803295 - DNA, 13 bp, Homo sapiens
aactagcccctgg

SEQ ID NO: 803296 - DNA, 16 bp, Homo sapiens
aactagcccctggggt

SEQ ID NO: 803297 - DNA, 15 bp, Homo sapiens
aactagctgggacta

SEQ ID NO: 803298 - DNA, 16 bp, Homo sapiens
aactaggatatgtata

SEQ ID NO: 803299 - DNA, 21 bp, Homo sapiens
aactaggatatgtatatttta

SEQ ID NO: 803300 - DNA, 22 bp, Homo sapiens
aactaggcttctgtaatcaata

SEQ ID NO: 803301 - DNA, 17 bp, Homo sapiens
aactagggccaagccca

SEQ ID NO: 803302 - DNA, 17 bp, Homo sapiens
aactagggctagtcttc

SEQ ID NO: 803303 - DNA, 22 bp, Homo sapiens
aactagggctagtcttccctta

SEQ ID NO: 803304 - DNA, 18 bp, Homo sapiens
aactaggtttttgcttct

SEQ ID NO: 803305 - DNA, 14 bp, Homo sapiens
aactataaaaaaga

SEQ ID NO: 803306 - DNA, 13 bp, Homo sapiens
aactataaactta

SEQ ID NO: 803307 - DNA, 15 bp, Homo sapiens
aactataaggtgcct

SEQ ID NO: 803308 - DNA, 20 bp, Homo sapiens
aactatacttgatagtttgg

SEQ ID NO: 803309 - DNA, 19 bp, Homo sapiens
aactatatcagtagtgtac

SEQ ID NO: 803310 - DNA, 22 bp, Homo sapiens
aactatatcagtagtgtacatt

SEQ ID NO: 803311 - DNA, 16 bp, Homo sapiens
aactatcaattcttga

SEQ ID NO: 803312 - DNA, 19 bp, Homo sapiens
aactatcctgattccaaat

SEQ ID NO: 803313 - DNA, 24 bp, Homo sapiens
aactatctcacttccagatatcca

SEQ ID NO: 803314 - DNA, 22 bp, Homo sapiens
aactggccctatttagatgata

SEQ ID NO: 803315 - DNA, 15 bp, Homo sapiens
aactggccttttgat

SEQ ID NO: 803316 - DNA, 14 bp, Homo sapiens
aactggctctgatt

SEQ ID NO: 803317 - DNA, 23 bp, Homo sapiens
aactggctgaaaggttaattctc

SEQ ID NO: 803318 - DNA, 17 bp, Homo sapiens
aactggctggccagtct

SEQ ID NO: 803319 - DNA, 14 bp, Homo sapiens
aactggctgggccc

SEQ ID NO: 803320 - DNA, 17 bp, Homo sapiens
aactggctgggcccctg

SEQ ID NO: 803321 - DNA, 18 bp, Homo sapiens
aactggctgggcccctgg

SEQ ID NO: 803322 - DNA, 21 bp, Homo sapiens
aactggctgggcccctgggga

SEQ ID NO: 803323 - DNA, 16 bp, Homo sapiens
aactggcttcatttta

SEQ ID NO: 803324 - DNA, 22 bp, Homo sapiens
aactgggcacagattgaagaat

SEQ ID NO: 803325 - DNA, 15 bp, Homo sapiens
aactgggctgggcct

SEQ ID NO: 803326 - DNA, 16 bp, Homo sapiens
aactggggttgagggc

SEQ ID NO: 803327 - DNA, 18 bp, Homo sapiens
aactgggtaatgaaacaa

SEQ ID NO: 803328 - DNA, 17 bp, Homo sapiens
aactgggttctttggaa

SEQ ID NO: 803329 - DNA, 24 bp, Homo sapiens
aactggtaaaaagatccagggatg

SEQ ID NO: 803330 - DNA, 21 bp, Homo sapiens
aactggtattctgttctggag

SEQ ID NO: 803331 - DNA, 16 bp, Homo sapiens
aactggtattgtttac

SEQ ID NO: 803332 - DNA, 18 bp, Homo sapiens
aactggtgcactttgtaa

SEQ ID NO: 803333 - DNA, 22 bp, Homo sapiens
aactggtgggtctttaataaaa

SEQ ID NO: 803334 - DNA, 14 bp, Homo sapiens
aactgtaaagatgt

SEQ ID NO: 803335 - DNA, 15 bp, Homo sapiens
aactgtaaagcaaat

SEQ ID NO: 803336 - DNA, 21 bp, Homo sapiens
aactgtaaatatgtttgtgcc

SEQ ID NO: 803337 - DNA, 10 bp, Homo sapiens
aactgtacag

SEQ ID NO: 803338 - DNA, 13 bp, Homo sapiens
aactgtacattgt

SEQ ID NO: 803339 - DNA, 14 bp, Homo sapiens
aactgtactgtgtt

SEQ ID NO: 803340 - DNA, 18 bp, Homo sapiens
aactgtagcgaccccaga

SEQ ID NO: 803341 - DNA, 15 bp, Homo sapiens
aactgtagtctctga

SEQ ID NO: 803342 - DNA, 14 bp, Homo sapiens
aactgtatgtcaga

SEQ ID NO: 803343 - DNA, 20 bp, Homo sapiens
aactgtatttgaaataagaa

SEQ ID NO: 803344 - DNA, 21 bp, Homo sapiens
aactgtatttttgaagactat

SEQ ID NO: 803345 - DNA, 15 bp, Homo sapiens
aactgtcaaattttc

SEQ ID NO: 803346 - DNA, 20 bp, Homo sapiens
aactgtcactctaggaagaa

SEQ ID NO: 803347 - DNA, 23 bp, Homo sapiens
aactgtcatagggattgtccctg

SEQ ID NO: 803348 - DNA, 19 bp, Homo sapiens
aactgtccacatctgcctc

SEQ ID NO: 803349 - DNA, 16 bp, Homo sapiens
aactgtccagagagca

SEQ ID NO: 803350 - DNA, 21 bp, Homo sapiens
aactgtccgtaagcagtatat

SEQ ID NO: 803351 - DNA, 14 bp, Homo sapiens
aactgtcttcctca

SEQ ID NO: 803352 - DNA, 11 bp, Homo sapiens
aactgtcttgt

SEQ ID NO: 803353 - DNA, 13 bp, Homo sapiens
aactgtcttgttt

SEQ ID NO: 803354 - DNA, 15 bp, Homo sapiens
aactgtcttgtttca

SEQ ID NO: 803355 - DNA, 20 bp, Homo sapiens
aactgtgaaaatagtgtaag

SEQ ID NO: 803356 - DNA, 18 bp, Homo sapiens
aactgtgcaaagggctgc

SEQ ID NO: 803357 - DNA, 15 bp, Homo sapiens
aactgtgccacaatg

SEQ ID NO: 803358 - DNA, 18 bp, Homo sapiens
aactgtggaatataaata

SEQ ID NO: 803359 - DNA, 20 bp, Homo sapiens
aactgtggaatttattggca

SEQ ID NO: 803360 - DNA, 14 bp, Homo sapiens
aactgtggatattg

SEQ ID NO: 803361 - DNA, 11 bp, Homo sapiens
aactgtggccg

SEQ ID NO: 803362 - DNA, 15 bp, Homo sapiens
aactgtggtgccaca

SEQ ID NO: 803363 - DNA, 17 bp, Homo sapiens
aactgtgtatcattaaa

SEQ ID NO: 803364 - DNA, 22 bp, Homo sapiens
aactgtgtatcattaaaatata

SEQ ID NO: 803365 - DNA, 13 bp, Homo sapiens
aactgtgtatgta

SEQ ID NO: 803366 - DNA, 15 bp, Homo sapiens
aactgtgtatgtaca

SEQ ID NO: 803367 - DNA, 17 bp, Homo sapiens
aactgtgtatgtacata

SEQ ID NO: 803368 - DNA, 13 bp, Homo sapiens
aactgtgtattta

SEQ ID NO: 803369 - DNA, 11 bp, Homo sapiens
aactgtgtgac

SEQ ID NO: 803370 - DNA, 13 bp, Homo sapiens
aactgtgtggcag

SEQ ID NO: 803371 - DNA, 14 bp, Homo sapiens
aactgtgtgtaatt

SEQ ID NO: 803372 - DNA, 12 bp, Homo sapiens
aactgtgttgta

SEQ ID NO: 803373 - DNA, 16 bp, Homo sapiens
aactgtgttgtattaa

SEQ ID NO: 803374 - DNA, 20 bp, Homo sapiens
aactgtgttgtattaacaaa

SEQ ID NO: 803375 - DNA, 19 bp, Homo sapiens
aactgtgtttcaagttcaa

SEQ ID NO: 803376 - DNA, 15 bp, Homo sapiens
aactgttaacttatt

SEQ ID NO: 803377 - DNA, 14 bp, Homo sapiens
aactgttacagtaa

SEQ ID NO: 803378 - DNA, 18 bp, Homo sapiens
aactgttagcactgttga

SEQ ID NO: 803379 - DNA, 22 bp, Homo sapiens
aactgttagcactgttgatgta

SEQ ID NO: 803380 - DNA, 21 bp, Homo sapiens
aactgttctctattagacttt

SEQ ID NO: 803381 - DNA, 18 bp, Homo sapiens
aactgttgtagaagacaa

SEQ ID NO: 803382 - DNA, 19 bp, Homo sapiens
aactgttgtagaagacaaa

SEQ ID NO: 803383 - DNA, 14 bp, Homo sapiens
aactgttgtataaa

SEQ ID NO: 803384 - DNA, 19 bp, Homo sapiens
aactgttgtataaatttat

SEQ ID NO: 803385 - DNA, 18 bp, Homo sapiens
aactgttttagaaattgg

SEQ ID NO: 803386 - DNA, 15 bp, Homo sapiens
aactgttttttaagt

SEQ ID NO: 803387 - DNA, 13 bp, Homo sapiens
aacttaaaaatgt

SEQ ID NO: 803388 - DNA, 17 bp, Homo sapiens
aacttaaaaatgtaaat

SEQ ID NO: 803389 - DNA, 11 bp, Homo sapiens
aacttaaaata

SEQ ID NO: 803390 - DNA, 14 bp, Homo sapiens
aacttaaaatattt

SEQ ID NO: 803391 - DNA, 18 bp, Homo sapiens
aacttaaagcaaaatagt

SEQ ID NO: 803392 - DNA, 13 bp, Homo sapiens
aacttaaataata

SEQ ID NO: 803393 - DNA, 19 bp, Homo sapiens
aacttaaataatgtgaaac

SEQ ID NO: 803394 - DNA, 16 bp, Homo sapiens
aacttaaattttaatt

SEQ ID NO: 803395 - DNA, 16 bp, Homo sapiens
aacttaacattctgta

SEQ ID NO: 803396 - DNA, 11 bp, Homo sapiens
aacttaactga

SEQ ID NO: 803397 - DNA, 13 bp, Homo sapiens
aacttaactgaag

SEQ ID NO: 803398 - DNA, 14 bp, Homo sapiens
aacttaactgaaga

SEQ ID NO: 803399 - DNA, 22 bp, Homo sapiens
aacttaagatgggcctgtatga

SEQ ID NO: 803400 - DNA, 14 bp, Homo sapiens
aacttaagcaaagg

SEQ ID NO: 803401 - DNA, 18 bp, Homo sapiens
aacttaatagtatttatg

SEQ ID NO: 803402 - DNA, 16 bp, Homo sapiens
aacttaatctaaatgg

SEQ ID NO: 803403 - DNA, 14 bp, Homo sapiens
aacttacacctgga

SEQ ID NO: 803404 - DNA, 18 bp, Homo sapiens
aacttacacttggagccc

SEQ ID NO: 803405 - DNA, 20 bp, Homo sapiens
aacttacattgttcaattag

SEQ ID NO: 803406 - DNA, 14 bp, Homo sapiens
aacttacatttgta

SEQ ID NO: 803407 - DNA, 16 bp, Homo sapiens
aacttacatttgtact

SEQ ID NO: 803408 - DNA, 12 bp, Homo sapiens
aacttactgtat

SEQ ID NO: 803409 - DNA, 14 bp, Homo sapiens
aacttactgtatat

SEQ ID NO: 803410 - DNA, 16 bp, Homo sapiens
aacttagaggaaaatg

SEQ ID NO: 803411 - DNA, 19 bp, Homo sapiens
aacttagcatgtgttgaaa

SEQ ID NO: 803412 - DNA, 21 bp, Homo sapiens
aacttaggcatgcacagctgt

SEQ ID NO: 803413 - DNA, 22 bp, Homo sapiens
aacttagtgcggacaagtttta

SEQ ID NO: 803414 - DNA, 22 bp, Homo sapiens
aacttatagttaatattttgtt

SEQ ID NO: 803415 - DNA, 20 bp, Homo sapiens
aacttatatactatttccct

SEQ ID NO: 803416 - DNA, 19 bp, Homo sapiens
aacttatattgaagacaat

SEQ ID NO: 803417 - DNA, 15 bp, Homo sapiens
aacttatattgtaag

SEQ ID NO: 803418 - DNA, 14 bp, Homo sapiens
aacttattcaaaga

SEQ ID NO: 803419 - DNA, 13 bp, Homo sapiens
aacttattccaag

SEQ ID NO: 803420 - DNA, 20 bp, Homo sapiens
aacttattccaagtgcattt

SEQ ID NO: 803421 - DNA, 23 bp, Homo sapiens
aacttattctgtagattctgtgg

SEQ ID NO: 803422 - DNA, 19 bp, Homo sapiens
aacttattttaaatatgcc

SEQ ID NO: 803423 - DNA, 20 bp, Homo sapiens
aacttcaagggacaagtatt

SEQ ID NO: 803424 - DNA, 22 bp, Homo sapiens
aacttcaagtgcatgctctctg

SEQ ID NO: 803425 - DNA, 16 bp, Homo sapiens
aacttcacaactaggc

SEQ ID NO: 803426 - DNA, 17 bp, Homo sapiens
aacttcacattaaaaaa

SEQ ID NO: 803427 - DNA, 17 bp, Homo sapiens
aacttcacatttatgtg

SEQ ID NO: 803428 - DNA, 14 bp, Homo sapiens
aacttcaccacccc

SEQ ID NO: 803429 - DNA, 22 bp, Homo sapiens
aacttcaccaccccctgtccca

SEQ ID NO: 803430 - DNA, 18 bp, Homo sapiens
aacttcagaaacccggct

SEQ ID NO: 803431 - DNA, 18 bp, Homo sapiens
aacttcagcagtacctat

SEQ ID NO: 803432 - DNA, 21 bp, Homo sapiens
aacttcagtaggatttatgta

SEQ ID NO: 803433 - DNA, 21 bp, Homo sapiens
aacttcagttttatttttgcc

SEQ ID NO: 803434 - DNA, 15 bp, Homo sapiens
aacttcatggatcag

SEQ ID NO: 803435 - DNA, 22 bp, Homo sapiens
aacttcattctaaaccaaaaca

SEQ ID NO: 803436 - DNA, 12 bp, Homo sapiens
aacttcatttga

SEQ ID NO: 803437 - DNA, 13 bp, Homo sapiens
aagaactctctgg

SEQ ID NO: 803438 - DNA, 14 bp, Homo sapiens
aagaactctctgga

SEQ ID NO: 803439 - DNA, 11 bp, Homo sapiens
aagaactgcac

SEQ ID NO: 803440 - DNA, 22 bp, Homo sapiens
aagaactgcagatagcccagga

SEQ ID NO: 803441 - DNA, 22 bp, Homo sapiens
aagaactgcaggccctggcctc

SEQ ID NO: 803442 - DNA, 16 bp, Homo sapiens
aagaactgtacattgt

SEQ ID NO: 803443 - DNA, 16 bp, Homo sapiens
aagaactgtgaaattt

SEQ ID NO: 803444 - DNA, 22 bp, Homo sapiens
aagaactgtgaaatttacaaat

SEQ ID NO: 803445 - DNA, 12 bp, Homo sapiens
aagaacttcatt

SEQ ID NO: 803446 - DNA, 22 bp, Homo sapiens
aagaacttgatttgcatggatt

SEQ ID NO: 803447 - DNA, 22 bp, Homo sapiens
aagaactttaaagctcaggagg

SEQ ID NO: 803448 - DNA, 11 bp, Homo sapiens
aagaagaaata

SEQ ID NO: 803449 - DNA, 15 bp, Homo sapiens
aagaagaacagctgt

SEQ ID NO: 803450 - DNA, 23 bp, Homo sapiens
aagaagaacagctgttcctgtgt

SEQ ID NO: 803451 - DNA, 23 bp, Homo sapiens
aagaagaaccagcccagcctgcc

SEQ ID NO: 803452 - DNA, 15 bp, Homo sapiens
aagaagaacttgcat

SEQ ID NO: 803453 - DNA, 14 bp, Homo sapiens
aagaagaattggcc

SEQ ID NO: 803454 - DNA, 19 bp, Homo sapiens
aagaagaccagactgtgga

SEQ ID NO: 803455 - DNA, 21 bp, Homo sapiens
aagaagacctgagaatgtatc

SEQ ID NO: 803456 - DNA, 13 bp, Homo sapiens
aagaagacttttt

SEQ ID NO: 803457 - DNA, 16 bp, Homo sapiens
aagaagagaagctgct

SEQ ID NO: 803458 - DNA, 19 bp, Homo sapiens
aagaagagcgagagatcaa

SEQ ID NO: 803459 - DNA, 15 bp, Homo sapiens
aagaagagctatcag

SEQ ID NO: 803460 - DNA, 14 bp, Homo sapiens
aagaagatgagcct

SEQ ID NO: 803461 - DNA, 17 bp, Homo sapiens
aagaagattcaagagga

SEQ ID NO: 803462 - DNA, 17 bp, Homo sapiens
aagaagcaataactatt

SEQ ID NO: 803463 - DNA, 18 bp, Homo sapiens
aagaagcaatctttgaaa

SEQ ID NO: 803464 - DNA, 22 bp, Homo sapiens
aagaagcaattatttaaagaaa

SEQ ID NO: 803465 - DNA, 23 bp, Homo sapiens
aagaagcaattatttaaagaaag

SEQ ID NO: 803466 - DNA, 12 bp, Homo sapiens
aagaagcagaga

SEQ ID NO: 803467 - DNA, 23 bp, Homo sapiens
aagaagcagcctgttttcactca

SEQ ID NO: 803468 - DNA, 11 bp, Homo sapiens
aagaagccata

SEQ ID NO: 803469 - DNA, 16 bp, Homo sapiens
aagaagccccttattt

SEQ ID NO: 803470 - DNA, 17 bp, Homo sapiens
aagaagccccttatttt

SEQ ID NO: 803471 - DNA, 16 bp, Homo sapiens
aagaagccctgcagag

SEQ ID NO: 803472 - DNA, 18 bp, Homo sapiens
aagaagccttaatttgca

SEQ ID NO: 803473 - DNA, 20 bp, Homo sapiens
aagaagccttaatttgcaca

SEQ ID NO: 803474 - DNA, 22 bp, Homo sapiens
aagaagcgccgactccctgagt

SEQ ID NO: 803475 - DNA, 19 bp, Homo sapiens
aagaagcgcggctaactta

SEQ ID NO: 803476 - DNA, 14 bp, Homo sapiens
aagaagctctctcc

SEQ ID NO: 803477 - DNA, 18 bp, Homo sapiens
aagaaggaaagatggtta

SEQ ID NO: 803478 - DNA, 17 bp, Homo sapiens
aagaaggaaagggaaga

SEQ ID NO: 803479 - DNA, 12 bp, Homo sapiens
aagaaggagctg

SEQ ID NO: 803480 - DNA, 17 bp, Homo sapiens
aagaaggatgatgtctt

SEQ ID NO: 803481 - DNA, 14 bp, Homo sapiens
aagaaggcaaaaat

SEQ ID NO: 803482 - DNA, 15 bp, Homo sapiens
aagaaggcaaaaata

SEQ ID NO: 803483 - DNA, 22 bp, Homo sapiens
aagaaggcaattttagtgtatt

SEQ ID NO: 803484 - DNA, 23 bp, Homo sapiens
aagaaggcatcgtcatgcacagt

SEQ ID NO: 803485 - DNA, 17 bp, Homo sapiens
aagaagggagaagaaag

SEQ ID NO: 803486 - DNA, 16 bp, Homo sapiens
aagaagggctggtatt

SEQ ID NO: 803487 - DNA, 22 bp, Homo sapiens
aagaaggggggtctctggcttt

SEQ ID NO: 803488 - DNA, 18 bp, Homo sapiens
aagaaggtatttttccaa

SEQ ID NO: 803489 - DNA, 21 bp, Homo sapiens
aagaaggttaccaagaagcct

SEQ ID NO: 803490 - DNA, 14 bp, Homo sapiens
aagaagtaaaagca

SEQ ID NO: 803491 - DNA, 13 bp, Homo sapiens
aagaagttacttt

SEQ ID NO: 803492 - DNA, 15 bp, Homo sapiens
aagaagttacttttt

SEQ ID NO: 803493 - DNA, 15 bp, Homo sapiens
aagaagtttcatcat

SEQ ID NO: 803494 - DNA, 15 bp, Homo sapiens
aagaataaaatgttg

SEQ ID NO: 803495 - DNA, 12 bp, Homo sapiens
aagaataaattc

SEQ ID NO: 803496 - DNA, 13 bp, Homo sapiens
aagaataataaaa

SEQ ID NO: 803497 - DNA, 15 bp, Homo sapiens
aagaataataaaatc

SEQ ID NO: 803498 - DNA, 16 bp, Homo sapiens
aagaataataaaatca

SEQ ID NO: 803499 - DNA, 16 bp, Homo sapiens
aagaataatcacgctt

SEQ ID NO: 803500 - DNA, 22 bp, Homo sapiens
aagaataatcacgctttcctga

SEQ ID NO: 803501 - DNA, 23 bp, Homo sapiens
aagaataatcacgctttcctgaa

SEQ ID NO: 803502 - DNA, 21 bp, Homo sapiens
aagaataattcaattttaaag

SEQ ID NO: 803503 - DNA, 22 bp, Homo sapiens
aagaataattcaattttaaaga

SEQ ID NO: 803504 - DNA, 16 bp, Homo sapiens
aagaataattttggaa

SEQ ID NO: 803505 - DNA, 17 bp, Homo sapiens
aagaatagcattgtaaa

SEQ ID NO: 803506 - DNA, 18 bp, Homo sapiens
aagaatagcattgtaaaa

SEQ ID NO: 803507 - DNA, 17 bp, Homo sapiens
aagaatagctttaatga

SEQ ID NO: 803508 - DNA, 13 bp, Homo sapiens
aagaatagttcta

SEQ ID NO: 803509 - DNA, 19 bp, Homo sapiens
aagaatagttctaaaattg

SEQ ID NO: 803510 - DNA, 20 bp, Homo sapiens
aagaatatcgatataaattg

SEQ ID NO: 803511 - DNA, 20 bp, Homo sapiens
aagaatatctgtaatggtac

SEQ ID NO: 803512 - DNA, 17 bp, Homo sapiens
aagaatatgaagttcta

SEQ ID NO: 803513 - DNA, 21 bp, Homo sapiens
aagaatatgtttccttgttta

SEQ ID NO: 803514 - DNA, 17 bp, Homo sapiens
aagaatattgcaaaata

SEQ ID NO: 803515 - DNA, 13 bp, Homo sapiens
aagaatattgtat

SEQ ID NO: 803516 - DNA, 18 bp, Homo sapiens
aagaatattgtattgtta

SEQ ID NO: 803517 - DNA, 23 bp, Homo sapiens
aagaatattttgatgcagataaa

SEQ ID NO: 803518 - DNA, 22 bp, Homo sapiens
aagaatcaggagagggatacaa

SEQ ID NO: 803519 - DNA, 16 bp, Homo sapiens
aagaatcattttgtgt

SEQ ID NO: 803520 - DNA, 21 bp, Homo sapiens
aagaatccctgttcattgtaa

SEQ ID NO: 803521 - DNA, 20 bp, Homo sapiens
aagaatccttagatgcctaa

SEQ ID NO: 803522 - DNA, 23 bp, Homo sapiens
aagaatctaaaccttacatgtgt

SEQ ID NO: 803523 - DNA, 17 bp, Homo sapiens
aagaatctagaagatgt

SEQ ID NO: 803524 - DNA, 20 bp, Homo sapiens
aagaatctcatctcagtgaa

SEQ ID NO: 803525 - DNA, 15 bp, Homo sapiens
aagaatgaaaaatat

SEQ ID NO: 803526 - DNA, 16 bp, Homo sapiens
aagaatgactatataa

SEQ ID NO: 803527 - DNA, 18 bp, Homo sapiens
aagaatgactatataatt

SEQ ID NO: 803528 - DNA, 14 bp, Homo sapiens
aagaatgagaaaca

SEQ ID NO: 803529 - DNA, 21 bp, Homo sapiens
aagaatgcagattcctgggcc

SEQ ID NO: 803530 - DNA, 22 bp, Homo sapiens
aagaatgcagattcctgggcct

SEQ ID NO: 803531 - DNA, 15 bp, Homo sapiens
aagaatgctggtttt

SEQ ID NO: 803532 - DNA, 19 bp, Homo sapiens
aagaatgctgttctgattt

SEQ ID NO: 803533 - DNA, 20 bp, Homo sapiens
aagaatggcagaaaagttta

SEQ ID NO: 803534 - DNA, 18 bp, Homo sapiens
aagaatgttaagacttga

SEQ ID NO: 803535 - DNA, 19 bp, Homo sapiens
aagaatgttaagacttgac

SEQ ID NO: 803536 - DNA, 18 bp, Homo sapiens
aagaatgttactgcctta

SEQ ID NO: 803537 - DNA, 15 bp, Homo sapiens
aagaatgttagagta

SEQ ID NO: 803538 - DNA, 21 bp, Homo sapiens
aagaatgttagagtaatgaaa

SEQ ID NO: 803539 - DNA, 18 bp, Homo sapiens
aagaatgttagtaaagga

SEQ ID NO: 803540 - DNA, 15 bp, Homo sapiens
aagaattaaaaactt

SEQ ID NO: 803541 - DNA, 12 bp, Homo sapiens
aagaattaaaac

SEQ ID NO: 803542 - DNA, 13 bp, Homo sapiens
aagaattaaaact

SEQ ID NO: 803543 - DNA, 14 bp, Homo sapiens
aagaattaaaactg

SEQ ID NO: 803544 - DNA, 16 bp, Homo sapiens
aagaattaaaactgag

SEQ ID NO: 803545 - DNA, 18 bp, Homo sapiens
aagaattaaaactgagtc

SEQ ID NO: 803546 - DNA, 19 bp, Homo sapiens
aagaattagaagtctttca

SEQ ID NO: 803547 - DNA, 23 bp, Homo sapiens
aagaattatgtaatatattgtac

SEQ ID NO: 803548 - DNA, 14 bp, Homo sapiens
aagaattatttttg

SEQ ID NO: 803549 - DNA, 15 bp, Homo sapiens
aagaattatttttgt

SEQ ID NO: 803550 - DNA, 22 bp, Homo sapiens
aagaattatttttgtgtttcta

SEQ ID NO: 803551 - DNA, 19 bp, Homo sapiens
aagaattcaaactggggcc

SEQ ID NO: 803552 - DNA, 14 bp, Homo sapiens
aagaattccaaagc

SEQ ID NO: 803553 - DNA, 19 bp, Homo sapiens
aagaattcctgaagccaga

SEQ ID NO: 803554 - DNA, 20 bp, Homo sapiens
aagaattctccaaaacaatt

SEQ ID NO: 803555 - DNA, 14 bp, Homo sapiens
aagaattgaaacca

SEQ ID NO: 803556 - DNA, 21 bp, Homo sapiens
aagaattgaccatctgctttt

SEQ ID NO: 803557 - DNA, 15 bp, Homo sapiens
aagaattgagtaatg

SEQ ID NO: 803558 - DNA, 21 bp, Homo sapiens
aagaattggccatcttaaaaa

SEQ ID NO: 803559 - DNA, 18 bp, Homo sapiens
aagaggctgaaagaggcc

SEQ ID NO: 803560 - DNA, 13 bp, Homo sapiens
aagaggctgaggc

SEQ ID NO: 803561 - DNA, 22 bp, Homo sapiens
aagaggctgaggctggcacagg

SEQ ID NO: 803562 - DNA, 21 bp, Homo sapiens
aagaggctgcccctctcacca

SEQ ID NO: 803563 - DNA, 22 bp, Homo sapiens
aagaggctgcccctctcaccaa

SEQ ID NO: 803564 - DNA, 23 bp, Homo sapiens
aagaggctgcccctctcaccaaa

SEQ ID NO: 803565 - DNA, 11 bp, Homo sapiens
aagaggctggt

SEQ ID NO: 803566 - DNA, 15 bp, Homo sapiens
aagaggctgtgtggc

SEQ ID NO: 803567 - DNA, 21 bp, Homo sapiens
aagaggctgtgtggccaacca

SEQ ID NO: 803568 - DNA, 17 bp, Homo sapiens
aagagggagaagcatga

SEQ ID NO: 803569 - DNA, 18 bp, Homo sapiens
aagagggagaagcatgaa

SEQ ID NO: 803570 - DNA, 16 bp, Homo sapiens
aagagggagaccaaat

SEQ ID NO: 803571 - DNA, 21 bp, Homo sapiens
aagagggaggggacagaggcc

SEQ ID NO: 803572 - DNA, 17 bp, Homo sapiens
aagagggcccaaagaat

SEQ ID NO: 803573 - DNA, 19 bp, Homo sapiens
aagagggcccaaagaattg

SEQ ID NO: 803574 - DNA, 16 bp, Homo sapiens
aagagggcccagccca

SEQ ID NO: 803575 - DNA, 23 bp, Homo sapiens
aagagggcccagcccagagccac

SEQ ID NO: 803576 - DNA, 19 bp, Homo sapiens
aagagggcctgtgggagcc

SEQ ID NO: 803577 - DNA, 11 bp, Homo sapiens
aagaggggcag

SEQ ID NO: 803578 - DNA, 15 bp, Homo sapiens
aagaggggcagccct

SEQ ID NO: 803579 - DNA, 18 bp, Homo sapiens
aagaggggcctgatgaga

SEQ ID NO: 803580 - DNA, 17 bp, Homo sapiens
aagaggggcgggctcag

SEQ ID NO: 803581 - DNA, 23 bp, Homo sapiens
aagagggggacctgccaccaggg

SEQ ID NO: 803582 - DNA, 14 bp, Homo sapiens
aagagggggctctg

SEQ ID NO: 803583 - DNA, 15 bp, Homo sapiens
aagagggggctctgc

SEQ ID NO: 803584 - DNA, 17 bp, Homo sapiens
aagagggggctctgccc

SEQ ID NO: 803585 - DNA, 13 bp, Homo sapiens
aagagggtctctt

SEQ ID NO: 803586 - DNA, 22 bp, Homo sapiens
aagagggttttaggtagaaaaa

SEQ ID NO: 803587 - DNA, 23 bp, Homo sapiens
aagagggttttaggtagaaaaac

SEQ ID NO: 803588 - DNA, 20 bp, Homo sapiens
aagaggtaactgaggtaaaa

SEQ ID NO: 803589 - DNA, 22 bp, Homo sapiens
aagaggtccttggttgggtcaa

SEQ ID NO: 803590 - DNA, 15 bp, Homo sapiens
aagaggtctgagccc

SEQ ID NO: 803591 - DNA, 18 bp, Homo sapiens
aagaggtctgagccctgg

SEQ ID NO: 803592 - DNA, 22 bp, Homo sapiens
aagaggtctgagccctggtgtg

SEQ ID NO: 803593 - DNA, 15 bp, Homo sapiens
aagaggtgggagggc

SEQ ID NO: 803594 - DNA, 16 bp, Homo sapiens
aagaggtgggagggcc

SEQ ID NO: 803595 - DNA, 17 bp, Homo sapiens
aagaggtgggagggccc

SEQ ID NO: 803596 - DNA, 21 bp, Homo sapiens
aagaggtgggtggtgggcttc

SEQ ID NO: 803597 - DNA, 22 bp, Homo sapiens
aagaggtgtgggtgtctgtttg

SEQ ID NO: 803598 - DNA, 15 bp, Homo sapiens
aagaggtgttatttg

SEQ ID NO: 803599 - DNA, 18 bp, Homo sapiens
aagaggttggagcaacaa

SEQ ID NO: 803600 - DNA, 18 bp, Homo sapiens
aagaggttttaaaaaaat

SEQ ID NO: 803601 - DNA, 13 bp, Homo sapiens
aagagtagaaact

SEQ ID NO: 803602 - DNA, 21 bp, Homo sapiens
aagagtagcaagttctagaga

SEQ ID NO: 803603 - DNA, 17 bp, Homo sapiens
aagagtatccttccttc

SEQ ID NO: 803604 - DNA, 22 bp, Homo sapiens
aagagtattttaagaagacata

SEQ ID NO: 803605 - DNA, 12 bp, Homo sapiens
aagagtattttt

SEQ ID NO: 803606 - DNA, 14 bp, Homo sapiens
aagagtcagccctt

SEQ ID NO: 803607 - DNA, 20 bp, Homo sapiens
aagagtccaggtaaatggta

SEQ ID NO: 803608 - DNA, 15 bp, Homo sapiens
aagagtcctctgaat

SEQ ID NO: 803609 - DNA, 15 bp, Homo sapiens
aagagtcgctgtgcc

SEQ ID NO: 803610 - DNA, 22 bp, Homo sapiens
aagagtcgctgtgccacaggct

SEQ ID NO: 803611 - DNA, 15 bp, Homo sapiens
aagagtctattgtct

SEQ ID NO: 803612 - DNA, 22 bp, Homo sapiens
aagagtgacagtggattgcatt

SEQ ID NO: 803613 - DNA, 18 bp, Homo sapiens
aagagtgacttattttgt

SEQ ID NO: 803614 - DNA, 14 bp, Homo sapiens
aagagtgattgcag

SEQ ID NO: 803615 - DNA, 17 bp, Homo sapiens
aagagtgattgcagctt

SEQ ID NO: 803616 - DNA, 15 bp, Homo sapiens
aagagtggggggagg

SEQ ID NO: 803617 - DNA, 16 bp, Homo sapiens
aagagtggggggagga

SEQ ID NO: 803618 - DNA, 19 bp, Homo sapiens
aagagtgtcagaatcagaa

SEQ ID NO: 803619 - DNA, 14 bp, Homo sapiens
aagagtgtgaaatc

SEQ ID NO: 803620 - DNA, 16 bp, Homo sapiens
aagagtgtgaaatctc

SEQ ID NO: 803621 - DNA, 15 bp, Homo sapiens
aagagttaagaatgt

SEQ ID NO: 803622 - DNA, 20 bp, Homo sapiens
aagagttattcaaatgaagg

SEQ ID NO: 803623 - DNA, 14 bp, Homo sapiens
aagagttcaagaaa

SEQ ID NO: 803624 - DNA, 16 bp, Homo sapiens
aagagttcaagaaata

SEQ ID NO: 803625 - DNA, 23 bp, Homo sapiens
aagagttcttaaggattgtgata

SEQ ID NO: 803626 - DNA, 20 bp, Homo sapiens
aagagttgctttgccagagc

SEQ ID NO: 803627 - DNA, 19 bp, Homo sapiens
aagagttggggacagaact

SEQ ID NO: 803628 - DNA, 15 bp, Homo sapiens
aagagtttgttctgt

SEQ ID NO: 803629 - DNA, 16 bp, Homo sapiens
aagagtttttttctgt

SEQ ID NO: 803630 - DNA, 21 bp, Homo sapiens
aagagtttttttctgtttata

SEQ ID NO: 803631 - DNA, 22 bp, Homo sapiens
aagagtttttttctgtttataa

SEQ ID NO: 803632 - DNA, 18 bp, Homo sapiens
aagataaaatatcctcag

SEQ ID NO: 803633 - DNA, 19 bp, Homo sapiens
aagataaaatatcctcagg

SEQ ID NO: 803634 - DNA, 14 bp, Homo sapiens
aagataaagatgat

SEQ ID NO: 803635 - DNA, 12 bp, Homo sapiens
aagataaatgtg

SEQ ID NO: 803636 - DNA, 21 bp, Homo sapiens
aagataacaagatctttcagg

SEQ ID NO: 803637 - DNA, 22 bp, Homo sapiens
aagataacaagatctttcagga

SEQ ID NO: 803638 - DNA, 15 bp, Homo sapiens
aagataacttactgt

SEQ ID NO: 803639 - DNA, 16 bp, Homo sapiens
aagataacttactgta

SEQ ID NO: 803640 - DNA, 22 bp, Homo sapiens
aagataagatttctgtctacta

SEQ ID NO: 803641 - DNA, 21 bp, Homo sapiens
aagataagtgtatttttcaat

SEQ ID NO: 803642 - DNA, 15 bp, Homo sapiens
aagataatctcagtg

SEQ ID NO: 803643 - DNA, 16 bp, Homo sapiens
aagataatgttcttta

SEQ ID NO: 803644 - DNA, 12 bp, Homo sapiens
aagataattata

SEQ ID NO: 803645 - DNA, 18 bp, Homo sapiens
aagatacaaattaatttt

SEQ ID NO: 803646 - DNA, 20 bp, Homo sapiens
aagatacaaattaattttac

SEQ ID NO: 803647 - DNA, 15 bp, Homo sapiens
aagatacaagtttca

SEQ ID NO: 803648 - DNA, 20 bp, Homo sapiens
aagatacaagtttcagacag

SEQ ID NO: 803649 - DNA, 20 bp, Homo sapiens
aagatacagaactctttcaa

SEQ ID NO: 803650 - DNA, 22 bp, Homo sapiens
aagatacagaactctttcaaaa

SEQ ID NO: 803651 - DNA, 15 bp, Homo sapiens
aagatagaacacaaa

SEQ ID NO: 803652 - DNA, 17 bp, Homo sapiens
aagatagcgcatatatt

SEQ ID NO: 803653 - DNA, 17 bp, Homo sapiens
aagatagcttcacccca

SEQ ID NO: 803654 - DNA, 18 bp, Homo sapiens
aagataggagttctctga

SEQ ID NO: 803655 - DNA, 20 bp, Homo sapiens
aagatagtcttggaagctgt

SEQ ID NO: 803656 - DNA, 21 bp, Homo sapiens
aagatagtgtaacttgcttaa

SEQ ID NO: 803657 - DNA, 12 bp, Homo sapiens
aagatatatgtg

SEQ ID NO: 803658 - DNA, 20 bp, Homo sapiens
aagatatattaaaaatataa

SEQ ID NO: 803659 - DNA, 21 bp, Homo sapiens
aagatatattaaaaatataaa

SEQ ID NO: 803660 - DNA, 17 bp, Homo sapiens
aagatatcagagctctt

SEQ ID NO: 803661 - DNA, 18 bp, Homo sapiens
aagatatcagagctctta

SEQ ID NO: 803662 - DNA, 12 bp, Homo sapiens
aagatatggaca

SEQ ID NO: 803663 - DNA, 14 bp, Homo sapiens
aagatattatttgt

SEQ ID NO: 803664 - DNA, 20 bp, Homo sapiens
aagatattatttgtcttaaa

SEQ ID NO: 803665 - DNA, 15 bp, Homo sapiens
aagatattgatcaaa

SEQ ID NO: 803666 - DNA, 20 bp, Homo sapiens
aagatattgatcaaatatag

SEQ ID NO: 803667 - DNA, 15 bp, Homo sapiens
aagatattgtacata

SEQ ID NO: 803668 - DNA, 16 bp, Homo sapiens
aagatattgtacataa

SEQ ID NO: 803669 - DNA, 19 bp, Homo sapiens
aagatatttgcagtttttc

SEQ ID NO: 803670 - DNA, 19 bp, Homo sapiens
aagatattttaaaatctgt

SEQ ID NO: 803671 - DNA, 22 bp, Homo sapiens
aagatattttgctttgtgattt

SEQ ID NO: 803672 - DNA, 19 bp, Homo sapiens
aagatatttttatctttat

SEQ ID NO: 803673 - DNA, 20 bp, Homo sapiens
aagatcaaaaggttaataaa

SEQ ID NO: 803674 - DNA, 22 bp, Homo sapiens
aagatcaaaataaaaagtgaca

SEQ ID NO: 803675 - DNA, 20 bp, Homo sapiens
aagatcaagaaatgtctctg

SEQ ID NO: 803676 - DNA, 15 bp, Homo sapiens
aagatcaatttctcc

SEQ ID NO: 803677 - DNA, 19 bp, Homo sapiens
aagatcacacatcaagact

SEQ ID NO: 803678 - DNA, 17 bp, Homo sapiens
aagatcaccttgtattc

SEQ ID NO: 803679 - DNA, 18 bp, Homo sapiens
aagatcaccttgtattct

SEQ ID NO: 803680 - DNA, 22 bp, Homo sapiens
aagcaaacatcaaataaatttc

SEQ ID NO: 803681 - DNA, 14 bp, Homo sapiens
aagcaaagacaaaa

SEQ ID NO: 803682 - DNA, 15 bp, Homo sapiens
aagcaaagacaaaag

SEQ ID NO: 803683 - DNA, 17 bp, Homo sapiens
aagcaaagacaaaagaa

SEQ ID NO: 803684 - DNA, 17 bp, Homo sapiens
aagcaaagcaccagctt

SEQ ID NO: 803685 - DNA, 21 bp, Homo sapiens
aagcaaagcacccatttcaat

SEQ ID NO: 803686 - DNA, 20 bp, Homo sapiens
aagcaaaggcagtcccggga

SEQ ID NO: 803687 - DNA, 21 bp, Homo sapiens
aagcaaaggggacagctgtgt

SEQ ID NO: 803688 - DNA, 16 bp, Homo sapiens
aagcaaaggggggagg

SEQ ID NO: 803689 - DNA, 11 bp, Homo sapiens
aagcaaaggtg

SEQ ID NO: 803690 - DNA, 17 bp, Homo sapiens
aagcaaaggtgaagaga

SEQ ID NO: 803691 - DNA, 22 bp, Homo sapiens
aagcaaagtgctttgacttctt

SEQ ID NO: 803692 - DNA, 16 bp, Homo sapiens
aagcaaatcatttgtt

SEQ ID NO: 803693 - DNA, 16 bp, Homo sapiens
aagcaaattactccaa

SEQ ID NO: 803694 - DNA, 14 bp, Homo sapiens
aagcaaattgatga

SEQ ID NO: 803695 - DNA, 14 bp, Homo sapiens
aagcaacatttgta

SEQ ID NO: 803696 - DNA, 18 bp, Homo sapiens
aagcaacatttgtatgga

SEQ ID NO: 803697 - DNA, 18 bp, Homo sapiens
aagcaacctcagtaattt

SEQ ID NO: 803698 - DNA, 19 bp, Homo sapiens
aagcaacctcagtaattta

SEQ ID NO: 803699 - DNA, 22 bp, Homo sapiens
aagcaacctcagtaatttagaa

SEQ ID NO: 803700 - DNA, 18 bp, Homo sapiens
aagcaacttgcttctaaa

SEQ ID NO: 803701 - DNA, 22 bp, Homo sapiens
aagcaacttgcttctaaatgcc

SEQ ID NO: 803702 - DNA, 14 bp, Homo sapiens
aagcaagaaacagt

SEQ ID NO: 803703 - DNA, 15 bp, Homo sapiens
aagcaagagagatgt

SEQ ID NO: 803704 - DNA, 13 bp, Homo sapiens
aagcaagcttaat

SEQ ID NO: 803705 - DNA, 13 bp, Homo sapiens
aagcaagggagaa

SEQ ID NO: 803706 - DNA, 22 bp, Homo sapiens
aagcaagggagaaaagagaaac

SEQ ID NO: 803707 - DNA, 20 bp, Homo sapiens
aagcaagggctccagcatcc

SEQ ID NO: 803708 - DNA, 13 bp, Homo sapiens
aagcaagtagctt

SEQ ID NO: 803709 - DNA, 19 bp, Homo sapiens
aagcaagtagctttccaca

SEQ ID NO: 803710 - DNA, 17 bp, Homo sapiens
aagcaataaagaagagt

SEQ ID NO: 803711 - DNA, 13 bp, Homo sapiens
aagcaataactat

SEQ ID NO: 803712 - DNA, 22 bp, Homo sapiens
aagcaataactatttttcctca

SEQ ID NO: 803713 - DNA, 21 bp, Homo sapiens
aagcaataatggtcccatcca

SEQ ID NO: 803714 - DNA, 15 bp, Homo sapiens
aagcaatcattttat

SEQ ID NO: 803715 - DNA, 18 bp, Homo sapiens
aagcaatccacctgcctt

SEQ ID NO: 803716 - DNA, 17 bp, Homo sapiens
aagcaatcctcctacct

SEQ ID NO: 803717 - DNA, 17 bp, Homo sapiens
aagcaatcctcctgcct

SEQ ID NO: 803718 - DNA, 17 bp, Homo sapiens
aagcaatccttctgcct

SEQ ID NO: 803719 - DNA, 19 bp, Homo sapiens
aagcaatccttctgccttg

SEQ ID NO: 803720 - DNA, 17 bp, Homo sapiens
aagcaatgtgttttttc

SEQ ID NO: 803721 - DNA, 16 bp, Homo sapiens
aagcaattctgactgt

SEQ ID NO: 803722 - DNA, 16 bp, Homo sapiens
aagcaattgccctgta

SEQ ID NO: 803723 - DNA, 21 bp, Homo sapiens
aagcacaaagttctcagagct

SEQ ID NO: 803724 - DNA, 22 bp, Homo sapiens
aagcacaaagttctcagagctc

SEQ ID NO: 803725 - DNA, 15 bp, Homo sapiens
aagcacaactccctt

SEQ ID NO: 803726 - DNA, 18 bp, Homo sapiens
aagcacacacaataaaga

SEQ ID NO: 803727 - DNA, 19 bp, Homo sapiens
aagcacacacaataaagaa

SEQ ID NO: 803728 - DNA, 15 bp, Homo sapiens
aagcacacacatctg

SEQ ID NO: 803729 - DNA, 21 bp, Homo sapiens
aagcacactggaatataaaac

SEQ ID NO: 803730 - DNA, 16 bp, Homo sapiens
aagcacagaatatttt

SEQ ID NO: 803731 - DNA, 12 bp, Homo sapiens
aagcacagagcc

SEQ ID NO: 803732 - DNA, 11 bp, Homo sapiens
aagcacagagg

SEQ ID NO: 803733 - DNA, 11 bp, Homo sapiens
aagcacagcag

SEQ ID NO: 803734 - DNA, 16 bp, Homo sapiens
aagcacagcctcagaa

SEQ ID NO: 803735 - DNA, 20 bp, Homo sapiens
aagcacagtctgatgacaca

SEQ ID NO: 803736 - DNA, 18 bp, Homo sapiens
aagcacagtgttaaatga

SEQ ID NO: 803737 - DNA, 17 bp, Homo sapiens
aagcacagtttgaacaa

SEQ ID NO: 803738 - DNA, 15 bp, Homo sapiens
aagcacataactgga

SEQ ID NO: 803739 - DNA, 18 bp, Homo sapiens
aagcacataactggattt

SEQ ID NO: 803740 - DNA, 23 bp, Homo sapiens
aagcacatattagtgcagccaag

SEQ ID NO: 803741 - DNA, 17 bp, Homo sapiens
aagcacatgcttagctt

SEQ ID NO: 803742 - DNA, 17 bp, Homo sapiens
aagcaccaaaataagaa

SEQ ID NO: 803743 - DNA, 22 bp, Homo sapiens
aagcaccaaaataagaaaagat

SEQ ID NO: 803744 - DNA, 21 bp, Homo sapiens
aagcaccagcttctccaggct

SEQ ID NO: 803745 - DNA, 18 bp, Homo sapiens
aagcaccaggaagtgttt

SEQ ID NO: 803746 - DNA, 19 bp, Homo sapiens
aagcacctactatgtgctg

SEQ ID NO: 803747 - DNA, 16 bp, Homo sapiens
aagcaccttagctggc

SEQ ID NO: 803748 - DNA, 19 bp, Homo sapiens
aagcactacaccttgcctt

SEQ ID NO: 803749 - DNA, 23 bp, Homo sapiens
aagcactacaccttgccttgctg

SEQ ID NO: 803750 - DNA, 17 bp, Homo sapiens
aagcactacataaactg

SEQ ID NO: 803751 - DNA, 16 bp, Homo sapiens
aagcactattttatat

SEQ ID NO: 803752 - DNA, 21 bp, Homo sapiens
aagcactcccttaggcattat

SEQ ID NO: 803753 - DNA, 20 bp, Homo sapiens
aagcactcgagaccatcctg

SEQ ID NO: 803754 - DNA, 21 bp, Homo sapiens
aagcactctctgcagtcctcc

SEQ ID NO: 803755 - DNA, 12 bp, Homo sapiens
aagcactgagca

SEQ ID NO: 803756 - DNA, 19 bp, Homo sapiens
aagcactgctaggcgagtg

SEQ ID NO: 803757 - DNA, 23 bp, Homo sapiens
aagcactgctaggcgagtgccag

SEQ ID NO: 803758 - DNA, 12 bp, Homo sapiens
aagcacttctag

SEQ ID NO: 803759 - DNA, 13 bp, Homo sapiens
aagcacttctaga

SEQ ID NO: 803760 - DNA, 13 bp, Homo sapiens
aagcactttgatt

SEQ ID NO: 803761 - DNA, 16 bp, Homo sapiens
aagcactttgcactta

SEQ ID NO: 803762 - DNA, 19 bp, Homo sapiens
aagcagaaaataaaggaag

SEQ ID NO: 803763 - DNA, 15 bp, Homo sapiens
aagcagaacaaatgt

SEQ ID NO: 803764 - DNA, 20 bp, Homo sapiens
aagcagaacaaatgtgtttt

SEQ ID NO: 803765 - DNA, 14 bp, Homo sapiens
aagcagaagtctgg

SEQ ID NO: 803766 - DNA, 16 bp, Homo sapiens
aagcagaattttaatg

SEQ ID NO: 803767 - DNA, 21 bp, Homo sapiens
aagcagaattttaatgtgaag

SEQ ID NO: 803768 - DNA, 12 bp, Homo sapiens
aagcagacagct

SEQ ID NO: 803769 - DNA, 16 bp, Homo sapiens
aagcagactccagccc

SEQ ID NO: 803770 - DNA, 17 bp, Homo sapiens
aagcagactccagcccc

SEQ ID NO: 803771 - DNA, 23 bp, Homo sapiens
aagcagactccagcccctggacc

SEQ ID NO: 803772 - DNA, 12 bp, Homo sapiens
aagcagagccaa

SEQ ID NO: 803773 - DNA, 14 bp, Homo sapiens
aagcagagcctcct

SEQ ID NO: 803774 - DNA, 16 bp, Homo sapiens
aagcagagcctcctgg

SEQ ID NO: 803775 - DNA, 18 bp, Homo sapiens
aagcagagcctcctggga

SEQ ID NO: 803776 - DNA, 21 bp, Homo sapiens
aagcagaggaaggagaggaga

SEQ ID NO: 803777 - DNA, 15 bp, Homo sapiens
aagcagaggaggggc

SEQ ID NO: 803778 - DNA, 20 bp, Homo sapiens
aagcagaggaggggccgctg

SEQ ID NO: 803779 - DNA, 15 bp, Homo sapiens
aagcagcactgtgag

SEQ ID NO: 803780 - DNA, 20 bp, Homo sapiens
aagcagcatggaaaaatggt

SEQ ID NO: 803781 - DNA, 13 bp, Homo sapiens
aagcagccagcca

SEQ ID NO: 803782 - DNA, 13 bp, Homo sapiens
aagcagcctcatt

SEQ ID NO: 803783 - DNA, 18 bp, Homo sapiens
aagcagcctcattctgag

SEQ ID NO: 803784 - DNA, 22 bp, Homo sapiens
aagcagcctctccccaggtcca

SEQ ID NO: 803785 - DNA, 17 bp, Homo sapiens
aagcagcgtttctatga

SEQ ID NO: 803786 - DNA, 20 bp, Homo sapiens
aagcagcgtttctatgacac

SEQ ID NO: 803787 - DNA, 24 bp, Homo sapiens
aagcagctaaatgtaacttattcc

SEQ ID NO: 803788 - DNA, 13 bp, Homo sapiens
aagcagctctccc

SEQ ID NO: 803789 - DNA, 17 bp, Homo sapiens
aagcagctctcccctca

SEQ ID NO: 803790 - DNA, 15 bp, Homo sapiens
aagcaggctggaggt

SEQ ID NO: 803791 - DNA, 17 bp, Homo sapiens
aagcagggacacccccc

SEQ ID NO: 803792 - DNA, 22 bp, Homo sapiens
aagcagggctatatttcagtga

SEQ ID NO: 803793 - DNA, 23 bp, Homo sapiens
aagcagggtaccctttggggagc

SEQ ID NO: 803794 - DNA, 14 bp, Homo sapiens
aagcaggtggatct

SEQ ID NO: 803795 - DNA, 22 bp, Homo sapiens
aagcaggtggatctatttcatg

SEQ ID NO: 803796 - DNA, 19 bp, Homo sapiens
aagcaggttcccaagctca

SEQ ID NO: 803797 - DNA, 20 bp, Homo sapiens
aagcaggttcttgatgtcat

SEQ ID NO: 803798 - DNA, 14 bp, Homo sapiens
aagcagtaaaaact

SEQ ID NO: 803799 - DNA, 17 bp, Homo sapiens
aagcagtaaatttgcta

SEQ ID NO: 803800 - DNA, 21 bp, Homo sapiens
aagcagtagaaataatatgca

SEQ ID NO: 803801 - DNA, 22 bp, Homo sapiens
aagcagtagaaataatatgcat

SEQ ID NO: 803802 - DNA, 14 bp, Homo sapiens
aagccttgttgcct

SEQ ID NO: 803803 - DNA, 17 bp, Homo sapiens
aagcctttatggctgct

SEQ ID NO: 803804 - DNA, 14 bp, Homo sapiens
aagcctttccataa

SEQ ID NO: 803805 - DNA, 14 bp, Homo sapiens
aagccttttaaatc

SEQ ID NO: 803806 - DNA, 14 bp, Homo sapiens
aagcgaccaaggat

SEQ ID NO: 803807 - DNA, 14 bp, Homo sapiens
aagcgattctcctg

SEQ ID NO: 803808 - DNA, 14 bp, Homo sapiens
aagcgatttgaaac

SEQ ID NO: 803809 - DNA, 15 bp, Homo sapiens
aagcgccaggctgga

SEQ ID NO: 803810 - DNA, 22 bp, Homo sapiens
aagcgctccagggccgtgaggg

SEQ ID NO: 803811 - DNA, 15 bp, Homo sapiens
aagcggccctgtgtg

SEQ ID NO: 803812 - DNA, 23 bp, Homo sapiens
aagcggccctgtgtgtttgacat

SEQ ID NO: 803813 - DNA, 22 bp, Homo sapiens
aagcggccgatgggagtctccc

SEQ ID NO: 803814 - DNA, 14 bp, Homo sapiens
aagcggctggcagc

SEQ ID NO: 803815 - DNA, 22 bp, Homo sapiens
aagcggggcttcatctgcaaag

SEQ ID NO: 803816 - DNA, 14 bp, Homo sapiens
aagcggggggaggg

SEQ ID NO: 803817 - DNA, 16 bp, Homo sapiens
aagcggtggaggaagg

SEQ ID NO: 803818 - DNA, 19 bp, Homo sapiens
aagcgttcctggccttctg

SEQ ID NO: 803819 - DNA, 15 bp, Homo sapiens
aagcgtttctgtgta

SEQ ID NO: 803820 - DNA, 14 bp, Homo sapiens
aagctaaaatggtg

SEQ ID NO: 803821 - DNA, 11 bp, Homo sapiens
aagctaaagag

SEQ ID NO: 803822 - DNA, 18 bp, Homo sapiens
aagctaaattttgttact

SEQ ID NO: 803823 - DNA, 15 bp, Homo sapiens
aagctaacatcttta

SEQ ID NO: 803824 - DNA, 19 bp, Homo sapiens
aagctaatgtaggactgta

SEQ ID NO: 803825 - DNA, 20 bp, Homo sapiens
aagctaatgtaggactgtat

SEQ ID NO: 803826 - DNA, 20 bp, Homo sapiens
aagctaatgtcacaattatg

SEQ ID NO: 803827 - DNA, 14 bp, Homo sapiens
aagctaatttgcat

SEQ ID NO: 803828 - DNA, 15 bp, Homo sapiens
aagctaatttgcatt

SEQ ID NO: 803829 - DNA, 17 bp, Homo sapiens
aagctacaatctgttca

SEQ ID NO: 803830 - DNA, 20 bp, Homo sapiens
aagctacagaagaaactggg

SEQ ID NO: 803831 - DNA, 21 bp, Homo sapiens
aagctacccctcaaactgcac

SEQ ID NO: 803832 - DNA, 23 bp, Homo sapiens
aagctacccctcaaactgcacat

SEQ ID NO: 803833 - DNA, 17 bp, Homo sapiens
aagctactagcaaaata

SEQ ID NO: 803834 - DNA, 19 bp, Homo sapiens
aagctactgtgtgtgtgaa

SEQ ID NO: 803835 - DNA, 22 bp, Homo sapiens
aagctactgtgtgtgtgaatga

SEQ ID NO: 803836 - DNA, 16 bp, Homo sapiens
aagctagacacatgaa

SEQ ID NO: 803837 - DNA, 18 bp, Homo sapiens
aagctagacacatgaagg

SEQ ID NO: 803838 - DNA, 22 bp, Homo sapiens
aagctagacacatgaaggtaaa

SEQ ID NO: 803839 - DNA, 16 bp, Homo sapiens
aagctagatatgcctt

SEQ ID NO: 803840 - DNA, 23 bp, Homo sapiens
aagctaggtgctatttgtcatct

SEQ ID NO: 803841 - DNA, 19 bp, Homo sapiens
aagctagtcttttgctttt

SEQ ID NO: 803842 - DNA, 20 bp, Homo sapiens
aagctataaagcagtatttt

SEQ ID NO: 803843 - DNA, 14 bp, Homo sapiens
aagctatcagcaat

SEQ ID NO: 803844 - DNA, 20 bp, Homo sapiens
aagctatccttgcacctcag

SEQ ID NO: 803845 - DNA, 14 bp, Homo sapiens
aagctatctaaagt

SEQ ID NO: 803846 - DNA, 15 bp, Homo sapiens
aagctatcttcatgt

SEQ ID NO: 803847 - DNA, 21 bp, Homo sapiens
aagctatggtgagatgcagct

SEQ ID NO: 803848 - DNA, 22 bp, Homo sapiens
aagctatggtgagatgcagctg

SEQ ID NO: 803849 - DNA, 14 bp, Homo sapiens
aagctattaaagtt

SEQ ID NO: 803850 - DNA, 18 bp, Homo sapiens
aagctattcacattgtta

SEQ ID NO: 803851 - DNA, 13 bp, Homo sapiens
aagctattccttt

SEQ ID NO: 803852 - DNA, 14 bp, Homo sapiens
aagctattcctttc

SEQ ID NO: 803853 - DNA, 19 bp, Homo sapiens
aagctattcctttcccttc

SEQ ID NO: 803854 - DNA, 22 bp, Homo sapiens
aagctattcctttcccttcctc

SEQ ID NO: 803855 - DNA, 23 bp, Homo sapiens
aagctattcctttcccttcctct

SEQ ID NO: 803856 - DNA, 22 bp, Homo sapiens
aagctcaaaggtttggaaggag

SEQ ID NO: 803857 - DNA, 11 bp, Homo sapiens
aagctcacagt

SEQ ID NO: 803858 - DNA, 20 bp, Homo sapiens
aagctcacagttcctcgccc

SEQ ID NO: 803859 - DNA, 22 bp, Homo sapiens
aagctcacagttcctcgccctg

SEQ ID NO: 803860 - DNA, 15 bp, Homo sapiens
aagctcacgtcctga

SEQ ID NO: 803861 - DNA, 14 bp, Homo sapiens
aagctcagaataga

SEQ ID NO: 803862 - DNA, 15 bp, Homo sapiens
aagctcagattattt

SEQ ID NO: 803863 - DNA, 16 bp, Homo sapiens
aagctcagattattta

SEQ ID NO: 803864 - DNA, 21 bp, Homo sapiens
aagctcagcccacccccctca

SEQ ID NO: 803865 - DNA, 20 bp, Homo sapiens
aagctcatattttgtatata

SEQ ID NO: 803866 - DNA, 21 bp, Homo sapiens
aagctcatgcatttcaagcag

SEQ ID NO: 803867 - DNA, 19 bp, Homo sapiens
aagctccacggtgcgtggc

SEQ ID NO: 803868 - DNA, 21 bp, Homo sapiens
aagctccacggtgcgtggctg

SEQ ID NO: 803869 - DNA, 15 bp, Homo sapiens
aagctccatgtgcat

SEQ ID NO: 803870 - DNA, 16 bp, Homo sapiens
aagctccatgtgcata

SEQ ID NO: 803871 - DNA, 17 bp, Homo sapiens
aagctccatgtgcatat

SEQ ID NO: 803872 - DNA, 16 bp, Homo sapiens
aagctccctgccccaa

SEQ ID NO: 803873 - DNA, 14 bp, Homo sapiens
aagctccctggagc

SEQ ID NO: 803874 - DNA, 18 bp, Homo sapiens
aagctccctggagccctg

SEQ ID NO: 803875 - DNA, 21 bp, Homo sapiens
aagctccctggagccctgttg

SEQ ID NO: 803876 - DNA, 13 bp, Homo sapiens
aagctcctcctcc

SEQ ID NO: 803877 - DNA, 16 bp, Homo sapiens
aagctcctcctccctg

SEQ ID NO: 803878 - DNA, 17 bp, Homo sapiens
aagctcctcctccctgc

SEQ ID NO: 803879 - DNA, 18 bp, Homo sapiens
aagctcctcctccctgca

SEQ ID NO: 803880 - DNA, 21 bp, Homo sapiens
aagctcctcctccctgcatct

SEQ ID NO: 803881 - DNA, 13 bp, Homo sapiens
aagctcctgtcct

SEQ ID NO: 803882 - DNA, 20 bp, Homo sapiens
aagctcctgtcctcccatcc

SEQ ID NO: 803883 - DNA, 13 bp, Homo sapiens
aagctccttcctg

SEQ ID NO: 803884 - DNA, 13 bp, Homo sapiens
aagctcgcatcca

SEQ ID NO: 803885 - DNA, 13 bp, Homo sapiens
aagctctccaggc

SEQ ID NO: 803886 - DNA, 22 bp, Homo sapiens
aagctctctgcatctactccca

SEQ ID NO: 803887 - DNA, 13 bp, Homo sapiens
aagctctgaaaac

SEQ ID NO: 803888 - DNA, 15 bp, Homo sapiens
aagctctgaaaacaa

SEQ ID NO: 803889 - DNA, 17 bp, Homo sapiens
aagctcttcatttctgg

SEQ ID NO: 803890 - DNA, 14 bp, Homo sapiens
aagctcttggacaa

SEQ ID NO: 803891 - DNA, 19 bp, Homo sapiens
aagctcttggagctgtgag

SEQ ID NO: 803892 - DNA, 16 bp, Homo sapiens
aagctctttgagaact

SEQ ID NO: 803893 - DNA, 12 bp, Homo sapiens
aagctgaaattt

SEQ ID NO: 803894 - DNA, 18 bp, Homo sapiens
aagctgaaattttagaaa

SEQ ID NO: 803895 - DNA, 22 bp, Homo sapiens
aagctgaaattttagaaatatt

SEQ ID NO: 803896 - DNA, 17 bp, Homo sapiens
aagctgaagaggttgaa

SEQ ID NO: 803897 - DNA, 15 bp, Homo sapiens
aagctgaagcccccc

SEQ ID NO: 803898 - DNA, 17 bp, Homo sapiens
aagctgaagtgcatcca

SEQ ID NO: 803899 - DNA, 19 bp, Homo sapiens
aagctgaagtgcatccaaa

SEQ ID NO: 803900 - DNA, 18 bp, Homo sapiens
aagctgaatattttttat

SEQ ID NO: 803901 - DNA, 21 bp, Homo sapiens
aagctgaatcagacagtggat

SEQ ID NO: 803902 - DNA, 22 bp, Homo sapiens
aagctgacattgccaaaaagga

SEQ ID NO: 803903 - DNA, 21 bp, Homo sapiens
aagctgactgttttttttgca

SEQ ID NO: 803904 - DNA, 22 bp, Homo sapiens
aagctgactttatagctgcaag

SEQ ID NO: 803905 - DNA, 21 bp, Homo sapiens
aagctgagaaaagtattctca

SEQ ID NO: 803906 - DNA, 15 bp, Homo sapiens
aagctgagaagaatg

SEQ ID NO: 803907 - DNA, 20 bp, Homo sapiens
aagctgagagaccctggcct

SEQ ID NO: 803908 - DNA, 21 bp, Homo sapiens
aagctgagagaccctggcctc

SEQ ID NO: 803909 - DNA, 12 bp, Homo sapiens
aagctgaggcct

SEQ ID NO: 803910 - DNA, 23 bp, Homo sapiens
aagctgagtgactgtaggcaggg

SEQ ID NO: 803911 - DNA, 14 bp, Homo sapiens
aagctgagtttcct

SEQ ID NO: 803912 - DNA, 15 bp, Homo sapiens
aagctgagtttccta

SEQ ID NO: 803913 - DNA, 22 bp, Homo sapiens
aagctgagtttcctatgggaac

SEQ ID NO: 803914 - DNA, 20 bp, Homo sapiens
aagctgatattatttcttct

SEQ ID NO: 803915 - DNA, 22 bp, Homo sapiens
aagctgatattatttcttctct

SEQ ID NO: 803916 - DNA, 16 bp, Homo sapiens
aagctgattaaaacac

SEQ ID NO: 803917 - DNA, 17 bp, Homo sapiens
aagctgcactgtgaacc

SEQ ID NO: 803918 - DNA, 18 bp, Homo sapiens
aagctgcagatctttgct

SEQ ID NO: 803919 - DNA, 17 bp, Homo sapiens
aagctgccacccctctt

SEQ ID NO: 803920 - DNA, 21 bp, Homo sapiens
aagctgccatttcccttctgg

SEQ ID NO: 803921 - DNA, 18 bp, Homo sapiens
aagctgcccactgtttct

SEQ ID NO: 803922 - DNA, 20 bp, Homo sapiens
aagctgcccactgtttctct

SEQ ID NO: 803923 - DNA, 15 bp, Homo sapiens
aagctgccctgccca

SEQ ID NO: 803924 - DNA, 14 bp, Homo sapiens
aagctgcctctggg

SEQ ID NO: 803925 - DNA, 15 bp, Homo sapiens
aagctgcctctgggc

SEQ ID NO: 803926 - DNA, 20 bp, Homo sapiens
aagctgcctggtatatccaa

SEQ ID NO: 803927 - DNA, 16 bp, Homo sapiens
aagctgcctgtagtta

SEQ ID NO: 803928 - DNA, 21 bp, Homo sapiens
aagctgcctgtagttaggaaa

SEQ ID NO: 803929 - DNA, 22 bp, Homo sapiens
aagctgcctgtagttaggaaat

SEQ ID NO: 803930 - DNA, 14 bp, Homo sapiens
aagctgcctgtgcc

SEQ ID NO: 803931 - DNA, 23 bp, Homo sapiens
aagctgcctgtgccatgcccaag

SEQ ID NO: 803932 - DNA, 19 bp, Homo sapiens
aagctgctctgagccacag

SEQ ID NO: 803933 - DNA, 22 bp, Homo sapiens
aagctgctgaccaattgtgctg

SEQ ID NO: 803934 - DNA, 19 bp, Homo sapiens
aagctgcttgtcctgggcc

SEQ ID NO: 803935 - DNA, 14 bp, Homo sapiens
aagctggaagcaca

SEQ ID NO: 803936 - DNA, 16 bp, Homo sapiens
aagctggcaacatgaa

SEQ ID NO: 803937 - DNA, 15 bp, Homo sapiens
aagctggcagaacgg

SEQ ID NO: 803938 - DNA, 22 bp, Homo sapiens
aagctggccgagggtcctggct

SEQ ID NO: 803939 - DNA, 13 bp, Homo sapiens
aagctggcctgga

SEQ ID NO: 803940 - DNA, 15 bp, Homo sapiens
aagctggcctggacc

SEQ ID NO: 803941 - DNA, 21 bp, Homo sapiens
aagctggcctggaccattcct

SEQ ID NO: 803942 - DNA, 21 bp, Homo sapiens
aagctggctagtcctttctgt

SEQ ID NO: 803943 - DNA, 16 bp, Homo sapiens
aagctggctctgtttg

SEQ ID NO: 803944 - DNA, 15 bp, Homo sapiens
aagctgggcaggttg

SEQ ID NO: 803945 - DNA, 12 bp, Homo sapiens
aagctgggccca

SEQ ID NO: 803946 - DNA, 21 bp, Homo sapiens
aagctgggcccaaaggcccag

SEQ ID NO: 803947 - DNA, 15 bp, Homo sapiens
aagctgggggaaggg

SEQ ID NO: 803948 - DNA, 15 bp, Homo sapiens
aagctggtaaaaatg

SEQ ID NO: 803949 - DNA, 17 bp, Homo sapiens
aagctggtaaactattt

SEQ ID NO: 803950 - DNA, 17 bp, Homo sapiens
aagctggtggccttggc

SEQ ID NO: 803951 - DNA, 23 bp, Homo sapiens
aagctgtaaattactatggctga

SEQ ID NO: 803952 - DNA, 18 bp, Homo sapiens
aagctgtactcagagcag

SEQ ID NO: 803953 - DNA, 23 bp, Homo sapiens
aagctgtagtagccctttctgtg

SEQ ID NO: 803954 - DNA, 22 bp, Homo sapiens
aagctgtataattaattgtcat

SEQ ID NO: 803955 - DNA, 12 bp, Homo sapiens
aagctgtcccct

SEQ ID NO: 803956 - DNA, 23 bp, Homo sapiens
aagctgtctcttcggcagggagg

SEQ ID NO: 803957 - DNA, 19 bp, Homo sapiens
aagctgtgacttctccagg

SEQ ID NO: 803958 - DNA, 13 bp, Homo sapiens
aagctgtgagaca

SEQ ID NO: 803959 - DNA, 10 bp, Homo sapiens
aagctgtgca

SEQ ID NO: 803960 - DNA, 22 bp, Homo sapiens
aagctgtgtccttgcacctgca

SEQ ID NO: 803961 - DNA, 23 bp, Homo sapiens
aagctgtgtctgcccaatgaata

SEQ ID NO: 803962 - DNA, 14 bp, Homo sapiens
aagctgttaaactg

SEQ ID NO: 803963 - DNA, 15 bp, Homo sapiens
aagctgttaaactgt

SEQ ID NO: 803964 - DNA, 19 bp, Homo sapiens
aagctgtttatttattcac

SEQ ID NO: 803965 - DNA, 19 bp, Homo sapiens
aagctgtttgccaagctga

SEQ ID NO: 803966 - DNA, 20 bp, Homo sapiens
aagctgtttgccaagctgaa

SEQ ID NO: 803967 - DNA, 14 bp, Homo sapiens
aagctgtttggaaa

SEQ ID NO: 803968 - DNA, 17 bp, Homo sapiens
aagctgtttggaaaaga

SEQ ID NO: 803969 - DNA, 21 bp, Homo sapiens
aagctgtttggaaaagacagt

SEQ ID NO: 803970 - DNA, 15 bp, Homo sapiens
aagcttaaaaagagc

SEQ ID NO: 803971 - DNA, 14 bp, Homo sapiens
aagcttaaactgaa

SEQ ID NO: 803972 - DNA, 18 bp, Homo sapiens
aagcttaaataggaaagt

SEQ ID NO: 803973 - DNA, 14 bp, Homo sapiens
aagcttaataaatt

SEQ ID NO: 803974 - DNA, 15 bp, Homo sapiens
aagcttaataaattc

SEQ ID NO: 803975 - DNA, 17 bp, Homo sapiens
aagcttaatagccctcc

SEQ ID NO: 803976 - DNA, 18 bp, Homo sapiens
aagcttaatagccctccc

SEQ ID NO: 803977 - DNA, 14 bp, Homo sapiens
aagcttaatatgtg

SEQ ID NO: 803978 - DNA, 13 bp, Homo sapiens
aagcttactacag

SEQ ID NO: 803979 - DNA, 15 bp, Homo sapiens
aagcttactacagtg

SEQ ID NO: 803980 - DNA, 18 bp, Homo sapiens
aagcttatttttatgtgg

SEQ ID NO: 803981 - DNA, 22 bp, Homo sapiens
aagcttcaaattatagaaacaa

SEQ ID NO: 803982 - DNA, 20 bp, Homo sapiens
aagcttcatgcacttaaaga

SEQ ID NO: 803983 - DNA, 21 bp, Homo sapiens
aagcttcatgcacttaaagaa

SEQ ID NO: 803984 - DNA, 22 bp, Homo sapiens
aagcttcatgcacttaaagaag

SEQ ID NO: 803985 - DNA, 15 bp, Homo sapiens
aagcttccatgattc

SEQ ID NO: 803986 - DNA, 16 bp, Homo sapiens
aagcttccatgattct

SEQ ID NO: 803987 - DNA, 11 bp, Homo sapiens
aagcttccctc

SEQ ID NO: 803988 - DNA, 15 bp, Homo sapiens
aagcttctataaaat

SEQ ID NO: 803989 - DNA, 14 bp, Homo sapiens
aagcttctgagtct

SEQ ID NO: 803990 - DNA, 15 bp, Homo sapiens
aagcttgactcccaa

SEQ ID NO: 803991 - DNA, 18 bp, Homo sapiens
aagcttgactcccaagtt

SEQ ID NO: 803992 - DNA, 23 bp, Homo sapiens
aagcttgagtctcaagggtggca

SEQ ID NO: 803993 - DNA, 18 bp, Homo sapiens
aagcttggattaaataca

SEQ ID NO: 803994 - DNA, 20 bp, Homo sapiens
aagcttggcttcctcttctt

SEQ ID NO: 803995 - DNA, 17 bp, Homo sapiens
aagcttggtcaaacttt

SEQ ID NO: 803996 - DNA, 20 bp, Homo sapiens
aagcttggtgacaaaattca

SEQ ID NO: 803997 - DNA, 21 bp, Homo sapiens
aagcttggttctgtgaacaag

SEQ ID NO: 803998 - DNA, 17 bp, Homo sapiens
aagcttgtcaaagatgc

SEQ ID NO: 803999 - DNA, 15 bp, Homo sapiens
aagctttaccagctg

SEQ ID NO: 804000 - DNA, 14 bp, Homo sapiens
aagctttactactg

SEQ ID NO: 804001 - DNA, 16 bp, Homo sapiens
aagctttatctttgtg

SEQ ID NO: 804002 - DNA, 21 bp, Homo sapiens
aagctttattaccagtggcgt

SEQ ID NO: 804003 - DNA, 16 bp, Homo sapiens
aagctttatttctagc

SEQ ID NO: 804004 - DNA, 13 bp, Homo sapiens
aagctttcaacat

SEQ ID NO: 804005 - DNA, 21 bp, Homo sapiens
aagctttcatgtcccagaact

SEQ ID NO: 804006 - DNA, 22 bp, Homo sapiens
aagctttgaggctctgtcactg

SEQ ID NO: 804007 - DNA, 14 bp, Homo sapiens
aagctttggctgag

SEQ ID NO: 804008 - DNA, 21 bp, Homo sapiens
aagctttgggggagtgggcgc

SEQ ID NO: 804009 - DNA, 12 bp, Homo sapiens
aagctttgtgaa

SEQ ID NO: 804010 - DNA, 19 bp, Homo sapiens
aagcttttaagaaaaacaa

SEQ ID NO: 804011 - DNA, 23 bp, Homo sapiens
aagcttttgcttgatccagaaga

SEQ ID NO: 804012 - DNA, 19 bp, Homo sapiens
aagcttttgtctacacacc

SEQ ID NO: 804013 - DNA, 23 bp, Homo sapiens
aagctttttttttttgaacccca

SEQ ID NO: 804014 - DNA, 19 bp, Homo sapiens
aaggaaaaaaaacacaaaa

SEQ ID NO: 804015 - DNA, 17 bp, Homo sapiens
aaggaaaaaatgttgga

SEQ ID NO: 804016 - DNA, 16 bp, Homo sapiens
aaggaaaaacacaagc

SEQ ID NO: 804017 - DNA, 14 bp, Homo sapiens
aaggaaaaataatc

SEQ ID NO: 804018 - DNA, 19 bp, Homo sapiens
aaggaaaaataatcaagat

SEQ ID NO: 804019 - DNA, 17 bp, Homo sapiens
aaggaaaaatgtgtaat

SEQ ID NO: 804020 - DNA, 14 bp, Homo sapiens
aaggaaaagcaaga

SEQ ID NO: 804021 - DNA, 19 bp, Homo sapiens
aaggaaaaggttgttgtta

SEQ ID NO: 804022 - DNA, 17 bp, Homo sapiens
aaggaaaatagtaatgt

SEQ ID NO: 804023 - DNA, 13 bp, Homo sapiens
aaggaaaatgatc

SEQ ID NO: 804024 - DNA, 14 bp, Homo sapiens
aaggaaaatgatct

SEQ ID NO: 804025 - DNA, 14 bp, Homo sapiens
aaggaaaattgaaa

SEQ ID NO: 804026 - DNA, 17 bp, Homo sapiens
aaggaaaattgaaagta

SEQ ID NO: 804027 - DNA, 13 bp, Homo sapiens
aaggaaacaaatg

SEQ ID NO: 804028 - DNA, 17 bp, Homo sapiens
aaggaaacaaatgtgta

SEQ ID NO: 804029 - DNA, 23 bp, Homo sapiens
aaggaaacactaaggctgcttca

SEQ ID NO: 804030 - DNA, 16 bp, Homo sapiens
aaggaaacattttatc

SEQ ID NO: 804031 - DNA, 22 bp, Homo sapiens
aaggaaaccacagtgagcctga

SEQ ID NO: 804032 - DNA, 15 bp, Homo sapiens
aaggaaaccagtgca

SEQ ID NO: 804033 - DNA, 21 bp, Homo sapiens
aaggaaaccgcctagtttact

SEQ ID NO: 804034 - DNA, 20 bp, Homo sapiens
aaggaaacttcagttgatct

SEQ ID NO: 804035 - DNA, 21 bp, Homo sapiens
aaggaaactttatttaaatgc

SEQ ID NO: 804036 - DNA, 14 bp, Homo sapiens
aaggaaagcatgtc

SEQ ID NO: 804037 - DNA, 21 bp, Homo sapiens
aaggaaaggctcatttaaaac

SEQ ID NO: 804038 - DNA, 19 bp, Homo sapiens
aaggaaagtcaagaagaat

SEQ ID NO: 804039 - DNA, 21 bp, Homo sapiens
aaggaaatacacttcttttga

SEQ ID NO: 804040 - DNA, 15 bp, Homo sapiens
aaggaaatattcttt

SEQ ID NO: 804041 - DNA, 14 bp, Homo sapiens
aaggaaatccaaaa

SEQ ID NO: 804042 - DNA, 14 bp, Homo sapiens
aaggaaatgagtgg

SEQ ID NO: 804043 - DNA, 22 bp, Homo sapiens
aaggaaatgagtggccagcgcc

SEQ ID NO: 804044 - DNA, 12 bp, Homo sapiens
aaggaaatgatg

SEQ ID NO: 804045 - DNA, 21 bp, Homo sapiens
aaggggtgggactggtggggg

SEQ ID NO: 804046 - DNA, 19 bp, Homo sapiens
aaggggttcctcaaatttt

SEQ ID NO: 804047 - DNA, 20 bp, Homo sapiens
aaggggttggttgaggtgga

SEQ ID NO: 804048 - DNA, 13 bp, Homo sapiens
aagggtaaagaag

SEQ ID NO: 804049 - DNA, 13 bp, Homo sapiens
aagggtaggatgt

SEQ ID NO: 804050 - DNA, 17 bp, Homo sapiens
aagggtaggatgttgct

SEQ ID NO: 804051 - DNA, 17 bp, Homo sapiens
aagggtagttcaaagag

SEQ ID NO: 804052 - DNA, 18 bp, Homo sapiens
aagggtatgggaagccat

SEQ ID NO: 804053 - DNA, 19 bp, Homo sapiens
aagggtcttgggaaatatg

SEQ ID NO: 804054 - DNA, 16 bp, Homo sapiens
aagggtgcccatttgt

SEQ ID NO: 804055 - DNA, 23 bp, Homo sapiens
aagggtgctgcttccctctgcct

SEQ ID NO: 804056 - DNA, 21 bp, Homo sapiens
aagggtggatgacagggcaga

SEQ ID NO: 804057 - DNA, 17 bp, Homo sapiens
aagggtgggtgctcaga

SEQ ID NO: 804058 - DNA, 15 bp, Homo sapiens
aagggtgtatagtgt

SEQ ID NO: 804059 - DNA, 14 bp, Homo sapiens
aagggttaagaaaa

SEQ ID NO: 804060 - DNA, 20 bp, Homo sapiens
aagggttctgccctgcctga

SEQ ID NO: 804061 - DNA, 23 bp, Homo sapiens
aagggttctgccctgcctgagga

SEQ ID NO: 804062 - DNA, 15 bp, Homo sapiens
aagggttgaaggcag

SEQ ID NO: 804063 - DNA, 17 bp, Homo sapiens
aagggttgaaggcagtc

SEQ ID NO: 804064 - DNA, 15 bp, Homo sapiens
aagggttgagagcca

SEQ ID NO: 804065 - DNA, 17 bp, Homo sapiens
aagggttgagagccagt

SEQ ID NO: 804066 - DNA, 18 bp, Homo sapiens
aagggttggtgggctggc

SEQ ID NO: 804067 - DNA, 12 bp, Homo sapiens
aagggttgtgag

SEQ ID NO: 804068 - DNA, 13 bp, Homo sapiens
aagggtttctcta

SEQ ID NO: 804069 - DNA, 15 bp, Homo sapiens
aagggtttgtaatac

SEQ ID NO: 804070 - DNA, 21 bp, Homo sapiens
aagggttttccaccctggaat

SEQ ID NO: 804071 - DNA, 13 bp, Homo sapiens
aagggttttcttt

SEQ ID NO: 804072 - DNA, 16 bp, Homo sapiens
aagggttttcttttct

SEQ ID NO: 804073 - DNA, 17 bp, Homo sapiens
aagggttttcttttctt

SEQ ID NO: 804074 - DNA, 19 bp, Homo sapiens
aagggtttttagagaatgt

SEQ ID NO: 804075 - DNA, 14 bp, Homo sapiens
aaggtaaaatcact

SEQ ID NO: 804076 - DNA, 15 bp, Homo sapiens
aaggtaaaatcactt

SEQ ID NO: 804077 - DNA, 16 bp, Homo sapiens
aaggtaaaatcacttc

SEQ ID NO: 804078 - DNA, 19 bp, Homo sapiens
aaggtaaataaaaagaaag

SEQ ID NO: 804079 - DNA, 21 bp, Homo sapiens
aaggtaaatggttaaatttta

SEQ ID NO: 804080 - DNA, 19 bp, Homo sapiens
aaggtaacatttatagaag

SEQ ID NO: 804081 - DNA, 16 bp, Homo sapiens
aaggtaactaactgct

SEQ ID NO: 804082 - DNA, 13 bp, Homo sapiens
aaggtaattgttt

SEQ ID NO: 804083 - DNA, 19 bp, Homo sapiens
aaggtacaagaagcatttt

SEQ ID NO: 804084 - DNA, 13 bp, Homo sapiens
aaggtacatattt

SEQ ID NO: 804085 - DNA, 20 bp, Homo sapiens
aaggtagaaatatctgaaaa

SEQ ID NO: 804086 - DNA, 14 bp, Homo sapiens
aaggtagactttta

SEQ ID NO: 804087 - DNA, 23 bp, Homo sapiens
aaggtagcattcattacctgttt

SEQ ID NO: 804088 - DNA, 12 bp, Homo sapiens
aaggtagttttt

SEQ ID NO: 804089 - DNA, 22 bp, Homo sapiens
aaggtagtttttacctaccaca

SEQ ID NO: 804090 - DNA, 15 bp, Homo sapiens
aaggtatattgtgaa

SEQ ID NO: 804091 - DNA, 16 bp, Homo sapiens
aaggtattggcctgtt

SEQ ID NO: 804092 - DNA, 19 bp, Homo sapiens
aaggtattttgaataccat

SEQ ID NO: 804093 - DNA, 16 bp, Homo sapiens
aaggtcactcttggtc

SEQ ID NO: 804094 - DNA, 20 bp, Homo sapiens
aaggtcactcttggtccctg

SEQ ID NO: 804095 - DNA, 23 bp, Homo sapiens
aaggtcagcccgtttcagaagga

SEQ ID NO: 804096 - DNA, 18 bp, Homo sapiens
aaggtcagcgagaaggag

SEQ ID NO: 804097 - DNA, 21 bp, Homo sapiens
aaggtcagtaatgctgcagga

SEQ ID NO: 804098 - DNA, 22 bp, Homo sapiens
aaggtcatcaaacatttgccaa

SEQ ID NO: 804099 - DNA, 13 bp, Homo sapiens
aaggtcatcatcg

SEQ ID NO: 804100 - DNA, 18 bp, Homo sapiens
aaggtcattttttttaag

SEQ ID NO: 804101 - DNA, 20 bp, Homo sapiens
aaggtccactccctgctcca

SEQ ID NO: 804102 - DNA, 11 bp, Homo sapiens
aaggtccagtg

SEQ ID NO: 804103 - DNA, 12 bp, Homo sapiens
aaggtccctggg

SEQ ID NO: 804104 - DNA, 23 bp, Homo sapiens
aaggtcctctcagttctctccct

SEQ ID NO: 804105 - DNA, 18 bp, Homo sapiens
aaggtcctgaaagtaact

SEQ ID NO: 804106 - DNA, 20 bp, Homo sapiens
aaggtctaactgtggaatat

SEQ ID NO: 804107 - DNA, 18 bp, Homo sapiens
aaggtctcagcttgtata

SEQ ID NO: 804108 - DNA, 17 bp, Homo sapiens
aaggtctccaagggagg

SEQ ID NO: 804109 - DNA, 22 bp, Homo sapiens
aaggtctccaagggagggtgca

SEQ ID NO: 804110 - DNA, 21 bp, Homo sapiens
aaggtctccttactctgagcc

SEQ ID NO: 804111 - DNA, 23 bp, Homo sapiens
aaggtctggagaagctcccagga

SEQ ID NO: 804112 - DNA, 21 bp, Homo sapiens
aaggtcttgcagtggcttttc

SEQ ID NO: 804113 - DNA, 23 bp, Homo sapiens
aaggtcttgcagtggcttttcat

SEQ ID NO: 804114 - DNA, 13 bp, Homo sapiens
aaggtctttgtaa

SEQ ID NO: 804115 - DNA, 18 bp, Homo sapiens
aaggtgaaaatgttttat

SEQ ID NO: 804116 - DNA, 18 bp, Homo sapiens
aaggtgaaacgactcaaa

SEQ ID NO: 804117 - DNA, 14 bp, Homo sapiens
aaggtgaaggaata

SEQ ID NO: 804118 - DNA, 19 bp, Homo sapiens
aaggtgacatcggaaaaat

SEQ ID NO: 804119 - DNA, 17 bp, Homo sapiens
aaggtgaccgcccagct

SEQ ID NO: 804120 - DNA, 16 bp, Homo sapiens
aaggtgagaattaagt

SEQ ID NO: 804121 - DNA, 18 bp, Homo sapiens
aaggtgagaattaagttt

SEQ ID NO: 804122 - DNA, 16 bp, Homo sapiens
aaggtgatatataatt

SEQ ID NO: 804123 - DNA, 11 bp, Homo sapiens
aaggtgcacat

SEQ ID NO: 804124 - DNA, 12 bp, Homo sapiens
aaggtgcacatt

SEQ ID NO: 804125 - DNA, 23 bp, Homo sapiens
aaggtgcacattttccacggaaa

SEQ ID NO: 804126 - DNA, 17 bp, Homo sapiens
aaggtgcatctttccct

SEQ ID NO: 804127 - DNA, 16 bp, Homo sapiens
aaggtgccagaaggaa

SEQ ID NO: 804128 - DNA, 17 bp, Homo sapiens
aaggtgccagaaggaag

SEQ ID NO: 804129 - DNA, 22 bp, Homo sapiens
aaggtgccattttaaattttat

SEQ ID NO: 804130 - DNA, 18 bp, Homo sapiens
aaggtgcctgtgaggcag

SEQ ID NO: 804131 - DNA, 14 bp, Homo sapiens
aaggtgctaacata

SEQ ID NO: 804132 - DNA, 16 bp, Homo sapiens
aaggtgcttggagttt

SEQ ID NO: 804133 - DNA, 12 bp, Homo sapiens
aaggtggaataa

SEQ ID NO: 804134 - DNA, 20 bp, Homo sapiens
aaggtggagggaaggataaa

SEQ ID NO: 804135 - DNA, 17 bp, Homo sapiens
aaggtgggccttgctac

SEQ ID NO: 804136 - DNA, 19 bp, Homo sapiens
aaggtgggctgagccctgg

SEQ ID NO: 804137 - DNA, 20 bp, Homo sapiens
aaggtgggctgagccctggc

SEQ ID NO: 804138 - DNA, 19 bp, Homo sapiens
aaggtggggccctgcccct

SEQ ID NO: 804139 - DNA, 21 bp, Homo sapiens
aaggtggggtctttgtgagag

SEQ ID NO: 804140 - DNA, 24 bp, Homo sapiens
aaggtgggtccaggaaggcagctg

SEQ ID NO: 804141 - DNA, 12 bp, Homo sapiens
aaggtgtccagg

SEQ ID NO: 804142 - DNA, 13 bp, Homo sapiens
aaggtgtggtctg

SEQ ID NO: 804143 - DNA, 21 bp, Homo sapiens
aaggtgtgtccttgaactgag

SEQ ID NO: 804144 - DNA, 20 bp, Homo sapiens
aaggttaatgttcatcatcc

SEQ ID NO: 804145 - DNA, 19 bp, Homo sapiens
aaggttactcagcagcaga

SEQ ID NO: 804146 - DNA, 22 bp, Homo sapiens
aaggttactcagcagcagagag

SEQ ID NO: 804147 - DNA, 18 bp, Homo sapiens
aaggttagagaataaatt

SEQ ID NO: 804148 - DNA, 17 bp, Homo sapiens
aaggttaggatttaaca

SEQ ID NO: 804149 - DNA, 15 bp, Homo sapiens
aaggttatcagtgct

SEQ ID NO: 804150 - DNA, 21 bp, Homo sapiens
aaggttccaactgtatatatt

SEQ ID NO: 804151 - DNA, 22 bp, Homo sapiens
aaggttccaatcagatctttat

SEQ ID NO: 804152 - DNA, 15 bp, Homo sapiens
aaggttcccaaggac

SEQ ID NO: 804153 - DNA, 16 bp, Homo sapiens
aaggttccctctgaga

SEQ ID NO: 804154 - DNA, 23 bp, Homo sapiens
aaggttccgcttggagcagaggg

SEQ ID NO: 804155 - DNA, 22 bp, Homo sapiens
aaggttcttcttgggagtatgt

SEQ ID NO: 804156 - DNA, 22 bp, Homo sapiens
aaggttgacaataaatgtgctt

SEQ ID NO: 804157 - DNA, 21 bp, Homo sapiens
aaggttgcatactgagccaag

SEQ ID NO: 804158 - DNA, 17 bp, Homo sapiens
aaggttggcgtgccctg

SEQ ID NO: 804159 - DNA, 15 bp, Homo sapiens
aaggtttaggctggt

SEQ ID NO: 804160 - DNA, 20 bp, Homo sapiens
aaggtttaggctggtggccc

SEQ ID NO: 804161 - DNA, 14 bp, Homo sapiens
aaggtttataaagc

SEQ ID NO: 804162 - DNA, 17 bp, Homo sapiens
aaggtttataaagcaga

SEQ ID NO: 804163 - DNA, 16 bp, Homo sapiens
aaggtttcctgctcca

SEQ ID NO: 804164 - DNA, 16 bp, Homo sapiens
aaggtttcgtttctgt

SEQ ID NO: 804165 - DNA, 20 bp, Homo sapiens
aaggtttctggagcagtgga

SEQ ID NO: 804166 - DNA, 20 bp, Homo sapiens
aagtctggaaaaaaacaaaa

SEQ ID NO: 804167 - DNA, 18 bp, Homo sapiens
aagtctggatctgggacc

SEQ ID NO: 804168 - DNA, 15 bp, Homo sapiens
aagtctggctttgct

SEQ ID NO: 804169 - DNA, 20 bp, Homo sapiens
aagtctgggatgtagaactt

SEQ ID NO: 804170 - DNA, 17 bp, Homo sapiens
aagtctgtatggcatga

SEQ ID NO: 804171 - DNA, 18 bp, Homo sapiens
aagtctgtccttgaagga

SEQ ID NO: 804172 - DNA, 15 bp, Homo sapiens
aagtctgtctttcct

SEQ ID NO: 804173 - DNA, 15 bp, Homo sapiens
aagtctgtctttcta

SEQ ID NO: 804174 - DNA, 21 bp, Homo sapiens
aagtctgtctttctatagaaa

SEQ ID NO: 804175 - DNA, 16 bp, Homo sapiens
aagtctgtggactgca

SEQ ID NO: 804176 - DNA, 21 bp, Homo sapiens
aagtctgttatttattattaa

SEQ ID NO: 804177 - DNA, 16 bp, Homo sapiens
aagtcttagatgtata

SEQ ID NO: 804178 - DNA, 17 bp, Homo sapiens
aagtcttagatgtatat

SEQ ID NO: 804179 - DNA, 19 bp, Homo sapiens
aagtcttagatgtatatat

SEQ ID NO: 804180 - DNA, 12 bp, Homo sapiens
aagtcttatctt

SEQ ID NO: 804181 - DNA, 14 bp, Homo sapiens
aagtcttccctcag

SEQ ID NO: 804182 - DNA, 16 bp, Homo sapiens
aagtcttccctcagat

SEQ ID NO: 804183 - DNA, 18 bp, Homo sapiens
aagtcttccctgatcaag

SEQ ID NO: 804184 - DNA, 15 bp, Homo sapiens
aagtcttttctgtca

SEQ ID NO: 804185 - DNA, 14 bp, Homo sapiens
aagtcttttgttcg

SEQ ID NO: 804186 - DNA, 18 bp, Homo sapiens
aagtcttttgttcgcatg

SEQ ID NO: 804187 - DNA, 15 bp, Homo sapiens
aagtcttttttttcc

SEQ ID NO: 804188 - DNA, 14 bp, Homo sapiens
aagtgaaaaaaaga

SEQ ID NO: 804189 - DNA, 14 bp, Homo sapiens
aagtgaaaatatag

SEQ ID NO: 804190 - DNA, 14 bp, Homo sapiens
aagtgaaaatctta

SEQ ID NO: 804191 - DNA, 23 bp, Homo sapiens
aagtgaaaatgccactctctcca

SEQ ID NO: 804192 - DNA, 11 bp, Homo sapiens
aagtgaaatta

SEQ ID NO: 804193 - DNA, 16 bp, Homo sapiens
aagtgaacactagcca

SEQ ID NO: 804194 - DNA, 15 bp, Homo sapiens
aagtgaacttttgta

SEQ ID NO: 804195 - DNA, 16 bp, Homo sapiens
aagtgaacttttgtaa

SEQ ID NO: 804196 - DNA, 22 bp, Homo sapiens
aagtgaacttttgtaatttgaa

SEQ ID NO: 804197 - DNA, 23 bp, Homo sapiens
aagtgaacttttgtaatttgaat

SEQ ID NO: 804198 - DNA, 19 bp, Homo sapiens
aagtgaagacaatgactta

SEQ ID NO: 804199 - DNA, 16 bp, Homo sapiens
aagtgaagactggaag

SEQ ID NO: 804200 - DNA, 13 bp, Homo sapiens
aagtgaagagtca

SEQ ID NO: 804201 - DNA, 11 bp, Homo sapiens
aagtgaaggaa

SEQ ID NO: 804202 - DNA, 18 bp, Homo sapiens
aagtgaaggggaaacaca

SEQ ID NO: 804203 - DNA, 10 bp, Homo sapiens
aagtgaaggt

SEQ ID NO: 804204 - DNA, 18 bp, Homo sapiens
aagtgaaggtttacaatt

SEQ ID NO: 804205 - DNA, 17 bp, Homo sapiens
aagtgaatctgattgca

SEQ ID NO: 804206 - DNA, 21 bp, Homo sapiens
aagtgaatctttctcctggtg

SEQ ID NO: 804207 - DNA, 21 bp, Homo sapiens
aagtgaattgaagtttcaagt

SEQ ID NO: 804208 - DNA, 17 bp, Homo sapiens
aagtgaatttgaatgaa

SEQ ID NO: 804209 - DNA, 19 bp, Homo sapiens
aagtgaatttgaatgaaaa

SEQ ID NO: 804210 - DNA, 17 bp, Homo sapiens
aagtgacaccaataaat

SEQ ID NO: 804211 - DNA, 20 bp, Homo sapiens
aagtgaccagggaagtgtgt

SEQ ID NO: 804212 - DNA, 21 bp, Homo sapiens
aagtgaccccagggcctgtct

SEQ ID NO: 804213 - DNA, 15 bp, Homo sapiens
aagtgactgaccatg

SEQ ID NO: 804214 - DNA, 19 bp, Homo sapiens
aagtgactgcacaagtaaa

SEQ ID NO: 804215 - DNA, 14 bp, Homo sapiens
aagtgagaggggag

SEQ ID NO: 804216 - DNA, 16 bp, Homo sapiens
aagtgagcagaacagg

SEQ ID NO: 804217 - DNA, 20 bp, Homo sapiens
aagtgagcgtgtagcgtcct

SEQ ID NO: 804218 - DNA, 17 bp, Homo sapiens
aagtgagctttgctgct

SEQ ID NO: 804219 - DNA, 11 bp, Homo sapiens
aagtgaggaag

SEQ ID NO: 804220 - DNA, 16 bp, Homo sapiens
aagtgaggcccaagga

SEQ ID NO: 804221 - DNA, 16 bp, Homo sapiens
aagtgagtttgtaaat

SEQ ID NO: 804222 - DNA, 22 bp, Homo sapiens
aagtgatatcacctctcttcag

SEQ ID NO: 804223 - DNA, 17 bp, Homo sapiens
aagtgatctgtgttcaa

SEQ ID NO: 804224 - DNA, 16 bp, Homo sapiens
aagtgatgctgtgata

SEQ ID NO: 804225 - DNA, 13 bp, Homo sapiens
aagtgatgtattt

SEQ ID NO: 804226 - DNA, 18 bp, Homo sapiens
aagtgatgtattttcata

SEQ ID NO: 804227 - DNA, 16 bp, Homo sapiens
aagtgattatctcttt

SEQ ID NO: 804228 - DNA, 23 bp, Homo sapiens
aagtgattctcctgcctcagcct

SEQ ID NO: 804229 - DNA, 19 bp, Homo sapiens
aagtgatttagttgtggaa

SEQ ID NO: 804230 - DNA, 17 bp, Homo sapiens
aagtgatttccacaggt

SEQ ID NO: 804231 - DNA, 14 bp, Homo sapiens
aagtgcaacatttc

SEQ ID NO: 804232 - DNA, 19 bp, Homo sapiens
aagtgcaacatttctgtat

SEQ ID NO: 804233 - DNA, 16 bp, Homo sapiens
aagtgcactttctaat

SEQ ID NO: 804234 - DNA, 17 bp, Homo sapiens
aagtgcagcccttcctc

SEQ ID NO: 804235 - DNA, 12 bp, Homo sapiens
aagtgcagtcag

SEQ ID NO: 804236 - DNA, 18 bp, Homo sapiens
aagtgcagtcagcagatg

SEQ ID NO: 804237 - DNA, 23 bp, Homo sapiens
aagtgcagtcagcagatgctgtt

SEQ ID NO: 804238 - DNA, 18 bp, Homo sapiens
aagtgcatatgaaatcct

SEQ ID NO: 804239 - DNA, 15 bp, Homo sapiens
aagtgcatttaagga

SEQ ID NO: 804240 - DNA, 17 bp, Homo sapiens
aagtgcatttaaggaga

SEQ ID NO: 804241 - DNA, 17 bp, Homo sapiens
aagtgcatttttcttat

SEQ ID NO: 804242 - DNA, 19 bp, Homo sapiens
aagtgcatttttcttattt

SEQ ID NO: 804243 - DNA, 20 bp, Homo sapiens
aagtgccactcattcctgta

SEQ ID NO: 804244 - DNA, 21 bp, Homo sapiens
aagtgccactcattcctgtag

SEQ ID NO: 804245 - DNA, 21 bp, Homo sapiens
aagtgccactgcccgagctgg

SEQ ID NO: 804246 - DNA, 22 bp, Homo sapiens
aagtgccactgcccgagctggt

SEQ ID NO: 804247 - DNA, 14 bp, Homo sapiens
aagtgccagaggtg

SEQ ID NO: 804248 - DNA, 14 bp, Homo sapiens
aagtgccagtattt

SEQ ID NO: 804249 - DNA, 16 bp, Homo sapiens
aagtgccattaacaaa

SEQ ID NO: 804250 - DNA, 19 bp, Homo sapiens
aagtgccattactactgta

SEQ ID NO: 804251 - DNA, 20 bp, Homo sapiens
aagtgccattactactgtac

SEQ ID NO: 804252 - DNA, 12 bp, Homo sapiens
aagtgcccctgc

SEQ ID NO: 804253 - DNA, 13 bp, Homo sapiens
aagtgcccctgct

SEQ ID NO: 804254 - DNA, 23 bp, Homo sapiens
aagtgcccctgctgcctccccaa

SEQ ID NO: 804255 - DNA, 15 bp, Homo sapiens
aagtgccgcaaattg

SEQ ID NO: 804256 - DNA, 19 bp, Homo sapiens
aagtgccgcaaattgtacc

SEQ ID NO: 804257 - DNA, 16 bp, Homo sapiens
aagtgcctatgcaaac

SEQ ID NO: 804258 - DNA, 14 bp, Homo sapiens
aagtgcctgagctg

SEQ ID NO: 804259 - DNA, 19 bp, Homo sapiens
aagtgcctgagctggggaa

SEQ ID NO: 804260 - DNA, 12 bp, Homo sapiens
aagtgcctgcct

SEQ ID NO: 804261 - DNA, 16 bp, Homo sapiens
aagtgcctgcttttga

SEQ ID NO: 804262 - DNA, 13 bp, Homo sapiens
aagtgcctgggaa

SEQ ID NO: 804263 - DNA, 14 bp, Homo sapiens
aagtgcctgggaag

SEQ ID NO: 804264 - DNA, 14 bp, Homo sapiens
aagtgccttctggg

SEQ ID NO: 804265 - DNA, 23 bp, Homo sapiens
aagtgcctttctgcagtttttca

SEQ ID NO: 804266 - DNA, 16 bp, Homo sapiens
aagtgcgtgccgtgtg

SEQ ID NO: 804267 - DNA, 15 bp, Homo sapiens
aagtgcgttctccca

SEQ ID NO: 804268 - DNA, 17 bp, Homo sapiens
aagtgctacctttgagt

SEQ ID NO: 804269 - DNA, 21 bp, Homo sapiens
aagtgctgagattgcagatgt

SEQ ID NO: 804270 - DNA, 13 bp, Homo sapiens
aagtgctgggatt

SEQ ID NO: 804271 - DNA, 19 bp, Homo sapiens
aagtgctgggattacaggt

SEQ ID NO: 804272 - DNA, 14 bp, Homo sapiens
aagtgctgtttatt

SEQ ID NO: 804273 - DNA, 21 bp, Homo sapiens
aagtgctgtttattaatctta

SEQ ID NO: 804274 - DNA, 18 bp, Homo sapiens
aagtgcttataatgtgtg

SEQ ID NO: 804275 - DNA, 18 bp, Homo sapiens
aagtgcttgctttttgcc

SEQ ID NO: 804276 - DNA, 18 bp, Homo sapiens
aagtggacaaattttgag

SEQ ID NO: 804277 - DNA, 22 bp, Homo sapiens
aagtggaccttaggccttcctc

SEQ ID NO: 804278 - DNA, 17 bp, Homo sapiens
aagtggagctgggaggt

SEQ ID NO: 804279 - DNA, 13 bp, Homo sapiens
aagtggatgggaa

SEQ ID NO: 804280 - DNA, 22 bp, Homo sapiens
aagtggcaatctcagatgcagt

SEQ ID NO: 804281 - DNA, 22 bp, Homo sapiens
aagtggcatgttttgtgcattt

SEQ ID NO: 804282 - DNA, 16 bp, Homo sapiens
aagtggccactggcat

SEQ ID NO: 804283 - DNA, 15 bp, Homo sapiens
aagtggccctccctc

SEQ ID NO: 804284 - DNA, 12 bp, Homo sapiens
aagtggctgctg

SEQ ID NO: 804285 - DNA, 14 bp, Homo sapiens
aagtggctgctgac

SEQ ID NO: 804286 - DNA, 13 bp, Homo sapiens
aagtggctgtccc

SEQ ID NO: 804287 - DNA, 22 bp, Homo sapiens
aagtgggcttgattctgcagta

SEQ ID NO: 804288 - DNA, 14 bp, Homo sapiens
aagtggggacagat

SEQ ID NO: 804289 - DNA, 21 bp, Homo sapiens
aataaaagcagcatctgctaa

SEQ ID NO: 804290 - DNA, 14 bp, Homo sapiens
aataaaaggaaaag

SEQ ID NO: 804291 - DNA, 21 bp, Homo sapiens
aataaaaggaagccaaagagt

SEQ ID NO: 804292 - DNA, 23 bp, Homo sapiens
aataaaagttaataacagctcct

SEQ ID NO: 804293 - DNA, 23 bp, Homo sapiens
aataaaagttcctctcccttccc

SEQ ID NO: 804294 - DNA, 13 bp, Homo sapiens
aataaaatatata

SEQ ID NO: 804295 - DNA, 20 bp, Homo sapiens
aataaaatcatgtagtttgt

SEQ ID NO: 804296 - DNA, 15 bp, Homo sapiens
aataaaatgcaaatg

SEQ ID NO: 804297 - DNA, 20 bp, Homo sapiens
aataaaatgcaaatgaatca

SEQ ID NO: 804298 - DNA, 13 bp, Homo sapiens
aataaaatgtgta

SEQ ID NO: 804299 - DNA, 14 bp, Homo sapiens
aataaaatgtgtac

SEQ ID NO: 804300 - DNA, 15 bp, Homo sapiens
aataaaatgtgtaca

SEQ ID NO: 804301 - DNA, 19 bp, Homo sapiens
aataaaatgtgtacagtga

SEQ ID NO: 804302 - DNA, 18 bp, Homo sapiens
aataaaattcaacaaaca

SEQ ID NO: 804303 - DNA, 15 bp, Homo sapiens
aataaaattcctatc

SEQ ID NO: 804304 - DNA, 14 bp, Homo sapiens
aataaaattgcact

SEQ ID NO: 804305 - DNA, 15 bp, Homo sapiens
aataaaattgcactt

SEQ ID NO: 804306 - DNA, 21 bp, Homo sapiens
aataaaatttctaagagagct

SEQ ID NO: 804307 - DNA, 11 bp, Homo sapiens
aataaaatttg

SEQ ID NO: 804308 - DNA, 17 bp, Homo sapiens
aataaaatttgttgcat

SEQ ID NO: 804309 - DNA, 18 bp, Homo sapiens
aataaacacatagattca

SEQ ID NO: 804310 - DNA, 22 bp, Homo sapiens
aataaacacatagattcacctg

SEQ ID NO: 804311 - DNA, 22 bp, Homo sapiens
aataaacagcttcatgcctttg

SEQ ID NO: 804312 - DNA, 18 bp, Homo sapiens
aataaacaggaattttat

SEQ ID NO: 804313 - DNA, 17 bp, Homo sapiens
aataaacagtgagcata

SEQ ID NO: 804314 - DNA, 13 bp, Homo sapiens
aataaacagttgt

SEQ ID NO: 804315 - DNA, 14 bp, Homo sapiens
aataaacagttgtt

SEQ ID NO: 804316 - DNA, 21 bp, Homo sapiens
aataaaccaaacccagccact

SEQ ID NO: 804317 - DNA, 17 bp, Homo sapiens
aataaacctgcactgaa

SEQ ID NO: 804318 - DNA, 20 bp, Homo sapiens
aataaacctgcactgaaacc

SEQ ID NO: 804319 - DNA, 21 bp, Homo sapiens
aataaacgtggattttaaaaa

SEQ ID NO: 804320 - DNA, 18 bp, Homo sapiens
aataaactaataattgca

SEQ ID NO: 804321 - DNA, 17 bp, Homo sapiens
aataaactactctttga

SEQ ID NO: 804322 - DNA, 18 bp, Homo sapiens
aataaactcaatgagctc

SEQ ID NO: 804323 - DNA, 19 bp, Homo sapiens
aataaactcataaaactca

SEQ ID NO: 804324 - DNA, 21 bp, Homo sapiens
aataaactcctactaaatccc

SEQ ID NO: 804325 - DNA, 22 bp, Homo sapiens
aataaactcctactaaatccct

SEQ ID NO: 804326 - DNA, 15 bp, Homo sapiens
aataaactctaaaca

SEQ ID NO: 804327 - DNA, 12 bp, Homo sapiens
aataaactgaat

SEQ ID NO: 804328 - DNA, 14 bp, Homo sapiens
aataaactgtatta

SEQ ID NO: 804329 - DNA, 20 bp, Homo sapiens
aataaacttagaggaaaatg

SEQ ID NO: 804330 - DNA, 11 bp, Homo sapiens
aataaacttct

SEQ ID NO: 804331 - DNA, 13 bp, Homo sapiens
aataaacttctta

SEQ ID NO: 804332 - DNA, 12 bp, Homo sapiens
aataaacttttt

SEQ ID NO: 804333 - DNA, 17 bp, Homo sapiens
aataaacttttttttga

SEQ ID NO: 804334 - DNA, 12 bp, Homo sapiens
aataaagaaata

SEQ ID NO: 804335 - DNA, 14 bp, Homo sapiens
aataaagaaatatt

SEQ ID NO: 804336 - DNA, 13 bp, Homo sapiens
aataaagaaattg

SEQ ID NO: 804337 - DNA, 17 bp, Homo sapiens
aataaagaaatttggta

SEQ ID NO: 804338 - DNA, 17 bp, Homo sapiens
aataaagaatgccattt

SEQ ID NO: 804339 - DNA, 11 bp, Homo sapiens
aataaagacag

SEQ ID NO: 804340 - DNA, 12 bp, Homo sapiens
aataaagacagg

SEQ ID NO: 804341 - DNA, 15 bp, Homo sapiens
aataaagatgagttg

SEQ ID NO: 804342 - DNA, 14 bp, Homo sapiens
aataaagcagcgtt

SEQ ID NO: 804343 - DNA, 11 bp, Homo sapiens
aataaagccct

SEQ ID NO: 804344 - DNA, 16 bp, Homo sapiens
aataaagccttttaaa

SEQ ID NO: 804345 - DNA, 22 bp, Homo sapiens
aataaaggactgtaatcttatt

SEQ ID NO: 804346 - DNA, 10 bp, Homo sapiens
aataaaggca

SEQ ID NO: 804347 - DNA, 12 bp, Homo sapiens
aataaaggcagc

SEQ ID NO: 804348 - DNA, 13 bp, Homo sapiens
aataaaggcagct

SEQ ID NO: 804349 - DNA, 14 bp, Homo sapiens
aataaaggcagctg

SEQ ID NO: 804350 - DNA, 19 bp, Homo sapiens
aataaaggcagctgcctct

SEQ ID NO: 804351 - DNA, 20 bp, Homo sapiens
aataaaggcagctgcctctg

SEQ ID NO: 804352 - DNA, 23 bp, Homo sapiens
aataaagggagaatggtgctgtt

SEQ ID NO: 804353 - DNA, 15 bp, Homo sapiens
aataaaggtaaaatc

SEQ ID NO: 804354 - DNA, 16 bp, Homo sapiens
aataaaggtaaaatca

SEQ ID NO: 804355 - DNA, 18 bp, Homo sapiens
aataaaggtaaaatcact

SEQ ID NO: 804356 - DNA, 19 bp, Homo sapiens
aataaaggtaaaatcactt

SEQ ID NO: 804357 - DNA, 19 bp, Homo sapiens
aataaaggtatgaaagggt

SEQ ID NO: 804358 - DNA, 14 bp, Homo sapiens
aataaagtaattat

SEQ ID NO: 804359 - DNA, 17 bp, Homo sapiens
aataaagtagcaaaaca

SEQ ID NO: 804360 - DNA, 23 bp, Homo sapiens
aataaagtagcaaaacaaattca

SEQ ID NO: 804361 - DNA, 11 bp, Homo sapiens
aataaagtatc

SEQ ID NO: 804362 - DNA, 16 bp, Homo sapiens
aataaagtatcatgca

SEQ ID NO: 804363 - DNA, 15 bp, Homo sapiens
aataaagtattccac

SEQ ID NO: 804364 - DNA, 19 bp, Homo sapiens
aataaagtattccacctta

SEQ ID NO: 804365 - DNA, 20 bp, Homo sapiens
aataaagtattccaccttaa

SEQ ID NO: 804366 - DNA, 17 bp, Homo sapiens
aataaagtcagatggaa

SEQ ID NO: 804367 - DNA, 13 bp, Homo sapiens
aataaagtggaaa

SEQ ID NO: 804368 - DNA, 15 bp, Homo sapiens
aataaagtgtaacaa

SEQ ID NO: 804369 - DNA, 19 bp, Homo sapiens
aataaagttctgagtgttt

SEQ ID NO: 804370 - DNA, 18 bp, Homo sapiens
aataaagttctgttttct

SEQ ID NO: 804371 - DNA, 20 bp, Homo sapiens
aataaagttctgttttctgt

SEQ ID NO: 804372 - DNA, 13 bp, Homo sapiens
aataaagtttatt

SEQ ID NO: 804373 - DNA, 16 bp, Homo sapiens
aataaataattttcat

SEQ ID NO: 804374 - DNA, 12 bp, Homo sapiens
aataaatatata

SEQ ID NO: 804375 - DNA, 13 bp, Homo sapiens
aataaatatatat

SEQ ID NO: 804376 - DNA, 16 bp, Homo sapiens
aataaatatatataaa

SEQ ID NO: 804377 - DNA, 12 bp, Homo sapiens
aataaatatgta

SEQ ID NO: 804378 - DNA, 15 bp, Homo sapiens
aataaatatgtaata

SEQ ID NO: 804379 - DNA, 16 bp, Homo sapiens
aataaatcataaaact

SEQ ID NO: 804380 - DNA, 16 bp, Homo sapiens
aataaatctaggatgt

SEQ ID NO: 804381 - DNA, 15 bp, Homo sapiens
aataaatgccctctt

SEQ ID NO: 804382 - DNA, 20 bp, Homo sapiens
aataaatggccagtgctgct

SEQ ID NO: 804383 - DNA, 23 bp, Homo sapiens
aataaatggccagtgctgcttct

SEQ ID NO: 804384 - DNA, 20 bp, Homo sapiens
aataaatgtatcatttttgt

SEQ ID NO: 804385 - DNA, 21 bp, Homo sapiens
aataaatgtttgttatttaca

SEQ ID NO: 804386 - DNA, 16 bp, Homo sapiens
aataaattatggcatt

SEQ ID NO: 804387 - DNA, 16 bp, Homo sapiens
aataaattcaaaacct

SEQ ID NO: 804388 - DNA, 23 bp, Homo sapiens
aataaattcaaaacctgcagtta

SEQ ID NO: 804389 - DNA, 14 bp, Homo sapiens
aataaattcagata

SEQ ID NO: 804390 - DNA, 21 bp, Homo sapiens
aataaattcctacaacttaat

SEQ ID NO: 804391 - DNA, 20 bp, Homo sapiens
aataaattctacctccttgt

SEQ ID NO: 804392 - DNA, 23 bp, Homo sapiens
aataaattgaataggtagtatca

SEQ ID NO: 804393 - DNA, 14 bp, Homo sapiens
aataaattgatttg

SEQ ID NO: 804394 - DNA, 15 bp, Homo sapiens
aataaattgatttgt

SEQ ID NO: 804395 - DNA, 19 bp, Homo sapiens
aataaattgctaatgttgc

SEQ ID NO: 804396 - DNA, 16 bp, Homo sapiens
aataaattgctccttg

SEQ ID NO: 804397 - DNA, 21 bp, Homo sapiens
aataaattgcttactgatatt

SEQ ID NO: 804398 - DNA, 17 bp, Homo sapiens
aataaattggaaatgtg

SEQ ID NO: 804399 - DNA, 13 bp, Homo sapiens
aataaatttaact

SEQ ID NO: 804400 - DNA, 15 bp, Homo sapiens
aataaatttatatga

SEQ ID NO: 804401 - DNA, 18 bp, Homo sapiens
aataaatttatatgaaaa

SEQ ID NO: 804402 - DNA, 12 bp, Homo sapiens
aataaatttctg

SEQ ID NO: 804403 - DNA, 13 bp, Homo sapiens
aataaatttctgg

SEQ ID NO: 804404 - DNA, 21 bp, Homo sapiens
aataaatttctgggatattta

SEQ ID NO: 804405 - DNA, 22 bp, Homo sapiens
aataaatttctgggatatttaa

SEQ ID NO: 804406 - DNA, 23 bp, Homo sapiens
aataaatttctgggatatttaac

SEQ ID NO: 804407 - DNA, 13 bp, Homo sapiens
aataaatttgact

SEQ ID NO: 804408 - DNA, 20 bp, Homo sapiens
aataaatttgacttttctgt

SEQ ID NO: 804409 - DNA, 18 bp, Homo sapiens
aataaatttggttctaat

SEQ ID NO: 804410 - DNA, 22 bp, Homo sapiens
aataaattttcaaatccttatt

SEQ ID NO: 804411 - DNA, 22 bp, Homo sapiens
aataaattttttataaaagtgt

SEQ ID NO: 804412 - DNA, 13 bp, Homo sapiens
aatagaaaactga

SEQ ID NO: 804413 - DNA, 15 bp, Homo sapiens
aatagaaaagttatt

SEQ ID NO: 804414 - DNA, 21 bp, Homo sapiens
aatagaaactcaccatgtaaa

SEQ ID NO: 804415 - DNA, 11 bp, Homo sapiens
aatagaaagaa

SEQ ID NO: 804416 - DNA, 22 bp, Homo sapiens
aatagaaataaaggatgtgatt

SEQ ID NO: 804417 - DNA, 14 bp, Homo sapiens
aatagaaataaatt

SEQ ID NO: 804418 - DNA, 16 bp, Homo sapiens
aatagaaataagtggt

SEQ ID NO: 804419 - DNA, 17 bp, Homo sapiens
aatagaaattttgtaag

SEQ ID NO: 804420 - DNA, 17 bp, Homo sapiens
aatagaacaaggctgag

SEQ ID NO: 804421 - DNA, 16 bp, Homo sapiens
aatagaacactgcctc

SEQ ID NO: 804422 - DNA, 15 bp, Homo sapiens
aatagaagaacatcc

SEQ ID NO: 804423 - DNA, 22 bp, Homo sapiens
aatagaagcccaaattcatata

SEQ ID NO: 804424 - DNA, 22 bp, Homo sapiens
aatagaaggatgtacatttcca

SEQ ID NO: 804425 - DNA, 15 bp, Homo sapiens
aatagaataaaggca

SEQ ID NO: 804426 - DNA, 13 bp, Homo sapiens
aatagaatgataa

SEQ ID NO: 804427 - DNA, 22 bp, Homo sapiens
aatagaattgacattgaaatct

SEQ ID NO: 804428 - DNA, 14 bp, Homo sapiens
aatagacaaataga

SEQ ID NO: 804429 - DNA, 19 bp, Homo sapiens
aatagacaaatagaaaatg

SEQ ID NO: 804430 - DNA, 22 bp, Homo sapiens
aatagacaaatagaaaatggtc

SEQ ID NO: 804431 - DNA, 20 bp, Homo sapiens
aatagacacatcaaatgccc

SEQ ID NO: 804432 - DNA, 15 bp, Homo sapiens
aatagacttctctta

SEQ ID NO: 804433 - DNA, 21 bp, Homo sapiens
aatagacttctcttacatttt

SEQ ID NO: 804434 - DNA, 15 bp, Homo sapiens
aatagagagagaggt

SEQ ID NO: 804435 - DNA, 16 bp, Homo sapiens
aatagagatgaatcag

SEQ ID NO: 804436 - DNA, 22 bp, Homo sapiens
aatagagccaactgattttgta

SEQ ID NO: 804437 - DNA, 16 bp, Homo sapiens
aatagagctgccactg

SEQ ID NO: 804438 - DNA, 12 bp, Homo sapiens
aatagaggaaga

SEQ ID NO: 804439 - DNA, 18 bp, Homo sapiens
aatagatatgaaagctga

SEQ ID NO: 804440 - DNA, 19 bp, Homo sapiens
aatagatatgaaagctgat

SEQ ID NO: 804441 - DNA, 16 bp, Homo sapiens
aatagatgctgactgt

SEQ ID NO: 804442 - DNA, 15 bp, Homo sapiens
aatagatgtcttcat

SEQ ID NO: 804443 - DNA, 11 bp, Homo sapiens
aatagatgttt

SEQ ID NO: 804444 - DNA, 19 bp, Homo sapiens
aatagatgtttgatagatt

SEQ ID NO: 804445 - DNA, 22 bp, Homo sapiens
aatagatgtttgatagattttc

SEQ ID NO: 804446 - DNA, 14 bp, Homo sapiens
aatagattaggttt

SEQ ID NO: 804447 - DNA, 18 bp, Homo sapiens
aatagatttaggagcaga

SEQ ID NO: 804448 - DNA, 20 bp, Homo sapiens
aatagatttaggagcagaaa

SEQ ID NO: 804449 - DNA, 13 bp, Homo sapiens
aatagatttttga

SEQ ID NO: 804450 - DNA, 16 bp, Homo sapiens
aatagatttttgattc

SEQ ID NO: 804451 - DNA, 20 bp, Homo sapiens
aatagatttttgattcagct

SEQ ID NO: 804452 - DNA, 16 bp, Homo sapiens
aatagcaaaagaagaa

SEQ ID NO: 804453 - DNA, 18 bp, Homo sapiens
aatagcaaagaattgact

SEQ ID NO: 804454 - DNA, 13 bp, Homo sapiens
aatagcaactttt

SEQ ID NO: 804455 - DNA, 15 bp, Homo sapiens
aatagcaacttttgt

SEQ ID NO: 804456 - DNA, 13 bp, Homo sapiens
aatagcactaacc

SEQ ID NO: 804457 - DNA, 16 bp, Homo sapiens
aatagcacttaaattc

SEQ ID NO: 804458 - DNA, 15 bp, Homo sapiens
aatagcatactgtgt

SEQ ID NO: 804459 - DNA, 17 bp, Homo sapiens
aatagcatactgtgtat

SEQ ID NO: 804460 - DNA, 21 bp, Homo sapiens
aatagccaaaaaggcaaataa

SEQ ID NO: 804461 - DNA, 22 bp, Homo sapiens
aatagccacatttggaatactt

SEQ ID NO: 804462 - DNA, 23 bp, Homo sapiens
aatagccactaaccttgcctggt

SEQ ID NO: 804463 - DNA, 22 bp, Homo sapiens
aatagccagagaggagcacctg

SEQ ID NO: 804464 - DNA, 12 bp, Homo sapiens
aatagccccaga

SEQ ID NO: 804465 - DNA, 17 bp, Homo sapiens
aatagccctccccctca

SEQ ID NO: 804466 - DNA, 15 bp, Homo sapiens
aatagcctaaatgat

SEQ ID NO: 804467 - DNA, 18 bp, Homo sapiens
aatagctatatccatgta

SEQ ID NO: 804468 - DNA, 14 bp, Homo sapiens
aatagctctgtgtg

SEQ ID NO: 804469 - DNA, 21 bp, Homo sapiens
aatagctgttttgtgtatatt

SEQ ID NO: 804470 - DNA, 18 bp, Homo sapiens
aatagcttccaataaagc

SEQ ID NO: 804471 - DNA, 14 bp, Homo sapiens
aatagcttgtatag

SEQ ID NO: 804472 - DNA, 15 bp, Homo sapiens
aatagctttaatgat

SEQ ID NO: 804473 - DNA, 16 bp, Homo sapiens
aatagctttaatgata

SEQ ID NO: 804474 - DNA, 17 bp, Homo sapiens
aatagctttactgtttc

SEQ ID NO: 804475 - DNA, 18 bp, Homo sapiens
aatagctttactgtttct

SEQ ID NO: 804476 - DNA, 17 bp, Homo sapiens
aatagcttttattgtat

SEQ ID NO: 804477 - DNA, 19 bp, Homo sapiens
aataggaatcaccctccta

SEQ ID NO: 804478 - DNA, 11 bp, Homo sapiens
aataggaattc

SEQ ID NO: 804479 - DNA, 16 bp, Homo sapiens
aataggaattggtttc

SEQ ID NO: 804480 - DNA, 15 bp, Homo sapiens
aataggatcctggag

SEQ ID NO: 804481 - DNA, 14 bp, Homo sapiens
aataggcactttaa

SEQ ID NO: 804482 - DNA, 15 bp, Homo sapiens
aataggcattttaag

SEQ ID NO: 804483 - DNA, 20 bp, Homo sapiens
aataggctattaaaaaagtc

SEQ ID NO: 804484 - DNA, 21 bp, Homo sapiens
aataggctattaaaaaagtct

SEQ ID NO: 804485 - DNA, 21 bp, Homo sapiens
aatagggaagtaaaaaaacaa

SEQ ID NO: 804486 - DNA, 15 bp, Homo sapiens
aataggggatattta

SEQ ID NO: 804487 - DNA, 19 bp, Homo sapiens
aataggtagagtcattcat

SEQ ID NO: 804488 - DNA, 15 bp, Homo sapiens
aataggtagtttgga

SEQ ID NO: 804489 - DNA, 17 bp, Homo sapiens
aataggtagtttggata

SEQ ID NO: 804490 - DNA, 14 bp, Homo sapiens
aataggtcagataa

SEQ ID NO: 804491 - DNA, 19 bp, Homo sapiens
aataggtgtgatttcctaa

SEQ ID NO: 804492 - DNA, 18 bp, Homo sapiens
aataggttaaactgaagc

SEQ ID NO: 804493 - DNA, 16 bp, Homo sapiens
aatagtaatttgtaaa

SEQ ID NO: 804494 - DNA, 21 bp, Homo sapiens
aatagtaatttgtaaagttgg

SEQ ID NO: 804495 - DNA, 14 bp, Homo sapiens
aatagtatgaaaat

SEQ ID NO: 804496 - DNA, 13 bp, Homo sapiens
aatagtattgctg

SEQ ID NO: 804497 - DNA, 13 bp, Homo sapiens
aatagtatttatg

SEQ ID NO: 804498 - DNA, 18 bp, Homo sapiens
aatagtatttatgaaatg

SEQ ID NO: 804499 - DNA, 15 bp, Homo sapiens
aatagtatttcccat

SEQ ID NO: 804500 - DNA, 21 bp, Homo sapiens
aatagtcaccttcatgattat

SEQ ID NO: 804501 - DNA, 14 bp, Homo sapiens
aatagtcatacctg

SEQ ID NO: 804502 - DNA, 16 bp, Homo sapiens
aatagtcattccaaat

SEQ ID NO: 804503 - DNA, 14 bp, Homo sapiens
aatagtccaatatt

SEQ ID NO: 804504 - DNA, 17 bp, Homo sapiens
aatagtcggtgaagaaa

SEQ ID NO: 804505 - DNA, 15 bp, Homo sapiens
aatagtctgtgtgaa

SEQ ID NO: 804506 - DNA, 14 bp, Homo sapiens
aatagtgatttcct

SEQ ID NO: 804507 - DNA, 19 bp, Homo sapiens
aatagtgcctaaagtgctg

SEQ ID NO: 804508 - DNA, 13 bp, Homo sapiens
aatagtgcttttt

SEQ ID NO: 804509 - DNA, 17 bp, Homo sapiens
aatagtggacatggtca

SEQ ID NO: 804510 - DNA, 22 bp, Homo sapiens
aatagtggtgtgatttggggat

SEQ ID NO: 804511 - DNA, 23 bp, Homo sapiens
aatagtgtcaccaattccaccaa

SEQ ID NO: 804512 - DNA, 23 bp, Homo sapiens
aatagtgtcatcctcacagtgaa

SEQ ID NO: 804513 - DNA, 17 bp, Homo sapiens
aatagtgtgaaatatat

SEQ ID NO: 804514 - DNA, 12 bp, Homo sapiens
aatagtgtggaa

SEQ ID NO: 804515 - DNA, 15 bp, Homo sapiens
aatagtgtgttctga

SEQ ID NO: 804516 - DNA, 21 bp, Homo sapiens
aatagtgtgttctgattagaa

SEQ ID NO: 804517 - DNA, 23 bp, Homo sapiens
aatagttaagacatgatttcctt

SEQ ID NO: 804518 - DNA, 13 bp, Homo sapiens
aatagttaatata

SEQ ID NO: 804519 - DNA, 22 bp, Homo sapiens
aatagttcagtagaattaccat

SEQ ID NO: 804520 - DNA, 19 bp, Homo sapiens
aatagtttacatgtagtag

SEQ ID NO: 804521 - DNA, 15 bp, Homo sapiens
aatagtttaggaaaa

SEQ ID NO: 804522 - DNA, 16 bp, Homo sapiens
aatagtttaggaaaat

SEQ ID NO: 804523 - DNA, 12 bp, Homo sapiens
aatataaaaaat

SEQ ID NO: 804524 - DNA, 16 bp, Homo sapiens
aatataaaaaatcatg

SEQ ID NO: 804525 - DNA, 20 bp, Homo sapiens
aatataaaaaatcatgccag

SEQ ID NO: 804526 - DNA, 18 bp, Homo sapiens
aatataaaactgaaataa

SEQ ID NO: 804527 - DNA, 18 bp, Homo sapiens
aatataaaactgcgttaa

SEQ ID NO: 804528 - DNA, 21 bp, Homo sapiens
aatataaactgaaaaatgtca

SEQ ID NO: 804529 - DNA, 13 bp, Homo sapiens
aatataaactgta

SEQ ID NO: 804530 - DNA, 13 bp, Homo sapiens
aatataaatagct

SEQ ID NO: 804531 - DNA, 20 bp, Homo sapiens
aatataaatagctgaaaact

SEQ ID NO: 804532 - DNA, 17 bp, Homo sapiens
aatataaattgtacatt

SEQ ID NO: 804533 - DNA, 19 bp, Homo sapiens
aatataaattgtacatttt

SEQ ID NO: 804534 - DNA, 20 bp, Homo sapiens
aatataaccattacatgttt

SEQ ID NO: 804535 - DNA, 18 bp, Homo sapiens
aatatttactctttgcaa

SEQ ID NO: 804536 - DNA, 12 bp, Homo sapiens
aatatttagaaa

SEQ ID NO: 804537 - DNA, 13 bp, Homo sapiens
aatatttagaaaa

SEQ ID NO: 804538 - DNA, 19 bp, Homo sapiens
aatatttataaatgagcaa

SEQ ID NO: 804539 - DNA, 17 bp, Homo sapiens
aatatttatatatttat

SEQ ID NO: 804540 - DNA, 14 bp, Homo sapiens
aatatttatatttc

SEQ ID NO: 804541 - DNA, 21 bp, Homo sapiens
aatatttatgcttaaaatatg

SEQ ID NO: 804542 - DNA, 20 bp, Homo sapiens
aatatttcaggttcttcaga

SEQ ID NO: 804543 - DNA, 13 bp, Homo sapiens
aatatttccatat

SEQ ID NO: 804544 - DNA, 12 bp, Homo sapiens
aatatttcctga

SEQ ID NO: 804545 - DNA, 22 bp, Homo sapiens
aatatttcctgacttgagtgtt

SEQ ID NO: 804546 - DNA, 19 bp, Homo sapiens
aatatttccttaaactgtg

SEQ ID NO: 804547 - DNA, 21 bp, Homo sapiens
aatatttccttaaactgtgtg

SEQ ID NO: 804548 - DNA, 13 bp, Homo sapiens
aatatttctatgt

SEQ ID NO: 804549 - DNA, 16 bp, Homo sapiens
aatatttctatgtaaa

SEQ ID NO: 804550 - DNA, 18 bp, Homo sapiens
aatatttctatgtaaatt

SEQ ID NO: 804551 - DNA, 12 bp, Homo sapiens
aatatttcttca

SEQ ID NO: 804552 - DNA, 14 bp, Homo sapiens
aatatttcttcaaa

SEQ ID NO: 804553 - DNA, 22 bp, Homo sapiens
aatatttcttcacaaaggaact

SEQ ID NO: 804554 - DNA, 13 bp, Homo sapiens
aatatttgaattt

SEQ ID NO: 804555 - DNA, 23 bp, Homo sapiens
aatatttgacttgcatgaagaga

SEQ ID NO: 804556 - DNA, 13 bp, Homo sapiens
aatatttgcttta

SEQ ID NO: 804557 - DNA, 12 bp, Homo sapiens
aatatttgtaca

SEQ ID NO: 804558 - DNA, 11 bp, Homo sapiens
aatattttaaa

SEQ ID NO: 804559 - DNA, 16 bp, Homo sapiens
aatattttaaaatcag

SEQ ID NO: 804560 - DNA, 15 bp, Homo sapiens
aatattttaagaaag

SEQ ID NO: 804561 - DNA, 17 bp, Homo sapiens
aatattttaagaaagag

SEQ ID NO: 804562 - DNA, 22 bp, Homo sapiens
aatattttaagaaagagaatga

SEQ ID NO: 804563 - DNA, 15 bp, Homo sapiens
aatattttagaagct

SEQ ID NO: 804564 - DNA, 18 bp, Homo sapiens
aatattttagatgttatt

SEQ ID NO: 804565 - DNA, 22 bp, Homo sapiens
aatattttagccttaaattttt

SEQ ID NO: 804566 - DNA, 10 bp, Homo sapiens
aatattttat

SEQ ID NO: 804567 - DNA, 16 bp, Homo sapiens
aatattttatcctgta

SEQ ID NO: 804568 - DNA, 17 bp, Homo sapiens
aatattttatctttcct

SEQ ID NO: 804569 - DNA, 21 bp, Homo sapiens
aatattttatggttatgtttt

SEQ ID NO: 804570 - DNA, 17 bp, Homo sapiens
aatattttattatatat

SEQ ID NO: 804571 - DNA, 13 bp, Homo sapiens
aatattttctatt

SEQ ID NO: 804572 - DNA, 19 bp, Homo sapiens
aatattttctttaatgctt

SEQ ID NO: 804573 - DNA, 14 bp, Homo sapiens
aatattttgaatca

SEQ ID NO: 804574 - DNA, 16 bp, Homo sapiens
aatattttgaatcaat

SEQ ID NO: 804575 - DNA, 18 bp, Homo sapiens
aatattttgaatcaataa

SEQ ID NO: 804576 - DNA, 22 bp, Homo sapiens
aatattttgaatcaataatata

SEQ ID NO: 804577 - DNA, 15 bp, Homo sapiens
aatattttggaaact

SEQ ID NO: 804578 - DNA, 21 bp, Homo sapiens
aatattttggaaactgctaaa

SEQ ID NO: 804579 - DNA, 16 bp, Homo sapiens
aatattttgtctaaaa

SEQ ID NO: 804580 - DNA, 19 bp, Homo sapiens
aatattttgtctaaaatgc

SEQ ID NO: 804581 - DNA, 22 bp, Homo sapiens
aatatttttatatttcctttat

SEQ ID NO: 804582 - DNA, 22 bp, Homo sapiens
aatatttttccctccgggcagg

SEQ ID NO: 804583 - DNA, 23 bp, Homo sapiens
aatatttttggggcatcctggat

SEQ ID NO: 804584 - DNA, 20 bp, Homo sapiens
aatatttttgtatttctcta

SEQ ID NO: 804585 - DNA, 19 bp, Homo sapiens
aatattttttatatataca

SEQ ID NO: 804586 - DNA, 20 bp, Homo sapiens
aatattttttatttctaagt

SEQ ID NO: 804587 - DNA, 21 bp, Homo sapiens
aatattttttatttctaagta

SEQ ID NO: 804588 - DNA, 14 bp, Homo sapiens
aatattttttctgt

SEQ ID NO: 804589 - DNA, 17 bp, Homo sapiens
aatattttttgcaagtt

SEQ ID NO: 804590 - DNA, 18 bp, Homo sapiens
aatcaaaactctcctaca

SEQ ID NO: 804591 - DNA, 23 bp, Homo sapiens
aatcaaaagggccaaagaaccaa

SEQ ID NO: 804592 - DNA, 23 bp, Homo sapiens
aatcaaacattttgaaagtctgt

SEQ ID NO: 804593 - DNA, 13 bp, Homo sapiens
aatcaaagaaaag

SEQ ID NO: 804594 - DNA, 19 bp, Homo sapiens
aatcaaagcaagggctcca

SEQ ID NO: 804595 - DNA, 22 bp, Homo sapiens
aatcaaagtgattttagcaatt

SEQ ID NO: 804596 - DNA, 22 bp, Homo sapiens
aatcaaataaaaattctagatt

SEQ ID NO: 804597 - DNA, 12 bp, Homo sapiens
aatcaaatgaat

SEQ ID NO: 804598 - DNA, 14 bp, Homo sapiens
aatcaacagaagca

SEQ ID NO: 804599 - DNA, 15 bp, Homo sapiens
aatcaacagaagcat

SEQ ID NO: 804600 - DNA, 16 bp, Homo sapiens
aatcaacagaagcatt

SEQ ID NO: 804601 - DNA, 17 bp, Homo sapiens
aatcaacagaagtatca

SEQ ID NO: 804602 - DNA, 17 bp, Homo sapiens
aatcaacagatgatagt

SEQ ID NO: 804603 - DNA, 22 bp, Homo sapiens
aatcaactaggtatttaagact

SEQ ID NO: 804604 - DNA, 14 bp, Homo sapiens
aatcaactctaata

SEQ ID NO: 804605 - DNA, 15 bp, Homo sapiens
aatcaactttactgt

SEQ ID NO: 804606 - DNA, 16 bp, Homo sapiens
aatcaactttactgta

SEQ ID NO: 804607 - DNA, 14 bp, Homo sapiens
aatcaagagaaact

SEQ ID NO: 804608 - DNA, 15 bp, Homo sapiens
aatcaagagaaactt

SEQ ID NO: 804609 - DNA, 13 bp, Homo sapiens
aatcaagatttta

SEQ ID NO: 804610 - DNA, 18 bp, Homo sapiens
aatcaagattttagggct

SEQ ID NO: 804611 - DNA, 12 bp, Homo sapiens
aatcaaggaaag

SEQ ID NO: 804612 - DNA, 15 bp, Homo sapiens
aatcaagtaatgaat

SEQ ID NO: 804613 - DNA, 22 bp, Homo sapiens
aatcaagtacctatattgattt

SEQ ID NO: 804614 - DNA, 23 bp, Homo sapiens
aatcaagtacctatattgattta

SEQ ID NO: 804615 - DNA, 15 bp, Homo sapiens
aatcaagttgtaact

SEQ ID NO: 804616 - DNA, 23 bp, Homo sapiens
aatcaagttttaagtgaaagtga

SEQ ID NO: 804617 - DNA, 18 bp, Homo sapiens
aatcaatacactagttgt

SEQ ID NO: 804618 - DNA, 15 bp, Homo sapiens
aatcaatacagacaa

SEQ ID NO: 804619 - DNA, 18 bp, Homo sapiens
aatcaatatcccaacatt

SEQ ID NO: 804620 - DNA, 13 bp, Homo sapiens
aatcaatgaaaaa

SEQ ID NO: 804621 - DNA, 19 bp, Homo sapiens
aatcaatgaaaaatgtaat

SEQ ID NO: 804622 - DNA, 22 bp, Homo sapiens
aatcaatgcaagagtgattgca

SEQ ID NO: 804623 - DNA, 17 bp, Homo sapiens
aatcaatgtcacttaaa

SEQ ID NO: 804624 - DNA, 12 bp, Homo sapiens
aatcaatttaag

SEQ ID NO: 804625 - DNA, 14 bp, Homo sapiens
aatcacaaaaattt

SEQ ID NO: 804626 - DNA, 16 bp, Homo sapiens
aatcacagaaaattta

SEQ ID NO: 804627 - DNA, 19 bp, Homo sapiens
aatcacagaaaatttaact

SEQ ID NO: 804628 - DNA, 23 bp, Homo sapiens
aatcacagatgggtattaaactt

SEQ ID NO: 804629 - DNA, 15 bp, Homo sapiens
aatcacagctcactg

SEQ ID NO: 804630 - DNA, 20 bp, Homo sapiens
aatcacaggcttctgagcac

SEQ ID NO: 804631 - DNA, 16 bp, Homo sapiens
aatcaccctaccaact

SEQ ID NO: 804632 - DNA, 15 bp, Homo sapiens
aatcacgtaaagcta

SEQ ID NO: 804633 - DNA, 20 bp, Homo sapiens
aatcacgtaaagctagaaat

SEQ ID NO: 804634 - DNA, 20 bp, Homo sapiens
aatcacgttgctggtggttt

SEQ ID NO: 804635 - DNA, 16 bp, Homo sapiens
aatcactaaactttat

SEQ ID NO: 804636 - DNA, 17 bp, Homo sapiens
aatcactaaactttatt

SEQ ID NO: 804637 - DNA, 18 bp, Homo sapiens
aatcactaaactttattt

SEQ ID NO: 804638 - DNA, 13 bp, Homo sapiens
aatcactactgta

SEQ ID NO: 804639 - DNA, 14 bp, Homo sapiens
aatcactactgtat

SEQ ID NO: 804640 - DNA, 17 bp, Homo sapiens
aatcactactgtatgta

SEQ ID NO: 804641 - DNA, 13 bp, Homo sapiens
aatcactattctt

SEQ ID NO: 804642 - DNA, 20 bp, Homo sapiens
aatcactctaattaattgta

SEQ ID NO: 804643 - DNA, 21 bp, Homo sapiens
aatcactgttgagttctgatt

SEQ ID NO: 804644 - DNA, 23 bp, Homo sapiens
aatcactttgtctaactcagaat

SEQ ID NO: 804645 - DNA, 21 bp, Homo sapiens
aatcagaaaagctattaaagt

SEQ ID NO: 804646 - DNA, 20 bp, Homo sapiens
aatcagaaaagtaattttgt

SEQ ID NO: 804647 - DNA, 17 bp, Homo sapiens
aatcagaaagtaacaat

SEQ ID NO: 804648 - DNA, 20 bp, Homo sapiens
aatcagaagtcatcttgcta

SEQ ID NO: 804649 - DNA, 19 bp, Homo sapiens
aatcagaatgaaccctcct

SEQ ID NO: 804650 - DNA, 13 bp, Homo sapiens
aatcagaattaga

SEQ ID NO: 804651 - DNA, 17 bp, Homo sapiens
aatcagaattggcataa

SEQ ID NO: 804652 - DNA, 16 bp, Homo sapiens
aatcagagagcctaga

SEQ ID NO: 804653 - DNA, 14 bp, Homo sapiens
aatcagaggagaga

SEQ ID NO: 804654 - DNA, 19 bp, Homo sapiens
aatcagagtgtacaaattg

SEQ ID NO: 804655 - DNA, 16 bp, Homo sapiens
aatcagatagatattc

SEQ ID NO: 804656 - DNA, 15 bp, Homo sapiens
aatcagatcatttca

SEQ ID NO: 804657 - DNA, 16 bp, Homo sapiens
aatccctgccactggg

SEQ ID NO: 804658 - DNA, 22 bp, Homo sapiens
aatccctgccactgggctctgg

SEQ ID NO: 804659 - DNA, 14 bp, Homo sapiens
aatccctgcttttt

SEQ ID NO: 804660 - DNA, 22 bp, Homo sapiens
aatccctgctttttgtgttttt

SEQ ID NO: 804661 - DNA, 17 bp, Homo sapiens
aatccctgggcattgct

SEQ ID NO: 804662 - DNA, 12 bp, Homo sapiens
aatccctgttca

SEQ ID NO: 804663 - DNA, 13 bp, Homo sapiens
aatccctgtttaa

SEQ ID NO: 804664 - DNA, 14 bp, Homo sapiens
aatccctgtttaat

SEQ ID NO: 804665 - DNA, 23 bp, Homo sapiens
aatccctgtttaatatttaaaca

SEQ ID NO: 804666 - DNA, 14 bp, Homo sapiens
aatcccttaaaatt

SEQ ID NO: 804667 - DNA, 19 bp, Homo sapiens
aatccctttattaccccct

SEQ ID NO: 804668 - DNA, 13 bp, Homo sapiens
aatccctttgcac

SEQ ID NO: 804669 - DNA, 15 bp, Homo sapiens
aatcctaagacacaa

SEQ ID NO: 804670 - DNA, 16 bp, Homo sapiens
aatcctaatttctcct

SEQ ID NO: 804671 - DNA, 15 bp, Homo sapiens
aatcctacctcaaaa

SEQ ID NO: 804672 - DNA, 17 bp, Homo sapiens
aatcctacctgttttgt

SEQ ID NO: 804673 - DNA, 20 bp, Homo sapiens
aatcctaccttgcttttgct

SEQ ID NO: 804674 - DNA, 19 bp, Homo sapiens
aatcctatatctgtttgta

SEQ ID NO: 804675 - DNA, 21 bp, Homo sapiens
aatcctatatctgtttgtata

SEQ ID NO: 804676 - DNA, 20 bp, Homo sapiens
aatcctatctggggagctcc

SEQ ID NO: 804677 - DNA, 21 bp, Homo sapiens
aatcctatctggggagctcct

SEQ ID NO: 804678 - DNA, 23 bp, Homo sapiens
aatcctatctggggagctcctgg

SEQ ID NO: 804679 - DNA, 13 bp, Homo sapiens
aatcctcaaatca

SEQ ID NO: 804680 - DNA, 16 bp, Homo sapiens
aatcctcaggaaatta

SEQ ID NO: 804681 - DNA, 21 bp, Homo sapiens
aatcctcatgttactcagtgt

SEQ ID NO: 804682 - DNA, 13 bp, Homo sapiens
aatcctcctccag

SEQ ID NO: 804683 - DNA, 19 bp, Homo sapiens
aatcctcctgcctcagcct

SEQ ID NO: 804684 - DNA, 12 bp, Homo sapiens
aatcctgcctct

SEQ ID NO: 804685 - DNA, 15 bp, Homo sapiens
aatcctggaagattt

SEQ ID NO: 804686 - DNA, 21 bp, Homo sapiens
aatcctggaaggacacagtga

SEQ ID NO: 804687 - DNA, 21 bp, Homo sapiens
aatcctggagagggtattttt

SEQ ID NO: 804688 - DNA, 13 bp, Homo sapiens
aatcctggcagcc

SEQ ID NO: 804689 - DNA, 20 bp, Homo sapiens
aatcctgtcgattagactgg

SEQ ID NO: 804690 - DNA, 19 bp, Homo sapiens
aatcctgtttataatctga

SEQ ID NO: 804691 - DNA, 20 bp, Homo sapiens
aatccttcctaaacccaatg

SEQ ID NO: 804692 - DNA, 21 bp, Homo sapiens
aatccttctagtttcccacaa

SEQ ID NO: 804693 - DNA, 13 bp, Homo sapiens
aatccttgcttat

SEQ ID NO: 804694 - DNA, 18 bp, Homo sapiens
aatccttgcttatgacat

SEQ ID NO: 804695 - DNA, 22 bp, Homo sapiens
aatccttgtgacttacaatttg

SEQ ID NO: 804696 - DNA, 22 bp, Homo sapiens
aatcctttctgccccccagggc

SEQ ID NO: 804697 - DNA, 14 bp, Homo sapiens
aatcctttggaaaa

SEQ ID NO: 804698 - DNA, 20 bp, Homo sapiens
aatccttttgttttgaagct

SEQ ID NO: 804699 - DNA, 17 bp, Homo sapiens
aatcgaagtgtttatgt

SEQ ID NO: 804700 - DNA, 20 bp, Homo sapiens
aatcgagatttgggagctga

SEQ ID NO: 804701 - DNA, 19 bp, Homo sapiens
aatcgaggaaccagagcca

SEQ ID NO: 804702 - DNA, 14 bp, Homo sapiens
aatcgatgaatgta

SEQ ID NO: 804703 - DNA, 22 bp, Homo sapiens
aatcgatgaatgtaaactcggg

SEQ ID NO: 804704 - DNA, 13 bp, Homo sapiens
aatcggactgcca

SEQ ID NO: 804705 - DNA, 15 bp, Homo sapiens
aatcggactgccaaa

SEQ ID NO: 804706 - DNA, 16 bp, Homo sapiens
aatcggactgccaaat

SEQ ID NO: 804707 - DNA, 18 bp, Homo sapiens
aatcggcccacagctccc

SEQ ID NO: 804708 - DNA, 16 bp, Homo sapiens
aatcgtcaaccacttt

SEQ ID NO: 804709 - DNA, 15 bp, Homo sapiens
aatcgtgtgccatgg

SEQ ID NO: 804710 - DNA, 23 bp, Homo sapiens
aatcgtgtgccatggatctgatc

SEQ ID NO: 804711 - DNA, 17 bp, Homo sapiens
aatctaaaaaagcacta

SEQ ID NO: 804712 - DNA, 23 bp, Homo sapiens
aatctaaaatgattgtgcctctg

SEQ ID NO: 804713 - DNA, 12 bp, Homo sapiens
aatctaaaattt

SEQ ID NO: 804714 - DNA, 18 bp, Homo sapiens
aatctaaatggaaccact

SEQ ID NO: 804715 - DNA, 14 bp, Homo sapiens
aatctaacattatt

SEQ ID NO: 804716 - DNA, 15 bp, Homo sapiens
aatctaacattatta

SEQ ID NO: 804717 - DNA, 15 bp, Homo sapiens
aatctaaggccttcc

SEQ ID NO: 804718 - DNA, 20 bp, Homo sapiens
aatctaagtatatgtgagaa

SEQ ID NO: 804719 - DNA, 16 bp, Homo sapiens
aatctaatattaaaaa

SEQ ID NO: 804720 - DNA, 17 bp, Homo sapiens
aatctaatattaaaaat

SEQ ID NO: 804721 - DNA, 15 bp, Homo sapiens
aatctacccaaagga

SEQ ID NO: 804722 - DNA, 16 bp, Homo sapiens
aatctacccaaaggat

SEQ ID NO: 804723 - DNA, 18 bp, Homo sapiens
aatctagccgatggaaaa

SEQ ID NO: 804724 - DNA, 17 bp, Homo sapiens
aatctaggatgtgatga

SEQ ID NO: 804725 - DNA, 15 bp, Homo sapiens
aatctagtttacaga

SEQ ID NO: 804726 - DNA, 17 bp, Homo sapiens
aatctagtttacagaaa

SEQ ID NO: 804727 - DNA, 19 bp, Homo sapiens
aatctagtttacagaaaaa

SEQ ID NO: 804728 - DNA, 19 bp, Homo sapiens
aatctagttttttttgtaa

SEQ ID NO: 804729 - DNA, 20 bp, Homo sapiens
aatctataagtagtaaatca

SEQ ID NO: 804730 - DNA, 17 bp, Homo sapiens
aatctatattaaatgag

SEQ ID NO: 804731 - DNA, 15 bp, Homo sapiens
aatctatatttgtct

SEQ ID NO: 804732 - DNA, 19 bp, Homo sapiens
aatctatatttgtcttccg

SEQ ID NO: 804733 - DNA, 19 bp, Homo sapiens
aatctatggcttatttcta

SEQ ID NO: 804734 - DNA, 23 bp, Homo sapiens
aatctatgtcgtgttttcaagga

SEQ ID NO: 804735 - DNA, 18 bp, Homo sapiens
aatctattagattttaga

SEQ ID NO: 804736 - DNA, 23 bp, Homo sapiens
aatctattcctgtaaataagagt

SEQ ID NO: 804737 - DNA, 16 bp, Homo sapiens
aatctattgggttcat

SEQ ID NO: 804738 - DNA, 18 bp, Homo sapiens
aatctattgggttcatta

SEQ ID NO: 804739 - DNA, 19 bp, Homo sapiens
aatctattgggttcattat

SEQ ID NO: 804740 - DNA, 12 bp, Homo sapiens
aatctatttaag

SEQ ID NO: 804741 - DNA, 17 bp, Homo sapiens
aatctatttattaatat

SEQ ID NO: 804742 - DNA, 20 bp, Homo sapiens
aatctatttattaatattta

SEQ ID NO: 804743 - DNA, 21 bp, Homo sapiens
aatctatttattaatatttaa

SEQ ID NO: 804744 - DNA, 18 bp, Homo sapiens
aatctcaaaggagaaaaa

SEQ ID NO: 804745 - DNA, 13 bp, Homo sapiens
aatctcaaataac

SEQ ID NO: 804746 - DNA, 16 bp, Homo sapiens
aatctcaaataggcta

SEQ ID NO: 804747 - DNA, 15 bp, Homo sapiens
aatctcaagattcta

SEQ ID NO: 804748 - DNA, 22 bp, Homo sapiens
aatctcaccccatcccacaccc

SEQ ID NO: 804749 - DNA, 15 bp, Homo sapiens
aatctcagatactta

SEQ ID NO: 804750 - DNA, 17 bp, Homo sapiens
aatctcagcaaagctac

SEQ ID NO: 804751 - DNA, 17 bp, Homo sapiens
aatctcatccccccacc

SEQ ID NO: 804752 - DNA, 17 bp, Homo sapiens
aatctcatctcagtgaa

SEQ ID NO: 804753 - DNA, 12 bp, Homo sapiens
aatctcattccc

SEQ ID NO: 804754 - DNA, 17 bp, Homo sapiens
aatctcattgcttacaa

SEQ ID NO: 804755 - DNA, 18 bp, Homo sapiens
aatctccaaaataaaact

SEQ ID NO: 804756 - DNA, 21 bp, Homo sapiens
aatctccaagacctggtgtgc

SEQ ID NO: 804757 - DNA, 15 bp, Homo sapiens
aatctcctcttttat

SEQ ID NO: 804758 - DNA, 12 bp, Homo sapiens
aatctcctgctg

SEQ ID NO: 804759 - DNA, 18 bp, Homo sapiens
aatctctaaatcaagtat

SEQ ID NO: 804760 - DNA, 18 bp, Homo sapiens
aatctctacccctttctt

SEQ ID NO: 804761 - DNA, 19 bp, Homo sapiens
aatctctacccctttcttc

SEQ ID NO: 804762 - DNA, 20 bp, Homo sapiens
aatctctcggttccacgtcc

SEQ ID NO: 804763 - DNA, 17 bp, Homo sapiens
aatctctctctcttttt

SEQ ID NO: 804764 - DNA, 17 bp, Homo sapiens
aatctctctgcagctgc

SEQ ID NO: 804765 - DNA, 23 bp, Homo sapiens
aatctcttaatattgagaatcag

SEQ ID NO: 804766 - DNA, 13 bp, Homo sapiens
aatctcttcacta

SEQ ID NO: 804767 - DNA, 20 bp, Homo sapiens
aatctcttcactaccctgat

SEQ ID NO: 804768 - DNA, 21 bp, Homo sapiens
aatctcttcatgcttgacata

SEQ ID NO: 804769 - DNA, 18 bp, Homo sapiens
aatctcttcattattctc

SEQ ID NO: 804770 - DNA, 19 bp, Homo sapiens
aatctcttgattataaatg

SEQ ID NO: 804771 - DNA, 23 bp, Homo sapiens
aatctcttgattataaatgtttg

SEQ ID NO: 804772 - DNA, 15 bp, Homo sapiens
aatctctttcccttc

SEQ ID NO: 804773 - DNA, 14 bp, Homo sapiens
aatctgaactctca

SEQ ID NO: 804774 - DNA, 16 bp, Homo sapiens
aatctgaactctcaaa

SEQ ID NO: 804775 - DNA, 12 bp, Homo sapiens
aatctgaagaaa

SEQ ID NO: 804776 - DNA, 21 bp, Homo sapiens
aatctgaagaaagttattctt

SEQ ID NO: 804777 - DNA, 12 bp, Homo sapiens
aatctgaagata

SEQ ID NO: 804778 - DNA, 18 bp, Homo sapiens
aatctgagaaactctaca

SEQ ID NO: 804779 - DNA, 22 bp, Homo sapiens
aatggatgccttgaataataag

SEQ ID NO: 804780 - DNA, 15 bp, Homo sapiens
aatggatttcagaag

SEQ ID NO: 804781 - DNA, 15 bp, Homo sapiens
aatggcacctctgcc

SEQ ID NO: 804782 - DNA, 18 bp, Homo sapiens
aatggcagctagactgga

SEQ ID NO: 804783 - DNA, 17 bp, Homo sapiens
aatggcagttatatttt

SEQ ID NO: 804784 - DNA, 22 bp, Homo sapiens
aatggcattattaggtcttaaa

SEQ ID NO: 804785 - DNA, 18 bp, Homo sapiens
aatggcatttctctttaa

SEQ ID NO: 804786 - DNA, 19 bp, Homo sapiens
aatggccagagcctctggc

SEQ ID NO: 804787 - DNA, 17 bp, Homo sapiens
aatggccagtgctgctt

SEQ ID NO: 804788 - DNA, 19 bp, Homo sapiens
aatggccagtgctgcttct

SEQ ID NO: 804789 - DNA, 14 bp, Homo sapiens
aatggcctggaggg

SEQ ID NO: 804790 - DNA, 16 bp, Homo sapiens
aatggcgtctgctctg

SEQ ID NO: 804791 - DNA, 14 bp, Homo sapiens
aatggctaataaac

SEQ ID NO: 804792 - DNA, 19 bp, Homo sapiens
aatggctaataaactgtat

SEQ ID NO: 804793 - DNA, 18 bp, Homo sapiens
aatggctcaagtagaaaa

SEQ ID NO: 804794 - DNA, 22 bp, Homo sapiens
aatggctccttgccctcaagca

SEQ ID NO: 804795 - DNA, 17 bp, Homo sapiens
aatggctgataatttta

SEQ ID NO: 804796 - DNA, 13 bp, Homo sapiens
aatggctgcacgt

SEQ ID NO: 804797 - DNA, 12 bp, Homo sapiens
aatgggaagcag

SEQ ID NO: 804798 - DNA, 18 bp, Homo sapiens
aatgggagatggtcagtg

SEQ ID NO: 804799 - DNA, 12 bp, Homo sapiens
aatgggagctga

SEQ ID NO: 804800 - DNA, 22 bp, Homo sapiens
aatgggcagttctcccagggag

SEQ ID NO: 804801 - DNA, 19 bp, Homo sapiens
aatgggcatttattttata

SEQ ID NO: 804802 - DNA, 19 bp, Homo sapiens
aatgggccgtcccctctcc

SEQ ID NO: 804803 - DNA, 21 bp, Homo sapiens
aatgggccgtcccctctcccc

SEQ ID NO: 804804 - DNA, 22 bp, Homo sapiens
aatgggcctgcctgcctccacc

SEQ ID NO: 804805 - DNA, 21 bp, Homo sapiens
aatgggcgcccccccctcccc

SEQ ID NO: 804806 - DNA, 15 bp, Homo sapiens
aatgggctcttccaa

SEQ ID NO: 804807 - DNA, 20 bp, Homo sapiens
aatggggataataatactga

SEQ ID NO: 804808 - DNA, 23 bp, Homo sapiens
aatgggggcaggaaagccacatc

SEQ ID NO: 804809 - DNA, 20 bp, Homo sapiens
aatgggggcctcttcaaatt

SEQ ID NO: 804810 - DNA, 23 bp, Homo sapiens
aatggggggcgggccagggtggg

SEQ ID NO: 804811 - DNA, 17 bp, Homo sapiens
aatggggtcctggccat

SEQ ID NO: 804812 - DNA, 17 bp, Homo sapiens
aatgggtcttagctctt

SEQ ID NO: 804813 - DNA, 18 bp, Homo sapiens
aatgggtgtatataattt

SEQ ID NO: 804814 - DNA, 20 bp, Homo sapiens
aatgggtgtatataatttta

SEQ ID NO: 804815 - DNA, 15 bp, Homo sapiens
aatgggttacttgat

SEQ ID NO: 804816 - DNA, 16 bp, Homo sapiens
aatgggtttttccctg

SEQ ID NO: 804817 - DNA, 20 bp, Homo sapiens
aatggtaaaataaaatgcct

SEQ ID NO: 804818 - DNA, 20 bp, Homo sapiens
aatggtaacatttttcaata

SEQ ID NO: 804819 - DNA, 20 bp, Homo sapiens
aatggtactccacatatttc

SEQ ID NO: 804820 - DNA, 18 bp, Homo sapiens
aatggtactgactttgct

SEQ ID NO: 804821 - DNA, 19 bp, Homo sapiens
aatggtagcattttaaaca

SEQ ID NO: 804822 - DNA, 18 bp, Homo sapiens
aatggtagttagcaacta

SEQ ID NO: 804823 - DNA, 16 bp, Homo sapiens
aatggtatggaactct

SEQ ID NO: 804824 - DNA, 20 bp, Homo sapiens
aatggtccaattagtttcct

SEQ ID NO: 804825 - DNA, 19 bp, Homo sapiens
aatggtccaggagaaggcc

SEQ ID NO: 804826 - DNA, 17 bp, Homo sapiens
aatggtcccatccaggc

SEQ ID NO: 804827 - DNA, 19 bp, Homo sapiens
aatggtcccatccaggcag

SEQ ID NO: 804828 - DNA, 15 bp, Homo sapiens
aatggtcgcccagga

SEQ ID NO: 804829 - DNA, 16 bp, Homo sapiens
aatggtgatcactcca

SEQ ID NO: 804830 - DNA, 23 bp, Homo sapiens
aatggtgatcctctattttgtga

SEQ ID NO: 804831 - DNA, 13 bp, Homo sapiens
aatggtgcaaaaa

SEQ ID NO: 804832 - DNA, 16 bp, Homo sapiens
aatggtgccattttcg

SEQ ID NO: 804833 - DNA, 19 bp, Homo sapiens
aatggtgtagaacactaat

SEQ ID NO: 804834 - DNA, 16 bp, Homo sapiens
aatggtgtcatggctg

SEQ ID NO: 804835 - DNA, 19 bp, Homo sapiens
aatggtgttgtatgccttt

SEQ ID NO: 804836 - DNA, 17 bp, Homo sapiens
aatggtgtttttttaat

SEQ ID NO: 804837 - DNA, 14 bp, Homo sapiens
aatggttaaatttt

SEQ ID NO: 804838 - DNA, 16 bp, Homo sapiens
aatggttaaattttac

SEQ ID NO: 804839 - DNA, 23 bp, Homo sapiens
aatggttaatttttcctgcatgt

SEQ ID NO: 804840 - DNA, 22 bp, Homo sapiens
aatggttcagaattaaactttt

SEQ ID NO: 804841 - DNA, 19 bp, Homo sapiens
aatggttccatgcctgagg

SEQ ID NO: 804842 - DNA, 17 bp, Homo sapiens
aatggttgactgggttt

SEQ ID NO: 804843 - DNA, 18 bp, Homo sapiens
aatggttgatggaaaata

SEQ ID NO: 804844 - DNA, 20 bp, Homo sapiens
aatggttgatggaaaataaa

SEQ ID NO: 804845 - DNA, 23 bp, Homo sapiens
aatggttgatggaaaataaacat

SEQ ID NO: 804846 - DNA, 18 bp, Homo sapiens
aatggttgtgaaatgtaa

SEQ ID NO: 804847 - DNA, 14 bp, Homo sapiens
aatggtttattccc

SEQ ID NO: 804848 - DNA, 16 bp, Homo sapiens
aatggtttcctctgga

SEQ ID NO: 804849 - DNA, 23 bp, Homo sapiens
aatggtttggtgctttttataaa

SEQ ID NO: 804850 - DNA, 13 bp, Homo sapiens
aatggtttttaaa

SEQ ID NO: 804851 - DNA, 16 bp, Homo sapiens
aatggtttttaaattt

SEQ ID NO: 804852 - DNA, 22 bp, Homo sapiens
aatgtaaaaatccttttgaatg

SEQ ID NO: 804853 - DNA, 13 bp, Homo sapiens
aatgtaaaaatga

SEQ ID NO: 804854 - DNA, 21 bp, Homo sapiens
aatgtaaaacacatacaaaag

SEQ ID NO: 804855 - DNA, 14 bp, Homo sapiens
aatgtaaactgcca

SEQ ID NO: 804856 - DNA, 20 bp, Homo sapiens
aatgtaaagaacttaaatta

SEQ ID NO: 804857 - DNA, 21 bp, Homo sapiens
aatgtaaagaacttaaattat

SEQ ID NO: 804858 - DNA, 18 bp, Homo sapiens
aatgtaaatactcatgaa

SEQ ID NO: 804859 - DNA, 19 bp, Homo sapiens
aatgtaaatattttaaaga

SEQ ID NO: 804860 - DNA, 21 bp, Homo sapiens
aatgtaaatattttaaagaat

SEQ ID NO: 804861 - DNA, 14 bp, Homo sapiens
aatgtaaatttata

SEQ ID NO: 804862 - DNA, 16 bp, Homo sapiens
aatgtaacatcataat

SEQ ID NO: 804863 - DNA, 18 bp, Homo sapiens
aatgtaacatcataatta

SEQ ID NO: 804864 - DNA, 14 bp, Homo sapiens
aatgtaacatgaag

SEQ ID NO: 804865 - DNA, 17 bp, Homo sapiens
aatgtaacatgaagcaa

SEQ ID NO: 804866 - DNA, 22 bp, Homo sapiens
aatgtaactccagatagagaaa

SEQ ID NO: 804867 - DNA, 23 bp, Homo sapiens
aatgtaactccagatagagaaat

SEQ ID NO: 804868 - DNA, 16 bp, Homo sapiens
aatgtaacttttgtaa

SEQ ID NO: 804869 - DNA, 22 bp, Homo sapiens
aatgtaacttttgtaagacaaa

SEQ ID NO: 804870 - DNA, 13 bp, Homo sapiens
aatgtaagcaaag

SEQ ID NO: 804871 - DNA, 13 bp, Homo sapiens
aatgtaagctcta

SEQ ID NO: 804872 - DNA, 17 bp, Homo sapiens
aatgtaaggctgtgtaa

SEQ ID NO: 804873 - DNA, 15 bp, Homo sapiens
aatgtaatactggaa

SEQ ID NO: 804874 - DNA, 16 bp, Homo sapiens
aatgtaatactggaat

SEQ ID NO: 804875 - DNA, 15 bp, Homo sapiens
aatgtaatgatcata

SEQ ID NO: 804876 - DNA, 17 bp, Homo sapiens
aatgtaatgtcagactt

SEQ ID NO: 804877 - DNA, 13 bp, Homo sapiens
aatgtaattgtaa

SEQ ID NO: 804878 - DNA, 17 bp, Homo sapiens
aatgtaatttagaaact

SEQ ID NO: 804879 - DNA, 12 bp, Homo sapiens
aatgtacaatta

SEQ ID NO: 804880 - DNA, 14 bp, Homo sapiens
aatgtacaattatg

SEQ ID NO: 804881 - DNA, 22 bp, Homo sapiens
aatgtacacactggtacttaga

SEQ ID NO: 804882 - DNA, 20 bp, Homo sapiens
aatgtacactaccaaacact

SEQ ID NO: 804883 - DNA, 15 bp, Homo sapiens
aatgtacagacatat

SEQ ID NO: 804884 - DNA, 16 bp, Homo sapiens
aatgtacagagtggcc

SEQ ID NO: 804885 - DNA, 23 bp, Homo sapiens
aatgtaccgatgatactgtttct

SEQ ID NO: 804886 - DNA, 12 bp, Homo sapiens
aatgtactgaga

SEQ ID NO: 804887 - DNA, 12 bp, Homo sapiens
aatgtactgcat

SEQ ID NO: 804888 - DNA, 12 bp, Homo sapiens
aatgtactgtac

SEQ ID NO: 804889 - DNA, 14 bp, Homo sapiens
aatgtacttgtttg

SEQ ID NO: 804890 - DNA, 16 bp, Homo sapiens
aatgtacttgtttgaa

SEQ ID NO: 804891 - DNA, 15 bp, Homo sapiens
aatgtacttttggat

SEQ ID NO: 804892 - DNA, 20 bp, Homo sapiens
aatgtagaatattcagacaa

SEQ ID NO: 804893 - DNA, 14 bp, Homo sapiens
aatgtagctggttt

SEQ ID NO: 804894 - DNA, 14 bp, Homo sapiens
aatgtaggctggct

SEQ ID NO: 804895 - DNA, 22 bp, Homo sapiens
aatgtaggcttagtttgtgtgt

SEQ ID NO: 804896 - DNA, 21 bp, Homo sapiens
aatgtagggcctgcatggaga

SEQ ID NO: 804897 - DNA, 22 bp, Homo sapiens
aatgtagggcctgcatggagaa

SEQ ID NO: 804898 - DNA, 17 bp, Homo sapiens
aatgtagggttatattt

SEQ ID NO: 804899 - DNA, 22 bp, Homo sapiens
aatgtagtgaagggatgtatca

SEQ ID NO: 804900 - DNA, 22 bp, Homo sapiens
aattaactgggtaatgaaacaa

SEQ ID NO: 804901 - DNA, 15 bp, Homo sapiens
aattaactgtaaact

SEQ ID NO: 804902 - DNA, 15 bp, Homo sapiens
aattaacttgagttt

SEQ ID NO: 804903 - DNA, 12 bp, Homo sapiens
aattaactttta

SEQ ID NO: 804904 - DNA, 23 bp, Homo sapiens
aattaagaaatactcatgtgcaa

SEQ ID NO: 804905 - DNA, 12 bp, Homo sapiens
aattaagaagaa

SEQ ID NO: 804906 - DNA, 21 bp, Homo sapiens
aattaagaggatgctgggctc

SEQ ID NO: 804907 - DNA, 16 bp, Homo sapiens
aattaagcagaaacag

SEQ ID NO: 804908 - DNA, 21 bp, Homo sapiens
aattaagcattttgaaacaaa

SEQ ID NO: 804909 - DNA, 13 bp, Homo sapiens
aattaagtactat

SEQ ID NO: 804910 - DNA, 13 bp, Homo sapiens
aattaagtagaac

SEQ ID NO: 804911 - DNA, 13 bp, Homo sapiens
aattaagttactg

SEQ ID NO: 804912 - DNA, 16 bp, Homo sapiens
aattaagttgaaaaag

SEQ ID NO: 804913 - DNA, 23 bp, Homo sapiens
aattaataaaaaatggaaagaat

SEQ ID NO: 804914 - DNA, 21 bp, Homo sapiens
aattaataaatcatgttttga

SEQ ID NO: 804915 - DNA, 14 bp, Homo sapiens
aattaatacagagt

SEQ ID NO: 804916 - DNA, 14 bp, Homo sapiens
aattaatagctttt

SEQ ID NO: 804917 - DNA, 22 bp, Homo sapiens
aattaatagtttgtctatttta

SEQ ID NO: 804918 - DNA, 17 bp, Homo sapiens
aattaatatattaaaat

SEQ ID NO: 804919 - DNA, 19 bp, Homo sapiens
aattaatatattaaaattc

SEQ ID NO: 804920 - DNA, 19 bp, Homo sapiens
aattaatatccctacatgt

SEQ ID NO: 804921 - DNA, 14 bp, Homo sapiens
aattaattaaatga

SEQ ID NO: 804922 - DNA, 13 bp, Homo sapiens
aattaatttggag

SEQ ID NO: 804923 - DNA, 18 bp, Homo sapiens
aattaatttgtgaatttg

SEQ ID NO: 804924 - DNA, 14 bp, Homo sapiens
aattacaattgtca

SEQ ID NO: 804925 - DNA, 17 bp, Homo sapiens
aattacacaataaagca

SEQ ID NO: 804926 - DNA, 14 bp, Homo sapiens
aattacacccaaag

SEQ ID NO: 804927 - DNA, 19 bp, Homo sapiens
aattacagggtgactcaca

SEQ ID NO: 804928 - DNA, 14 bp, Homo sapiens
aattacataatttt

SEQ ID NO: 804929 - DNA, 13 bp, Homo sapiens
aattacatatact

SEQ ID NO: 804930 - DNA, 19 bp, Homo sapiens
aattacatatttgactctt

SEQ ID NO: 804931 - DNA, 22 bp, Homo sapiens
aattacatatttgactctttca

SEQ ID NO: 804932 - DNA, 24 bp, Homo sapiens
aattacatggaacttttctgtaat

SEQ ID NO: 804933 - DNA, 14 bp, Homo sapiens
aattacattcctaa

SEQ ID NO: 804934 - DNA, 21 bp, Homo sapiens
aattaccttagattagctctg

SEQ ID NO: 804935 - DNA, 17 bp, Homo sapiens
aattacctttaatttta

SEQ ID NO: 804936 - DNA, 22 bp, Homo sapiens
aattacgttcttacaagcttaa

SEQ ID NO: 804937 - DNA, 22 bp, Homo sapiens
aattacgtttgttattcctagt

SEQ ID NO: 804938 - DNA, 16 bp, Homo sapiens
aattactaaattgtat

SEQ ID NO: 804939 - DNA, 16 bp, Homo sapiens
aattactacaaaattt

SEQ ID NO: 804940 - DNA, 17 bp, Homo sapiens
aattactacaaaatttg

SEQ ID NO: 804941 - DNA, 18 bp, Homo sapiens
aattactatctgttgaaa

SEQ ID NO: 804942 - DNA, 20 bp, Homo sapiens
aattactatctgttgaaaag

SEQ ID NO: 804943 - DNA, 14 bp, Homo sapiens
aattactggtccaa

SEQ ID NO: 804944 - DNA, 19 bp, Homo sapiens
aattactgttttatgttga

SEQ ID NO: 804945 - DNA, 17 bp, Homo sapiens
aattacttgtgttactt

SEQ ID NO: 804946 - DNA, 23 bp, Homo sapiens
aattactttggggctaatttaac

SEQ ID NO: 804947 - DNA, 19 bp, Homo sapiens
aattagaaaaatatatgct

SEQ ID NO: 804948 - DNA, 14 bp, Homo sapiens
aattagaaaacaaa

SEQ ID NO: 804949 - DNA, 17 bp, Homo sapiens
aattagaaaattagtga

SEQ ID NO: 804950 - DNA, 18 bp, Homo sapiens
aattagaatgaatttatc

SEQ ID NO: 804951 - DNA, 15 bp, Homo sapiens
aattagactgtgatt

SEQ ID NO: 804952 - DNA, 19 bp, Homo sapiens
aattagactgtgattcaga

SEQ ID NO: 804953 - DNA, 20 bp, Homo sapiens
aattagactgtgattcagaa

SEQ ID NO: 804954 - DNA, 21 bp, Homo sapiens
aattagactgtgattcagaaa

SEQ ID NO: 804955 - DNA, 23 bp, Homo sapiens
aattagactgtgattcagaaaat

SEQ ID NO: 804956 - DNA, 23 bp, Homo sapiens
aattagataaattgtagggcttt

SEQ ID NO: 804957 - DNA, 16 bp, Homo sapiens
aattagatccattaat

SEQ ID NO: 804958 - DNA, 13 bp, Homo sapiens
aattagatggctt

SEQ ID NO: 804959 - DNA, 19 bp, Homo sapiens
aattagattatttctgtat

SEQ ID NO: 804960 - DNA, 13 bp, Homo sapiens
aattagatttctc

SEQ ID NO: 804961 - DNA, 12 bp, Homo sapiens
aattagcaattg

SEQ ID NO: 804962 - DNA, 15 bp, Homo sapiens
aattagcagaatgga

SEQ ID NO: 804963 - DNA, 15 bp, Homo sapiens
aattagcatgcaagc

SEQ ID NO: 804964 - DNA, 15 bp, Homo sapiens
aattagccaagtgtg

SEQ ID NO: 804965 - DNA, 23 bp, Homo sapiens
aattaggcaaggctatgtgatta

SEQ ID NO: 804966 - DNA, 22 bp, Homo sapiens
aattaggctgtaactactttat

SEQ ID NO: 804967 - DNA, 23 bp, Homo sapiens
aattaggctgtaactactttata

SEQ ID NO: 804968 - DNA, 18 bp, Homo sapiens
aattagtcttttgtaata

SEQ ID NO: 804969 - DNA, 13 bp, Homo sapiens
aattagtcttttt

SEQ ID NO: 804970 - DNA, 21 bp, Homo sapiens
aattagtgaccattattcaca

SEQ ID NO: 804971 - DNA, 19 bp, Homo sapiens
aattagtggtcataaaata

SEQ ID NO: 804972 - DNA, 14 bp, Homo sapiens
aattagttatatat

SEQ ID NO: 804973 - DNA, 18 bp, Homo sapiens
aattagttccagtttctc

SEQ ID NO: 804974 - DNA, 12 bp, Homo sapiens
aattagtttcct

SEQ ID NO: 804975 - DNA, 13 bp, Homo sapiens
aattagtttcctt

SEQ ID NO: 804976 - DNA, 15 bp, Homo sapiens
aattataacagttat

SEQ ID NO: 804977 - DNA, 17 bp, Homo sapiens
aattataacagttatat

SEQ ID NO: 804978 - DNA, 18 bp, Homo sapiens
aattataacagttatatt

SEQ ID NO: 804979 - DNA, 23 bp, Homo sapiens
aattataacagttatatttttgt

SEQ ID NO: 804980 - DNA, 17 bp, Homo sapiens
aattataactagacatc

SEQ ID NO: 804981 - DNA, 23 bp, Homo sapiens
aattataacttaaaatattttat

SEQ ID NO: 804982 - DNA, 12 bp, Homo sapiens
aattatactaac

SEQ ID NO: 804983 - DNA, 16 bp, Homo sapiens
aattatactgtgtgtg

SEQ ID NO: 804984 - DNA, 21 bp, Homo sapiens
aattatagaaacaatactgtt

SEQ ID NO: 804985 - DNA, 18 bp, Homo sapiens
aattatagacctctagta

SEQ ID NO: 804986 - DNA, 21 bp, Homo sapiens
aattatataggttgtgcaaat

SEQ ID NO: 804987 - DNA, 13 bp, Homo sapiens
aattatatttgtg

SEQ ID NO: 804988 - DNA, 23 bp, Homo sapiens
aattatatttgtgctatagtatt

SEQ ID NO: 804989 - DNA, 20 bp, Homo sapiens
aattatcaatatctaatata

SEQ ID NO: 804990 - DNA, 13 bp, Homo sapiens
aattatcagcaaa

SEQ ID NO: 804991 - DNA, 19 bp, Homo sapiens
aattatcagcaaagaaaaa

SEQ ID NO: 804992 - DNA, 20 bp, Homo sapiens
aattatcagcaaagaaaaaa

SEQ ID NO: 804993 - DNA, 21 bp, Homo sapiens
aattatcagcaaagaaaaaaa

SEQ ID NO: 804994 - DNA, 13 bp, Homo sapiens
aattatccaggaa

SEQ ID NO: 804995 - DNA, 20 bp, Homo sapiens
aattatccattacgtgcatt

SEQ ID NO: 804996 - DNA, 21 bp, Homo sapiens
aattatccattacgtgcattt

SEQ ID NO: 804997 - DNA, 17 bp, Homo sapiens
aattatcgggaacagtg

SEQ ID NO: 804998 - DNA, 19 bp, Homo sapiens
aattatcgggaacagtgtt

SEQ ID NO: 804999 - DNA, 20 bp, Homo sapiens
aattatcgggaacagtgttt

SEQ ID NO: 805000 - DNA, 23 bp, Homo sapiens
aattatcgggaacagtgtttccc

SEQ ID NO: 805001 - DNA, 12 bp, Homo sapiens
aattatgacagt

SEQ ID NO: 805002 - DNA, 19 bp, Homo sapiens
aattatgagttatttttat

SEQ ID NO: 805003 - DNA, 15 bp, Homo sapiens
aattatgcaaaagca

SEQ ID NO: 805004 - DNA, 16 bp, Homo sapiens
aattatggcatttcta

SEQ ID NO: 805005 - DNA, 21 bp, Homo sapiens
aattatgggagaagtgggggc

SEQ ID NO: 805006 - DNA, 19 bp, Homo sapiens
aattatgtaatatattgta

SEQ ID NO: 805007 - DNA, 20 bp, Homo sapiens
aattatgtaatatattgtac

SEQ ID NO: 805008 - DNA, 15 bp, Homo sapiens
aattatgtaatgcaa

SEQ ID NO: 805009 - DNA, 15 bp, Homo sapiens
aattatgtatgttta

SEQ ID NO: 805010 - DNA, 16 bp, Homo sapiens
aattatgtatgtttac

SEQ ID NO: 805011 - DNA, 18 bp, Homo sapiens
aattatgtatgtttacat

SEQ ID NO: 805012 - DNA, 21 bp, Homo sapiens
aattatgtatgtttacatatc

SEQ ID NO: 805013 - DNA, 13 bp, Homo sapiens
aattatgtctctt

SEQ ID NO: 805014 - DNA, 20 bp, Homo sapiens
aattatgttttcaactcagg

SEQ ID NO: 805015 - DNA, 12 bp, Homo sapiens
aattattaattg

SEQ ID NO: 805016 - DNA, 23 bp, Homo sapiens
aattattacagtgtttatccttt

SEQ ID NO: 805017 - DNA, 18 bp, Homo sapiens
aattattacatttataca

SEQ ID NO: 805018 - DNA, 21 bp, Homo sapiens
aattattagaacattcacttt

SEQ ID NO: 805019 - DNA, 21 bp, Homo sapiens
aattattattcttcataacaa

SEQ ID NO: 805020 - DNA, 16 bp, Homo sapiens
aattattatttatata

SEQ ID NO: 805021 - DNA, 12 bp, Homo sapiens
aatttcacagtt

SEQ ID NO: 805022 - DNA, 18 bp, Homo sapiens
aatttcacagttctgtaa

SEQ ID NO: 805023 - DNA, 19 bp, Homo sapiens
aatttcacctgtaaacctg

SEQ ID NO: 805024 - DNA, 18 bp, Homo sapiens
aatttcacgattcatttt

SEQ ID NO: 805025 - DNA, 22 bp, Homo sapiens
aatttcagtcaattctgatgtt

SEQ ID NO: 805026 - DNA, 13 bp, Homo sapiens
aatttcagtgtaa

SEQ ID NO: 805027 - DNA, 20 bp, Homo sapiens
aatttcataattctgaaaca

SEQ ID NO: 805028 - DNA, 21 bp, Homo sapiens
aatttcatactatttagattt

SEQ ID NO: 805029 - DNA, 18 bp, Homo sapiens
aatttcatagctgtactt

SEQ ID NO: 805030 - DNA, 18 bp, Homo sapiens
aatttcatgattggctta

SEQ ID NO: 805031 - DNA, 18 bp, Homo sapiens
aatttcatgtaaaacaga

SEQ ID NO: 805032 - DNA, 11 bp, Homo sapiens
aatttccaaaa

SEQ ID NO: 805033 - DNA, 22 bp, Homo sapiens
aatttccaaaataatctatatt

SEQ ID NO: 805034 - DNA, 15 bp, Homo sapiens
aatttccagtacctt

SEQ ID NO: 805035 - DNA, 19 bp, Homo sapiens
aatttccccctaaaccaac

SEQ ID NO: 805036 - DNA, 13 bp, Homo sapiens
aatttcctctatt

SEQ ID NO: 805037 - DNA, 15 bp, Homo sapiens
aatttcctgtttgaa

SEQ ID NO: 805038 - DNA, 18 bp, Homo sapiens
aatttccttctgttaaga

SEQ ID NO: 805039 - DNA, 22 bp, Homo sapiens
aatttccttctgttaagaaagg

SEQ ID NO: 805040 - DNA, 21 bp, Homo sapiens
aatttcctttatatttagtga

SEQ ID NO: 805041 - DNA, 20 bp, Homo sapiens
aatttcctttattattctgt

SEQ ID NO: 805042 - DNA, 19 bp, Homo sapiens
aatttcctttttgacactg

SEQ ID NO: 805043 - DNA, 21 bp, Homo sapiens
aatttcctttttgacactgaa

SEQ ID NO: 805044 - DNA, 14 bp, Homo sapiens
aatttcgccttaaa

SEQ ID NO: 805045 - DNA, 15 bp, Homo sapiens
aatttcgccttaaac

SEQ ID NO: 805046 - DNA, 15 bp, Homo sapiens
aatttctaaagtaaa

SEQ ID NO: 805047 - DNA, 18 bp, Homo sapiens
aatttctaaagtaaaatt

SEQ ID NO: 805048 - DNA, 23 bp, Homo sapiens
aatttctaaagtaaaattgaagc

SEQ ID NO: 805049 - DNA, 21 bp, Homo sapiens
aatttctaaatctccaaaata

SEQ ID NO: 805050 - DNA, 18 bp, Homo sapiens
aatttctaagaagttact

SEQ ID NO: 805051 - DNA, 14 bp, Homo sapiens
aatttctaccagat

SEQ ID NO: 805052 - DNA, 14 bp, Homo sapiens
aatttctcatgttc

SEQ ID NO: 805053 - DNA, 22 bp, Homo sapiens
aatttctcatgttccttttgaa

SEQ ID NO: 805054 - DNA, 12 bp, Homo sapiens
aatttctcctcc

SEQ ID NO: 805055 - DNA, 14 bp, Homo sapiens
aatttctgccattt

SEQ ID NO: 805056 - DNA, 17 bp, Homo sapiens
aatttctgccatttcat

SEQ ID NO: 805057 - DNA, 19 bp, Homo sapiens
aatttctgctgtggtctat

SEQ ID NO: 805058 - DNA, 13 bp, Homo sapiens
aatttctgtcctt

SEQ ID NO: 805059 - DNA, 21 bp, Homo sapiens
aatttctgtgttgccaagctc

SEQ ID NO: 805060 - DNA, 15 bp, Homo sapiens
aatttcttatgtgac

SEQ ID NO: 805061 - DNA, 18 bp, Homo sapiens
aatttcttatgtgacatt

SEQ ID NO: 805062 - DNA, 20 bp, Homo sapiens
aatttcttatgtgacattaa

SEQ ID NO: 805063 - DNA, 21 bp, Homo sapiens
aatttcttcatgtgatgtcat

SEQ ID NO: 805064 - DNA, 13 bp, Homo sapiens
aatttcttccttc

SEQ ID NO: 805065 - DNA, 21 bp, Homo sapiens
aatttcttctggtagtgtcag

SEQ ID NO: 805066 - DNA, 16 bp, Homo sapiens
aatttcttctttagat

SEQ ID NO: 805067 - DNA, 22 bp, Homo sapiens
aatttcttggcaaattttaaaa

SEQ ID NO: 805068 - DNA, 17 bp, Homo sapiens
aatttcttggtaagaag

SEQ ID NO: 805069 - DNA, 15 bp, Homo sapiens
aatttgaaaaagttc

SEQ ID NO: 805070 - DNA, 23 bp, Homo sapiens
aatttgaaaacataatctgcaaa

SEQ ID NO: 805071 - DNA, 14 bp, Homo sapiens
aatttgaaatttag

SEQ ID NO: 805072 - DNA, 16 bp, Homo sapiens
aatttgaattgggtcc

SEQ ID NO: 805073 - DNA, 16 bp, Homo sapiens
aatttgacttttctgt

SEQ ID NO: 805074 - DNA, 15 bp, Homo sapiens
aatttgagactgaaa

SEQ ID NO: 805075 - DNA, 16 bp, Homo sapiens
aatttgagactgaaat

SEQ ID NO: 805076 - DNA, 18 bp, Homo sapiens
aatttgagagaaatatga

SEQ ID NO: 805077 - DNA, 18 bp, Homo sapiens
aatttgagagttcacaga

SEQ ID NO: 805078 - DNA, 17 bp, Homo sapiens
aatttgataaaaaccca

SEQ ID NO: 805079 - DNA, 13 bp, Homo sapiens
aatttgatacata

SEQ ID NO: 805080 - DNA, 17 bp, Homo sapiens
aatttgatacataataa

SEQ ID NO: 805081 - DNA, 18 bp, Homo sapiens
aatttgatcgttccagtt

SEQ ID NO: 805082 - DNA, 17 bp, Homo sapiens
aatttgatgaaagctga

SEQ ID NO: 805083 - DNA, 13 bp, Homo sapiens
aatttgcaactca

SEQ ID NO: 805084 - DNA, 16 bp, Homo sapiens
aatttgcacagtgata

SEQ ID NO: 805085 - DNA, 18 bp, Homo sapiens
aatttgcacagtgtgtga

SEQ ID NO: 805086 - DNA, 22 bp, Homo sapiens
aatttgcacatcttggctatgt

SEQ ID NO: 805087 - DNA, 17 bp, Homo sapiens
aatttgcacctttgtct

SEQ ID NO: 805088 - DNA, 12 bp, Homo sapiens
aatttgcactga

SEQ ID NO: 805089 - DNA, 19 bp, Homo sapiens
aatttgcatattctattgt

SEQ ID NO: 805090 - DNA, 23 bp, Homo sapiens
aatttgcatattctattgtatta

SEQ ID NO: 805091 - DNA, 15 bp, Homo sapiens
aatttgcattaaatt

SEQ ID NO: 805092 - DNA, 18 bp, Homo sapiens
aatttgcattaaattcac

SEQ ID NO: 805093 - DNA, 21 bp, Homo sapiens
aatttgcattactctggtgga

SEQ ID NO: 805094 - DNA, 20 bp, Homo sapiens
aatttgcattgtgtcagaaa

SEQ ID NO: 805095 - DNA, 19 bp, Homo sapiens
aatttgccatgacatttca

SEQ ID NO: 805096 - DNA, 23 bp, Homo sapiens
aatttgccatgacatttcatctg

SEQ ID NO: 805097 - DNA, 15 bp, Homo sapiens
aatttgcctgctggg

SEQ ID NO: 805098 - DNA, 19 bp, Homo sapiens
aatttggagcacaaaattc

SEQ ID NO: 805099 - DNA, 22 bp, Homo sapiens
aatttggaggctggagtaatca

SEQ ID NO: 805100 - DNA, 12 bp, Homo sapiens
aatttggattta

SEQ ID NO: 805101 - DNA, 18 bp, Homo sapiens
aatttggcaattttgtgg

SEQ ID NO: 805102 - DNA, 17 bp, Homo sapiens
aatttggccttaagaac

SEQ ID NO: 805103 - DNA, 20 bp, Homo sapiens
aatttggccttaagaactgt

SEQ ID NO: 805104 - DNA, 16 bp, Homo sapiens
aatttgggagggtgag

SEQ ID NO: 805105 - DNA, 21 bp, Homo sapiens
aatttggtaaaaatgctgctc

SEQ ID NO: 805106 - DNA, 22 bp, Homo sapiens
aatttggtgccgatgttgaact

SEQ ID NO: 805107 - DNA, 17 bp, Homo sapiens
aatttggttctaggccg

SEQ ID NO: 805108 - DNA, 22 bp, Homo sapiens
aatttgtaaaaacagcattgct

SEQ ID NO: 805109 - DNA, 14 bp, Homo sapiens
aatttgtaaacttc

SEQ ID NO: 805110 - DNA, 22 bp, Homo sapiens
aatttgtaaacttctgaagact

SEQ ID NO: 805111 - DNA, 15 bp, Homo sapiens
aatttgtaaatgatt

SEQ ID NO: 805112 - DNA, 17 bp, Homo sapiens
aatttgtaaattgaata

SEQ ID NO: 805113 - DNA, 12 bp, Homo sapiens
aatttgtacagg

SEQ ID NO: 805114 - DNA, 22 bp, Homo sapiens
aatttgtacaggactgtaaaga

SEQ ID NO: 805115 - DNA, 20 bp, Homo sapiens
aatttgtacatatgtaaaat

SEQ ID NO: 805116 - DNA, 21 bp, Homo sapiens
aatttgtactattagcaagaa

SEQ ID NO: 805117 - DNA, 13 bp, Homo sapiens
aatttgtacttct

SEQ ID NO: 805118 - DNA, 18 bp, Homo sapiens
aatttgtacttcttattg

SEQ ID NO: 805119 - DNA, 19 bp, Homo sapiens
aatttgtattaaaaagcct

SEQ ID NO: 805120 - DNA, 20 bp, Homo sapiens
aatttgtcagcgttctacca

SEQ ID NO: 805121 - DNA, 15 bp, Homo sapiens
aatttgtccattgta

SEQ ID NO: 805122 - DNA, 18 bp, Homo sapiens
aatttgtccattgtaaat

SEQ ID NO: 805123 - DNA, 20 bp, Homo sapiens
aatttgtctcctactctgtg

SEQ ID NO: 805124 - DNA, 20 bp, Homo sapiens
aatttgtcttaaaaatttat

SEQ ID NO: 805125 - DNA, 15 bp, Homo sapiens
aatttgtgaatttgc

SEQ ID NO: 805126 - DNA, 16 bp, Homo sapiens
aatttgtgaatttgca

SEQ ID NO: 805127 - DNA, 17 bp, Homo sapiens
aatttgtgatacaatgc

SEQ ID NO: 805128 - DNA, 20 bp, Homo sapiens
aatttgtgatacaatgctgt

SEQ ID NO: 805129 - DNA, 15 bp, Homo sapiens
aatttgtgctgggtt

SEQ ID NO: 805130 - DNA, 16 bp, Homo sapiens
aatttgtgtgcttctg

SEQ ID NO: 805131 - DNA, 15 bp, Homo sapiens
aatttgttcttgtat

SEQ ID NO: 805132 - DNA, 16 bp, Homo sapiens
aatttgttcttgtatt

SEQ ID NO: 805133 - DNA, 21 bp, Homo sapiens
aatttgttcttgtatttattg

SEQ ID NO: 805134 - DNA, 21 bp, Homo sapiens
aatttgttggggctttacata

SEQ ID NO: 805135 - DNA, 14 bp, Homo sapiens
aatttgtttaaaga

SEQ ID NO: 805136 - DNA, 20 bp, Homo sapiens
aatttgtttaaagaataaag

SEQ ID NO: 805137 - DNA, 17 bp, Homo sapiens
aatttgtttgtattttt

SEQ ID NO: 805138 - DNA, 17 bp, Homo sapiens
aatttgttttggatata

SEQ ID NO: 805139 - DNA, 17 bp, Homo sapiens
aatttgttttgttttaa

SEQ ID NO: 805140 - DNA, 16 bp, Homo sapiens
aatttgtttttgcatt

SEQ ID NO: 805141 - DNA, 17 bp, Homo sapiens
aatttgtttttgcattt

SEQ ID NO: 805142 - DNA, 20 bp, Homo sapiens
acaactgctgtggccccctg

SEQ ID NO: 805143 - DNA, 11 bp, Homo sapiens
acaactgtgac

SEQ ID NO: 805144 - DNA, 13 bp, Homo sapiens
acaactgtgactg

SEQ ID NO: 805145 - DNA, 13 bp, Homo sapiens
acaacttaagttg

SEQ ID NO: 805146 - DNA, 14 bp, Homo sapiens
acaacttagctcag

SEQ ID NO: 805147 - DNA, 21 bp, Homo sapiens
acaacttagctcaggtgcctt

SEQ ID NO: 805148 - DNA, 23 bp, Homo sapiens
acaacttatttaaaaatatttca

SEQ ID NO: 805149 - DNA, 14 bp, Homo sapiens
acaacttcagcagt

SEQ ID NO: 805150 - DNA, 21 bp, Homo sapiens
acaacttctgtttcttctctt

SEQ ID NO: 805151 - DNA, 16 bp, Homo sapiens
acaacttgaagattgt

SEQ ID NO: 805152 - DNA, 17 bp, Homo sapiens
acaacttgattttttca

SEQ ID NO: 805153 - DNA, 15 bp, Homo sapiens
acaacttgctactta

SEQ ID NO: 805154 - DNA, 18 bp, Homo sapiens
acaacttggcatttctat

SEQ ID NO: 805155 - DNA, 21 bp, Homo sapiens
acaactttaccataaagcctt

SEQ ID NO: 805156 - DNA, 23 bp, Homo sapiens
acaactttaccataaagccttta

SEQ ID NO: 805157 - DNA, 14 bp, Homo sapiens
acaactttcagtgg

SEQ ID NO: 805158 - DNA, 16 bp, Homo sapiens
acaacttttgttttct

SEQ ID NO: 805159 - DNA, 16 bp, Homo sapiens
acaagaaaaaatgaat

SEQ ID NO: 805160 - DNA, 15 bp, Homo sapiens
acaagaaagtggtct

SEQ ID NO: 805161 - DNA, 16 bp, Homo sapiens
acaagaaatccctgtt

SEQ ID NO: 805162 - DNA, 19 bp, Homo sapiens
acaagaacacacacatata

SEQ ID NO: 805163 - DNA, 15 bp, Homo sapiens
acaagaactgaaacc

SEQ ID NO: 805164 - DNA, 17 bp, Homo sapiens
acaagaagaaatatgaa

SEQ ID NO: 805165 - DNA, 19 bp, Homo sapiens
acaagaagaatttgaagac

SEQ ID NO: 805166 - DNA, 17 bp, Homo sapiens
acaagaataattttgga

SEQ ID NO: 805167 - DNA, 12 bp, Homo sapiens
acaagaatctag

SEQ ID NO: 805168 - DNA, 23 bp, Homo sapiens
acaagaatgcattccctgaatct

SEQ ID NO: 805169 - DNA, 13 bp, Homo sapiens
acaagacacagtg

SEQ ID NO: 805170 - DNA, 16 bp, Homo sapiens
acaagaccacgtttct

SEQ ID NO: 805171 - DNA, 18 bp, Homo sapiens
acaagaccacgtttctaa

SEQ ID NO: 805172 - DNA, 15 bp, Homo sapiens
acaagacccccagca

SEQ ID NO: 805173 - DNA, 16 bp, Homo sapiens
acaagactgccaggtg

SEQ ID NO: 805174 - DNA, 13 bp, Homo sapiens
acaagactgcctc

SEQ ID NO: 805175 - DNA, 14 bp, Homo sapiens
acaagactgcctcc

SEQ ID NO: 805176 - DNA, 15 bp, Homo sapiens
acaagactgcctccc

SEQ ID NO: 805177 - DNA, 14 bp, Homo sapiens
acaagacttcagta

SEQ ID NO: 805178 - DNA, 17 bp, Homo sapiens
acaagacttcagtatgt

SEQ ID NO: 805179 - DNA, 14 bp, Homo sapiens
acaagagcagcctg

SEQ ID NO: 805180 - DNA, 20 bp, Homo sapiens
acaagagcccagcagggcct

SEQ ID NO: 805181 - DNA, 16 bp, Homo sapiens
acaagagcgaaactcc

SEQ ID NO: 805182 - DNA, 17 bp, Homo sapiens
acaagagctgctgtcct

SEQ ID NO: 805183 - DNA, 20 bp, Homo sapiens
acaagaggaagagagagacc

SEQ ID NO: 805184 - DNA, 15 bp, Homo sapiens
acaagaggacacaat

SEQ ID NO: 805185 - DNA, 13 bp, Homo sapiens
acaagagtgaatt

SEQ ID NO: 805186 - DNA, 17 bp, Homo sapiens
acaagatattgatgata

SEQ ID NO: 805187 - DNA, 19 bp, Homo sapiens
acaagatattgtacataaa

SEQ ID NO: 805188 - DNA, 22 bp, Homo sapiens
acaagatattgtacataaaaga

SEQ ID NO: 805189 - DNA, 21 bp, Homo sapiens
acaagatggcgaccaccaaag

SEQ ID NO: 805190 - DNA, 14 bp, Homo sapiens
acaagatggtccat

SEQ ID NO: 805191 - DNA, 23 bp, Homo sapiens
acaagatggtccatttgttcctg

SEQ ID NO: 805192 - DNA, 14 bp, Homo sapiens
acaagattcccaga

SEQ ID NO: 805193 - DNA, 18 bp, Homo sapiens
acaagattcccagagaca

SEQ ID NO: 805194 - DNA, 16 bp, Homo sapiens
acaagatttagaaaaa

SEQ ID NO: 805195 - DNA, 21 bp, Homo sapiens
acaagattttttaattgttta

SEQ ID NO: 805196 - DNA, 17 bp, Homo sapiens
acaagcacgaggcctca

SEQ ID NO: 805197 - DNA, 15 bp, Homo sapiens
acaagcactatttta

SEQ ID NO: 805198 - DNA, 17 bp, Homo sapiens
acaagcactattttata

SEQ ID NO: 805199 - DNA, 14 bp, Homo sapiens
acaagcagtccctt

SEQ ID NO: 805200 - DNA, 18 bp, Homo sapiens
acaagcagtgtctgtcag

SEQ ID NO: 805201 - DNA, 15 bp, Homo sapiens
acaagcatgtctctc

SEQ ID NO: 805202 - DNA, 22 bp, Homo sapiens
acaagccaaaagtccctccctg

SEQ ID NO: 805203 - DNA, 14 bp, Homo sapiens
acaagccaaagagc

SEQ ID NO: 805204 - DNA, 12 bp, Homo sapiens
acaagccaagaa

SEQ ID NO: 805205 - DNA, 17 bp, Homo sapiens
acaagccccaggcaggc

SEQ ID NO: 805206 - DNA, 19 bp, Homo sapiens
acaagccccaggcaggctg

SEQ ID NO: 805207 - DNA, 14 bp, Homo sapiens
acaagccccccctt

SEQ ID NO: 805208 - DNA, 11 bp, Homo sapiens
acaagccctgg

SEQ ID NO: 805209 - DNA, 13 bp, Homo sapiens
acaagccctggca

SEQ ID NO: 805210 - DNA, 14 bp, Homo sapiens
acaagcctcctgta

SEQ ID NO: 805211 - DNA, 21 bp, Homo sapiens
acaagcctcctgtacctcagt

SEQ ID NO: 805212 - DNA, 13 bp, Homo sapiens
acaagccttaatc

SEQ ID NO: 805213 - DNA, 22 bp, Homo sapiens
acaagctctcgggactagctgc

SEQ ID NO: 805214 - DNA, 14 bp, Homo sapiens
acaagctgcactgt

SEQ ID NO: 805215 - DNA, 18 bp, Homo sapiens
acaagctgcactgtgaac

SEQ ID NO: 805216 - DNA, 19 bp, Homo sapiens
acaagctgcactgtgaacc

SEQ ID NO: 805217 - DNA, 13 bp, Homo sapiens
acaagctgcctct

SEQ ID NO: 805218 - DNA, 14 bp, Homo sapiens
acaagctgcctctg

SEQ ID NO: 805219 - DNA, 16 bp, Homo sapiens
acaagctggaagcaca

SEQ ID NO: 805220 - DNA, 18 bp, Homo sapiens
acaagctggaagcacatg

SEQ ID NO: 805221 - DNA, 23 bp, Homo sapiens
acaaggaaaatctatatttgtct

SEQ ID NO: 805222 - DNA, 21 bp, Homo sapiens
acaaggaagtcaaagcaagga

SEQ ID NO: 805223 - DNA, 23 bp, Homo sapiens
acaaggaataaatgagagggaat

SEQ ID NO: 805224 - DNA, 11 bp, Homo sapiens
acaaggaatgc

SEQ ID NO: 805225 - DNA, 16 bp, Homo sapiens
acaaggaatgcctgtg

SEQ ID NO: 805226 - DNA, 18 bp, Homo sapiens
acaaggaatgcctgtgcc

SEQ ID NO: 805227 - DNA, 20 bp, Homo sapiens
acaaggaatttccctgtgtg

SEQ ID NO: 805228 - DNA, 17 bp, Homo sapiens
acaaggacattcactgc

SEQ ID NO: 805229 - DNA, 20 bp, Homo sapiens
acaaggagctcaccctgccc

SEQ ID NO: 805230 - DNA, 13 bp, Homo sapiens
acaaggagtgccc

SEQ ID NO: 805231 - DNA, 18 bp, Homo sapiens
acaaggccatctgggctc

SEQ ID NO: 805232 - DNA, 11 bp, Homo sapiens
acaaggcccca

SEQ ID NO: 805233 - DNA, 17 bp, Homo sapiens
acaaggccccagagact

SEQ ID NO: 805234 - DNA, 18 bp, Homo sapiens
acaaggctgaccaagaga

SEQ ID NO: 805235 - DNA, 17 bp, Homo sapiens
acaagggtctagggaga

SEQ ID NO: 805236 - DNA, 14 bp, Homo sapiens
acaaggtaattgtt

SEQ ID NO: 805237 - DNA, 21 bp, Homo sapiens
acaaggtaggctgcaaaatta

SEQ ID NO: 805238 - DNA, 14 bp, Homo sapiens
acaaggtagttttt

SEQ ID NO: 805239 - DNA, 20 bp, Homo sapiens
acaaggtccactccctgctc

SEQ ID NO: 805240 - DNA, 11 bp, Homo sapiens
acaaggtcccc

SEQ ID NO: 805241 - DNA, 23 bp, Homo sapiens
acaaggtcctctgtcagtcacag

SEQ ID NO: 805242 - DNA, 19 bp, Homo sapiens
acaaggttatatgaatata

SEQ ID NO: 805243 - DNA, 20 bp, Homo sapiens
acaaggttccctctgagaat

SEQ ID NO: 805244 - DNA, 13 bp, Homo sapiens
acaaggttcttcc

SEQ ID NO: 805245 - DNA, 17 bp, Homo sapiens
acaaggttggcacccca

SEQ ID NO: 805246 - DNA, 16 bp, Homo sapiens
acaagtaaaactgtgg

SEQ ID NO: 805247 - DNA, 14 bp, Homo sapiens
acaagtaacaaaaa

SEQ ID NO: 805248 - DNA, 15 bp, Homo sapiens
acaagtaacaaaaat

SEQ ID NO: 805249 - DNA, 15 bp, Homo sapiens
acaagtaagaaaaat

SEQ ID NO: 805250 - DNA, 15 bp, Homo sapiens
acaagtaatattatt

SEQ ID NO: 805251 - DNA, 13 bp, Homo sapiens
acaagtaatgtat

SEQ ID NO: 805252 - DNA, 15 bp, Homo sapiens
acaagtaatttcagt

SEQ ID NO: 805253 - DNA, 11 bp, Homo sapiens
acaagtactgg

SEQ ID NO: 805254 - DNA, 22 bp, Homo sapiens
acaagtactggctctttattca

SEQ ID NO: 805255 - DNA, 20 bp, Homo sapiens
acaagtagatgcctgaactt

SEQ ID NO: 805256 - DNA, 19 bp, Homo sapiens
acaagtatatgtgaaaaaa

SEQ ID NO: 805257 - DNA, 23 bp, Homo sapiens
acaagtatgaataaagacaccta

SEQ ID NO: 805258 - DNA, 23 bp, Homo sapiens
acaagtcataggttaatatttaa

SEQ ID NO: 805259 - DNA, 23 bp, Homo sapiens
acaagtcattttaactttatcac

SEQ ID NO: 805260 - DNA, 22 bp, Homo sapiens
acaagtccccattgctgtggtc

SEQ ID NO: 805261 - DNA, 17 bp, Homo sapiens
acaagtccctgtaattg

SEQ ID NO: 805262 - DNA, 16 bp, Homo sapiens
acaagtcctgtgaatt

SEQ ID NO: 805263 - DNA, 24 bp, Homo sapiens
acaagtgaatctttctcctggtga

SEQ ID NO: 805264 - DNA, 23 bp, Homo sapiens
acaagtgccgcaaattgtacctt

SEQ ID NO: 805265 - DNA, 16 bp, Homo sapiens
acaccaataaatgttt

SEQ ID NO: 805266 - DNA, 18 bp, Homo sapiens
acaccaataaatgtttgt

SEQ ID NO: 805267 - DNA, 20 bp, Homo sapiens
acaccaataaatgtttgtta

SEQ ID NO: 805268 - DNA, 23 bp, Homo sapiens
acaccaatttggtaaaaatgctg

SEQ ID NO: 805269 - DNA, 12 bp, Homo sapiens
acaccacagaca

SEQ ID NO: 805270 - DNA, 14 bp, Homo sapiens
acaccacagacaca

SEQ ID NO: 805271 - DNA, 17 bp, Homo sapiens
acaccacagacacacac

SEQ ID NO: 805272 - DNA, 18 bp, Homo sapiens
acaccacagacacacaca

SEQ ID NO: 805273 - DNA, 22 bp, Homo sapiens
acaccacagacacacacacgca

SEQ ID NO: 805274 - DNA, 22 bp, Homo sapiens
acaccactgccctgcctgccca

SEQ ID NO: 805275 - DNA, 23 bp, Homo sapiens
acaccagactgaagtaaacagct

SEQ ID NO: 805276 - DNA, 16 bp, Homo sapiens
acaccagcattccttt

SEQ ID NO: 805277 - DNA, 20 bp, Homo sapiens
acaccagccccacttctggg

SEQ ID NO: 805278 - DNA, 19 bp, Homo sapiens
acaccaggagtccctggta

SEQ ID NO: 805279 - DNA, 21 bp, Homo sapiens
acaccaggctgcagatgatca

SEQ ID NO: 805280 - DNA, 14 bp, Homo sapiens
acaccaggctgtgg

SEQ ID NO: 805281 - DNA, 20 bp, Homo sapiens
acaccatcgatcatgatgta

SEQ ID NO: 805282 - DNA, 19 bp, Homo sapiens
acaccatcttaaatgacag

SEQ ID NO: 805283 - DNA, 15 bp, Homo sapiens
acaccatcttttatt

SEQ ID NO: 805284 - DNA, 14 bp, Homo sapiens
acaccatcttttgt

SEQ ID NO: 805285 - DNA, 13 bp, Homo sapiens
acaccatgtgcaa

SEQ ID NO: 805286 - DNA, 14 bp, Homo sapiens
acaccatgtgcaat

SEQ ID NO: 805287 - DNA, 23 bp, Homo sapiens
acaccatgtgcaataagattggt

SEQ ID NO: 805288 - DNA, 21 bp, Homo sapiens
acaccattaccaaaataataa

SEQ ID NO: 805289 - DNA, 17 bp, Homo sapiens
acaccattgaaggctta

SEQ ID NO: 805290 - DNA, 13 bp, Homo sapiens
acacccaaaaata

SEQ ID NO: 805291 - DNA, 22 bp, Homo sapiens
acacccaaaaatatctcctcca

SEQ ID NO: 805292 - DNA, 20 bp, Homo sapiens
acacccaaagaggtatttat

SEQ ID NO: 805293 - DNA, 15 bp, Homo sapiens
acacccaagcctgat

SEQ ID NO: 805294 - DNA, 12 bp, Homo sapiens
acacccaccctt

SEQ ID NO: 805295 - DNA, 23 bp, Homo sapiens
acacccaccgtccgccctgctcc

SEQ ID NO: 805296 - DNA, 14 bp, Homo sapiens
acacccactgcccc

SEQ ID NO: 805297 - DNA, 15 bp, Homo sapiens
acacccagaccttcc

SEQ ID NO: 805298 - DNA, 16 bp, Homo sapiens
acacccagcggccccc

SEQ ID NO: 805299 - DNA, 19 bp, Homo sapiens
acacccaggggaaggccct

SEQ ID NO: 805300 - DNA, 23 bp, Homo sapiens
acacccaggggaaggccctgagg

SEQ ID NO: 805301 - DNA, 18 bp, Homo sapiens
acacccatgccagagagg

SEQ ID NO: 805302 - DNA, 18 bp, Homo sapiens
acaccccacaccccagcc

SEQ ID NO: 805303 - DNA, 13 bp, Homo sapiens
acaccccagccca

SEQ ID NO: 805304 - DNA, 12 bp, Homo sapiens
acaccccctccc

SEQ ID NO: 805305 - DNA, 21 bp, Homo sapiens
acaccccctccccgcccctgt

SEQ ID NO: 805306 - DNA, 23 bp, Homo sapiens
acacccctcccctgccctagagc

SEQ ID NO: 805307 - DNA, 14 bp, Homo sapiens
acacccctctgtct

SEQ ID NO: 805308 - DNA, 21 bp, Homo sapiens
acacccctctgtctaggactg

SEQ ID NO: 805309 - DNA, 23 bp, Homo sapiens
acacccctgctctacccatgagc

SEQ ID NO: 805310 - DNA, 17 bp, Homo sapiens
acaccccttatccagga

SEQ ID NO: 805311 - DNA, 16 bp, Homo sapiens
acacccgaagtcctgt

SEQ ID NO: 805312 - DNA, 17 bp, Homo sapiens
acacccgaagtcctgtc

SEQ ID NO: 805313 - DNA, 24 bp, Homo sapiens
acacccgaagtcctgtcactgagc

SEQ ID NO: 805314 - DNA, 12 bp, Homo sapiens
acaccctggcct

SEQ ID NO: 805315 - DNA, 21 bp, Homo sapiens
acaccctgggatggaacctca

SEQ ID NO: 805316 - DNA, 16 bp, Homo sapiens
acaccctttcatctca

SEQ ID NO: 805317 - DNA, 15 bp, Homo sapiens
acaccgctcagtatt

SEQ ID NO: 805318 - DNA, 19 bp, Homo sapiens
acaccgtcccagggctctg

SEQ ID NO: 805319 - DNA, 15 bp, Homo sapiens
acaccgtggcctggg

SEQ ID NO: 805320 - DNA, 18 bp, Homo sapiens
acaccgtggggaaggggt

SEQ ID NO: 805321 - DNA, 17 bp, Homo sapiens
acaccgtgtaaaccaaa

SEQ ID NO: 805322 - DNA, 21 bp, Homo sapiens
acacctactagtcaccagaga

SEQ ID NO: 805323 - DNA, 12 bp, Homo sapiens
acacctagaaag

SEQ ID NO: 805324 - DNA, 22 bp, Homo sapiens
acacctagaaaggaactgcaat

SEQ ID NO: 805325 - DNA, 21 bp, Homo sapiens
acacctagacaaacaagggag

SEQ ID NO: 805326 - DNA, 15 bp, Homo sapiens
acacctcctcccgaa

SEQ ID NO: 805327 - DNA, 21 bp, Homo sapiens
acacctcctcccgaaaaatgt

SEQ ID NO: 805328 - DNA, 11 bp, Homo sapiens
acacctcctct

SEQ ID NO: 805329 - DNA, 13 bp, Homo sapiens
acacctctggggg

SEQ ID NO: 805330 - DNA, 14 bp, Homo sapiens
acacctgactctga

SEQ ID NO: 805331 - DNA, 21 bp, Homo sapiens
acacctgactctgaaatctga

SEQ ID NO: 805332 - DNA, 18 bp, Homo sapiens
acacctgagcgctgtgga

SEQ ID NO: 805333 - DNA, 14 bp, Homo sapiens
acacctgccctgcc

SEQ ID NO: 805334 - DNA, 13 bp, Homo sapiens
acacctggaatgt

SEQ ID NO: 805335 - DNA, 15 bp, Homo sapiens
acacctggactgagc

SEQ ID NO: 805336 - DNA, 19 bp, Homo sapiens
acacctggccttaaagagg

SEQ ID NO: 805337 - DNA, 23 bp, Homo sapiens
acacctggctgaggttcctctgc

SEQ ID NO: 805338 - DNA, 20 bp, Homo sapiens
acacctgggcatttggtgag

SEQ ID NO: 805339 - DNA, 17 bp, Homo sapiens
acacctgggcccgggca

SEQ ID NO: 805340 - DNA, 21 bp, Homo sapiens
acacctgggcccgggcaggcc

SEQ ID NO: 805341 - DNA, 12 bp, Homo sapiens
acacctgtacat

SEQ ID NO: 805342 - DNA, 20 bp, Homo sapiens
acacctgtagcacttactgg

SEQ ID NO: 805343 - DNA, 15 bp, Homo sapiens
acacctgtgcctcct

SEQ ID NO: 805344 - DNA, 23 bp, Homo sapiens
acacctgttcacagaaaaagcat

SEQ ID NO: 805345 - DNA, 17 bp, Homo sapiens
acaccttagagaagcta

SEQ ID NO: 805346 - DNA, 16 bp, Homo sapiens
acaccttccagctcct

SEQ ID NO: 805347 - DNA, 16 bp, Homo sapiens
acaccttcctcctgca

SEQ ID NO: 805348 - DNA, 17 bp, Homo sapiens
acaccttcctcctgcag

SEQ ID NO: 805349 - DNA, 17 bp, Homo sapiens
acaccttcttggcttct

SEQ ID NO: 805350 - DNA, 20 bp, Homo sapiens
acaccttggacatcctcctc

SEQ ID NO: 805351 - DNA, 23 bp, Homo sapiens
acaccttttattgacacagaaaa

SEQ ID NO: 805352 - DNA, 18 bp, Homo sapiens
acacgaatagacatcaaa

SEQ ID NO: 805353 - DNA, 22 bp, Homo sapiens
acacgagatttcttttttatgt

SEQ ID NO: 805354 - DNA, 13 bp, Homo sapiens
acacgagcaaacc

SEQ ID NO: 805355 - DNA, 13 bp, Homo sapiens
acacgagccacaa

SEQ ID NO: 805356 - DNA, 18 bp, Homo sapiens
acacgagccacaagctgc

SEQ ID NO: 805357 - DNA, 21 bp, Homo sapiens
acacgatgcatttaataaaga

SEQ ID NO: 805358 - DNA, 17 bp, Homo sapiens
acacgattttattgctg

SEQ ID NO: 805359 - DNA, 21 bp, Homo sapiens
acacgcaagggcatcaggcac

SEQ ID NO: 805360 - DNA, 23 bp, Homo sapiens
acacgcaagggcatcaggcactg

SEQ ID NO: 805361 - DNA, 16 bp, Homo sapiens
acacgcaagtgtgtga

SEQ ID NO: 805362 - DNA, 17 bp, Homo sapiens
acacgcaagtgtgtgag

SEQ ID NO: 805363 - DNA, 20 bp, Homo sapiens
acacgcacacacacacacag

SEQ ID NO: 805364 - DNA, 20 bp, Homo sapiens
acacgcacacatcttacctc

SEQ ID NO: 805365 - DNA, 16 bp, Homo sapiens
acacgcacgcacacac

SEQ ID NO: 805366 - DNA, 20 bp, Homo sapiens
acacgcacgcacacacacat

SEQ ID NO: 805367 - DNA, 17 bp, Homo sapiens
acacgcagcctgctctg

SEQ ID NO: 805368 - DNA, 18 bp, Homo sapiens
acacgcaggcggccaggg

SEQ ID NO: 805369 - DNA, 13 bp, Homo sapiens
acacgcatgggca

SEQ ID NO: 805370 - DNA, 14 bp, Homo sapiens
acacgcatgggcat

SEQ ID NO: 805371 - DNA, 17 bp, Homo sapiens
acacgcatgggcattgc

SEQ ID NO: 805372 - DNA, 21 bp, Homo sapiens
acacgcatgggcattgcagcc

SEQ ID NO: 805373 - DNA, 16 bp, Homo sapiens
acacgccagctcctct

SEQ ID NO: 805374 - DNA, 16 bp, Homo sapiens
acacgcgtgattgacc

SEQ ID NO: 805375 - DNA, 13 bp, Homo sapiens
acacgctgcctgg

SEQ ID NO: 805376 - DNA, 17 bp, Homo sapiens
acacgcttttgtgatgg

SEQ ID NO: 805377 - DNA, 21 bp, Homo sapiens
acacggactcccgggccacgc

SEQ ID NO: 805378 - DNA, 18 bp, Homo sapiens
acacggagcccagccctc

SEQ ID NO: 805379 - DNA, 18 bp, Homo sapiens
acacggaggcatctgcac

SEQ ID NO: 805380 - DNA, 19 bp, Homo sapiens
acacggctggtcactctgc

SEQ ID NO: 805381 - DNA, 22 bp, Homo sapiens
acacggctggtcactctgccct

SEQ ID NO: 805382 - DNA, 23 bp, Homo sapiens
acacggctggtcactctgccctc

SEQ ID NO: 805383 - DNA, 18 bp, Homo sapiens
acacgtaccttcatgtga

SEQ ID NO: 805384 - DNA, 16 bp, Homo sapiens
acacgtacttaaatga

SEQ ID NO: 805385 - DNA, 21 bp, Homo sapiens
acacgtggaggaatgctcccc

SEQ ID NO: 805386 - DNA, 18 bp, Homo sapiens
acagatcccactggaaga

SEQ ID NO: 805387 - DNA, 12 bp, Homo sapiens
acagatgaaaag

SEQ ID NO: 805388 - DNA, 17 bp, Homo sapiens
acagatgaatgtattta

SEQ ID NO: 805389 - DNA, 16 bp, Homo sapiens
acagatgaccaaagtc

SEQ ID NO: 805390 - DNA, 18 bp, Homo sapiens
acagatgaccaaagtccc

SEQ ID NO: 805391 - DNA, 22 bp, Homo sapiens
acagatgaggagcagctggggt

SEQ ID NO: 805392 - DNA, 18 bp, Homo sapiens
acagatgataaatattta

SEQ ID NO: 805393 - DNA, 12 bp, Homo sapiens
acagatgatact

SEQ ID NO: 805394 - DNA, 18 bp, Homo sapiens
acagatgatacttccaag

SEQ ID NO: 805395 - DNA, 24 bp, Homo sapiens
acagatgcaagttattttatttgc

SEQ ID NO: 805396 - DNA, 17 bp, Homo sapiens
acagatgcaatgtgcta

SEQ ID NO: 805397 - DNA, 20 bp, Homo sapiens
acagatgcaatgtgctactg

SEQ ID NO: 805398 - DNA, 15 bp, Homo sapiens
acagatgccaacttc

SEQ ID NO: 805399 - DNA, 20 bp, Homo sapiens
acagatgccaacttcccaca

SEQ ID NO: 805400 - DNA, 13 bp, Homo sapiens
acagatgcccacg

SEQ ID NO: 805401 - DNA, 14 bp, Homo sapiens
acagatgcccacgt

SEQ ID NO: 805402 - DNA, 13 bp, Homo sapiens
acagatgccccag

SEQ ID NO: 805403 - DNA, 17 bp, Homo sapiens
acagatgctgagccata

SEQ ID NO: 805404 - DNA, 14 bp, Homo sapiens
acagatgcttttct

SEQ ID NO: 805405 - DNA, 21 bp, Homo sapiens
acagatgcttttctgtctctg

SEQ ID NO: 805406 - DNA, 18 bp, Homo sapiens
acagatggacactgccaa

SEQ ID NO: 805407 - DNA, 21 bp, Homo sapiens
acagatggacgcaggccctgt

SEQ ID NO: 805408 - DNA, 20 bp, Homo sapiens
acagatggcccaagggatgg

SEQ ID NO: 805409 - DNA, 18 bp, Homo sapiens
acagatgggtattaaact

SEQ ID NO: 805410 - DNA, 20 bp, Homo sapiens
acagatgggtattaaacttg

SEQ ID NO: 805411 - DNA, 23 bp, Homo sapiens
acagatgggtattaaacttgtca

SEQ ID NO: 805412 - DNA, 20 bp, Homo sapiens
acagatgtaaaagacttttt

SEQ ID NO: 805413 - DNA, 20 bp, Homo sapiens
acagatgtcagccgagccgg

SEQ ID NO: 805414 - DNA, 16 bp, Homo sapiens
acagatgtctctgggg

SEQ ID NO: 805415 - DNA, 17 bp, Homo sapiens
acagatgtctctggggc

SEQ ID NO: 805416 - DNA, 18 bp, Homo sapiens
acagatgtctctggggca

SEQ ID NO: 805417 - DNA, 23 bp, Homo sapiens
acagatgtgtctgggagagcctg

SEQ ID NO: 805418 - DNA, 19 bp, Homo sapiens
acagattcactttgtttat

SEQ ID NO: 805419 - DNA, 17 bp, Homo sapiens
acagattcaggccagcc

SEQ ID NO: 805420 - DNA, 22 bp, Homo sapiens
acagattcaggccagcccagcc

SEQ ID NO: 805421 - DNA, 15 bp, Homo sapiens
acagattctgacatt

SEQ ID NO: 805422 - DNA, 20 bp, Homo sapiens
acagattctgacatttatat

SEQ ID NO: 805423 - DNA, 12 bp, Homo sapiens
acagattctgat

SEQ ID NO: 805424 - DNA, 17 bp, Homo sapiens
acagattctgattccct

SEQ ID NO: 805425 - DNA, 12 bp, Homo sapiens
acagattctttt

SEQ ID NO: 805426 - DNA, 13 bp, Homo sapiens
acagattgcctcc

SEQ ID NO: 805427 - DNA, 14 bp, Homo sapiens
acagattgcctcct

SEQ ID NO: 805428 - DNA, 23 bp, Homo sapiens
acagattggcaatgggccgtccc

SEQ ID NO: 805429 - DNA, 20 bp, Homo sapiens
acagatttaatacagtttat

SEQ ID NO: 805430 - DNA, 16 bp, Homo sapiens
acagatttcatacctc

SEQ ID NO: 805431 - DNA, 17 bp, Homo sapiens
acagatttcatacctca

SEQ ID NO: 805432 - DNA, 14 bp, Homo sapiens
acagatttgagctc

SEQ ID NO: 805433 - DNA, 15 bp, Homo sapiens
acagatttggaaaga

SEQ ID NO: 805434 - DNA, 21 bp, Homo sapiens
acagatttgtgcccattccta

SEQ ID NO: 805435 - DNA, 11 bp, Homo sapiens
acagattttat

SEQ ID NO: 805436 - DNA, 15 bp, Homo sapiens
acagattttctagaa

SEQ ID NO: 805437 - DNA, 17 bp, Homo sapiens
acagatttttacaaatg

SEQ ID NO: 805438 - DNA, 14 bp, Homo sapiens
acagcaaaaaggga

SEQ ID NO: 805439 - DNA, 15 bp, Homo sapiens
acagcaaaaccattg

SEQ ID NO: 805440 - DNA, 22 bp, Homo sapiens
acagcaaaaccattgcttcact

SEQ ID NO: 805441 - DNA, 20 bp, Homo sapiens
acagcaacaatttatgaatt

SEQ ID NO: 805442 - DNA, 13 bp, Homo sapiens
acagcaactgacc

SEQ ID NO: 805443 - DNA, 21 bp, Homo sapiens
acagcaagagtaagcagtgtt

SEQ ID NO: 805444 - DNA, 17 bp, Homo sapiens
acagcaagccggccccc

SEQ ID NO: 805445 - DNA, 16 bp, Homo sapiens
acagcaaggagattta

SEQ ID NO: 805446 - DNA, 21 bp, Homo sapiens
acagcaaggagatttacaact

SEQ ID NO: 805447 - DNA, 19 bp, Homo sapiens
acagcaattcctcaggcta

SEQ ID NO: 805448 - DNA, 16 bp, Homo sapiens
acagcacaaccggtcc

SEQ ID NO: 805449 - DNA, 14 bp, Homo sapiens
acagcacaagggca

SEQ ID NO: 805450 - DNA, 19 bp, Homo sapiens
acagcacaccagccgctgc

SEQ ID NO: 805451 - DNA, 14 bp, Homo sapiens
acagcacagaatga

SEQ ID NO: 805452 - DNA, 12 bp, Homo sapiens
acagcacagcca

SEQ ID NO: 805453 - DNA, 12 bp, Homo sapiens
acagcactactc

SEQ ID NO: 805454 - DNA, 14 bp, Homo sapiens
acagcactactctg

SEQ ID NO: 805455 - DNA, 20 bp, Homo sapiens
acagcactactctgtgccag

SEQ ID NO: 805456 - DNA, 22 bp, Homo sapiens
acagcactggctctctccagga

SEQ ID NO: 805457 - DNA, 13 bp, Homo sapiens
acagcagaagcct

SEQ ID NO: 805458 - DNA, 19 bp, Homo sapiens
acagcagactcagctctga

SEQ ID NO: 805459 - DNA, 22 bp, Homo sapiens
acagcagcactcccgctgcaca

SEQ ID NO: 805460 - DNA, 18 bp, Homo sapiens
acagcagcccctgcacaa

SEQ ID NO: 805461 - DNA, 16 bp, Homo sapiens
acagcagcctctgaag

SEQ ID NO: 805462 - DNA, 17 bp, Homo sapiens
acagcagcctctgaagt

SEQ ID NO: 805463 - DNA, 22 bp, Homo sapiens
acagcagcctggggctggcctc

SEQ ID NO: 805464 - DNA, 14 bp, Homo sapiens
acagcagcctgtat

SEQ ID NO: 805465 - DNA, 15 bp, Homo sapiens
acagcagctcaggca

SEQ ID NO: 805466 - DNA, 13 bp, Homo sapiens
acagcagctcata

SEQ ID NO: 805467 - DNA, 22 bp, Homo sapiens
acagcagctcatagaattttga

SEQ ID NO: 805468 - DNA, 16 bp, Homo sapiens
acagcagcttcaccag

SEQ ID NO: 805469 - DNA, 18 bp, Homo sapiens
acagcagcttcaccagag

SEQ ID NO: 805470 - DNA, 21 bp, Homo sapiens
acagcaggatcgaagggtttt

SEQ ID NO: 805471 - DNA, 18 bp, Homo sapiens
acagcagtgatctcaggg

SEQ ID NO: 805472 - DNA, 21 bp, Homo sapiens
acagcagtgatctcagggcag

SEQ ID NO: 805473 - DNA, 23 bp, Homo sapiens
acagcagtgatctcagggcagac

SEQ ID NO: 805474 - DNA, 13 bp, Homo sapiens
acagcagtgttcc

SEQ ID NO: 805475 - DNA, 20 bp, Homo sapiens
acagcatcattttgcattca

SEQ ID NO: 805476 - DNA, 21 bp, Homo sapiens
acagcatcattttgcattcaa

SEQ ID NO: 805477 - DNA, 21 bp, Homo sapiens
acagcatcgggagcacccaga

SEQ ID NO: 805478 - DNA, 19 bp, Homo sapiens
acagcatcgtgatcactga

SEQ ID NO: 805479 - DNA, 14 bp, Homo sapiens
acagcatgaataaa

SEQ ID NO: 805480 - DNA, 16 bp, Homo sapiens
acagcatgaataaaac

SEQ ID NO: 805481 - DNA, 22 bp, Homo sapiens
acagcatgtacggattttcagt

SEQ ID NO: 805482 - DNA, 15 bp, Homo sapiens
acagcatgtgccctc

SEQ ID NO: 805483 - DNA, 18 bp, Homo sapiens
acagcatgtgccctcctg

SEQ ID NO: 805484 - DNA, 16 bp, Homo sapiens
acagcatgtgttaatc

SEQ ID NO: 805485 - DNA, 21 bp, Homo sapiens
acagcatgtgttaatcttaat

SEQ ID NO: 805486 - DNA, 14 bp, Homo sapiens
acagcattgtcttt

SEQ ID NO: 805487 - DNA, 15 bp, Homo sapiens
acagcattgtctttg

SEQ ID NO: 805488 - DNA, 17 bp, Homo sapiens
acagcattgtctttgct

SEQ ID NO: 805489 - DNA, 17 bp, Homo sapiens
acagccaacgagacaca

SEQ ID NO: 805490 - DNA, 18 bp, Homo sapiens
acagccaacgagacacat

SEQ ID NO: 805491 - DNA, 16 bp, Homo sapiens
acagccaactagcccc

SEQ ID NO: 805492 - DNA, 17 bp, Homo sapiens
acagccaactagcccct

SEQ ID NO: 805493 - DNA, 18 bp, Homo sapiens
acagccaactagcccctg

SEQ ID NO: 805494 - DNA, 17 bp, Homo sapiens
acagccacctccgccag

SEQ ID NO: 805495 - DNA, 19 bp, Homo sapiens
acagccacctccgccagac

SEQ ID NO: 805496 - DNA, 13 bp, Homo sapiens
acagccagagctg

SEQ ID NO: 805497 - DNA, 12 bp, Homo sapiens
acagccagagga

SEQ ID NO: 805498 - DNA, 19 bp, Homo sapiens
acagccagaggagggcaga

SEQ ID NO: 805499 - DNA, 14 bp, Homo sapiens
acagccagcaagag

SEQ ID NO: 805500 - DNA, 21 bp, Homo sapiens
acagccagttttactgtgatt

SEQ ID NO: 805501 - DNA, 22 bp, Homo sapiens
acagccatgtccaagttcttca

SEQ ID NO: 805502 - DNA, 19 bp, Homo sapiens
acagcccagaaccacagat

SEQ ID NO: 805503 - DNA, 20 bp, Homo sapiens
acagcccaggatactggcac

SEQ ID NO: 805504 - DNA, 21 bp, Homo sapiens
acagcccaggcatctccttgg

SEQ ID NO: 805505 - DNA, 19 bp, Homo sapiens
acagccccaagcttctgag

SEQ ID NO: 805506 - DNA, 17 bp, Homo sapiens
acagcccccactccagt

SEQ ID NO: 805507 - DNA, 11 bp, Homo sapiens
acagccccctt

SEQ ID NO: 805508 - DNA, 18 bp, Homo sapiens
acagtccctatggaaaga

SEQ ID NO: 805509 - DNA, 18 bp, Homo sapiens
acagtcctatgtacagag

SEQ ID NO: 805510 - DNA, 15 bp, Homo sapiens
acagtcgtaaaagag

SEQ ID NO: 805511 - DNA, 14 bp, Homo sapiens
acagtctaaagctg

SEQ ID NO: 805512 - DNA, 14 bp, Homo sapiens
acagtctctttaat

SEQ ID NO: 805513 - DNA, 19 bp, Homo sapiens
acagtctctttaatcttca

SEQ ID NO: 805514 - DNA, 18 bp, Homo sapiens
acagtctctttcttcctt

SEQ ID NO: 805515 - DNA, 22 bp, Homo sapiens
acagtctctttcttcctttcta

SEQ ID NO: 805516 - DNA, 13 bp, Homo sapiens
acagtctggccac

SEQ ID NO: 805517 - DNA, 13 bp, Homo sapiens
acagtctgtcatg

SEQ ID NO: 805518 - DNA, 15 bp, Homo sapiens
acagtctgttatgca

SEQ ID NO: 805519 - DNA, 17 bp, Homo sapiens
acagtctgttatgcact

SEQ ID NO: 805520 - DNA, 18 bp, Homo sapiens
acagtctgttatgcactg

SEQ ID NO: 805521 - DNA, 15 bp, Homo sapiens
acagtctgttttcta

SEQ ID NO: 805522 - DNA, 17 bp, Homo sapiens
acagtcttactctgtct

SEQ ID NO: 805523 - DNA, 23 bp, Homo sapiens
acagtgaaattttggtgaatgtg

SEQ ID NO: 805524 - DNA, 21 bp, Homo sapiens
acagtgaagcagcactgtgag

SEQ ID NO: 805525 - DNA, 17 bp, Homo sapiens
acagtgaatattgcttt

SEQ ID NO: 805526 - DNA, 13 bp, Homo sapiens
acagtgaatgtgt

SEQ ID NO: 805527 - DNA, 13 bp, Homo sapiens
acagtgaattgtc

SEQ ID NO: 805528 - DNA, 17 bp, Homo sapiens
acagtgacttggcccca

SEQ ID NO: 805529 - DNA, 12 bp, Homo sapiens
acagtgagaaag

SEQ ID NO: 805530 - DNA, 13 bp, Homo sapiens
acagtgagctcta

SEQ ID NO: 805531 - DNA, 15 bp, Homo sapiens
acagtgaggactcgg

SEQ ID NO: 805532 - DNA, 17 bp, Homo sapiens
acagtgaggactcggcc

SEQ ID NO: 805533 - DNA, 18 bp, Homo sapiens
acagtgaggactcggcca

SEQ ID NO: 805534 - DNA, 18 bp, Homo sapiens
acagtgaggcaggagaag

SEQ ID NO: 805535 - DNA, 18 bp, Homo sapiens
acagtgatctccatatgt

SEQ ID NO: 805536 - DNA, 12 bp, Homo sapiens
acagtgatgaat

SEQ ID NO: 805537 - DNA, 15 bp, Homo sapiens
acagtgatgaatgta

SEQ ID NO: 805538 - DNA, 15 bp, Homo sapiens
acagtgatgccgggc

SEQ ID NO: 805539 - DNA, 23 bp, Homo sapiens
acagtgatgccgggcgccaggac

SEQ ID NO: 805540 - DNA, 10 bp, Homo sapiens
acagtgcaag

SEQ ID NO: 805541 - DNA, 21 bp, Homo sapiens
acagtgcagagccttctcaga

SEQ ID NO: 805542 - DNA, 18 bp, Homo sapiens
acagtgcagcttgcagtc

SEQ ID NO: 805543 - DNA, 18 bp, Homo sapiens
acagtgcatctcagccca

SEQ ID NO: 805544 - DNA, 14 bp, Homo sapiens
acagtgccatcccc

SEQ ID NO: 805545 - DNA, 21 bp, Homo sapiens
acagtgccatccccaccttca

SEQ ID NO: 805546 - DNA, 13 bp, Homo sapiens
acagtgcccaaga

SEQ ID NO: 805547 - DNA, 18 bp, Homo sapiens
acagtgcccaagagtggg

SEQ ID NO: 805548 - DNA, 16 bp, Homo sapiens
acagtgcccaccgccc

SEQ ID NO: 805549 - DNA, 21 bp, Homo sapiens
acagtgcccaccgccctcctc

SEQ ID NO: 805550 - DNA, 21 bp, Homo sapiens
acagtgcccatgaatgggaca

SEQ ID NO: 805551 - DNA, 19 bp, Homo sapiens
acagtgcctcttccagtga

SEQ ID NO: 805552 - DNA, 11 bp, Homo sapiens
acagtgcctgc

SEQ ID NO: 805553 - DNA, 22 bp, Homo sapiens
acagtgcctggcccattcttga

SEQ ID NO: 805554 - DNA, 12 bp, Homo sapiens
acagtgccttct

SEQ ID NO: 805555 - DNA, 15 bp, Homo sapiens
acagtgctcttttct

SEQ ID NO: 805556 - DNA, 20 bp, Homo sapiens
acagtgctgaccagacagcc

SEQ ID NO: 805557 - DNA, 12 bp, Homo sapiens
acagtgctgccc

SEQ ID NO: 805558 - DNA, 17 bp, Homo sapiens
acagtgctgccccttgc

SEQ ID NO: 805559 - DNA, 18 bp, Homo sapiens
acagtgctgccccttgca

SEQ ID NO: 805560 - DNA, 21 bp, Homo sapiens
acagtgcttgcatcctatttg

SEQ ID NO: 805561 - DNA, 22 bp, Homo sapiens
acagtgcttgcatcctatttgg

SEQ ID NO: 805562 - DNA, 23 bp, Homo sapiens
acagtgcttgcatcctatttggt

SEQ ID NO: 805563 - DNA, 16 bp, Homo sapiens
acagtggaactacatt

SEQ ID NO: 805564 - DNA, 16 bp, Homo sapiens
acagtggactcagcag

SEQ ID NO: 805565 - DNA, 19 bp, Homo sapiens
acagtggactcagcagtga

SEQ ID NO: 805566 - DNA, 21 bp, Homo sapiens
acagtggactcagcagtgacc

SEQ ID NO: 805567 - DNA, 23 bp, Homo sapiens
acagtggatatgacccacactgc

SEQ ID NO: 805568 - DNA, 18 bp, Homo sapiens
acagtggatcacaaagtg

SEQ ID NO: 805569 - DNA, 14 bp, Homo sapiens
acagtggcctcttg

SEQ ID NO: 805570 - DNA, 19 bp, Homo sapiens
acagtggctcgtatcccaa

SEQ ID NO: 805571 - DNA, 14 bp, Homo sapiens
acagtgggaaatat

SEQ ID NO: 805572 - DNA, 15 bp, Homo sapiens
acagtgggagccctg

SEQ ID NO: 805573 - DNA, 19 bp, Homo sapiens
acagtgggagccctgacct

SEQ ID NO: 805574 - DNA, 22 bp, Homo sapiens
acagtgggcgttgggagcctag

SEQ ID NO: 805575 - DNA, 17 bp, Homo sapiens
acagtggggctgcaggc

SEQ ID NO: 805576 - DNA, 20 bp, Homo sapiens
acagtggggctgcaggcagg

SEQ ID NO: 805577 - DNA, 14 bp, Homo sapiens
acagtgggtggcac

SEQ ID NO: 805578 - DNA, 17 bp, Homo sapiens
acagtgggtggcacctc

SEQ ID NO: 805579 - DNA, 17 bp, Homo sapiens
acagtggtggcaacatt

SEQ ID NO: 805580 - DNA, 14 bp, Homo sapiens
acagtggttcttat

SEQ ID NO: 805581 - DNA, 22 bp, Homo sapiens
acagtggttttatactgaagga

SEQ ID NO: 805582 - DNA, 12 bp, Homo sapiens
acagtgtacagt

SEQ ID NO: 805583 - DNA, 23 bp, Homo sapiens
acagtgtctgtgccatggatttc

SEQ ID NO: 805584 - DNA, 11 bp, Homo sapiens
acagtgtcttt

SEQ ID NO: 805585 - DNA, 19 bp, Homo sapiens
acagtgtctttttttgtat

SEQ ID NO: 805586 - DNA, 12 bp, Homo sapiens
acagtgtgtgtg

SEQ ID NO: 805587 - DNA, 18 bp, Homo sapiens
acagtgtgttggtgcttt

SEQ ID NO: 805588 - DNA, 14 bp, Homo sapiens
acagtgtttatcct

SEQ ID NO: 805589 - DNA, 22 bp, Homo sapiens
acagtgtttcccataattttct

SEQ ID NO: 805590 - DNA, 17 bp, Homo sapiens
acagtgtttgcaatggt

SEQ ID NO: 805591 - DNA, 16 bp, Homo sapiens
acagttaaggaatata

SEQ ID NO: 805592 - DNA, 14 bp, Homo sapiens
acagttacagttga

SEQ ID NO: 805593 - DNA, 13 bp, Homo sapiens
acagttactcaga

SEQ ID NO: 805594 - DNA, 22 bp, Homo sapiens
acagttagcagggatgttcctt

SEQ ID NO: 805595 - DNA, 17 bp, Homo sapiens
acagttataaaattaaa

SEQ ID NO: 805596 - DNA, 23 bp, Homo sapiens
acagttatatttttgtgttttct

SEQ ID NO: 805597 - DNA, 14 bp, Homo sapiens
acagttatcatgaa

SEQ ID NO: 805598 - DNA, 15 bp, Homo sapiens
acagttattgtttga

SEQ ID NO: 805599 - DNA, 16 bp, Homo sapiens
acagttcaagaaagct

SEQ ID NO: 805600 - DNA, 20 bp, Homo sapiens
acagttcaagaaagcttcaa

SEQ ID NO: 805601 - DNA, 14 bp, Homo sapiens
acagttccatttat

SEQ ID NO: 805602 - DNA, 12 bp, Homo sapiens
acagttcctcgc

SEQ ID NO: 805603 - DNA, 14 bp, Homo sapiens
acagttcctcgccc

SEQ ID NO: 805604 - DNA, 16 bp, Homo sapiens
acagttcctcgccctg

SEQ ID NO: 805605 - DNA, 18 bp, Homo sapiens
acagttcctcgccctggg

SEQ ID NO: 805606 - DNA, 21 bp, Homo sapiens
acagttcctgggaacatcaca

SEQ ID NO: 805607 - DNA, 18 bp, Homo sapiens
acagttctacagaaaaac

SEQ ID NO: 805608 - DNA, 12 bp, Homo sapiens
acagttctctgt

SEQ ID NO: 805609 - DNA, 18 bp, Homo sapiens
acagttctgagctgtaat

SEQ ID NO: 805610 - DNA, 19 bp, Homo sapiens
acagttctgagctgtaatt

SEQ ID NO: 805611 - DNA, 16 bp, Homo sapiens
acagttctgtaatgta

SEQ ID NO: 805612 - DNA, 17 bp, Homo sapiens
acagttcttggtgactg

SEQ ID NO: 805613 - DNA, 12 bp, Homo sapiens
acagttctttcc

SEQ ID NO: 805614 - DNA, 15 bp, Homo sapiens
acagttctttcctct

SEQ ID NO: 805615 - DNA, 15 bp, Homo sapiens
acagttgatgtttgg

SEQ ID NO: 805616 - DNA, 18 bp, Homo sapiens
acagttgcagcccttgtg

SEQ ID NO: 805617 - DNA, 15 bp, Homo sapiens
acagttgctgtcata

SEQ ID NO: 805618 - DNA, 16 bp, Homo sapiens
acagttggccttcaga

SEQ ID NO: 805619 - DNA, 16 bp, Homo sapiens
acagttgtatgtttgc

SEQ ID NO: 805620 - DNA, 18 bp, Homo sapiens
acagttgtatttaacaga

SEQ ID NO: 805621 - DNA, 12 bp, Homo sapiens
acagttgtcctg

SEQ ID NO: 805622 - DNA, 19 bp, Homo sapiens
acagttgtcctgatttctt

SEQ ID NO: 805623 - DNA, 19 bp, Homo sapiens
acagttgtctattctgagc

SEQ ID NO: 805624 - DNA, 21 bp, Homo sapiens
acagttgtctattctgagcct

SEQ ID NO: 805625 - DNA, 12 bp, Homo sapiens
acagttgtttga

SEQ ID NO: 805626 - DNA, 22 bp, Homo sapiens
acagtttaccagttgcctttta

SEQ ID NO: 805627 - DNA, 16 bp, Homo sapiens
acagtttactttgcca

SEQ ID NO: 805628 - DNA, 18 bp, Homo sapiens
acagtttatattgtggaa

SEQ ID NO: 805629 - DNA, 13 bp, Homo sapiens
acagtttatcctg

SEQ ID NO: 805630 - DNA, 22 bp, Homo sapiens
acagtttattgatattcaataa

SEQ ID NO: 805631 - DNA, 16 bp, Homo sapiens
acatggacccggagct

SEQ ID NO: 805632 - DNA, 14 bp, Homo sapiens
acatggacttgtat

SEQ ID NO: 805633 - DNA, 16 bp, Homo sapiens
acatggatacttcctg

SEQ ID NO: 805634 - DNA, 21 bp, Homo sapiens
acatggatacttctaaaagct

SEQ ID NO: 805635 - DNA, 15 bp, Homo sapiens
acatggcacaggccc

SEQ ID NO: 805636 - DNA, 15 bp, Homo sapiens
acatggccagtgtga

SEQ ID NO: 805637 - DNA, 19 bp, Homo sapiens
acatggccatagaggccca

SEQ ID NO: 805638 - DNA, 22 bp, Homo sapiens
acatggccatagaggcccaggc

SEQ ID NO: 805639 - DNA, 23 bp, Homo sapiens
acatggccatagaggcccaggca

SEQ ID NO: 805640 - DNA, 16 bp, Homo sapiens
acatggcccattggag

SEQ ID NO: 805641 - DNA, 21 bp, Homo sapiens
acatggcccctccccctgcca

SEQ ID NO: 805642 - DNA, 16 bp, Homo sapiens
acatggcttaatctta

SEQ ID NO: 805643 - DNA, 13 bp, Homo sapiens
acatggcttttga

SEQ ID NO: 805644 - DNA, 12 bp, Homo sapiens
acatgggacctg

SEQ ID NO: 805645 - DNA, 15 bp, Homo sapiens
acatgggagggatca

SEQ ID NO: 805646 - DNA, 16 bp, Homo sapiens
acatgggagggatcag

SEQ ID NO: 805647 - DNA, 18 bp, Homo sapiens
acatgggagggatcagcc

SEQ ID NO: 805648 - DNA, 13 bp, Homo sapiens
acatgggctgggg

SEQ ID NO: 805649 - DNA, 18 bp, Homo sapiens
acatggggaaggcagagg

SEQ ID NO: 805650 - DNA, 15 bp, Homo sapiens
acatggggcaagcca

SEQ ID NO: 805651 - DNA, 16 bp, Homo sapiens
acatggggcaagccag

SEQ ID NO: 805652 - DNA, 17 bp, Homo sapiens
acatggggttggctggg

SEQ ID NO: 805653 - DNA, 20 bp, Homo sapiens
acatggggttggctgggccc

SEQ ID NO: 805654 - DNA, 22 bp, Homo sapiens
acatggggtttcagttgcgaaa

SEQ ID NO: 805655 - DNA, 12 bp, Homo sapiens
acatgggtgggg

SEQ ID NO: 805656 - DNA, 17 bp, Homo sapiens
acatggtctgtcaatga

SEQ ID NO: 805657 - DNA, 18 bp, Homo sapiens
acatggtgggtccatggg

SEQ ID NO: 805658 - DNA, 14 bp, Homo sapiens
acatggtgtctccc

SEQ ID NO: 805659 - DNA, 23 bp, Homo sapiens
acatggtgtggccatcactcagc

SEQ ID NO: 805660 - DNA, 14 bp, Homo sapiens
acatggtgtggggg

SEQ ID NO: 805661 - DNA, 19 bp, Homo sapiens
acatggtgtggggggctgg

SEQ ID NO: 805662 - DNA, 22 bp, Homo sapiens
acatggttacaatcattgctga

SEQ ID NO: 805663 - DNA, 23 bp, Homo sapiens
acatggttacaatcattgctgaa

SEQ ID NO: 805664 - DNA, 17 bp, Homo sapiens
acatggtttgactcccg

SEQ ID NO: 805665 - DNA, 20 bp, Homo sapiens
acatgtaaatacaaattttg

SEQ ID NO: 805666 - DNA, 23 bp, Homo sapiens
acatgtaagtgtggttttgtaat

SEQ ID NO: 805667 - DNA, 17 bp, Homo sapiens
acatgtaattaagtact

SEQ ID NO: 805668 - DNA, 18 bp, Homo sapiens
acatgtaccccctttccc

SEQ ID NO: 805669 - DNA, 21 bp, Homo sapiens
acatgtaccccctttcccttc

SEQ ID NO: 805670 - DNA, 20 bp, Homo sapiens
acatgtagtagtacttgaaa

SEQ ID NO: 805671 - DNA, 18 bp, Homo sapiens
acatgtattgcacattgt

SEQ ID NO: 805672 - DNA, 19 bp, Homo sapiens
acatgtcagtaccttcaaa

SEQ ID NO: 805673 - DNA, 14 bp, Homo sapiens
acatgtcccagatc

SEQ ID NO: 805674 - DNA, 19 bp, Homo sapiens
acatgtcctaattcttctg

SEQ ID NO: 805675 - DNA, 18 bp, Homo sapiens
acatgtctcctatcctgg

SEQ ID NO: 805676 - DNA, 14 bp, Homo sapiens
acatgtctgtcctc

SEQ ID NO: 805677 - DNA, 17 bp, Homo sapiens
acatgtgaaaagaatag

SEQ ID NO: 805678 - DNA, 14 bp, Homo sapiens
acatgtgaaaagct

SEQ ID NO: 805679 - DNA, 15 bp, Homo sapiens
acatgtgacatttat

SEQ ID NO: 805680 - DNA, 18 bp, Homo sapiens
acatgtgaggaggaaaag

SEQ ID NO: 805681 - DNA, 21 bp, Homo sapiens
acatgtgcaattgtgagggac

SEQ ID NO: 805682 - DNA, 20 bp, Homo sapiens
acatgtgccgaatgtgcagg

SEQ ID NO: 805683 - DNA, 17 bp, Homo sapiens
acatgtgccttttctga

SEQ ID NO: 805684 - DNA, 19 bp, Homo sapiens
acatgtggaaagtgaattt

SEQ ID NO: 805685 - DNA, 21 bp, Homo sapiens
acatgtggcaaaatatggttt

SEQ ID NO: 805686 - DNA, 19 bp, Homo sapiens
acatgtggccatggcctct

SEQ ID NO: 805687 - DNA, 23 bp, Homo sapiens
acatgtggtgggacagggaccca

SEQ ID NO: 805688 - DNA, 16 bp, Homo sapiens
acatgtggtttataga

SEQ ID NO: 805689 - DNA, 17 bp, Homo sapiens
acatgtgtgaaaacaat

SEQ ID NO: 805690 - DNA, 20 bp, Homo sapiens
acatgtgttaagtattttca

SEQ ID NO: 805691 - DNA, 13 bp, Homo sapiens
acatgtgtttctg

SEQ ID NO: 805692 - DNA, 12 bp, Homo sapiens
acatgtgtttta

SEQ ID NO: 805693 - DNA, 22 bp, Homo sapiens
acatgtgttttcatcatttcag

SEQ ID NO: 805694 - DNA, 23 bp, Homo sapiens
acatgtgttttcatcatttcagc

SEQ ID NO: 805695 - DNA, 19 bp, Homo sapiens
acatgttactgaccagcaa

SEQ ID NO: 805696 - DNA, 13 bp, Homo sapiens
acatgttactgct

SEQ ID NO: 805697 - DNA, 18 bp, Homo sapiens
acatgttactgcttcatt

SEQ ID NO: 805698 - DNA, 19 bp, Homo sapiens
acatgttactggataaatt

SEQ ID NO: 805699 - DNA, 21 bp, Homo sapiens
acatgttactggataaattgt

SEQ ID NO: 805700 - DNA, 15 bp, Homo sapiens
acatgttatatattt

SEQ ID NO: 805701 - DNA, 19 bp, Homo sapiens
acatgttggaaatgtgttt

SEQ ID NO: 805702 - DNA, 16 bp, Homo sapiens
acatgtttaaattgta

SEQ ID NO: 805703 - DNA, 13 bp, Homo sapiens
acatgtttccatc

SEQ ID NO: 805704 - DNA, 17 bp, Homo sapiens
acatgtttctgttttgt

SEQ ID NO: 805705 - DNA, 14 bp, Homo sapiens
acatgttttttcat

SEQ ID NO: 805706 - DNA, 15 bp, Homo sapiens
acattaaaacaatat

SEQ ID NO: 805707 - DNA, 18 bp, Homo sapiens
acattaaaactcataatt

SEQ ID NO: 805708 - DNA, 21 bp, Homo sapiens
acattaaacactgtaatctta

SEQ ID NO: 805709 - DNA, 17 bp, Homo sapiens
acattaaatgcaataat

SEQ ID NO: 805710 - DNA, 19 bp, Homo sapiens
acattaaatgcaataattt

SEQ ID NO: 805711 - DNA, 23 bp, Homo sapiens
acattaaatgcaataattttact

SEQ ID NO: 805712 - DNA, 14 bp, Homo sapiens
acattaacaaataa

SEQ ID NO: 805713 - DNA, 15 bp, Homo sapiens
acattaacaaataaa

SEQ ID NO: 805714 - DNA, 22 bp, Homo sapiens
acattaacagttttccatgaaa

SEQ ID NO: 805715 - DNA, 14 bp, Homo sapiens
acattaacggtgct

SEQ ID NO: 805716 - DNA, 16 bp, Homo sapiens
acattaacggtgctaa

SEQ ID NO: 805717 - DNA, 15 bp, Homo sapiens
acattaactccctcc

SEQ ID NO: 805718 - DNA, 17 bp, Homo sapiens
acattaagaagagcaga

SEQ ID NO: 805719 - DNA, 19 bp, Homo sapiens
acattaaggaatttgatga

SEQ ID NO: 805720 - DNA, 14 bp, Homo sapiens
acattaaggagcag

SEQ ID NO: 805721 - DNA, 18 bp, Homo sapiens
acattaatagcagccttt

SEQ ID NO: 805722 - DNA, 21 bp, Homo sapiens
acattaatcaatcatctgtgt

SEQ ID NO: 805723 - DNA, 19 bp, Homo sapiens
acattaatccacatgtttc

SEQ ID NO: 805724 - DNA, 22 bp, Homo sapiens
acattaatccacatgtttcaga

SEQ ID NO: 805725 - DNA, 17 bp, Homo sapiens
acattaatgataaactc

SEQ ID NO: 805726 - DNA, 21 bp, Homo sapiens
acattaatgtcctcttgctgt

SEQ ID NO: 805727 - DNA, 15 bp, Homo sapiens
acattaatgttaatt

SEQ ID NO: 805728 - DNA, 21 bp, Homo sapiens
acattaatgttaattcagcac

SEQ ID NO: 805729 - DNA, 22 bp, Homo sapiens
acattaatgttaattcagcact

SEQ ID NO: 805730 - DNA, 13 bp, Homo sapiens
acattaattttgt

SEQ ID NO: 805731 - DNA, 16 bp, Homo sapiens
acattaattttgtgca

SEQ ID NO: 805732 - DNA, 22 bp, Homo sapiens
acattacaaagttaaaattgtt

SEQ ID NO: 805733 - DNA, 12 bp, Homo sapiens
acattacagttc

SEQ ID NO: 805734 - DNA, 13 bp, Homo sapiens
acattacagttca

SEQ ID NO: 805735 - DNA, 17 bp, Homo sapiens
acattacagttcataat

SEQ ID NO: 805736 - DNA, 16 bp, Homo sapiens
acattacttatttaac

SEQ ID NO: 805737 - DNA, 18 bp, Homo sapiens
acattagaacactgcatt

SEQ ID NO: 805738 - DNA, 14 bp, Homo sapiens
acattagatgtcat

SEQ ID NO: 805739 - DNA, 12 bp, Homo sapiens
acattaggaatt

SEQ ID NO: 805740 - DNA, 16 bp, Homo sapiens
acattaggaattgttt

SEQ ID NO: 805741 - DNA, 13 bp, Homo sapiens
acattaggctgtt

SEQ ID NO: 805742 - DNA, 19 bp, Homo sapiens
acattagtgaaaattctgt

SEQ ID NO: 805743 - DNA, 22 bp, Homo sapiens
acattataaaccttcagaagct

SEQ ID NO: 805744 - DNA, 21 bp, Homo sapiens
acattatcttcatatgtcacc

SEQ ID NO: 805745 - DNA, 12 bp, Homo sapiens
acattattactt

SEQ ID NO: 805746 - DNA, 16 bp, Homo sapiens
acattatttctagtcc

SEQ ID NO: 805747 - DNA, 20 bp, Homo sapiens
acattcaaaacgtgatgttt

SEQ ID NO: 805748 - DNA, 13 bp, Homo sapiens
acattcacagccc

SEQ ID NO: 805749 - DNA, 14 bp, Homo sapiens
acattcacagccca

SEQ ID NO: 805750 - DNA, 17 bp, Homo sapiens
acattcactgctgattt

SEQ ID NO: 805751 - DNA, 16 bp, Homo sapiens
acattcaggaagatga

SEQ ID NO: 805752 - DNA, 15 bp, Homo sapiens
acattcatgtaactc

SEQ ID NO: 805753 - DNA, 22 bp, Homo sapiens
accacactggactccggccctc

SEQ ID NO: 805754 - DNA, 23 bp, Homo sapiens
accacactgggtgcgtctccagt

SEQ ID NO: 805755 - DNA, 13 bp, Homo sapiens
accacacttcctg

SEQ ID NO: 805756 - DNA, 17 bp, Homo sapiens
accacacttcctgtcca

SEQ ID NO: 805757 - DNA, 15 bp, Homo sapiens
accacagaaatcaca

SEQ ID NO: 805758 - DNA, 23 bp, Homo sapiens
accacagacacaatatgtatgct

SEQ ID NO: 805759 - DNA, 13 bp, Homo sapiens
accacagacacac

SEQ ID NO: 805760 - DNA, 21 bp, Homo sapiens
accacagacatactaaccagc

SEQ ID NO: 805761 - DNA, 21 bp, Homo sapiens
accacagatgtgtctgggaga

SEQ ID NO: 805762 - DNA, 22 bp, Homo sapiens
accacagatgtgtctgggagag

SEQ ID NO: 805763 - DNA, 16 bp, Homo sapiens
accacagcaactgacc

SEQ ID NO: 805764 - DNA, 18 bp, Homo sapiens
accacagcaactgacctg

SEQ ID NO: 805765 - DNA, 21 bp, Homo sapiens
accacagcagctgaacagcca

SEQ ID NO: 805766 - DNA, 19 bp, Homo sapiens
accacagccagcacctggc

SEQ ID NO: 805767 - DNA, 17 bp, Homo sapiens
accacagccggtcagag

SEQ ID NO: 805768 - DNA, 14 bp, Homo sapiens
accacagctgggca

SEQ ID NO: 805769 - DNA, 19 bp, Homo sapiens
accacagtgggtggcacct

SEQ ID NO: 805770 - DNA, 16 bp, Homo sapiens
accacatataacactt

SEQ ID NO: 805771 - DNA, 20 bp, Homo sapiens
accacatcctccgtccagcc

SEQ ID NO: 805772 - DNA, 21 bp, Homo sapiens
accacatcctccgtccagccg

SEQ ID NO: 805773 - DNA, 20 bp, Homo sapiens
accacatctaagcctgaagg

SEQ ID NO: 805774 - DNA, 20 bp, Homo sapiens
accacatctgtcctcaccct

SEQ ID NO: 805775 - DNA, 23 bp, Homo sapiens
accacatctgtcctcaccctgtg

SEQ ID NO: 805776 - DNA, 17 bp, Homo sapiens
accacatgtcccagatc

SEQ ID NO: 805777 - DNA, 15 bp, Homo sapiens
accacattgaagaat

SEQ ID NO: 805778 - DNA, 13 bp, Homo sapiens
accacattgcttt

SEQ ID NO: 805779 - DNA, 20 bp, Homo sapiens
accaccactggccaccaggc

SEQ ID NO: 805780 - DNA, 21 bp, Homo sapiens
accaccactggccaccaggct

SEQ ID NO: 805781 - DNA, 15 bp, Homo sapiens
accaccagccccagc

SEQ ID NO: 805782 - DNA, 19 bp, Homo sapiens
accaccaggactgaaagaa

SEQ ID NO: 805783 - DNA, 15 bp, Homo sapiens
accaccaggagcagc

SEQ ID NO: 805784 - DNA, 19 bp, Homo sapiens
accaccaggagcagcagcc

SEQ ID NO: 805785 - DNA, 18 bp, Homo sapiens
accaccccaacaaaccat

SEQ ID NO: 805786 - DNA, 18 bp, Homo sapiens
accacccccaaacacaaa

SEQ ID NO: 805787 - DNA, 18 bp, Homo sapiens
accaccccgcctgccctc

SEQ ID NO: 805788 - DNA, 13 bp, Homo sapiens
accacccctacca

SEQ ID NO: 805789 - DNA, 21 bp, Homo sapiens
accaccctagtcccttcccct

SEQ ID NO: 805790 - DNA, 14 bp, Homo sapiens
accaccctctgggg

SEQ ID NO: 805791 - DNA, 19 bp, Homo sapiens
accaccgaatatattactg

SEQ ID NO: 805792 - DNA, 21 bp, Homo sapiens
accaccgaatatattactgat

SEQ ID NO: 805793 - DNA, 19 bp, Homo sapiens
accaccgcatatgcatgcc

SEQ ID NO: 805794 - DNA, 20 bp, Homo sapiens
accaccgcatatgcatgcca

SEQ ID NO: 805795 - DNA, 22 bp, Homo sapiens
accaccgcatatgcatgccagg

SEQ ID NO: 805796 - DNA, 22 bp, Homo sapiens
accaccgcctctggccgccacc

SEQ ID NO: 805797 - DNA, 23 bp, Homo sapiens
accaccgctccccagcccagggt

SEQ ID NO: 805798 - DNA, 23 bp, Homo sapiens
accaccggccccctccccccaga

SEQ ID NO: 805799 - DNA, 21 bp, Homo sapiens
accacctaggccactcctcca

SEQ ID NO: 805800 - DNA, 13 bp, Homo sapiens
accacctctgtgg

SEQ ID NO: 805801 - DNA, 14 bp, Homo sapiens
accacctctgtggc

SEQ ID NO: 805802 - DNA, 15 bp, Homo sapiens
accacctctgtggca

SEQ ID NO: 805803 - DNA, 13 bp, Homo sapiens
accacctgtacat

SEQ ID NO: 805804 - DNA, 16 bp, Homo sapiens
accacctgtacataca

SEQ ID NO: 805805 - DNA, 13 bp, Homo sapiens
accaccttcccag

SEQ ID NO: 805806 - DNA, 14 bp, Homo sapiens
accaccttcccagc

SEQ ID NO: 805807 - DNA, 16 bp, Homo sapiens
accaccttcccagctc

SEQ ID NO: 805808 - DNA, 17 bp, Homo sapiens
accaccttcccagctct

SEQ ID NO: 805809 - DNA, 21 bp, Homo sapiens
accaccttcccagctctccct

SEQ ID NO: 805810 - DNA, 20 bp, Homo sapiens
accaccttctgtccccagcc

SEQ ID NO: 805811 - DNA, 21 bp, Homo sapiens
accaccttctgtccccagccc

SEQ ID NO: 805812 - DNA, 20 bp, Homo sapiens
accaccttggactcctccca

SEQ ID NO: 805813 - DNA, 22 bp, Homo sapiens
accaccttggactcctcccaca

SEQ ID NO: 805814 - DNA, 15 bp, Homo sapiens
accacctttactgtg

SEQ ID NO: 805815 - DNA, 16 bp, Homo sapiens
accacctttactgtgc

SEQ ID NO: 805816 - DNA, 20 bp, Homo sapiens
accacctttactgtgcttat

SEQ ID NO: 805817 - DNA, 15 bp, Homo sapiens
accacctttggctgg

SEQ ID NO: 805818 - DNA, 19 bp, Homo sapiens
accacgactggccagggcc

SEQ ID NO: 805819 - DNA, 14 bp, Homo sapiens
accacgaggctgcc

SEQ ID NO: 805820 - DNA, 16 bp, Homo sapiens
accacgaggctgcccc

SEQ ID NO: 805821 - DNA, 23 bp, Homo sapiens
accacgaggctgcccccatccag

SEQ ID NO: 805822 - DNA, 14 bp, Homo sapiens
accacgcagccgcc

SEQ ID NO: 805823 - DNA, 21 bp, Homo sapiens
accacgcccgtcctgcctgtg

SEQ ID NO: 805824 - DNA, 14 bp, Homo sapiens
accacggaaaagag

SEQ ID NO: 805825 - DNA, 18 bp, Homo sapiens
accacggaaaagagcgca

SEQ ID NO: 805826 - DNA, 20 bp, Homo sapiens
accacggacgtttccatcag

SEQ ID NO: 805827 - DNA, 14 bp, Homo sapiens
accacgtctgccag

SEQ ID NO: 805828 - DNA, 19 bp, Homo sapiens
accacgtctggctccctgc

SEQ ID NO: 805829 - DNA, 22 bp, Homo sapiens
accacgtctggctccctgcccc

SEQ ID NO: 805830 - DNA, 23 bp, Homo sapiens
accacgtgctacccccatgctgg

SEQ ID NO: 805831 - DNA, 13 bp, Homo sapiens
accacgtggggct

SEQ ID NO: 805832 - DNA, 13 bp, Homo sapiens
accacgtttctaa

SEQ ID NO: 805833 - DNA, 19 bp, Homo sapiens
accacgtttctaaaggcta

SEQ ID NO: 805834 - DNA, 23 bp, Homo sapiens
accactaaaagatcgcagtttgc

SEQ ID NO: 805835 - DNA, 17 bp, Homo sapiens
accactaaccatcccca

SEQ ID NO: 805836 - DNA, 17 bp, Homo sapiens
accactaactcctgaga

SEQ ID NO: 805837 - DNA, 22 bp, Homo sapiens
accactaccagccagcctcaga

SEQ ID NO: 805838 - DNA, 13 bp, Homo sapiens
accactagagctg

SEQ ID NO: 805839 - DNA, 19 bp, Homo sapiens
accactaggaatcccagag

SEQ ID NO: 805840 - DNA, 12 bp, Homo sapiens
accactcagccc

SEQ ID NO: 805841 - DNA, 16 bp, Homo sapiens
accactcagcccctag

SEQ ID NO: 805842 - DNA, 18 bp, Homo sapiens
accactcagcccctagga

SEQ ID NO: 805843 - DNA, 13 bp, Homo sapiens
accactcaggcca

SEQ ID NO: 805844 - DNA, 16 bp, Homo sapiens
accactcctgtccctg

SEQ ID NO: 805845 - DNA, 18 bp, Homo sapiens
accactcctgtccctgta

SEQ ID NO: 805846 - DNA, 19 bp, Homo sapiens
accactcgaggcctgcaaa

SEQ ID NO: 805847 - DNA, 14 bp, Homo sapiens
accactcgtgcatc

SEQ ID NO: 805848 - DNA, 21 bp, Homo sapiens
accactcgtgcatccctgaga

SEQ ID NO: 805849 - DNA, 14 bp, Homo sapiens
accactctgtaatt

SEQ ID NO: 805850 - DNA, 18 bp, Homo sapiens
accactcttttgctgtgc

SEQ ID NO: 805851 - DNA, 14 bp, Homo sapiens
accactgaaaaaat

SEQ ID NO: 805852 - DNA, 15 bp, Homo sapiens
accactgaaaaaata

SEQ ID NO: 805853 - DNA, 19 bp, Homo sapiens
accactgaaaaaatatatg

SEQ ID NO: 805854 - DNA, 20 bp, Homo sapiens
accactgcactccagcctgg

SEQ ID NO: 805855 - DNA, 21 bp, Homo sapiens
accactgcactccagcctggg

SEQ ID NO: 805856 - DNA, 16 bp, Homo sapiens
accactgccaatgctg

SEQ ID NO: 805857 - DNA, 18 bp, Homo sapiens
accactgccaatgctgta

SEQ ID NO: 805858 - DNA, 13 bp, Homo sapiens
accactgccctgc

SEQ ID NO: 805859 - DNA, 18 bp, Homo sapiens
accactgccctgcctgcc

SEQ ID NO: 805860 - DNA, 19 bp, Homo sapiens
accactgccctgcctgccc

SEQ ID NO: 805861 - DNA, 20 bp, Homo sapiens
accactgctatgccatttct

SEQ ID NO: 805862 - DNA, 23 bp, Homo sapiens
accactgctgaggagtctgagga

SEQ ID NO: 805863 - DNA, 16 bp, Homo sapiens
accactggccaccagg

SEQ ID NO: 805864 - DNA, 13 bp, Homo sapiens
accactgggcctg

SEQ ID NO: 805865 - DNA, 15 bp, Homo sapiens
accactgggcctgct

SEQ ID NO: 805866 - DNA, 19 bp, Homo sapiens
accactgtaaaatgaaatt

SEQ ID NO: 805867 - DNA, 20 bp, Homo sapiens
accactgtaaaatgaaatta

SEQ ID NO: 805868 - DNA, 15 bp, Homo sapiens
accactgtgaacatt

SEQ ID NO: 805869 - DNA, 19 bp, Homo sapiens
accactgtgaacatttttt

SEQ ID NO: 805870 - DNA, 21 bp, Homo sapiens
accactgtgaacattttttat

SEQ ID NO: 805871 - DNA, 18 bp, Homo sapiens
accacttaaaaaatgtcc

SEQ ID NO: 805872 - DNA, 13 bp, Homo sapiens
accacttcagctg

SEQ ID NO: 805873 - DNA, 15 bp, Homo sapiens
accacttcagctgac

SEQ ID NO: 805874 - DNA, 17 bp, Homo sapiens
acccaagtttatttctc

SEQ ID NO: 805875 - DNA, 14 bp, Homo sapiens
acccaataaaactg

SEQ ID NO: 805876 - DNA, 14 bp, Homo sapiens
acccaatgggaccg

SEQ ID NO: 805877 - DNA, 21 bp, Homo sapiens
acccaatgggaccgtgcccca

SEQ ID NO: 805878 - DNA, 22 bp, Homo sapiens
acccaatgggaccgtgccccac

SEQ ID NO: 805879 - DNA, 17 bp, Homo sapiens
acccaatgtctcccaca

SEQ ID NO: 805880 - DNA, 12 bp, Homo sapiens
acccacaagccc

SEQ ID NO: 805881 - DNA, 13 bp, Homo sapiens
acccacaagcccg

SEQ ID NO: 805882 - DNA, 14 bp, Homo sapiens
acccacaagctgcc

SEQ ID NO: 805883 - DNA, 22 bp, Homo sapiens
acccacaagctgcctctgacag

SEQ ID NO: 805884 - DNA, 13 bp, Homo sapiens
acccacaagtgcc

SEQ ID NO: 805885 - DNA, 16 bp, Homo sapiens
acccacacagctgccc

SEQ ID NO: 805886 - DNA, 20 bp, Homo sapiens
acccacacagctgccctagc

SEQ ID NO: 805887 - DNA, 20 bp, Homo sapiens
acccacacattccagggctg

SEQ ID NO: 805888 - DNA, 18 bp, Homo sapiens
acccacaccgtcttcctt

SEQ ID NO: 805889 - DNA, 20 bp, Homo sapiens
acccacactgccagaagaga

SEQ ID NO: 805890 - DNA, 20 bp, Homo sapiens
acccacagatgtctctgggg

SEQ ID NO: 805891 - DNA, 20 bp, Homo sapiens
acccacagctctgggcctct

SEQ ID NO: 805892 - DNA, 21 bp, Homo sapiens
acccacagctctgggcctctt

SEQ ID NO: 805893 - DNA, 21 bp, Homo sapiens
acccacaggtgaggggcagga

SEQ ID NO: 805894 - DNA, 20 bp, Homo sapiens
acccaccagaaattccagta

SEQ ID NO: 805895 - DNA, 12 bp, Homo sapiens
acccaccagctc

SEQ ID NO: 805896 - DNA, 18 bp, Homo sapiens
acccaccagctccacaca

SEQ ID NO: 805897 - DNA, 19 bp, Homo sapiens
acccaccagctccacacat

SEQ ID NO: 805898 - DNA, 19 bp, Homo sapiens
acccacccagcccctctcc

SEQ ID NO: 805899 - DNA, 17 bp, Homo sapiens
acccacccatcttcctg

SEQ ID NO: 805900 - DNA, 20 bp, Homo sapiens
acccacccatcttcctgctg

SEQ ID NO: 805901 - DNA, 21 bp, Homo sapiens
acccacccatcttcctgctgc

SEQ ID NO: 805902 - DNA, 13 bp, Homo sapiens
acccaccccaact

SEQ ID NO: 805903 - DNA, 15 bp, Homo sapiens
acccaccccacagac

SEQ ID NO: 805904 - DNA, 21 bp, Homo sapiens
acccaccccacagactccggc

SEQ ID NO: 805905 - DNA, 13 bp, Homo sapiens
acccaccccagca

SEQ ID NO: 805906 - DNA, 16 bp, Homo sapiens
acccaccccagcacag

SEQ ID NO: 805907 - DNA, 14 bp, Homo sapiens
acccacccccaggc

SEQ ID NO: 805908 - DNA, 15 bp, Homo sapiens
acccacccccaggcc

SEQ ID NO: 805909 - DNA, 22 bp, Homo sapiens
acccacccccaggcctcctagg

SEQ ID NO: 805910 - DNA, 12 bp, Homo sapiens
acccacccctgc

SEQ ID NO: 805911 - DNA, 15 bp, Homo sapiens
acccacccctgcaca

SEQ ID NO: 805912 - DNA, 14 bp, Homo sapiens
acccaccctctggt

SEQ ID NO: 805913 - DNA, 23 bp, Homo sapiens
acccacccttacttcctggcctc

SEQ ID NO: 805914 - DNA, 17 bp, Homo sapiens
acccaccgtccgccctg

SEQ ID NO: 805915 - DNA, 20 bp, Homo sapiens
acccaccgtctcggccctga

SEQ ID NO: 805916 - DNA, 12 bp, Homo sapiens
acccacctccac

SEQ ID NO: 805917 - DNA, 13 bp, Homo sapiens
acccacctccacc

SEQ ID NO: 805918 - DNA, 16 bp, Homo sapiens
acccacctccacccag

SEQ ID NO: 805919 - DNA, 17 bp, Homo sapiens
acccacctccacccagc

SEQ ID NO: 805920 - DNA, 21 bp, Homo sapiens
acccacctccacccagcccct

SEQ ID NO: 805921 - DNA, 13 bp, Homo sapiens
acccacctccctg

SEQ ID NO: 805922 - DNA, 16 bp, Homo sapiens
acccacctccctgcct

SEQ ID NO: 805923 - DNA, 13 bp, Homo sapiens
acccacctcctgc

SEQ ID NO: 805924 - DNA, 22 bp, Homo sapiens
acccacctcctgcggctcagcc

SEQ ID NO: 805925 - DNA, 14 bp, Homo sapiens
acccacctcggcct

SEQ ID NO: 805926 - DNA, 15 bp, Homo sapiens
acccacctcggcctc

SEQ ID NO: 805927 - DNA, 13 bp, Homo sapiens
acccacctgctga

SEQ ID NO: 805928 - DNA, 15 bp, Homo sapiens
acccacctggagccc

SEQ ID NO: 805929 - DNA, 21 bp, Homo sapiens
acccaccttgttggagcctgc

SEQ ID NO: 805930 - DNA, 22 bp, Homo sapiens
acccaccttgttggagcctgca

SEQ ID NO: 805931 - DNA, 18 bp, Homo sapiens
acccacgaacgctcttag

SEQ ID NO: 805932 - DNA, 19 bp, Homo sapiens
acccacgattttctccagc

SEQ ID NO: 805933 - DNA, 21 bp, Homo sapiens
acccacgtgagagaatctgcc

SEQ ID NO: 805934 - DNA, 15 bp, Homo sapiens
acccactcaccaggg

SEQ ID NO: 805935 - DNA, 17 bp, Homo sapiens
acccactcaccagggtc

SEQ ID NO: 805936 - DNA, 23 bp, Homo sapiens
acccactcggatggaccaacctg

SEQ ID NO: 805937 - DNA, 16 bp, Homo sapiens
acccactctggtggcc

SEQ ID NO: 805938 - DNA, 22 bp, Homo sapiens
acccactgaattgacatgaccc

SEQ ID NO: 805939 - DNA, 23 bp, Homo sapiens
acccactgccccgtgtgaatgta

SEQ ID NO: 805940 - DNA, 17 bp, Homo sapiens
acccactggactcacct

SEQ ID NO: 805941 - DNA, 16 bp, Homo sapiens
acccactgtccgcctc

SEQ ID NO: 805942 - DNA, 18 bp, Homo sapiens
acccactgtccgcctctg

SEQ ID NO: 805943 - DNA, 21 bp, Homo sapiens
acccacttctggcctccagcc

SEQ ID NO: 805944 - DNA, 21 bp, Homo sapiens
acccagaatggagcctgctct

SEQ ID NO: 805945 - DNA, 18 bp, Homo sapiens
acccagacaaccaaaaca

SEQ ID NO: 805946 - DNA, 21 bp, Homo sapiens
acccagagcacaggagctgcc

SEQ ID NO: 805947 - DNA, 19 bp, Homo sapiens
acccagagccctctgagcc

SEQ ID NO: 805948 - DNA, 13 bp, Homo sapiens
acccagaggccct

SEQ ID NO: 805949 - DNA, 14 bp, Homo sapiens
acccagaggccctg

SEQ ID NO: 805950 - DNA, 14 bp, Homo sapiens
acccagatcaggaa

SEQ ID NO: 805951 - DNA, 17 bp, Homo sapiens
acccagatcaggaacca

SEQ ID NO: 805952 - DNA, 23 bp, Homo sapiens
acccagatcaggaaccagggcct

SEQ ID NO: 805953 - DNA, 17 bp, Homo sapiens
acccagcaacagaaaaa

SEQ ID NO: 805954 - DNA, 14 bp, Homo sapiens
acccagcatctccc

SEQ ID NO: 805955 - DNA, 18 bp, Homo sapiens
acccagccagctgcaggg

SEQ ID NO: 805956 - DNA, 19 bp, Homo sapiens
acccagccatctgcccagg

SEQ ID NO: 805957 - DNA, 15 bp, Homo sapiens
acccagcccagccca

SEQ ID NO: 805958 - DNA, 14 bp, Homo sapiens
acccagcccattct

SEQ ID NO: 805959 - DNA, 19 bp, Homo sapiens
acccagcccattctctctc

SEQ ID NO: 805960 - DNA, 20 bp, Homo sapiens
acccagcccctctcccctct

SEQ ID NO: 805961 - DNA, 23 bp, Homo sapiens
acccagcccctctcccctctctg

SEQ ID NO: 805962 - DNA, 17 bp, Homo sapiens
acccagccccttgagaa

SEQ ID NO: 805963 - DNA, 15 bp, Homo sapiens
acccagccctcatcc

SEQ ID NO: 805964 - DNA, 13 bp, Homo sapiens
acccagcccttcc

SEQ ID NO: 805965 - DNA, 15 bp, Homo sapiens
acccagcgtggccca

SEQ ID NO: 805966 - DNA, 16 bp, Homo sapiens
acccagcgtggcccag

SEQ ID NO: 805967 - DNA, 20 bp, Homo sapiens
acccagcgtggcccaggccg

SEQ ID NO: 805968 - DNA, 22 bp, Homo sapiens
acccagctactctgtccaggcc

SEQ ID NO: 805969 - DNA, 22 bp, Homo sapiens
acccagctactgaaccagccac

SEQ ID NO: 805970 - DNA, 16 bp, Homo sapiens
acccagctcctctgag

SEQ ID NO: 805971 - DNA, 21 bp, Homo sapiens
acccagctccttttgtcccca

SEQ ID NO: 805972 - DNA, 16 bp, Homo sapiens
acccagctgcagacca

SEQ ID NO: 805973 - DNA, 14 bp, Homo sapiens
acccagctggtcct

SEQ ID NO: 805974 - DNA, 22 bp, Homo sapiens
acccagctggtcctgtggatgg

SEQ ID NO: 805975 - DNA, 20 bp, Homo sapiens
acccagctgtgcccctcccc

SEQ ID NO: 805976 - DNA, 20 bp, Homo sapiens
acccagcttagagttcttct

SEQ ID NO: 805977 - DNA, 11 bp, Homo sapiens
acccaggaagg

SEQ ID NO: 805978 - DNA, 13 bp, Homo sapiens
acccaggaaggga

SEQ ID NO: 805979 - DNA, 10 bp, Homo sapiens
acccaggaca

SEQ ID NO: 805980 - DNA, 18 bp, Homo sapiens
acccaggacgcttctgaa

SEQ ID NO: 805981 - DNA, 23 bp, Homo sapiens
acccaggagatggaagttgcagt

SEQ ID NO: 805982 - DNA, 11 bp, Homo sapiens
acccaggaggt

SEQ ID NO: 805983 - DNA, 20 bp, Homo sapiens
acccaggaggtggaggttgc

SEQ ID NO: 805984 - DNA, 22 bp, Homo sapiens
acccaggaggtggaggttgcag

SEQ ID NO: 805985 - DNA, 20 bp, Homo sapiens
acccaggccctccatgggct

SEQ ID NO: 805986 - DNA, 19 bp, Homo sapiens
acccaggctccgcccttag

SEQ ID NO: 805987 - DNA, 12 bp, Homo sapiens
acccaggctgca

SEQ ID NO: 805988 - DNA, 14 bp, Homo sapiens
acccaggctgcact

SEQ ID NO: 805989 - DNA, 18 bp, Homo sapiens
acccaggctgcactgcag

SEQ ID NO: 805990 - DNA, 19 bp, Homo sapiens
acccaggctggagtgcagt

SEQ ID NO: 805991 - DNA, 20 bp, Homo sapiens
acccaggctggagtgcggtg

SEQ ID NO: 805992 - DNA, 17 bp, Homo sapiens
acccagggcctgacttg

SEQ ID NO: 805993 - DNA, 19 bp, Homo sapiens
acccagggctccctcctgg

SEQ ID NO: 805994 - DNA, 22 bp, Homo sapiens
acccagggctccctcctggagc

SEQ ID NO: 805995 - DNA, 20 bp, Homo sapiens
acccaggggaaggccctgag

SEQ ID NO: 805996 - DNA, 18 bp, Homo sapiens
accctcagcaccccttcc

SEQ ID NO: 805997 - DNA, 22 bp, Homo sapiens
accctcagcaccccttccatgt

SEQ ID NO: 805998 - DNA, 16 bp, Homo sapiens
accctcagccctggcc

SEQ ID NO: 805999 - DNA, 21 bp, Homo sapiens
accctcagccctggccttttt

SEQ ID NO: 806000 - DNA, 20 bp, Homo sapiens
accctcagctgtcacctgct

SEQ ID NO: 806001 - DNA, 14 bp, Homo sapiens
accctcaggcaggt

SEQ ID NO: 806002 - DNA, 20 bp, Homo sapiens
accctcaggcataggcctgg

SEQ ID NO: 806003 - DNA, 20 bp, Homo sapiens
accctcaggccaccctccac

SEQ ID NO: 806004 - DNA, 20 bp, Homo sapiens
accctcagggagcctcccca

SEQ ID NO: 806005 - DNA, 17 bp, Homo sapiens
accctcatgttcttaat

SEQ ID NO: 806006 - DNA, 16 bp, Homo sapiens
accctcattgtgtttc

SEQ ID NO: 806007 - DNA, 15 bp, Homo sapiens
accctccacaaagca

SEQ ID NO: 806008 - DNA, 20 bp, Homo sapiens
accctccacaaagcaaaggc

SEQ ID NO: 806009 - DNA, 23 bp, Homo sapiens
accctccaccctgtcccccagct

SEQ ID NO: 806010 - DNA, 16 bp, Homo sapiens
accctccactcactgc

SEQ ID NO: 806011 - DNA, 15 bp, Homo sapiens
accctccacttcccg

SEQ ID NO: 806012 - DNA, 16 bp, Homo sapiens
accctccacttcccgt

SEQ ID NO: 806013 - DNA, 12 bp, Homo sapiens
accctcccaccc

SEQ ID NO: 806014 - DNA, 14 bp, Homo sapiens
accctcccaccccc

SEQ ID NO: 806015 - DNA, 20 bp, Homo sapiens
accctcccacccccttctct

SEQ ID NO: 806016 - DNA, 12 bp, Homo sapiens
accctcccactc

SEQ ID NO: 806017 - DNA, 16 bp, Homo sapiens
accctcccactcccat

SEQ ID NO: 806018 - DNA, 21 bp, Homo sapiens
accctcccactcccatctcct

SEQ ID NO: 806019 - DNA, 23 bp, Homo sapiens
accctcccagaaacatctctggc

SEQ ID NO: 806020 - DNA, 21 bp, Homo sapiens
accctcccagtctcatctcct

SEQ ID NO: 806021 - DNA, 10 bp, Homo sapiens
accctccccc

SEQ ID NO: 806022 - DNA, 13 bp, Homo sapiens
accctcccccgca

SEQ ID NO: 806023 - DNA, 14 bp, Homo sapiens
accctcccccgcag

SEQ ID NO: 806024 - DNA, 22 bp, Homo sapiens
accctccccggcggtgccgcgc

SEQ ID NO: 806025 - DNA, 14 bp, Homo sapiens
accctccctcagcc

SEQ ID NO: 806026 - DNA, 19 bp, Homo sapiens
accctccctcagcccctct

SEQ ID NO: 806027 - DNA, 21 bp, Homo sapiens
accctccctccactcctctca

SEQ ID NO: 806028 - DNA, 16 bp, Homo sapiens
accctccctccgatcc

SEQ ID NO: 806029 - DNA, 15 bp, Homo sapiens
accctccgccttcac

SEQ ID NO: 806030 - DNA, 19 bp, Homo sapiens
accctcctccagaccattc

SEQ ID NO: 806031 - DNA, 16 bp, Homo sapiens
accctcctccctccaa

SEQ ID NO: 806032 - DNA, 22 bp, Homo sapiens
accctcctccctccaagcctgg

SEQ ID NO: 806033 - DNA, 12 bp, Homo sapiens
accctcctcctt

SEQ ID NO: 806034 - DNA, 13 bp, Homo sapiens
accctcctccttt

SEQ ID NO: 806035 - DNA, 14 bp, Homo sapiens
accctcctcctttt

SEQ ID NO: 806036 - DNA, 15 bp, Homo sapiens
accctcctctgctgg

SEQ ID NO: 806037 - DNA, 18 bp, Homo sapiens
accctcctctgctgggaa

SEQ ID NO: 806038 - DNA, 11 bp, Homo sapiens
accctcctctt

SEQ ID NO: 806039 - DNA, 16 bp, Homo sapiens
accctccttctatttt

SEQ ID NO: 806040 - DNA, 21 bp, Homo sapiens
accctccttctattttcccta

SEQ ID NO: 806041 - DNA, 20 bp, Homo sapiens
accctcggaaatcagtgcga

SEQ ID NO: 806042 - DNA, 13 bp, Homo sapiens
accctcgggccca

SEQ ID NO: 806043 - DNA, 19 bp, Homo sapiens
accctcgggcccacctggc

SEQ ID NO: 806044 - DNA, 21 bp, Homo sapiens
accctcgggcccacctggcca

SEQ ID NO: 806045 - DNA, 20 bp, Homo sapiens
accctctcactagtgccaat

SEQ ID NO: 806046 - DNA, 15 bp, Homo sapiens
accctctcagctcca

SEQ ID NO: 806047 - DNA, 15 bp, Homo sapiens
accctctcctggggg

SEQ ID NO: 806048 - DNA, 20 bp, Homo sapiens
accctctcctgggggtggca

SEQ ID NO: 806049 - DNA, 22 bp, Homo sapiens
accctctcctgggggtggcagg

SEQ ID NO: 806050 - DNA, 23 bp, Homo sapiens
accctctcctgggggtggcaggc

SEQ ID NO: 806051 - DNA, 22 bp, Homo sapiens
accctctcttgattaagggcta

SEQ ID NO: 806052 - DNA, 19 bp, Homo sapiens
accctctgaatggtccagg

SEQ ID NO: 806053 - DNA, 21 bp, Homo sapiens
accctctgaatggtccagggt

SEQ ID NO: 806054 - DNA, 15 bp, Homo sapiens
accctctgaccctag

SEQ ID NO: 806055 - DNA, 18 bp, Homo sapiens
accctctgcccagggagt

SEQ ID NO: 806056 - DNA, 13 bp, Homo sapiens
accctctgggaac

SEQ ID NO: 806057 - DNA, 12 bp, Homo sapiens
accctctgggag

SEQ ID NO: 806058 - DNA, 13 bp, Homo sapiens
accctctggggac

SEQ ID NO: 806059 - DNA, 15 bp, Homo sapiens
accctctgtccccag

SEQ ID NO: 806060 - DNA, 24 bp, Homo sapiens
accctctgtccccaggcctggctc

SEQ ID NO: 806061 - DNA, 14 bp, Homo sapiens
accctcttagaaaa

SEQ ID NO: 806062 - DNA, 16 bp, Homo sapiens
accctcttcctgtgat

SEQ ID NO: 806063 - DNA, 20 bp, Homo sapiens
accctcttgccatcctgatg

SEQ ID NO: 806064 - DNA, 18 bp, Homo sapiens
accctgaacccacacctg

SEQ ID NO: 806065 - DNA, 21 bp, Homo sapiens
accctgaatggttccatgcct

SEQ ID NO: 806066 - DNA, 17 bp, Homo sapiens
accctgacctccgcccc

SEQ ID NO: 806067 - DNA, 20 bp, Homo sapiens
accctgacctccgcccctgc

SEQ ID NO: 806068 - DNA, 21 bp, Homo sapiens
accctgacctccgcccctgcc

SEQ ID NO: 806069 - DNA, 17 bp, Homo sapiens
accctgagactccagaa

SEQ ID NO: 806070 - DNA, 17 bp, Homo sapiens
accctgagccccttcct

SEQ ID NO: 806071 - DNA, 20 bp, Homo sapiens
accctgaggtcagggagtgc

SEQ ID NO: 806072 - DNA, 22 bp, Homo sapiens
accctgaggtcagggagtgctg

SEQ ID NO: 806073 - DNA, 15 bp, Homo sapiens
accctgatccttttc

SEQ ID NO: 806074 - DNA, 20 bp, Homo sapiens
accctgatctctcagcccca

SEQ ID NO: 806075 - DNA, 12 bp, Homo sapiens
accctgcaccct

SEQ ID NO: 806076 - DNA, 13 bp, Homo sapiens
accctgcacctgc

SEQ ID NO: 806077 - DNA, 14 bp, Homo sapiens
accctgcacctgct

SEQ ID NO: 806078 - DNA, 17 bp, Homo sapiens
accctgcacctgctgcg

SEQ ID NO: 806079 - DNA, 13 bp, Homo sapiens
accctgcagagct

SEQ ID NO: 806080 - DNA, 14 bp, Homo sapiens
accctgcagagcta

SEQ ID NO: 806081 - DNA, 17 bp, Homo sapiens
accctgcattttcctct

SEQ ID NO: 806082 - DNA, 22 bp, Homo sapiens
accctgccaagactcctcaggc

SEQ ID NO: 806083 - DNA, 15 bp, Homo sapiens
accctgccacagcca

SEQ ID NO: 806084 - DNA, 18 bp, Homo sapiens
accctgccacagccagag

SEQ ID NO: 806085 - DNA, 11 bp, Homo sapiens
accctgccagt

SEQ ID NO: 806086 - DNA, 15 bp, Homo sapiens
accctgccagtgcca

SEQ ID NO: 806087 - DNA, 11 bp, Homo sapiens
accctgcccct

SEQ ID NO: 806088 - DNA, 18 bp, Homo sapiens
accctgcccctaagttat

SEQ ID NO: 806089 - DNA, 20 bp, Homo sapiens
accctgcccctaagttatta

SEQ ID NO: 806090 - DNA, 22 bp, Homo sapiens
accctgcccctaagttattacc

SEQ ID NO: 806091 - DNA, 22 bp, Homo sapiens
accctgcccctccccaaaagaa

SEQ ID NO: 806092 - DNA, 12 bp, Homo sapiens
accctgcccctg

SEQ ID NO: 806093 - DNA, 14 bp, Homo sapiens
accctgcccctgcc

SEQ ID NO: 806094 - DNA, 12 bp, Homo sapiens
accctgcccgct

SEQ ID NO: 806095 - DNA, 19 bp, Homo sapiens
accctgccgtcaccaccac

SEQ ID NO: 806096 - DNA, 14 bp, Homo sapiens
accctgcctccctt

SEQ ID NO: 806097 - DNA, 20 bp, Homo sapiens
accctgcctcccttgacttt

SEQ ID NO: 806098 - DNA, 23 bp, Homo sapiens
accctgcctcccttgactttgct

SEQ ID NO: 806099 - DNA, 16 bp, Homo sapiens
accctgcctgagccca

SEQ ID NO: 806100 - DNA, 22 bp, Homo sapiens
accctgcgcccagtccttccac

SEQ ID NO: 806101 - DNA, 22 bp, Homo sapiens
accctgcgcctccagaggtcct

SEQ ID NO: 806102 - DNA, 18 bp, Homo sapiens
accctgctcacaggcagg

SEQ ID NO: 806103 - DNA, 14 bp, Homo sapiens
accctgctcctcct

SEQ ID NO: 806104 - DNA, 15 bp, Homo sapiens
accctgctcctcctg

SEQ ID NO: 806105 - DNA, 21 bp, Homo sapiens
accctgctgaacacagtgtct

SEQ ID NO: 806106 - DNA, 17 bp, Homo sapiens
accctgctgcactagga

SEQ ID NO: 806107 - DNA, 20 bp, Homo sapiens
accctgcttctcccggggac

SEQ ID NO: 806108 - DNA, 16 bp, Homo sapiens
accctggaaaggggag

SEQ ID NO: 806109 - DNA, 19 bp, Homo sapiens
accctggaattcagcaccc

SEQ ID NO: 806110 - DNA, 13 bp, Homo sapiens
accctggagccat

SEQ ID NO: 806111 - DNA, 16 bp, Homo sapiens
accctggagccatccc

SEQ ID NO: 806112 - DNA, 18 bp, Homo sapiens
accctggagttcttggga

SEQ ID NO: 806113 - DNA, 16 bp, Homo sapiens
accctggatcagtcct

SEQ ID NO: 806114 - DNA, 23 bp, Homo sapiens
accctggcactataatgtaagct

SEQ ID NO: 806115 - DNA, 22 bp, Homo sapiens
accctggcccgcccctcgctgc

SEQ ID NO: 806116 - DNA, 18 bp, Homo sapiens
accctggccgagtccaag

SEQ ID NO: 806117 - DNA, 11 bp, Homo sapiens
accctggcctg

SEQ ID NO: 806118 - DNA, 19 bp, Homo sapiens
accgatggagcccccagat

SEQ ID NO: 806119 - DNA, 21 bp, Homo sapiens
accgatggtcccaggaagcag

SEQ ID NO: 806120 - DNA, 18 bp, Homo sapiens
accgattatgctttcttt

SEQ ID NO: 806121 - DNA, 12 bp, Homo sapiens
accgcacagctc

SEQ ID NO: 806122 - DNA, 17 bp, Homo sapiens
accgcacatgcacacac

SEQ ID NO: 806123 - DNA, 23 bp, Homo sapiens
accgcagccagccggtgcctggc

SEQ ID NO: 806124 - DNA, 12 bp, Homo sapiens
accgcagctact

SEQ ID NO: 806125 - DNA, 13 bp, Homo sapiens
accgcaggcccgg

SEQ ID NO: 806126 - DNA, 14 bp, Homo sapiens
accgcaggcccgga

SEQ ID NO: 806127 - DNA, 15 bp, Homo sapiens
accgcaggcccggac

SEQ ID NO: 806128 - DNA, 16 bp, Homo sapiens
accgcaggcccggact

SEQ ID NO: 806129 - DNA, 16 bp, Homo sapiens
accgcatatgcatgcc

SEQ ID NO: 806130 - DNA, 17 bp, Homo sapiens
accgcatatgcatgcca

SEQ ID NO: 806131 - DNA, 18 bp, Homo sapiens
accgcatatgcatgccag

SEQ ID NO: 806132 - DNA, 19 bp, Homo sapiens
accgcatatgcatgccagg

SEQ ID NO: 806133 - DNA, 16 bp, Homo sapiens
accgccacgtcccagc

SEQ ID NO: 806134 - DNA, 17 bp, Homo sapiens
accgccacgtcccagca

SEQ ID NO: 806135 - DNA, 13 bp, Homo sapiens
accgcccagctca

SEQ ID NO: 806136 - DNA, 14 bp, Homo sapiens
accgcccagctctc

SEQ ID NO: 806137 - DNA, 17 bp, Homo sapiens
accgcccagctctccca

SEQ ID NO: 806138 - DNA, 19 bp, Homo sapiens
accgcccagctctcccaca

SEQ ID NO: 806139 - DNA, 13 bp, Homo sapiens
accgcccccaccc

SEQ ID NO: 806140 - DNA, 15 bp, Homo sapiens
accgcccccacccct

SEQ ID NO: 806141 - DNA, 21 bp, Homo sapiens
accgcccccaccccttcccca

SEQ ID NO: 806142 - DNA, 22 bp, Homo sapiens
accgcccccaccccttccccag

SEQ ID NO: 806143 - DNA, 11 bp, Homo sapiens
accgccccctc

SEQ ID NO: 806144 - DNA, 12 bp, Homo sapiens
accgccccctcc

SEQ ID NO: 806145 - DNA, 19 bp, Homo sapiens
accgccccctcctctagct

SEQ ID NO: 806146 - DNA, 16 bp, Homo sapiens
accgcccctggccgcg

SEQ ID NO: 806147 - DNA, 18 bp, Homo sapiens
accgccctgggctggact

SEQ ID NO: 806148 - DNA, 19 bp, Homo sapiens
accgcctagtttactgttt

SEQ ID NO: 806149 - DNA, 16 bp, Homo sapiens
accgcctcgtgccagc

SEQ ID NO: 806150 - DNA, 17 bp, Homo sapiens
accgcctcgtgccagca

SEQ ID NO: 806151 - DNA, 21 bp, Homo sapiens
accgcctcgtgccagcagcct

SEQ ID NO: 806152 - DNA, 13 bp, Homo sapiens
accgcctctggcc

SEQ ID NO: 806153 - DNA, 13 bp, Homo sapiens
accgcctgccctc

SEQ ID NO: 806154 - DNA, 23 bp, Homo sapiens
accgcctgccctgcctgggcctt

SEQ ID NO: 806155 - DNA, 12 bp, Homo sapiens
accgcctggccc

SEQ ID NO: 806156 - DNA, 13 bp, Homo sapiens
accgcctggccct

SEQ ID NO: 806157 - DNA, 14 bp, Homo sapiens
accgcctggccctc

SEQ ID NO: 806158 - DNA, 20 bp, Homo sapiens
accgcctggccctccctccc

SEQ ID NO: 806159 - DNA, 22 bp, Homo sapiens
accgcctggccctccctcccta

SEQ ID NO: 806160 - DNA, 17 bp, Homo sapiens
accgcggacgtgctggc

SEQ ID NO: 806161 - DNA, 19 bp, Homo sapiens
accgcggacgtgctggcct

SEQ ID NO: 806162 - DNA, 20 bp, Homo sapiens
accgcggacgtgctggcctt

SEQ ID NO: 806163 - DNA, 21 bp, Homo sapiens
accgcggaggaggctggtgac

SEQ ID NO: 806164 - DNA, 13 bp, Homo sapiens
accgctaaaagaa

SEQ ID NO: 806165 - DNA, 16 bp, Homo sapiens
accgctaaaagaaact

SEQ ID NO: 806166 - DNA, 13 bp, Homo sapiens
accgctcagtatt

SEQ ID NO: 806167 - DNA, 14 bp, Homo sapiens
accgctcagtattt

SEQ ID NO: 806168 - DNA, 23 bp, Homo sapiens
accgctccccacagctttgcacc

SEQ ID NO: 806169 - DNA, 17 bp, Homo sapiens
accgctccccagcccag

SEQ ID NO: 806170 - DNA, 19 bp, Homo sapiens
accgctcccctctcctccg

SEQ ID NO: 806171 - DNA, 15 bp, Homo sapiens
accgctctccctttg

SEQ ID NO: 806172 - DNA, 14 bp, Homo sapiens
accgctgccagcac

SEQ ID NO: 806173 - DNA, 19 bp, Homo sapiens
accgctgccagcacagagc

SEQ ID NO: 806174 - DNA, 15 bp, Homo sapiens
accgctggcccttag

SEQ ID NO: 806175 - DNA, 18 bp, Homo sapiens
accgctggcccttagaga

SEQ ID NO: 806176 - DNA, 13 bp, Homo sapiens
accgctgggtggt

SEQ ID NO: 806177 - DNA, 16 bp, Homo sapiens
accgcttcacccctgc

SEQ ID NO: 806178 - DNA, 19 bp, Homo sapiens
accgcttcacccctgcact

SEQ ID NO: 806179 - DNA, 20 bp, Homo sapiens
accgcttcacccctgcactt

SEQ ID NO: 806180 - DNA, 15 bp, Homo sapiens
accgcttctgccttt

SEQ ID NO: 806181 - DNA, 19 bp, Homo sapiens
accggagagttatcctgat

SEQ ID NO: 806182 - DNA, 15 bp, Homo sapiens
accggcccctggcag

SEQ ID NO: 806183 - DNA, 14 bp, Homo sapiens
accggcgctgcagg

SEQ ID NO: 806184 - DNA, 16 bp, Homo sapiens
accggctctcacctgg

SEQ ID NO: 806185 - DNA, 21 bp, Homo sapiens
accggctctcacctggccctg

SEQ ID NO: 806186 - DNA, 20 bp, Homo sapiens
accgggagcctccccctcag

SEQ ID NO: 806187 - DNA, 16 bp, Homo sapiens
accgggatccagttcc

SEQ ID NO: 806188 - DNA, 12 bp, Homo sapiens
accgggctgcag

SEQ ID NO: 806189 - DNA, 14 bp, Homo sapiens
accgggctgcaggt

SEQ ID NO: 806190 - DNA, 15 bp, Homo sapiens
accggggcaagaggg

SEQ ID NO: 806191 - DNA, 17 bp, Homo sapiens
accgggtgggcctggcc

SEQ ID NO: 806192 - DNA, 23 bp, Homo sapiens
accgggtgggcctggcctgagct

SEQ ID NO: 806193 - DNA, 13 bp, Homo sapiens
accggtcagtgcc

SEQ ID NO: 806194 - DNA, 16 bp, Homo sapiens
accggtcagtgccttt

SEQ ID NO: 806195 - DNA, 14 bp, Homo sapiens
accggtccagctgg

SEQ ID NO: 806196 - DNA, 18 bp, Homo sapiens
accggtgcttctggaaac

SEQ ID NO: 806197 - DNA, 22 bp, Homo sapiens
accgtaaaggtttatttttctg

SEQ ID NO: 806198 - DNA, 17 bp, Homo sapiens
accgtaataattattat

SEQ ID NO: 806199 - DNA, 16 bp, Homo sapiens
accgtacaaccccctc

SEQ ID NO: 806200 - DNA, 22 bp, Homo sapiens
accgtacagtttctgcttggga

SEQ ID NO: 806201 - DNA, 18 bp, Homo sapiens
accgtactccctgcaccg

SEQ ID NO: 806202 - DNA, 18 bp, Homo sapiens
accgtactctcacatgtg

SEQ ID NO: 806203 - DNA, 19 bp, Homo sapiens
accgtactctcacatgtgg

SEQ ID NO: 806204 - DNA, 13 bp, Homo sapiens
accgtagcctccg

SEQ ID NO: 806205 - DNA, 22 bp, Homo sapiens
accgtcatggcttaatgtttat

SEQ ID NO: 806206 - DNA, 23 bp, Homo sapiens
accgtcatggcttaatgtttatt

SEQ ID NO: 806207 - DNA, 12 bp, Homo sapiens
accgtccagggg

SEQ ID NO: 806208 - DNA, 16 bp, Homo sapiens
accgtccgccctgctc

SEQ ID NO: 806209 - DNA, 14 bp, Homo sapiens
accgtcctgctgtc

SEQ ID NO: 806210 - DNA, 18 bp, Homo sapiens
accgtcctgctgtccctg

SEQ ID NO: 806211 - DNA, 18 bp, Homo sapiens
accgtcgaccaggaaagc

SEQ ID NO: 806212 - DNA, 15 bp, Homo sapiens
accgtctcggccctg

SEQ ID NO: 806213 - DNA, 20 bp, Homo sapiens
accgtctcggccctgaacca

SEQ ID NO: 806214 - DNA, 12 bp, Homo sapiens
accgtcttcctt

SEQ ID NO: 806215 - DNA, 14 bp, Homo sapiens
accgtgatggagag

SEQ ID NO: 806216 - DNA, 22 bp, Homo sapiens
accgtgccaaccccacccagct

SEQ ID NO: 806217 - DNA, 22 bp, Homo sapiens
accgtgccattgtactccagcc

SEQ ID NO: 806218 - DNA, 15 bp, Homo sapiens
accgtgcctggccag

SEQ ID NO: 806219 - DNA, 15 bp, Homo sapiens
accgtggaggaggaa

SEQ ID NO: 806220 - DNA, 18 bp, Homo sapiens
accgtgggcagtgccacc

SEQ ID NO: 806221 - DNA, 14 bp, Homo sapiens
accgtgggctccct

SEQ ID NO: 806222 - DNA, 16 bp, Homo sapiens
accgtgggctccctga

SEQ ID NO: 806223 - DNA, 17 bp, Homo sapiens
accgtgggggaactgac

SEQ ID NO: 806224 - DNA, 14 bp, Homo sapiens
accgtgtaaaccaa

SEQ ID NO: 806225 - DNA, 11 bp, Homo sapiens
accgtgtacaa

SEQ ID NO: 806226 - DNA, 13 bp, Homo sapiens
accgtgtacaata

SEQ ID NO: 806227 - DNA, 19 bp, Homo sapiens
accgtgtcccaaggagctg

SEQ ID NO: 806228 - DNA, 15 bp, Homo sapiens
accgtgtcctcctct

SEQ ID NO: 806229 - DNA, 21 bp, Homo sapiens
accgttcgtacgcccaggaca

SEQ ID NO: 806230 - DNA, 23 bp, Homo sapiens
accgttctctgtccccaggtcct

SEQ ID NO: 806231 - DNA, 19 bp, Homo sapiens
accgttttcatcctggcct

SEQ ID NO: 806232 - DNA, 21 bp, Homo sapiens
accgttttcatcctggcctcc

SEQ ID NO: 806233 - DNA, 14 bp, Homo sapiens
accgttttgtattg

SEQ ID NO: 806234 - DNA, 15 bp, Homo sapiens
acctaaaaaagatat

SEQ ID NO: 806235 - DNA, 19 bp, Homo sapiens
acctaaaaaagatatatta

SEQ ID NO: 806236 - DNA, 12 bp, Homo sapiens
acctaaagaaaa

SEQ ID NO: 806237 - DNA, 16 bp, Homo sapiens
acctaaaggtgtattt

SEQ ID NO: 806238 - DNA, 15 bp, Homo sapiens
acctaaatggcctca

SEQ ID NO: 806239 - DNA, 20 bp, Homo sapiens
acctaacaacattgtagcct

SEQ ID NO: 806240 - DNA, 20 bp, Homo sapiens
acctaacacattaaatgtgg

SEQ ID NO: 806241 - DNA, 19 bp, Homo sapiens
acctctacggacctcacat

SEQ ID NO: 806242 - DNA, 13 bp, Homo sapiens
acctctactgtct

SEQ ID NO: 806243 - DNA, 16 bp, Homo sapiens
acctctagtagctgaa

SEQ ID NO: 806244 - DNA, 12 bp, Homo sapiens
acctctatacag

SEQ ID NO: 806245 - DNA, 21 bp, Homo sapiens
acctctattcttgggaaacac

SEQ ID NO: 806246 - DNA, 16 bp, Homo sapiens
acctctcactccccat

SEQ ID NO: 806247 - DNA, 23 bp, Homo sapiens
acctctcagcatagcctgcctga

SEQ ID NO: 806248 - DNA, 20 bp, Homo sapiens
acctctcaggattgctagga

SEQ ID NO: 806249 - DNA, 13 bp, Homo sapiens
acctctccaaggg

SEQ ID NO: 806250 - DNA, 16 bp, Homo sapiens
acctctccaagtctct

SEQ ID NO: 806251 - DNA, 12 bp, Homo sapiens
acctctccctcg

SEQ ID NO: 806252 - DNA, 18 bp, Homo sapiens
acctctccctgcatcctg

SEQ ID NO: 806253 - DNA, 23 bp, Homo sapiens
acctctccctgcatcctgaggcc

SEQ ID NO: 806254 - DNA, 22 bp, Homo sapiens
acctctcggccccatcgcccca

SEQ ID NO: 806255 - DNA, 17 bp, Homo sapiens
acctctctacttcccct

SEQ ID NO: 806256 - DNA, 16 bp, Homo sapiens
acctctctatttttaa

SEQ ID NO: 806257 - DNA, 22 bp, Homo sapiens
acctctctcagccccatcgccc

SEQ ID NO: 806258 - DNA, 18 bp, Homo sapiens
acctctctcggccccctc

SEQ ID NO: 806259 - DNA, 13 bp, Homo sapiens
acctctctctggg

SEQ ID NO: 806260 - DNA, 15 bp, Homo sapiens
acctctctgcctctc

SEQ ID NO: 806261 - DNA, 18 bp, Homo sapiens
acctctctgcctctcttc

SEQ ID NO: 806262 - DNA, 23 bp, Homo sapiens
acctctctgcctctcttcttccc

SEQ ID NO: 806263 - DNA, 19 bp, Homo sapiens
acctctctgtcccttgctg

SEQ ID NO: 806264 - DNA, 20 bp, Homo sapiens
acctctcttttcctctctgt

SEQ ID NO: 806265 - DNA, 23 bp, Homo sapiens
acctctcttttcctctctgtctg

SEQ ID NO: 806266 - DNA, 20 bp, Homo sapiens
acctctgacgcaccactgcc

SEQ ID NO: 806267 - DNA, 18 bp, Homo sapiens
acctctgatttattttgt

SEQ ID NO: 806268 - DNA, 23 bp, Homo sapiens
acctctgatttattttgtatgaa

SEQ ID NO: 806269 - DNA, 16 bp, Homo sapiens
acctctgcacaagctg

SEQ ID NO: 806270 - DNA, 18 bp, Homo sapiens
acctctgcacaagctgca

SEQ ID NO: 806271 - DNA, 21 bp, Homo sapiens
acctctgcacaagctgcaccc

SEQ ID NO: 806272 - DNA, 21 bp, Homo sapiens
acctctgcactactgacatgt

SEQ ID NO: 806273 - DNA, 15 bp, Homo sapiens
acctctgcagcaata

SEQ ID NO: 806274 - DNA, 18 bp, Homo sapiens
acctctgcctcccaggtt

SEQ ID NO: 806275 - DNA, 23 bp, Homo sapiens
acctctgctctgaggcttccaga

SEQ ID NO: 806276 - DNA, 20 bp, Homo sapiens
acctctgctgagtgctgggc

SEQ ID NO: 806277 - DNA, 21 bp, Homo sapiens
acctctgctgagtgctgggca

SEQ ID NO: 806278 - DNA, 24 bp, Homo sapiens
acctctgcttttatctcagatgtt

SEQ ID NO: 806279 - DNA, 19 bp, Homo sapiens
acctctggaaccccccagg

SEQ ID NO: 806280 - DNA, 15 bp, Homo sapiens
acctctggactggct

SEQ ID NO: 806281 - DNA, 16 bp, Homo sapiens
acctctggactggcta

SEQ ID NO: 806282 - DNA, 23 bp, Homo sapiens
acctctggactggctagagtcct

SEQ ID NO: 806283 - DNA, 22 bp, Homo sapiens
acctctggccaaatatgcactt

SEQ ID NO: 806284 - DNA, 17 bp, Homo sapiens
acctctggcccttggaa

SEQ ID NO: 806285 - DNA, 11 bp, Homo sapiens
acctctgggct

SEQ ID NO: 806286 - DNA, 22 bp, Homo sapiens
acctctggggggataatgtccc

SEQ ID NO: 806287 - DNA, 23 bp, Homo sapiens
acctctgggtccttggctcccgg

SEQ ID NO: 806288 - DNA, 19 bp, Homo sapiens
acctctggtggctcctcct

SEQ ID NO: 806289 - DNA, 15 bp, Homo sapiens
acctctgtaggcagc

SEQ ID NO: 806290 - DNA, 21 bp, Homo sapiens
acctctgtaggcagcagagag

SEQ ID NO: 806291 - DNA, 19 bp, Homo sapiens
acctctgtatagaaatcta

SEQ ID NO: 806292 - DNA, 22 bp, Homo sapiens
acctctgtatagaaatctaaaa

SEQ ID NO: 806293 - DNA, 20 bp, Homo sapiens
acctctgtccctcaaaattg

SEQ ID NO: 806294 - DNA, 14 bp, Homo sapiens
acctcttcccatga

SEQ ID NO: 806295 - DNA, 15 bp, Homo sapiens
acctcttcccatgac

SEQ ID NO: 806296 - DNA, 14 bp, Homo sapiens
acctcttccccaga

SEQ ID NO: 806297 - DNA, 23 bp, Homo sapiens
acctcttccccagaaaggagact

SEQ ID NO: 806298 - DNA, 14 bp, Homo sapiens
acctcttcctctgg

SEQ ID NO: 806299 - DNA, 17 bp, Homo sapiens
acctcttctcttcctgt

SEQ ID NO: 806300 - DNA, 21 bp, Homo sapiens
acctcttctcttcctgtaaca

SEQ ID NO: 806301 - DNA, 14 bp, Homo sapiens
acctcttgctgcca

SEQ ID NO: 806302 - DNA, 18 bp, Homo sapiens
acctcttgctgtctctgc

SEQ ID NO: 806303 - DNA, 24 bp, Homo sapiens
acctcttgctgtctctgctcgccc

SEQ ID NO: 806304 - DNA, 22 bp, Homo sapiens
acctcttttgcttgccaaagta

SEQ ID NO: 806305 - DNA, 15 bp, Homo sapiens
acctctttttcctcc

SEQ ID NO: 806306 - DNA, 19 bp, Homo sapiens
acctctttttcctcctgga

SEQ ID NO: 806307 - DNA, 21 bp, Homo sapiens
acctctttttcctcctggaca

SEQ ID NO: 806308 - DNA, 14 bp, Homo sapiens
acctcttttttcta

SEQ ID NO: 806309 - DNA, 21 bp, Homo sapiens
acctgaaaaaaagtttacaag

SEQ ID NO: 806310 - DNA, 11 bp, Homo sapiens
acctgaaaaca

SEQ ID NO: 806311 - DNA, 18 bp, Homo sapiens
acctgaaaacactgtgca

SEQ ID NO: 806312 - DNA, 18 bp, Homo sapiens
acctgaaacactggacct

SEQ ID NO: 806313 - DNA, 18 bp, Homo sapiens
acctgaaagcctgtctct

SEQ ID NO: 806314 - DNA, 13 bp, Homo sapiens
acctgaagactga

SEQ ID NO: 806315 - DNA, 16 bp, Homo sapiens
acctgaagactgagga

SEQ ID NO: 806316 - DNA, 21 bp, Homo sapiens
acctgaagagcgctcctctgc

SEQ ID NO: 806317 - DNA, 13 bp, Homo sapiens
acctgaagatgtc

SEQ ID NO: 806318 - DNA, 15 bp, Homo sapiens
acctgaagatgtctc

SEQ ID NO: 806319 - DNA, 21 bp, Homo sapiens
acctgaagtttttttgctgct

SEQ ID NO: 806320 - DNA, 18 bp, Homo sapiens
acctgaatcagctggaca

SEQ ID NO: 806321 - DNA, 19 bp, Homo sapiens
acctgaatcagctggacat

SEQ ID NO: 806322 - DNA, 12 bp, Homo sapiens
acctgaatcttt

SEQ ID NO: 806323 - DNA, 15 bp, Homo sapiens
acctgaatctttttt

SEQ ID NO: 806324 - DNA, 16 bp, Homo sapiens
acctgacaagcactgc

SEQ ID NO: 806325 - DNA, 16 bp, Homo sapiens
acctgacaatggcagc

SEQ ID NO: 806326 - DNA, 22 bp, Homo sapiens
acctgacaatggcagctagact

SEQ ID NO: 806327 - DNA, 15 bp, Homo sapiens
acctgacccctgctc

SEQ ID NO: 806328 - DNA, 19 bp, Homo sapiens
acctgacccttctctcact

SEQ ID NO: 806329 - DNA, 22 bp, Homo sapiens
acctgacctcttgctgtctctg

SEQ ID NO: 806330 - DNA, 16 bp, Homo sapiens
acctgactaagaaatt

SEQ ID NO: 806331 - DNA, 13 bp, Homo sapiens
acctgactctgaa

SEQ ID NO: 806332 - DNA, 14 bp, Homo sapiens
acctgactctgaaa

SEQ ID NO: 806333 - DNA, 16 bp, Homo sapiens
acctgactctgaaatc

SEQ ID NO: 806334 - DNA, 22 bp, Homo sapiens
acctgactctgaaatctgaaga

SEQ ID NO: 806335 - DNA, 23 bp, Homo sapiens
acctgagaccagttgggagcact

SEQ ID NO: 806336 - DNA, 23 bp, Homo sapiens
acctgagaccctgggagagaagt

SEQ ID NO: 806337 - DNA, 22 bp, Homo sapiens
acctgagacgggcatcgcagga

SEQ ID NO: 806338 - DNA, 23 bp, Homo sapiens
acctgagactcacactctctgca

SEQ ID NO: 806339 - DNA, 18 bp, Homo sapiens
acctgagctattttcctc

SEQ ID NO: 806340 - DNA, 17 bp, Homo sapiens
acctgaggaactgtctc

SEQ ID NO: 806341 - DNA, 12 bp, Homo sapiens
acctgaggtggg

SEQ ID NO: 806342 - DNA, 13 bp, Homo sapiens
acctgaggtgggc

SEQ ID NO: 806343 - DNA, 14 bp, Homo sapiens
acctgaggtgggcc

SEQ ID NO: 806344 - DNA, 23 bp, Homo sapiens
acctgaggtgggcccaggaccag

SEQ ID NO: 806345 - DNA, 22 bp, Homo sapiens
acctgatggaagtaaagcctca

SEQ ID NO: 806346 - DNA, 21 bp, Homo sapiens
acctgatggcacttagctatc

SEQ ID NO: 806347 - DNA, 15 bp, Homo sapiens
acctgcaaaaaatac

SEQ ID NO: 806348 - DNA, 15 bp, Homo sapiens
acctgcaaaaaatag

SEQ ID NO: 806349 - DNA, 10 bp, Homo sapiens
acctgcaaga

SEQ ID NO: 806350 - DNA, 15 bp, Homo sapiens
acctgcaagatggac

SEQ ID NO: 806351 - DNA, 12 bp, Homo sapiens
acctgcaagccc

SEQ ID NO: 806352 - DNA, 18 bp, Homo sapiens
acctgcaagccccagggc

SEQ ID NO: 806353 - DNA, 22 bp, Homo sapiens
acctgcaagccccagggcctgg

SEQ ID NO: 806354 - DNA, 20 bp, Homo sapiens
acctgcaataaaaaaattac

SEQ ID NO: 806355 - DNA, 13 bp, Homo sapiens
acctgcacacagg

SEQ ID NO: 806356 - DNA, 14 bp, Homo sapiens
acctgcacacagga

SEQ ID NO: 806357 - DNA, 15 bp, Homo sapiens
acctgcacacaggac

SEQ ID NO: 806358 - DNA, 16 bp, Homo sapiens
acctgcacacaggaca

SEQ ID NO: 806359 - DNA, 18 bp, Homo sapiens
acctgcacacaggacagc

SEQ ID NO: 806360 - DNA, 20 bp, Homo sapiens
acctgcacacaggacagcgg

SEQ ID NO: 806361 - DNA, 21 bp, Homo sapiens
acctgcacacaggacagcggg

SEQ ID NO: 806362 - DNA, 15 bp, Homo sapiens
accttccttcctgtt

SEQ ID NO: 806363 - DNA, 15 bp, Homo sapiens
accttcgagtagaga

SEQ ID NO: 806364 - DNA, 18 bp, Homo sapiens
accttcgggctgtgcccg

SEQ ID NO: 806365 - DNA, 18 bp, Homo sapiens
accttctaaaagccatta

SEQ ID NO: 806366 - DNA, 21 bp, Homo sapiens
accttctagtgagcctgggcc

SEQ ID NO: 806367 - DNA, 14 bp, Homo sapiens
accttctatgtatt

SEQ ID NO: 806368 - DNA, 14 bp, Homo sapiens
accttctccaaatg

SEQ ID NO: 806369 - DNA, 17 bp, Homo sapiens
accttctccccattctg

SEQ ID NO: 806370 - DNA, 17 bp, Homo sapiens
accttctcccttcttgg

SEQ ID NO: 806371 - DNA, 17 bp, Homo sapiens
accttctctggagccaa

SEQ ID NO: 806372 - DNA, 23 bp, Homo sapiens
accttctctggagccaagtccag

SEQ ID NO: 806373 - DNA, 15 bp, Homo sapiens
accttctgagtattc

SEQ ID NO: 806374 - DNA, 17 bp, Homo sapiens
accttctgagtattctc

SEQ ID NO: 806375 - DNA, 18 bp, Homo sapiens
accttctggcctcccaca

SEQ ID NO: 806376 - DNA, 17 bp, Homo sapiens
accttctggtatcttgt

SEQ ID NO: 806377 - DNA, 19 bp, Homo sapiens
accttctggttgcttcaga

SEQ ID NO: 806378 - DNA, 14 bp, Homo sapiens
accttctgtcccca

SEQ ID NO: 806379 - DNA, 21 bp, Homo sapiens
accttcttcgctgctagagaa

SEQ ID NO: 806380 - DNA, 23 bp, Homo sapiens
accttcttggcttctgggacctg

SEQ ID NO: 806381 - DNA, 17 bp, Homo sapiens
accttctttcactctgt

SEQ ID NO: 806382 - DNA, 10 bp, Homo sapiens
accttgaaaa

SEQ ID NO: 806383 - DNA, 23 bp, Homo sapiens
accttgaaaaaaaacagtggatc

SEQ ID NO: 806384 - DNA, 20 bp, Homo sapiens
accttgaaaataagaataga

SEQ ID NO: 806385 - DNA, 17 bp, Homo sapiens
accttgaaaggcaggaa

SEQ ID NO: 806386 - DNA, 12 bp, Homo sapiens
accttgaacagt

SEQ ID NO: 806387 - DNA, 18 bp, Homo sapiens
accttgagggtgggccag

SEQ ID NO: 806388 - DNA, 20 bp, Homo sapiens
accttgagggtgggccagca

SEQ ID NO: 806389 - DNA, 22 bp, Homo sapiens
accttgagggtgggccagcata

SEQ ID NO: 806390 - DNA, 22 bp, Homo sapiens
accttgaggtcttttgacatgt

SEQ ID NO: 806391 - DNA, 16 bp, Homo sapiens
accttgcaacacacag

SEQ ID NO: 806392 - DNA, 17 bp, Homo sapiens
accttgcaacctcacct

SEQ ID NO: 806393 - DNA, 15 bp, Homo sapiens
accttgcaacttcat

SEQ ID NO: 806394 - DNA, 14 bp, Homo sapiens
accttgcactcctc

SEQ ID NO: 806395 - DNA, 17 bp, Homo sapiens
accttgcagattttctt

SEQ ID NO: 806396 - DNA, 13 bp, Homo sapiens
accttgccagggc

SEQ ID NO: 806397 - DNA, 16 bp, Homo sapiens
accttgccgagagagg

SEQ ID NO: 806398 - DNA, 18 bp, Homo sapiens
accttgcctgaacatcct

SEQ ID NO: 806399 - DNA, 23 bp, Homo sapiens
accttgctgtcctgatctgtgat

SEQ ID NO: 806400 - DNA, 18 bp, Homo sapiens
accttgcttttgcttcta

SEQ ID NO: 806401 - DNA, 20 bp, Homo sapiens
accttggaccactcctgtcc

SEQ ID NO: 806402 - DNA, 15 bp, Homo sapiens
accttggactcctcc

SEQ ID NO: 806403 - DNA, 16 bp, Homo sapiens
accttggactcctccc

SEQ ID NO: 806404 - DNA, 18 bp, Homo sapiens
accttggactcctcccac

SEQ ID NO: 806405 - DNA, 14 bp, Homo sapiens
accttggcagtgtg

SEQ ID NO: 806406 - DNA, 20 bp, Homo sapiens
accttggcccaggagctctg

SEQ ID NO: 806407 - DNA, 21 bp, Homo sapiens
accttggcccaggagctctgc

SEQ ID NO: 806408 - DNA, 17 bp, Homo sapiens
accttgggcacatctgc

SEQ ID NO: 806409 - DNA, 12 bp, Homo sapiens
accttgggccaa

SEQ ID NO: 806410 - DNA, 13 bp, Homo sapiens
accttgggccctg

SEQ ID NO: 806411 - DNA, 15 bp, Homo sapiens
accttgggccctgga

SEQ ID NO: 806412 - DNA, 24 bp, Homo sapiens
accttggggctggggaagaggact

SEQ ID NO: 806413 - DNA, 15 bp, Homo sapiens
accttggtccctctc

SEQ ID NO: 806414 - DNA, 19 bp, Homo sapiens
accttgtaaaaaaagcaaa

SEQ ID NO: 806415 - DNA, 21 bp, Homo sapiens
accttgtaaaaaaagcaaaaa

SEQ ID NO: 806416 - DNA, 18 bp, Homo sapiens
accttgtattctctttac

SEQ ID NO: 806417 - DNA, 20 bp, Homo sapiens
accttgtcatgtaccatcaa

SEQ ID NO: 806418 - DNA, 21 bp, Homo sapiens
accttgtcatgtaccatcaat

SEQ ID NO: 806419 - DNA, 20 bp, Homo sapiens
accttgtgcattgtggctta

SEQ ID NO: 806420 - DNA, 13 bp, Homo sapiens
accttgtgcccag

SEQ ID NO: 806421 - DNA, 15 bp, Homo sapiens
accttgtggccgcct

SEQ ID NO: 806422 - DNA, 16 bp, Homo sapiens
accttgttacttctga

SEQ ID NO: 806423 - DNA, 17 bp, Homo sapiens
accttgttacttctgag

SEQ ID NO: 806424 - DNA, 16 bp, Homo sapiens
accttgttcctgccct

SEQ ID NO: 806425 - DNA, 15 bp, Homo sapiens
accttgttctatttt

SEQ ID NO: 806426 - DNA, 17 bp, Homo sapiens
acctttaaatgcaacag

SEQ ID NO: 806427 - DNA, 18 bp, Homo sapiens
acctttaaatgcaacagt

SEQ ID NO: 806428 - DNA, 21 bp, Homo sapiens
acctttaagaaaaatgaaaac

SEQ ID NO: 806429 - DNA, 11 bp, Homo sapiens
acctttaatga

SEQ ID NO: 806430 - DNA, 12 bp, Homo sapiens
acctttaatgag

SEQ ID NO: 806431 - DNA, 15 bp, Homo sapiens
acctttactgtgctt

SEQ ID NO: 806432 - DNA, 20 bp, Homo sapiens
acctttatcacctcattctg

SEQ ID NO: 806433 - DNA, 18 bp, Homo sapiens
acctttattaaaatctta

SEQ ID NO: 806434 - DNA, 17 bp, Homo sapiens
acctttcaaatttcaca

SEQ ID NO: 806435 - DNA, 18 bp, Homo sapiens
acctttcacctttgtgta

SEQ ID NO: 806436 - DNA, 21 bp, Homo sapiens
acctttccagggtcaaagtac

SEQ ID NO: 806437 - DNA, 19 bp, Homo sapiens
acctttccgctgtcgcccc

SEQ ID NO: 806438 - DNA, 13 bp, Homo sapiens
acctttcctctcc

SEQ ID NO: 806439 - DNA, 18 bp, Homo sapiens
acctttcctctccctcag

SEQ ID NO: 806440 - DNA, 19 bp, Homo sapiens
acctttcctctccctcagg

SEQ ID NO: 806441 - DNA, 19 bp, Homo sapiens
acctttcctgatgcccctg

SEQ ID NO: 806442 - DNA, 21 bp, Homo sapiens
acctttcctgatgcccctgac

SEQ ID NO: 806443 - DNA, 22 bp, Homo sapiens
acctttcctgatgcccctgaca

SEQ ID NO: 806444 - DNA, 16 bp, Homo sapiens
acctttctagccttag

SEQ ID NO: 806445 - DNA, 15 bp, Homo sapiens
acctttctagttgaa

SEQ ID NO: 806446 - DNA, 12 bp, Homo sapiens
acctttctctga

SEQ ID NO: 806447 - DNA, 13 bp, Homo sapiens
acctttctggcct

SEQ ID NO: 806448 - DNA, 15 bp, Homo sapiens
acctttctggcctgt

SEQ ID NO: 806449 - DNA, 16 bp, Homo sapiens
acctttctgggctttc

SEQ ID NO: 806450 - DNA, 20 bp, Homo sapiens
acctttctgggctttctcct

SEQ ID NO: 806451 - DNA, 22 bp, Homo sapiens
acctttctgggctttctcctgg

SEQ ID NO: 806452 - DNA, 23 bp, Homo sapiens
acctttctgggctttctcctgga

SEQ ID NO: 806453 - DNA, 16 bp, Homo sapiens
acctttctgtagccta

SEQ ID NO: 806454 - DNA, 22 bp, Homo sapiens
acctttgatgaattcttcctct

SEQ ID NO: 806455 - DNA, 22 bp, Homo sapiens
acctttgcgtggatcaagcttg

SEQ ID NO: 806456 - DNA, 14 bp, Homo sapiens
acctttgctatgta

SEQ ID NO: 806457 - DNA, 15 bp, Homo sapiens
acctttgctatgtaa

SEQ ID NO: 806458 - DNA, 16 bp, Homo sapiens
acctttgctatgtaag

SEQ ID NO: 806459 - DNA, 18 bp, Homo sapiens
acctttgctatgtaaggg

SEQ ID NO: 806460 - DNA, 19 bp, Homo sapiens
acctttgggatcagcctcc

SEQ ID NO: 806461 - DNA, 19 bp, Homo sapiens
acctttgggttctttctgg

SEQ ID NO: 806462 - DNA, 17 bp, Homo sapiens
acctttggtgcagaggt

SEQ ID NO: 806463 - DNA, 15 bp, Homo sapiens
acctttgtattctct

SEQ ID NO: 806464 - DNA, 23 bp, Homo sapiens
acctttgtggggtttttggagaa

SEQ ID NO: 806465 - DNA, 15 bp, Homo sapiens
acctttgtgtatttt

SEQ ID NO: 806466 - DNA, 11 bp, Homo sapiens
accttttactg

SEQ ID NO: 806467 - DNA, 20 bp, Homo sapiens
accttttactggttgcatgg

SEQ ID NO: 806468 - DNA, 24 bp, Homo sapiens
accttttactggttgcatggaaat

SEQ ID NO: 806469 - DNA, 15 bp, Homo sapiens
accttttatgtagta

SEQ ID NO: 806470 - DNA, 18 bp, Homo sapiens
accttttcacaatggaaa

SEQ ID NO: 806471 - DNA, 13 bp, Homo sapiens
accttttcaggaa

SEQ ID NO: 806472 - DNA, 17 bp, Homo sapiens
accttttccttatactg

SEQ ID NO: 806473 - DNA, 10 bp, Homo sapiens
accttttcta

SEQ ID NO: 806474 - DNA, 23 bp, Homo sapiens
accttttctataagttgtaccaa

SEQ ID NO: 806475 - DNA, 17 bp, Homo sapiens
accttttctcacaaaaa

SEQ ID NO: 806476 - DNA, 15 bp, Homo sapiens
accttttctgtggct

SEQ ID NO: 806477 - DNA, 16 bp, Homo sapiens
accttttctgtggctg

SEQ ID NO: 806478 - DNA, 21 bp, Homo sapiens
accttttgcacctgctctctt

SEQ ID NO: 806479 - DNA, 13 bp, Homo sapiens
accttttgtctct

SEQ ID NO: 806480 - DNA, 19 bp, Homo sapiens
acctttttatttgcatgtg

SEQ ID NO: 806481 - DNA, 14 bp, Homo sapiens
acctttttccttcc

SEQ ID NO: 806482 - DNA, 15 bp, Homo sapiens
acctttttccttcct

SEQ ID NO: 806483 - DNA, 17 bp, Homo sapiens
acctttttcttgatctt

SEQ ID NO: 806484 - DNA, 22 bp, Homo sapiens
acgtgtcagaagcctccaagcc

SEQ ID NO: 806485 - DNA, 13 bp, Homo sapiens
acgtgtcttccac

SEQ ID NO: 806486 - DNA, 17 bp, Homo sapiens
acgtgtgtccaggctct

SEQ ID NO: 806487 - DNA, 21 bp, Homo sapiens
acgtgtgttcttttgagtcct

SEQ ID NO: 806488 - DNA, 15 bp, Homo sapiens
acgtgtttttttcct

SEQ ID NO: 806489 - DNA, 19 bp, Homo sapiens
acgttaaaagcaaaaagat

SEQ ID NO: 806490 - DNA, 21 bp, Homo sapiens
acgttaagggaaggaactctg

SEQ ID NO: 806491 - DNA, 17 bp, Homo sapiens
acgttaccttgacacat

SEQ ID NO: 806492 - DNA, 16 bp, Homo sapiens
acgttaggcatttcct

SEQ ID NO: 806493 - DNA, 20 bp, Homo sapiens
acgttaggcatttcctgctg

SEQ ID NO: 806494 - DNA, 16 bp, Homo sapiens
acgttcagggaggggc

SEQ ID NO: 806495 - DNA, 13 bp, Homo sapiens
acgttccacagtt

SEQ ID NO: 806496 - DNA, 12 bp, Homo sapiens
acgttccgggca

SEQ ID NO: 806497 - DNA, 20 bp, Homo sapiens
acgttccgggcaaatgccag

SEQ ID NO: 806498 - DNA, 14 bp, Homo sapiens
acgttcctaagctg

SEQ ID NO: 806499 - DNA, 20 bp, Homo sapiens
acgttcctattgtcattaaa

SEQ ID NO: 806500 - DNA, 16 bp, Homo sapiens
acgttccttactgcag

SEQ ID NO: 806501 - DNA, 19 bp, Homo sapiens
acgttccttactgcagaat

SEQ ID NO: 806502 - DNA, 20 bp, Homo sapiens
acgttccttactgcagaata

SEQ ID NO: 806503 - DNA, 15 bp, Homo sapiens
acgttctcacaccca

SEQ ID NO: 806504 - DNA, 12 bp, Homo sapiens
acgttctgattt

SEQ ID NO: 806505 - DNA, 16 bp, Homo sapiens
acgttgagcccctgga

SEQ ID NO: 806506 - DNA, 20 bp, Homo sapiens
acgttgccaggggcttgaga

SEQ ID NO: 806507 - DNA, 13 bp, Homo sapiens
acgttgctcccca

SEQ ID NO: 806508 - DNA, 22 bp, Homo sapiens
acgttgctggtggtttttcagc

SEQ ID NO: 806509 - DNA, 21 bp, Homo sapiens
acgttggacttttcgttaaca

SEQ ID NO: 806510 - DNA, 18 bp, Homo sapiens
acgttggagaagcccgtg

SEQ ID NO: 806511 - DNA, 19 bp, Homo sapiens
acgttggagaagcccgtgt

SEQ ID NO: 806512 - DNA, 13 bp, Homo sapiens
acgttgtgcattt

SEQ ID NO: 806513 - DNA, 23 bp, Homo sapiens
acgtttaagccaaaacaatgttt

SEQ ID NO: 806514 - DNA, 16 bp, Homo sapiens
acgtttacttatctta

SEQ ID NO: 806515 - DNA, 18 bp, Homo sapiens
acgtttccccgaagagtc

SEQ ID NO: 806516 - DNA, 15 bp, Homo sapiens
acgtttcctgagaag

SEQ ID NO: 806517 - DNA, 12 bp, Homo sapiens
acgtttctaaag

SEQ ID NO: 806518 - DNA, 14 bp, Homo sapiens
acgtttctaaaggc

SEQ ID NO: 806519 - DNA, 22 bp, Homo sapiens
acgtttctcattaaaatccagt

SEQ ID NO: 806520 - DNA, 15 bp, Homo sapiens
acgtttgatacaaca

SEQ ID NO: 806521 - DNA, 17 bp, Homo sapiens
acgtttgcatagagaga

SEQ ID NO: 806522 - DNA, 17 bp, Homo sapiens
acgtttgccccatggga

SEQ ID NO: 806523 - DNA, 18 bp, Homo sapiens
acgtttgtaatcccagtt

SEQ ID NO: 806524 - DNA, 12 bp, Homo sapiens
acgttttattgg

SEQ ID NO: 806525 - DNA, 14 bp, Homo sapiens
acgttttattgtgt

SEQ ID NO: 806526 - DNA, 18 bp, Homo sapiens
acgttttattgtgttttt

SEQ ID NO: 806527 - DNA, 12 bp, Homo sapiens
acgttttcttct

SEQ ID NO: 806528 - DNA, 14 bp, Homo sapiens
acgttttcttcttt

SEQ ID NO: 806529 - DNA, 23 bp, Homo sapiens
acgttttcttctttccctggaca

SEQ ID NO: 806530 - DNA, 20 bp, Homo sapiens
acgtttttaatataaagcct

SEQ ID NO: 806531 - DNA, 15 bp, Homo sapiens
actaaaaaaaagatg

SEQ ID NO: 806532 - DNA, 16 bp, Homo sapiens
actaaaaaaaagatga

SEQ ID NO: 806533 - DNA, 17 bp, Homo sapiens
actaaaaaaaagatgaa

SEQ ID NO: 806534 - DNA, 13 bp, Homo sapiens
actaaaaaaattt

SEQ ID NO: 806535 - DNA, 15 bp, Homo sapiens
actaaaaatattgtt

SEQ ID NO: 806536 - DNA, 15 bp, Homo sapiens
actaaaaatgcaaaa

SEQ ID NO: 806537 - DNA, 16 bp, Homo sapiens
actaaaaatttttaca

SEQ ID NO: 806538 - DNA, 12 bp, Homo sapiens
actaaaagatcg

SEQ ID NO: 806539 - DNA, 16 bp, Homo sapiens
actaaaatgtatctaa

SEQ ID NO: 806540 - DNA, 23 bp, Homo sapiens
actaaactctctttgggaatgtt

SEQ ID NO: 806541 - DNA, 13 bp, Homo sapiens
actaaactttatt

SEQ ID NO: 806542 - DNA, 18 bp, Homo sapiens
actaaactttatttgtaa

SEQ ID NO: 806543 - DNA, 16 bp, Homo sapiens
actaaagagagaatgt

SEQ ID NO: 806544 - DNA, 21 bp, Homo sapiens
actaaagagagaatgtagata

SEQ ID NO: 806545 - DNA, 19 bp, Homo sapiens
actaaagatatcagagctc

SEQ ID NO: 806546 - DNA, 15 bp, Homo sapiens
actaaagccagcctg

SEQ ID NO: 806547 - DNA, 16 bp, Homo sapiens
actaaagctatgttac

SEQ ID NO: 806548 - DNA, 16 bp, Homo sapiens
actaaagcttcagact

SEQ ID NO: 806549 - DNA, 12 bp, Homo sapiens
actaaataatga

SEQ ID NO: 806550 - DNA, 14 bp, Homo sapiens
actaaatacatgtt

SEQ ID NO: 806551 - DNA, 16 bp, Homo sapiens
actaaatatatgtctg

SEQ ID NO: 806552 - DNA, 18 bp, Homo sapiens
actaaatcagagacaaaa

SEQ ID NO: 806553 - DNA, 22 bp, Homo sapiens
actaaatgagattatatgtgga

SEQ ID NO: 806554 - DNA, 14 bp, Homo sapiens
actaaatgtaaaat

SEQ ID NO: 806555 - DNA, 13 bp, Homo sapiens
actaaattactgt

SEQ ID NO: 806556 - DNA, 20 bp, Homo sapiens
actaaattgtatacattttg

SEQ ID NO: 806557 - DNA, 21 bp, Homo sapiens
actaaattgtatacattttgt

SEQ ID NO: 806558 - DNA, 13 bp, Homo sapiens
actaaattttaaa

SEQ ID NO: 806559 - DNA, 21 bp, Homo sapiens
actaaattttcttttaagcat

SEQ ID NO: 806560 - DNA, 15 bp, Homo sapiens
actaaatttttcata

SEQ ID NO: 806561 - DNA, 17 bp, Homo sapiens
actaaatttttcataga

SEQ ID NO: 806562 - DNA, 13 bp, Homo sapiens
actaacaagaatg

SEQ ID NO: 806563 - DNA, 14 bp, Homo sapiens
actaacaagaatgt

SEQ ID NO: 806564 - DNA, 17 bp, Homo sapiens
actaacaggatatttaa

SEQ ID NO: 806565 - DNA, 15 bp, Homo sapiens
actaacagggagaag

SEQ ID NO: 806566 - DNA, 17 bp, Homo sapiens
actaacataaaatctgt

SEQ ID NO: 806567 - DNA, 18 bp, Homo sapiens
actaacataaaatctgtg

SEQ ID NO: 806568 - DNA, 16 bp, Homo sapiens
actaaccatccccaac

SEQ ID NO: 806569 - DNA, 21 bp, Homo sapiens
actaacctggtattttaagag

SEQ ID NO: 806570 - DNA, 22 bp, Homo sapiens
actaaccttgcctggtacagta

SEQ ID NO: 806571 - DNA, 17 bp, Homo sapiens
actaactatcaaataga

SEQ ID NO: 806572 - DNA, 20 bp, Homo sapiens
actaactccaggattcagga

SEQ ID NO: 806573 - DNA, 15 bp, Homo sapiens
actaactgcttcatc

SEQ ID NO: 806574 - DNA, 13 bp, Homo sapiens
actaacttactgt

SEQ ID NO: 806575 - DNA, 18 bp, Homo sapiens
actaagaattttgtttta

SEQ ID NO: 806576 - DNA, 17 bp, Homo sapiens
actaagagattcttcta

SEQ ID NO: 806577 - DNA, 15 bp, Homo sapiens
actaagatgaaattg

SEQ ID NO: 806578 - DNA, 18 bp, Homo sapiens
actaagatgttcactgtg

SEQ ID NO: 806579 - DNA, 21 bp, Homo sapiens
actaagattcttttaaattag

SEQ ID NO: 806580 - DNA, 14 bp, Homo sapiens
actaagcagaggag

SEQ ID NO: 806581 - DNA, 15 bp, Homo sapiens
actaagcagaggagg

SEQ ID NO: 806582 - DNA, 19 bp, Homo sapiens
actaagcagaggaggggcc

SEQ ID NO: 806583 - DNA, 15 bp, Homo sapiens
actaagccacaagaa

SEQ ID NO: 806584 - DNA, 18 bp, Homo sapiens
actaagccacaagaaatt

SEQ ID NO: 806585 - DNA, 11 bp, Homo sapiens
actaagccagg

SEQ ID NO: 806586 - DNA, 12 bp, Homo sapiens
actaagccagga

SEQ ID NO: 806587 - DNA, 18 bp, Homo sapiens
actaagccaggcctggct

SEQ ID NO: 806588 - DNA, 21 bp, Homo sapiens
actaagccaggcctggctgga

SEQ ID NO: 806589 - DNA, 16 bp, Homo sapiens
actaagccctgtcgag

SEQ ID NO: 806590 - DNA, 16 bp, Homo sapiens
actaagctctttgaga

SEQ ID NO: 806591 - DNA, 17 bp, Homo sapiens
actaagctctttgagaa

SEQ ID NO: 806592 - DNA, 18 bp, Homo sapiens
actaaggacaaattagca

SEQ ID NO: 806593 - DNA, 22 bp, Homo sapiens
actaagggaacaatccatgtga

SEQ ID NO: 806594 - DNA, 20 bp, Homo sapiens
actaagggggtagaagtagt

SEQ ID NO: 806595 - DNA, 21 bp, Homo sapiens
actaagtcaggagtgtagttg

SEQ ID NO: 806596 - DNA, 18 bp, Homo sapiens
actaagttatagtatatc

SEQ ID NO: 806597 - DNA, 22 bp, Homo sapiens
actaagtttttatggcttttgt

SEQ ID NO: 806598 - DNA, 23 bp, Homo sapiens
actaatacgtgccagatataact

SEQ ID NO: 806599 - DNA, 13 bp, Homo sapiens
actaatatatgga

SEQ ID NO: 806600 - DNA, 17 bp, Homo sapiens
actaatatatggaccta

SEQ ID NO: 806601 - DNA, 17 bp, Homo sapiens
actaatatatttaaaaa

SEQ ID NO: 806602 - DNA, 18 bp, Homo sapiens
actaatatatttaaaaat

SEQ ID NO: 806603 - DNA, 20 bp, Homo sapiens
actaatatatttaaaaataa

SEQ ID NO: 806604 - DNA, 13 bp, Homo sapiens
actaatcatgaga

SEQ ID NO: 806605 - DNA, 17 bp, Homo sapiens
actaatcttgaatgttt

SEQ ID NO: 806606 - DNA, 16 bp, Homo sapiens
actaatgatgagcatt

SEQ ID NO: 806607 - DNA, 23 bp, Homo sapiens
actcatttttcatgataatgaac

SEQ ID NO: 806608 - DNA, 16 bp, Homo sapiens
actcatttttttttga

SEQ ID NO: 806609 - DNA, 13 bp, Homo sapiens
actccaaaatgtt

SEQ ID NO: 806610 - DNA, 22 bp, Homo sapiens
actccaaaatgttggtcatttt

SEQ ID NO: 806611 - DNA, 16 bp, Homo sapiens
actccaaacctgtctt

SEQ ID NO: 806612 - DNA, 19 bp, Homo sapiens
actccaacagaagaactgt

SEQ ID NO: 806613 - DNA, 19 bp, Homo sapiens
actccaagatatggacaca

SEQ ID NO: 806614 - DNA, 13 bp, Homo sapiens
actccaagcagac

SEQ ID NO: 806615 - DNA, 15 bp, Homo sapiens
actccaagcagactc

SEQ ID NO: 806616 - DNA, 16 bp, Homo sapiens
actccaagcagactcc

SEQ ID NO: 806617 - DNA, 19 bp, Homo sapiens
actccaagcagactccagc

SEQ ID NO: 806618 - DNA, 14 bp, Homo sapiens
actccaagccccct

SEQ ID NO: 806619 - DNA, 16 bp, Homo sapiens
actccaagccccctgg

SEQ ID NO: 806620 - DNA, 23 bp, Homo sapiens
actccaaggtttataaagcagat

SEQ ID NO: 806621 - DNA, 17 bp, Homo sapiens
actccacagtgtttata

SEQ ID NO: 806622 - DNA, 13 bp, Homo sapiens
actccacatctgc

SEQ ID NO: 806623 - DNA, 15 bp, Homo sapiens
actccaccaacccat

SEQ ID NO: 806624 - DNA, 20 bp, Homo sapiens
actccaccaacccatcagaa

SEQ ID NO: 806625 - DNA, 20 bp, Homo sapiens
actccaccatcactcactca

SEQ ID NO: 806626 - DNA, 21 bp, Homo sapiens
actccaccatccccaccccac

SEQ ID NO: 806627 - DNA, 11 bp, Homo sapiens
actccacccag

SEQ ID NO: 806628 - DNA, 15 bp, Homo sapiens
actccacccagagta

SEQ ID NO: 806629 - DNA, 21 bp, Homo sapiens
actccaccctgttagttttgt

SEQ ID NO: 806630 - DNA, 22 bp, Homo sapiens
actccaccctgttagttttgta

SEQ ID NO: 806631 - DNA, 15 bp, Homo sapiens
actccacctccaccc

SEQ ID NO: 806632 - DNA, 22 bp, Homo sapiens
actccactctccttcgtgtctc

SEQ ID NO: 806633 - DNA, 23 bp, Homo sapiens
actccactgccctggcagcagca

SEQ ID NO: 806634 - DNA, 23 bp, Homo sapiens
actccagaatctgctgttgccat

SEQ ID NO: 806635 - DNA, 15 bp, Homo sapiens
actccagacccctgg

SEQ ID NO: 806636 - DNA, 18 bp, Homo sapiens
actccagacccctggctt

SEQ ID NO: 806637 - DNA, 19 bp, Homo sapiens
actccagacccctggcttt

SEQ ID NO: 806638 - DNA, 12 bp, Homo sapiens
actccagagaag

SEQ ID NO: 806639 - DNA, 17 bp, Homo sapiens
actccagagccccttta

SEQ ID NO: 806640 - DNA, 14 bp, Homo sapiens
actccagagtctga

SEQ ID NO: 806641 - DNA, 16 bp, Homo sapiens
actccagagtctgagc

SEQ ID NO: 806642 - DNA, 17 bp, Homo sapiens
actccagatagagaaat

SEQ ID NO: 806643 - DNA, 16 bp, Homo sapiens
actccagcacctgtgg

SEQ ID NO: 806644 - DNA, 22 bp, Homo sapiens
actccagccaaagaaatgggcc

SEQ ID NO: 806645 - DNA, 12 bp, Homo sapiens
actccagccagc

SEQ ID NO: 806646 - DNA, 16 bp, Homo sapiens
actccagccagcgcct

SEQ ID NO: 806647 - DNA, 19 bp, Homo sapiens
actccagccagcgcctccc

SEQ ID NO: 806648 - DNA, 20 bp, Homo sapiens
actccagccagcgcctccct

SEQ ID NO: 806649 - DNA, 23 bp, Homo sapiens
actccagccagcgcctccctcca

SEQ ID NO: 806650 - DNA, 13 bp, Homo sapiens
actccagcccctg

SEQ ID NO: 806651 - DNA, 19 bp, Homo sapiens
actccagcctggcgacaga

SEQ ID NO: 806652 - DNA, 14 bp, Homo sapiens
actccagcctgggc

SEQ ID NO: 806653 - DNA, 19 bp, Homo sapiens
actccagcttgggtgataa

SEQ ID NO: 806654 - DNA, 19 bp, Homo sapiens
actccaggatttataaagc

SEQ ID NO: 806655 - DNA, 20 bp, Homo sapiens
actccaggatttataaagca

SEQ ID NO: 806656 - DNA, 17 bp, Homo sapiens
actccaggcagcagaca

SEQ ID NO: 806657 - DNA, 20 bp, Homo sapiens
actccaggcatatgtttccc

SEQ ID NO: 806658 - DNA, 21 bp, Homo sapiens
actccaggcccaaggctcccg

SEQ ID NO: 806659 - DNA, 20 bp, Homo sapiens
actccagggacacacagcct

SEQ ID NO: 806660 - DNA, 15 bp, Homo sapiens
actccaggggcacct

SEQ ID NO: 806661 - DNA, 19 bp, Homo sapiens
actccagggtcccctgcca

SEQ ID NO: 806662 - DNA, 20 bp, Homo sapiens
actccagggtcccctgccac

SEQ ID NO: 806663 - DNA, 15 bp, Homo sapiens
actccagtgccagca

SEQ ID NO: 806664 - DNA, 20 bp, Homo sapiens
actccagttaaaaaaaattt

SEQ ID NO: 806665 - DNA, 21 bp, Homo sapiens
actccatacagcctctacagc

SEQ ID NO: 806666 - DNA, 16 bp, Homo sapiens
actccatcgccatctt

SEQ ID NO: 806667 - DNA, 19 bp, Homo sapiens
actccatcgccatcttctt

SEQ ID NO: 806668 - DNA, 22 bp, Homo sapiens
actccatcgccatcttcttccc

SEQ ID NO: 806669 - DNA, 11 bp, Homo sapiens
actccatctct

SEQ ID NO: 806670 - DNA, 13 bp, Homo sapiens
actccatgctcct

SEQ ID NO: 806671 - DNA, 13 bp, Homo sapiens
actccatggccac

SEQ ID NO: 806672 - DNA, 22 bp, Homo sapiens
actccatggccaccccgtgcca

SEQ ID NO: 806673 - DNA, 23 bp, Homo sapiens
actccatggccaccccgtgccac

SEQ ID NO: 806674 - DNA, 20 bp, Homo sapiens
actccatggggttcgagact

SEQ ID NO: 806675 - DNA, 16 bp, Homo sapiens
actccatttctttctt

SEQ ID NO: 806676 - DNA, 19 bp, Homo sapiens
actcccaaagctcagactt

SEQ ID NO: 806677 - DNA, 16 bp, Homo sapiens
actcccaaccctggct

SEQ ID NO: 806678 - DNA, 22 bp, Homo sapiens
actcccaagggacagcaagtga

SEQ ID NO: 806679 - DNA, 14 bp, Homo sapiens
actcccaagtatgg

SEQ ID NO: 806680 - DNA, 16 bp, Homo sapiens
actcccacctgacaca

SEQ ID NO: 806681 - DNA, 17 bp, Homo sapiens
actcccagcagagccca

SEQ ID NO: 806682 - DNA, 18 bp, Homo sapiens
actcccatctccttacct

SEQ ID NO: 806683 - DNA, 12 bp, Homo sapiens
actccccactcc

SEQ ID NO: 806684 - DNA, 14 bp, Homo sapiens
actccccagagctg

SEQ ID NO: 806685 - DNA, 17 bp, Homo sapiens
actccccagagctgtgc

SEQ ID NO: 806686 - DNA, 19 bp, Homo sapiens
actccccagcctgggccca

SEQ ID NO: 806687 - DNA, 15 bp, Homo sapiens
actccccaggccagg

SEQ ID NO: 806688 - DNA, 12 bp, Homo sapiens
actccccaggga

SEQ ID NO: 806689 - DNA, 14 bp, Homo sapiens
actccccagggagc

SEQ ID NO: 806690 - DNA, 16 bp, Homo sapiens
actccccagggagctc

SEQ ID NO: 806691 - DNA, 20 bp, Homo sapiens
actccccagggagctctggg

SEQ ID NO: 806692 - DNA, 17 bp, Homo sapiens
actcccccaaccaagga

SEQ ID NO: 806693 - DNA, 22 bp, Homo sapiens
actcccccaaccaaggaaggag

SEQ ID NO: 806694 - DNA, 18 bp, Homo sapiens
actcccccaccactcagg

SEQ ID NO: 806695 - DNA, 20 bp, Homo sapiens
actcccccaccactcaggcc

SEQ ID NO: 806696 - DNA, 21 bp, Homo sapiens
actcccccaccactcaggcca

SEQ ID NO: 806697 - DNA, 14 bp, Homo sapiens
actcccccacccat

SEQ ID NO: 806698 - DNA, 19 bp, Homo sapiens
actcccccacccatgggga

SEQ ID NO: 806699 - DNA, 22 bp, Homo sapiens
actccccctaaacccctgtccc

SEQ ID NO: 806700 - DNA, 11 bp, Homo sapiens
actccccttcc

SEQ ID NO: 806701 - DNA, 13 bp, Homo sapiens
actccccttccct

SEQ ID NO: 806702 - DNA, 15 bp, Homo sapiens
actccccttgagctg

SEQ ID NO: 806703 - DNA, 17 bp, Homo sapiens
actccccttgagctgag

SEQ ID NO: 806704 - DNA, 20 bp, Homo sapiens
actccccttgagctgagatg

SEQ ID NO: 806705 - DNA, 17 bp, Homo sapiens
actcccctttcttccaa

SEQ ID NO: 806706 - DNA, 19 bp, Homo sapiens
actcccgccccgggctggc

SEQ ID NO: 806707 - DNA, 20 bp, Homo sapiens
actcccgccccgggctggcc

SEQ ID NO: 806708 - DNA, 21 bp, Homo sapiens
actcccgccccgggctggccc

SEQ ID NO: 806709 - DNA, 23 bp, Homo sapiens
actcccgccccgggctggccctg

SEQ ID NO: 806710 - DNA, 13 bp, Homo sapiens
actcccgctgcac

SEQ ID NO: 806711 - DNA, 18 bp, Homo sapiens
actcccgctgcacacaga

SEQ ID NO: 806712 - DNA, 20 bp, Homo sapiens
actcccgctgcacacagacg

SEQ ID NO: 806713 - DNA, 18 bp, Homo sapiens
actcccggcactccatgc

SEQ ID NO: 806714 - DNA, 19 bp, Homo sapiens
actcccggcactccatgct

SEQ ID NO: 806715 - DNA, 15 bp, Homo sapiens
actcccgggccaaga

SEQ ID NO: 806716 - DNA, 22 bp, Homo sapiens
actcccgggccaagacagatgg

SEQ ID NO: 806717 - DNA, 17 bp, Homo sapiens
actcccgggccacgccc

SEQ ID NO: 806718 - DNA, 22 bp, Homo sapiens
actccctaatttatgtgctata

SEQ ID NO: 806719 - DNA, 12 bp, Homo sapiens
actccctccacc

SEQ ID NO: 806720 - DNA, 16 bp, Homo sapiens
actccctccaccagcc

SEQ ID NO: 806721 - DNA, 18 bp, Homo sapiens
actccctccaccagcctg

SEQ ID NO: 806722 - DNA, 21 bp, Homo sapiens
actccctccaccagcctgctg

SEQ ID NO: 806723 - DNA, 12 bp, Homo sapiens
actccctcccag

SEQ ID NO: 806724 - DNA, 14 bp, Homo sapiens
actccctcccagaa

SEQ ID NO: 806725 - DNA, 20 bp, Homo sapiens
actccctccccacccaagag

SEQ ID NO: 806726 - DNA, 20 bp, Homo sapiens
actccctcctcacctctgga

SEQ ID NO: 806727 - DNA, 22 bp, Homo sapiens
actccctcttcactgtggccac

SEQ ID NO: 806728 - DNA, 15 bp, Homo sapiens
actctgcttgatttt

SEQ ID NO: 806729 - DNA, 18 bp, Homo sapiens
actctgcttgatttttgc

SEQ ID NO: 806730 - DNA, 17 bp, Homo sapiens
actctggactttctcta

SEQ ID NO: 806731 - DNA, 17 bp, Homo sapiens
actctggattcagcctt

SEQ ID NO: 806732 - DNA, 16 bp, Homo sapiens
actctggattttgaat

SEQ ID NO: 806733 - DNA, 14 bp, Homo sapiens
actctggcaaagct

SEQ ID NO: 806734 - DNA, 16 bp, Homo sapiens
actctggcaaagcttt

SEQ ID NO: 806735 - DNA, 14 bp, Homo sapiens
actctggccctggc

SEQ ID NO: 806736 - DNA, 11 bp, Homo sapiens
actctggcctc

SEQ ID NO: 806737 - DNA, 20 bp, Homo sapiens
actctggcggtggccacagc

SEQ ID NO: 806738 - DNA, 13 bp, Homo sapiens
actctgggaaata

SEQ ID NO: 806739 - DNA, 19 bp, Homo sapiens
actctgggaaataagagag

SEQ ID NO: 806740 - DNA, 22 bp, Homo sapiens
actctggggctcaagcagttct

SEQ ID NO: 806741 - DNA, 20 bp, Homo sapiens
actctgggtcttggccatga

SEQ ID NO: 806742 - DNA, 19 bp, Homo sapiens
actctgggtttcatatcca

SEQ ID NO: 806743 - DNA, 17 bp, Homo sapiens
actctggtgttctattg

SEQ ID NO: 806744 - DNA, 12 bp, Homo sapiens
actctgtaattg

SEQ ID NO: 806745 - DNA, 21 bp, Homo sapiens
actctgtatctatgcaaagca

SEQ ID NO: 806746 - DNA, 13 bp, Homo sapiens
actctgtattaca

SEQ ID NO: 806747 - DNA, 16 bp, Homo sapiens
actctgtcagatggga

SEQ ID NO: 806748 - DNA, 21 bp, Homo sapiens
actctgtcagccagccgccct

SEQ ID NO: 806749 - DNA, 17 bp, Homo sapiens
actctgtccaggccact

SEQ ID NO: 806750 - DNA, 18 bp, Homo sapiens
actctgtccaggccactg

SEQ ID NO: 806751 - DNA, 21 bp, Homo sapiens
actctgtccaggccactgtgg

SEQ ID NO: 806752 - DNA, 14 bp, Homo sapiens
actctgtcttaaat

SEQ ID NO: 806753 - DNA, 15 bp, Homo sapiens
actctgtcttgtgtt

SEQ ID NO: 806754 - DNA, 21 bp, Homo sapiens
actctgttattgatcccttct

SEQ ID NO: 806755 - DNA, 19 bp, Homo sapiens
actctgttcccccaccctc

SEQ ID NO: 806756 - DNA, 22 bp, Homo sapiens
actctgttcccccaccctccat

SEQ ID NO: 806757 - DNA, 23 bp, Homo sapiens
actctgttcccccaccctccatg

SEQ ID NO: 806758 - DNA, 14 bp, Homo sapiens
actctgttccttca

SEQ ID NO: 806759 - DNA, 13 bp, Homo sapiens
actctgttgtact

SEQ ID NO: 806760 - DNA, 16 bp, Homo sapiens
actcttaaatactttt

SEQ ID NO: 806761 - DNA, 17 bp, Homo sapiens
actcttaaatacttttt

SEQ ID NO: 806762 - DNA, 20 bp, Homo sapiens
actcttaaatgatctgcctc

SEQ ID NO: 806763 - DNA, 14 bp, Homo sapiens
actcttaatcaaat

SEQ ID NO: 806764 - DNA, 15 bp, Homo sapiens
actcttaattttaaa

SEQ ID NO: 806765 - DNA, 17 bp, Homo sapiens
actcttacagagccttg

SEQ ID NO: 806766 - DNA, 17 bp, Homo sapiens
actcttacctaaactga

SEQ ID NO: 806767 - DNA, 18 bp, Homo sapiens
actcttacctaaactgag

SEQ ID NO: 806768 - DNA, 15 bp, Homo sapiens
actcttacgtggaga

SEQ ID NO: 806769 - DNA, 19 bp, Homo sapiens
actcttaggaagagaaacc

SEQ ID NO: 806770 - DNA, 22 bp, Homo sapiens
actcttaggcacatcaattaat

SEQ ID NO: 806771 - DNA, 16 bp, Homo sapiens
actcttataaatttct

SEQ ID NO: 806772 - DNA, 18 bp, Homo sapiens
actcttattgtccttcta

SEQ ID NO: 806773 - DNA, 23 bp, Homo sapiens
actcttcaaatgggagactcttt

SEQ ID NO: 806774 - DNA, 12 bp, Homo sapiens
actcttcagtgc

SEQ ID NO: 806775 - DNA, 17 bp, Homo sapiens
actcttcagttaattct

SEQ ID NO: 806776 - DNA, 18 bp, Homo sapiens
actcttcagttaattctt

SEQ ID NO: 806777 - DNA, 16 bp, Homo sapiens
actcttccgtgcatcc

SEQ ID NO: 806778 - DNA, 14 bp, Homo sapiens
actcttcctcccct

SEQ ID NO: 806779 - DNA, 16 bp, Homo sapiens
actcttcctcccctct

SEQ ID NO: 806780 - DNA, 11 bp, Homo sapiens
actcttcctgt

SEQ ID NO: 806781 - DNA, 13 bp, Homo sapiens
actcttcctgtcc

SEQ ID NO: 806782 - DNA, 15 bp, Homo sapiens
actcttctctccttt

SEQ ID NO: 806783 - DNA, 14 bp, Homo sapiens
actcttgaaatgta

SEQ ID NO: 806784 - DNA, 15 bp, Homo sapiens
actcttgaaatgtag

SEQ ID NO: 806785 - DNA, 12 bp, Homo sapiens
actcttgagaat

SEQ ID NO: 806786 - DNA, 17 bp, Homo sapiens
actcttggagcctcttt

SEQ ID NO: 806787 - DNA, 21 bp, Homo sapiens
actcttgtgaattattctgat

SEQ ID NO: 806788 - DNA, 23 bp, Homo sapiens
actcttgtggtacctagtcagat

SEQ ID NO: 806789 - DNA, 20 bp, Homo sapiens
actcttgtttgctttgaaaa

SEQ ID NO: 806790 - DNA, 21 bp, Homo sapiens
actcttgtttgctttgaaaat

SEQ ID NO: 806791 - DNA, 15 bp, Homo sapiens
actctttaacacatt

SEQ ID NO: 806792 - DNA, 15 bp, Homo sapiens
actctttattgtctg

SEQ ID NO: 806793 - DNA, 19 bp, Homo sapiens
actctttattgtctgtaaa

SEQ ID NO: 806794 - DNA, 21 bp, Homo sapiens
actctttatttctagcagagt

SEQ ID NO: 806795 - DNA, 17 bp, Homo sapiens
actctttatttttctct

SEQ ID NO: 806796 - DNA, 17 bp, Homo sapiens
actctttcaaattatat

SEQ ID NO: 806797 - DNA, 13 bp, Homo sapiens
actctttcattct

SEQ ID NO: 806798 - DNA, 17 bp, Homo sapiens
actctttcattcttctc

SEQ ID NO: 806799 - DNA, 17 bp, Homo sapiens
actctttcctaaagcca

SEQ ID NO: 806800 - DNA, 23 bp, Homo sapiens
actctttcggtaggtggaagcta

SEQ ID NO: 806801 - DNA, 21 bp, Homo sapiens
actctttctgaaggaagagaa

SEQ ID NO: 806802 - DNA, 16 bp, Homo sapiens
actctttgagatagaa

SEQ ID NO: 806803 - DNA, 23 bp, Homo sapiens
actctttgagatagaagaactgc

SEQ ID NO: 806804 - DNA, 20 bp, Homo sapiens
actctttgggtccattcaga

SEQ ID NO: 806805 - DNA, 21 bp, Homo sapiens
actctttgggtccattcagat

SEQ ID NO: 806806 - DNA, 21 bp, Homo sapiens
actctttgtggggaagagggg

SEQ ID NO: 806807 - DNA, 18 bp, Homo sapiens
actcttttccttcccttt

SEQ ID NO: 806808 - DNA, 17 bp, Homo sapiens
actcttttgagtggtaa

SEQ ID NO: 806809 - DNA, 14 bp, Homo sapiens
actcttttgcttta

SEQ ID NO: 806810 - DNA, 20 bp, Homo sapiens
actcttttgctttattccag

SEQ ID NO: 806811 - DNA, 17 bp, Homo sapiens
actctttttgggctcct

SEQ ID NO: 806812 - DNA, 14 bp, Homo sapiens
actctttttgtaaa

SEQ ID NO: 806813 - DNA, 20 bp, Homo sapiens
actcttttttcatggacact

SEQ ID NO: 806814 - DNA, 23 bp, Homo sapiens
actctttttttgagtgacagctt

SEQ ID NO: 806815 - DNA, 13 bp, Homo sapiens
actgaaaaaatac

SEQ ID NO: 806816 - DNA, 17 bp, Homo sapiens
actgaaaaatgtcagtc

SEQ ID NO: 806817 - DNA, 18 bp, Homo sapiens
actgaaaaatgtcagtct

SEQ ID NO: 806818 - DNA, 14 bp, Homo sapiens
actgaaaacatctg

SEQ ID NO: 806819 - DNA, 18 bp, Homo sapiens
actgaaaacttagccaga

SEQ ID NO: 806820 - DNA, 17 bp, Homo sapiens
actgaaaagaaggaaag

SEQ ID NO: 806821 - DNA, 15 bp, Homo sapiens
actgaaaatctaata

SEQ ID NO: 806822 - DNA, 17 bp, Homo sapiens
actgaaaattatttaaa

SEQ ID NO: 806823 - DNA, 15 bp, Homo sapiens
actgaaaatttaaca

SEQ ID NO: 806824 - DNA, 14 bp, Homo sapiens
actgaaacagattt

SEQ ID NO: 806825 - DNA, 13 bp, Homo sapiens
actgaaaccaaaa

SEQ ID NO: 806826 - DNA, 20 bp, Homo sapiens
actgaaagaagaaaacagta

SEQ ID NO: 806827 - DNA, 20 bp, Homo sapiens
actgaaagatctctgtcaca

SEQ ID NO: 806828 - DNA, 21 bp, Homo sapiens
actgaaagatctctgtcacat

SEQ ID NO: 806829 - DNA, 15 bp, Homo sapiens
actgaaagcagcagc

SEQ ID NO: 806830 - DNA, 19 bp, Homo sapiens
actgaaaggtagactttta

SEQ ID NO: 806831 - DNA, 20 bp, Homo sapiens
actgaaagtgttttactctt

SEQ ID NO: 806832 - DNA, 15 bp, Homo sapiens
actgaaagttttgta

SEQ ID NO: 806833 - DNA, 18 bp, Homo sapiens
actgaacaaaagctcagg

SEQ ID NO: 806834 - DNA, 19 bp, Homo sapiens
actgaacaccattgaaggc

SEQ ID NO: 806835 - DNA, 18 bp, Homo sapiens
actgaacaggttctcttc

SEQ ID NO: 806836 - DNA, 19 bp, Homo sapiens
actgaacatctgagtcctg

SEQ ID NO: 806837 - DNA, 23 bp, Homo sapiens
actgaacatctgagtcctggatg

SEQ ID NO: 806838 - DNA, 19 bp, Homo sapiens
actgaacatgtacactggt

SEQ ID NO: 806839 - DNA, 16 bp, Homo sapiens
actgaacattccagag

SEQ ID NO: 806840 - DNA, 17 bp, Homo sapiens
actgaaccacaaaaaaa

SEQ ID NO: 806841 - DNA, 14 bp, Homo sapiens
actgaaccactgct

SEQ ID NO: 806842 - DNA, 19 bp, Homo sapiens
actgaaccactgcttctct

SEQ ID NO: 806843 - DNA, 16 bp, Homo sapiens
actgaaccctgcctct

SEQ ID NO: 806844 - DNA, 22 bp, Homo sapiens
actgaactgtgtgtaattgttc

SEQ ID NO: 806845 - DNA, 13 bp, Homo sapiens
actgaacttcagg

SEQ ID NO: 806846 - DNA, 13 bp, Homo sapiens
actgaagaatttt

SEQ ID NO: 806847 - DNA, 21 bp, Homo sapiens
actgaagaattttgagtgaat

SEQ ID NO: 806848 - DNA, 18 bp, Homo sapiens
actgaagacctccacatt

SEQ ID NO: 806849 - DNA, 14 bp, Homo sapiens
actgaagactgcac

SEQ ID NO: 806850 - DNA, 15 bp, Homo sapiens
actgatcacaaaaac

SEQ ID NO: 806851 - DNA, 19 bp, Homo sapiens
actgatcatccaggcctca

SEQ ID NO: 806852 - DNA, 18 bp, Homo sapiens
actgatcatgcattgttg

SEQ ID NO: 806853 - DNA, 23 bp, Homo sapiens
actgatcatgtttatgagaaact

SEQ ID NO: 806854 - DNA, 22 bp, Homo sapiens
actgatctctactaccacaagg

SEQ ID NO: 806855 - DNA, 15 bp, Homo sapiens
actgatgacttacta

SEQ ID NO: 806856 - DNA, 12 bp, Homo sapiens
actgatgagcac

SEQ ID NO: 806857 - DNA, 17 bp, Homo sapiens
actgatgagtaaactga

SEQ ID NO: 806858 - DNA, 22 bp, Homo sapiens
actgatgagtaaactgaggccc

SEQ ID NO: 806859 - DNA, 19 bp, Homo sapiens
actgatgagtttcactgta

SEQ ID NO: 806860 - DNA, 23 bp, Homo sapiens
actgatggaccgggtgggcctgg

SEQ ID NO: 806861 - DNA, 21 bp, Homo sapiens
actgatgggctggggcagggg

SEQ ID NO: 806862 - DNA, 17 bp, Homo sapiens
actgatgttactagcct

SEQ ID NO: 806863 - DNA, 16 bp, Homo sapiens
actgattaaaaatacc

SEQ ID NO: 806864 - DNA, 13 bp, Homo sapiens
actgattaaatat

SEQ ID NO: 806865 - DNA, 20 bp, Homo sapiens
actgattaaatatttgaaga

SEQ ID NO: 806866 - DNA, 15 bp, Homo sapiens
actgattagtattca

SEQ ID NO: 806867 - DNA, 20 bp, Homo sapiens
actgattcataataaatatc

SEQ ID NO: 806868 - DNA, 16 bp, Homo sapiens
actgatttaacacttt

SEQ ID NO: 806869 - DNA, 19 bp, Homo sapiens
actgatttagaagcaaaga

SEQ ID NO: 806870 - DNA, 17 bp, Homo sapiens
actgatttcacaacaga

SEQ ID NO: 806871 - DNA, 15 bp, Homo sapiens
actgatttcagtaag

SEQ ID NO: 806872 - DNA, 13 bp, Homo sapiens
actgatttccttt

SEQ ID NO: 806873 - DNA, 19 bp, Homo sapiens
actgatttcttcagaatta

SEQ ID NO: 806874 - DNA, 23 bp, Homo sapiens
actgatttgggctgaatgtatgt

SEQ ID NO: 806875 - DNA, 16 bp, Homo sapiens
actgattttaaaatga

SEQ ID NO: 806876 - DNA, 16 bp, Homo sapiens
actgattttgtatgta

SEQ ID NO: 806877 - DNA, 22 bp, Homo sapiens
actgattttgttatttttatat

SEQ ID NO: 806878 - DNA, 16 bp, Homo sapiens
actgcaaaaaaagcct

SEQ ID NO: 806879 - DNA, 17 bp, Homo sapiens
actgcaaaaaaagcctc

SEQ ID NO: 806880 - DNA, 20 bp, Homo sapiens
actgcaaaaaaagcctccaa

SEQ ID NO: 806881 - DNA, 18 bp, Homo sapiens
actgcaaagtcgccagtc

SEQ ID NO: 806882 - DNA, 22 bp, Homo sapiens
actgcaaagtcgccagtcactg

SEQ ID NO: 806883 - DNA, 22 bp, Homo sapiens
actgcaaatcaggcttttgttt

SEQ ID NO: 806884 - DNA, 18 bp, Homo sapiens
actgcaacctccgcctct

SEQ ID NO: 806885 - DNA, 20 bp, Homo sapiens
actgcaaccttgtttattaa

SEQ ID NO: 806886 - DNA, 15 bp, Homo sapiens
actgcaacttgtgaa

SEQ ID NO: 806887 - DNA, 18 bp, Homo sapiens
actgcaagcatttttcca

SEQ ID NO: 806888 - DNA, 23 bp, Homo sapiens
actgcaagtgtttcttctggctt

SEQ ID NO: 806889 - DNA, 15 bp, Homo sapiens
actgcaatagagact

SEQ ID NO: 806890 - DNA, 16 bp, Homo sapiens
actgcaatagagactg

SEQ ID NO: 806891 - DNA, 18 bp, Homo sapiens
actgcaatagagactgta

SEQ ID NO: 806892 - DNA, 22 bp, Homo sapiens
actgcaatagagactgtagatt

SEQ ID NO: 806893 - DNA, 20 bp, Homo sapiens
actgcaatcctgtctttctg

SEQ ID NO: 806894 - DNA, 16 bp, Homo sapiens
actgcacacagtgact

SEQ ID NO: 806895 - DNA, 15 bp, Homo sapiens
actgcacaccagccc

SEQ ID NO: 806896 - DNA, 16 bp, Homo sapiens
actgcacagcgtcctg

SEQ ID NO: 806897 - DNA, 15 bp, Homo sapiens
actgcacaggaggag

SEQ ID NO: 806898 - DNA, 16 bp, Homo sapiens
actgcacaggaggagg

SEQ ID NO: 806899 - DNA, 16 bp, Homo sapiens
actgcacagtgcatct

SEQ ID NO: 806900 - DNA, 18 bp, Homo sapiens
actgcacagtgcatctca

SEQ ID NO: 806901 - DNA, 22 bp, Homo sapiens
actgcacagtgcatctcagccc

SEQ ID NO: 806902 - DNA, 13 bp, Homo sapiens
actgcacagtgct

SEQ ID NO: 806903 - DNA, 22 bp, Homo sapiens
actgcacccagctccaggggcc

SEQ ID NO: 806904 - DNA, 16 bp, Homo sapiens
actgcacctgcccagc

SEQ ID NO: 806905 - DNA, 13 bp, Homo sapiens
actgcacctgggc

SEQ ID NO: 806906 - DNA, 16 bp, Homo sapiens
actgcacctgggcagc

SEQ ID NO: 806907 - DNA, 17 bp, Homo sapiens
actgcacctgggcagct

SEQ ID NO: 806908 - DNA, 19 bp, Homo sapiens
actgcactccagcctgggt

SEQ ID NO: 806909 - DNA, 18 bp, Homo sapiens
actgcactttcccccttc

SEQ ID NO: 806910 - DNA, 19 bp, Homo sapiens
actgcactttcccccttcc

SEQ ID NO: 806911 - DNA, 16 bp, Homo sapiens
actgcactttgtttag

SEQ ID NO: 806912 - DNA, 15 bp, Homo sapiens
actgcagacattctc

SEQ ID NO: 806913 - DNA, 20 bp, Homo sapiens
actgcagacattctcaaagc

SEQ ID NO: 806914 - DNA, 16 bp, Homo sapiens
actgcagatagcccag

SEQ ID NO: 806915 - DNA, 17 bp, Homo sapiens
actgcagatagcccagg

SEQ ID NO: 806916 - DNA, 19 bp, Homo sapiens
actgcagatagcccaggag

SEQ ID NO: 806917 - DNA, 20 bp, Homo sapiens
actgcagatagcccaggagc

SEQ ID NO: 806918 - DNA, 21 bp, Homo sapiens
actgcagatagcccaggagca

SEQ ID NO: 806919 - DNA, 14 bp, Homo sapiens
actgcagcacctcc

SEQ ID NO: 806920 - DNA, 21 bp, Homo sapiens
actgcagcacctccaggcctg

SEQ ID NO: 806921 - DNA, 22 bp, Homo sapiens
actgcagcctgggctccctctt

SEQ ID NO: 806922 - DNA, 16 bp, Homo sapiens
actgcagctgcaccag

SEQ ID NO: 806923 - DNA, 12 bp, Homo sapiens
actgcagctgct

SEQ ID NO: 806924 - DNA, 14 bp, Homo sapiens
actgcagctgctga

SEQ ID NO: 806925 - DNA, 11 bp, Homo sapiens
actgcagctgt

SEQ ID NO: 806926 - DNA, 15 bp, Homo sapiens
actgcagctgtgagt

SEQ ID NO: 806927 - DNA, 12 bp, Homo sapiens
actgcaggccct

SEQ ID NO: 806928 - DNA, 15 bp, Homo sapiens
actgcaggccctggc

SEQ ID NO: 806929 - DNA, 16 bp, Homo sapiens
actgcaggccctggcc

SEQ ID NO: 806930 - DNA, 17 bp, Homo sapiens
actgcaggccctggcct

SEQ ID NO: 806931 - DNA, 17 bp, Homo sapiens
actgcagggactgccag

SEQ ID NO: 806932 - DNA, 23 bp, Homo sapiens
actgcaggggccactccaaactc

SEQ ID NO: 806933 - DNA, 18 bp, Homo sapiens
actgcaggtgggctgggc

SEQ ID NO: 806934 - DNA, 19 bp, Homo sapiens
actgcagtcggcatgccag

SEQ ID NO: 806935 - DNA, 16 bp, Homo sapiens
actgcagtcttatttc

SEQ ID NO: 806936 - DNA, 14 bp, Homo sapiens
actgcagtgtggag

SEQ ID NO: 806937 - DNA, 14 bp, Homo sapiens
actgcagtttcctg

SEQ ID NO: 806938 - DNA, 16 bp, Homo sapiens
actgcatatgaaagga

SEQ ID NO: 806939 - DNA, 14 bp, Homo sapiens
actgcatccagcct

SEQ ID NO: 806940 - DNA, 16 bp, Homo sapiens
actgcatggggaggca

SEQ ID NO: 806941 - DNA, 17 bp, Homo sapiens
actgcatggggaggcag

SEQ ID NO: 806942 - DNA, 18 bp, Homo sapiens
actgcatggggaggcagc

SEQ ID NO: 806943 - DNA, 19 bp, Homo sapiens
actgcatggggaggcagca

SEQ ID NO: 806944 - DNA, 21 bp, Homo sapiens
actgcatgtaccatttgcatg

SEQ ID NO: 806945 - DNA, 21 bp, Homo sapiens
actgcatgtggcttctctgtc

SEQ ID NO: 806946 - DNA, 21 bp, Homo sapiens
actgcattaccgcgttgtaaa

SEQ ID NO: 806947 - DNA, 22 bp, Homo sapiens
actgcattaccgcgttgtaaaa

SEQ ID NO: 806948 - DNA, 16 bp, Homo sapiens
actgcattcctgtgcc

SEQ ID NO: 806949 - DNA, 13 bp, Homo sapiens
actgcattctttt

SEQ ID NO: 806950 - DNA, 22 bp, Homo sapiens
actgcatttaaatttgatttcc

SEQ ID NO: 806951 - DNA, 16 bp, Homo sapiens
actgcattttaccaga

SEQ ID NO: 806952 - DNA, 21 bp, Homo sapiens
actgccaaagggaaatatcat

SEQ ID NO: 806953 - DNA, 19 bp, Homo sapiens
actgccaagcttcctgtgc

SEQ ID NO: 806954 - DNA, 21 bp, Homo sapiens
actgccaagcttcctgtgccc

SEQ ID NO: 806955 - DNA, 19 bp, Homo sapiens
actgccaagggcaggacca

SEQ ID NO: 806956 - DNA, 12 bp, Homo sapiens
actgccaagggt

SEQ ID NO: 806957 - DNA, 18 bp, Homo sapiens
actgccaagggtgctggt

SEQ ID NO: 806958 - DNA, 12 bp, Homo sapiens
actgccacaagc

SEQ ID NO: 806959 - DNA, 16 bp, Homo sapiens
actgccaccttgtggc

SEQ ID NO: 806960 - DNA, 15 bp, Homo sapiens
actgccagaagagaa

SEQ ID NO: 806961 - DNA, 23 bp, Homo sapiens
actgccagaagagaattcagtat

SEQ ID NO: 806962 - DNA, 14 bp, Homo sapiens
actgccagcagcag

SEQ ID NO: 806963 - DNA, 16 bp, Homo sapiens
actgccagcagcagca

SEQ ID NO: 806964 - DNA, 20 bp, Homo sapiens
actgccaggaccccaggtca

SEQ ID NO: 806965 - DNA, 23 bp, Homo sapiens
actgccaggaccccaggtcaggg

SEQ ID NO: 806966 - DNA, 19 bp, Homo sapiens
actgccaggcacctggcct

SEQ ID NO: 806967 - DNA, 21 bp, Homo sapiens
actgccaggcacctggcctgc

SEQ ID NO: 806968 - DNA, 16 bp, Homo sapiens
actgccaggccagcct

SEQ ID NO: 806969 - DNA, 17 bp, Homo sapiens
actgccaggctgtttca

SEQ ID NO: 806970 - DNA, 22 bp, Homo sapiens
actgccataaaacattaagaaa

SEQ ID NO: 806971 - DNA, 19 bp, Homo sapiens
actgggaagataggctctg

SEQ ID NO: 806972 - DNA, 15 bp, Homo sapiens
actgggaagctggag

SEQ ID NO: 806973 - DNA, 16 bp, Homo sapiens
actgggaaggaaacaa

SEQ ID NO: 806974 - DNA, 16 bp, Homo sapiens
actgggacagcccagg

SEQ ID NO: 806975 - DNA, 17 bp, Homo sapiens
actgggaccgtgcgagc

SEQ ID NO: 806976 - DNA, 18 bp, Homo sapiens
actgggaccgtgcgagct

SEQ ID NO: 806977 - DNA, 22 bp, Homo sapiens
actgggactcccagcagagccc

SEQ ID NO: 806978 - DNA, 14 bp, Homo sapiens
actgggagtcagag

SEQ ID NO: 806979 - DNA, 16 bp, Homo sapiens
actgggagtcagagcc

SEQ ID NO: 806980 - DNA, 17 bp, Homo sapiens
actgggcaacactgcag

SEQ ID NO: 806981 - DNA, 19 bp, Homo sapiens
actgggcacagattgaaga

SEQ ID NO: 806982 - DNA, 22 bp, Homo sapiens
actgggcacagattgaagaatc

SEQ ID NO: 806983 - DNA, 21 bp, Homo sapiens
actgggcacctgcgcacaggt

SEQ ID NO: 806984 - DNA, 11 bp, Homo sapiens
actgggcagca

SEQ ID NO: 806985 - DNA, 16 bp, Homo sapiens
actgggcagcaaggct

SEQ ID NO: 806986 - DNA, 18 bp, Homo sapiens
actgggcaggttcctggg

SEQ ID NO: 806987 - DNA, 19 bp, Homo sapiens
actgggcaggttcctgggg

SEQ ID NO: 806988 - DNA, 22 bp, Homo sapiens
actgggcaggttcctggggccg

SEQ ID NO: 806989 - DNA, 17 bp, Homo sapiens
actgggccagccctgca

SEQ ID NO: 806990 - DNA, 19 bp, Homo sapiens
actgggccagccctgcagc

SEQ ID NO: 806991 - DNA, 20 bp, Homo sapiens
actgggcccaggcaggtctg

SEQ ID NO: 806992 - DNA, 16 bp, Homo sapiens
actgggcccctgtccc

SEQ ID NO: 806993 - DNA, 18 bp, Homo sapiens
actgggcccctgtcccca

SEQ ID NO: 806994 - DNA, 22 bp, Homo sapiens
actgggcccctgtccccagtcc

SEQ ID NO: 806995 - DNA, 11 bp, Homo sapiens
actgggctctg

SEQ ID NO: 806996 - DNA, 14 bp, Homo sapiens
actgggctctggct

SEQ ID NO: 806997 - DNA, 13 bp, Homo sapiens
actgggctgaggg

SEQ ID NO: 806998 - DNA, 22 bp, Homo sapiens
actgggctggcgcttggatctg

SEQ ID NO: 806999 - DNA, 23 bp, Homo sapiens
actgggctggcgcttggatctgg

SEQ ID NO: 807000 - DNA, 23 bp, Homo sapiens
actgggctgggcctcgtgcgccc

SEQ ID NO: 807001 - DNA, 13 bp, Homo sapiens
actggggagcccg

SEQ ID NO: 807002 - DNA, 22 bp, Homo sapiens
actggggagggctgcagtcaca

SEQ ID NO: 807003 - DNA, 15 bp, Homo sapiens
actggggagtctttg

SEQ ID NO: 807004 - DNA, 21 bp, Homo sapiens
actggggatggtggcacaggc

SEQ ID NO: 807005 - DNA, 20 bp, Homo sapiens
actggggctggggtgagaga

SEQ ID NO: 807006 - DNA, 22 bp, Homo sapiens
actggggctggggtgagagagg

SEQ ID NO: 807007 - DNA, 13 bp, Homo sapiens
actgggggagggg

SEQ ID NO: 807008 - DNA, 12 bp, Homo sapiens
actggggggcca

SEQ ID NO: 807009 - DNA, 16 bp, Homo sapiens
actggggggccaccat

SEQ ID NO: 807010 - DNA, 17 bp, Homo sapiens
actggggtgggaggtct

SEQ ID NO: 807011 - DNA, 21 bp, Homo sapiens
actggggtgggaggtcttgct

SEQ ID NO: 807012 - DNA, 22 bp, Homo sapiens
actggggtgggaggtcttgcta

SEQ ID NO: 807013 - DNA, 20 bp, Homo sapiens
actgggtaatgaaacaaaga

SEQ ID NO: 807014 - DNA, 14 bp, Homo sapiens
actgggtacccaag

SEQ ID NO: 807015 - DNA, 19 bp, Homo sapiens
actgggtgaggaaatccat

SEQ ID NO: 807016 - DNA, 22 bp, Homo sapiens
actgggtggggtgaggaccact

SEQ ID NO: 807017 - DNA, 22 bp, Homo sapiens
actgggtggtggcctggtccct

SEQ ID NO: 807018 - DNA, 17 bp, Homo sapiens
actgggtgtcatttcat

SEQ ID NO: 807019 - DNA, 20 bp, Homo sapiens
actgggtgtcatttcattcc

SEQ ID NO: 807020 - DNA, 14 bp, Homo sapiens
actgggttcttgtt

SEQ ID NO: 807021 - DNA, 13 bp, Homo sapiens
actgggttgactt

SEQ ID NO: 807022 - DNA, 18 bp, Homo sapiens
actgggtttcaagaaaat

SEQ ID NO: 807023 - DNA, 22 bp, Homo sapiens
actgggtttcaagaaaatcttt

SEQ ID NO: 807024 - DNA, 14 bp, Homo sapiens
actgggtttctagc

SEQ ID NO: 807025 - DNA, 16 bp, Homo sapiens
actgggtttggacccc

SEQ ID NO: 807026 - DNA, 20 bp, Homo sapiens
actgggtttggaccccagct

SEQ ID NO: 807027 - DNA, 24 bp, Homo sapiens
actggtaaaaagatccagggatgg

SEQ ID NO: 807028 - DNA, 13 bp, Homo sapiens
actggtaaatgtt

SEQ ID NO: 807029 - DNA, 20 bp, Homo sapiens
actggtaagcgatttgaaac

SEQ ID NO: 807030 - DNA, 16 bp, Homo sapiens
actggtactcaagcca

SEQ ID NO: 807031 - DNA, 16 bp, Homo sapiens
actggtacttagagtt

SEQ ID NO: 807032 - DNA, 13 bp, Homo sapiens
actggtatgatgt

SEQ ID NO: 807033 - DNA, 16 bp, Homo sapiens
actggtattctgttct

SEQ ID NO: 807034 - DNA, 14 bp, Homo sapiens
actggtattgttta

SEQ ID NO: 807035 - DNA, 15 bp, Homo sapiens
actggtcagggcagt

SEQ ID NO: 807036 - DNA, 16 bp, Homo sapiens
actggtcagggcagtg

SEQ ID NO: 807037 - DNA, 22 bp, Homo sapiens
actggtccaaaagattgctgaa

SEQ ID NO: 807038 - DNA, 14 bp, Homo sapiens
actggtccagctct

SEQ ID NO: 807039 - DNA, 23 bp, Homo sapiens
actggtccagctctgacatccct

SEQ ID NO: 807040 - DNA, 13 bp, Homo sapiens
actggtcccttcc

SEQ ID NO: 807041 - DNA, 17 bp, Homo sapiens
actggtctcaggccaag

SEQ ID NO: 807042 - DNA, 15 bp, Homo sapiens
actggtctgtaggga

SEQ ID NO: 807043 - DNA, 23 bp, Homo sapiens
actggtgatgttgaaatatgcat

SEQ ID NO: 807044 - DNA, 16 bp, Homo sapiens
actggtgcactttgta

SEQ ID NO: 807045 - DNA, 21 bp, Homo sapiens
actggtgcactttgtaaattc

SEQ ID NO: 807046 - DNA, 22 bp, Homo sapiens
actggtgcactttgtaaattcc

SEQ ID NO: 807047 - DNA, 20 bp, Homo sapiens
actggtggcccgacagcctg

SEQ ID NO: 807048 - DNA, 23 bp, Homo sapiens
actggtggcccgacagcctggca

SEQ ID NO: 807049 - DNA, 22 bp, Homo sapiens
actggtgttatcaccgtgggct

SEQ ID NO: 807050 - DNA, 22 bp, Homo sapiens
actggttaaaaaacaaatgttc

SEQ ID NO: 807051 - DNA, 17 bp, Homo sapiens
actggttagtgatgcag

SEQ ID NO: 807052 - DNA, 18 bp, Homo sapiens
actggttccatggcctct

SEQ ID NO: 807053 - DNA, 14 bp, Homo sapiens
actggttctcaatg

SEQ ID NO: 807054 - DNA, 17 bp, Homo sapiens
actggttgcatggaaat

SEQ ID NO: 807055 - DNA, 22 bp, Homo sapiens
actggtttatccacccacaaca

SEQ ID NO: 807056 - DNA, 22 bp, Homo sapiens
actggtttccccagggaaggaa

SEQ ID NO: 807057 - DNA, 17 bp, Homo sapiens
actggtttgaagaatgt

SEQ ID NO: 807058 - DNA, 22 bp, Homo sapiens
actggtttgttgcagccaaaga

SEQ ID NO: 807059 - DNA, 19 bp, Homo sapiens
actggtttgtttgcttaat

SEQ ID NO: 807060 - DNA, 15 bp, Homo sapiens
actggttttacacag

SEQ ID NO: 807061 - DNA, 20 bp, Homo sapiens
actggttttacacagagaaa

SEQ ID NO: 807062 - DNA, 13 bp, Homo sapiens
actggttttctgc

SEQ ID NO: 807063 - DNA, 14 bp, Homo sapiens
actggttttctgcc

SEQ ID NO: 807064 - DNA, 12 bp, Homo sapiens
actgtaaaagtt

SEQ ID NO: 807065 - DNA, 13 bp, Homo sapiens
actgtaaaagtta

SEQ ID NO: 807066 - DNA, 22 bp, Homo sapiens
actgtaaaagttataataactg

SEQ ID NO: 807067 - DNA, 18 bp, Homo sapiens
actgtaaagatttgttga

SEQ ID NO: 807068 - DNA, 18 bp, Homo sapiens
actgtaaataaaaagaaa

SEQ ID NO: 807069 - DNA, 15 bp, Homo sapiens
actgtaaatatccct

SEQ ID NO: 807070 - DNA, 22 bp, Homo sapiens
actgtaaatatccctcccctct

SEQ ID NO: 807071 - DNA, 19 bp, Homo sapiens
actgtaaatatgtttgtgc

SEQ ID NO: 807072 - DNA, 23 bp, Homo sapiens
actgtaaatatgtttgtgcctta

SEQ ID NO: 807073 - DNA, 11 bp, Homo sapiens
actgtaaatca

SEQ ID NO: 807074 - DNA, 20 bp, Homo sapiens
actgtaacactttacaatgt

SEQ ID NO: 807075 - DNA, 14 bp, Homo sapiens
actgtaactgctca

SEQ ID NO: 807076 - DNA, 16 bp, Homo sapiens
actgtaactgctcaga

SEQ ID NO: 807077 - DNA, 21 bp, Homo sapiens
actgtaactgctcagagcttt

SEQ ID NO: 807078 - DNA, 22 bp, Homo sapiens
actgtaactgctcagagcttta

SEQ ID NO: 807079 - DNA, 20 bp, Homo sapiens
actgtaacttccaaataaat

SEQ ID NO: 807080 - DNA, 13 bp, Homo sapiens
actgtaacttttt

SEQ ID NO: 807081 - DNA, 20 bp, Homo sapiens
actgtaactttttttcagtt

SEQ ID NO: 807082 - DNA, 21 bp, Homo sapiens
actgtaactttttttcagttc

SEQ ID NO: 807083 - DNA, 21 bp, Homo sapiens
actgtaagacgtatgtaacat

SEQ ID NO: 807084 - DNA, 12 bp, Homo sapiens
actgtaagatgt

SEQ ID NO: 807085 - DNA, 22 bp, Homo sapiens
actgtaagtttattttttctac

SEQ ID NO: 807086 - DNA, 16 bp, Homo sapiens
actgtaataaagatga

SEQ ID NO: 807087 - DNA, 18 bp, Homo sapiens
actgtaatcttaaaagtg

SEQ ID NO: 807088 - DNA, 19 bp, Homo sapiens
actgtaatcttatttagga

SEQ ID NO: 807089 - DNA, 22 bp, Homo sapiens
actgtaatcttatttaggaagt

SEQ ID NO: 807090 - DNA, 15 bp, Homo sapiens
actgtaatgggtaat

SEQ ID NO: 807091 - DNA, 19 bp, Homo sapiens
actgtaatgggtaattctg

SEQ ID NO: 807092 - DNA, 19 bp, Homo sapiens
acttatgctgctgtgaatt

SEQ ID NO: 807093 - DNA, 20 bp, Homo sapiens
acttatgctgctgtgaattt

SEQ ID NO: 807094 - DNA, 20 bp, Homo sapiens
acttatggacactgccttag

SEQ ID NO: 807095 - DNA, 15 bp, Homo sapiens
acttatgtacagaaa

SEQ ID NO: 807096 - DNA, 23 bp, Homo sapiens
acttatgttactggtgtccagct

SEQ ID NO: 807097 - DNA, 14 bp, Homo sapiens
acttatgtttttaa

SEQ ID NO: 807098 - DNA, 19 bp, Homo sapiens
acttattattaataatgaa

SEQ ID NO: 807099 - DNA, 22 bp, Homo sapiens
acttattattaataatgaagta

SEQ ID NO: 807100 - DNA, 17 bp, Homo sapiens
acttattcaaagagaaa

SEQ ID NO: 807101 - DNA, 15 bp, Homo sapiens
acttatttaaaaata

SEQ ID NO: 807102 - DNA, 20 bp, Homo sapiens
acttatttacctataaaatg

SEQ ID NO: 807103 - DNA, 22 bp, Homo sapiens
acttatttattgttgccttttc

SEQ ID NO: 807104 - DNA, 12 bp, Homo sapiens
acttatttctgc

SEQ ID NO: 807105 - DNA, 20 bp, Homo sapiens
acttattttcagtgcatcat

SEQ ID NO: 807106 - DNA, 19 bp, Homo sapiens
acttattttgtcttattct

SEQ ID NO: 807107 - DNA, 14 bp, Homo sapiens
acttatttttgaca

SEQ ID NO: 807108 - DNA, 22 bp, Homo sapiens
acttatttttgacagtgttgaa

SEQ ID NO: 807109 - DNA, 15 bp, Homo sapiens
acttcaaaagccata

SEQ ID NO: 807110 - DNA, 16 bp, Homo sapiens
acttcaaagctgaata

SEQ ID NO: 807111 - DNA, 17 bp, Homo sapiens
acttcaaagctgaatat

SEQ ID NO: 807112 - DNA, 20 bp, Homo sapiens
acttcaaataattaaatctc

SEQ ID NO: 807113 - DNA, 22 bp, Homo sapiens
acttcaatgggctcttccaaca

SEQ ID NO: 807114 - DNA, 19 bp, Homo sapiens
acttcaatgtgtcatttcc

SEQ ID NO: 807115 - DNA, 14 bp, Homo sapiens
acttcaattaatgc

SEQ ID NO: 807116 - DNA, 15 bp, Homo sapiens
acttcacactgcaag

SEQ ID NO: 807117 - DNA, 23 bp, Homo sapiens
acttcacactgcaagagccttgg

SEQ ID NO: 807118 - DNA, 23 bp, Homo sapiens
acttcacatattgatttccgtta

SEQ ID NO: 807119 - DNA, 13 bp, Homo sapiens
acttcacctttcc

SEQ ID NO: 807120 - DNA, 12 bp, Homo sapiens
acttcactgtat

SEQ ID NO: 807121 - DNA, 21 bp, Homo sapiens
acttcactgtcaggaagaaat

SEQ ID NO: 807122 - DNA, 12 bp, Homo sapiens
acttcactgtga

SEQ ID NO: 807123 - DNA, 12 bp, Homo sapiens
acttcagaaaga

SEQ ID NO: 807124 - DNA, 15 bp, Homo sapiens
acttcagaattccat

SEQ ID NO: 807125 - DNA, 19 bp, Homo sapiens
acttcagacacaggaaaaa

SEQ ID NO: 807126 - DNA, 22 bp, Homo sapiens
acttcagacacaggaaaaataa

SEQ ID NO: 807127 - DNA, 19 bp, Homo sapiens
acttcagactgaacatgta

SEQ ID NO: 807128 - DNA, 13 bp, Homo sapiens
acttcagctctgt

SEQ ID NO: 807129 - DNA, 11 bp, Homo sapiens
acttcagctga

SEQ ID NO: 807130 - DNA, 20 bp, Homo sapiens
acttcagctgcctgaaacag

SEQ ID NO: 807131 - DNA, 21 bp, Homo sapiens
acttcagctgcctgaaacagc

SEQ ID NO: 807132 - DNA, 14 bp, Homo sapiens
acttcaggctcttc

SEQ ID NO: 807133 - DNA, 16 bp, Homo sapiens
acttcaggctcttctc

SEQ ID NO: 807134 - DNA, 20 bp, Homo sapiens
acttcagggcagggctctga

SEQ ID NO: 807135 - DNA, 21 bp, Homo sapiens
acttcagggcagggctctgat

SEQ ID NO: 807136 - DNA, 23 bp, Homo sapiens
acttcagggcagggctctgatat

SEQ ID NO: 807137 - DNA, 20 bp, Homo sapiens
acttcaggtggagagcacta

SEQ ID NO: 807138 - DNA, 16 bp, Homo sapiens
acttcagtatgtgtca

SEQ ID NO: 807139 - DNA, 12 bp, Homo sapiens
acttcagtctgt

SEQ ID NO: 807140 - DNA, 21 bp, Homo sapiens
acttcagtttcacagaaaata

SEQ ID NO: 807141 - DNA, 15 bp, Homo sapiens
acttcatcaaacatg

SEQ ID NO: 807142 - DNA, 22 bp, Homo sapiens
acttcatggcctttgataaatg

SEQ ID NO: 807143 - DNA, 22 bp, Homo sapiens
acttcatgtaattttattttaa

SEQ ID NO: 807144 - DNA, 14 bp, Homo sapiens
acttcatgtcaact

SEQ ID NO: 807145 - DNA, 14 bp, Homo sapiens
acttcattccagca

SEQ ID NO: 807146 - DNA, 16 bp, Homo sapiens
acttcattccagcagc

SEQ ID NO: 807147 - DNA, 18 bp, Homo sapiens
acttcattccagcagctg

SEQ ID NO: 807148 - DNA, 18 bp, Homo sapiens
acttcattctaaaccaaa

SEQ ID NO: 807149 - DNA, 21 bp, Homo sapiens
acttcattgagagttttgtct

SEQ ID NO: 807150 - DNA, 15 bp, Homo sapiens
acttcatttgtgcca

SEQ ID NO: 807151 - DNA, 14 bp, Homo sapiens
acttcatttttaat

SEQ ID NO: 807152 - DNA, 12 bp, Homo sapiens
acttccaaagct

SEQ ID NO: 807153 - DNA, 21 bp, Homo sapiens
acttccaaatcccctaagcag

SEQ ID NO: 807154 - DNA, 21 bp, Homo sapiens
acttccaagctccaaatccaa

SEQ ID NO: 807155 - DNA, 19 bp, Homo sapiens
acttccaagtgataatttt

SEQ ID NO: 807156 - DNA, 18 bp, Homo sapiens
acttccaatttacatact

SEQ ID NO: 807157 - DNA, 16 bp, Homo sapiens
acttccactaatccat

SEQ ID NO: 807158 - DNA, 22 bp, Homo sapiens
acttccagatatccacataaat

SEQ ID NO: 807159 - DNA, 15 bp, Homo sapiens
acttccaggatggat

SEQ ID NO: 807160 - DNA, 13 bp, Homo sapiens
acttccagtctgg

SEQ ID NO: 807161 - DNA, 19 bp, Homo sapiens
acttccataggacatactg

SEQ ID NO: 807162 - DNA, 15 bp, Homo sapiens
acttccatgaatttt

SEQ ID NO: 807163 - DNA, 12 bp, Homo sapiens
acttccatgcct

SEQ ID NO: 807164 - DNA, 14 bp, Homo sapiens
acttcccaacagcc

SEQ ID NO: 807165 - DNA, 20 bp, Homo sapiens
acttcccacacggcagcccc

SEQ ID NO: 807166 - DNA, 24 bp, Homo sapiens
acttcccagttcaggagtcccaag

SEQ ID NO: 807167 - DNA, 14 bp, Homo sapiens
acttcccatctcca

SEQ ID NO: 807168 - DNA, 17 bp, Homo sapiens
acttcccatctccaggg

SEQ ID NO: 807169 - DNA, 16 bp, Homo sapiens
acttcccatctggctc

SEQ ID NO: 807170 - DNA, 15 bp, Homo sapiens
acttccccaccccta

SEQ ID NO: 807171 - DNA, 13 bp, Homo sapiens
acttccccatccc

SEQ ID NO: 807172 - DNA, 15 bp, Homo sapiens
acttcccctgggatg

SEQ ID NO: 807173 - DNA, 23 bp, Homo sapiens
acttcccctgggatgctgaccca

SEQ ID NO: 807174 - DNA, 20 bp, Homo sapiens
acttccccttgtctccctgg

SEQ ID NO: 807175 - DNA, 19 bp, Homo sapiens
acttcccgggccagggctg

SEQ ID NO: 807176 - DNA, 17 bp, Homo sapiens
acttcccgtctcagaat

SEQ ID NO: 807177 - DNA, 14 bp, Homo sapiens
acttccctctgttt

SEQ ID NO: 807178 - DNA, 21 bp, Homo sapiens
acttccctgattgacctgctc

SEQ ID NO: 807179 - DNA, 12 bp, Homo sapiens
acttccctgtgt

SEQ ID NO: 807180 - DNA, 15 bp, Homo sapiens
acttccgctccctgg

SEQ ID NO: 807181 - DNA, 14 bp, Homo sapiens
acttcctcaataaa

SEQ ID NO: 807182 - DNA, 12 bp, Homo sapiens
acttcctccaca

SEQ ID NO: 807183 - DNA, 13 bp, Homo sapiens
acttcctcctacc

SEQ ID NO: 807184 - DNA, 15 bp, Homo sapiens
acttcctcctcccca

SEQ ID NO: 807185 - DNA, 18 bp, Homo sapiens
acttcctctcgcggccct

SEQ ID NO: 807186 - DNA, 22 bp, Homo sapiens
acttcctctcgcggccctcagt

SEQ ID NO: 807187 - DNA, 16 bp, Homo sapiens
acttcctctctacccc

SEQ ID NO: 807188 - DNA, 23 bp, Homo sapiens
acttcctctctcggagccctcag

SEQ ID NO: 807189 - DNA, 14 bp, Homo sapiens
acttcctctgccat

SEQ ID NO: 807190 - DNA, 21 bp, Homo sapiens
acttcctgactctcacctgta

SEQ ID NO: 807191 - DNA, 20 bp, Homo sapiens
acttcctgcagtgaatttga

SEQ ID NO: 807192 - DNA, 12 bp, Homo sapiens
acttcctgctgc

SEQ ID NO: 807193 - DNA, 13 bp, Homo sapiens
acttcctggcctc

SEQ ID NO: 807194 - DNA, 23 bp, Homo sapiens
acttcctggctccttcactgaac

SEQ ID NO: 807195 - DNA, 23 bp, Homo sapiens
acttcctggggatgtcatagcca

SEQ ID NO: 807196 - DNA, 23 bp, Homo sapiens
acttcctggtgaggcccagcctg

SEQ ID NO: 807197 - DNA, 14 bp, Homo sapiens
acttcctgtccaga

SEQ ID NO: 807198 - DNA, 13 bp, Homo sapiens
acttcctgtcctt

SEQ ID NO: 807199 - DNA, 15 bp, Homo sapiens
acttcctgtccttgt

SEQ ID NO: 807200 - DNA, 11 bp, Homo sapiens
acttcctgtgt

SEQ ID NO: 807201 - DNA, 13 bp, Homo sapiens
acttcctgtgtac

SEQ ID NO: 807202 - DNA, 16 bp, Homo sapiens
acttcctgtgtactct

SEQ ID NO: 807203 - DNA, 18 bp, Homo sapiens
acttcctgtttgggcccc

SEQ ID NO: 807204 - DNA, 12 bp, Homo sapiens
acttcctttaca

SEQ ID NO: 807205 - DNA, 14 bp, Homo sapiens
acttcctttcctac

SEQ ID NO: 807206 - DNA, 15 bp, Homo sapiens
acttcctttcctact

SEQ ID NO: 807207 - DNA, 22 bp, Homo sapiens
acttcgcaccggagtgtctgga

SEQ ID NO: 807208 - DNA, 16 bp, Homo sapiens
acttcgggctgtgtaa

SEQ ID NO: 807209 - DNA, 21 bp, Homo sapiens
acttcgtcttcgccctctgaa

SEQ ID NO: 807210 - DNA, 18 bp, Homo sapiens
acttcgtcttctaatttc

SEQ ID NO: 807211 - DNA, 17 bp, Homo sapiens
acttctaaatgcatatc

SEQ ID NO: 807212 - DNA, 22 bp, Homo sapiens
acttctaatatatttttatatt

SEQ ID NO: 807213 - DNA, 13 bp, Homo sapiens
acttctaatttat

SEQ ID NO: 807214 - DNA, 20 bp, Homo sapiens
actttctgaaaacacttgat

SEQ ID NO: 807215 - DNA, 13 bp, Homo sapiens
actttctgctttg

SEQ ID NO: 807216 - DNA, 22 bp, Homo sapiens
actttctgtctaggttaaagct

SEQ ID NO: 807217 - DNA, 23 bp, Homo sapiens
actttctgtctaggttaaagcta

SEQ ID NO: 807218 - DNA, 17 bp, Homo sapiens
actttctgtgacgcaga

SEQ ID NO: 807219 - DNA, 16 bp, Homo sapiens
actttctgttccttcc

SEQ ID NO: 807220 - DNA, 17 bp, Homo sapiens
actttctgttccttcct

SEQ ID NO: 807221 - DNA, 14 bp, Homo sapiens
actttctgttttct

SEQ ID NO: 807222 - DNA, 23 bp, Homo sapiens
actttctgttttctgtttgtaaa

SEQ ID NO: 807223 - DNA, 14 bp, Homo sapiens
actttcttctgaat

SEQ ID NO: 807224 - DNA, 20 bp, Homo sapiens
actttcttctgaatatttta

SEQ ID NO: 807225 - DNA, 17 bp, Homo sapiens
actttctttcagatgtt

SEQ ID NO: 807226 - DNA, 18 bp, Homo sapiens
actttctttcagatgttt

SEQ ID NO: 807227 - DNA, 17 bp, Homo sapiens
actttgaaaacaattca

SEQ ID NO: 807228 - DNA, 21 bp, Homo sapiens
actttgaaaacaattcagtgg

SEQ ID NO: 807229 - DNA, 14 bp, Homo sapiens
actttgaaaactga

SEQ ID NO: 807230 - DNA, 19 bp, Homo sapiens
actttgaaaagttggaagg

SEQ ID NO: 807231 - DNA, 15 bp, Homo sapiens
actttgaaaatattt

SEQ ID NO: 807232 - DNA, 20 bp, Homo sapiens
actttgaaaatatttctatg

SEQ ID NO: 807233 - DNA, 13 bp, Homo sapiens
actttgaactgaa

SEQ ID NO: 807234 - DNA, 16 bp, Homo sapiens
actttgaactgaaact

SEQ ID NO: 807235 - DNA, 14 bp, Homo sapiens
actttgaagggcaa

SEQ ID NO: 807236 - DNA, 21 bp, Homo sapiens
actttgaagggcaagaaatgg

SEQ ID NO: 807237 - DNA, 17 bp, Homo sapiens
actttgaagttagcttt

SEQ ID NO: 807238 - DNA, 13 bp, Homo sapiens
actttgaattatt

SEQ ID NO: 807239 - DNA, 18 bp, Homo sapiens
actttgacacttttcata

SEQ ID NO: 807240 - DNA, 18 bp, Homo sapiens
actttgacagtgttttta

SEQ ID NO: 807241 - DNA, 13 bp, Homo sapiens
actttgacctctg

SEQ ID NO: 807242 - DNA, 14 bp, Homo sapiens
actttgacctctgc

SEQ ID NO: 807243 - DNA, 15 bp, Homo sapiens
actttgactttttgc

SEQ ID NO: 807244 - DNA, 20 bp, Homo sapiens
actttgactttttgcattta

SEQ ID NO: 807245 - DNA, 21 bp, Homo sapiens
actttgactttttgcatttaa

SEQ ID NO: 807246 - DNA, 14 bp, Homo sapiens
actttgagaagatg

SEQ ID NO: 807247 - DNA, 18 bp, Homo sapiens
actttgagcctgcatctt

SEQ ID NO: 807248 - DNA, 20 bp, Homo sapiens
actttgagcctgcatcttct

SEQ ID NO: 807249 - DNA, 21 bp, Homo sapiens
actttgagcctgcatcttctt

SEQ ID NO: 807250 - DNA, 16 bp, Homo sapiens
actttgatgctccctt

SEQ ID NO: 807251 - DNA, 20 bp, Homo sapiens
actttgcacgacgccctctc

SEQ ID NO: 807252 - DNA, 18 bp, Homo sapiens
actttgcactgatatatc

SEQ ID NO: 807253 - DNA, 13 bp, Homo sapiens
actttgcacttaa

SEQ ID NO: 807254 - DNA, 19 bp, Homo sapiens
actttgcaggcggccctca

SEQ ID NO: 807255 - DNA, 15 bp, Homo sapiens
actttgcataaatta

SEQ ID NO: 807256 - DNA, 16 bp, Homo sapiens
actttgcatctcagta

SEQ ID NO: 807257 - DNA, 14 bp, Homo sapiens
actttgccaaggct

SEQ ID NO: 807258 - DNA, 17 bp, Homo sapiens
actttgccaaggctctc

SEQ ID NO: 807259 - DNA, 15 bp, Homo sapiens
actttgccatttttc

SEQ ID NO: 807260 - DNA, 21 bp, Homo sapiens
actttgcccagggtcctgtgc

SEQ ID NO: 807261 - DNA, 20 bp, Homo sapiens
actttgctcaaaattttaaa

SEQ ID NO: 807262 - DNA, 18 bp, Homo sapiens
actttgctctcaattaaa

SEQ ID NO: 807263 - DNA, 19 bp, Homo sapiens
actttgctctcaattaaag

SEQ ID NO: 807264 - DNA, 20 bp, Homo sapiens
actttgctctcaattaaagt

SEQ ID NO: 807265 - DNA, 15 bp, Homo sapiens
actttgctctcttct

SEQ ID NO: 807266 - DNA, 20 bp, Homo sapiens
actttgctctcttcttcttt

SEQ ID NO: 807267 - DNA, 16 bp, Homo sapiens
actttgctgttactgc

SEQ ID NO: 807268 - DNA, 20 bp, Homo sapiens
actttgctgttactgcttct

SEQ ID NO: 807269 - DNA, 21 bp, Homo sapiens
actttgctgttactgcttctc

SEQ ID NO: 807270 - DNA, 19 bp, Homo sapiens
actttgctgttccttactt

SEQ ID NO: 807271 - DNA, 22 bp, Homo sapiens
actttgcttagtattgacaact

SEQ ID NO: 807272 - DNA, 14 bp, Homo sapiens
actttgcttcccat

SEQ ID NO: 807273 - DNA, 11 bp, Homo sapiens
actttgcttgc

SEQ ID NO: 807274 - DNA, 14 bp, Homo sapiens
actttgcttgcttt

SEQ ID NO: 807275 - DNA, 22 bp, Homo sapiens
actttggaaccagactcttgcc

SEQ ID NO: 807276 - DNA, 18 bp, Homo sapiens
actttggaagtttgtgtt

SEQ ID NO: 807277 - DNA, 21 bp, Homo sapiens
actttggaagtttgtgttctg

SEQ ID NO: 807278 - DNA, 17 bp, Homo sapiens
actttggacagtggcct

SEQ ID NO: 807279 - DNA, 19 bp, Homo sapiens
actttggacagtggcctct

SEQ ID NO: 807280 - DNA, 18 bp, Homo sapiens
actttggagtcccctcac

SEQ ID NO: 807281 - DNA, 20 bp, Homo sapiens
actttggcttctcctgtgac

SEQ ID NO: 807282 - DNA, 14 bp, Homo sapiens
actttgggaggcca

SEQ ID NO: 807283 - DNA, 15 bp, Homo sapiens
actttgggaggccaa

SEQ ID NO: 807284 - DNA, 20 bp, Homo sapiens
actttgggaggccaaggtgg

SEQ ID NO: 807285 - DNA, 22 bp, Homo sapiens
actttgggagtttttgtttgtt

SEQ ID NO: 807286 - DNA, 20 bp, Homo sapiens
actttgggataggaaaaatg

SEQ ID NO: 807287 - DNA, 16 bp, Homo sapiens
actttgggcttagtat

SEQ ID NO: 807288 - DNA, 23 bp, Homo sapiens
actttgggcttagtatttctcag

SEQ ID NO: 807289 - DNA, 11 bp, Homo sapiens
actttggggac

SEQ ID NO: 807290 - DNA, 12 bp, Homo sapiens
actttggggaca

SEQ ID NO: 807291 - DNA, 17 bp, Homo sapiens
actttggggctaattta

SEQ ID NO: 807292 - DNA, 23 bp, Homo sapiens
actttggtactgctgtcttccaa

SEQ ID NO: 807293 - DNA, 23 bp, Homo sapiens
actttggtagtggaatagtgaat

SEQ ID NO: 807294 - DNA, 22 bp, Homo sapiens
actttggtgcgggcacaataaa

SEQ ID NO: 807295 - DNA, 23 bp, Homo sapiens
actttggtgcgggcacaataaat

SEQ ID NO: 807296 - DNA, 14 bp, Homo sapiens
actttggtttctga

SEQ ID NO: 807297 - DNA, 22 bp, Homo sapiens
actttgtacttgtgtttgctta

SEQ ID NO: 807298 - DNA, 18 bp, Homo sapiens
actttgtagactgtttca

SEQ ID NO: 807299 - DNA, 14 bp, Homo sapiens
actttgtatacaag

SEQ ID NO: 807300 - DNA, 15 bp, Homo sapiens
actttgtcattatga

SEQ ID NO: 807301 - DNA, 18 bp, Homo sapiens
actttgtcctaagagatt

SEQ ID NO: 807302 - DNA, 17 bp, Homo sapiens
actttgtctgaaaaatt

SEQ ID NO: 807303 - DNA, 14 bp, Homo sapiens
actttgtctgtaca

SEQ ID NO: 807304 - DNA, 20 bp, Homo sapiens
actttgtgaattaacacagt

SEQ ID NO: 807305 - DNA, 21 bp, Homo sapiens
actttgtggatgtcttccttg

SEQ ID NO: 807306 - DNA, 19 bp, Homo sapiens
actttgtgttcatttcatt

SEQ ID NO: 807307 - DNA, 23 bp, Homo sapiens
actttgtgtttttttaatttcta

SEQ ID NO: 807308 - DNA, 15 bp, Homo sapiens
actttgttctttagg

SEQ ID NO: 807309 - DNA, 17 bp, Homo sapiens
actttgttgcaagatgt

SEQ ID NO: 807310 - DNA, 16 bp, Homo sapiens
actttgtttatgcata

SEQ ID NO: 807311 - DNA, 17 bp, Homo sapiens
acttttaaaaaaatttt

SEQ ID NO: 807312 - DNA, 23 bp, Homo sapiens
acttttaaaaaaatttttataaa

SEQ ID NO: 807313 - DNA, 15 bp, Homo sapiens
acttttaaactgtgt

SEQ ID NO: 807314 - DNA, 22 bp, Homo sapiens
acttttaaagaaaaatatgata

SEQ ID NO: 807315 - DNA, 13 bp, Homo sapiens
acttttaaagatt

SEQ ID NO: 807316 - DNA, 19 bp, Homo sapiens
acttttaaaggaatgtgaa

SEQ ID NO: 807317 - DNA, 21 bp, Homo sapiens
acttttaaaggaatgtgaaat

SEQ ID NO: 807318 - DNA, 18 bp, Homo sapiens
acttttaaggataaatca

SEQ ID NO: 807319 - DNA, 11 bp, Homo sapiens
acttttaataa

SEQ ID NO: 807320 - DNA, 22 bp, Homo sapiens
acttttaatatcactaatttct

SEQ ID NO: 807321 - DNA, 17 bp, Homo sapiens
acttttacagaatgcat

SEQ ID NO: 807322 - DNA, 21 bp, Homo sapiens
acttttacagaatgcattaaa

SEQ ID NO: 807323 - DNA, 19 bp, Homo sapiens
acttttactctgcctacag

SEQ ID NO: 807324 - DNA, 21 bp, Homo sapiens
acttttactctgcctacagaa

SEQ ID NO: 807325 - DNA, 18 bp, Homo sapiens
acttttagaaatgcatat

SEQ ID NO: 807326 - DNA, 15 bp, Homo sapiens
acttttataaacttt

SEQ ID NO: 807327 - DNA, 17 bp, Homo sapiens
acttttataaattaaat

SEQ ID NO: 807328 - DNA, 21 bp, Homo sapiens
acttttataaattaaatatat

SEQ ID NO: 807329 - DNA, 11 bp, Homo sapiens
acttttataat

SEQ ID NO: 807330 - DNA, 20 bp, Homo sapiens
acttttatgatgtatattta

SEQ ID NO: 807331 - DNA, 17 bp, Homo sapiens
acttttatgtgagattt

SEQ ID NO: 807332 - DNA, 22 bp, Homo sapiens
acttttatgtgagatttcctta

SEQ ID NO: 807333 - DNA, 13 bp, Homo sapiens
acttttattattt

SEQ ID NO: 807334 - DNA, 15 bp, Homo sapiens
acttttcaccaatga

SEQ ID NO: 807335 - DNA, 17 bp, Homo sapiens
agaaatcattgtagaaa

SEQ ID NO: 807336 - DNA, 22 bp, Homo sapiens
agaaatccctgtttaatattta

SEQ ID NO: 807337 - DNA, 17 bp, Homo sapiens
agaaatctgtttcaaca

SEQ ID NO: 807338 - DNA, 13 bp, Homo sapiens
agaaatcttgctt

SEQ ID NO: 807339 - DNA, 19 bp, Homo sapiens
agaaatcttgtcttaccac

SEQ ID NO: 807340 - DNA, 21 bp, Homo sapiens
agaaatgaaaaaaaaaaacaa

SEQ ID NO: 807341 - DNA, 12 bp, Homo sapiens
agaaatgaataa

SEQ ID NO: 807342 - DNA, 15 bp, Homo sapiens
agaaatgatggaagt

SEQ ID NO: 807343 - DNA, 14 bp, Homo sapiens
agaaatgcaaaaat

SEQ ID NO: 807344 - DNA, 16 bp, Homo sapiens
agaaatgcaataactc

SEQ ID NO: 807345 - DNA, 21 bp, Homo sapiens
agaaatgcaataactctggga

SEQ ID NO: 807346 - DNA, 21 bp, Homo sapiens
agaaatgcagagaagaataag

SEQ ID NO: 807347 - DNA, 22 bp, Homo sapiens
agaaatgcatccattcctcagg

SEQ ID NO: 807348 - DNA, 11 bp, Homo sapiens
agaaatgccag

SEQ ID NO: 807349 - DNA, 13 bp, Homo sapiens
agaaatgctgcct

SEQ ID NO: 807350 - DNA, 15 bp, Homo sapiens
agaaatgctgcctgc

SEQ ID NO: 807351 - DNA, 23 bp, Homo sapiens
agaaatgctgcctgcctgtctgt

SEQ ID NO: 807352 - DNA, 13 bp, Homo sapiens
agaaatgctgctg

SEQ ID NO: 807353 - DNA, 17 bp, Homo sapiens
agaaatgctgctggcca

SEQ ID NO: 807354 - DNA, 16 bp, Homo sapiens
agaaatggaaattttg

SEQ ID NO: 807355 - DNA, 16 bp, Homo sapiens
agaaatggacaaagaa

SEQ ID NO: 807356 - DNA, 18 bp, Homo sapiens
agaaatggcgtctgctct

SEQ ID NO: 807357 - DNA, 22 bp, Homo sapiens
agaaatggctaataaactttgt

SEQ ID NO: 807358 - DNA, 17 bp, Homo sapiens
agaaatggctatgaaca

SEQ ID NO: 807359 - DNA, 20 bp, Homo sapiens
agaaatgggacttaactcct

SEQ ID NO: 807360 - DNA, 13 bp, Homo sapiens
agaaatgggcctg

SEQ ID NO: 807361 - DNA, 14 bp, Homo sapiens
agaaatgggcctgc

SEQ ID NO: 807362 - DNA, 18 bp, Homo sapiens
agaaatgggcctgcctgc

SEQ ID NO: 807363 - DNA, 21 bp, Homo sapiens
agaaatgggcctgcctgcctc

SEQ ID NO: 807364 - DNA, 22 bp, Homo sapiens
agaaatgggcctgcctgcctcc

SEQ ID NO: 807365 - DNA, 19 bp, Homo sapiens
agaaatggtgagattgttt

SEQ ID NO: 807366 - DNA, 18 bp, Homo sapiens
agaaatggtttcctctgg

SEQ ID NO: 807367 - DNA, 20 bp, Homo sapiens
agaaatggtttcctctggat

SEQ ID NO: 807368 - DNA, 13 bp, Homo sapiens
agaaatgtaaact

SEQ ID NO: 807369 - DNA, 15 bp, Homo sapiens
agaaatgtaaactgc

SEQ ID NO: 807370 - DNA, 23 bp, Homo sapiens
agaaatgtaaatgttattattct

SEQ ID NO: 807371 - DNA, 15 bp, Homo sapiens
agaaatgtacagcaa

SEQ ID NO: 807372 - DNA, 18 bp, Homo sapiens
agaaatgtctctgctcct

SEQ ID NO: 807373 - DNA, 21 bp, Homo sapiens
agaaatgtgtagctgcaaaaa

SEQ ID NO: 807374 - DNA, 15 bp, Homo sapiens
agaaatgtttttaac

SEQ ID NO: 807375 - DNA, 20 bp, Homo sapiens
agaaatgtttttaacactat

SEQ ID NO: 807376 - DNA, 14 bp, Homo sapiens
agaaattaaaatat

SEQ ID NO: 807377 - DNA, 16 bp, Homo sapiens
agaaattaaaatatta

SEQ ID NO: 807378 - DNA, 21 bp, Homo sapiens
agaaattaaaatattatttga

SEQ ID NO: 807379 - DNA, 22 bp, Homo sapiens
agaaattaaaatattatttgat

SEQ ID NO: 807380 - DNA, 18 bp, Homo sapiens
agaaattacctgtggata

SEQ ID NO: 807381 - DNA, 12 bp, Homo sapiens
agaaattagaaa

SEQ ID NO: 807382 - DNA, 14 bp, Homo sapiens
agaaattagccggg

SEQ ID NO: 807383 - DNA, 15 bp, Homo sapiens
agaaattagctgtgt

SEQ ID NO: 807384 - DNA, 11 bp, Homo sapiens
agaaattcagg

SEQ ID NO: 807385 - DNA, 14 bp, Homo sapiens
agaaattcaggtac

SEQ ID NO: 807386 - DNA, 16 bp, Homo sapiens
agaaattcctgtagca

SEQ ID NO: 807387 - DNA, 18 bp, Homo sapiens
agaaattcgtgtgttttt

SEQ ID NO: 807388 - DNA, 23 bp, Homo sapiens
agaaattcgtgtgtttttttatg

SEQ ID NO: 807389 - DNA, 13 bp, Homo sapiens
agaaattctgtgg

SEQ ID NO: 807390 - DNA, 22 bp, Homo sapiens
agaaattggaacagaatgtttt

SEQ ID NO: 807391 - DNA, 14 bp, Homo sapiens
agaaattggctgga

SEQ ID NO: 807392 - DNA, 16 bp, Homo sapiens
agaaattgtatattgt

SEQ ID NO: 807393 - DNA, 20 bp, Homo sapiens
agaaatttaaactataagca

SEQ ID NO: 807394 - DNA, 17 bp, Homo sapiens
agaaatttaattcatgt

SEQ ID NO: 807395 - DNA, 16 bp, Homo sapiens
agaaatttccagagaa

SEQ ID NO: 807396 - DNA, 16 bp, Homo sapiens
agaaatttgcaactca

SEQ ID NO: 807397 - DNA, 20 bp, Homo sapiens
agaaatttgcaactcactga

SEQ ID NO: 807398 - DNA, 11 bp, Homo sapiens
agaaattttca

SEQ ID NO: 807399 - DNA, 18 bp, Homo sapiens
agaaattttggtttttca

SEQ ID NO: 807400 - DNA, 14 bp, Homo sapiens
agaaattttgtaag

SEQ ID NO: 807401 - DNA, 16 bp, Homo sapiens
agaaattttgtaagaa

SEQ ID NO: 807402 - DNA, 13 bp, Homo sapiens
agaaatttttatt

SEQ ID NO: 807403 - DNA, 22 bp, Homo sapiens
agaaatttttatttttctaagg

SEQ ID NO: 807404 - DNA, 18 bp, Homo sapiens
agaaatttttatttttga

SEQ ID NO: 807405 - DNA, 18 bp, Homo sapiens
agaaatttttcagatgct

SEQ ID NO: 807406 - DNA, 23 bp, Homo sapiens
agaaatttttcagatgcttctgg

SEQ ID NO: 807407 - DNA, 10 bp, Homo sapiens
agaacaaaaa

SEQ ID NO: 807408 - DNA, 20 bp, Homo sapiens
agaacaaaaaaatctgcaga

SEQ ID NO: 807409 - DNA, 13 bp, Homo sapiens
agaacaaaaaacc

SEQ ID NO: 807410 - DNA, 22 bp, Homo sapiens
agaacaaaaagaaatcttgtct

SEQ ID NO: 807411 - DNA, 18 bp, Homo sapiens
agaacaaacaaaacttaa

SEQ ID NO: 807412 - DNA, 13 bp, Homo sapiens
agaacaaagctgt

SEQ ID NO: 807413 - DNA, 14 bp, Homo sapiens
agaacaaagctgtt

SEQ ID NO: 807414 - DNA, 19 bp, Homo sapiens
agaacaaagctgttaaact

SEQ ID NO: 807415 - DNA, 20 bp, Homo sapiens
agaacaaagctgttaaactg

SEQ ID NO: 807416 - DNA, 22 bp, Homo sapiens
agaacaaagctgttaaactgtt

SEQ ID NO: 807417 - DNA, 13 bp, Homo sapiens
agaacaaatgtgt

SEQ ID NO: 807418 - DNA, 16 bp, Homo sapiens
agaacaacaggcaggg

SEQ ID NO: 807419 - DNA, 18 bp, Homo sapiens
agaacaacttgctactta

SEQ ID NO: 807420 - DNA, 20 bp, Homo sapiens
agaacaagtcacagctgcag

SEQ ID NO: 807421 - DNA, 23 bp, Homo sapiens
agaacaagtcacagctgcagctg

SEQ ID NO: 807422 - DNA, 19 bp, Homo sapiens
agaacaatcactattctta

SEQ ID NO: 807423 - DNA, 15 bp, Homo sapiens
agaacaatgccaggg

SEQ ID NO: 807424 - DNA, 15 bp, Homo sapiens
agaacaatgtgctat

SEQ ID NO: 807425 - DNA, 17 bp, Homo sapiens
agaacacaaaacttgaa

SEQ ID NO: 807426 - DNA, 12 bp, Homo sapiens
agaacacacaca

SEQ ID NO: 807427 - DNA, 14 bp, Homo sapiens
agaacacacacact

SEQ ID NO: 807428 - DNA, 20 bp, Homo sapiens
agaacacagcaattcctcag

SEQ ID NO: 807429 - DNA, 18 bp, Homo sapiens
agaacacctggccgggtc

SEQ ID NO: 807430 - DNA, 20 bp, Homo sapiens
agaacactaactcaccagcc

SEQ ID NO: 807431 - DNA, 11 bp, Homo sapiens
agaacactaat

SEQ ID NO: 807432 - DNA, 16 bp, Homo sapiens
agaacactaattcata

SEQ ID NO: 807433 - DNA, 18 bp, Homo sapiens
agaacagaggcatttaaa

SEQ ID NO: 807434 - DNA, 18 bp, Homo sapiens
agaacagagggccagagc

SEQ ID NO: 807435 - DNA, 16 bp, Homo sapiens
agaacagatcttttac

SEQ ID NO: 807436 - DNA, 15 bp, Homo sapiens
agaacagatggggtc

SEQ ID NO: 807437 - DNA, 13 bp, Homo sapiens
agaacagcagagg

SEQ ID NO: 807438 - DNA, 23 bp, Homo sapiens
agaacagcagggtagtctggttt

SEQ ID NO: 807439 - DNA, 15 bp, Homo sapiens
agaacagcattgtcc

SEQ ID NO: 807440 - DNA, 19 bp, Homo sapiens
agaacagggaaaataggca

SEQ ID NO: 807441 - DNA, 22 bp, Homo sapiens
agaacagggaaaataggcagga

SEQ ID NO: 807442 - DNA, 22 bp, Homo sapiens
agaacagggcgggggggggggc

SEQ ID NO: 807443 - DNA, 11 bp, Homo sapiens
agaacagggtc

SEQ ID NO: 807444 - DNA, 14 bp, Homo sapiens
agaacagtatgaat

SEQ ID NO: 807445 - DNA, 22 bp, Homo sapiens
agaacagtggaaactatgtgtt

SEQ ID NO: 807446 - DNA, 22 bp, Homo sapiens
agaacagtgggcgttgggagcc

SEQ ID NO: 807447 - DNA, 15 bp, Homo sapiens
agaacataaaaagga

SEQ ID NO: 807448 - DNA, 14 bp, Homo sapiens
agaacataaagcaa

SEQ ID NO: 807449 - DNA, 11 bp, Homo sapiens
agaacatagaa

SEQ ID NO: 807450 - DNA, 18 bp, Homo sapiens
agaacatcattagaacaa

SEQ ID NO: 807451 - DNA, 17 bp, Homo sapiens
agaacatccctgggcaa

SEQ ID NO: 807452 - DNA, 21 bp, Homo sapiens
agaacatccctgtcttaactg

SEQ ID NO: 807453 - DNA, 13 bp, Homo sapiens
agaacatgcacat

SEQ ID NO: 807454 - DNA, 13 bp, Homo sapiens
agaacatgtgaga

SEQ ID NO: 807455 - DNA, 22 bp, Homo sapiens
agaacatgtgagaggtttgact

SEQ ID NO: 807456 - DNA, 22 bp, Homo sapiens
agaacattcacttttgttaaca

SEQ ID NO: 807457 - DNA, 21 bp, Homo sapiens
agaatccaaacttggattttt

SEQ ID NO: 807458 - DNA, 15 bp, Homo sapiens
agaatccaatactgc

SEQ ID NO: 807459 - DNA, 17 bp, Homo sapiens
agaatccataaatgtgt

SEQ ID NO: 807460 - DNA, 20 bp, Homo sapiens
agaatccataaatgtgttcc

SEQ ID NO: 807461 - DNA, 17 bp, Homo sapiens
agaatcccaatgtttga

SEQ ID NO: 807462 - DNA, 23 bp, Homo sapiens
agaatccccaagtgcctgctttt

SEQ ID NO: 807463 - DNA, 14 bp, Homo sapiens
agaatccctgcagc

SEQ ID NO: 807464 - DNA, 16 bp, Homo sapiens
agaatccctgcagcct

SEQ ID NO: 807465 - DNA, 17 bp, Homo sapiens
agaatccctgcagcctg

SEQ ID NO: 807466 - DNA, 14 bp, Homo sapiens
agaatccctgttca

SEQ ID NO: 807467 - DNA, 12 bp, Homo sapiens
agaatcctgcct

SEQ ID NO: 807468 - DNA, 17 bp, Homo sapiens
agaatcctgcctctccc

SEQ ID NO: 807469 - DNA, 14 bp, Homo sapiens
agaatccttggctg

SEQ ID NO: 807470 - DNA, 21 bp, Homo sapiens
agaatccttggctgaattaaa

SEQ ID NO: 807471 - DNA, 22 bp, Homo sapiens
agaatcgatgggggatgcttca

SEQ ID NO: 807472 - DNA, 18 bp, Homo sapiens
agaatctagaaaatcaga

SEQ ID NO: 807473 - DNA, 16 bp, Homo sapiens
agaatctagaagatgt

SEQ ID NO: 807474 - DNA, 18 bp, Homo sapiens
agaatctagaagatgtgt

SEQ ID NO: 807475 - DNA, 18 bp, Homo sapiens
agaatctatatttaacaa

SEQ ID NO: 807476 - DNA, 17 bp, Homo sapiens
agaatctcaaataacta

SEQ ID NO: 807477 - DNA, 16 bp, Homo sapiens
agaatctcttcatgct

SEQ ID NO: 807478 - DNA, 22 bp, Homo sapiens
agaatctcttcatgcttgacat

SEQ ID NO: 807479 - DNA, 13 bp, Homo sapiens
agaatctcttgaa

SEQ ID NO: 807480 - DNA, 18 bp, Homo sapiens
agaatctgatgcctttat

SEQ ID NO: 807481 - DNA, 12 bp, Homo sapiens
agaatctgcccc

SEQ ID NO: 807482 - DNA, 23 bp, Homo sapiens
agaatctgcccctgttgaggtgg

SEQ ID NO: 807483 - DNA, 12 bp, Homo sapiens
agaatctgcctg

SEQ ID NO: 807484 - DNA, 17 bp, Homo sapiens
agaatctgctgttgcca

SEQ ID NO: 807485 - DNA, 13 bp, Homo sapiens
agaatctgtgtga

SEQ ID NO: 807486 - DNA, 22 bp, Homo sapiens
agaatctgtgtgaagttacaca

SEQ ID NO: 807487 - DNA, 21 bp, Homo sapiens
agaatcttaaggtctaactgt

SEQ ID NO: 807488 - DNA, 17 bp, Homo sapiens
agaatcttaatgcttgt

SEQ ID NO: 807489 - DNA, 13 bp, Homo sapiens
agaatcttctggg

SEQ ID NO: 807490 - DNA, 16 bp, Homo sapiens
agaatcttgactttct

SEQ ID NO: 807491 - DNA, 19 bp, Homo sapiens
agaatcttgactttctgat

SEQ ID NO: 807492 - DNA, 14 bp, Homo sapiens
agaatcttgtattt

SEQ ID NO: 807493 - DNA, 14 bp, Homo sapiens
agaatctttagaga

SEQ ID NO: 807494 - DNA, 21 bp, Homo sapiens
agaatctttattgagaaagag

SEQ ID NO: 807495 - DNA, 21 bp, Homo sapiens
agaatgaacccatagggagct

SEQ ID NO: 807496 - DNA, 19 bp, Homo sapiens
agaatgaactgtggaattt

SEQ ID NO: 807497 - DNA, 20 bp, Homo sapiens
agaatgaactgtggaattta

SEQ ID NO: 807498 - DNA, 19 bp, Homo sapiens
agaatgaagaactgcatgt

SEQ ID NO: 807499 - DNA, 13 bp, Homo sapiens
agaatgaatagag

SEQ ID NO: 807500 - DNA, 19 bp, Homo sapiens
agaatgaatttatctttac

SEQ ID NO: 807501 - DNA, 20 bp, Homo sapiens
agaatgaatttatctttacc

SEQ ID NO: 807502 - DNA, 21 bp, Homo sapiens
agaatgaatttatctttacca

SEQ ID NO: 807503 - DNA, 21 bp, Homo sapiens
agaatgactatataatttatt

SEQ ID NO: 807504 - DNA, 18 bp, Homo sapiens
agaatgagagcgacacag

SEQ ID NO: 807505 - DNA, 19 bp, Homo sapiens
agaatgagagcgacacaga

SEQ ID NO: 807506 - DNA, 14 bp, Homo sapiens
agaatgagagtgtg

SEQ ID NO: 807507 - DNA, 14 bp, Homo sapiens
agaatgagtgggaa

SEQ ID NO: 807508 - DNA, 15 bp, Homo sapiens
agaatgatgctatga

SEQ ID NO: 807509 - DNA, 13 bp, Homo sapiens
agaatgattaatc

SEQ ID NO: 807510 - DNA, 15 bp, Homo sapiens
agaatgattaatcaa

SEQ ID NO: 807511 - DNA, 14 bp, Homo sapiens
agaatgatttcatg

SEQ ID NO: 807512 - DNA, 20 bp, Homo sapiens
agaatgcagattcctgggcc

SEQ ID NO: 807513 - DNA, 21 bp, Homo sapiens
agaatgcagattcctgggcct

SEQ ID NO: 807514 - DNA, 16 bp, Homo sapiens
agaatgcagcccacca

SEQ ID NO: 807515 - DNA, 23 bp, Homo sapiens
agaatgcagcccaccaggagcac

SEQ ID NO: 807516 - DNA, 14 bp, Homo sapiens
agaatgcattaaaa

SEQ ID NO: 807517 - DNA, 15 bp, Homo sapiens
agaatgcattaaaaa

SEQ ID NO: 807518 - DNA, 20 bp, Homo sapiens
agaatgcattccctgaatct

SEQ ID NO: 807519 - DNA, 22 bp, Homo sapiens
agaatgccataaaattgcagtt

SEQ ID NO: 807520 - DNA, 15 bp, Homo sapiens
agaatgctgtacatc

SEQ ID NO: 807521 - DNA, 15 bp, Homo sapiens
agaatggaagcctga

SEQ ID NO: 807522 - DNA, 14 bp, Homo sapiens
agaatggagaaagt

SEQ ID NO: 807523 - DNA, 15 bp, Homo sapiens
agaatggagaaagta

SEQ ID NO: 807524 - DNA, 13 bp, Homo sapiens
agaatggagacag

SEQ ID NO: 807525 - DNA, 15 bp, Homo sapiens
agaatggaggcaggg

SEQ ID NO: 807526 - DNA, 16 bp, Homo sapiens
agaatggcagaaaagt

SEQ ID NO: 807527 - DNA, 21 bp, Homo sapiens
agaatggcgccaccagctctg

SEQ ID NO: 807528 - DNA, 15 bp, Homo sapiens
agaatggctgggtca

SEQ ID NO: 807529 - DNA, 17 bp, Homo sapiens
agaatgggaatatttta

SEQ ID NO: 807530 - DNA, 23 bp, Homo sapiens
agaatgggggctttcggggaggg

SEQ ID NO: 807531 - DNA, 16 bp, Homo sapiens
agaatggggttcctgc

SEQ ID NO: 807532 - DNA, 17 bp, Homo sapiens
agaatggggttcctgct

SEQ ID NO: 807533 - DNA, 20 bp, Homo sapiens
agaatggggttcctgctgtg

SEQ ID NO: 807534 - DNA, 15 bp, Homo sapiens
agaatggtggagtgt

SEQ ID NO: 807535 - DNA, 19 bp, Homo sapiens
agaatggtgtgaacccggg

SEQ ID NO: 807536 - DNA, 15 bp, Homo sapiens
agaatgtaagaaaac

SEQ ID NO: 807537 - DNA, 19 bp, Homo sapiens
agaatgtaagaaaacaaaa

SEQ ID NO: 807538 - DNA, 23 bp, Homo sapiens
agaatgtatattaaggtgtggct

SEQ ID NO: 807539 - DNA, 14 bp, Homo sapiens
agaatgtatcccca

SEQ ID NO: 807540 - DNA, 22 bp, Homo sapiens
agaatgtcactgtagttttgag

SEQ ID NO: 807541 - DNA, 16 bp, Homo sapiens
agaatgtcagatttct

SEQ ID NO: 807542 - DNA, 16 bp, Homo sapiens
agaatgtcattttggt

SEQ ID NO: 807543 - DNA, 20 bp, Homo sapiens
agaatgtcattttggtactt

SEQ ID NO: 807544 - DNA, 16 bp, Homo sapiens
agaatgtcctcttgga

SEQ ID NO: 807545 - DNA, 16 bp, Homo sapiens
agaatgtgaaaaagga

SEQ ID NO: 807546 - DNA, 16 bp, Homo sapiens
agaatgtgattccttt

SEQ ID NO: 807547 - DNA, 17 bp, Homo sapiens
agaatgtgtgtgtgtgg

SEQ ID NO: 807548 - DNA, 22 bp, Homo sapiens
agaatgtgttcttttctccttt

SEQ ID NO: 807549 - DNA, 21 bp, Homo sapiens
agaatgttaagacttgacagt

SEQ ID NO: 807550 - DNA, 16 bp, Homo sapiens
agaatgttaatttatt

SEQ ID NO: 807551 - DNA, 22 bp, Homo sapiens
agaatgttaatttattttgctc

SEQ ID NO: 807552 - DNA, 13 bp, Homo sapiens
agaatgttccaga

SEQ ID NO: 807553 - DNA, 15 bp, Homo sapiens
agaatgtttcatttg

SEQ ID NO: 807554 - DNA, 23 bp, Homo sapiens
agaatgtttggcactctctaacg

SEQ ID NO: 807555 - DNA, 19 bp, Homo sapiens
agaatgttttactgtgaaa

SEQ ID NO: 807556 - DNA, 14 bp, Homo sapiens
agaattaaaaactt

SEQ ID NO: 807557 - DNA, 15 bp, Homo sapiens
agaattaaaaacttt

SEQ ID NO: 807558 - DNA, 16 bp, Homo sapiens
agaattaaaactgagt

SEQ ID NO: 807559 - DNA, 20 bp, Homo sapiens
agaattaaacttttaattca

SEQ ID NO: 807560 - DNA, 17 bp, Homo sapiens
agaattaacagagattg

SEQ ID NO: 807561 - DNA, 19 bp, Homo sapiens
agaattaccatttgttaat

SEQ ID NO: 807562 - DNA, 23 bp, Homo sapiens
agaattacttgtgttacttgcca

SEQ ID NO: 807563 - DNA, 22 bp, Homo sapiens
agaattagtgccagaattttag

SEQ ID NO: 807564 - DNA, 14 bp, Homo sapiens
agaattatctaatt

SEQ ID NO: 807565 - DNA, 18 bp, Homo sapiens
agaattatctaatttata

SEQ ID NO: 807566 - DNA, 15 bp, Homo sapiens
agaattattcagtga

SEQ ID NO: 807567 - DNA, 21 bp, Homo sapiens
agaattattcagtgaatttgt

SEQ ID NO: 807568 - DNA, 23 bp, Homo sapiens
agaattattcagtgaatttgtcc

SEQ ID NO: 807569 - DNA, 11 bp, Homo sapiens
agaattattta

SEQ ID NO: 807570 - DNA, 21 bp, Homo sapiens
agaattatttttgtgtttcta

SEQ ID NO: 807571 - DNA, 21 bp, Homo sapiens
agaattcaaaagtgattatct

SEQ ID NO: 807572 - DNA, 13 bp, Homo sapiens
agaattcattcat

SEQ ID NO: 807573 - DNA, 16 bp, Homo sapiens
agaattccaaagcaaa

SEQ ID NO: 807574 - DNA, 20 bp, Homo sapiens
agaattcccttgaattgtgt

SEQ ID NO: 807575 - DNA, 17 bp, Homo sapiens
agaattcctgaagccag

SEQ ID NO: 807576 - DNA, 13 bp, Homo sapiens
agaattccttcga

SEQ ID NO: 807577 - DNA, 22 bp, Homo sapiens
agaattcggtgtgctgccaact

SEQ ID NO: 807578 - DNA, 23 bp, Homo sapiens
agaattctagtgctgctgaagat

SEQ ID NO: 807579 - DNA, 14 bp, Homo sapiens
agacctaagccctg

SEQ ID NO: 807580 - DNA, 16 bp, Homo sapiens
agacctacaggctgac

SEQ ID NO: 807581 - DNA, 20 bp, Homo sapiens
agacctacattccctctcct

SEQ ID NO: 807582 - DNA, 21 bp, Homo sapiens
agacctacattccctctcctg

SEQ ID NO: 807583 - DNA, 16 bp, Homo sapiens
agacctagctatgttg

SEQ ID NO: 807584 - DNA, 15 bp, Homo sapiens
agacctagggaggac

SEQ ID NO: 807585 - DNA, 21 bp, Homo sapiens
agacctagtcccctttcctct

SEQ ID NO: 807586 - DNA, 13 bp, Homo sapiens
agacctatactga

SEQ ID NO: 807587 - DNA, 17 bp, Homo sapiens
agacctatactgaaaga

SEQ ID NO: 807588 - DNA, 23 bp, Homo sapiens
agacctatactgaaagatctctg

SEQ ID NO: 807589 - DNA, 16 bp, Homo sapiens
agacctatttgacata

SEQ ID NO: 807590 - DNA, 18 bp, Homo sapiens
agacctcagccatgagga

SEQ ID NO: 807591 - DNA, 13 bp, Homo sapiens
agacctcagcctg

SEQ ID NO: 807592 - DNA, 17 bp, Homo sapiens
agacctcagcctgtgct

SEQ ID NO: 807593 - DNA, 19 bp, Homo sapiens
agacctcagcctgtgctgc

SEQ ID NO: 807594 - DNA, 22 bp, Homo sapiens
agacctcatcaggatgaaccca

SEQ ID NO: 807595 - DNA, 16 bp, Homo sapiens
agacctccaataaagt

SEQ ID NO: 807596 - DNA, 21 bp, Homo sapiens
agacctccaataaagtgcctt

SEQ ID NO: 807597 - DNA, 17 bp, Homo sapiens
agacctccccctcactt

SEQ ID NO: 807598 - DNA, 17 bp, Homo sapiens
agacctgacaagcactg

SEQ ID NO: 807599 - DNA, 19 bp, Homo sapiens
agacctgacaccgtccctc

SEQ ID NO: 807600 - DNA, 20 bp, Homo sapiens
agacctgacaccgtccctca

SEQ ID NO: 807601 - DNA, 14 bp, Homo sapiens
agacctgaggcaga

SEQ ID NO: 807602 - DNA, 14 bp, Homo sapiens
agacctgagtattt

SEQ ID NO: 807603 - DNA, 12 bp, Homo sapiens
agacctgctctg

SEQ ID NO: 807604 - DNA, 18 bp, Homo sapiens
agacctggcctttcactt

SEQ ID NO: 807605 - DNA, 18 bp, Homo sapiens
agacctgggatttgagat

SEQ ID NO: 807606 - DNA, 18 bp, Homo sapiens
agacctggtgtgcggagg

SEQ ID NO: 807607 - DNA, 19 bp, Homo sapiens
agacctggtgtgcggaggc

SEQ ID NO: 807608 - DNA, 15 bp, Homo sapiens
agacctgtcaccctg

SEQ ID NO: 807609 - DNA, 12 bp, Homo sapiens
agacctgtgcta

SEQ ID NO: 807610 - DNA, 19 bp, Homo sapiens
agacctgttagcagacagg

SEQ ID NO: 807611 - DNA, 21 bp, Homo sapiens
agaccttaagacactgtgaga

SEQ ID NO: 807612 - DNA, 20 bp, Homo sapiens
agaccttctagtgagcctgg

SEQ ID NO: 807613 - DNA, 21 bp, Homo sapiens
agaccttctagtgagcctggg

SEQ ID NO: 807614 - DNA, 13 bp, Homo sapiens
agacctttactga

SEQ ID NO: 807615 - DNA, 23 bp, Homo sapiens
agacctttgatgaattcttcctc

SEQ ID NO: 807616 - DNA, 17 bp, Homo sapiens
agaccttttcaacttgg

SEQ ID NO: 807617 - DNA, 22 bp, Homo sapiens
agaccttttggcccaatctctg

SEQ ID NO: 807618 - DNA, 14 bp, Homo sapiens
agaccttttttagg

SEQ ID NO: 807619 - DNA, 21 bp, Homo sapiens
agacgacacctggagactgtc

SEQ ID NO: 807620 - DNA, 14 bp, Homo sapiens
agacgagatcctgt

SEQ ID NO: 807621 - DNA, 24 bp, Homo sapiens
agacgagcatccccctcctctccc

SEQ ID NO: 807622 - DNA, 19 bp, Homo sapiens
agacgagctgtctgctgcc

SEQ ID NO: 807623 - DNA, 20 bp, Homo sapiens
agacgcacacagctgagcac

SEQ ID NO: 807624 - DNA, 19 bp, Homo sapiens
agacgcatagactgaggta

SEQ ID NO: 807625 - DNA, 13 bp, Homo sapiens
agacgcccctccc

SEQ ID NO: 807626 - DNA, 14 bp, Homo sapiens
agacgcccctccca

SEQ ID NO: 807627 - DNA, 20 bp, Homo sapiens
agacgccttccaggtcagga

SEQ ID NO: 807628 - DNA, 13 bp, Homo sapiens
agacgctcttttc

SEQ ID NO: 807629 - DNA, 22 bp, Homo sapiens
agacggagtttcgctcttggtg

SEQ ID NO: 807630 - DNA, 22 bp, Homo sapiens
agacggccggccggacctctga

SEQ ID NO: 807631 - DNA, 17 bp, Homo sapiens
agacggggtctccctgt

SEQ ID NO: 807632 - DNA, 21 bp, Homo sapiens
agacggggtttcaccatgttg

SEQ ID NO: 807633 - DNA, 15 bp, Homo sapiens
agacggtgttgggag

SEQ ID NO: 807634 - DNA, 17 bp, Homo sapiens
agacgtggactcctctt

SEQ ID NO: 807635 - DNA, 16 bp, Homo sapiens
agacgtggtgggactc

SEQ ID NO: 807636 - DNA, 15 bp, Homo sapiens
agacgttgcctgaga

SEQ ID NO: 807637 - DNA, 16 bp, Homo sapiens
agactaaaagttgcat

SEQ ID NO: 807638 - DNA, 13 bp, Homo sapiens
agactaaatgaaa

SEQ ID NO: 807639 - DNA, 13 bp, Homo sapiens
agactaagaaata

SEQ ID NO: 807640 - DNA, 22 bp, Homo sapiens
agactaattaaaatctggaaat

SEQ ID NO: 807641 - DNA, 16 bp, Homo sapiens
agactacacaggatga

SEQ ID NO: 807642 - DNA, 19 bp, Homo sapiens
agactagaattctagtgct

SEQ ID NO: 807643 - DNA, 20 bp, Homo sapiens
agactagaattctagtgctg

SEQ ID NO: 807644 - DNA, 22 bp, Homo sapiens
agactagaattctagtgctgct

SEQ ID NO: 807645 - DNA, 12 bp, Homo sapiens
agactagatgta

SEQ ID NO: 807646 - DNA, 19 bp, Homo sapiens
agactagatgtagtatttt

SEQ ID NO: 807647 - DNA, 16 bp, Homo sapiens
agactagattgccttt

SEQ ID NO: 807648 - DNA, 13 bp, Homo sapiens
agactagttctct

SEQ ID NO: 807649 - DNA, 19 bp, Homo sapiens
agactataaagcagtagac

SEQ ID NO: 807650 - DNA, 18 bp, Homo sapiens
agactatctaaatgttga

SEQ ID NO: 807651 - DNA, 20 bp, Homo sapiens
agactatcttactatttcac

SEQ ID NO: 807652 - DNA, 13 bp, Homo sapiens
agactatggcctc

SEQ ID NO: 807653 - DNA, 14 bp, Homo sapiens
agactatggcctcg

SEQ ID NO: 807654 - DNA, 13 bp, Homo sapiens
agactatttcaaa

SEQ ID NO: 807655 - DNA, 19 bp, Homo sapiens
agactatttcaaaatgtcc

SEQ ID NO: 807656 - DNA, 14 bp, Homo sapiens
agactatttgctta

SEQ ID NO: 807657 - DNA, 13 bp, Homo sapiens
agactattttcta

SEQ ID NO: 807658 - DNA, 14 bp, Homo sapiens
agactatttttaga

SEQ ID NO: 807659 - DNA, 22 bp, Homo sapiens
agactcaaaacctggagatgca

SEQ ID NO: 807660 - DNA, 17 bp, Homo sapiens
agactcaagcctcccca

SEQ ID NO: 807661 - DNA, 15 bp, Homo sapiens
agactcaaggggctg

SEQ ID NO: 807662 - DNA, 17 bp, Homo sapiens
agactcaaggggctgga

SEQ ID NO: 807663 - DNA, 22 bp, Homo sapiens
agactcaaggtggtcagtaaat

SEQ ID NO: 807664 - DNA, 15 bp, Homo sapiens
agactcacaggaagg

SEQ ID NO: 807665 - DNA, 16 bp, Homo sapiens
agactcacctctgcct

SEQ ID NO: 807666 - DNA, 17 bp, Homo sapiens
agactcacctctgcctc

SEQ ID NO: 807667 - DNA, 18 bp, Homo sapiens
agactcacttgccattgc

SEQ ID NO: 807668 - DNA, 22 bp, Homo sapiens
agactcacttgccattgccagg

SEQ ID NO: 807669 - DNA, 15 bp, Homo sapiens
agactcagactccat

SEQ ID NO: 807670 - DNA, 18 bp, Homo sapiens
agactcagctctgacatt

SEQ ID NO: 807671 - DNA, 19 bp, Homo sapiens
agactcaggagtctgccac

SEQ ID NO: 807672 - DNA, 23 bp, Homo sapiens
agactcaggccaagaaacgtctt

SEQ ID NO: 807673 - DNA, 17 bp, Homo sapiens
agactcagggccccagc

SEQ ID NO: 807674 - DNA, 13 bp, Homo sapiens
agactcaggttcc

SEQ ID NO: 807675 - DNA, 23 bp, Homo sapiens
agactcaggttgtagtaaagaaa

SEQ ID NO: 807676 - DNA, 12 bp, Homo sapiens
agactcagtgtt

SEQ ID NO: 807677 - DNA, 21 bp, Homo sapiens
agactcagtttgtcagacttt

SEQ ID NO: 807678 - DNA, 17 bp, Homo sapiens
agactcatcttactgta

SEQ ID NO: 807679 - DNA, 18 bp, Homo sapiens
agactcatcttactgtac

SEQ ID NO: 807680 - DNA, 19 bp, Homo sapiens
agactccaaggagctactg

SEQ ID NO: 807681 - DNA, 14 bp, Homo sapiens
agactccacctcaa

SEQ ID NO: 807682 - DNA, 18 bp, Homo sapiens
agactccagcccctggac

SEQ ID NO: 807683 - DNA, 14 bp, Homo sapiens
agactccatagttt

SEQ ID NO: 807684 - DNA, 21 bp, Homo sapiens
agactcccgccccgggctggc

SEQ ID NO: 807685 - DNA, 22 bp, Homo sapiens
agactcccgccccgggctggcc

SEQ ID NO: 807686 - DNA, 24 bp, Homo sapiens
agactcccgccccgggctggccct

SEQ ID NO: 807687 - DNA, 14 bp, Homo sapiens
agactccggcctgt

SEQ ID NO: 807688 - DNA, 15 bp, Homo sapiens
agactccggcctgta

SEQ ID NO: 807689 - DNA, 19 bp, Homo sapiens
agactccggcctgtaatca

SEQ ID NO: 807690 - DNA, 21 bp, Homo sapiens
agactcctcctgggggctggc

SEQ ID NO: 807691 - DNA, 12 bp, Homo sapiens
agactcctctgg

SEQ ID NO: 807692 - DNA, 15 bp, Homo sapiens
agactcctgaggaca

SEQ ID NO: 807693 - DNA, 20 bp, Homo sapiens
agactcctgaggacagctgt

SEQ ID NO: 807694 - DNA, 14 bp, Homo sapiens
agactcctgccctg

SEQ ID NO: 807695 - DNA, 15 bp, Homo sapiens
agactcctgccctgt

SEQ ID NO: 807696 - DNA, 17 bp, Homo sapiens
agactccttctccccaa

SEQ ID NO: 807697 - DNA, 13 bp, Homo sapiens
agactcggacttg

SEQ ID NO: 807698 - DNA, 13 bp, Homo sapiens
agactctagaaaa

SEQ ID NO: 807699 - DNA, 22 bp, Homo sapiens
agactctagaaaaaagggctga

SEQ ID NO: 807700 - DNA, 18 bp, Homo sapiens
agactctagacaagatat

SEQ ID NO: 807701 - DNA, 21 bp, Homo sapiens
agagcaaaggagacaaagcag

SEQ ID NO: 807702 - DNA, 23 bp, Homo sapiens
agagcaaaggagacaaagcagga

SEQ ID NO: 807703 - DNA, 19 bp, Homo sapiens
agagcaaaggcccatgccc

SEQ ID NO: 807704 - DNA, 18 bp, Homo sapiens
agagcaaagggaaatcaa

SEQ ID NO: 807705 - DNA, 21 bp, Homo sapiens
agagcaacccctgtacccagc

SEQ ID NO: 807706 - DNA, 22 bp, Homo sapiens
agagcaatgcttttaatgaatt

SEQ ID NO: 807707 - DNA, 14 bp, Homo sapiens
agagcacaaacttc

SEQ ID NO: 807708 - DNA, 19 bp, Homo sapiens
agagcacacttatttatga

SEQ ID NO: 807709 - DNA, 22 bp, Homo sapiens
agagcacagagccctgaggggc

SEQ ID NO: 807710 - DNA, 12 bp, Homo sapiens
agagcacccact

SEQ ID NO: 807711 - DNA, 22 bp, Homo sapiens
agagcaccccctgctccaccag

SEQ ID NO: 807712 - DNA, 16 bp, Homo sapiens
agagcacccctctctg

SEQ ID NO: 807713 - DNA, 17 bp, Homo sapiens
agagcacccctctctgc

SEQ ID NO: 807714 - DNA, 17 bp, Homo sapiens
agagcaccctcgagaag

SEQ ID NO: 807715 - DNA, 20 bp, Homo sapiens
agagcaccctcgagaagggt

SEQ ID NO: 807716 - DNA, 23 bp, Homo sapiens
agagcaccctcgagaagggtgga

SEQ ID NO: 807717 - DNA, 14 bp, Homo sapiens
agagcaccttcctc

SEQ ID NO: 807718 - DNA, 14 bp, Homo sapiens
agagcacgcctgcc

SEQ ID NO: 807719 - DNA, 13 bp, Homo sapiens
agagcactcccta

SEQ ID NO: 807720 - DNA, 13 bp, Homo sapiens
agagcactctcac

SEQ ID NO: 807721 - DNA, 15 bp, Homo sapiens
agagcactctcaccc

SEQ ID NO: 807722 - DNA, 17 bp, Homo sapiens
agagcactctcacccca

SEQ ID NO: 807723 - DNA, 14 bp, Homo sapiens
agagcactgcctct

SEQ ID NO: 807724 - DNA, 17 bp, Homo sapiens
agagcactgcctctatg

SEQ ID NO: 807725 - DNA, 19 bp, Homo sapiens
agagcactgcctctatgcc

SEQ ID NO: 807726 - DNA, 22 bp, Homo sapiens
agagcactgcctctatgccctg

SEQ ID NO: 807727 - DNA, 21 bp, Homo sapiens
agagcactgggttgcagggga

SEQ ID NO: 807728 - DNA, 15 bp, Homo sapiens
agagcacttaagaga

SEQ ID NO: 807729 - DNA, 19 bp, Homo sapiens
agagcacttaagagaatat

SEQ ID NO: 807730 - DNA, 21 bp, Homo sapiens
agagcacttaagagaatattt

SEQ ID NO: 807731 - DNA, 20 bp, Homo sapiens
agagcagaacagatctttta

SEQ ID NO: 807732 - DNA, 14 bp, Homo sapiens
agagcagagagcag

SEQ ID NO: 807733 - DNA, 18 bp, Homo sapiens
agagcagagcaaatgagg

SEQ ID NO: 807734 - DNA, 14 bp, Homo sapiens
agagcagaggcagc

SEQ ID NO: 807735 - DNA, 14 bp, Homo sapiens
agagcagagtctgg

SEQ ID NO: 807736 - DNA, 13 bp, Homo sapiens
agagcagcactcc

SEQ ID NO: 807737 - DNA, 12 bp, Homo sapiens
agagcagcagca

SEQ ID NO: 807738 - DNA, 14 bp, Homo sapiens
agagcagcaggtgc

SEQ ID NO: 807739 - DNA, 17 bp, Homo sapiens
agagcagcctcgtggag

SEQ ID NO: 807740 - DNA, 16 bp, Homo sapiens
agagcagcctgatggc

SEQ ID NO: 807741 - DNA, 12 bp, Homo sapiens
agagcagcctgt

SEQ ID NO: 807742 - DNA, 17 bp, Homo sapiens
agagcagcctgtggcat

SEQ ID NO: 807743 - DNA, 19 bp, Homo sapiens
agagcagcctgtggcatct

SEQ ID NO: 807744 - DNA, 14 bp, Homo sapiens
agagcagcgcccag

SEQ ID NO: 807745 - DNA, 16 bp, Homo sapiens
agagcagcgcccaggc

SEQ ID NO: 807746 - DNA, 19 bp, Homo sapiens
agagcagcgcccaggcctg

SEQ ID NO: 807747 - DNA, 22 bp, Homo sapiens
agagcagcgcccaggcctgctg

SEQ ID NO: 807748 - DNA, 22 bp, Homo sapiens
agagcagctccctttctcagga

SEQ ID NO: 807749 - DNA, 13 bp, Homo sapiens
agagcagctggct

SEQ ID NO: 807750 - DNA, 18 bp, Homo sapiens
agagcagctttaaactca

SEQ ID NO: 807751 - DNA, 18 bp, Homo sapiens
agagcaggaagcattcag

SEQ ID NO: 807752 - DNA, 13 bp, Homo sapiens
agagcaggacctc

SEQ ID NO: 807753 - DNA, 15 bp, Homo sapiens
agagcaggactccag

SEQ ID NO: 807754 - DNA, 17 bp, Homo sapiens
agagcaggactccaggc

SEQ ID NO: 807755 - DNA, 13 bp, Homo sapiens
agagcaggagccc

SEQ ID NO: 807756 - DNA, 15 bp, Homo sapiens
agagcaggaggcccc

SEQ ID NO: 807757 - DNA, 23 bp, Homo sapiens
agagcaggaggcccctggcccag

SEQ ID NO: 807758 - DNA, 18 bp, Homo sapiens
agagcaggcacatggagg

SEQ ID NO: 807759 - DNA, 20 bp, Homo sapiens
agagcaggcacatggaggag

SEQ ID NO: 807760 - DNA, 17 bp, Homo sapiens
agagcaggctcagactc

SEQ ID NO: 807761 - DNA, 20 bp, Homo sapiens
agagcaggctcagactctgg

SEQ ID NO: 807762 - DNA, 24 bp, Homo sapiens
agagcagggattaacctctgcact

SEQ ID NO: 807763 - DNA, 15 bp, Homo sapiens
agagcaggggctcca

SEQ ID NO: 807764 - DNA, 23 bp, Homo sapiens
agagcaggtgactgtgctgtgca

SEQ ID NO: 807765 - DNA, 19 bp, Homo sapiens
agagcagtcagagtccagt

SEQ ID NO: 807766 - DNA, 15 bp, Homo sapiens
agagcagtgggcagg

SEQ ID NO: 807767 - DNA, 18 bp, Homo sapiens
agagcagtgggcaggtgg

SEQ ID NO: 807768 - DNA, 20 bp, Homo sapiens
agagcatcgtgacccttcag

SEQ ID NO: 807769 - DNA, 19 bp, Homo sapiens
agagcatctgcaacaaaaa

SEQ ID NO: 807770 - DNA, 14 bp, Homo sapiens
agagcatgcacatg

SEQ ID NO: 807771 - DNA, 21 bp, Homo sapiens
agagcatgtgtcagagtgttg

SEQ ID NO: 807772 - DNA, 21 bp, Homo sapiens
agagcattacgtgagccaggt

SEQ ID NO: 807773 - DNA, 22 bp, Homo sapiens
agagcattacgtgagccaggta

SEQ ID NO: 807774 - DNA, 15 bp, Homo sapiens
agagcattagctggc

SEQ ID NO: 807775 - DNA, 24 bp, Homo sapiens
agagccaaattcatcctcttacca

SEQ ID NO: 807776 - DNA, 13 bp, Homo sapiens
agagccaagctgc

SEQ ID NO: 807777 - DNA, 16 bp, Homo sapiens
agagccaagctgcaca

SEQ ID NO: 807778 - DNA, 15 bp, Homo sapiens
agagccaaggccacc

SEQ ID NO: 807779 - DNA, 13 bp, Homo sapiens
agagccaagtcct

SEQ ID NO: 807780 - DNA, 15 bp, Homo sapiens
agagccaccaagagg

SEQ ID NO: 807781 - DNA, 12 bp, Homo sapiens
agagccacctgc

SEQ ID NO: 807782 - DNA, 17 bp, Homo sapiens
agagccacctgcaagat

SEQ ID NO: 807783 - DNA, 16 bp, Homo sapiens
agagccactgggcccc

SEQ ID NO: 807784 - DNA, 20 bp, Homo sapiens
agagccactgggcccctgtc

SEQ ID NO: 807785 - DNA, 18 bp, Homo sapiens
agagccagaaagggtgcc

SEQ ID NO: 807786 - DNA, 12 bp, Homo sapiens
agagccagccct

SEQ ID NO: 807787 - DNA, 14 bp, Homo sapiens
agagccagccctcc

SEQ ID NO: 807788 - DNA, 20 bp, Homo sapiens
agagccagccctccctgtcc

SEQ ID NO: 807789 - DNA, 22 bp, Homo sapiens
agagccagccctccctgtcctc

SEQ ID NO: 807790 - DNA, 17 bp, Homo sapiens
agagccagcctggctct

SEQ ID NO: 807791 - DNA, 20 bp, Homo sapiens
agagccagcctggctctgcc

SEQ ID NO: 807792 - DNA, 21 bp, Homo sapiens
agagccagcctggctctgccc

SEQ ID NO: 807793 - DNA, 13 bp, Homo sapiens
agagccagctccc

SEQ ID NO: 807794 - DNA, 12 bp, Homo sapiens
agagccagcttg

SEQ ID NO: 807795 - DNA, 16 bp, Homo sapiens
agagccaggagaagct

SEQ ID NO: 807796 - DNA, 15 bp, Homo sapiens
agagccaggatgccc

SEQ ID NO: 807797 - DNA, 12 bp, Homo sapiens
agagccagggct

SEQ ID NO: 807798 - DNA, 13 bp, Homo sapiens
agagccaggtgct

SEQ ID NO: 807799 - DNA, 20 bp, Homo sapiens
agagccatacataaaagaaa

SEQ ID NO: 807800 - DNA, 13 bp, Homo sapiens
agagccatgaagc

SEQ ID NO: 807801 - DNA, 14 bp, Homo sapiens
agagccatgccagg

SEQ ID NO: 807802 - DNA, 19 bp, Homo sapiens
agagccatggactctacac

SEQ ID NO: 807803 - DNA, 20 bp, Homo sapiens
agagccatgggcctgggcct

SEQ ID NO: 807804 - DNA, 22 bp, Homo sapiens
agagccatgggcctgggcctgc

SEQ ID NO: 807805 - DNA, 17 bp, Homo sapiens
agagcccaccagccagc

SEQ ID NO: 807806 - DNA, 18 bp, Homo sapiens
agagcccaccagccagcc

SEQ ID NO: 807807 - DNA, 13 bp, Homo sapiens
agagcccagctct

SEQ ID NO: 807808 - DNA, 15 bp, Homo sapiens
agagcccagctcttg

SEQ ID NO: 807809 - DNA, 19 bp, Homo sapiens
agagcccagctcttgctct

SEQ ID NO: 807810 - DNA, 20 bp, Homo sapiens
agagcccagctcttgctctc

SEQ ID NO: 807811 - DNA, 13 bp, Homo sapiens
agagccccactcc

SEQ ID NO: 807812 - DNA, 14 bp, Homo sapiens
agagccccactccc

SEQ ID NO: 807813 - DNA, 15 bp, Homo sapiens
agagccccagctgac

SEQ ID NO: 807814 - DNA, 14 bp, Homo sapiens
agagcccccaccag

SEQ ID NO: 807815 - DNA, 20 bp, Homo sapiens
agagcccctcctccagcccc

SEQ ID NO: 807816 - DNA, 22 bp, Homo sapiens
agagcccctcctccagcccctg

SEQ ID NO: 807817 - DNA, 15 bp, Homo sapiens
agagcccgccgtctg

SEQ ID NO: 807818 - DNA, 21 bp, Homo sapiens
agagcccgccgtctgcagggg

SEQ ID NO: 807819 - DNA, 23 bp, Homo sapiens
agagcccgccgtctgcaggggcc

SEQ ID NO: 807820 - DNA, 24 bp, Homo sapiens
agagcccgccgtctgcaggggcct

SEQ ID NO: 807821 - DNA, 19 bp, Homo sapiens
agagccctctgagccgcca

SEQ ID NO: 807822 - DNA, 14 bp, Homo sapiens
agagccctgaggcc

SEQ ID NO: 807823 - DNA, 17 bp, Homo sapiens
agaggttttaatgtctg

SEQ ID NO: 807824 - DNA, 18 bp, Homo sapiens
agaggttttaatgtctgt

SEQ ID NO: 807825 - DNA, 14 bp, Homo sapiens
agaggttttgtatt

SEQ ID NO: 807826 - DNA, 16 bp, Homo sapiens
agaggttttgttgttt

SEQ ID NO: 807827 - DNA, 19 bp, Homo sapiens
agaggttttgttgttttat

SEQ ID NO: 807828 - DNA, 15 bp, Homo sapiens
agagtaaaaactgaa

SEQ ID NO: 807829 - DNA, 18 bp, Homo sapiens
agagtaatgggtttcata

SEQ ID NO: 807830 - DNA, 17 bp, Homo sapiens
agagtacagactgcaga

SEQ ID NO: 807831 - DNA, 19 bp, Homo sapiens
agagtacagactgcagaca

SEQ ID NO: 807832 - DNA, 16 bp, Homo sapiens
agagtagagccaggtg

SEQ ID NO: 807833 - DNA, 21 bp, Homo sapiens
agagtagatggtgaaatttat

SEQ ID NO: 807834 - DNA, 22 bp, Homo sapiens
agagtagatggtgaaatttatt

SEQ ID NO: 807835 - DNA, 12 bp, Homo sapiens
agagtagcaagt

SEQ ID NO: 807836 - DNA, 23 bp, Homo sapiens
agagtagcaagttctagagaaga

SEQ ID NO: 807837 - DNA, 18 bp, Homo sapiens
agagtagccgagagcctg

SEQ ID NO: 807838 - DNA, 18 bp, Homo sapiens
agagtagggtagaaggaa

SEQ ID NO: 807839 - DNA, 14 bp, Homo sapiens
agagtagttatata

SEQ ID NO: 807840 - DNA, 12 bp, Homo sapiens
agagtataaata

SEQ ID NO: 807841 - DNA, 14 bp, Homo sapiens
agagtataaataac

SEQ ID NO: 807842 - DNA, 23 bp, Homo sapiens
agagtatatttttgtctgcagct

SEQ ID NO: 807843 - DNA, 24 bp, Homo sapiens
agagtatatttttgtctgcagctg

SEQ ID NO: 807844 - DNA, 14 bp, Homo sapiens
agagtatgaacacc

SEQ ID NO: 807845 - DNA, 18 bp, Homo sapiens
agagtatgtagtggcttc

SEQ ID NO: 807846 - DNA, 14 bp, Homo sapiens
agagtatttccctt

SEQ ID NO: 807847 - DNA, 13 bp, Homo sapiens
agagtcagaggag

SEQ ID NO: 807848 - DNA, 16 bp, Homo sapiens
agagtcagaggagaag

SEQ ID NO: 807849 - DNA, 20 bp, Homo sapiens
agagtcagctctctgccctg

SEQ ID NO: 807850 - DNA, 13 bp, Homo sapiens
agagtcatctcca

SEQ ID NO: 807851 - DNA, 18 bp, Homo sapiens
agagtccactgtggcact

SEQ ID NO: 807852 - DNA, 22 bp, Homo sapiens
agagtccagtgctctgcctcag

SEQ ID NO: 807853 - DNA, 17 bp, Homo sapiens
agagtccatttcccaca

SEQ ID NO: 807854 - DNA, 14 bp, Homo sapiens
agagtccgccagtg

SEQ ID NO: 807855 - DNA, 14 bp, Homo sapiens
agagtcctctgaat

SEQ ID NO: 807856 - DNA, 14 bp, Homo sapiens
agagtcctgcacag

SEQ ID NO: 807857 - DNA, 21 bp, Homo sapiens
agagtcctgcacagttttctg

SEQ ID NO: 807858 - DNA, 17 bp, Homo sapiens
agagtctctcttcactt

SEQ ID NO: 807859 - DNA, 18 bp, Homo sapiens
agagtctgaaagacagaa

SEQ ID NO: 807860 - DNA, 12 bp, Homo sapiens
agagtctgaaca

SEQ ID NO: 807861 - DNA, 16 bp, Homo sapiens
agagtctgaacagctg

SEQ ID NO: 807862 - DNA, 14 bp, Homo sapiens
agagtctgagcccc

SEQ ID NO: 807863 - DNA, 13 bp, Homo sapiens
agagtctgggacc

SEQ ID NO: 807864 - DNA, 14 bp, Homo sapiens
agagtctgtctctt

SEQ ID NO: 807865 - DNA, 16 bp, Homo sapiens
agagtgaaaaagagaa

SEQ ID NO: 807866 - DNA, 17 bp, Homo sapiens
agagtgaaagggctatg

SEQ ID NO: 807867 - DNA, 15 bp, Homo sapiens
agagtgaagaatctt

SEQ ID NO: 807868 - DNA, 22 bp, Homo sapiens
agagtgaagggaagagacagcc

SEQ ID NO: 807869 - DNA, 17 bp, Homo sapiens
agagtgacttattttgt

SEQ ID NO: 807870 - DNA, 13 bp, Homo sapiens
agagtgagagaca

SEQ ID NO: 807871 - DNA, 14 bp, Homo sapiens
agagtgagagggca

SEQ ID NO: 807872 - DNA, 17 bp, Homo sapiens
agagtgataatacaagt

SEQ ID NO: 807873 - DNA, 18 bp, Homo sapiens
agagtgattgcagcttta

SEQ ID NO: 807874 - DNA, 22 bp, Homo sapiens
agagtgcagggattacaggcgt

SEQ ID NO: 807875 - DNA, 12 bp, Homo sapiens
agagtgcccagc

SEQ ID NO: 807876 - DNA, 19 bp, Homo sapiens
agagtgctctgaccctggg

SEQ ID NO: 807877 - DNA, 20 bp, Homo sapiens
agagtgctgtcgggaccaca

SEQ ID NO: 807878 - DNA, 15 bp, Homo sapiens
agagtggactgcatt

SEQ ID NO: 807879 - DNA, 15 bp, Homo sapiens
agagtggaggaggag

SEQ ID NO: 807880 - DNA, 18 bp, Homo sapiens
agagtggagtctgagtct

SEQ ID NO: 807881 - DNA, 20 bp, Homo sapiens
agagtggcaggtgggctgcc

SEQ ID NO: 807882 - DNA, 13 bp, Homo sapiens
agagtggcccctc

SEQ ID NO: 807883 - DNA, 24 bp, Homo sapiens
agagtggcccctcacctgggcctt

SEQ ID NO: 807884 - DNA, 17 bp, Homo sapiens
agagtggcctccctgct

SEQ ID NO: 807885 - DNA, 18 bp, Homo sapiens
agagtggcctccctgctg

SEQ ID NO: 807886 - DNA, 13 bp, Homo sapiens
agagtggcctggc

SEQ ID NO: 807887 - DNA, 15 bp, Homo sapiens
agagtggcgtgagct

SEQ ID NO: 807888 - DNA, 12 bp, Homo sapiens
agagtggctcac

SEQ ID NO: 807889 - DNA, 15 bp, Homo sapiens
agagtggctcactgg

SEQ ID NO: 807890 - DNA, 15 bp, Homo sapiens
agagtggctcctccc

SEQ ID NO: 807891 - DNA, 19 bp, Homo sapiens
agagtgggagaggctggga

SEQ ID NO: 807892 - DNA, 22 bp, Homo sapiens
agagtgggagaggctgggaggt

SEQ ID NO: 807893 - DNA, 11 bp, Homo sapiens
agagtgggagc

SEQ ID NO: 807894 - DNA, 13 bp, Homo sapiens
agagtggggagag

SEQ ID NO: 807895 - DNA, 12 bp, Homo sapiens
agagtggtgagt

SEQ ID NO: 807896 - DNA, 18 bp, Homo sapiens
agagtggtgagtggaagg

SEQ ID NO: 807897 - DNA, 23 bp, Homo sapiens
agagtggtgagtggaagggagga

SEQ ID NO: 807898 - DNA, 15 bp, Homo sapiens
agagtggttattcat

SEQ ID NO: 807899 - DNA, 16 bp, Homo sapiens
agagtggttgttgcca

SEQ ID NO: 807900 - DNA, 19 bp, Homo sapiens
agagtggttgttgccaact

SEQ ID NO: 807901 - DNA, 17 bp, Homo sapiens
agagtgtacatcatgtt

SEQ ID NO: 807902 - DNA, 13 bp, Homo sapiens
agagtgtagccta

SEQ ID NO: 807903 - DNA, 22 bp, Homo sapiens
agagtgtagcctaaagggcagg

SEQ ID NO: 807904 - DNA, 12 bp, Homo sapiens
agagtgtagctg

SEQ ID NO: 807905 - DNA, 20 bp, Homo sapiens
agagtgtagctgtaagggca

SEQ ID NO: 807906 - DNA, 21 bp, Homo sapiens
agagtgtagctgtaagggcag

SEQ ID NO: 807907 - DNA, 23 bp, Homo sapiens
agagtgtagctgtaagggcagtg

SEQ ID NO: 807908 - DNA, 21 bp, Homo sapiens
agagtgtctcagggtgcagag

SEQ ID NO: 807909 - DNA, 19 bp, Homo sapiens
agagtgtgaaatagacatt

SEQ ID NO: 807910 - DNA, 23 bp, Homo sapiens
agagtgtgagagagactgatggg

SEQ ID NO: 807911 - DNA, 12 bp, Homo sapiens
agagtgtgagca

SEQ ID NO: 807912 - DNA, 19 bp, Homo sapiens
agagtgtgagcagggcttg

SEQ ID NO: 807913 - DNA, 19 bp, Homo sapiens
agagtgtgggaagggagag

SEQ ID NO: 807914 - DNA, 20 bp, Homo sapiens
agagtgtgggaagggagagc

SEQ ID NO: 807915 - DNA, 20 bp, Homo sapiens
agagtgttgttgctgaccag

SEQ ID NO: 807916 - DNA, 14 bp, Homo sapiens
agagttaagaatgt

SEQ ID NO: 807917 - DNA, 20 bp, Homo sapiens
agagttatcttctttattat

SEQ ID NO: 807918 - DNA, 23 bp, Homo sapiens
agagttatcttctttattattcc

SEQ ID NO: 807919 - DNA, 19 bp, Homo sapiens
agagttattgaatcttaat

SEQ ID NO: 807920 - DNA, 21 bp, Homo sapiens
agagttcaagaaataagtttt

SEQ ID NO: 807921 - DNA, 16 bp, Homo sapiens
agagttcaagcctgtg

SEQ ID NO: 807922 - DNA, 12 bp, Homo sapiens
agagttccttct

SEQ ID NO: 807923 - DNA, 16 bp, Homo sapiens
agagttccttctcact

SEQ ID NO: 807924 - DNA, 17 bp, Homo sapiens
agagttccttctcactt

SEQ ID NO: 807925 - DNA, 22 bp, Homo sapiens
agagttcggtctgacagtcctt

SEQ ID NO: 807926 - DNA, 15 bp, Homo sapiens
agagttctgtgaaga

SEQ ID NO: 807927 - DNA, 16 bp, Homo sapiens
agagttcttctttctt

SEQ ID NO: 807928 - DNA, 18 bp, Homo sapiens
agagttctttgctgcccc

SEQ ID NO: 807929 - DNA, 22 bp, Homo sapiens
agagttctttgctgcccctgtc

SEQ ID NO: 807930 - DNA, 23 bp, Homo sapiens
agagttctttgctgcccctgtct

SEQ ID NO: 807931 - DNA, 17 bp, Homo sapiens
agagttgatactacagt

SEQ ID NO: 807932 - DNA, 16 bp, Homo sapiens
agagttgcaacttaag

SEQ ID NO: 807933 - DNA, 17 bp, Homo sapiens
agagttgctttaaagta

SEQ ID NO: 807934 - DNA, 16 bp, Homo sapiens
agagttggagttttat

SEQ ID NO: 807935 - DNA, 15 bp, Homo sapiens
agagttggctcaggc

SEQ ID NO: 807936 - DNA, 17 bp, Homo sapiens
agagttggctcaggcag

SEQ ID NO: 807937 - DNA, 19 bp, Homo sapiens
agagttgggacaattgctt

SEQ ID NO: 807938 - DNA, 16 bp, Homo sapiens
agagttggggaaggca

SEQ ID NO: 807939 - DNA, 12 bp, Homo sapiens
agagttgttaca

SEQ ID NO: 807940 - DNA, 15 bp, Homo sapiens
agagtttagccctga

SEQ ID NO: 807941 - DNA, 18 bp, Homo sapiens
agagtttctgtttgattc

SEQ ID NO: 807942 - DNA, 19 bp, Homo sapiens
agagtttggaattattgta

SEQ ID NO: 807943 - DNA, 22 bp, Homo sapiens
agagtttgttctgttctggggg

SEQ ID NO: 807944 - DNA, 13 bp, Homo sapiens
agagtttttgtta

SEQ ID NO: 807945 - DNA, 17 bp, Homo sapiens
agattctatttaattga

SEQ ID NO: 807946 - DNA, 21 bp, Homo sapiens
agattctatttaattgaaact

SEQ ID NO: 807947 - DNA, 18 bp, Homo sapiens
agattctctttaaaaaag

SEQ ID NO: 807948 - DNA, 15 bp, Homo sapiens
agattctgacattta

SEQ ID NO: 807949 - DNA, 22 bp, Homo sapiens
agattctgacatttatatttgt

SEQ ID NO: 807950 - DNA, 17 bp, Homo sapiens
agattctgattcccttc

SEQ ID NO: 807951 - DNA, 12 bp, Homo sapiens
agattctgcctc

SEQ ID NO: 807952 - DNA, 19 bp, Homo sapiens
agattctgggtttgcccag

SEQ ID NO: 807953 - DNA, 21 bp, Homo sapiens
agattctgggtttgcccagtc

SEQ ID NO: 807954 - DNA, 15 bp, Homo sapiens
agattctgttgcata

SEQ ID NO: 807955 - DNA, 13 bp, Homo sapiens
agattcttaattc

SEQ ID NO: 807956 - DNA, 12 bp, Homo sapiens
agattcttcagc

SEQ ID NO: 807957 - DNA, 12 bp, Homo sapiens
agattctttccc

SEQ ID NO: 807958 - DNA, 22 bp, Homo sapiens
agattcttttaaattagaaaat

SEQ ID NO: 807959 - DNA, 16 bp, Homo sapiens
agattgactaaataaa

SEQ ID NO: 807960 - DNA, 17 bp, Homo sapiens
agattgagaaatgtgta

SEQ ID NO: 807961 - DNA, 16 bp, Homo sapiens
agattgattgtattgt

SEQ ID NO: 807962 - DNA, 20 bp, Homo sapiens
agattgcacagtcaaaacga

SEQ ID NO: 807963 - DNA, 16 bp, Homo sapiens
agattgcaccactgca

SEQ ID NO: 807964 - DNA, 23 bp, Homo sapiens
agattgcaccactgcactccagc

SEQ ID NO: 807965 - DNA, 14 bp, Homo sapiens
agattgctgaaatt

SEQ ID NO: 807966 - DNA, 22 bp, Homo sapiens
agattgctgaaattttatatgc

SEQ ID NO: 807967 - DNA, 22 bp, Homo sapiens
agattgctggaaaccaagtcag

SEQ ID NO: 807968 - DNA, 17 bp, Homo sapiens
agattgcttctgtagta

SEQ ID NO: 807969 - DNA, 17 bp, Homo sapiens
agattggagctgaagac

SEQ ID NO: 807970 - DNA, 17 bp, Homo sapiens
agattggatcaagtatt

SEQ ID NO: 807971 - DNA, 22 bp, Homo sapiens
agattggcacccctttctagtt

SEQ ID NO: 807972 - DNA, 15 bp, Homo sapiens
agattggccagtgag

SEQ ID NO: 807973 - DNA, 14 bp, Homo sapiens
agattgggataagg

SEQ ID NO: 807974 - DNA, 15 bp, Homo sapiens
agattggtgttcgtt

SEQ ID NO: 807975 - DNA, 13 bp, Homo sapiens
agattgtcctttt

SEQ ID NO: 807976 - DNA, 17 bp, Homo sapiens
agattgtccttttctcc

SEQ ID NO: 807977 - DNA, 20 bp, Homo sapiens
agattgtccttttgcaaaga

SEQ ID NO: 807978 - DNA, 22 bp, Homo sapiens
agattgtcttgcaacttcagtt

SEQ ID NO: 807979 - DNA, 16 bp, Homo sapiens
agattgtggaatgttg

SEQ ID NO: 807980 - DNA, 14 bp, Homo sapiens
agattgtggggtgc

SEQ ID NO: 807981 - DNA, 16 bp, Homo sapiens
agattgtggggtgcag

SEQ ID NO: 807982 - DNA, 13 bp, Homo sapiens
agattgtgtaaca

SEQ ID NO: 807983 - DNA, 15 bp, Homo sapiens
agattgtgtaacaat

SEQ ID NO: 807984 - DNA, 14 bp, Homo sapiens
agattgttaaaata

SEQ ID NO: 807985 - DNA, 16 bp, Homo sapiens
agattgttaagggcat

SEQ ID NO: 807986 - DNA, 20 bp, Homo sapiens
agattgttggtgaattttca

SEQ ID NO: 807987 - DNA, 22 bp, Homo sapiens
agattgttgtttgccatacttt

SEQ ID NO: 807988 - DNA, 19 bp, Homo sapiens
agattgtttcctcttccaa

SEQ ID NO: 807989 - DNA, 12 bp, Homo sapiens
agattgtttgca

SEQ ID NO: 807990 - DNA, 23 bp, Homo sapiens
agattgttttatcatgacatgtt

SEQ ID NO: 807991 - DNA, 12 bp, Homo sapiens
agattgttttgc

SEQ ID NO: 807992 - DNA, 22 bp, Homo sapiens
agatttaagtgaatacattaac

SEQ ID NO: 807993 - DNA, 11 bp, Homo sapiens
agatttacatt

SEQ ID NO: 807994 - DNA, 22 bp, Homo sapiens
agatttactgctctagaaagta

SEQ ID NO: 807995 - DNA, 19 bp, Homo sapiens
agatttagttttgtaactt

SEQ ID NO: 807996 - DNA, 18 bp, Homo sapiens
agatttatctttatacag

SEQ ID NO: 807997 - DNA, 15 bp, Homo sapiens
agatttattttacat

SEQ ID NO: 807998 - DNA, 21 bp, Homo sapiens
agatttatttttcagttccaa

SEQ ID NO: 807999 - DNA, 12 bp, Homo sapiens
agatttcaagat

SEQ ID NO: 808000 - DNA, 15 bp, Homo sapiens
agatttcagtaatgt

SEQ ID NO: 808001 - DNA, 22 bp, Homo sapiens
agatttcagtaatgtcttcagt

SEQ ID NO: 808002 - DNA, 20 bp, Homo sapiens
agatttcatagttcagaatt

SEQ ID NO: 808003 - DNA, 21 bp, Homo sapiens
agatttccattgtgtggcctg

SEQ ID NO: 808004 - DNA, 13 bp, Homo sapiens
agatttcctccat

SEQ ID NO: 808005 - DNA, 12 bp, Homo sapiens
agatttctatga

SEQ ID NO: 808006 - DNA, 11 bp, Homo sapiens
agatttctgac

SEQ ID NO: 808007 - DNA, 14 bp, Homo sapiens
agatttctggttga

SEQ ID NO: 808008 - DNA, 15 bp, Homo sapiens
agatttctggttgat

SEQ ID NO: 808009 - DNA, 19 bp, Homo sapiens
agatttctggttgatttgt

SEQ ID NO: 808010 - DNA, 19 bp, Homo sapiens
agatttcttgagttttgtt

SEQ ID NO: 808011 - DNA, 17 bp, Homo sapiens
agatttcttttttatgt

SEQ ID NO: 808012 - DNA, 19 bp, Homo sapiens
agatttcttttttatgtga

SEQ ID NO: 808013 - DNA, 22 bp, Homo sapiens
agatttggaataggaataagct

SEQ ID NO: 808014 - DNA, 16 bp, Homo sapiens
agatttggagcactct

SEQ ID NO: 808015 - DNA, 20 bp, Homo sapiens
agatttggggtataggtctc

SEQ ID NO: 808016 - DNA, 20 bp, Homo sapiens
agatttgttactgtattttt

SEQ ID NO: 808017 - DNA, 23 bp, Homo sapiens
agatttgttgacagcaaaatgtt

SEQ ID NO: 808018 - DNA, 15 bp, Homo sapiens
agatttgtttttaaa

SEQ ID NO: 808019 - DNA, 17 bp, Homo sapiens
agattttaaaaagtctt

SEQ ID NO: 808020 - DNA, 12 bp, Homo sapiens
agattttaaaga

SEQ ID NO: 808021 - DNA, 13 bp, Homo sapiens
agattttaaattc

SEQ ID NO: 808022 - DNA, 15 bp, Homo sapiens
agattttaatttatt

SEQ ID NO: 808023 - DNA, 17 bp, Homo sapiens
agattttaattttgaat

SEQ ID NO: 808024 - DNA, 21 bp, Homo sapiens
agattttaattttgaataaat

SEQ ID NO: 808025 - DNA, 17 bp, Homo sapiens
agattttacaaaagatg

SEQ ID NO: 808026 - DNA, 19 bp, Homo sapiens
agattttacaaaagatgta

SEQ ID NO: 808027 - DNA, 14 bp, Homo sapiens
agattttaggtgtt

SEQ ID NO: 808028 - DNA, 15 bp, Homo sapiens
agattttaggtgttg

SEQ ID NO: 808029 - DNA, 14 bp, Homo sapiens
agattttatagtgt

SEQ ID NO: 808030 - DNA, 12 bp, Homo sapiens
agattttatgca

SEQ ID NO: 808031 - DNA, 23 bp, Homo sapiens
agattttccacaagattcccaga

SEQ ID NO: 808032 - DNA, 19 bp, Homo sapiens
agattttcctccattttta

SEQ ID NO: 808033 - DNA, 20 bp, Homo sapiens
agattttctccacagtgttc

SEQ ID NO: 808034 - DNA, 19 bp, Homo sapiens
agattttctgctactttgc

SEQ ID NO: 808035 - DNA, 16 bp, Homo sapiens
agattttggtaatgat

SEQ ID NO: 808036 - DNA, 15 bp, Homo sapiens
agatttttaacaaaa

SEQ ID NO: 808037 - DNA, 21 bp, Homo sapiens
agatttttaagaacttcattt

SEQ ID NO: 808038 - DNA, 13 bp, Homo sapiens
agatttttacaaa

SEQ ID NO: 808039 - DNA, 20 bp, Homo sapiens
agatttttacactaatatat

SEQ ID NO: 808040 - DNA, 17 bp, Homo sapiens
agatttttatgtgtttg

SEQ ID NO: 808041 - DNA, 19 bp, Homo sapiens
agatttttatgtgtttgga

SEQ ID NO: 808042 - DNA, 22 bp, Homo sapiens
agatttttcatacttttcttac

SEQ ID NO: 808043 - DNA, 14 bp, Homo sapiens
agatttttgaatca

SEQ ID NO: 808044 - DNA, 15 bp, Homo sapiens
agatttttgatatct

SEQ ID NO: 808045 - DNA, 14 bp, Homo sapiens
agatttttgattca

SEQ ID NO: 808046 - DNA, 23 bp, Homo sapiens
agattttttaattgtttaaaaac

SEQ ID NO: 808047 - DNA, 19 bp, Homo sapiens
agatttttttgtgtatgtt

SEQ ID NO: 808048 - DNA, 16 bp, Homo sapiens
agattttttttaaagt

SEQ ID NO: 808049 - DNA, 14 bp, Homo sapiens
agcaaaaaagaaaa

SEQ ID NO: 808050 - DNA, 22 bp, Homo sapiens
agcaaaaactacattttgcaac

SEQ ID NO: 808051 - DNA, 19 bp, Homo sapiens
agcaaaaagaacaaagctg

SEQ ID NO: 808052 - DNA, 14 bp, Homo sapiens
agcaaaaagatgta

SEQ ID NO: 808053 - DNA, 17 bp, Homo sapiens
agcaaaaatctgagaaa

SEQ ID NO: 808054 - DNA, 13 bp, Homo sapiens
agcaaaacaaaac

SEQ ID NO: 808055 - DNA, 17 bp, Homo sapiens
agcaaaacatcacattc

SEQ ID NO: 808056 - DNA, 17 bp, Homo sapiens
agcaaaaccattgcttc

SEQ ID NO: 808057 - DNA, 12 bp, Homo sapiens
agcaaaagaaaa

SEQ ID NO: 808058 - DNA, 14 bp, Homo sapiens
agcaaaagaagaag

SEQ ID NO: 808059 - DNA, 21 bp, Homo sapiens
agcaaaagaatggcagaaaag

SEQ ID NO: 808060 - DNA, 13 bp, Homo sapiens
agcaaaaggcagc

SEQ ID NO: 808061 - DNA, 17 bp, Homo sapiens
agcaaaaggcagctcac

SEQ ID NO: 808062 - DNA, 16 bp, Homo sapiens
agcaaaataaggaaga

SEQ ID NO: 808063 - DNA, 20 bp, Homo sapiens
agcaaaataaggaagagggc

SEQ ID NO: 808064 - DNA, 14 bp, Homo sapiens
agcaaaatagtatt

SEQ ID NO: 808065 - DNA, 17 bp, Homo sapiens
agcaaaatatgcccctt

SEQ ID NO: 808066 - DNA, 18 bp, Homo sapiens
agcaaaatatgccccttc

SEQ ID NO: 808067 - DNA, 20 bp, Homo sapiens
agcaccacattgcctcattt

SEQ ID NO: 808068 - DNA, 12 bp, Homo sapiens
agcaccacccta

SEQ ID NO: 808069 - DNA, 23 bp, Homo sapiens
agcaccaccctagtcccttcccc

SEQ ID NO: 808070 - DNA, 18 bp, Homo sapiens
agcaccacctacacagga

SEQ ID NO: 808071 - DNA, 19 bp, Homo sapiens
agcaccacctacacaggag

SEQ ID NO: 808072 - DNA, 19 bp, Homo sapiens
agcaccaggaagtgtttat

SEQ ID NO: 808073 - DNA, 23 bp, Homo sapiens
agcaccaggcacgaacccacctg

SEQ ID NO: 808074 - DNA, 13 bp, Homo sapiens
agcacccacgtga

SEQ ID NO: 808075 - DNA, 22 bp, Homo sapiens
agcacccagagcaccccctgct

SEQ ID NO: 808076 - DNA, 14 bp, Homo sapiens
agcaccccaaggct

SEQ ID NO: 808077 - DNA, 12 bp, Homo sapiens
agcacccccacc

SEQ ID NO: 808078 - DNA, 16 bp, Homo sapiens
agcacccccacccacc

SEQ ID NO: 808079 - DNA, 18 bp, Homo sapiens
agcacccccacccacctc

SEQ ID NO: 808080 - DNA, 13 bp, Homo sapiens
agcaccccctcat

SEQ ID NO: 808081 - DNA, 20 bp, Homo sapiens
agcaccccctcattcccctc

SEQ ID NO: 808082 - DNA, 20 bp, Homo sapiens
agcaccccctgctccaccag

SEQ ID NO: 808083 - DNA, 22 bp, Homo sapiens
agcaccccctgctccaccagca

SEQ ID NO: 808084 - DNA, 18 bp, Homo sapiens
agcacccctactcacata

SEQ ID NO: 808085 - DNA, 15 bp, Homo sapiens
agcacccctctctgc

SEQ ID NO: 808086 - DNA, 19 bp, Homo sapiens
agcacccctctctgcatct

SEQ ID NO: 808087 - DNA, 12 bp, Homo sapiens
agcaccccttcc

SEQ ID NO: 808088 - DNA, 13 bp, Homo sapiens
agcaccctctccg

SEQ ID NO: 808089 - DNA, 13 bp, Homo sapiens
agcaccctgggtg

SEQ ID NO: 808090 - DNA, 21 bp, Homo sapiens
agcacccttctcggagaccca

SEQ ID NO: 808091 - DNA, 18 bp, Homo sapiens
agcaccgaatattgagca

SEQ ID NO: 808092 - DNA, 22 bp, Homo sapiens
agcaccgtgccaaccccaccca

SEQ ID NO: 808093 - DNA, 19 bp, Homo sapiens
agcaccgtgtcaagctgct

SEQ ID NO: 808094 - DNA, 15 bp, Homo sapiens
agcaccgttctgtgc

SEQ ID NO: 808095 - DNA, 16 bp, Homo sapiens
agcaccgttctgtgca

SEQ ID NO: 808096 - DNA, 14 bp, Homo sapiens
agcacctacagtgt

SEQ ID NO: 808097 - DNA, 17 bp, Homo sapiens
agcacctagcctcgctc

SEQ ID NO: 808098 - DNA, 18 bp, Homo sapiens
agcacctagtccagtgac

SEQ ID NO: 808099 - DNA, 17 bp, Homo sapiens
agcacctccaaccaaat

SEQ ID NO: 808100 - DNA, 15 bp, Homo sapiens
agcacctccaggcct

SEQ ID NO: 808101 - DNA, 14 bp, Homo sapiens
agcacctccccgct

SEQ ID NO: 808102 - DNA, 16 bp, Homo sapiens
agcacctctcaggatt

SEQ ID NO: 808103 - DNA, 13 bp, Homo sapiens
agcacctgaaccc

SEQ ID NO: 808104 - DNA, 19 bp, Homo sapiens
agcacctgccgacctcgtc

SEQ ID NO: 808105 - DNA, 13 bp, Homo sapiens
agcacctggaccc

SEQ ID NO: 808106 - DNA, 16 bp, Homo sapiens
agcacctggaccccct

SEQ ID NO: 808107 - DNA, 19 bp, Homo sapiens
agcacctggaccccctgcc

SEQ ID NO: 808108 - DNA, 18 bp, Homo sapiens
agcacctgggccccactg

SEQ ID NO: 808109 - DNA, 21 bp, Homo sapiens
agcacctgggccccactggac

SEQ ID NO: 808110 - DNA, 23 bp, Homo sapiens
agcacctgggccccactggacaa

SEQ ID NO: 808111 - DNA, 12 bp, Homo sapiens
agcacctgtctg

SEQ ID NO: 808112 - DNA, 13 bp, Homo sapiens
agcacctgttttt

SEQ ID NO: 808113 - DNA, 21 bp, Homo sapiens
agcaccttcaagcgctccagg

SEQ ID NO: 808114 - DNA, 17 bp, Homo sapiens
agcaccttcagggctga

SEQ ID NO: 808115 - DNA, 15 bp, Homo sapiens
agcaccttcctcact

SEQ ID NO: 808116 - DNA, 19 bp, Homo sapiens
agcaccttcctcacttcca

SEQ ID NO: 808117 - DNA, 16 bp, Homo sapiens
agcaccttctttctgg

SEQ ID NO: 808118 - DNA, 17 bp, Homo sapiens
agcaccttggcccagga

SEQ ID NO: 808119 - DNA, 19 bp, Homo sapiens
agcaccttggcccaggagc

SEQ ID NO: 808120 - DNA, 24 bp, Homo sapiens
agcaccttggcccaggagctctgc

SEQ ID NO: 808121 - DNA, 23 bp, Homo sapiens
agcacctttgagccttggcccac

SEQ ID NO: 808122 - DNA, 16 bp, Homo sapiens
agcacgatttctgttt

SEQ ID NO: 808123 - DNA, 19 bp, Homo sapiens
agcacgatttctgtttaga

SEQ ID NO: 808124 - DNA, 17 bp, Homo sapiens
agcacgcctgccatctt

SEQ ID NO: 808125 - DNA, 20 bp, Homo sapiens
agcacgcctgccatcttctc

SEQ ID NO: 808126 - DNA, 17 bp, Homo sapiens
agcacggactgtcagtt

SEQ ID NO: 808127 - DNA, 16 bp, Homo sapiens
agcacggcccggcccc

SEQ ID NO: 808128 - DNA, 19 bp, Homo sapiens
agcacggtgactctgtcca

SEQ ID NO: 808129 - DNA, 13 bp, Homo sapiens
agcactaaagcag

SEQ ID NO: 808130 - DNA, 14 bp, Homo sapiens
agcactaaagcagt

SEQ ID NO: 808131 - DNA, 17 bp, Homo sapiens
agcactaaagcagtgga

SEQ ID NO: 808132 - DNA, 23 bp, Homo sapiens
agcactaaagcagtggacaccag

SEQ ID NO: 808133 - DNA, 17 bp, Homo sapiens
agcactaaggccgtgtc

SEQ ID NO: 808134 - DNA, 17 bp, Homo sapiens
agcactacaatcatggt

SEQ ID NO: 808135 - DNA, 17 bp, Homo sapiens
agcactactgggtgtca

SEQ ID NO: 808136 - DNA, 14 bp, Homo sapiens
agcactagaagtgg

SEQ ID NO: 808137 - DNA, 16 bp, Homo sapiens
agcactagtttgatta

SEQ ID NO: 808138 - DNA, 14 bp, Homo sapiens
agcactcaagaccc

SEQ ID NO: 808139 - DNA, 12 bp, Homo sapiens
agcactcagcct

SEQ ID NO: 808140 - DNA, 23 bp, Homo sapiens
agcactccccagagctgtgccag

SEQ ID NO: 808141 - DNA, 15 bp, Homo sapiens
agcactcccgctgca

SEQ ID NO: 808142 - DNA, 18 bp, Homo sapiens
agcactcccgctgcacac

SEQ ID NO: 808143 - DNA, 19 bp, Homo sapiens
agcactcccgctgcacaca

SEQ ID NO: 808144 - DNA, 21 bp, Homo sapiens
agcactcctcggtactcccat

SEQ ID NO: 808145 - DNA, 19 bp, Homo sapiens
agcactcgagaccatcctg

SEQ ID NO: 808146 - DNA, 22 bp, Homo sapiens
agcactcgagaccatcctggcc

SEQ ID NO: 808147 - DNA, 14 bp, Homo sapiens
agcactcgtgtgca

SEQ ID NO: 808148 - DNA, 16 bp, Homo sapiens
agcactctaattagag

SEQ ID NO: 808149 - DNA, 17 bp, Homo sapiens
agcactctaattagaga

SEQ ID NO: 808150 - DNA, 17 bp, Homo sapiens
agcactgagcaagttga

SEQ ID NO: 808151 - DNA, 12 bp, Homo sapiens
agcactgagctc

SEQ ID NO: 808152 - DNA, 20 bp, Homo sapiens
agcactgagctcacatggga

SEQ ID NO: 808153 - DNA, 22 bp, Homo sapiens
agcactgagggtggcactcaac

SEQ ID NO: 808154 - DNA, 16 bp, Homo sapiens
agcactgatagtcctt

SEQ ID NO: 808155 - DNA, 13 bp, Homo sapiens
agcactgatttca

SEQ ID NO: 808156 - DNA, 17 bp, Homo sapiens
agcactgatttcacaac

SEQ ID NO: 808157 - DNA, 12 bp, Homo sapiens
agcactgcctcc

SEQ ID NO: 808158 - DNA, 13 bp, Homo sapiens
agcactgcctcta

SEQ ID NO: 808159 - DNA, 20 bp, Homo sapiens
agcactgcctctatgccctg

SEQ ID NO: 808160 - DNA, 21 bp, Homo sapiens
agcactgcctctatgccctgc

SEQ ID NO: 808161 - DNA, 22 bp, Homo sapiens
agcactgcctctatgccctgca

SEQ ID NO: 808162 - DNA, 24 bp, Homo sapiens
agcactgcctctatgccctgcaga

SEQ ID NO: 808163 - DNA, 20 bp, Homo sapiens
agcactggagtgcagggagg

SEQ ID NO: 808164 - DNA, 13 bp, Homo sapiens
agcactggccaga

SEQ ID NO: 808165 - DNA, 15 bp, Homo sapiens
agcactggccagaga

SEQ ID NO: 808166 - DNA, 17 bp, Homo sapiens
agcactggccagagagg

SEQ ID NO: 808167 - DNA, 19 bp, Homo sapiens
agcactggccagagagggc

SEQ ID NO: 808168 - DNA, 20 bp, Homo sapiens
agcactggccagagagggcc

SEQ ID NO: 808169 - DNA, 23 bp, Homo sapiens
agcactggccagagagggcccag

SEQ ID NO: 808170 - DNA, 14 bp, Homo sapiens
agcactggctctct

SEQ ID NO: 808171 - DNA, 15 bp, Homo sapiens
agcactgggaagctg

SEQ ID NO: 808172 - DNA, 16 bp, Homo sapiens
agcactggggaaaaat

SEQ ID NO: 808173 - DNA, 18 bp, Homo sapiens
agcactggggaaaaataa

SEQ ID NO: 808174 - DNA, 23 bp, Homo sapiens
agcactggggaaaaataaacaat

SEQ ID NO: 808175 - DNA, 23 bp, Homo sapiens
agcactggtgaactgagctgggc

SEQ ID NO: 808176 - DNA, 20 bp, Homo sapiens
agcactggtgtgaactcacc

SEQ ID NO: 808177 - DNA, 17 bp, Homo sapiens
agcactggtttcaagaa

SEQ ID NO: 808178 - DNA, 21 bp, Homo sapiens
agcactggtttcaagaatatg

SEQ ID NO: 808179 - DNA, 13 bp, Homo sapiens
agcactgtccctt

SEQ ID NO: 808180 - DNA, 18 bp, Homo sapiens
agcacttcacagctggac

SEQ ID NO: 808181 - DNA, 14 bp, Homo sapiens
agcacttgcctgga

SEQ ID NO: 808182 - DNA, 15 bp, Homo sapiens
agcacttgcctggaa

SEQ ID NO: 808183 - DNA, 18 bp, Homo sapiens
agcacttgcgtcctgcag

SEQ ID NO: 808184 - DNA, 20 bp, Homo sapiens
agcacttgcgtcctgcagag

SEQ ID NO: 808185 - DNA, 18 bp, Homo sapiens
agcactttaaccctctct

SEQ ID NO: 808186 - DNA, 21 bp, Homo sapiens
agcactttaaccctctcttcc

SEQ ID NO: 808187 - DNA, 22 bp, Homo sapiens
agcactttaaccctctcttccc

SEQ ID NO: 808188 - DNA, 22 bp, Homo sapiens
agcactttctacaatgtgaact

SEQ ID NO: 808189 - DNA, 20 bp, Homo sapiens
agcctaggaccactcagccc

SEQ ID NO: 808190 - DNA, 15 bp, Homo sapiens
agcctaggtggaggc

SEQ ID NO: 808191 - DNA, 22 bp, Homo sapiens
agcctaggtgttgtcagcaggc

SEQ ID NO: 808192 - DNA, 20 bp, Homo sapiens
agcctagtgaaggcttctct

SEQ ID NO: 808193 - DNA, 17 bp, Homo sapiens
agcctagttatcaaggg

SEQ ID NO: 808194 - DNA, 14 bp, Homo sapiens
agcctagttcatcc

SEQ ID NO: 808195 - DNA, 20 bp, Homo sapiens
agcctagttcatccaatcct

SEQ ID NO: 808196 - DNA, 19 bp, Homo sapiens
agcctatacgtttctgtgg

SEQ ID NO: 808197 - DNA, 13 bp, Homo sapiens
agcctatagtaaa

SEQ ID NO: 808198 - DNA, 23 bp, Homo sapiens
agcctatgagcatcctgagcccc

SEQ ID NO: 808199 - DNA, 16 bp, Homo sapiens
agcctcaaaacgggtc

SEQ ID NO: 808200 - DNA, 23 bp, Homo sapiens
agcctcaaggccctcggagctgg

SEQ ID NO: 808201 - DNA, 21 bp, Homo sapiens
agcctcaagtcttatttcctc

SEQ ID NO: 808202 - DNA, 18 bp, Homo sapiens
agcctcacagcagtgaga

SEQ ID NO: 808203 - DNA, 19 bp, Homo sapiens
agcctcacgcccccaggaa

SEQ ID NO: 808204 - DNA, 22 bp, Homo sapiens
agcctcacgtatttcacagagc

SEQ ID NO: 808205 - DNA, 17 bp, Homo sapiens
agcctcacttgaatgtg

SEQ ID NO: 808206 - DNA, 16 bp, Homo sapiens
agcctcacttgccctc

SEQ ID NO: 808207 - DNA, 20 bp, Homo sapiens
agcctcagaaggccccagag

SEQ ID NO: 808208 - DNA, 23 bp, Homo sapiens
agcctcagaaggccccagagaga

SEQ ID NO: 808209 - DNA, 13 bp, Homo sapiens
agcctcagactgg

SEQ ID NO: 808210 - DNA, 15 bp, Homo sapiens
agcctcagccattca

SEQ ID NO: 808211 - DNA, 12 bp, Homo sapiens
agcctcagccca

SEQ ID NO: 808212 - DNA, 13 bp, Homo sapiens
agcctcagcccaa

SEQ ID NO: 808213 - DNA, 20 bp, Homo sapiens
agcctcagcccaacttctta

SEQ ID NO: 808214 - DNA, 16 bp, Homo sapiens
agcctcagctacccac

SEQ ID NO: 808215 - DNA, 13 bp, Homo sapiens
agcctcagtgcca

SEQ ID NO: 808216 - DNA, 15 bp, Homo sapiens
agcctcagtgccact

SEQ ID NO: 808217 - DNA, 16 bp, Homo sapiens
agcctcatactcctgg

SEQ ID NO: 808218 - DNA, 15 bp, Homo sapiens
agcctcatatttaaa

SEQ ID NO: 808219 - DNA, 17 bp, Homo sapiens
agcctcatatttaaaga

SEQ ID NO: 808220 - DNA, 15 bp, Homo sapiens
agcctcatcatcaga

SEQ ID NO: 808221 - DNA, 17 bp, Homo sapiens
agcctcatcatcagagc

SEQ ID NO: 808222 - DNA, 19 bp, Homo sapiens
agcctcatccgaggcaggg

SEQ ID NO: 808223 - DNA, 17 bp, Homo sapiens
agcctcatgttctcttc

SEQ ID NO: 808224 - DNA, 13 bp, Homo sapiens
agcctcattcagc

SEQ ID NO: 808225 - DNA, 19 bp, Homo sapiens
agcctcattctgaggcctg

SEQ ID NO: 808226 - DNA, 19 bp, Homo sapiens
agcctccaagcctgcctcc

SEQ ID NO: 808227 - DNA, 18 bp, Homo sapiens
agcctccaagggtttcga

SEQ ID NO: 808228 - DNA, 14 bp, Homo sapiens
agcctccacagcga

SEQ ID NO: 808229 - DNA, 15 bp, Homo sapiens
agcctccacagcgag

SEQ ID NO: 808230 - DNA, 20 bp, Homo sapiens
agcctccagagccagcctgg

SEQ ID NO: 808231 - DNA, 22 bp, Homo sapiens
agcctccagagccagcctggga

SEQ ID NO: 808232 - DNA, 21 bp, Homo sapiens
agcctccaggcccccaactcc

SEQ ID NO: 808233 - DNA, 14 bp, Homo sapiens
agcctccagggccc

SEQ ID NO: 808234 - DNA, 17 bp, Homo sapiens
agcctccagggcccccc

SEQ ID NO: 808235 - DNA, 18 bp, Homo sapiens
agcctccatgctgcctcc

SEQ ID NO: 808236 - DNA, 20 bp, Homo sapiens
agcctccatgctgcctccag

SEQ ID NO: 808237 - DNA, 21 bp, Homo sapiens
agcctccatttagttctttgt

SEQ ID NO: 808238 - DNA, 18 bp, Homo sapiens
agcctcccaaagtgctgg

SEQ ID NO: 808239 - DNA, 20 bp, Homo sapiens
agcctcccaagtagctggga

SEQ ID NO: 808240 - DNA, 17 bp, Homo sapiens
agcctcccatccagggc

SEQ ID NO: 808241 - DNA, 21 bp, Homo sapiens
agcctccccatctgtccagct

SEQ ID NO: 808242 - DNA, 15 bp, Homo sapiens
agcctccccctcaga

SEQ ID NO: 808243 - DNA, 12 bp, Homo sapiens
agcctcccctcc

SEQ ID NO: 808244 - DNA, 13 bp, Homo sapiens
agcctcccctccc

SEQ ID NO: 808245 - DNA, 17 bp, Homo sapiens
agcctcccctcccctgg

SEQ ID NO: 808246 - DNA, 19 bp, Homo sapiens
agcctcccctgccagggca

SEQ ID NO: 808247 - DNA, 22 bp, Homo sapiens
agcctcccctgccagggcaggg

SEQ ID NO: 808248 - DNA, 11 bp, Homo sapiens
agcctcccctt

SEQ ID NO: 808249 - DNA, 13 bp, Homo sapiens
agcctccccttct

SEQ ID NO: 808250 - DNA, 23 bp, Homo sapiens
agcctccccttcttcccgcccca

SEQ ID NO: 808251 - DNA, 17 bp, Homo sapiens
agcctcccgagtagctg

SEQ ID NO: 808252 - DNA, 20 bp, Homo sapiens
agcctcccgagtagctggga

SEQ ID NO: 808253 - DNA, 15 bp, Homo sapiens
agcctccctctgacc

SEQ ID NO: 808254 - DNA, 22 bp, Homo sapiens
agcctccctctgacctgcaggc

SEQ ID NO: 808255 - DNA, 11 bp, Homo sapiens
agcctccctga

SEQ ID NO: 808256 - DNA, 14 bp, Homo sapiens
agcctccctgagcc

SEQ ID NO: 808257 - DNA, 17 bp, Homo sapiens
agcctccctgagcctgc

SEQ ID NO: 808258 - DNA, 21 bp, Homo sapiens
agcctccctgtctccagctgc

SEQ ID NO: 808259 - DNA, 22 bp, Homo sapiens
agcctccctgtctccagctgcc

SEQ ID NO: 808260 - DNA, 24 bp, Homo sapiens
agcctccctgtctccagctgcctg

SEQ ID NO: 808261 - DNA, 14 bp, Homo sapiens
agcctccgtggaac

SEQ ID NO: 808262 - DNA, 14 bp, Homo sapiens
agcctcctcagggg

SEQ ID NO: 808263 - DNA, 14 bp, Homo sapiens
agcctcctccagcc

SEQ ID NO: 808264 - DNA, 14 bp, Homo sapiens
agcctcctctggac

SEQ ID NO: 808265 - DNA, 18 bp, Homo sapiens
agcctcctctggacggca

SEQ ID NO: 808266 - DNA, 12 bp, Homo sapiens
agcctcctgagc

SEQ ID NO: 808267 - DNA, 16 bp, Homo sapiens
agcctcctgagcctgt

SEQ ID NO: 808268 - DNA, 19 bp, Homo sapiens
agcctcctgagtagctgga

SEQ ID NO: 808269 - DNA, 20 bp, Homo sapiens
agcctcctgccccctgccag

SEQ ID NO: 808270 - DNA, 17 bp, Homo sapiens
agcctcctgctgccaca

SEQ ID NO: 808271 - DNA, 14 bp, Homo sapiens
agcctcctgtacct

SEQ ID NO: 808272 - DNA, 15 bp, Homo sapiens
agcctcctgtgcctg

SEQ ID NO: 808273 - DNA, 17 bp, Homo sapiens
agcctcctgtgcctggc

SEQ ID NO: 808274 - DNA, 15 bp, Homo sapiens
agcctccttgctgac

SEQ ID NO: 808275 - DNA, 21 bp, Homo sapiens
agcctccttgctgaccccagg

SEQ ID NO: 808276 - DNA, 23 bp, Homo sapiens
agcctccttgctgaccccaggtc

SEQ ID NO: 808277 - DNA, 13 bp, Homo sapiens
agcctcgaggctg

SEQ ID NO: 808278 - DNA, 14 bp, Homo sapiens
agcctcgaggctgg

SEQ ID NO: 808279 - DNA, 15 bp, Homo sapiens
agcctcgcacaggcc

SEQ ID NO: 808280 - DNA, 16 bp, Homo sapiens
agcctcgcacaggccc

SEQ ID NO: 808281 - DNA, 14 bp, Homo sapiens
agcctcgcccctcc

SEQ ID NO: 808282 - DNA, 16 bp, Homo sapiens
agcctcgcccctccag

SEQ ID NO: 808283 - DNA, 22 bp, Homo sapiens
agcctcgcggtcttgggcactg

SEQ ID NO: 808284 - DNA, 18 bp, Homo sapiens
agcctcggggatggggag

SEQ ID NO: 808285 - DNA, 19 bp, Homo sapiens
agcctcggggatggggagg

SEQ ID NO: 808286 - DNA, 21 bp, Homo sapiens
agcctcggggatggggaggga

SEQ ID NO: 808287 - DNA, 20 bp, Homo sapiens
agcctcgtggagctcgcccc

SEQ ID NO: 808288 - DNA, 15 bp, Homo sapiens
agcctcgttggagag

SEQ ID NO: 808289 - DNA, 18 bp, Homo sapiens
agcctcgttggagagcag

SEQ ID NO: 808290 - DNA, 20 bp, Homo sapiens
agcctcgttggagagcagca

SEQ ID NO: 808291 - DNA, 14 bp, Homo sapiens
agcctctccaggaa

SEQ ID NO: 808292 - DNA, 11 bp, Homo sapiens
agcctctccca

SEQ ID NO: 808293 - DNA, 23 bp, Homo sapiens
agcctctccccaggtccagctct

SEQ ID NO: 808294 - DNA, 13 bp, Homo sapiens
agcctctcccggc

SEQ ID NO: 808295 - DNA, 14 bp, Homo sapiens
agcctctcccggct

SEQ ID NO: 808296 - DNA, 20 bp, Homo sapiens
agcctctccggcagaaggga

SEQ ID NO: 808297 - DNA, 13 bp, Homo sapiens
agcctctcctgta

SEQ ID NO: 808298 - DNA, 22 bp, Homo sapiens
agcctctctccttggccacaga

SEQ ID NO: 808299 - DNA, 18 bp, Homo sapiens
agcctctctctccctccc

SEQ ID NO: 808300 - DNA, 15 bp, Homo sapiens
agcctctctggctgg

SEQ ID NO: 808301 - DNA, 19 bp, Homo sapiens
agcctctctggctggtctt

SEQ ID NO: 808302 - DNA, 23 bp, Homo sapiens
agcctctctggctggtcttcact

SEQ ID NO: 808303 - DNA, 23 bp, Homo sapiens
agcctctgaaaaccaatgttctc

SEQ ID NO: 808304 - DNA, 20 bp, Homo sapiens
agcctctgaagttggacagc

SEQ ID NO: 808305 - DNA, 16 bp, Homo sapiens
agcctctgagatgcta

SEQ ID NO: 808306 - DNA, 11 bp, Homo sapiens
agcctctgcct

SEQ ID NO: 808307 - DNA, 13 bp, Homo sapiens
agcctctgctccc

SEQ ID NO: 808308 - DNA, 16 bp, Homo sapiens
agcctctgctccccag

SEQ ID NO: 808309 - DNA, 14 bp, Homo sapiens
agcctctgctgcca

SEQ ID NO: 808310 - DNA, 18 bp, Homo sapiens
agcctctgctgccatggc

SEQ ID NO: 808311 - DNA, 15 bp, Homo sapiens
agcgtggcccaggcc

SEQ ID NO: 808312 - DNA, 16 bp, Homo sapiens
agcgtggcccaggccg

SEQ ID NO: 808313 - DNA, 23 bp, Homo sapiens
agcgtggccttgggaggacatgc

SEQ ID NO: 808314 - DNA, 15 bp, Homo sapiens
agcgtgggctctgcc

SEQ ID NO: 808315 - DNA, 16 bp, Homo sapiens
agcgtgtgccaggcag

SEQ ID NO: 808316 - DNA, 16 bp, Homo sapiens
agcgttcccttctccc

SEQ ID NO: 808317 - DNA, 18 bp, Homo sapiens
agcgttctggactctgcc

SEQ ID NO: 808318 - DNA, 19 bp, Homo sapiens
agcgttctggactctgccc

SEQ ID NO: 808319 - DNA, 11 bp, Homo sapiens
agcgttcttgt

SEQ ID NO: 808320 - DNA, 18 bp, Homo sapiens
agcgttcttgtaatttta

SEQ ID NO: 808321 - DNA, 22 bp, Homo sapiens
agcgttgggtttgctcatgtaa

SEQ ID NO: 808322 - DNA, 12 bp, Homo sapiens
agctaaaataaa

SEQ ID NO: 808323 - DNA, 15 bp, Homo sapiens
agctaaaatgatttt

SEQ ID NO: 808324 - DNA, 21 bp, Homo sapiens
agctaaaccaagaaggagacc

SEQ ID NO: 808325 - DNA, 17 bp, Homo sapiens
agctaaacggattccaa

SEQ ID NO: 808326 - DNA, 18 bp, Homo sapiens
agctaaacggattccaaa

SEQ ID NO: 808327 - DNA, 16 bp, Homo sapiens
agctaaagcccaacct

SEQ ID NO: 808328 - DNA, 11 bp, Homo sapiens
agctaaataaa

SEQ ID NO: 808329 - DNA, 15 bp, Homo sapiens
agctaaatgtaactt

SEQ ID NO: 808330 - DNA, 18 bp, Homo sapiens
agctaaattacaattgtc

SEQ ID NO: 808331 - DNA, 15 bp, Homo sapiens
agctaaattttgtta

SEQ ID NO: 808332 - DNA, 18 bp, Homo sapiens
agctaacactggccccta

SEQ ID NO: 808333 - DNA, 19 bp, Homo sapiens
agctaacactggcccctag

SEQ ID NO: 808334 - DNA, 23 bp, Homo sapiens
agctaacattttaaataaaagaa

SEQ ID NO: 808335 - DNA, 15 bp, Homo sapiens
agctaactgtaaatc

SEQ ID NO: 808336 - DNA, 17 bp, Homo sapiens
agctaagctaggaatga

SEQ ID NO: 808337 - DNA, 16 bp, Homo sapiens
agctaagggtgggtgc

SEQ ID NO: 808338 - DNA, 21 bp, Homo sapiens
agctaagggtgggtgctcaga

SEQ ID NO: 808339 - DNA, 15 bp, Homo sapiens
agctaagtaaaaata

SEQ ID NO: 808340 - DNA, 16 bp, Homo sapiens
agctaagtaaaaatat

SEQ ID NO: 808341 - DNA, 22 bp, Homo sapiens
agctaagtaaaaatatgtcatc

SEQ ID NO: 808342 - DNA, 23 bp, Homo sapiens
agctaagtcacccagagcacagg

SEQ ID NO: 808343 - DNA, 12 bp, Homo sapiens
agctaataaatc

SEQ ID NO: 808344 - DNA, 20 bp, Homo sapiens
agctaataaatctcttcttt

SEQ ID NO: 808345 - DNA, 21 bp, Homo sapiens
agctaatcagcattctcactc

SEQ ID NO: 808346 - DNA, 22 bp, Homo sapiens
agctaatctgcctggttttatt

SEQ ID NO: 808347 - DNA, 17 bp, Homo sapiens
agctaatctgtagggct

SEQ ID NO: 808348 - DNA, 20 bp, Homo sapiens
agctaatctgtagggctgga

SEQ ID NO: 808349 - DNA, 22 bp, Homo sapiens
agctaatgaactctttcaaatt

SEQ ID NO: 808350 - DNA, 18 bp, Homo sapiens
agctaatgtgcagggata

SEQ ID NO: 808351 - DNA, 13 bp, Homo sapiens
agctaatttgcat

SEQ ID NO: 808352 - DNA, 22 bp, Homo sapiens
agctaatttgcattaaattcac

SEQ ID NO: 808353 - DNA, 16 bp, Homo sapiens
agctaatttttgtatg

SEQ ID NO: 808354 - DNA, 15 bp, Homo sapiens
agctacactgagcag

SEQ ID NO: 808355 - DNA, 15 bp, Homo sapiens
agctacataatttag

SEQ ID NO: 808356 - DNA, 17 bp, Homo sapiens
agctacatagcagactt

SEQ ID NO: 808357 - DNA, 12 bp, Homo sapiens
agctacattcct

SEQ ID NO: 808358 - DNA, 19 bp, Homo sapiens
agctaccaacggccaggaa

SEQ ID NO: 808359 - DNA, 21 bp, Homo sapiens
agctaccattttacatttcta

SEQ ID NO: 808360 - DNA, 17 bp, Homo sapiens
agctacccctcaaactg

SEQ ID NO: 808361 - DNA, 14 bp, Homo sapiens
agctacctcaacca

SEQ ID NO: 808362 - DNA, 17 bp, Homo sapiens
agctactagcaaaataa

SEQ ID NO: 808363 - DNA, 15 bp, Homo sapiens
agctactcagaagcc

SEQ ID NO: 808364 - DNA, 18 bp, Homo sapiens
agctactcagaagcctga

SEQ ID NO: 808365 - DNA, 19 bp, Homo sapiens
agctactcagaagcctgag

SEQ ID NO: 808366 - DNA, 12 bp, Homo sapiens
agctactcagga

SEQ ID NO: 808367 - DNA, 19 bp, Homo sapiens
agctactcgggaggctgag

SEQ ID NO: 808368 - DNA, 15 bp, Homo sapiens
agctactctagttct

SEQ ID NO: 808369 - DNA, 17 bp, Homo sapiens
agctactctagttctgt

SEQ ID NO: 808370 - DNA, 21 bp, Homo sapiens
agctactctagttctgttgtt

SEQ ID NO: 808371 - DNA, 12 bp, Homo sapiens
agctactctgtc

SEQ ID NO: 808372 - DNA, 21 bp, Homo sapiens
agctactctgtccaggccact

SEQ ID NO: 808373 - DNA, 22 bp, Homo sapiens
agctactctgtccaggccactg

SEQ ID NO: 808374 - DNA, 23 bp, Homo sapiens
agctactctgtccaggccactgt

SEQ ID NO: 808375 - DNA, 19 bp, Homo sapiens
agctactggaatggtgttt

SEQ ID NO: 808376 - DNA, 18 bp, Homo sapiens
agctactggattcttatt

SEQ ID NO: 808377 - DNA, 14 bp, Homo sapiens
agctactgtaactt

SEQ ID NO: 808378 - DNA, 16 bp, Homo sapiens
agctactgtaactttt

SEQ ID NO: 808379 - DNA, 16 bp, Homo sapiens
agctactgtatgcaaa

SEQ ID NO: 808380 - DNA, 15 bp, Homo sapiens
agctactgtgtgtgt

SEQ ID NO: 808381 - DNA, 15 bp, Homo sapiens
agctacttcctcctc

SEQ ID NO: 808382 - DNA, 16 bp, Homo sapiens
agctacttcctcctcc

SEQ ID NO: 808383 - DNA, 16 bp, Homo sapiens
agctacttgggaggct

SEQ ID NO: 808384 - DNA, 18 bp, Homo sapiens
agctacttgggaggctga

SEQ ID NO: 808385 - DNA, 16 bp, Homo sapiens
agctacttggtttgtg

SEQ ID NO: 808386 - DNA, 12 bp, Homo sapiens
agctagaaatga

SEQ ID NO: 808387 - DNA, 15 bp, Homo sapiens
agctagaagtgggcc

SEQ ID NO: 808388 - DNA, 19 bp, Homo sapiens
agctagaagtgggccagga

SEQ ID NO: 808389 - DNA, 22 bp, Homo sapiens
agctagaagtgggccaggacag

SEQ ID NO: 808390 - DNA, 24 bp, Homo sapiens
agctagaagtgggccaggacaggc

SEQ ID NO: 808391 - DNA, 20 bp, Homo sapiens
agctagaattgagtgtttaa

SEQ ID NO: 808392 - DNA, 14 bp, Homo sapiens
agctagaatttctg

SEQ ID NO: 808393 - DNA, 17 bp, Homo sapiens
agctagacacatgaagg

SEQ ID NO: 808394 - DNA, 16 bp, Homo sapiens
agctagatatgcctta

SEQ ID NO: 808395 - DNA, 20 bp, Homo sapiens
agctagccagagggtgggag

SEQ ID NO: 808396 - DNA, 12 bp, Homo sapiens
agctagccagcc

SEQ ID NO: 808397 - DNA, 12 bp, Homo sapiens
agctagcctcca

SEQ ID NO: 808398 - DNA, 18 bp, Homo sapiens
agctagcgctgccgcacc

SEQ ID NO: 808399 - DNA, 17 bp, Homo sapiens
agctagcgtgtgccagg

SEQ ID NO: 808400 - DNA, 19 bp, Homo sapiens
agctagcgtgtgccaggca

SEQ ID NO: 808401 - DNA, 13 bp, Homo sapiens
agctagctgccac

SEQ ID NO: 808402 - DNA, 19 bp, Homo sapiens
agctaggcttaaacctgga

SEQ ID NO: 808403 - DNA, 16 bp, Homo sapiens
agctagggctgctgct

SEQ ID NO: 808404 - DNA, 19 bp, Homo sapiens
agctagggctgctgcttct

SEQ ID NO: 808405 - DNA, 20 bp, Homo sapiens
agctaggtgacatatacata

SEQ ID NO: 808406 - DNA, 15 bp, Homo sapiens
agctagtaatgcttt

SEQ ID NO: 808407 - DNA, 22 bp, Homo sapiens
agctagtatcttcaaactttca

SEQ ID NO: 808408 - DNA, 23 bp, Homo sapiens
agctagtcttttgcttttgccca

SEQ ID NO: 808409 - DNA, 13 bp, Homo sapiens
agctagtgccaaa

SEQ ID NO: 808410 - DNA, 14 bp, Homo sapiens
agctagtgccaaat

SEQ ID NO: 808411 - DNA, 21 bp, Homo sapiens
agctagtgcctttagagggta

SEQ ID NO: 808412 - DNA, 19 bp, Homo sapiens
agctagtggcttcaaaata

SEQ ID NO: 808413 - DNA, 23 bp, Homo sapiens
agctagtgtacctcctctcagtg

SEQ ID NO: 808414 - DNA, 17 bp, Homo sapiens
agctagttcgtagcttt

SEQ ID NO: 808415 - DNA, 15 bp, Homo sapiens
agctataaagtatat

SEQ ID NO: 808416 - DNA, 17 bp, Homo sapiens
agctatcaagtgtgctt

SEQ ID NO: 808417 - DNA, 15 bp, Homo sapiens
agctatcacctagca

SEQ ID NO: 808418 - DNA, 20 bp, Homo sapiens
agctatcagaagaccacaaa

SEQ ID NO: 808419 - DNA, 12 bp, Homo sapiens
agctatcagcaa

SEQ ID NO: 808420 - DNA, 23 bp, Homo sapiens
agctatccagtgacttgttctga

SEQ ID NO: 808421 - DNA, 15 bp, Homo sapiens
agctatctaaagttt

SEQ ID NO: 808422 - DNA, 21 bp, Homo sapiens
agctatctgcactctaaactg

SEQ ID NO: 808423 - DNA, 18 bp, Homo sapiens
agctatctgtcatctctc

SEQ ID NO: 808424 - DNA, 15 bp, Homo sapiens
agctatcttcatgta

SEQ ID NO: 808425 - DNA, 21 bp, Homo sapiens
agctatggcccagaaacaaca

SEQ ID NO: 808426 - DNA, 22 bp, Homo sapiens
agctatgttatattgaaaaaat

SEQ ID NO: 808427 - DNA, 15 bp, Homo sapiens
agctattaagaaaat

SEQ ID NO: 808428 - DNA, 19 bp, Homo sapiens
agctattcagtaataactc

SEQ ID NO: 808429 - DNA, 14 bp, Homo sapiens
agctattcctttcc

SEQ ID NO: 808430 - DNA, 18 bp, Homo sapiens
agctattcctttcccttc

SEQ ID NO: 808431 - DNA, 19 bp, Homo sapiens
agctattcctttcccttcc

SEQ ID NO: 808432 - DNA, 17 bp, Homo sapiens
agctattgccaaccagt

SEQ ID NO: 808433 - DNA, 18 bp, Homo sapiens
agctgacattgccaaaaa

SEQ ID NO: 808434 - DNA, 23 bp, Homo sapiens
agctgacccagccccttgagaaa

SEQ ID NO: 808435 - DNA, 22 bp, Homo sapiens
agctgaccccgagaagtgctct

SEQ ID NO: 808436 - DNA, 15 bp, Homo sapiens
agctgacctctgttg

SEQ ID NO: 808437 - DNA, 21 bp, Homo sapiens
agctgacctctgttgtcctcc

SEQ ID NO: 808438 - DNA, 23 bp, Homo sapiens
agctgactaaactttttttctgt

SEQ ID NO: 808439 - DNA, 14 bp, Homo sapiens
agctgactgtggcc

SEQ ID NO: 808440 - DNA, 15 bp, Homo sapiens
agctgacttggcact

SEQ ID NO: 808441 - DNA, 16 bp, Homo sapiens
agctgacttggcactt

SEQ ID NO: 808442 - DNA, 13 bp, Homo sapiens
agctgagaaaagt

SEQ ID NO: 808443 - DNA, 18 bp, Homo sapiens
agctgagaagaggaggag

SEQ ID NO: 808444 - DNA, 14 bp, Homo sapiens
agctgagaccaggg

SEQ ID NO: 808445 - DNA, 20 bp, Homo sapiens
agctgagagaccctggcctc

SEQ ID NO: 808446 - DNA, 22 bp, Homo sapiens
agctgagagaccctggcctcaa

SEQ ID NO: 808447 - DNA, 22 bp, Homo sapiens
agctgagagccctgctgtggga

SEQ ID NO: 808448 - DNA, 15 bp, Homo sapiens
agctgagcagcctct

SEQ ID NO: 808449 - DNA, 21 bp, Homo sapiens
agctgagcaggacagccagca

SEQ ID NO: 808450 - DNA, 13 bp, Homo sapiens
agctgagcctctc

SEQ ID NO: 808451 - DNA, 14 bp, Homo sapiens
agctgagcctctca

SEQ ID NO: 808452 - DNA, 12 bp, Homo sapiens
agctgagcgcca

SEQ ID NO: 808453 - DNA, 11 bp, Homo sapiens
agctgagctgg

SEQ ID NO: 808454 - DNA, 23 bp, Homo sapiens
agctgagcttcggttctccagaa

SEQ ID NO: 808455 - DNA, 20 bp, Homo sapiens
agctgaggacacaccccaca

SEQ ID NO: 808456 - DNA, 20 bp, Homo sapiens
agctgaggatttcctggagt

SEQ ID NO: 808457 - DNA, 13 bp, Homo sapiens
agctgaggccaca

SEQ ID NO: 808458 - DNA, 20 bp, Homo sapiens
agctgaggcctatgcagaca

SEQ ID NO: 808459 - DNA, 21 bp, Homo sapiens
agctgagggagggagccatgg

SEQ ID NO: 808460 - DNA, 15 bp, Homo sapiens
agctgagggccctgt

SEQ ID NO: 808461 - DNA, 17 bp, Homo sapiens
agctgagggccctgtgg

SEQ ID NO: 808462 - DNA, 19 bp, Homo sapiens
agctgaggggacgggcaag

SEQ ID NO: 808463 - DNA, 13 bp, Homo sapiens
agctgaggggggc

SEQ ID NO: 808464 - DNA, 21 bp, Homo sapiens
agctgaggtctcttgagggag

SEQ ID NO: 808465 - DNA, 20 bp, Homo sapiens
agctgagtcacctcctccac

SEQ ID NO: 808466 - DNA, 14 bp, Homo sapiens
agctgagtggccag

SEQ ID NO: 808467 - DNA, 21 bp, Homo sapiens
agctgagttacttgtctgagg

SEQ ID NO: 808468 - DNA, 23 bp, Homo sapiens
agctgagttacttgtctgaggcc

SEQ ID NO: 808469 - DNA, 16 bp, Homo sapiens
agctgagttatgatgt

SEQ ID NO: 808470 - DNA, 13 bp, Homo sapiens
agctgagtttcct

SEQ ID NO: 808471 - DNA, 20 bp, Homo sapiens
agctgataaggaaactttat

SEQ ID NO: 808472 - DNA, 19 bp, Homo sapiens
agctgatattatttcttct

SEQ ID NO: 808473 - DNA, 20 bp, Homo sapiens
agctgatattatttcttctc

SEQ ID NO: 808474 - DNA, 23 bp, Homo sapiens
agctgatattatttcttctctta

SEQ ID NO: 808475 - DNA, 15 bp, Homo sapiens
agctgatccagagca

SEQ ID NO: 808476 - DNA, 19 bp, Homo sapiens
agctgatccagagcacaga

SEQ ID NO: 808477 - DNA, 16 bp, Homo sapiens
agctgatccataggac

SEQ ID NO: 808478 - DNA, 19 bp, Homo sapiens
agctgatccataggactac

SEQ ID NO: 808479 - DNA, 22 bp, Homo sapiens
agctgatctgcggatctcagct

SEQ ID NO: 808480 - DNA, 21 bp, Homo sapiens
agctgatgatgtctcttgtag

SEQ ID NO: 808481 - DNA, 14 bp, Homo sapiens
agctgatggcagct

SEQ ID NO: 808482 - DNA, 15 bp, Homo sapiens
agctgatggcagctg

SEQ ID NO: 808483 - DNA, 21 bp, Homo sapiens
agctgattactgtcaataaac

SEQ ID NO: 808484 - DNA, 23 bp, Homo sapiens
agctgatttaacttgtattttgt

SEQ ID NO: 808485 - DNA, 15 bp, Homo sapiens
agctgatttccaggc

SEQ ID NO: 808486 - DNA, 16 bp, Homo sapiens
agctgatttccaggcc

SEQ ID NO: 808487 - DNA, 19 bp, Homo sapiens
agctgatttccaggcccct

SEQ ID NO: 808488 - DNA, 14 bp, Homo sapiens
agctgatttgtata

SEQ ID NO: 808489 - DNA, 15 bp, Homo sapiens
agctgattttaacaa

SEQ ID NO: 808490 - DNA, 19 bp, Homo sapiens
agctgattttaacaataac

SEQ ID NO: 808491 - DNA, 16 bp, Homo sapiens
agctgcaaatctgatg

SEQ ID NO: 808492 - DNA, 21 bp, Homo sapiens
agctgcaaggtactctggtga

SEQ ID NO: 808493 - DNA, 15 bp, Homo sapiens
agctgcacaatttaa

SEQ ID NO: 808494 - DNA, 20 bp, Homo sapiens
agctgcacacacctgggtgg

SEQ ID NO: 808495 - DNA, 23 bp, Homo sapiens
agctgcacacacctgggtggaca

SEQ ID NO: 808496 - DNA, 21 bp, Homo sapiens
agctgcacatgtgccacacag

SEQ ID NO: 808497 - DNA, 14 bp, Homo sapiens
agctgcacattcct

SEQ ID NO: 808498 - DNA, 18 bp, Homo sapiens
agctgcacattcctggcc

SEQ ID NO: 808499 - DNA, 19 bp, Homo sapiens
agctgcacattcctggccc

SEQ ID NO: 808500 - DNA, 14 bp, Homo sapiens
agctgcaccagagc

SEQ ID NO: 808501 - DNA, 15 bp, Homo sapiens
agctgcaccagagca

SEQ ID NO: 808502 - DNA, 16 bp, Homo sapiens
agctgcacctgccagc

SEQ ID NO: 808503 - DNA, 18 bp, Homo sapiens
agctgcacctgccagcct

SEQ ID NO: 808504 - DNA, 11 bp, Homo sapiens
agctgcactga

SEQ ID NO: 808505 - DNA, 14 bp, Homo sapiens
agctgcactgtgaa

SEQ ID NO: 808506 - DNA, 13 bp, Homo sapiens
agctgcactttaa

SEQ ID NO: 808507 - DNA, 19 bp, Homo sapiens
agctgcactttaaccctag

SEQ ID NO: 808508 - DNA, 21 bp, Homo sapiens
agctgcagaaacgaagccatc

SEQ ID NO: 808509 - DNA, 19 bp, Homo sapiens
agctgcagaccatgccaga

SEQ ID NO: 808510 - DNA, 15 bp, Homo sapiens
agctgcagctgggcc

SEQ ID NO: 808511 - DNA, 21 bp, Homo sapiens
agctgcagctgggccccatgc

SEQ ID NO: 808512 - DNA, 22 bp, Homo sapiens
agctgcagctgggccccatgct

SEQ ID NO: 808513 - DNA, 14 bp, Homo sapiens
agctgcagggcacg

SEQ ID NO: 808514 - DNA, 16 bp, Homo sapiens
agctgcatggagcctg

SEQ ID NO: 808515 - DNA, 20 bp, Homo sapiens
agctgcatgttaagtgccat

SEQ ID NO: 808516 - DNA, 14 bp, Homo sapiens
agctgccaagcact

SEQ ID NO: 808517 - DNA, 14 bp, Homo sapiens
agctgccacattga

SEQ ID NO: 808518 - DNA, 16 bp, Homo sapiens
agctgccacccctctt

SEQ ID NO: 808519 - DNA, 18 bp, Homo sapiens
agctgccactgggcacct

SEQ ID NO: 808520 - DNA, 19 bp, Homo sapiens
agctgccactgggcacctg

SEQ ID NO: 808521 - DNA, 19 bp, Homo sapiens
agctgccaggtgagaaact

SEQ ID NO: 808522 - DNA, 15 bp, Homo sapiens
agctgccagtgctgg

SEQ ID NO: 808523 - DNA, 19 bp, Homo sapiens
agctgccatccttgctgca

SEQ ID NO: 808524 - DNA, 16 bp, Homo sapiens
agctgccatttccctt

SEQ ID NO: 808525 - DNA, 19 bp, Homo sapiens
agctgccccggcccctccc

SEQ ID NO: 808526 - DNA, 13 bp, Homo sapiens
agctgcccctccc

SEQ ID NO: 808527 - DNA, 17 bp, Homo sapiens
agctgcccctccctcag

SEQ ID NO: 808528 - DNA, 14 bp, Homo sapiens
agctgcccctcctg

SEQ ID NO: 808529 - DNA, 15 bp, Homo sapiens
agctgcccctcctgg

SEQ ID NO: 808530 - DNA, 23 bp, Homo sapiens
agctgcccctcctggagcagaaa

SEQ ID NO: 808531 - DNA, 17 bp, Homo sapiens
agctgccctatgggcct

SEQ ID NO: 808532 - DNA, 19 bp, Homo sapiens
agctgccctatgggcctgc

SEQ ID NO: 808533 - DNA, 12 bp, Homo sapiens
agctgccctgct

SEQ ID NO: 808534 - DNA, 17 bp, Homo sapiens
agctgccctgctgccac

SEQ ID NO: 808535 - DNA, 18 bp, Homo sapiens
agctgccctgctgccaca

SEQ ID NO: 808536 - DNA, 19 bp, Homo sapiens
agctgccctgctgccacag

SEQ ID NO: 808537 - DNA, 15 bp, Homo sapiens
agctgcccttccgca

SEQ ID NO: 808538 - DNA, 20 bp, Homo sapiens
agctgcctcccctctccttc

SEQ ID NO: 808539 - DNA, 16 bp, Homo sapiens
agctgcctctgacagc

SEQ ID NO: 808540 - DNA, 20 bp, Homo sapiens
agctgcctctgacagcagcc

SEQ ID NO: 808541 - DNA, 22 bp, Homo sapiens
agctgcctctgacagcagcctg

SEQ ID NO: 808542 - DNA, 12 bp, Homo sapiens
agctgcctctgc

SEQ ID NO: 808543 - DNA, 18 bp, Homo sapiens
agctgcctctgctccctc

SEQ ID NO: 808544 - DNA, 20 bp, Homo sapiens
agctgcctctgctccctctg

SEQ ID NO: 808545 - DNA, 15 bp, Homo sapiens
agctgcctgaaacag

SEQ ID NO: 808546 - DNA, 22 bp, Homo sapiens
agctgcctgaaacagccatgtc

SEQ ID NO: 808547 - DNA, 13 bp, Homo sapiens
agctgcctgcagc

SEQ ID NO: 808548 - DNA, 13 bp, Homo sapiens
agctgcctggcgg

SEQ ID NO: 808549 - DNA, 13 bp, Homo sapiens
agctgcctgggcc

SEQ ID NO: 808550 - DNA, 17 bp, Homo sapiens
agctgcctgggcccgga

SEQ ID NO: 808551 - DNA, 15 bp, Homo sapiens
agctgcctggggccc

SEQ ID NO: 808552 - DNA, 19 bp, Homo sapiens
agctgcctgtagttaggaa

SEQ ID NO: 808553 - DNA, 20 bp, Homo sapiens
agctgcctgtagttaggaaa

SEQ ID NO: 808554 - DNA, 15 bp, Homo sapiens
agctgcctgtgccat

SEQ ID NO: 808555 - DNA, 20 bp, Homo sapiens
agcttcagctcaactcacag

SEQ ID NO: 808556 - DNA, 14 bp, Homo sapiens
agcttcagttgttc

SEQ ID NO: 808557 - DNA, 17 bp, Homo sapiens
agcttcagttgttcttt

SEQ ID NO: 808558 - DNA, 17 bp, Homo sapiens
agcttcatgcctttgta

SEQ ID NO: 808559 - DNA, 18 bp, Homo sapiens
agcttcatgcctttgtaa

SEQ ID NO: 808560 - DNA, 20 bp, Homo sapiens
agcttcatgtggcttccctt

SEQ ID NO: 808561 - DNA, 22 bp, Homo sapiens
agcttcattatctgagttgcat

SEQ ID NO: 808562 - DNA, 16 bp, Homo sapiens
agcttcattctccttg

SEQ ID NO: 808563 - DNA, 14 bp, Homo sapiens
agcttccaaagcct

SEQ ID NO: 808564 - DNA, 16 bp, Homo sapiens
agcttccaaagcctag

SEQ ID NO: 808565 - DNA, 19 bp, Homo sapiens
agcttccaaagcctagaca

SEQ ID NO: 808566 - DNA, 11 bp, Homo sapiens
agcttccaaat

SEQ ID NO: 808567 - DNA, 14 bp, Homo sapiens
agcttccacctcat

SEQ ID NO: 808568 - DNA, 15 bp, Homo sapiens
agcttccacctcatg

SEQ ID NO: 808569 - DNA, 13 bp, Homo sapiens
agcttccctccat

SEQ ID NO: 808570 - DNA, 14 bp, Homo sapiens
agcttcctcacacc

SEQ ID NO: 808571 - DNA, 24 bp, Homo sapiens
agcttcctcacacccctgtcccac

SEQ ID NO: 808572 - DNA, 13 bp, Homo sapiens
agcttcctccaga

SEQ ID NO: 808573 - DNA, 18 bp, Homo sapiens
agcttcctccagaggagg

SEQ ID NO: 808574 - DNA, 16 bp, Homo sapiens
agcttcctgagggcta

SEQ ID NO: 808575 - DNA, 21 bp, Homo sapiens
agcttcctgctgctggggcca

SEQ ID NO: 808576 - DNA, 18 bp, Homo sapiens
agcttcctggctctgggg

SEQ ID NO: 808577 - DNA, 17 bp, Homo sapiens
agcttcctgtctgttta

SEQ ID NO: 808578 - DNA, 22 bp, Homo sapiens
agcttcctgtgccctcacccca

SEQ ID NO: 808579 - DNA, 19 bp, Homo sapiens
agcttcggagggcccctgc

SEQ ID NO: 808580 - DNA, 15 bp, Homo sapiens
agcttcggggccggt

SEQ ID NO: 808581 - DNA, 17 bp, Homo sapiens
agcttcggggccggtga

SEQ ID NO: 808582 - DNA, 16 bp, Homo sapiens
agcttcggtgtgcaga

SEQ ID NO: 808583 - DNA, 17 bp, Homo sapiens
agcttcggtgtgcagat

SEQ ID NO: 808584 - DNA, 14 bp, Homo sapiens
agcttcgtgctgga

SEQ ID NO: 808585 - DNA, 16 bp, Homo sapiens
agcttcgtgctggagg

SEQ ID NO: 808586 - DNA, 17 bp, Homo sapiens
agcttcgtgctggagga

SEQ ID NO: 808587 - DNA, 22 bp, Homo sapiens
agcttcgttagaatgtctgcct

SEQ ID NO: 808588 - DNA, 17 bp, Homo sapiens
agcttctaccatgaaca

SEQ ID NO: 808589 - DNA, 18 bp, Homo sapiens
agcttctagacagagttg

SEQ ID NO: 808590 - DNA, 23 bp, Homo sapiens
agcttctattatagccacatccc

SEQ ID NO: 808591 - DNA, 14 bp, Homo sapiens
agcttctccaggct

SEQ ID NO: 808592 - DNA, 16 bp, Homo sapiens
agcttctcctgtgtga

SEQ ID NO: 808593 - DNA, 21 bp, Homo sapiens
agcttctcctgtgtgattgac

SEQ ID NO: 808594 - DNA, 17 bp, Homo sapiens
agcttctctctccaggg

SEQ ID NO: 808595 - DNA, 18 bp, Homo sapiens
agcttctctctccctgtc

SEQ ID NO: 808596 - DNA, 23 bp, Homo sapiens
agcttctctctccctgtcacaca

SEQ ID NO: 808597 - DNA, 13 bp, Homo sapiens
agcttctctgcag

SEQ ID NO: 808598 - DNA, 19 bp, Homo sapiens
agcttctcttctttctgaa

SEQ ID NO: 808599 - DNA, 12 bp, Homo sapiens
agcttctgcttt

SEQ ID NO: 808600 - DNA, 14 bp, Homo sapiens
agcttctggtactc

SEQ ID NO: 808601 - DNA, 19 bp, Homo sapiens
agcttctggtactctccta

SEQ ID NO: 808602 - DNA, 13 bp, Homo sapiens
agcttctgttggc

SEQ ID NO: 808603 - DNA, 13 bp, Homo sapiens
agcttcttcacag

SEQ ID NO: 808604 - DNA, 15 bp, Homo sapiens
agcttcttcagagtg

SEQ ID NO: 808605 - DNA, 19 bp, Homo sapiens
agcttcttcagagtgaaga

SEQ ID NO: 808606 - DNA, 19 bp, Homo sapiens
agcttcttgcactccttcc

SEQ ID NO: 808607 - DNA, 13 bp, Homo sapiens
agcttcttgggct

SEQ ID NO: 808608 - DNA, 15 bp, Homo sapiens
agcttcttgggctga

SEQ ID NO: 808609 - DNA, 23 bp, Homo sapiens
agcttcttgggctgagtgcagcc

SEQ ID NO: 808610 - DNA, 18 bp, Homo sapiens
agcttcttgtttccttgt

SEQ ID NO: 808611 - DNA, 16 bp, Homo sapiens
agcttgaaagttttca

SEQ ID NO: 808612 - DNA, 17 bp, Homo sapiens
agcttgaaagttttcag

SEQ ID NO: 808613 - DNA, 22 bp, Homo sapiens
agcttgaaagttttcagaacct

SEQ ID NO: 808614 - DNA, 18 bp, Homo sapiens
agcttgaacctgcttcct

SEQ ID NO: 808615 - DNA, 22 bp, Homo sapiens
agcttgaagatcgttagtatct

SEQ ID NO: 808616 - DNA, 19 bp, Homo sapiens
agcttgatctgtgatttct

SEQ ID NO: 808617 - DNA, 15 bp, Homo sapiens
agcttgattaaatca

SEQ ID NO: 808618 - DNA, 18 bp, Homo sapiens
agcttgatttgatctttg

SEQ ID NO: 808619 - DNA, 19 bp, Homo sapiens
agcttgatttgatctttgt

SEQ ID NO: 808620 - DNA, 20 bp, Homo sapiens
agcttgcaccttttcatgta

SEQ ID NO: 808621 - DNA, 20 bp, Homo sapiens
agcttgcagtccgttgctga

SEQ ID NO: 808622 - DNA, 22 bp, Homo sapiens
agcttgcagtccgttgctgaaa

SEQ ID NO: 808623 - DNA, 15 bp, Homo sapiens
agcttgccacactct

SEQ ID NO: 808624 - DNA, 19 bp, Homo sapiens
agcttgctccagattctga

SEQ ID NO: 808625 - DNA, 20 bp, Homo sapiens
agcttgctccagattctgat

SEQ ID NO: 808626 - DNA, 22 bp, Homo sapiens
agcttgctccagattctgatgc

SEQ ID NO: 808627 - DNA, 23 bp, Homo sapiens
agcttgctccagattctgatgca

SEQ ID NO: 808628 - DNA, 17 bp, Homo sapiens
agcttgctccctgtgtc

SEQ ID NO: 808629 - DNA, 14 bp, Homo sapiens
agcttgctcttcag

SEQ ID NO: 808630 - DNA, 20 bp, Homo sapiens
agcttgctgaggggcaggga

SEQ ID NO: 808631 - DNA, 15 bp, Homo sapiens
agcttgctgtcactt

SEQ ID NO: 808632 - DNA, 17 bp, Homo sapiens
agcttgctgtcacttct

SEQ ID NO: 808633 - DNA, 18 bp, Homo sapiens
agcttgctgtcacttctt

SEQ ID NO: 808634 - DNA, 19 bp, Homo sapiens
agcttgctgtcacttcttc

SEQ ID NO: 808635 - DNA, 23 bp, Homo sapiens
agcttgctgtcacttcttcacct

SEQ ID NO: 808636 - DNA, 16 bp, Homo sapiens
agcttggaggaagtat

SEQ ID NO: 808637 - DNA, 13 bp, Homo sapiens
agcttggcagccg

SEQ ID NO: 808638 - DNA, 17 bp, Homo sapiens
agcttggccctttcctt

SEQ ID NO: 808639 - DNA, 17 bp, Homo sapiens
agcttggccttgggccg

SEQ ID NO: 808640 - DNA, 12 bp, Homo sapiens
agcttgggactc

SEQ ID NO: 808641 - DNA, 18 bp, Homo sapiens
agcttgggaggcttcccc

SEQ ID NO: 808642 - DNA, 21 bp, Homo sapiens
agcttgggcagtgccccaggg

SEQ ID NO: 808643 - DNA, 10 bp, Homo sapiens
agcttgggcc

SEQ ID NO: 808644 - DNA, 16 bp, Homo sapiens
agcttgggcccagctg

SEQ ID NO: 808645 - DNA, 23 bp, Homo sapiens
agcttgggcccagctgggctctg

SEQ ID NO: 808646 - DNA, 17 bp, Homo sapiens
agcttgggcttcttcct

SEQ ID NO: 808647 - DNA, 20 bp, Homo sapiens
agcttggggccaccaaagct

SEQ ID NO: 808648 - DNA, 21 bp, Homo sapiens
agcttggggccaccaaagctg

SEQ ID NO: 808649 - DNA, 17 bp, Homo sapiens
agcttgggtcaggttct

SEQ ID NO: 808650 - DNA, 20 bp, Homo sapiens
agcttgggtcaggttcttgc

SEQ ID NO: 808651 - DNA, 21 bp, Homo sapiens
agcttgggtcaggttcttgcc

SEQ ID NO: 808652 - DNA, 22 bp, Homo sapiens
agcttgggtcaggttcttgcct

SEQ ID NO: 808653 - DNA, 18 bp, Homo sapiens
agcttgggtttttgttac

SEQ ID NO: 808654 - DNA, 17 bp, Homo sapiens
agcttgtaggagctgag

SEQ ID NO: 808655 - DNA, 15 bp, Homo sapiens
agcttgtcaaagatg

SEQ ID NO: 808656 - DNA, 19 bp, Homo sapiens
agcttgtcattgagcctgg

SEQ ID NO: 808657 - DNA, 14 bp, Homo sapiens
agcttgtgattcct

SEQ ID NO: 808658 - DNA, 18 bp, Homo sapiens
agcttgtgattcctaccc

SEQ ID NO: 808659 - DNA, 18 bp, Homo sapiens
agcttgtgctcctcttga

SEQ ID NO: 808660 - DNA, 18 bp, Homo sapiens
agcttgtggcaagtgaat

SEQ ID NO: 808661 - DNA, 14 bp, Homo sapiens
agcttgtggcccct

SEQ ID NO: 808662 - DNA, 18 bp, Homo sapiens
agcttgtggcccctttta

SEQ ID NO: 808663 - DNA, 18 bp, Homo sapiens
agcttgtgtcctgtcctt

SEQ ID NO: 808664 - DNA, 17 bp, Homo sapiens
agcttgttccctgtctt

SEQ ID NO: 808665 - DNA, 15 bp, Homo sapiens
agcttgtttctgtca

SEQ ID NO: 808666 - DNA, 19 bp, Homo sapiens
agctttaaaagtatcttta

SEQ ID NO: 808667 - DNA, 19 bp, Homo sapiens
agctttaaactcagggaca

SEQ ID NO: 808668 - DNA, 21 bp, Homo sapiens
agctttaaactcagggacaga

SEQ ID NO: 808669 - DNA, 12 bp, Homo sapiens
agctttaaatta

SEQ ID NO: 808670 - DNA, 18 bp, Homo sapiens
agctttaacttaaatagt

SEQ ID NO: 808671 - DNA, 15 bp, Homo sapiens
agctttactgtttct

SEQ ID NO: 808672 - DNA, 16 bp, Homo sapiens
agctttactgtttctc

SEQ ID NO: 808673 - DNA, 17 bp, Homo sapiens
agctttactgtttctca

SEQ ID NO: 808674 - DNA, 18 bp, Homo sapiens
agctttactgtttctcaa

SEQ ID NO: 808675 - DNA, 15 bp, Homo sapiens
agctttactgtttgt

SEQ ID NO: 808676 - DNA, 16 bp, Homo sapiens
agctttagacagcaga

SEQ ID NO: 808677 - DNA, 22 bp, Homo sapiens
aggacatgagtctgtaggagca

SEQ ID NO: 808678 - DNA, 22 bp, Homo sapiens
aggacatgatactgatgccatg

SEQ ID NO: 808679 - DNA, 23 bp, Homo sapiens
aggacatgcgtgtgtcagggatg

SEQ ID NO: 808680 - DNA, 21 bp, Homo sapiens
aggacatgtttttgttttctt

SEQ ID NO: 808681 - DNA, 14 bp, Homo sapiens
aggacattcactgc

SEQ ID NO: 808682 - DNA, 15 bp, Homo sapiens
aggacattcactgct

SEQ ID NO: 808683 - DNA, 21 bp, Homo sapiens
aggacattgtatgcagggagc

SEQ ID NO: 808684 - DNA, 18 bp, Homo sapiens
aggacatttatgattgtc

SEQ ID NO: 808685 - DNA, 21 bp, Homo sapiens
aggaccaaaaaacctcactgg

SEQ ID NO: 808686 - DNA, 17 bp, Homo sapiens
aggaccaactggcttct

SEQ ID NO: 808687 - DNA, 23 bp, Homo sapiens
aggaccaactggcttctgtgcac

SEQ ID NO: 808688 - DNA, 14 bp, Homo sapiens
aggaccaagggggc

SEQ ID NO: 808689 - DNA, 20 bp, Homo sapiens
aggaccaattgactctcaca

SEQ ID NO: 808690 - DNA, 17 bp, Homo sapiens
aggaccactcagcccct

SEQ ID NO: 808691 - DNA, 20 bp, Homo sapiens
aggaccagagcggtatctct

SEQ ID NO: 808692 - DNA, 20 bp, Homo sapiens
aggaccagattgctctgccc

SEQ ID NO: 808693 - DNA, 23 bp, Homo sapiens
aggaccaggactatagcccaggt

SEQ ID NO: 808694 - DNA, 19 bp, Homo sapiens
aggaccaggactccctcct

SEQ ID NO: 808695 - DNA, 12 bp, Homo sapiens
aggaccagggcc

SEQ ID NO: 808696 - DNA, 13 bp, Homo sapiens
aggaccaggggcc

SEQ ID NO: 808697 - DNA, 17 bp, Homo sapiens
aggaccagggtggagct

SEQ ID NO: 808698 - DNA, 20 bp, Homo sapiens
aggaccatcagagaggcaag

SEQ ID NO: 808699 - DNA, 16 bp, Homo sapiens
aggacccacccatctt

SEQ ID NO: 808700 - DNA, 20 bp, Homo sapiens
aggacccacccatcttcctg

SEQ ID NO: 808701 - DNA, 22 bp, Homo sapiens
aggacccacccatcttcctgct

SEQ ID NO: 808702 - DNA, 15 bp, Homo sapiens
aggacccagaggaag

SEQ ID NO: 808703 - DNA, 13 bp, Homo sapiens
aggacccaggaca

SEQ ID NO: 808704 - DNA, 14 bp, Homo sapiens
aggacccaggacag

SEQ ID NO: 808705 - DNA, 13 bp, Homo sapiens
aggacccaggccc

SEQ ID NO: 808706 - DNA, 15 bp, Homo sapiens
aggacccaggccctc

SEQ ID NO: 808707 - DNA, 16 bp, Homo sapiens
aggacccaggccctcc

SEQ ID NO: 808708 - DNA, 18 bp, Homo sapiens
aggacccagggtcccctc

SEQ ID NO: 808709 - DNA, 21 bp, Homo sapiens
aggacccagggtcccctcccc

SEQ ID NO: 808710 - DNA, 14 bp, Homo sapiens
aggaccccagggtg

SEQ ID NO: 808711 - DNA, 16 bp, Homo sapiens
aggacccccttcccct

SEQ ID NO: 808712 - DNA, 17 bp, Homo sapiens
aggacccccttccccta

SEQ ID NO: 808713 - DNA, 17 bp, Homo sapiens
aggacccctcaccaccc

SEQ ID NO: 808714 - DNA, 15 bp, Homo sapiens
aggacccctcacctt

SEQ ID NO: 808715 - DNA, 18 bp, Homo sapiens
aggacccctgccttcctc

SEQ ID NO: 808716 - DNA, 19 bp, Homo sapiens
aggacccctgccttcctct

SEQ ID NO: 808717 - DNA, 16 bp, Homo sapiens
aggacccctgtccagg

SEQ ID NO: 808718 - DNA, 15 bp, Homo sapiens
aggacccgccagccc

SEQ ID NO: 808719 - DNA, 17 bp, Homo sapiens
aggacccgcctgctccc

SEQ ID NO: 808720 - DNA, 22 bp, Homo sapiens
aggaccctccactcactgctgt

SEQ ID NO: 808721 - DNA, 22 bp, Homo sapiens
aggaccctgacctccgcccctg

SEQ ID NO: 808722 - DNA, 17 bp, Homo sapiens
aggaccctgtcctgcag

SEQ ID NO: 808723 - DNA, 22 bp, Homo sapiens
aggaccctgtcctgcagtccca

SEQ ID NO: 808724 - DNA, 14 bp, Homo sapiens
aggaccctgtttct

SEQ ID NO: 808725 - DNA, 23 bp, Homo sapiens
aggaccgttttgtattgcttcct

SEQ ID NO: 808726 - DNA, 19 bp, Homo sapiens
aggacctagctgttgtaaa

SEQ ID NO: 808727 - DNA, 13 bp, Homo sapiens
aggacctcccttc

SEQ ID NO: 808728 - DNA, 14 bp, Homo sapiens
aggacctcgtgcca

SEQ ID NO: 808729 - DNA, 19 bp, Homo sapiens
aggacctctgtaggcagca

SEQ ID NO: 808730 - DNA, 20 bp, Homo sapiens
aggacctgagtttgggagag

SEQ ID NO: 808731 - DNA, 14 bp, Homo sapiens
aggacctgcctagc

SEQ ID NO: 808732 - DNA, 23 bp, Homo sapiens
aggacctggcgtgctcagaccca

SEQ ID NO: 808733 - DNA, 17 bp, Homo sapiens
aggacctggctgccata

SEQ ID NO: 808734 - DNA, 19 bp, Homo sapiens
aggacctgggacctcccct

SEQ ID NO: 808735 - DNA, 13 bp, Homo sapiens
aggacctggggca

SEQ ID NO: 808736 - DNA, 17 bp, Homo sapiens
aggacctggggcacagt

SEQ ID NO: 808737 - DNA, 20 bp, Homo sapiens
aggaccttgggcacatctgc

SEQ ID NO: 808738 - DNA, 15 bp, Homo sapiens
aggaccttgggccaa

SEQ ID NO: 808739 - DNA, 16 bp, Homo sapiens
aggacgccactcattt

SEQ ID NO: 808740 - DNA, 19 bp, Homo sapiens
aggacgctgaccgtggagc

SEQ ID NO: 808741 - DNA, 14 bp, Homo sapiens
aggacgcttctgaa

SEQ ID NO: 808742 - DNA, 14 bp, Homo sapiens
aggacggccctgcc

SEQ ID NO: 808743 - DNA, 16 bp, Homo sapiens
aggacggccctgcctg

SEQ ID NO: 808744 - DNA, 19 bp, Homo sapiens
aggacggtgccaagggccc

SEQ ID NO: 808745 - DNA, 20 bp, Homo sapiens
aggacggttgtaagcagttg

SEQ ID NO: 808746 - DNA, 21 bp, Homo sapiens
aggacggttgtaagcagttgt

SEQ ID NO: 808747 - DNA, 15 bp, Homo sapiens
aggacgtaaaattta

SEQ ID NO: 808748 - DNA, 21 bp, Homo sapiens
aggacgtcatcggaggctggg

SEQ ID NO: 808749 - DNA, 15 bp, Homo sapiens
aggacgtccttccat

SEQ ID NO: 808750 - DNA, 20 bp, Homo sapiens
aggactaacataaaatctgt

SEQ ID NO: 808751 - DNA, 17 bp, Homo sapiens
aggactaatagaaaagt

SEQ ID NO: 808752 - DNA, 16 bp, Homo sapiens
aggactaccgcaggcc

SEQ ID NO: 808753 - DNA, 17 bp, Homo sapiens
aggactaccgcaggccc

SEQ ID NO: 808754 - DNA, 16 bp, Homo sapiens
aggactcaccctccac

SEQ ID NO: 808755 - DNA, 18 bp, Homo sapiens
aggactccaggcagcaga

SEQ ID NO: 808756 - DNA, 16 bp, Homo sapiens
aggactccaggcccaa

SEQ ID NO: 808757 - DNA, 17 bp, Homo sapiens
aggactccatttctttc

SEQ ID NO: 808758 - DNA, 18 bp, Homo sapiens
aggactccatttctttct

SEQ ID NO: 808759 - DNA, 19 bp, Homo sapiens
aggactccatttctttctt

SEQ ID NO: 808760 - DNA, 17 bp, Homo sapiens
aggactcccaaccctgg

SEQ ID NO: 808761 - DNA, 18 bp, Homo sapiens
aggactcccaaccctggc

SEQ ID NO: 808762 - DNA, 20 bp, Homo sapiens
aggactcccaaccctggctt

SEQ ID NO: 808763 - DNA, 16 bp, Homo sapiens
aggactccccaggcca

SEQ ID NO: 808764 - DNA, 15 bp, Homo sapiens
aggactccctcctca

SEQ ID NO: 808765 - DNA, 16 bp, Homo sapiens
aggactccctcctcac

SEQ ID NO: 808766 - DNA, 18 bp, Homo sapiens
aggactccgggaccattg

SEQ ID NO: 808767 - DNA, 16 bp, Homo sapiens
aggactcggccactgt

SEQ ID NO: 808768 - DNA, 20 bp, Homo sapiens
aggactcggccactgtgtct

SEQ ID NO: 808769 - DNA, 21 bp, Homo sapiens
aggactcggccactgtgtctc

SEQ ID NO: 808770 - DNA, 13 bp, Homo sapiens
aggactctgaggc

SEQ ID NO: 808771 - DNA, 19 bp, Homo sapiens
aggactctgcgggaggctg

SEQ ID NO: 808772 - DNA, 20 bp, Homo sapiens
aggactctgcgggaggctgg

SEQ ID NO: 808773 - DNA, 14 bp, Homo sapiens
aggactctgcttaa

SEQ ID NO: 808774 - DNA, 14 bp, Homo sapiens
aggactgaactcca

SEQ ID NO: 808775 - DNA, 15 bp, Homo sapiens
aggactgaactccat

SEQ ID NO: 808776 - DNA, 17 bp, Homo sapiens
aggactgaattgtcccc

SEQ ID NO: 808777 - DNA, 16 bp, Homo sapiens
aggactgactttgcca

SEQ ID NO: 808778 - DNA, 12 bp, Homo sapiens
aggactgagccc

SEQ ID NO: 808779 - DNA, 15 bp, Homo sapiens
aggactgagccccca

SEQ ID NO: 808780 - DNA, 16 bp, Homo sapiens
aggactgagcccccac

SEQ ID NO: 808781 - DNA, 15 bp, Homo sapiens
aggactgagccctct

SEQ ID NO: 808782 - DNA, 11 bp, Homo sapiens
aggactgaggg

SEQ ID NO: 808783 - DNA, 21 bp, Homo sapiens
aggactgcacagcgtcctgtc

SEQ ID NO: 808784 - DNA, 21 bp, Homo sapiens
aggactggtactcaagccagc

SEQ ID NO: 808785 - DNA, 14 bp, Homo sapiens
aggactgtaaacat

SEQ ID NO: 808786 - DNA, 23 bp, Homo sapiens
aggactgtcctcccacagacctg

SEQ ID NO: 808787 - DNA, 16 bp, Homo sapiens
aggactgtttcagtgt

SEQ ID NO: 808788 - DNA, 21 bp, Homo sapiens
aggactgttttttcctgagct

SEQ ID NO: 808789 - DNA, 22 bp, Homo sapiens
aggactgttttttcctgagctt

SEQ ID NO: 808790 - DNA, 18 bp, Homo sapiens
aggacttaacggctccag

SEQ ID NO: 808791 - DNA, 21 bp, Homo sapiens
aggacttaacggctccaggat

SEQ ID NO: 808792 - DNA, 16 bp, Homo sapiens
aggacttgaaagaaat

SEQ ID NO: 808793 - DNA, 23 bp, Homo sapiens
aggacttgccacccccagttcct

SEQ ID NO: 808794 - DNA, 19 bp, Homo sapiens
aggacttgctaaagcactt

SEQ ID NO: 808795 - DNA, 16 bp, Homo sapiens
aggacttggagggtct

SEQ ID NO: 808796 - DNA, 18 bp, Homo sapiens
aggacttggagggtctgg

SEQ ID NO: 808797 - DNA, 19 bp, Homo sapiens
aggacttggagggtctggg

SEQ ID NO: 808798 - DNA, 15 bp, Homo sapiens
aggattcccccagcc

SEQ ID NO: 808799 - DNA, 18 bp, Homo sapiens
aggattccccctgccctg

SEQ ID NO: 808800 - DNA, 23 bp, Homo sapiens
aggattccccctgccctgtgccg

SEQ ID NO: 808801 - DNA, 14 bp, Homo sapiens
aggattcccttctg

SEQ ID NO: 808802 - DNA, 16 bp, Homo sapiens
aggattccttaaacct

SEQ ID NO: 808803 - DNA, 22 bp, Homo sapiens
aggattctcatgggaaggggag

SEQ ID NO: 808804 - DNA, 18 bp, Homo sapiens
aggattctgttccctggg

SEQ ID NO: 808805 - DNA, 24 bp, Homo sapiens
aggattctttccccagaggctccc

SEQ ID NO: 808806 - DNA, 21 bp, Homo sapiens
aggattgaaaatgtccaggaa

SEQ ID NO: 808807 - DNA, 14 bp, Homo sapiens
aggattgaagagca

SEQ ID NO: 808808 - DNA, 19 bp, Homo sapiens
aggattgcttgagcccagg

SEQ ID NO: 808809 - DNA, 22 bp, Homo sapiens
aggattggatgttgtgtattgt

SEQ ID NO: 808810 - DNA, 21 bp, Homo sapiens
aggattggcaactcttcagac

SEQ ID NO: 808811 - DNA, 18 bp, Homo sapiens
aggatttaacagtcattt

SEQ ID NO: 808812 - DNA, 15 bp, Homo sapiens
aggatttataaagca

SEQ ID NO: 808813 - DNA, 19 bp, Homo sapiens
aggatttatgtattttgaa

SEQ ID NO: 808814 - DNA, 14 bp, Homo sapiens
aggatttcaagcct

SEQ ID NO: 808815 - DNA, 17 bp, Homo sapiens
aggatttcctggagtgc

SEQ ID NO: 808816 - DNA, 17 bp, Homo sapiens
aggatttcttcaaatct

SEQ ID NO: 808817 - DNA, 21 bp, Homo sapiens
aggatttcttcaaatctcagc

SEQ ID NO: 808818 - DNA, 16 bp, Homo sapiens
aggatttgacagcatt

SEQ ID NO: 808819 - DNA, 21 bp, Homo sapiens
aggattttaatttcaggaaaa

SEQ ID NO: 808820 - DNA, 17 bp, Homo sapiens
aggattttaccaaagca

SEQ ID NO: 808821 - DNA, 18 bp, Homo sapiens
aggattttaccaaagcat

SEQ ID NO: 808822 - DNA, 19 bp, Homo sapiens
aggatttttttcctcccca

SEQ ID NO: 808823 - DNA, 16 bp, Homo sapiens
aggatttttttctgag

SEQ ID NO: 808824 - DNA, 17 bp, Homo sapiens
aggatttttttctgagc

SEQ ID NO: 808825 - DNA, 15 bp, Homo sapiens
aggcaaaaaactctt

SEQ ID NO: 808826 - DNA, 22 bp, Homo sapiens
aggcaaaaatgtccagccaccc

SEQ ID NO: 808827 - DNA, 16 bp, Homo sapiens
aggcaaaagactggtt

SEQ ID NO: 808828 - DNA, 19 bp, Homo sapiens
aggcaaaatccttgcttat

SEQ ID NO: 808829 - DNA, 16 bp, Homo sapiens
aggcaaagtacaaaat

SEQ ID NO: 808830 - DNA, 16 bp, Homo sapiens
aggcaaatattgaagt

SEQ ID NO: 808831 - DNA, 17 bp, Homo sapiens
aggcaaatattgaagtt

SEQ ID NO: 808832 - DNA, 13 bp, Homo sapiens
aggcaaatgtgta

SEQ ID NO: 808833 - DNA, 14 bp, Homo sapiens
aggcaaatgtttat

SEQ ID NO: 808834 - DNA, 17 bp, Homo sapiens
aggcaactcatcttagg

SEQ ID NO: 808835 - DNA, 24 bp, Homo sapiens
aggcaactgacttcatttgtgcca

SEQ ID NO: 808836 - DNA, 14 bp, Homo sapiens
aggcaactgaggca

SEQ ID NO: 808837 - DNA, 15 bp, Homo sapiens
aggcaactgaggcag

SEQ ID NO: 808838 - DNA, 15 bp, Homo sapiens
aggcaacttttaaag

SEQ ID NO: 808839 - DNA, 14 bp, Homo sapiens
aggcaagaaaagga

SEQ ID NO: 808840 - DNA, 18 bp, Homo sapiens
aggcaagaaaaggacaaa

SEQ ID NO: 808841 - DNA, 12 bp, Homo sapiens
aggcaagagaat

SEQ ID NO: 808842 - DNA, 13 bp, Homo sapiens
aggcaagcccctc

SEQ ID NO: 808843 - DNA, 17 bp, Homo sapiens
aggcaagcccctcagcc

SEQ ID NO: 808844 - DNA, 23 bp, Homo sapiens
aggcaagcccctcagcccttgcc

SEQ ID NO: 808845 - DNA, 15 bp, Homo sapiens
aggcaagctgaaatt

SEQ ID NO: 808846 - DNA, 16 bp, Homo sapiens
aggcaagctgaaattt

SEQ ID NO: 808847 - DNA, 21 bp, Homo sapiens
aggcaagctgaaattttagaa

SEQ ID NO: 808848 - DNA, 18 bp, Homo sapiens
aggcaaggctgacttctc

SEQ ID NO: 808849 - DNA, 17 bp, Homo sapiens
aggcaaggttatatgca

SEQ ID NO: 808850 - DNA, 15 bp, Homo sapiens
aggcaagtttctagc

SEQ ID NO: 808851 - DNA, 15 bp, Homo sapiens
aggcaagtttgttca

SEQ ID NO: 808852 - DNA, 14 bp, Homo sapiens
aggcaataaaaatc

SEQ ID NO: 808853 - DNA, 15 bp, Homo sapiens
aggcaatcctacctt

SEQ ID NO: 808854 - DNA, 17 bp, Homo sapiens
aggcaatcttgccttct

SEQ ID NO: 808855 - DNA, 12 bp, Homo sapiens
aggcaattagac

SEQ ID NO: 808856 - DNA, 14 bp, Homo sapiens
aggcaattgattgt

SEQ ID NO: 808857 - DNA, 19 bp, Homo sapiens
aggcaattttagtgtatta

SEQ ID NO: 808858 - DNA, 20 bp, Homo sapiens
aggcaattttagtgtattaa

SEQ ID NO: 808859 - DNA, 18 bp, Homo sapiens
aggcacacaaggggccct

SEQ ID NO: 808860 - DNA, 23 bp, Homo sapiens
aggcacacagagattctggatct

SEQ ID NO: 808861 - DNA, 11 bp, Homo sapiens
aggcacacagc

SEQ ID NO: 808862 - DNA, 18 bp, Homo sapiens
aggcacacagcagccccc

SEQ ID NO: 808863 - DNA, 23 bp, Homo sapiens
aggcacacagcagccccccagca

SEQ ID NO: 808864 - DNA, 12 bp, Homo sapiens
aggcacacttct

SEQ ID NO: 808865 - DNA, 14 bp, Homo sapiens
aggcacagaggagg

SEQ ID NO: 808866 - DNA, 19 bp, Homo sapiens
aggcacagtgggagctgag

SEQ ID NO: 808867 - DNA, 21 bp, Homo sapiens
aggcacagtgggagctgagct

SEQ ID NO: 808868 - DNA, 17 bp, Homo sapiens
aggcaccaaaagaagta

SEQ ID NO: 808869 - DNA, 16 bp, Homo sapiens
aggcaccaccaggagc

SEQ ID NO: 808870 - DNA, 15 bp, Homo sapiens
aggcaccagctctgt

SEQ ID NO: 808871 - DNA, 16 bp, Homo sapiens
aggcaccagctctgtg

SEQ ID NO: 808872 - DNA, 19 bp, Homo sapiens
aggcaccagctctgtggcc

SEQ ID NO: 808873 - DNA, 20 bp, Homo sapiens
aggcaccagctctgtggcct

SEQ ID NO: 808874 - DNA, 14 bp, Homo sapiens
aggcaccaggaagc

SEQ ID NO: 808875 - DNA, 19 bp, Homo sapiens
aggcaccccctggagagaa

SEQ ID NO: 808876 - DNA, 20 bp, Homo sapiens
aggcaccccctggagagaag

SEQ ID NO: 808877 - DNA, 22 bp, Homo sapiens
aggcacccctccgtgtggagca

SEQ ID NO: 808878 - DNA, 20 bp, Homo sapiens
aggcacccggggccagagac

SEQ ID NO: 808879 - DNA, 22 bp, Homo sapiens
aggcacccggggccagagacat

SEQ ID NO: 808880 - DNA, 23 bp, Homo sapiens
aggcacccggggccagagacata

SEQ ID NO: 808881 - DNA, 13 bp, Homo sapiens
aggcaccctcagg

SEQ ID NO: 808882 - DNA, 15 bp, Homo sapiens
aggcaccgagaatgt

SEQ ID NO: 808883 - DNA, 20 bp, Homo sapiens
aggcaccgccacgtcccagc

SEQ ID NO: 808884 - DNA, 16 bp, Homo sapiens
aggcaccggcgctgca

SEQ ID NO: 808885 - DNA, 20 bp, Homo sapiens
aggcaccggcgctgcaggta

SEQ ID NO: 808886 - DNA, 16 bp, Homo sapiens
aggcaccgggctggct

SEQ ID NO: 808887 - DNA, 12 bp, Homo sapiens
aggcacctccag

SEQ ID NO: 808888 - DNA, 14 bp, Homo sapiens
aggcacctgctgga

SEQ ID NO: 808889 - DNA, 19 bp, Homo sapiens
aggcacctggcctgctggg

SEQ ID NO: 808890 - DNA, 16 bp, Homo sapiens
aggcacgggtggtccc

SEQ ID NO: 808891 - DNA, 20 bp, Homo sapiens
aggcactagtcaccgacagc

SEQ ID NO: 808892 - DNA, 13 bp, Homo sapiens
aggcactcagtga

SEQ ID NO: 808893 - DNA, 15 bp, Homo sapiens
aggcactctcctgtc

SEQ ID NO: 808894 - DNA, 18 bp, Homo sapiens
aggcactctcctgtctga

SEQ ID NO: 808895 - DNA, 16 bp, Homo sapiens
aggcactctgttattt

SEQ ID NO: 808896 - DNA, 19 bp, Homo sapiens
aggcactctgttatttaga

SEQ ID NO: 808897 - DNA, 18 bp, Homo sapiens
aggcactgaacaggctgg

SEQ ID NO: 808898 - DNA, 23 bp, Homo sapiens
aggcactgagataccagcgagga

SEQ ID NO: 808899 - DNA, 17 bp, Homo sapiens
aggcactgagggatctg

SEQ ID NO: 808900 - DNA, 19 bp, Homo sapiens
aggcactgagggatctgag

SEQ ID NO: 808901 - DNA, 16 bp, Homo sapiens
aggcactggtggcatc

SEQ ID NO: 808902 - DNA, 18 bp, Homo sapiens
aggcactgtggcccttct

SEQ ID NO: 808903 - DNA, 22 bp, Homo sapiens
aggcactttagggctgtaaaat

SEQ ID NO: 808904 - DNA, 18 bp, Homo sapiens
aggcacttttattttcat

SEQ ID NO: 808905 - DNA, 22 bp, Homo sapiens
aggcagaaacctatctcaggga

SEQ ID NO: 808906 - DNA, 19 bp, Homo sapiens
aggcagaaagcaaaattat

SEQ ID NO: 808907 - DNA, 15 bp, Homo sapiens
aggcagaactcagaa

SEQ ID NO: 808908 - DNA, 23 bp, Homo sapiens
aggcagaagaattgaacccagga

SEQ ID NO: 808909 - DNA, 15 bp, Homo sapiens
aggcagaatggctgc

SEQ ID NO: 808910 - DNA, 17 bp, Homo sapiens
aggcagaatggctgcac

SEQ ID NO: 808911 - DNA, 14 bp, Homo sapiens
aggcagacacaggg

SEQ ID NO: 808912 - DNA, 11 bp, Homo sapiens
aggcagacacg

SEQ ID NO: 808913 - DNA, 15 bp, Homo sapiens
aggcagacagcagct

SEQ ID NO: 808914 - DNA, 21 bp, Homo sapiens
aggcagacagcagctcaggca

SEQ ID NO: 808915 - DNA, 19 bp, Homo sapiens
aggcagacagcaggcagcg

SEQ ID NO: 808916 - DNA, 23 bp, Homo sapiens
aggcagacagcaggcagcgccaa

SEQ ID NO: 808917 - DNA, 18 bp, Homo sapiens
aggcagactacacaggat

SEQ ID NO: 808918 - DNA, 15 bp, Homo sapiens
aggcagagaaagaag

SEQ ID NO: 808919 - DNA, 19 bp, Homo sapiens
aggcagagaaagaagagac

SEQ ID NO: 808920 - DNA, 16 bp, Homo sapiens
aggccatgatggcctt

SEQ ID NO: 808921 - DNA, 19 bp, Homo sapiens
aggccatgattcgcccaaa

SEQ ID NO: 808922 - DNA, 22 bp, Homo sapiens
aggccatggcatccctttttca

SEQ ID NO: 808923 - DNA, 15 bp, Homo sapiens
aggccatgtggcctg

SEQ ID NO: 808924 - DNA, 18 bp, Homo sapiens
aggccatgtggcctgccc

SEQ ID NO: 808925 - DNA, 21 bp, Homo sapiens
aggccatgtggcctgcccagc

SEQ ID NO: 808926 - DNA, 13 bp, Homo sapiens
aggccattattgt

SEQ ID NO: 808927 - DNA, 21 bp, Homo sapiens
aggccattgggtttggggcca

SEQ ID NO: 808928 - DNA, 14 bp, Homo sapiens
aggccattgtgaac

SEQ ID NO: 808929 - DNA, 19 bp, Homo sapiens
aggccattgtgaaccaatg

SEQ ID NO: 808930 - DNA, 20 bp, Homo sapiens
aggccattgtgaaccaatgc

SEQ ID NO: 808931 - DNA, 14 bp, Homo sapiens
aggccatttttggt

SEQ ID NO: 808932 - DNA, 14 bp, Homo sapiens
aggcccaactgtga

SEQ ID NO: 808933 - DNA, 20 bp, Homo sapiens
aggcccaagagatgaagagt

SEQ ID NO: 808934 - DNA, 20 bp, Homo sapiens
aggcccaagagcagagtctg

SEQ ID NO: 808935 - DNA, 17 bp, Homo sapiens
aggcccaagagccctgt

SEQ ID NO: 808936 - DNA, 19 bp, Homo sapiens
aggcccaccatcaccaccg

SEQ ID NO: 808937 - DNA, 21 bp, Homo sapiens
aggcccaccatcaccaccgcc

SEQ ID NO: 808938 - DNA, 14 bp, Homo sapiens
aggcccacgaggag

SEQ ID NO: 808939 - DNA, 18 bp, Homo sapiens
aggcccactccccagccc

SEQ ID NO: 808940 - DNA, 19 bp, Homo sapiens
aggcccagcatgcaggtgg

SEQ ID NO: 808941 - DNA, 13 bp, Homo sapiens
aggcccagcattg

SEQ ID NO: 808942 - DNA, 22 bp, Homo sapiens
aggcccagcattgctggttcta

SEQ ID NO: 808943 - DNA, 16 bp, Homo sapiens
aggcccagccgcagga

SEQ ID NO: 808944 - DNA, 13 bp, Homo sapiens
aggcccagcctgt

SEQ ID NO: 808945 - DNA, 16 bp, Homo sapiens
aggcccagctgctccc

SEQ ID NO: 808946 - DNA, 15 bp, Homo sapiens
aggcccaggcaccac

SEQ ID NO: 808947 - DNA, 23 bp, Homo sapiens
aggcccaggcaccaccaggagca

SEQ ID NO: 808948 - DNA, 21 bp, Homo sapiens
aggcccaggccagccccccca

SEQ ID NO: 808949 - DNA, 15 bp, Homo sapiens
aggcccaggctggga

SEQ ID NO: 808950 - DNA, 19 bp, Homo sapiens
aggcccagggaggcagcgt

SEQ ID NO: 808951 - DNA, 23 bp, Homo sapiens
aggcccagtgacaaagactcctc

SEQ ID NO: 808952 - DNA, 12 bp, Homo sapiens
aggcccatctca

SEQ ID NO: 808953 - DNA, 22 bp, Homo sapiens
aggcccatctcaggtgccactc

SEQ ID NO: 808954 - DNA, 15 bp, Homo sapiens
aggcccatgccccct

SEQ ID NO: 808955 - DNA, 17 bp, Homo sapiens
aggcccatgctatgagt

SEQ ID NO: 808956 - DNA, 23 bp, Homo sapiens
aggccccaaaaccacagccctgt

SEQ ID NO: 808957 - DNA, 23 bp, Homo sapiens
aggccccaatcttgcccactggc

SEQ ID NO: 808958 - DNA, 14 bp, Homo sapiens
aggccccacgccct

SEQ ID NO: 808959 - DNA, 17 bp, Homo sapiens
aggccccacgccctctc

SEQ ID NO: 808960 - DNA, 17 bp, Homo sapiens
aggccccagacagggtg

SEQ ID NO: 808961 - DNA, 14 bp, Homo sapiens
aggccccagagact

SEQ ID NO: 808962 - DNA, 22 bp, Homo sapiens
aggccccagagactcagaggga

SEQ ID NO: 808963 - DNA, 14 bp, Homo sapiens
aggccccagagaga

SEQ ID NO: 808964 - DNA, 19 bp, Homo sapiens
aggccccagcctccaggcc

SEQ ID NO: 808965 - DNA, 19 bp, Homo sapiens
aggcccccaaacatagccc

SEQ ID NO: 808966 - DNA, 14 bp, Homo sapiens
aggcccccacttct

SEQ ID NO: 808967 - DNA, 17 bp, Homo sapiens
aggcccccacttgcctc

SEQ ID NO: 808968 - DNA, 14 bp, Homo sapiens
aggcccccagccca

SEQ ID NO: 808969 - DNA, 19 bp, Homo sapiens
aggcccccagcccagggct

SEQ ID NO: 808970 - DNA, 21 bp, Homo sapiens
aggcccccagtggggacaggg

SEQ ID NO: 808971 - DNA, 23 bp, Homo sapiens
aggccccccagaaagctgccaga

SEQ ID NO: 808972 - DNA, 22 bp, Homo sapiens
aggcccccggctttcctccgga

SEQ ID NO: 808973 - DNA, 17 bp, Homo sapiens
aggccccgcttgtccag

SEQ ID NO: 808974 - DNA, 20 bp, Homo sapiens
aggccccgcttgtccagcgc

SEQ ID NO: 808975 - DNA, 22 bp, Homo sapiens
aggccccgcttgtccagcgcct

SEQ ID NO: 808976 - DNA, 18 bp, Homo sapiens
aggcccctctgtggagcg

SEQ ID NO: 808977 - DNA, 13 bp, Homo sapiens
aggcccctgagga

SEQ ID NO: 808978 - DNA, 16 bp, Homo sapiens
aggcccctgaggactg

SEQ ID NO: 808979 - DNA, 20 bp, Homo sapiens
aggcccctgaggactggaga

SEQ ID NO: 808980 - DNA, 21 bp, Homo sapiens
aggcccctgaggactggagac

SEQ ID NO: 808981 - DNA, 16 bp, Homo sapiens
aggcccgcccgcccac

SEQ ID NO: 808982 - DNA, 19 bp, Homo sapiens
aggcccgccctctgcctcc

SEQ ID NO: 808983 - DNA, 17 bp, Homo sapiens
aggcccgcgggcacagc

SEQ ID NO: 808984 - DNA, 22 bp, Homo sapiens
aggcccgcttgctgggtacctg

SEQ ID NO: 808985 - DNA, 23 bp, Homo sapiens
aggcccgcttgctgggtacctgg

SEQ ID NO: 808986 - DNA, 19 bp, Homo sapiens
aggcccggaagcgccaggc

SEQ ID NO: 808987 - DNA, 23 bp, Homo sapiens
aggcccggaagcgccaggctgga

SEQ ID NO: 808988 - DNA, 13 bp, Homo sapiens
aggcccggggctg

SEQ ID NO: 808989 - DNA, 15 bp, Homo sapiens
aggcccggggctggc

SEQ ID NO: 808990 - DNA, 15 bp, Homo sapiens
aggcccgtcggagct

SEQ ID NO: 808991 - DNA, 23 bp, Homo sapiens
aggcccgtcggagctgcctgcag

SEQ ID NO: 808992 - DNA, 16 bp, Homo sapiens
aggcccgtgggcgcaa

SEQ ID NO: 808993 - DNA, 12 bp, Homo sapiens
aggccctccagt

SEQ ID NO: 808994 - DNA, 16 bp, Homo sapiens
aggccctccatgggct

SEQ ID NO: 808995 - DNA, 17 bp, Homo sapiens
aggccctccatgggcta

SEQ ID NO: 808996 - DNA, 23 bp, Homo sapiens
aggccctccctctactcttcctg

SEQ ID NO: 808997 - DNA, 16 bp, Homo sapiens
aggccctccctgtctc

SEQ ID NO: 808998 - DNA, 22 bp, Homo sapiens
aggccctccctgtctccagggc

SEQ ID NO: 808999 - DNA, 23 bp, Homo sapiens
aggccctcctctcccatccttga

SEQ ID NO: 809000 - DNA, 17 bp, Homo sapiens
aggccctcctgtgctgg

SEQ ID NO: 809001 - DNA, 21 bp, Homo sapiens
aggccctcctgtgctggggga

SEQ ID NO: 809002 - DNA, 18 bp, Homo sapiens
aggccctcggagctggct

SEQ ID NO: 809003 - DNA, 15 bp, Homo sapiens
aggccctctgcctgc

SEQ ID NO: 809004 - DNA, 16 bp, Homo sapiens
aggccctctgcctgca

SEQ ID NO: 809005 - DNA, 21 bp, Homo sapiens
aggccctctgcctgcactccc

SEQ ID NO: 809006 - DNA, 13 bp, Homo sapiens
aggccctctggag

SEQ ID NO: 809007 - DNA, 13 bp, Homo sapiens
aggccctctgtgg

SEQ ID NO: 809008 - DNA, 17 bp, Homo sapiens
aggccctctgtggcctg

SEQ ID NO: 809009 - DNA, 18 bp, Homo sapiens
aggccctgactcctctgg

SEQ ID NO: 809010 - DNA, 15 bp, Homo sapiens
aggccctgaggcgga

SEQ ID NO: 809011 - DNA, 23 bp, Homo sapiens
aggccctgccacgtcccgctgcc

SEQ ID NO: 809012 - DNA, 22 bp, Homo sapiens
aggccctgcctccgggaggtca

SEQ ID NO: 809013 - DNA, 12 bp, Homo sapiens
aggccctgcctg

SEQ ID NO: 809014 - DNA, 22 bp, Homo sapiens
aggccctgcctgacccatccct

SEQ ID NO: 809015 - DNA, 19 bp, Homo sapiens
aggccctgctcctgcagca

SEQ ID NO: 809016 - DNA, 15 bp, Homo sapiens
aggccctggcctccc

SEQ ID NO: 809017 - DNA, 12 bp, Homo sapiens
aggccctgggct

SEQ ID NO: 809018 - DNA, 19 bp, Homo sapiens
aggccctggtgtcaggcag

SEQ ID NO: 809019 - DNA, 20 bp, Homo sapiens
aggccctggtgtcaggcagg

SEQ ID NO: 809020 - DNA, 11 bp, Homo sapiens
aggccctgtga

SEQ ID NO: 809021 - DNA, 20 bp, Homo sapiens
aggccctgtggtctggggag

SEQ ID NO: 809022 - DNA, 17 bp, Homo sapiens
aggccctgttccctgga

SEQ ID NO: 809023 - DNA, 22 bp, Homo sapiens
aggcccttattttcaagaaact

SEQ ID NO: 809024 - DNA, 15 bp, Homo sapiens
aggcccttcctctcc

SEQ ID NO: 809025 - DNA, 17 bp, Homo sapiens
aggcccttcctctccac

SEQ ID NO: 809026 - DNA, 14 bp, Homo sapiens
aggcccttggctgc

SEQ ID NO: 809027 - DNA, 16 bp, Homo sapiens
aggcccttggctgcag

SEQ ID NO: 809028 - DNA, 17 bp, Homo sapiens
aggcccttgtcctgcca

SEQ ID NO: 809029 - DNA, 23 bp, Homo sapiens
aggcccttgtcctgccagctgcc

SEQ ID NO: 809030 - DNA, 17 bp, Homo sapiens
aggcccttgtcgtggga

SEQ ID NO: 809031 - DNA, 21 bp, Homo sapiens
aggccctttgaagcctcagct

SEQ ID NO: 809032 - DNA, 15 bp, Homo sapiens
aggccgaagctctgg

SEQ ID NO: 809033 - DNA, 17 bp, Homo sapiens
aggccgaagctctggct

SEQ ID NO: 809034 - DNA, 20 bp, Homo sapiens
aggccgacgttttctccgca

SEQ ID NO: 809035 - DNA, 14 bp, Homo sapiens
aggccgaggcagga

SEQ ID NO: 809036 - DNA, 16 bp, Homo sapiens
aggccgaggcgggtgg

SEQ ID NO: 809037 - DNA, 16 bp, Homo sapiens
aggccgagggccaggc

SEQ ID NO: 809038 - DNA, 19 bp, Homo sapiens
aggccgagggccaggcaga

SEQ ID NO: 809039 - DNA, 21 bp, Homo sapiens
aggccgcagctcttgcccttc

SEQ ID NO: 809040 - DNA, 22 bp, Homo sapiens
aggccgcagctcttgcccttcc

SEQ ID NO: 809041 - DNA, 18 bp, Homo sapiens
aggctcttcctggacctg

SEQ ID NO: 809042 - DNA, 19 bp, Homo sapiens
aggctcttcctggacctga

SEQ ID NO: 809043 - DNA, 18 bp, Homo sapiens
aggctctttctgggccaa

SEQ ID NO: 809044 - DNA, 20 bp, Homo sapiens
aggctctttctgggccaagt

SEQ ID NO: 809045 - DNA, 23 bp, Homo sapiens
aggctctttggggtcagccaggg

SEQ ID NO: 809046 - DNA, 20 bp, Homo sapiens
aggctgaaatatccacccag

SEQ ID NO: 809047 - DNA, 16 bp, Homo sapiens
aggctgaactcttcag

SEQ ID NO: 809048 - DNA, 18 bp, Homo sapiens
aggctgaactcttcagaa

SEQ ID NO: 809049 - DNA, 14 bp, Homo sapiens
aggctgaccaagag

SEQ ID NO: 809050 - DNA, 18 bp, Homo sapiens
aggctgaccaagagagaa

SEQ ID NO: 809051 - DNA, 19 bp, Homo sapiens
aggctgaccaagagagaaa

SEQ ID NO: 809052 - DNA, 13 bp, Homo sapiens
aggctgaccacag

SEQ ID NO: 809053 - DNA, 16 bp, Homo sapiens
aggctgaccacagcac

SEQ ID NO: 809054 - DNA, 20 bp, Homo sapiens
aggctgacgtgtgagggagg

SEQ ID NO: 809055 - DNA, 21 bp, Homo sapiens
aggctgagaactcgttcacct

SEQ ID NO: 809056 - DNA, 14 bp, Homo sapiens
aggctgagacagga

SEQ ID NO: 809057 - DNA, 13 bp, Homo sapiens
aggctgaggcagg

SEQ ID NO: 809058 - DNA, 14 bp, Homo sapiens
aggctgaggcagga

SEQ ID NO: 809059 - DNA, 16 bp, Homo sapiens
aggctgaggcaggaga

SEQ ID NO: 809060 - DNA, 14 bp, Homo sapiens
aggctgaggcctgg

SEQ ID NO: 809061 - DNA, 16 bp, Homo sapiens
aggctgaggcctggac

SEQ ID NO: 809062 - DNA, 17 bp, Homo sapiens
aggctgaggcctggact

SEQ ID NO: 809063 - DNA, 11 bp, Homo sapiens
aggctgaggcg

SEQ ID NO: 809064 - DNA, 15 bp, Homo sapiens
aggctgaggctggca

SEQ ID NO: 809065 - DNA, 18 bp, Homo sapiens
aggctgaggctggcacag

SEQ ID NO: 809066 - DNA, 14 bp, Homo sapiens
aggctgagtccaga

SEQ ID NO: 809067 - DNA, 17 bp, Homo sapiens
aggctgcaaaattaaat

SEQ ID NO: 809068 - DNA, 22 bp, Homo sapiens
aggctgcaaggtttaggctggt

SEQ ID NO: 809069 - DNA, 19 bp, Homo sapiens
aggctgcacccctgggcca

SEQ ID NO: 809070 - DNA, 17 bp, Homo sapiens
aggctgcactgcagtga

SEQ ID NO: 809071 - DNA, 19 bp, Homo sapiens
aggctgcactgcagtgatg

SEQ ID NO: 809072 - DNA, 14 bp, Homo sapiens
aggctgcactggag

SEQ ID NO: 809073 - DNA, 17 bp, Homo sapiens
aggctgcactggagcca

SEQ ID NO: 809074 - DNA, 17 bp, Homo sapiens
aggctgcagaaggccaa

SEQ ID NO: 809075 - DNA, 21 bp, Homo sapiens
aggctgcagaaggccaagaat

SEQ ID NO: 809076 - DNA, 14 bp, Homo sapiens
aggctgcagagccc

SEQ ID NO: 809077 - DNA, 19 bp, Homo sapiens
aggctgcagagctgaccca

SEQ ID NO: 809078 - DNA, 20 bp, Homo sapiens
aggctgcagagctgacccag

SEQ ID NO: 809079 - DNA, 11 bp, Homo sapiens
aggctgcagca

SEQ ID NO: 809080 - DNA, 23 bp, Homo sapiens
aggctgcagcaggtgctgggctg

SEQ ID NO: 809081 - DNA, 14 bp, Homo sapiens
aggctgcagctgga

SEQ ID NO: 809082 - DNA, 15 bp, Homo sapiens
aggctgcagctggac

SEQ ID NO: 809083 - DNA, 17 bp, Homo sapiens
aggctgcagctggacag

SEQ ID NO: 809084 - DNA, 22 bp, Homo sapiens
aggctgcagctggacagagggg

SEQ ID NO: 809085 - DNA, 15 bp, Homo sapiens
aggctgcaggagggc

SEQ ID NO: 809086 - DNA, 15 bp, Homo sapiens
aggctgcatgctctg

SEQ ID NO: 809087 - DNA, 16 bp, Homo sapiens
aggctgcatgctctgg

SEQ ID NO: 809088 - DNA, 17 bp, Homo sapiens
aggctgcatgctctgga

SEQ ID NO: 809089 - DNA, 20 bp, Homo sapiens
aggctgcatgctctggaagc

SEQ ID NO: 809090 - DNA, 17 bp, Homo sapiens
aggctgccaaggccaga

SEQ ID NO: 809091 - DNA, 13 bp, Homo sapiens
aggctgccccagg

SEQ ID NO: 809092 - DNA, 23 bp, Homo sapiens
aggctgccccaggccggagccca

SEQ ID NO: 809093 - DNA, 19 bp, Homo sapiens
aggctgcccccatccagcc

SEQ ID NO: 809094 - DNA, 17 bp, Homo sapiens
aggctgccctgaggggc

SEQ ID NO: 809095 - DNA, 19 bp, Homo sapiens
aggctgccctgaggggctg

SEQ ID NO: 809096 - DNA, 18 bp, Homo sapiens
aggctgcctcagccagtg

SEQ ID NO: 809097 - DNA, 20 bp, Homo sapiens
aggctgcctcggactccatg

SEQ ID NO: 809098 - DNA, 18 bp, Homo sapiens
aggctgcctgctgtgctg

SEQ ID NO: 809099 - DNA, 10 bp, Homo sapiens
aggctgctag

SEQ ID NO: 809100 - DNA, 16 bp, Homo sapiens
aggctgctctgcctgt

SEQ ID NO: 809101 - DNA, 18 bp, Homo sapiens
aggctgctggagtgcagt

SEQ ID NO: 809102 - DNA, 11 bp, Homo sapiens
aggctgctggc

SEQ ID NO: 809103 - DNA, 14 bp, Homo sapiens
aggctgcttagaat

SEQ ID NO: 809104 - DNA, 22 bp, Homo sapiens
aggctgcttagaatccaaactt

SEQ ID NO: 809105 - DNA, 23 bp, Homo sapiens
aggctgcttctctacagaggtga

SEQ ID NO: 809106 - DNA, 13 bp, Homo sapiens
aggctggaagcca

SEQ ID NO: 809107 - DNA, 16 bp, Homo sapiens
aggctggaatgaggga

SEQ ID NO: 809108 - DNA, 17 bp, Homo sapiens
aggctggaatgagggag

SEQ ID NO: 809109 - DNA, 18 bp, Homo sapiens
aggctggaatgagggagg

SEQ ID NO: 809110 - DNA, 13 bp, Homo sapiens
aggctggagaagc

SEQ ID NO: 809111 - DNA, 15 bp, Homo sapiens
aggctggagactgga

SEQ ID NO: 809112 - DNA, 17 bp, Homo sapiens
aggctggagctggcgtc

SEQ ID NO: 809113 - DNA, 20 bp, Homo sapiens
aggctggaggacagtggcac

SEQ ID NO: 809114 - DNA, 18 bp, Homo sapiens
aggctggaggcagggcct

SEQ ID NO: 809115 - DNA, 17 bp, Homo sapiens
aggctggagtgcagtga

SEQ ID NO: 809116 - DNA, 20 bp, Homo sapiens
aggctggagtgcagtggcat

SEQ ID NO: 809117 - DNA, 23 bp, Homo sapiens
aggctggatcttggagaatgtga

SEQ ID NO: 809118 - DNA, 16 bp, Homo sapiens
aggctggatggcacct

SEQ ID NO: 809119 - DNA, 21 bp, Homo sapiens
aggctggcaagataaacactt

SEQ ID NO: 809120 - DNA, 18 bp, Homo sapiens
aggctggcaccatggtga

SEQ ID NO: 809121 - DNA, 19 bp, Homo sapiens
aggctggcaccgccttctc

SEQ ID NO: 809122 - DNA, 20 bp, Homo sapiens
aggctggcaccgccttctct

SEQ ID NO: 809123 - DNA, 19 bp, Homo sapiens
aggctggcagctctccagt

SEQ ID NO: 809124 - DNA, 20 bp, Homo sapiens
aggctggcagctctccagtc

SEQ ID NO: 809125 - DNA, 21 bp, Homo sapiens
aggctggcagctctccagtca

SEQ ID NO: 809126 - DNA, 15 bp, Homo sapiens
aggctggcaggtatg

SEQ ID NO: 809127 - DNA, 21 bp, Homo sapiens
aggctggccaaggtgtccagg

SEQ ID NO: 809128 - DNA, 20 bp, Homo sapiens
aggctggccagcaaggcagg

SEQ ID NO: 809129 - DNA, 21 bp, Homo sapiens
aggctggccagcaaggcaggt

SEQ ID NO: 809130 - DNA, 15 bp, Homo sapiens
aggctggccagtcca

SEQ ID NO: 809131 - DNA, 21 bp, Homo sapiens
aggctggccagtccaggctgc

SEQ ID NO: 809132 - DNA, 19 bp, Homo sapiens
aggctggcgcagccaaggc

SEQ ID NO: 809133 - DNA, 18 bp, Homo sapiens
aggctggctgagtggaat

SEQ ID NO: 809134 - DNA, 18 bp, Homo sapiens
aggctgggaactcatctg

SEQ ID NO: 809135 - DNA, 23 bp, Homo sapiens
aggctgggcacggctccgagggc

SEQ ID NO: 809136 - DNA, 12 bp, Homo sapiens
aggctgggccat

SEQ ID NO: 809137 - DNA, 18 bp, Homo sapiens
aggctgggccatgtccaa

SEQ ID NO: 809138 - DNA, 14 bp, Homo sapiens
aggctgggcccctg

SEQ ID NO: 809139 - DNA, 21 bp, Homo sapiens
aggctgggccgcaagggcctg

SEQ ID NO: 809140 - DNA, 20 bp, Homo sapiens
aggctgggcctcccctgggc

SEQ ID NO: 809141 - DNA, 17 bp, Homo sapiens
aggctgggctctgcctg

SEQ ID NO: 809142 - DNA, 21 bp, Homo sapiens
aggctgggctctgcctgtctg

SEQ ID NO: 809143 - DNA, 18 bp, Homo sapiens
aggctggggaggccagtg

SEQ ID NO: 809144 - DNA, 16 bp, Homo sapiens
aggctggggaggtgct

SEQ ID NO: 809145 - DNA, 22 bp, Homo sapiens
aggctggggaggtgctggggga

SEQ ID NO: 809146 - DNA, 19 bp, Homo sapiens
aggctgggggagagccgtg

SEQ ID NO: 809147 - DNA, 21 bp, Homo sapiens
aggctggtctcaaactcctga

SEQ ID NO: 809148 - DNA, 22 bp, Homo sapiens
aggctggtctcaaactcctgac

SEQ ID NO: 809149 - DNA, 22 bp, Homo sapiens
aggctggtctcgaactcctgac

SEQ ID NO: 809150 - DNA, 22 bp, Homo sapiens
aggctggtcttgaactgggctc

SEQ ID NO: 809151 - DNA, 23 bp, Homo sapiens
aggctggtcttgaactgggctca

SEQ ID NO: 809152 - DNA, 12 bp, Homo sapiens
aggctggtgaca

SEQ ID NO: 809153 - DNA, 20 bp, Homo sapiens
aggctggtgctgtggccagg

SEQ ID NO: 809154 - DNA, 14 bp, Homo sapiens
aggctggtggccca

SEQ ID NO: 809155 - DNA, 17 bp, Homo sapiens
aggctggtggcccagga

SEQ ID NO: 809156 - DNA, 15 bp, Homo sapiens
aggctggtggccttg

SEQ ID NO: 809157 - DNA, 20 bp, Homo sapiens
aggctggttttggcatctct

SEQ ID NO: 809158 - DNA, 12 bp, Homo sapiens
aggctgtaacta

SEQ ID NO: 809159 - DNA, 21 bp, Homo sapiens
aggctgtaactgagagaaaga

SEQ ID NO: 809160 - DNA, 22 bp, Homo sapiens
aggctgtaagcattctgagctg

SEQ ID NO: 809161 - DNA, 11 bp, Homo sapiens
aggctgtcccc

SEQ ID NO: 809162 - DNA, 19 bp, Homo sapiens
agggatcttgcattcccag

SEQ ID NO: 809163 - DNA, 20 bp, Homo sapiens
agggatgatggcagagccag

SEQ ID NO: 809164 - DNA, 18 bp, Homo sapiens
agggatgcccccaggcag

SEQ ID NO: 809165 - DNA, 14 bp, Homo sapiens
agggatgctgggct

SEQ ID NO: 809166 - DNA, 22 bp, Homo sapiens
agggatggaaaaggaagactag

SEQ ID NO: 809167 - DNA, 14 bp, Homo sapiens
agggatggagaaag

SEQ ID NO: 809168 - DNA, 16 bp, Homo sapiens
agggatggagaaagaa

SEQ ID NO: 809169 - DNA, 18 bp, Homo sapiens
agggatggagaaagaagt

SEQ ID NO: 809170 - DNA, 17 bp, Homo sapiens
agggatggagaggcggc

SEQ ID NO: 809171 - DNA, 15 bp, Homo sapiens
agggatggcgaggcc

SEQ ID NO: 809172 - DNA, 17 bp, Homo sapiens
agggatgggcctggcat

SEQ ID NO: 809173 - DNA, 22 bp, Homo sapiens
agggatgggcctggcattcttg

SEQ ID NO: 809174 - DNA, 16 bp, Homo sapiens
agggatgggggatggg

SEQ ID NO: 809175 - DNA, 18 bp, Homo sapiens
agggatggtaagttgaga

SEQ ID NO: 809176 - DNA, 23 bp, Homo sapiens
agggatggtggagtgagagcctt

SEQ ID NO: 809177 - DNA, 21 bp, Homo sapiens
agggatgttattatccttggg

SEQ ID NO: 809178 - DNA, 17 bp, Homo sapiens
agggattaacctctgca

SEQ ID NO: 809179 - DNA, 18 bp, Homo sapiens
agggattaacctctgcac

SEQ ID NO: 809180 - DNA, 16 bp, Homo sapiens
agggattcaggctgct

SEQ ID NO: 809181 - DNA, 18 bp, Homo sapiens
agggattcaggctgcttg

SEQ ID NO: 809182 - DNA, 22 bp, Homo sapiens
agggattctgggcttggggtgt

SEQ ID NO: 809183 - DNA, 19 bp, Homo sapiens
agggattgaggggccctgg

SEQ ID NO: 809184 - DNA, 16 bp, Homo sapiens
agggatttccctgcag

SEQ ID NO: 809185 - DNA, 20 bp, Homo sapiens
agggcaaaagggcagctgtg

SEQ ID NO: 809186 - DNA, 12 bp, Homo sapiens
agggcaaaatcg

SEQ ID NO: 809187 - DNA, 17 bp, Homo sapiens
agggcaaattattttaa

SEQ ID NO: 809188 - DNA, 14 bp, Homo sapiens
agggcaagaaatgg

SEQ ID NO: 809189 - DNA, 18 bp, Homo sapiens
agggcaagaattcttatg

SEQ ID NO: 809190 - DNA, 14 bp, Homo sapiens
agggcaagggccat

SEQ ID NO: 809191 - DNA, 17 bp, Homo sapiens
agggcaagggtgcctca

SEQ ID NO: 809192 - DNA, 15 bp, Homo sapiens
agggcaatctttgcc

SEQ ID NO: 809193 - DNA, 23 bp, Homo sapiens
agggcaatgccatcagcccctgg

SEQ ID NO: 809194 - DNA, 13 bp, Homo sapiens
agggcacagatga

SEQ ID NO: 809195 - DNA, 19 bp, Homo sapiens
agggcacagatgaccaaag

SEQ ID NO: 809196 - DNA, 16 bp, Homo sapiens
agggcacagctgccct

SEQ ID NO: 809197 - DNA, 15 bp, Homo sapiens
agggcacatctccag

SEQ ID NO: 809198 - DNA, 14 bp, Homo sapiens
agggcacattgccc

SEQ ID NO: 809199 - DNA, 23 bp, Homo sapiens
agggcacattgcccatggctggg

SEQ ID NO: 809200 - DNA, 14 bp, Homo sapiens
agggcaccaggggt

SEQ ID NO: 809201 - DNA, 21 bp, Homo sapiens
agggcacgcaggaccagtttg

SEQ ID NO: 809202 - DNA, 15 bp, Homo sapiens
agggcacggggacct

SEQ ID NO: 809203 - DNA, 17 bp, Homo sapiens
agggcacggggacctgg

SEQ ID NO: 809204 - DNA, 20 bp, Homo sapiens
agggcacttaatttgtaaac

SEQ ID NO: 809205 - DNA, 22 bp, Homo sapiens
agggcacttaatttgtaaactt

SEQ ID NO: 809206 - DNA, 23 bp, Homo sapiens
agggcacttaatttgtaaacttc

SEQ ID NO: 809207 - DNA, 20 bp, Homo sapiens
agggcacttcaggtccgtgg

SEQ ID NO: 809208 - DNA, 16 bp, Homo sapiens
agggcacttcctccac

SEQ ID NO: 809209 - DNA, 14 bp, Homo sapiens
agggcagaatgaat

SEQ ID NO: 809210 - DNA, 15 bp, Homo sapiens
agggcagagaatggc

SEQ ID NO: 809211 - DNA, 21 bp, Homo sapiens
agggcagagaatggctgggtc

SEQ ID NO: 809212 - DNA, 15 bp, Homo sapiens
agggcagagccatgg

SEQ ID NO: 809213 - DNA, 20 bp, Homo sapiens
agggcagagccatgggcctg

SEQ ID NO: 809214 - DNA, 13 bp, Homo sapiens
agggcagaggaat

SEQ ID NO: 809215 - DNA, 15 bp, Homo sapiens
agggcagaggaatgt

SEQ ID NO: 809216 - DNA, 14 bp, Homo sapiens
agggcagaggctgg

SEQ ID NO: 809217 - DNA, 15 bp, Homo sapiens
agggcagaggctgga

SEQ ID NO: 809218 - DNA, 13 bp, Homo sapiens
agggcagagggaa

SEQ ID NO: 809219 - DNA, 23 bp, Homo sapiens
agggcagagggaatgttccctgc

SEQ ID NO: 809220 - DNA, 18 bp, Homo sapiens
agggcagagggagaatcc

SEQ ID NO: 809221 - DNA, 23 bp, Homo sapiens
agggcagcaagggacctgctcat

SEQ ID NO: 809222 - DNA, 18 bp, Homo sapiens
agggcagcactgggaagc

SEQ ID NO: 809223 - DNA, 14 bp, Homo sapiens
agggcagcagggct

SEQ ID NO: 809224 - DNA, 14 bp, Homo sapiens
agggcagcagtggg

SEQ ID NO: 809225 - DNA, 17 bp, Homo sapiens
agggcagcagtggggtg

SEQ ID NO: 809226 - DNA, 15 bp, Homo sapiens
agggcagccctccat

SEQ ID NO: 809227 - DNA, 20 bp, Homo sapiens
agggcagccctccatggtcc

SEQ ID NO: 809228 - DNA, 22 bp, Homo sapiens
agggcagcctccaccttgctct

SEQ ID NO: 809229 - DNA, 17 bp, Homo sapiens
agggcagcgccaggctg

SEQ ID NO: 809230 - DNA, 12 bp, Homo sapiens
agggcagcggct

SEQ ID NO: 809231 - DNA, 16 bp, Homo sapiens
agggcagctgcctggc

SEQ ID NO: 809232 - DNA, 18 bp, Homo sapiens
agggcagctgcctggcca

SEQ ID NO: 809233 - DNA, 12 bp, Homo sapiens
agggcagctgct

SEQ ID NO: 809234 - DNA, 14 bp, Homo sapiens
agggcagctgtgat

SEQ ID NO: 809235 - DNA, 11 bp, Homo sapiens
agggcagcttg

SEQ ID NO: 809236 - DNA, 13 bp, Homo sapiens
agggcagcttgcc

SEQ ID NO: 809237 - DNA, 16 bp, Homo sapiens
agggcaggaaggagag

SEQ ID NO: 809238 - DNA, 14 bp, Homo sapiens
agggcaggaagggg

SEQ ID NO: 809239 - DNA, 15 bp, Homo sapiens
agggcaggccttgct

SEQ ID NO: 809240 - DNA, 23 bp, Homo sapiens
agggcaggccttgctggggtcca

SEQ ID NO: 809241 - DNA, 15 bp, Homo sapiens
agggcaggcgggccc

SEQ ID NO: 809242 - DNA, 15 bp, Homo sapiens
agggcagggcagcct

SEQ ID NO: 809243 - DNA, 18 bp, Homo sapiens
agggcagggcagcctgtc

SEQ ID NO: 809244 - DNA, 17 bp, Homo sapiens
agggcagggcatctcct

SEQ ID NO: 809245 - DNA, 17 bp, Homo sapiens
agggcagggcccacgtg

SEQ ID NO: 809246 - DNA, 18 bp, Homo sapiens
agggcagggcccacgtgt

SEQ ID NO: 809247 - DNA, 19 bp, Homo sapiens
agggcagggcccacgtgta

SEQ ID NO: 809248 - DNA, 15 bp, Homo sapiens
agggcagggctctga

SEQ ID NO: 809249 - DNA, 16 bp, Homo sapiens
agggcagggctctgat

SEQ ID NO: 809250 - DNA, 14 bp, Homo sapiens
agggcagggtctgg

SEQ ID NO: 809251 - DNA, 18 bp, Homo sapiens
agggcagggtctgggctg

SEQ ID NO: 809252 - DNA, 23 bp, Homo sapiens
agggcagggtctgggctgggcac

SEQ ID NO: 809253 - DNA, 13 bp, Homo sapiens
agggcagggtggg

SEQ ID NO: 809254 - DNA, 23 bp, Homo sapiens
agggcagggtgggcagcctatgg

SEQ ID NO: 809255 - DNA, 18 bp, Homo sapiens
agggcagtacctgggaaa

SEQ ID NO: 809256 - DNA, 15 bp, Homo sapiens
agggcagtgcccttt

SEQ ID NO: 809257 - DNA, 12 bp, Homo sapiens
agggcagtggcc

SEQ ID NO: 809258 - DNA, 22 bp, Homo sapiens
agggcagtggccaagcctgctg

SEQ ID NO: 809259 - DNA, 19 bp, Homo sapiens
agggcagtggcttctttcc

SEQ ID NO: 809260 - DNA, 16 bp, Homo sapiens
agggcagtgtttcctt

SEQ ID NO: 809261 - DNA, 18 bp, Homo sapiens
agggcagtgtttcctttt

SEQ ID NO: 809262 - DNA, 14 bp, Homo sapiens
agggcataaagtaa

SEQ ID NO: 809263 - DNA, 15 bp, Homo sapiens
agggcataaagtaaa

SEQ ID NO: 809264 - DNA, 14 bp, Homo sapiens
agggcatcaggcac

SEQ ID NO: 809265 - DNA, 16 bp, Homo sapiens
agggcatcaggcactg

SEQ ID NO: 809266 - DNA, 17 bp, Homo sapiens
agggcatcttagcttct

SEQ ID NO: 809267 - DNA, 13 bp, Homo sapiens
agggcatcttgct

SEQ ID NO: 809268 - DNA, 18 bp, Homo sapiens
agggcatcttgctggcta

SEQ ID NO: 809269 - DNA, 19 bp, Homo sapiens
agggcatgaagctgcatat

SEQ ID NO: 809270 - DNA, 18 bp, Homo sapiens
agggcatgcattttgcag

SEQ ID NO: 809271 - DNA, 19 bp, Homo sapiens
agggcatgggttggcaggg

SEQ ID NO: 809272 - DNA, 20 bp, Homo sapiens
agggcatgggttggcagggt

SEQ ID NO: 809273 - DNA, 16 bp, Homo sapiens
agggcatgtgcggctg

SEQ ID NO: 809274 - DNA, 15 bp, Homo sapiens
agggcatgtgtatgt

SEQ ID NO: 809275 - DNA, 16 bp, Homo sapiens
agggcatgtgtatgtg

SEQ ID NO: 809276 - DNA, 16 bp, Homo sapiens
agggcattcaaatggg

SEQ ID NO: 809277 - DNA, 23 bp, Homo sapiens
agggccaaacccacttctggcct

SEQ ID NO: 809278 - DNA, 21 bp, Homo sapiens
agggccaacccttctcctctt

SEQ ID NO: 809279 - DNA, 16 bp, Homo sapiens
agggccaagacttggc

SEQ ID NO: 809280 - DNA, 20 bp, Homo sapiens
agggccaagcgggggcgtgg

SEQ ID NO: 809281 - DNA, 18 bp, Homo sapiens
agggccacatagatgctg

SEQ ID NO: 809282 - DNA, 12 bp, Homo sapiens
agggccaccctg

SEQ ID NO: 809283 - DNA, 23 bp, Homo sapiens
agggccaccctgctgcactagga

SEQ ID NO: 809284 - DNA, 23 bp, Homo sapiens
aggggctccctacattccccaga

SEQ ID NO: 809285 - DNA, 21 bp, Homo sapiens
aggggctccgggtcactgctg

SEQ ID NO: 809286 - DNA, 16 bp, Homo sapiens
aggggctcctgggttg

SEQ ID NO: 809287 - DNA, 20 bp, Homo sapiens
aggggctcctgggttggagg

SEQ ID NO: 809288 - DNA, 23 bp, Homo sapiens
aggggctcctgggttggagggaa

SEQ ID NO: 809289 - DNA, 22 bp, Homo sapiens
aggggctctcagctcagcgcca

SEQ ID NO: 809290 - DNA, 12 bp, Homo sapiens
aggggctctgtg

SEQ ID NO: 809291 - DNA, 14 bp, Homo sapiens
aggggctgctccag

SEQ ID NO: 809292 - DNA, 23 bp, Homo sapiens
aggggctgctccagtgggcaggg

SEQ ID NO: 809293 - DNA, 12 bp, Homo sapiens
aggggctgctgg

SEQ ID NO: 809294 - DNA, 14 bp, Homo sapiens
aggggctgctgggg

SEQ ID NO: 809295 - DNA, 18 bp, Homo sapiens
aggggctgcttcctcctg

SEQ ID NO: 809296 - DNA, 21 bp, Homo sapiens
aggggctgcttcctcctggaa

SEQ ID NO: 809297 - DNA, 18 bp, Homo sapiens
aggggctgggcatcccag

SEQ ID NO: 809298 - DNA, 12 bp, Homo sapiens
aggggctgggct

SEQ ID NO: 809299 - DNA, 16 bp, Homo sapiens
aggggctgggctgggc

SEQ ID NO: 809300 - DNA, 19 bp, Homo sapiens
aggggctgggctgggctgg

SEQ ID NO: 809301 - DNA, 15 bp, Homo sapiens
aggggctggggaggg

SEQ ID NO: 809302 - DNA, 16 bp, Homo sapiens
aggggctggggagggg

SEQ ID NO: 809303 - DNA, 12 bp, Homo sapiens
aggggctggggc

SEQ ID NO: 809304 - DNA, 13 bp, Homo sapiens
aggggctggggca

SEQ ID NO: 809305 - DNA, 22 bp, Homo sapiens
aggggctggggcaggctctctc

SEQ ID NO: 809306 - DNA, 16 bp, Homo sapiens
aggggctgtcctcctt

SEQ ID NO: 809307 - DNA, 18 bp, Homo sapiens
aggggctgtcctccttcc

SEQ ID NO: 809308 - DNA, 19 bp, Homo sapiens
aggggctgtcctccttcct

SEQ ID NO: 809309 - DNA, 21 bp, Homo sapiens
aggggctgtggccgtctcctc

SEQ ID NO: 809310 - DNA, 14 bp, Homo sapiens
aggggctttctctt

SEQ ID NO: 809311 - DNA, 13 bp, Homo sapiens
aggggctttgggc

SEQ ID NO: 809312 - DNA, 16 bp, Homo sapiens
aggggctttgggccca

SEQ ID NO: 809313 - DNA, 14 bp, Homo sapiens
agggggaagcaaag

SEQ ID NO: 809314 - DNA, 15 bp, Homo sapiens
agggggaagcaaagg

SEQ ID NO: 809315 - DNA, 22 bp, Homo sapiens
agggggacctgccaccagggag

SEQ ID NO: 809316 - DNA, 20 bp, Homo sapiens
agggggacggggctgacatc

SEQ ID NO: 809317 - DNA, 20 bp, Homo sapiens
agggggactgctgctgcctg

SEQ ID NO: 809318 - DNA, 23 bp, Homo sapiens
agggggaggagtcaggggctctg

SEQ ID NO: 809319 - DNA, 22 bp, Homo sapiens
agggggagggggttacaaactg

SEQ ID NO: 809320 - DNA, 22 bp, Homo sapiens
agggggaggttggttccttggg

SEQ ID NO: 809321 - DNA, 23 bp, Homo sapiens
agggggagtccctcgtctcttgt

SEQ ID NO: 809322 - DNA, 21 bp, Homo sapiens
agggggatatgggtcctctgg

SEQ ID NO: 809323 - DNA, 17 bp, Homo sapiens
agggggccctgccccac

SEQ ID NO: 809324 - DNA, 20 bp, Homo sapiens
agggggccggggggagggga

SEQ ID NO: 809325 - DNA, 21 bp, Homo sapiens
agggggccggggggaggggac

SEQ ID NO: 809326 - DNA, 22 bp, Homo sapiens
agggggccttgcggaagccata

SEQ ID NO: 809327 - DNA, 21 bp, Homo sapiens
agggggcggggactgctggct

SEQ ID NO: 809328 - DNA, 16 bp, Homo sapiens
agggggctctgcccca

SEQ ID NO: 809329 - DNA, 17 bp, Homo sapiens
agggggctctgccccag

SEQ ID NO: 809330 - DNA, 14 bp, Homo sapiens
aggggggagctggg

SEQ ID NO: 809331 - DNA, 12 bp, Homo sapiens
aggggggagggg

SEQ ID NO: 809332 - DNA, 17 bp, Homo sapiens
aggggggagggggaggg

SEQ ID NO: 809333 - DNA, 12 bp, Homo sapiens
aggggggctgtg

SEQ ID NO: 809334 - DNA, 23 bp, Homo sapiens
aggggggggtatttcaattacct

SEQ ID NO: 809335 - DNA, 22 bp, Homo sapiens
aggggggggtgggtgagagaga

SEQ ID NO: 809336 - DNA, 20 bp, Homo sapiens
agggggtcccagtgggaggg

SEQ ID NO: 809337 - DNA, 21 bp, Homo sapiens
agggggtgagaggcaggaatg

SEQ ID NO: 809338 - DNA, 15 bp, Homo sapiens
agggggtggaggggt

SEQ ID NO: 809339 - DNA, 14 bp, Homo sapiens
agggggtgggaagg

SEQ ID NO: 809340 - DNA, 17 bp, Homo sapiens
agggggtgtcagaagct

SEQ ID NO: 809341 - DNA, 14 bp, Homo sapiens
agggggttgtggca

SEQ ID NO: 809342 - DNA, 15 bp, Homo sapiens
aggggtaacctggcc

SEQ ID NO: 809343 - DNA, 14 bp, Homo sapiens
aggggtcaaagaaa

SEQ ID NO: 809344 - DNA, 20 bp, Homo sapiens
aggggtcagcagagcttcag

SEQ ID NO: 809345 - DNA, 16 bp, Homo sapiens
aggggtcaggctccat

SEQ ID NO: 809346 - DNA, 14 bp, Homo sapiens
aggggtcagggacc

SEQ ID NO: 809347 - DNA, 24 bp, Homo sapiens
aggggtcagggaccaaggacccct

SEQ ID NO: 809348 - DNA, 15 bp, Homo sapiens
aggggtcccagccac

SEQ ID NO: 809349 - DNA, 15 bp, Homo sapiens
aggggtcccccctca

SEQ ID NO: 809350 - DNA, 14 bp, Homo sapiens
aggggtccctgcta

SEQ ID NO: 809351 - DNA, 16 bp, Homo sapiens
aggggtcctgggggca

SEQ ID NO: 809352 - DNA, 13 bp, Homo sapiens
aggggtctccctg

SEQ ID NO: 809353 - DNA, 15 bp, Homo sapiens
aggggtctccctgga

SEQ ID NO: 809354 - DNA, 16 bp, Homo sapiens
aggggtgacggccctc

SEQ ID NO: 809355 - DNA, 16 bp, Homo sapiens
aggggtgagagcaccc

SEQ ID NO: 809356 - DNA, 16 bp, Homo sapiens
aggggtgcagaggctg

SEQ ID NO: 809357 - DNA, 11 bp, Homo sapiens
aggggtgcccc

SEQ ID NO: 809358 - DNA, 15 bp, Homo sapiens
aggggtggagactgc

SEQ ID NO: 809359 - DNA, 14 bp, Homo sapiens
aggggtgggctggt

SEQ ID NO: 809360 - DNA, 19 bp, Homo sapiens
aggggtgggggtggaggct

SEQ ID NO: 809361 - DNA, 20 bp, Homo sapiens
aggggtgggttcctcttccc

SEQ ID NO: 809362 - DNA, 15 bp, Homo sapiens
aggggtggtcctgac

SEQ ID NO: 809363 - DNA, 18 bp, Homo sapiens
aggggtggtgtggtgttg

SEQ ID NO: 809364 - DNA, 17 bp, Homo sapiens
aggggtgtccgagaggc

SEQ ID NO: 809365 - DNA, 17 bp, Homo sapiens
aggggttacctccctcg

SEQ ID NO: 809366 - DNA, 21 bp, Homo sapiens
aggggttcccttgagggctgc

SEQ ID NO: 809367 - DNA, 23 bp, Homo sapiens
aggggttcccttgagggctgcag

SEQ ID NO: 809368 - DNA, 14 bp, Homo sapiens
aggggttgaagaaa

SEQ ID NO: 809369 - DNA, 23 bp, Homo sapiens
aggggttgagcagggatcctggt

SEQ ID NO: 809370 - DNA, 15 bp, Homo sapiens
aggggttgagggaag

SEQ ID NO: 809371 - DNA, 21 bp, Homo sapiens
aggggttgctccgcctggcct

SEQ ID NO: 809372 - DNA, 14 bp, Homo sapiens
aggggtttacagtg

SEQ ID NO: 809373 - DNA, 17 bp, Homo sapiens
aggggtttgggtggggg

SEQ ID NO: 809374 - DNA, 23 bp, Homo sapiens
agggtaaatcagtaagaggtgtt

SEQ ID NO: 809375 - DNA, 23 bp, Homo sapiens
agggtaactggggggccaccatg

SEQ ID NO: 809376 - DNA, 15 bp, Homo sapiens
agggtaaggtgcctt

SEQ ID NO: 809377 - DNA, 14 bp, Homo sapiens
agggtaccagcaga

SEQ ID NO: 809378 - DNA, 20 bp, Homo sapiens
agggtaccctttggggagca

SEQ ID NO: 809379 - DNA, 19 bp, Homo sapiens
agggtaccttgaacactgg

SEQ ID NO: 809380 - DNA, 19 bp, Homo sapiens
agggtactttattttgctt

SEQ ID NO: 809381 - DNA, 19 bp, Homo sapiens
agggtagaaaactccaggg

SEQ ID NO: 809382 - DNA, 15 bp, Homo sapiens
agggtagaaggaaag

SEQ ID NO: 809383 - DNA, 16 bp, Homo sapiens
agggtagacaggggcg

SEQ ID NO: 809384 - DNA, 15 bp, Homo sapiens
agggtagcaggtacc

SEQ ID NO: 809385 - DNA, 17 bp, Homo sapiens
agggtagtctggtttct

SEQ ID NO: 809386 - DNA, 17 bp, Homo sapiens
agggtatattttcctat

SEQ ID NO: 809387 - DNA, 16 bp, Homo sapiens
agggtatcccagaccc

SEQ ID NO: 809388 - DNA, 20 bp, Homo sapiens
agggtcaacatcttttacat

SEQ ID NO: 809389 - DNA, 13 bp, Homo sapiens
agggtcaccctgg

SEQ ID NO: 809390 - DNA, 18 bp, Homo sapiens
agggtcaggagaggggca

SEQ ID NO: 809391 - DNA, 19 bp, Homo sapiens
agggtccaatcctaggaca

SEQ ID NO: 809392 - DNA, 19 bp, Homo sapiens
agggtccaggagagcctgg

SEQ ID NO: 809393 - DNA, 21 bp, Homo sapiens
agggtccaggagagcctgggg

SEQ ID NO: 809394 - DNA, 12 bp, Homo sapiens
agggtcccaccc

SEQ ID NO: 809395 - DNA, 13 bp, Homo sapiens
agggtcccacccc

SEQ ID NO: 809396 - DNA, 15 bp, Homo sapiens
agggtccccacctgg

SEQ ID NO: 809397 - DNA, 17 bp, Homo sapiens
agggtcccctccccagc

SEQ ID NO: 809398 - DNA, 20 bp, Homo sapiens
agggtcccctccccagctcc

SEQ ID NO: 809399 - DNA, 24 bp, Homo sapiens
agggtcccggtgtatcctggccct

SEQ ID NO: 809400 - DNA, 14 bp, Homo sapiens
agggtccctctgtg

SEQ ID NO: 809401 - DNA, 20 bp, Homo sapiens
agggtccctctgtgtatttg

SEQ ID NO: 809402 - DNA, 19 bp, Homo sapiens
agggtccgcaccagctgct

SEQ ID NO: 809403 - DNA, 20 bp, Homo sapiens
agggtccgcaccagctgctc

SEQ ID NO: 809404 - DNA, 23 bp, Homo sapiens
agggtccgcaccagctgctctgc

SEQ ID NO: 809405 - DNA, 22 bp, Homo sapiens
agggtcctctagcccactccct

SEQ ID NO: 809406 - DNA, 15 bp, Homo sapiens
aggtccagcccatct

SEQ ID NO: 809407 - DNA, 14 bp, Homo sapiens
aggtccagctctgg

SEQ ID NO: 809408 - DNA, 16 bp, Homo sapiens
aggtccagctctggag

SEQ ID NO: 809409 - DNA, 17 bp, Homo sapiens
aggtccaggccagtggg

SEQ ID NO: 809410 - DNA, 13 bp, Homo sapiens
aggtccattttct

SEQ ID NO: 809411 - DNA, 14 bp, Homo sapiens
aggtccattttcta

SEQ ID NO: 809412 - DNA, 18 bp, Homo sapiens
aggtcccacctccagccc

SEQ ID NO: 809413 - DNA, 14 bp, Homo sapiens
aggtcccacgtctg

SEQ ID NO: 809414 - DNA, 19 bp, Homo sapiens
aggtcccacgtctggccag

SEQ ID NO: 809415 - DNA, 19 bp, Homo sapiens
aggtcccagccccaggcct

SEQ ID NO: 809416 - DNA, 21 bp, Homo sapiens
aggtcccagccccaggcctgg

SEQ ID NO: 809417 - DNA, 22 bp, Homo sapiens
aggtccccaaacttatggacac

SEQ ID NO: 809418 - DNA, 14 bp, Homo sapiens
aggtccccccaccg

SEQ ID NO: 809419 - DNA, 20 bp, Homo sapiens
aggtccccccaccgctcagt

SEQ ID NO: 809420 - DNA, 21 bp, Homo sapiens
aggtccccccaccgctcagtg

SEQ ID NO: 809421 - DNA, 21 bp, Homo sapiens
aggtcccccgaccaatcccca

SEQ ID NO: 809422 - DNA, 20 bp, Homo sapiens
aggtcccccgactgcctgtc

SEQ ID NO: 809423 - DNA, 21 bp, Homo sapiens
aggtcccccgactgcctgtct

SEQ ID NO: 809424 - DNA, 22 bp, Homo sapiens
aggtcccctcgtcccatccagc

SEQ ID NO: 809425 - DNA, 18 bp, Homo sapiens
aggtcccttcaaggcctc

SEQ ID NO: 809426 - DNA, 17 bp, Homo sapiens
aggtcccttcccgaccc

SEQ ID NO: 809427 - DNA, 19 bp, Homo sapiens
aggtccgtgggccgtatct

SEQ ID NO: 809428 - DNA, 16 bp, Homo sapiens
aggtcctcaggtcagc

SEQ ID NO: 809429 - DNA, 20 bp, Homo sapiens
aggtcctcaggtcagctggg

SEQ ID NO: 809430 - DNA, 23 bp, Homo sapiens
aggtcctcaggtcagctgggagc

SEQ ID NO: 809431 - DNA, 22 bp, Homo sapiens
aggtcctccgtagggtctttct

SEQ ID NO: 809432 - DNA, 15 bp, Homo sapiens
aggtcctctggagcc

SEQ ID NO: 809433 - DNA, 13 bp, Homo sapiens
aggtcctgcccat

SEQ ID NO: 809434 - DNA, 15 bp, Homo sapiens
aggtcctgcccatgt

SEQ ID NO: 809435 - DNA, 15 bp, Homo sapiens
aggtcctgtctctgc

SEQ ID NO: 809436 - DNA, 16 bp, Homo sapiens
aggtcgcgctcttgca

SEQ ID NO: 809437 - DNA, 22 bp, Homo sapiens
aggtcggtaggttcagccaagg

SEQ ID NO: 809438 - DNA, 19 bp, Homo sapiens
aggtcgttttccaaagagc

SEQ ID NO: 809439 - DNA, 13 bp, Homo sapiens
aggtctagacttt

SEQ ID NO: 809440 - DNA, 20 bp, Homo sapiens
aggtctatttaaaaaaaaag

SEQ ID NO: 809441 - DNA, 14 bp, Homo sapiens
aggtctcaatattt

SEQ ID NO: 809442 - DNA, 17 bp, Homo sapiens
aggtctcaatatttatt

SEQ ID NO: 809443 - DNA, 17 bp, Homo sapiens
aggtctccaagggaggg

SEQ ID NO: 809444 - DNA, 21 bp, Homo sapiens
aggtctccaagggagggtgca

SEQ ID NO: 809445 - DNA, 15 bp, Homo sapiens
aggtctcctcagggt

SEQ ID NO: 809446 - DNA, 13 bp, Homo sapiens
aggtctcctctta

SEQ ID NO: 809447 - DNA, 15 bp, Homo sapiens
aggtctccttactct

SEQ ID NO: 809448 - DNA, 24 bp, Homo sapiens
aggtctccttactctgagcccagg

SEQ ID NO: 809449 - DNA, 19 bp, Homo sapiens
aggtctcgtcccagccctc

SEQ ID NO: 809450 - DNA, 17 bp, Homo sapiens
aggtctcttctcccaga

SEQ ID NO: 809451 - DNA, 23 bp, Homo sapiens
aggtctcttctcccagaatccca

SEQ ID NO: 809452 - DNA, 13 bp, Homo sapiens
aggtctgaaatgg

SEQ ID NO: 809453 - DNA, 15 bp, Homo sapiens
aggtctgaaatggag

SEQ ID NO: 809454 - DNA, 13 bp, Homo sapiens
aggtctgaaattt

SEQ ID NO: 809455 - DNA, 23 bp, Homo sapiens
aggtctgaaatttttcttcttga

SEQ ID NO: 809456 - DNA, 22 bp, Homo sapiens
aggtctgcactcctttatctgt

SEQ ID NO: 809457 - DNA, 22 bp, Homo sapiens
aggtctgggcaagtagcaggac

SEQ ID NO: 809458 - DNA, 15 bp, Homo sapiens
aggtctgtaactgcc

SEQ ID NO: 809459 - DNA, 22 bp, Homo sapiens
aggtctgtaactgcccagcccc

SEQ ID NO: 809460 - DNA, 14 bp, Homo sapiens
aggtctgtagtata

SEQ ID NO: 809461 - DNA, 18 bp, Homo sapiens
aggtctgttctttccaaa

SEQ ID NO: 809462 - DNA, 12 bp, Homo sapiens
aggtctgtttaa

SEQ ID NO: 809463 - DNA, 21 bp, Homo sapiens
aggtcttcatcgaatctacta

SEQ ID NO: 809464 - DNA, 19 bp, Homo sapiens
aggtcttcttaatatgttc

SEQ ID NO: 809465 - DNA, 21 bp, Homo sapiens
aggtcttgcagtggcttttca

SEQ ID NO: 809466 - DNA, 11 bp, Homo sapiens
aggtcttgcta

SEQ ID NO: 809467 - DNA, 22 bp, Homo sapiens
aggtcttgggaggctttcaatt

SEQ ID NO: 809468 - DNA, 12 bp, Homo sapiens
aggtctttctct

SEQ ID NO: 809469 - DNA, 13 bp, Homo sapiens
aggtctttctctc

SEQ ID NO: 809470 - DNA, 18 bp, Homo sapiens
aggtctttctttacttaa

SEQ ID NO: 809471 - DNA, 18 bp, Homo sapiens
aggtcttttctagtctga

SEQ ID NO: 809472 - DNA, 12 bp, Homo sapiens
aggtcttttctt

SEQ ID NO: 809473 - DNA, 15 bp, Homo sapiens
aggtcttttgacatg

SEQ ID NO: 809474 - DNA, 18 bp, Homo sapiens
aggtcttttgacatgtgg

SEQ ID NO: 809475 - DNA, 17 bp, Homo sapiens
aggtgaaaatgttttat

SEQ ID NO: 809476 - DNA, 19 bp, Homo sapiens
aggtgaaacgactcaaaat

SEQ ID NO: 809477 - DNA, 23 bp, Homo sapiens
aggtgaaacgactcaaaatgaca

SEQ ID NO: 809478 - DNA, 24 bp, Homo sapiens
aggtgaaacgactcaaaatgacag

SEQ ID NO: 809479 - DNA, 17 bp, Homo sapiens
aggtgaacacttagtga

SEQ ID NO: 809480 - DNA, 14 bp, Homo sapiens
aggtgaacattggt

SEQ ID NO: 809481 - DNA, 21 bp, Homo sapiens
aggtgaacattggttctttca

SEQ ID NO: 809482 - DNA, 14 bp, Homo sapiens
aggtgaagggatgg

SEQ ID NO: 809483 - DNA, 17 bp, Homo sapiens
aggtgaagggatggggg

SEQ ID NO: 809484 - DNA, 16 bp, Homo sapiens
aggtgaatagcacagg

SEQ ID NO: 809485 - DNA, 14 bp, Homo sapiens
aggtgaatttcatt

SEQ ID NO: 809486 - DNA, 13 bp, Homo sapiens
aggtgacaagcgt

SEQ ID NO: 809487 - DNA, 22 bp, Homo sapiens
aggtgacagatcataggaagtg

SEQ ID NO: 809488 - DNA, 15 bp, Homo sapiens
aggtgacagcagtcg

SEQ ID NO: 809489 - DNA, 19 bp, Homo sapiens
aggtgacatcggaaaaata

SEQ ID NO: 809490 - DNA, 16 bp, Homo sapiens
aggtgacccctgccat

SEQ ID NO: 809491 - DNA, 18 bp, Homo sapiens
aggtgaccctgatgaaaa

SEQ ID NO: 809492 - DNA, 20 bp, Homo sapiens
aggtgaccttgcaacttcat

SEQ ID NO: 809493 - DNA, 14 bp, Homo sapiens
aggtgactgtgctg

SEQ ID NO: 809494 - DNA, 19 bp, Homo sapiens
aggtgacttctagcagaga

SEQ ID NO: 809495 - DNA, 14 bp, Homo sapiens
aggtgagaaaaaaa

SEQ ID NO: 809496 - DNA, 13 bp, Homo sapiens
aggtgagaaattt

SEQ ID NO: 809497 - DNA, 11 bp, Homo sapiens
aggtgagcctg

SEQ ID NO: 809498 - DNA, 18 bp, Homo sapiens
aggtgaggagcagagcag

SEQ ID NO: 809499 - DNA, 23 bp, Homo sapiens
aggtgaggtccaccggcccctgg

SEQ ID NO: 809500 - DNA, 19 bp, Homo sapiens
aggtgagtttgagctgcct

SEQ ID NO: 809501 - DNA, 15 bp, Homo sapiens
aggtgataaaatttt

SEQ ID NO: 809502 - DNA, 21 bp, Homo sapiens
aggtgataagggaaaagataa

SEQ ID NO: 809503 - DNA, 17 bp, Homo sapiens
aggtgatagcattgctt

SEQ ID NO: 809504 - DNA, 18 bp, Homo sapiens
aggtgatagcattgcttt

SEQ ID NO: 809505 - DNA, 22 bp, Homo sapiens
aggtgatatataatttcctcac

SEQ ID NO: 809506 - DNA, 20 bp, Homo sapiens
aggtgatatttttatgtgca

SEQ ID NO: 809507 - DNA, 21 bp, Homo sapiens
aggtgatatttttatgtgcag

SEQ ID NO: 809508 - DNA, 18 bp, Homo sapiens
aggtgatgccattacaga

SEQ ID NO: 809509 - DNA, 15 bp, Homo sapiens
aggtgatgctctggc

SEQ ID NO: 809510 - DNA, 20 bp, Homo sapiens
aggtgatggaggtatttgaa

SEQ ID NO: 809511 - DNA, 19 bp, Homo sapiens
aggtgattctcagggctgg

SEQ ID NO: 809512 - DNA, 12 bp, Homo sapiens
aggtgatttcct

SEQ ID NO: 809513 - DNA, 20 bp, Homo sapiens
aggtgcacacatcaccaggt

SEQ ID NO: 809514 - DNA, 21 bp, Homo sapiens
aggtgcacattttccacggaa

SEQ ID NO: 809515 - DNA, 16 bp, Homo sapiens
aggtgcagctcctcag

SEQ ID NO: 809516 - DNA, 23 bp, Homo sapiens
aggtgcagttcccccaacctcag

SEQ ID NO: 809517 - DNA, 18 bp, Homo sapiens
aggtgcatatagaaaaca

SEQ ID NO: 809518 - DNA, 19 bp, Homo sapiens
aggtgcatatagaaaacaa

SEQ ID NO: 809519 - DNA, 15 bp, Homo sapiens
aggtgcatctgcagg

SEQ ID NO: 809520 - DNA, 15 bp, Homo sapiens
aggtgcatttttact

SEQ ID NO: 809521 - DNA, 17 bp, Homo sapiens
aggtgccactccctgag

SEQ ID NO: 809522 - DNA, 19 bp, Homo sapiens
aggtgccactccctgagct

SEQ ID NO: 809523 - DNA, 14 bp, Homo sapiens
aggtgccactgacc

SEQ ID NO: 809524 - DNA, 23 bp, Homo sapiens
aggtgccactttacccacctaga

SEQ ID NO: 809525 - DNA, 14 bp, Homo sapiens
aggtgccagaagga

SEQ ID NO: 809526 - DNA, 19 bp, Homo sapiens
aggtgccagcaactgaata

SEQ ID NO: 809527 - DNA, 17 bp, Homo sapiens
aggtttttcttgggaaa

SEQ ID NO: 809528 - DNA, 14 bp, Homo sapiens
aggtttttgatttt

SEQ ID NO: 809529 - DNA, 23 bp, Homo sapiens
aggtttttggctgagtactggaa

SEQ ID NO: 809530 - DNA, 16 bp, Homo sapiens
aggttttttttttaag

SEQ ID NO: 809531 - DNA, 14 bp, Homo sapiens
agtaaaaacctgct

SEQ ID NO: 809532 - DNA, 13 bp, Homo sapiens
agtaaaaactaga

SEQ ID NO: 809533 - DNA, 17 bp, Homo sapiens
agtaaaaataaaatact

SEQ ID NO: 809534 - DNA, 19 bp, Homo sapiens
agtaaaaccttgttctatt

SEQ ID NO: 809535 - DNA, 14 bp, Homo sapiens
agtaaaacttgctg

SEQ ID NO: 809536 - DNA, 12 bp, Homo sapiens
agtaaaagcaaa

SEQ ID NO: 809537 - DNA, 17 bp, Homo sapiens
agtaaaagtaaagacta

SEQ ID NO: 809538 - DNA, 18 bp, Homo sapiens
agtaaaatgttttttaaa

SEQ ID NO: 809539 - DNA, 16 bp, Homo sapiens
agtaaacagggtacct

SEQ ID NO: 809540 - DNA, 20 bp, Homo sapiens
agtaaacattaagtaaatgc

SEQ ID NO: 809541 - DNA, 23 bp, Homo sapiens
agtaaaccactgaaaaaatatat

SEQ ID NO: 809542 - DNA, 20 bp, Homo sapiens
agtaaaccatgtattccctt

SEQ ID NO: 809543 - DNA, 19 bp, Homo sapiens
agtaaacgggaacatgccc

SEQ ID NO: 809544 - DNA, 15 bp, Homo sapiens
agtaaactgaggccc

SEQ ID NO: 809545 - DNA, 14 bp, Homo sapiens
agtaaactggtgag

SEQ ID NO: 809546 - DNA, 12 bp, Homo sapiens
agtaaagaaatt

SEQ ID NO: 809547 - DNA, 20 bp, Homo sapiens
agtaaagaaatttaaaagac

SEQ ID NO: 809548 - DNA, 17 bp, Homo sapiens
agtaaagctaaaatgat

SEQ ID NO: 809549 - DNA, 17 bp, Homo sapiens
agtaaagcttttctttt

SEQ ID NO: 809550 - DNA, 16 bp, Homo sapiens
agtaaaggcctcatct

SEQ ID NO: 809551 - DNA, 14 bp, Homo sapiens
agtaaagtaccttt

SEQ ID NO: 809552 - DNA, 19 bp, Homo sapiens
agtaaagtgataatttctg

SEQ ID NO: 809553 - DNA, 15 bp, Homo sapiens
agtaaatacaatttt

SEQ ID NO: 809554 - DNA, 22 bp, Homo sapiens
agtaaatacttgcagttgtgat

SEQ ID NO: 809555 - DNA, 17 bp, Homo sapiens
agtaaatgggagggcat

SEQ ID NO: 809556 - DNA, 17 bp, Homo sapiens
agtaaattaaacatttt

SEQ ID NO: 809557 - DNA, 12 bp, Homo sapiens
agtaaattggaa

SEQ ID NO: 809558 - DNA, 14 bp, Homo sapiens
agtaaattggaaac

SEQ ID NO: 809559 - DNA, 19 bp, Homo sapiens
agtaacaatacaaatggat

SEQ ID NO: 809560 - DNA, 14 bp, Homo sapiens
agtaacacaaacat

SEQ ID NO: 809561 - DNA, 17 bp, Homo sapiens
agtaacacagattattc

SEQ ID NO: 809562 - DNA, 22 bp, Homo sapiens
agtaacacagattattcatctt

SEQ ID NO: 809563 - DNA, 17 bp, Homo sapiens
agtaacactaatatatt

SEQ ID NO: 809564 - DNA, 23 bp, Homo sapiens
agtaacactaatatatttaaaaa

SEQ ID NO: 809565 - DNA, 23 bp, Homo sapiens
agtaacactttaaaaccagttac

SEQ ID NO: 809566 - DNA, 22 bp, Homo sapiens
agtaacatcagccatttttaga

SEQ ID NO: 809567 - DNA, 20 bp, Homo sapiens
agtaacattaactcagtgga

SEQ ID NO: 809568 - DNA, 15 bp, Homo sapiens
agtaacatttctgtt

SEQ ID NO: 809569 - DNA, 19 bp, Homo sapiens
agtaacatttctgttctca

SEQ ID NO: 809570 - DNA, 14 bp, Homo sapiens
agtaaccatttgca

SEQ ID NO: 809571 - DNA, 17 bp, Homo sapiens
agtaaccattttccttt

SEQ ID NO: 809572 - DNA, 19 bp, Homo sapiens
agtaaccattttcctttgg

SEQ ID NO: 809573 - DNA, 16 bp, Homo sapiens
agtaacctagtgaatt

SEQ ID NO: 809574 - DNA, 22 bp, Homo sapiens
agtaacgcgtcttcctgagtgg

SEQ ID NO: 809575 - DNA, 15 bp, Homo sapiens
agtaactaattttgt

SEQ ID NO: 809576 - DNA, 16 bp, Homo sapiens
agtaactaattttgtt

SEQ ID NO: 809577 - DNA, 21 bp, Homo sapiens
agtaactactttttatactcc

SEQ ID NO: 809578 - DNA, 12 bp, Homo sapiens
agtaactcattt

SEQ ID NO: 809579 - DNA, 22 bp, Homo sapiens
agtaactcatttgttaaaatta

SEQ ID NO: 809580 - DNA, 14 bp, Homo sapiens
agtaactgacaact

SEQ ID NO: 809581 - DNA, 17 bp, Homo sapiens
agtaacttcttatggaa

SEQ ID NO: 809582 - DNA, 22 bp, Homo sapiens
agtaactttactctgtgtttaa

SEQ ID NO: 809583 - DNA, 14 bp, Homo sapiens
agtaactttatgtg

SEQ ID NO: 809584 - DNA, 19 bp, Homo sapiens
agtaactttatgtgtaaat

SEQ ID NO: 809585 - DNA, 16 bp, Homo sapiens
agtaacttttaaaatt

SEQ ID NO: 809586 - DNA, 18 bp, Homo sapiens
agtaacttttttgtgtat

SEQ ID NO: 809587 - DNA, 21 bp, Homo sapiens
agtaacttttttgtgtatgta

SEQ ID NO: 809588 - DNA, 20 bp, Homo sapiens
agtaagaaagtgaagcaaat

SEQ ID NO: 809589 - DNA, 11 bp, Homo sapiens
agtaagagctt

SEQ ID NO: 809590 - DNA, 13 bp, Homo sapiens
agtaagcagtgtt

SEQ ID NO: 809591 - DNA, 22 bp, Homo sapiens
agtaagcccttgaagatatctt

SEQ ID NO: 809592 - DNA, 18 bp, Homo sapiens
agtaagctgctctattgt

SEQ ID NO: 809593 - DNA, 18 bp, Homo sapiens
agtaaggaatgatattgc

SEQ ID NO: 809594 - DNA, 21 bp, Homo sapiens
agtaaggtagcattcattacc

SEQ ID NO: 809595 - DNA, 23 bp, Homo sapiens
agtaagtggggttgcaaccactg

SEQ ID NO: 809596 - DNA, 16 bp, Homo sapiens
agtaagtgtacaattg

SEQ ID NO: 809597 - DNA, 16 bp, Homo sapiens
agtaagtgtgttcatt

SEQ ID NO: 809598 - DNA, 14 bp, Homo sapiens
agtaagttaataat

SEQ ID NO: 809599 - DNA, 19 bp, Homo sapiens
agtaagttaatgtatataa

SEQ ID NO: 809600 - DNA, 20 bp, Homo sapiens
agtaagttatctttgaatat

SEQ ID NO: 809601 - DNA, 22 bp, Homo sapiens
agtaataaaaagagatgaaata

SEQ ID NO: 809602 - DNA, 22 bp, Homo sapiens
agtaataaaattcaacaaacat

SEQ ID NO: 809603 - DNA, 17 bp, Homo sapiens
agtaataaactgtgttt

SEQ ID NO: 809604 - DNA, 12 bp, Homo sapiens
agtaataatgtg

SEQ ID NO: 809605 - DNA, 13 bp, Homo sapiens
agtaataatttgt

SEQ ID NO: 809606 - DNA, 14 bp, Homo sapiens
agtaataatttgta

SEQ ID NO: 809607 - DNA, 19 bp, Homo sapiens
agtaataatttgtaaattg

SEQ ID NO: 809608 - DNA, 18 bp, Homo sapiens
agtaatagattgttttgc

SEQ ID NO: 809609 - DNA, 22 bp, Homo sapiens
agtaatagtccaatatttggcg

SEQ ID NO: 809610 - DNA, 14 bp, Homo sapiens
agtaatatgcacac

SEQ ID NO: 809611 - DNA, 15 bp, Homo sapiens
agtaatatgcacaca

SEQ ID NO: 809612 - DNA, 13 bp, Homo sapiens
agtaatatgttta

SEQ ID NO: 809613 - DNA, 18 bp, Homo sapiens
agtaatatttatatattt

SEQ ID NO: 809614 - DNA, 19 bp, Homo sapiens
agtaatattttactttgag

SEQ ID NO: 809615 - DNA, 21 bp, Homo sapiens
agtaatcagaatgaaccctcc

SEQ ID NO: 809616 - DNA, 16 bp, Homo sapiens
agtaatcaggcagcct

SEQ ID NO: 809617 - DNA, 17 bp, Homo sapiens
agtaatcaggcagcctt

SEQ ID NO: 809618 - DNA, 14 bp, Homo sapiens
agtaatccacctgc

SEQ ID NO: 809619 - DNA, 15 bp, Homo sapiens
agtaatcccatttcc

SEQ ID NO: 809620 - DNA, 14 bp, Homo sapiens
agtaatctatgtgt

SEQ ID NO: 809621 - DNA, 19 bp, Homo sapiens
agtaatctgtataatactt

SEQ ID NO: 809622 - DNA, 23 bp, Homo sapiens
agtaatctgtataatactttgta

SEQ ID NO: 809623 - DNA, 13 bp, Homo sapiens
agtaatctgtgta

SEQ ID NO: 809624 - DNA, 21 bp, Homo sapiens
agtaatctgtgtacaaagaaa

SEQ ID NO: 809625 - DNA, 15 bp, Homo sapiens
agtaatctttaaact

SEQ ID NO: 809626 - DNA, 14 bp, Homo sapiens
agtaatctttttac

SEQ ID NO: 809627 - DNA, 17 bp, Homo sapiens
agtaatgaaatgtttac

SEQ ID NO: 809628 - DNA, 16 bp, Homo sapiens
agtaatgatactgtgt

SEQ ID NO: 809629 - DNA, 14 bp, Homo sapiens
agtaatgatgaaat

SEQ ID NO: 809630 - DNA, 17 bp, Homo sapiens
agtaatgatgaaatctt

SEQ ID NO: 809631 - DNA, 22 bp, Homo sapiens
agtaatgatgaaatctttcttt

SEQ ID NO: 809632 - DNA, 22 bp, Homo sapiens
agtaatgggtttcatatttctt

SEQ ID NO: 809633 - DNA, 14 bp, Homo sapiens
agtaatggtgtaga

SEQ ID NO: 809634 - DNA, 18 bp, Homo sapiens
agtaatggtgtagaacac

SEQ ID NO: 809635 - DNA, 19 bp, Homo sapiens
agtaatggtgtagaacact

SEQ ID NO: 809636 - DNA, 22 bp, Homo sapiens
agtaatggtgtagaacactaat

SEQ ID NO: 809637 - DNA, 23 bp, Homo sapiens
agtaatggtgtagaacactaatt

SEQ ID NO: 809638 - DNA, 13 bp, Homo sapiens
agtaatgtcttca

SEQ ID NO: 809639 - DNA, 22 bp, Homo sapiens
agtaattaataaagaaaaagaa

SEQ ID NO: 809640 - DNA, 13 bp, Homo sapiens
agtaattatcggg

SEQ ID NO: 809641 - DNA, 20 bp, Homo sapiens
agtaattatcgggaacagtg

SEQ ID NO: 809642 - DNA, 22 bp, Homo sapiens
agtaattatcgggaacagtgtt

SEQ ID NO: 809643 - DNA, 23 bp, Homo sapiens
agtaattgcacatttttttctat

SEQ ID NO: 809644 - DNA, 22 bp, Homo sapiens
agtaattggtccgatctttgac

SEQ ID NO: 809645 - DNA, 12 bp, Homo sapiens
agtaattgtgaa

SEQ ID NO: 809646 - DNA, 15 bp, Homo sapiens
agtaattgtgaaaaa

SEQ ID NO: 809647 - DNA, 12 bp, Homo sapiens
agtaatttagaa

SEQ ID NO: 809648 - DNA, 14 bp, Homo sapiens
agtaatttagaaat

SEQ ID NO: 809649 - DNA, 14 bp, Homo sapiens
agtattccacctta

SEQ ID NO: 809650 - DNA, 23 bp, Homo sapiens
agtattccaccttaaattaaaca

SEQ ID NO: 809651 - DNA, 19 bp, Homo sapiens
agtattccattgtgtgagt

SEQ ID NO: 809652 - DNA, 17 bp, Homo sapiens
agtattctaaagttttg

SEQ ID NO: 809653 - DNA, 20 bp, Homo sapiens
agtattctaaagttttgcaa

SEQ ID NO: 809654 - DNA, 23 bp, Homo sapiens
agtattctcagagcatgtgtcag

SEQ ID NO: 809655 - DNA, 14 bp, Homo sapiens
agtattgaaaactt

SEQ ID NO: 809656 - DNA, 18 bp, Homo sapiens
agtattgaaaacttcaaa

SEQ ID NO: 809657 - DNA, 15 bp, Homo sapiens
agtattgaaagccaa

SEQ ID NO: 809658 - DNA, 23 bp, Homo sapiens
agtattgacaactgcacatgaaa

SEQ ID NO: 809659 - DNA, 19 bp, Homo sapiens
agtattgcagccaaagaat

SEQ ID NO: 809660 - DNA, 20 bp, Homo sapiens
agtattgcatctgtataagt

SEQ ID NO: 809661 - DNA, 22 bp, Homo sapiens
agtattggaaaataaaaatgct

SEQ ID NO: 809662 - DNA, 18 bp, Homo sapiens
agtattggagcacatgtt

SEQ ID NO: 809663 - DNA, 13 bp, Homo sapiens
agtattggttact

SEQ ID NO: 809664 - DNA, 19 bp, Homo sapiens
agtattggttactggtgat

SEQ ID NO: 809665 - DNA, 12 bp, Homo sapiens
agtattgtaaat

SEQ ID NO: 809666 - DNA, 16 bp, Homo sapiens
agtattgtaaattata

SEQ ID NO: 809667 - DNA, 17 bp, Homo sapiens
agtattgtaaattatat

SEQ ID NO: 809668 - DNA, 22 bp, Homo sapiens
agtattgttgtccttttcatag

SEQ ID NO: 809669 - DNA, 15 bp, Homo sapiens
agtatttaaatgttc

SEQ ID NO: 809670 - DNA, 12 bp, Homo sapiens
agtatttactct

SEQ ID NO: 809671 - DNA, 17 bp, Homo sapiens
agtatttataaaaatat

SEQ ID NO: 809672 - DNA, 20 bp, Homo sapiens
agtatttataaaaatataaa

SEQ ID NO: 809673 - DNA, 16 bp, Homo sapiens
agtatttataatagca

SEQ ID NO: 809674 - DNA, 12 bp, Homo sapiens
agtatttatata

SEQ ID NO: 809675 - DNA, 23 bp, Homo sapiens
agtatttatatatttataactca

SEQ ID NO: 809676 - DNA, 15 bp, Homo sapiens
agtatttattgtcag

SEQ ID NO: 809677 - DNA, 13 bp, Homo sapiens
agtatttcattgc

SEQ ID NO: 809678 - DNA, 15 bp, Homo sapiens
agtatttcattgcct

SEQ ID NO: 809679 - DNA, 12 bp, Homo sapiens
agtatttccctt

SEQ ID NO: 809680 - DNA, 13 bp, Homo sapiens
agtatttcccttc

SEQ ID NO: 809681 - DNA, 14 bp, Homo sapiens
agtatttcccttcc

SEQ ID NO: 809682 - DNA, 19 bp, Homo sapiens
agtatttcccttccaaaga

SEQ ID NO: 809683 - DNA, 22 bp, Homo sapiens
agtatttccttccactgtagct

SEQ ID NO: 809684 - DNA, 23 bp, Homo sapiens
agtatttccttccactgtagcta

SEQ ID NO: 809685 - DNA, 12 bp, Homo sapiens
agtatttctcag

SEQ ID NO: 809686 - DNA, 14 bp, Homo sapiens
agtatttctcagga

SEQ ID NO: 809687 - DNA, 13 bp, Homo sapiens
agtatttgattca

SEQ ID NO: 809688 - DNA, 17 bp, Homo sapiens
agtatttgattcaaaat

SEQ ID NO: 809689 - DNA, 21 bp, Homo sapiens
agtatttgggaagtgaagact

SEQ ID NO: 809690 - DNA, 18 bp, Homo sapiens
agtatttggtccaaaaaa

SEQ ID NO: 809691 - DNA, 19 bp, Homo sapiens
agtatttggtccaaaaaaa

SEQ ID NO: 809692 - DNA, 22 bp, Homo sapiens
agtatttggtccaaaaaaagga

SEQ ID NO: 809693 - DNA, 16 bp, Homo sapiens
agtattttaaaatagc

SEQ ID NO: 809694 - DNA, 17 bp, Homo sapiens
agtattttaaaatagcg

SEQ ID NO: 809695 - DNA, 19 bp, Homo sapiens
agtattttaagaagacata

SEQ ID NO: 809696 - DNA, 13 bp, Homo sapiens
agtattttatctg

SEQ ID NO: 809697 - DNA, 21 bp, Homo sapiens
agtattttccagccttatgtg

SEQ ID NO: 809698 - DNA, 13 bp, Homo sapiens
agtatttttatac

SEQ ID NO: 809699 - DNA, 15 bp, Homo sapiens
agtattttttacatt

SEQ ID NO: 809700 - DNA, 18 bp, Homo sapiens
agtattttttacatttta

SEQ ID NO: 809701 - DNA, 19 bp, Homo sapiens
agtattttttacattttac

SEQ ID NO: 809702 - DNA, 19 bp, Homo sapiens
agtattttttcaagttgta

SEQ ID NO: 809703 - DNA, 19 bp, Homo sapiens
agtattttttgtataattg

SEQ ID NO: 809704 - DNA, 20 bp, Homo sapiens
agtatttttttttaattttg

SEQ ID NO: 809705 - DNA, 20 bp, Homo sapiens
agtcaaaaaattatttgcta

SEQ ID NO: 809706 - DNA, 21 bp, Homo sapiens
agtcaaaacagagatgtgata

SEQ ID NO: 809707 - DNA, 14 bp, Homo sapiens
agtcaaaagcctgg

SEQ ID NO: 809708 - DNA, 15 bp, Homo sapiens
agtcaaaaggtgcct

SEQ ID NO: 809709 - DNA, 18 bp, Homo sapiens
agtcaaaaggtgcctgtg

SEQ ID NO: 809710 - DNA, 19 bp, Homo sapiens
agtcaaaggcatctccctt

SEQ ID NO: 809711 - DNA, 17 bp, Homo sapiens
agtcaaatctgggctca

SEQ ID NO: 809712 - DNA, 18 bp, Homo sapiens
agtcaaattaataatctt

SEQ ID NO: 809713 - DNA, 20 bp, Homo sapiens
agtcaaattaataatcttat

SEQ ID NO: 809714 - DNA, 22 bp, Homo sapiens
agtcaaatttgaaaataattgt

SEQ ID NO: 809715 - DNA, 14 bp, Homo sapiens
agtcaacagtaaac

SEQ ID NO: 809716 - DNA, 17 bp, Homo sapiens
agtcaacagtaaaccac

SEQ ID NO: 809717 - DNA, 21 bp, Homo sapiens
agtcaacagtaaaccactgaa

SEQ ID NO: 809718 - DNA, 15 bp, Homo sapiens
agtcaacctgcctga

SEQ ID NO: 809719 - DNA, 14 bp, Homo sapiens
agtcaactggctgg

SEQ ID NO: 809720 - DNA, 17 bp, Homo sapiens
agtcaactggctggcca

SEQ ID NO: 809721 - DNA, 13 bp, Homo sapiens
agtcaagaagaat

SEQ ID NO: 809722 - DNA, 13 bp, Homo sapiens
agtcaagctcctc

SEQ ID NO: 809723 - DNA, 14 bp, Homo sapiens
agtcaagctcctcc

SEQ ID NO: 809724 - DNA, 18 bp, Homo sapiens
agtcaagctcctcctccc

SEQ ID NO: 809725 - DNA, 22 bp, Homo sapiens
agtcaagctcctcctccctgca

SEQ ID NO: 809726 - DNA, 22 bp, Homo sapiens
agtcaagctgttgaagtctcag

SEQ ID NO: 809727 - DNA, 18 bp, Homo sapiens
agtcaataaaagagctgt

SEQ ID NO: 809728 - DNA, 20 bp, Homo sapiens
agtcaataaaatgaacctga

SEQ ID NO: 809729 - DNA, 10 bp, Homo sapiens
agtcaataca

SEQ ID NO: 809730 - DNA, 19 bp, Homo sapiens
agtcaatcagcctttaggt

SEQ ID NO: 809731 - DNA, 16 bp, Homo sapiens
agtcaatccaagacta

SEQ ID NO: 809732 - DNA, 20 bp, Homo sapiens
agtcaatggaagaaatggct

SEQ ID NO: 809733 - DNA, 15 bp, Homo sapiens
agtcaatggatccac

SEQ ID NO: 809734 - DNA, 13 bp, Homo sapiens
agtcaatgtactt

SEQ ID NO: 809735 - DNA, 22 bp, Homo sapiens
agtcacaaactgatctaaaatg

SEQ ID NO: 809736 - DNA, 16 bp, Homo sapiens
agtcacaacagagtga

SEQ ID NO: 809737 - DNA, 12 bp, Homo sapiens
agtcacaatgag

SEQ ID NO: 809738 - DNA, 19 bp, Homo sapiens
agtcacactgctagcaaat

SEQ ID NO: 809739 - DNA, 11 bp, Homo sapiens
agtcacagctg

SEQ ID NO: 809740 - DNA, 18 bp, Homo sapiens
agtcacagctgcagctgg

SEQ ID NO: 809741 - DNA, 21 bp, Homo sapiens
agtcacagctgcagctgggcc

SEQ ID NO: 809742 - DNA, 23 bp, Homo sapiens
agtcacagctgcagctgggcccc

SEQ ID NO: 809743 - DNA, 15 bp, Homo sapiens
agtcacatcacagga

SEQ ID NO: 809744 - DNA, 23 bp, Homo sapiens
agtcacatcctgggatccagtgt

SEQ ID NO: 809745 - DNA, 14 bp, Homo sapiens
agtcacatctcttc

SEQ ID NO: 809746 - DNA, 14 bp, Homo sapiens
agtcacattctgct

SEQ ID NO: 809747 - DNA, 16 bp, Homo sapiens
agtcacattgatgtaa

SEQ ID NO: 809748 - DNA, 21 bp, Homo sapiens
agtcaccaaatagtgtgaaat

SEQ ID NO: 809749 - DNA, 14 bp, Homo sapiens
agtcaccacccagc

SEQ ID NO: 809750 - DNA, 15 bp, Homo sapiens
agtcaccacccagcc

SEQ ID NO: 809751 - DNA, 18 bp, Homo sapiens
agtcaccacccagccctt

SEQ ID NO: 809752 - DNA, 16 bp, Homo sapiens
agtcaccaggacttgg

SEQ ID NO: 809753 - DNA, 18 bp, Homo sapiens
agtcacccaaacacttct

SEQ ID NO: 809754 - DNA, 17 bp, Homo sapiens
agtcacccatgaagaca

SEQ ID NO: 809755 - DNA, 20 bp, Homo sapiens
agtcacccatgaagacagga

SEQ ID NO: 809756 - DNA, 15 bp, Homo sapiens
agtcaccctcctcac

SEQ ID NO: 809757 - DNA, 12 bp, Homo sapiens
agtcacctcctc

SEQ ID NO: 809758 - DNA, 13 bp, Homo sapiens
agtcacctctgtc

SEQ ID NO: 809759 - DNA, 16 bp, Homo sapiens
agtcacctgcaagccc

SEQ ID NO: 809760 - DNA, 22 bp, Homo sapiens
agtcacctgcaagccccagggc

SEQ ID NO: 809761 - DNA, 13 bp, Homo sapiens
agtcacctgctcc

SEQ ID NO: 809762 - DNA, 15 bp, Homo sapiens
agtcacctgctccag

SEQ ID NO: 809763 - DNA, 13 bp, Homo sapiens
agtcaccttccct

SEQ ID NO: 809764 - DNA, 14 bp, Homo sapiens
agtcaccttccctt

SEQ ID NO: 809765 - DNA, 15 bp, Homo sapiens
agtcaccttcccttg

SEQ ID NO: 809766 - DNA, 21 bp, Homo sapiens
agtcaccttcccttgccactt

SEQ ID NO: 809767 - DNA, 23 bp, Homo sapiens
agtcaccttcccttgccactttg

SEQ ID NO: 809768 - DNA, 13 bp, Homo sapiens
agtcaccttctgg

SEQ ID NO: 809769 - DNA, 13 bp, Homo sapiens
agtcacctttctg

SEQ ID NO: 809770 - DNA, 21 bp, Homo sapiens
agtcacggctgcgcactgtgt

SEQ ID NO: 809771 - DNA, 20 bp, Homo sapiens
agtcactagtgaacaattcg

SEQ ID NO: 809772 - DNA, 18 bp, Homo sapiens
agtcactccctctgcctt

SEQ ID NO: 809773 - DNA, 15 bp, Homo sapiens
agtcactgaacaaaa

SEQ ID NO: 809774 - DNA, 16 bp, Homo sapiens
agtcactgcctgcaga

SEQ ID NO: 809775 - DNA, 13 bp, Homo sapiens
agtcacttaaaat

SEQ ID NO: 809776 - DNA, 16 bp, Homo sapiens
agtcacttatttcata

SEQ ID NO: 809777 - DNA, 15 bp, Homo sapiens
agtcacttccagtgt

SEQ ID NO: 809778 - DNA, 14 bp, Homo sapiens
agtcagaacagcag

SEQ ID NO: 809779 - DNA, 17 bp, Homo sapiens
agtcagaacagcagact

SEQ ID NO: 809780 - DNA, 20 bp, Homo sapiens
agtcagaagcaggttcttga

SEQ ID NO: 809781 - DNA, 12 bp, Homo sapiens
agtcagagccct

SEQ ID NO: 809782 - DNA, 14 bp, Homo sapiens
agtcagagccctgg

SEQ ID NO: 809783 - DNA, 16 bp, Homo sapiens
agtcagagccctggct

SEQ ID NO: 809784 - DNA, 13 bp, Homo sapiens
agtcagaggagaa

SEQ ID NO: 809785 - DNA, 16 bp, Homo sapiens
agtcagaggagaagag

SEQ ID NO: 809786 - DNA, 14 bp, Homo sapiens
agtcagagtccagt

SEQ ID NO: 809787 - DNA, 20 bp, Homo sapiens
agtcagagtccagtgctctg

SEQ ID NO: 809788 - DNA, 17 bp, Homo sapiens
agtcagatcctgttact

SEQ ID NO: 809789 - DNA, 23 bp, Homo sapiens
agtcagatgcccagagggcccag

SEQ ID NO: 809790 - DNA, 18 bp, Homo sapiens
agtcagatgggtctgata

SEQ ID NO: 809791 - DNA, 21 bp, Homo sapiens
agtcagatgtttgagcagtgg

SEQ ID NO: 809792 - DNA, 19 bp, Homo sapiens
agtcagcaccttggcccag

SEQ ID NO: 809793 - DNA, 15 bp, Homo sapiens
agtcagccacactgg

SEQ ID NO: 809794 - DNA, 17 bp, Homo sapiens
agtcagccacactgggc

SEQ ID NO: 809795 - DNA, 19 bp, Homo sapiens
agtcagccacactgggcct

SEQ ID NO: 809796 - DNA, 20 bp, Homo sapiens
agtcagccacactgggcctg

SEQ ID NO: 809797 - DNA, 18 bp, Homo sapiens
agtcagccaggagctgtc

SEQ ID NO: 809798 - DNA, 14 bp, Homo sapiens
agtcagccagtggc

SEQ ID NO: 809799 - DNA, 18 bp, Homo sapiens
agtcagcccgaatgcctg

SEQ ID NO: 809800 - DNA, 16 bp, Homo sapiens
agtcagcctacataac

SEQ ID NO: 809801 - DNA, 16 bp, Homo sapiens
agtcagcgtgacaata

SEQ ID NO: 809802 - DNA, 20 bp, Homo sapiens
agtcagcgtgacaatatact

SEQ ID NO: 809803 - DNA, 20 bp, Homo sapiens
agtcagctactctagttctg

SEQ ID NO: 809804 - DNA, 18 bp, Homo sapiens
agtcagctttcatctttg

SEQ ID NO: 809805 - DNA, 19 bp, Homo sapiens
agtcagctttgccttccac

SEQ ID NO: 809806 - DNA, 22 bp, Homo sapiens
agtcagctttgccttccacgct

SEQ ID NO: 809807 - DNA, 20 bp, Homo sapiens
agtcaggaatcattaatttc

SEQ ID NO: 809808 - DNA, 17 bp, Homo sapiens
agtcaggaatggctgca

SEQ ID NO: 809809 - DNA, 22 bp, Homo sapiens
agtcaggagttttactgcctgt

SEQ ID NO: 809810 - DNA, 17 bp, Homo sapiens
agtcaggccaggtgggc

SEQ ID NO: 809811 - DNA, 18 bp, Homo sapiens
agtcagggaagagcagtg

SEQ ID NO: 809812 - DNA, 21 bp, Homo sapiens
agtcagggcacagctgccctg

SEQ ID NO: 809813 - DNA, 22 bp, Homo sapiens
agtcagggcacagctgccctgc

SEQ ID NO: 809814 - DNA, 20 bp, Homo sapiens
agtcaggggagaagctgaag

SEQ ID NO: 809815 - DNA, 11 bp, Homo sapiens
agtcaggggct

SEQ ID NO: 809816 - DNA, 15 bp, Homo sapiens
agtcaggggctctgt

SEQ ID NO: 809817 - DNA, 19 bp, Homo sapiens
agtcaggggctctgtgtta

SEQ ID NO: 809818 - DNA, 17 bp, Homo sapiens
agtcaggggtcaggtgt

SEQ ID NO: 809819 - DNA, 23 bp, Homo sapiens
agtcaggggtcaggtgtcaggcc

SEQ ID NO: 809820 - DNA, 18 bp, Homo sapiens
agtcagggttcacttggg

SEQ ID NO: 809821 - DNA, 14 bp, Homo sapiens
agtcaggtaatata

SEQ ID NO: 809822 - DNA, 17 bp, Homo sapiens
agtcagtgctctcagct

SEQ ID NO: 809823 - DNA, 22 bp, Homo sapiens
agtcagtgggaacgtgactgcc

SEQ ID NO: 809824 - DNA, 14 bp, Homo sapiens
agtcagtgtttctt

SEQ ID NO: 809825 - DNA, 16 bp, Homo sapiens
agtcagttgaaattct

SEQ ID NO: 809826 - DNA, 14 bp, Homo sapiens
agtcataccaatga

SEQ ID NO: 809827 - DNA, 18 bp, Homo sapiens
agtcatataaaagctatg

SEQ ID NO: 809828 - DNA, 13 bp, Homo sapiens
agtcatcatcagg

SEQ ID NO: 809829 - DNA, 18 bp, Homo sapiens
agtcatcatcagggcctg

SEQ ID NO: 809830 - DNA, 19 bp, Homo sapiens
agtcatcatcagggcctgg

SEQ ID NO: 809831 - DNA, 15 bp, Homo sapiens
agtcatcattacttg

SEQ ID NO: 809832 - DNA, 21 bp, Homo sapiens
agtcatcccctctcaggagag

SEQ ID NO: 809833 - DNA, 13 bp, Homo sapiens
agtcatcctgccc

SEQ ID NO: 809834 - DNA, 19 bp, Homo sapiens
agtcatcctgccctgcagc

SEQ ID NO: 809835 - DNA, 18 bp, Homo sapiens
agtcatctacttaataaa

SEQ ID NO: 809836 - DNA, 19 bp, Homo sapiens
agtcatctacttaataaat

SEQ ID NO: 809837 - DNA, 16 bp, Homo sapiens
agtcatctactttttt

SEQ ID NO: 809838 - DNA, 14 bp, Homo sapiens
agtcatctatagtt

SEQ ID NO: 809839 - DNA, 15 bp, Homo sapiens
agtcatctcccctcc

SEQ ID NO: 809840 - DNA, 21 bp, Homo sapiens
agtcatctgtaagagcttgct

SEQ ID NO: 809841 - DNA, 23 bp, Homo sapiens
agtcatcttgctaccagtattta

SEQ ID NO: 809842 - DNA, 18 bp, Homo sapiens
agtcatcttgtgagtgga

SEQ ID NO: 809843 - DNA, 15 bp, Homo sapiens
agtcatgatctccct

SEQ ID NO: 809844 - DNA, 18 bp, Homo sapiens
agtcatgatctccctgcc

SEQ ID NO: 809845 - DNA, 15 bp, Homo sapiens
agtcatgatgaatca

SEQ ID NO: 809846 - DNA, 21 bp, Homo sapiens
agtcatgctgaatactcctcc

SEQ ID NO: 809847 - DNA, 18 bp, Homo sapiens
agtcatggaatcttgctg

SEQ ID NO: 809848 - DNA, 17 bp, Homo sapiens
agtcatgggaacgcagc

SEQ ID NO: 809849 - DNA, 12 bp, Homo sapiens
agtcatggtact

SEQ ID NO: 809850 - DNA, 11 bp, Homo sapiens
agtcatgtatg

SEQ ID NO: 809851 - DNA, 13 bp, Homo sapiens
agtcatgtgagcc

SEQ ID NO: 809852 - DNA, 13 bp, Homo sapiens
agtcatgtgcatt

SEQ ID NO: 809853 - DNA, 14 bp, Homo sapiens
agtcatgtttatct

SEQ ID NO: 809854 - DNA, 19 bp, Homo sapiens
agtcatgtttatctgctta

SEQ ID NO: 809855 - DNA, 15 bp, Homo sapiens
agtcattagaatgtc

SEQ ID NO: 809856 - DNA, 12 bp, Homo sapiens
agtcattcttac

SEQ ID NO: 809857 - DNA, 15 bp, Homo sapiens
agtcattggctgtct

SEQ ID NO: 809858 - DNA, 21 bp, Homo sapiens
agtcattgtactgtttttaat

SEQ ID NO: 809859 - DNA, 18 bp, Homo sapiens
agtcattgtatgttatta

SEQ ID NO: 809860 - DNA, 13 bp, Homo sapiens
agtcattgtcata

SEQ ID NO: 809861 - DNA, 19 bp, Homo sapiens
agtcatttgctgagcatgt

SEQ ID NO: 809862 - DNA, 14 bp, Homo sapiens
agtcatttgtgaaa

SEQ ID NO: 809863 - DNA, 23 bp, Homo sapiens
agtcatttgtggttagaatcttg

SEQ ID NO: 809864 - DNA, 15 bp, Homo sapiens
agtcatttgtttaaa

SEQ ID NO: 809865 - DNA, 16 bp, Homo sapiens
agtcatttgtttaaac

SEQ ID NO: 809866 - DNA, 19 bp, Homo sapiens
agtcattttgtaatatttg

SEQ ID NO: 809867 - DNA, 20 bp, Homo sapiens
agtcattttgtaatatttga

SEQ ID NO: 809868 - DNA, 23 bp, Homo sapiens
agtcattttgtaatatttgaatt

SEQ ID NO: 809869 - DNA, 13 bp, Homo sapiens
agtcatttttagc

SEQ ID NO: 809870 - DNA, 19 bp, Homo sapiens
agtccaaatgtcctccaga

SEQ ID NO: 809871 - DNA, 23 bp, Homo sapiens
agtccaaatgtcctccagaagcc

SEQ ID NO: 809872 - DNA, 23 bp, Homo sapiens
agtccaacattttttcccagtga

SEQ ID NO: 809873 - DNA, 16 bp, Homo sapiens
agtccaaccagaaaca

SEQ ID NO: 809874 - DNA, 20 bp, Homo sapiens
agtccaactcacttccagtg

SEQ ID NO: 809875 - DNA, 11 bp, Homo sapiens
agtccaagctg

SEQ ID NO: 809876 - DNA, 16 bp, Homo sapiens
agtccaagctgggaga

SEQ ID NO: 809877 - DNA, 17 bp, Homo sapiens
agtccaattttaattta

SEQ ID NO: 809878 - DNA, 19 bp, Homo sapiens
agtccaattttaatttagt

SEQ ID NO: 809879 - DNA, 21 bp, Homo sapiens
agtccaattttaatttagtaa

SEQ ID NO: 809880 - DNA, 14 bp, Homo sapiens
agtccacaggggcc

SEQ ID NO: 809881 - DNA, 18 bp, Homo sapiens
agtccacggacccccaga

SEQ ID NO: 809882 - DNA, 19 bp, Homo sapiens
agtccacggacccccagag

SEQ ID NO: 809883 - DNA, 23 bp, Homo sapiens
agtccactcctgacccctctcct

SEQ ID NO: 809884 - DNA, 14 bp, Homo sapiens
agtccactgctcca

SEQ ID NO: 809885 - DNA, 12 bp, Homo sapiens
agtccactgtcc

SEQ ID NO: 809886 - DNA, 18 bp, Homo sapiens
agtccactgtcctccttg

SEQ ID NO: 809887 - DNA, 20 bp, Homo sapiens
agtccactgtcctccttggc

SEQ ID NO: 809888 - DNA, 13 bp, Homo sapiens
agtccagagcttg

SEQ ID NO: 809889 - DNA, 13 bp, Homo sapiens
agtccagctcccc

SEQ ID NO: 809890 - DNA, 12 bp, Homo sapiens
agtccagctcta

SEQ ID NO: 809891 - DNA, 13 bp, Homo sapiens
agtccaggaacaa

SEQ ID NO: 809892 - DNA, 22 bp, Homo sapiens
agtccaggatgctaacatctaa

SEQ ID NO: 809893 - DNA, 12 bp, Homo sapiens
agtcttaacaaa

SEQ ID NO: 809894 - DNA, 22 bp, Homo sapiens
agtcttaacaaaccaacatctt

SEQ ID NO: 809895 - DNA, 16 bp, Homo sapiens
agtcttaactgtattt

SEQ ID NO: 809896 - DNA, 18 bp, Homo sapiens
agtcttaatttatttctt

SEQ ID NO: 809897 - DNA, 18 bp, Homo sapiens
agtcttacaatcaaatct

SEQ ID NO: 809898 - DNA, 19 bp, Homo sapiens
agtcttacaatcaaatctc

SEQ ID NO: 809899 - DNA, 16 bp, Homo sapiens
agtcttacgaatactt

SEQ ID NO: 809900 - DNA, 14 bp, Homo sapiens
agtcttagatgtat

SEQ ID NO: 809901 - DNA, 16 bp, Homo sapiens
agtcttagatgtatat

SEQ ID NO: 809902 - DNA, 17 bp, Homo sapiens
agtcttagtaatagcat

SEQ ID NO: 809903 - DNA, 17 bp, Homo sapiens
agtcttatgtaaagtat

SEQ ID NO: 809904 - DNA, 13 bp, Homo sapiens
agtcttcaactgg

SEQ ID NO: 809905 - DNA, 22 bp, Homo sapiens
agtcttcaactggttagtgtga

SEQ ID NO: 809906 - DNA, 18 bp, Homo sapiens
agtcttcagacccagaga

SEQ ID NO: 809907 - DNA, 21 bp, Homo sapiens
agtcttccaaggccagaagga

SEQ ID NO: 809908 - DNA, 17 bp, Homo sapiens
agtcttccatttgcaag

SEQ ID NO: 809909 - DNA, 18 bp, Homo sapiens
agtcttcccttacctcaa

SEQ ID NO: 809910 - DNA, 17 bp, Homo sapiens
agtcttcctgacacttt

SEQ ID NO: 809911 - DNA, 12 bp, Homo sapiens
agtcttccttaa

SEQ ID NO: 809912 - DNA, 16 bp, Homo sapiens
agtcttccttgtctct

SEQ ID NO: 809913 - DNA, 20 bp, Homo sapiens
agtcttccttgtggaatgct

SEQ ID NO: 809914 - DNA, 18 bp, Homo sapiens
agtcttctcatagcatta

SEQ ID NO: 809915 - DNA, 20 bp, Homo sapiens
agtcttctcatagcattaac

SEQ ID NO: 809916 - DNA, 23 bp, Homo sapiens
agtcttctcctccatgaacatca

SEQ ID NO: 809917 - DNA, 16 bp, Homo sapiens
agtcttggaagctgtt

SEQ ID NO: 809918 - DNA, 22 bp, Homo sapiens
agtcttggaagctgtttggaaa

SEQ ID NO: 809919 - DNA, 22 bp, Homo sapiens
agtcttggcggcagcagccatc

SEQ ID NO: 809920 - DNA, 15 bp, Homo sapiens
agtcttggctcactg

SEQ ID NO: 809921 - DNA, 18 bp, Homo sapiens
agtcttgggtctgaattt

SEQ ID NO: 809922 - DNA, 14 bp, Homo sapiens
agtcttgggtggcg

SEQ ID NO: 809923 - DNA, 13 bp, Homo sapiens
agtcttgtcccaa

SEQ ID NO: 809924 - DNA, 15 bp, Homo sapiens
agtcttgtgcttttc

SEQ ID NO: 809925 - DNA, 17 bp, Homo sapiens
agtctttaaaggcccag

SEQ ID NO: 809926 - DNA, 17 bp, Homo sapiens
agtctttcccaatctct

SEQ ID NO: 809927 - DNA, 19 bp, Homo sapiens
agtctttccttagttaaaa

SEQ ID NO: 809928 - DNA, 20 bp, Homo sapiens
agtctttcttagtgcctgtg

SEQ ID NO: 809929 - DNA, 18 bp, Homo sapiens
agtctttgcaccaaagat

SEQ ID NO: 809930 - DNA, 13 bp, Homo sapiens
agtctttgctcag

SEQ ID NO: 809931 - DNA, 14 bp, Homo sapiens
agtctttgctcagt

SEQ ID NO: 809932 - DNA, 16 bp, Homo sapiens
agtctttgctcagtgt

SEQ ID NO: 809933 - DNA, 17 bp, Homo sapiens
agtctttgtgtgttata

SEQ ID NO: 809934 - DNA, 13 bp, Homo sapiens
agtcttttctgtc

SEQ ID NO: 809935 - DNA, 14 bp, Homo sapiens
agtcttttctgtca

SEQ ID NO: 809936 - DNA, 23 bp, Homo sapiens
agtcttttgcatgtcgcacaatg

SEQ ID NO: 809937 - DNA, 12 bp, Homo sapiens
agtcttttgctt

SEQ ID NO: 809938 - DNA, 18 bp, Homo sapiens
agtcttttgcttttggca

SEQ ID NO: 809939 - DNA, 15 bp, Homo sapiens
agtcttttgtaatat

SEQ ID NO: 809940 - DNA, 11 bp, Homo sapiens
agtcttttgtc

SEQ ID NO: 809941 - DNA, 22 bp, Homo sapiens
agtcttttgttcgcatggtcac

SEQ ID NO: 809942 - DNA, 16 bp, Homo sapiens
agtctttttcattttg

SEQ ID NO: 809943 - DNA, 17 bp, Homo sapiens
agtgaaaaaaagaaacg

SEQ ID NO: 809944 - DNA, 14 bp, Homo sapiens
agtgaaaaatatgt

SEQ ID NO: 809945 - DNA, 17 bp, Homo sapiens
agtgaaaaatatgttga

SEQ ID NO: 809946 - DNA, 22 bp, Homo sapiens
agtgaaaaatatgttgagtgtt

SEQ ID NO: 809947 - DNA, 13 bp, Homo sapiens
agtgaaaaatctt

SEQ ID NO: 809948 - DNA, 22 bp, Homo sapiens
agtgaaaaatcttaagtaccaa

SEQ ID NO: 809949 - DNA, 19 bp, Homo sapiens
agtgaaaagattttattta

SEQ ID NO: 809950 - DNA, 18 bp, Homo sapiens
agtgaaaattctgttggt

SEQ ID NO: 809951 - DNA, 14 bp, Homo sapiens
agtgaaacagagaa

SEQ ID NO: 809952 - DNA, 19 bp, Homo sapiens
agtgaaacagagaaagaaa

SEQ ID NO: 809953 - DNA, 22 bp, Homo sapiens
agtgaaacagagaaagaaaagg

SEQ ID NO: 809954 - DNA, 20 bp, Homo sapiens
agtgaaacataataataatg

SEQ ID NO: 809955 - DNA, 15 bp, Homo sapiens
agtgaaaccatgact

SEQ ID NO: 809956 - DNA, 17 bp, Homo sapiens
agtgaaaccatgactgt

SEQ ID NO: 809957 - DNA, 13 bp, Homo sapiens
agtgaaacttgtg

SEQ ID NO: 809958 - DNA, 21 bp, Homo sapiens
agtgaaagtgaggaaataaag

SEQ ID NO: 809959 - DNA, 21 bp, Homo sapiens
agtgaaattttggtgaatgtg

SEQ ID NO: 809960 - DNA, 21 bp, Homo sapiens
agtgaacattcccagcccagc

SEQ ID NO: 809961 - DNA, 13 bp, Homo sapiens
agtgaaccaaaga

SEQ ID NO: 809962 - DNA, 22 bp, Homo sapiens
agtgaaccaaagagactggagc

SEQ ID NO: 809963 - DNA, 17 bp, Homo sapiens
agtgaacctaccttcat

SEQ ID NO: 809964 - DNA, 17 bp, Homo sapiens
agtgaactcctgccagg

SEQ ID NO: 809965 - DNA, 12 bp, Homo sapiens
agtgaagaatac

SEQ ID NO: 809966 - DNA, 13 bp, Homo sapiens
agtgaagaatctt

SEQ ID NO: 809967 - DNA, 17 bp, Homo sapiens
agtgaagacttcttggg

SEQ ID NO: 809968 - DNA, 13 bp, Homo sapiens
agtgaagaggggc

SEQ ID NO: 809969 - DNA, 15 bp, Homo sapiens
agtgaagaggggcag

SEQ ID NO: 809970 - DNA, 16 bp, Homo sapiens
agtgaagaggggcagc

SEQ ID NO: 809971 - DNA, 18 bp, Homo sapiens
agtgaaggaaataaaggt

SEQ ID NO: 809972 - DNA, 12 bp, Homo sapiens
agtgaaggagaa

SEQ ID NO: 809973 - DNA, 20 bp, Homo sapiens
agtgaaggttcccaaggaca

SEQ ID NO: 809974 - DNA, 23 bp, Homo sapiens
agtgaaggtttacaatttacaaa

SEQ ID NO: 809975 - DNA, 18 bp, Homo sapiens
agtgaagtaaaattgagt

SEQ ID NO: 809976 - DNA, 20 bp, Homo sapiens
agtgaagtacacctgtgtgg

SEQ ID NO: 809977 - DNA, 15 bp, Homo sapiens
agtgaagtccttcag

SEQ ID NO: 809978 - DNA, 22 bp, Homo sapiens
agtgaagtccttcagtgagccc

SEQ ID NO: 809979 - DNA, 17 bp, Homo sapiens
agtgaagtctagaatca

SEQ ID NO: 809980 - DNA, 19 bp, Homo sapiens
agtgaagtctagaatcata

SEQ ID NO: 809981 - DNA, 15 bp, Homo sapiens
agtgaagtggcctct

SEQ ID NO: 809982 - DNA, 19 bp, Homo sapiens
agtgaagttgcttcttcta

SEQ ID NO: 809983 - DNA, 14 bp, Homo sapiens
agtgaataaatgtc

SEQ ID NO: 809984 - DNA, 17 bp, Homo sapiens
agtgaataaatgtcttg

SEQ ID NO: 809985 - DNA, 17 bp, Homo sapiens
agtgaataacctgagga

SEQ ID NO: 809986 - DNA, 20 bp, Homo sapiens
agtgaatacattttataatt

SEQ ID NO: 809987 - DNA, 21 bp, Homo sapiens
agtgaatacattttataattt

SEQ ID NO: 809988 - DNA, 16 bp, Homo sapiens
agtgaatactgctaca

SEQ ID NO: 809989 - DNA, 22 bp, Homo sapiens
agtgaatacttactataatttg

SEQ ID NO: 809990 - DNA, 14 bp, Homo sapiens
agtgaatccctggg

SEQ ID NO: 809991 - DNA, 13 bp, Homo sapiens
agtgaatctgatt

SEQ ID NO: 809992 - DNA, 20 bp, Homo sapiens
agtgaatctttctcctggtg

SEQ ID NO: 809993 - DNA, 19 bp, Homo sapiens
agtgaatgattcagtgtta

SEQ ID NO: 809994 - DNA, 17 bp, Homo sapiens
agtgaatgctagacaga

SEQ ID NO: 809995 - DNA, 15 bp, Homo sapiens
agtgaattgtaccta

SEQ ID NO: 809996 - DNA, 21 bp, Homo sapiens
agtgaattgtacctatttctg

SEQ ID NO: 809997 - DNA, 24 bp, Homo sapiens
agtgaattgtacctatttctgatg

SEQ ID NO: 809998 - DNA, 13 bp, Homo sapiens
agtgaattgtctt

SEQ ID NO: 809999 - DNA, 18 bp, Homo sapiens
agtgaatttatgagattt

SEQ ID NO: 810000 - DNA, 15 bp, Homo sapiens
agtgaatttgaatga

SEQ ID NO: 810001 - DNA, 12 bp, Homo sapiens
agtgaatttgtc

SEQ ID NO: 810002 - DNA, 14 bp, Homo sapiens
agtgaatttgtcca

SEQ ID NO: 810003 - DNA, 21 bp, Homo sapiens
agtgaatttgtccattgtaaa

SEQ ID NO: 810004 - DNA, 23 bp, Homo sapiens
agtgaatttttctctaactcaga

SEQ ID NO: 810005 - DNA, 19 bp, Homo sapiens
agtgacaaaatgggaggag

SEQ ID NO: 810006 - DNA, 18 bp, Homo sapiens
agtgacaaagactcctct

SEQ ID NO: 810007 - DNA, 14 bp, Homo sapiens
agtgacaaggcccc

SEQ ID NO: 810008 - DNA, 13 bp, Homo sapiens
agtgacacacact

SEQ ID NO: 810009 - DNA, 15 bp, Homo sapiens
agtgacacacactgt

SEQ ID NO: 810010 - DNA, 23 bp, Homo sapiens
agtgacacagcagcttcaccaga

SEQ ID NO: 810011 - DNA, 17 bp, Homo sapiens
agtgacacattaatgat

SEQ ID NO: 810012 - DNA, 21 bp, Homo sapiens
agtgacacctcagtcatattt

SEQ ID NO: 810013 - DNA, 15 bp, Homo sapiens
agtgacacttcagag

SEQ ID NO: 810014 - DNA, 17 bp, Homo sapiens
agtgacagacaggctct

SEQ ID NO: 810015 - DNA, 23 bp, Homo sapiens
agtgcctttttccttatttcaag

SEQ ID NO: 810016 - DNA, 13 bp, Homo sapiens
agtgcgatgtgga

SEQ ID NO: 810017 - DNA, 18 bp, Homo sapiens
agtgcgatgtttcaggag

SEQ ID NO: 810018 - DNA, 17 bp, Homo sapiens
agtgcgcagatctgtgc

SEQ ID NO: 810019 - DNA, 23 bp, Homo sapiens
agtgcgcagatctgtgcctggga

SEQ ID NO: 810020 - DNA, 18 bp, Homo sapiens
agtgcgctcttggtccct

SEQ ID NO: 810021 - DNA, 14 bp, Homo sapiens
agtgcgtgaatgta

SEQ ID NO: 810022 - DNA, 14 bp, Homo sapiens
agtgcgtggatctg

SEQ ID NO: 810023 - DNA, 21 bp, Homo sapiens
agtgcgtggtataatctccat

SEQ ID NO: 810024 - DNA, 13 bp, Homo sapiens
agtgcgttctccc

SEQ ID NO: 810025 - DNA, 16 bp, Homo sapiens
agtgcgttctcccagc

SEQ ID NO: 810026 - DNA, 19 bp, Homo sapiens
agtgcgttctcccagcact

SEQ ID NO: 810027 - DNA, 18 bp, Homo sapiens
agtgctaaagttttcttc

SEQ ID NO: 810028 - DNA, 17 bp, Homo sapiens
agtgctacctttgagtg

SEQ ID NO: 810029 - DNA, 24 bp, Homo sapiens
agtgctagaaaatttagcccttta

SEQ ID NO: 810030 - DNA, 21 bp, Homo sapiens
agtgctatgcggaggaaagca

SEQ ID NO: 810031 - DNA, 19 bp, Homo sapiens
agtgctattctgtgttgaa

SEQ ID NO: 810032 - DNA, 22 bp, Homo sapiens
agtgctcaccagccctgcagcc

SEQ ID NO: 810033 - DNA, 17 bp, Homo sapiens
agtgctccctcacatgt

SEQ ID NO: 810034 - DNA, 19 bp, Homo sapiens
agtgctcctccgtgtggac

SEQ ID NO: 810035 - DNA, 18 bp, Homo sapiens
agtgctctcagctggcag

SEQ ID NO: 810036 - DNA, 22 bp, Homo sapiens
agtgctctgaccctgggctttc

SEQ ID NO: 810037 - DNA, 21 bp, Homo sapiens
agtgctctgatccctctacag

SEQ ID NO: 810038 - DNA, 16 bp, Homo sapiens
agtgctcttggctgac

SEQ ID NO: 810039 - DNA, 17 bp, Homo sapiens
agtgctcttggctgacc

SEQ ID NO: 810040 - DNA, 22 bp, Homo sapiens
agtgctcttggctgacccctct

SEQ ID NO: 810041 - DNA, 23 bp, Homo sapiens
agtgctcttggctgacccctctg

SEQ ID NO: 810042 - DNA, 16 bp, Homo sapiens
agtgctgatccggctg

SEQ ID NO: 810043 - DNA, 16 bp, Homo sapiens
agtgctgcagcctaat

SEQ ID NO: 810044 - DNA, 17 bp, Homo sapiens
agtgctgcatttaaaag

SEQ ID NO: 810045 - DNA, 20 bp, Homo sapiens
agtgctgcatttaaaagata

SEQ ID NO: 810046 - DNA, 11 bp, Homo sapiens
agtgctgccat

SEQ ID NO: 810047 - DNA, 19 bp, Homo sapiens
agtgctgccatgccactgc

SEQ ID NO: 810048 - DNA, 18 bp, Homo sapiens
agtgctgccccttgcaag

SEQ ID NO: 810049 - DNA, 19 bp, Homo sapiens
agtgctgccccttgcaagc

SEQ ID NO: 810050 - DNA, 23 bp, Homo sapiens
agtgctgccccttgcaagccata

SEQ ID NO: 810051 - DNA, 12 bp, Homo sapiens
agtgctgccctg

SEQ ID NO: 810052 - DNA, 13 bp, Homo sapiens
agtgctgccctgc

SEQ ID NO: 810053 - DNA, 17 bp, Homo sapiens
agtgctgcctgtcccca

SEQ ID NO: 810054 - DNA, 15 bp, Homo sapiens
agtgctgctgtaaat

SEQ ID NO: 810055 - DNA, 19 bp, Homo sapiens
agtgctgctgtaaatacag

SEQ ID NO: 810056 - DNA, 13 bp, Homo sapiens
agtgctgcttctc

SEQ ID NO: 810057 - DNA, 14 bp, Homo sapiens
agtgctggaaggga

SEQ ID NO: 810058 - DNA, 19 bp, Homo sapiens
agtgctggagtctcctgag

SEQ ID NO: 810059 - DNA, 13 bp, Homo sapiens
agtgctggctcac

SEQ ID NO: 810060 - DNA, 14 bp, Homo sapiens
agtgctggctcaca

SEQ ID NO: 810061 - DNA, 21 bp, Homo sapiens
agtgctgggatggaggggagt

SEQ ID NO: 810062 - DNA, 19 bp, Homo sapiens
agtgctgggattacaggca

SEQ ID NO: 810063 - DNA, 14 bp, Homo sapiens
agtgctgggcactg

SEQ ID NO: 810064 - DNA, 21 bp, Homo sapiens
agtgctgggcactgctccaag

SEQ ID NO: 810065 - DNA, 15 bp, Homo sapiens
agtgctgggggaggc

SEQ ID NO: 810066 - DNA, 20 bp, Homo sapiens
agtgctgtaatattgtaaat

SEQ ID NO: 810067 - DNA, 18 bp, Homo sapiens
agtgctgtacccttccac

SEQ ID NO: 810068 - DNA, 22 bp, Homo sapiens
agtgctgtacccttccacctcc

SEQ ID NO: 810069 - DNA, 19 bp, Homo sapiens
agtgctgtcgggaccacat

SEQ ID NO: 810070 - DNA, 23 bp, Homo sapiens
agtgctgtcttgatgactgctga

SEQ ID NO: 810071 - DNA, 18 bp, Homo sapiens
agtgctgtggcctgggca

SEQ ID NO: 810072 - DNA, 21 bp, Homo sapiens
agtgctgtttattaatcttag

SEQ ID NO: 810073 - DNA, 19 bp, Homo sapiens
agtgctgttttgttatata

SEQ ID NO: 810074 - DNA, 20 bp, Homo sapiens
agtgctgttttgttatataa

SEQ ID NO: 810075 - DNA, 23 bp, Homo sapiens
agtgctgttttgttatataattt

SEQ ID NO: 810076 - DNA, 17 bp, Homo sapiens
agtgcttaaaaatcatt

SEQ ID NO: 810077 - DNA, 19 bp, Homo sapiens
agtgcttaacattttccca

SEQ ID NO: 810078 - DNA, 16 bp, Homo sapiens
agtgcttacattttaa

SEQ ID NO: 810079 - DNA, 17 bp, Homo sapiens
agtgcttataatgtgtg

SEQ ID NO: 810080 - DNA, 16 bp, Homo sapiens
agtgcttcacatttgt

SEQ ID NO: 810081 - DNA, 11 bp, Homo sapiens
agtgcttcaga

SEQ ID NO: 810082 - DNA, 17 bp, Homo sapiens
agtgcttcagagtttgt

SEQ ID NO: 810083 - DNA, 23 bp, Homo sapiens
agtgcttcagagtttgtgtgtat

SEQ ID NO: 810084 - DNA, 19 bp, Homo sapiens
agtgcttcagcctgaggct

SEQ ID NO: 810085 - DNA, 19 bp, Homo sapiens
agtgcttctccaacactga

SEQ ID NO: 810086 - DNA, 21 bp, Homo sapiens
agtgcttcttaaagagttctt

SEQ ID NO: 810087 - DNA, 21 bp, Homo sapiens
agtgcttcttactattaagca

SEQ ID NO: 810088 - DNA, 19 bp, Homo sapiens
agtgcttgagtttggggaa

SEQ ID NO: 810089 - DNA, 19 bp, Homo sapiens
agtgcttgatatgtaagta

SEQ ID NO: 810090 - DNA, 23 bp, Homo sapiens
agtgcttgcagatcatctgggga

SEQ ID NO: 810091 - DNA, 12 bp, Homo sapiens
agtgcttgcttt

SEQ ID NO: 810092 - DNA, 22 bp, Homo sapiens
agtgcttggaacatactgttca

SEQ ID NO: 810093 - DNA, 16 bp, Homo sapiens
agtgcttgggctccac

SEQ ID NO: 810094 - DNA, 23 bp, Homo sapiens
agtgcttgggtggtgggtgctgg

SEQ ID NO: 810095 - DNA, 22 bp, Homo sapiens
agtgcttgttagagagaaagag

SEQ ID NO: 810096 - DNA, 23 bp, Homo sapiens
agtgctttgacttcttgcttcag

SEQ ID NO: 810097 - DNA, 19 bp, Homo sapiens
agtgcttttaagtgaaaat

SEQ ID NO: 810098 - DNA, 23 bp, Homo sapiens
agtgcttttcagtgatactcacg

SEQ ID NO: 810099 - DNA, 16 bp, Homo sapiens
agtgcttttctgttta

SEQ ID NO: 810100 - DNA, 18 bp, Homo sapiens
agtggaaaaatagcctgc

SEQ ID NO: 810101 - DNA, 23 bp, Homo sapiens
agtggaaaataggctttttaatc

SEQ ID NO: 810102 - DNA, 16 bp, Homo sapiens
agtggaaaatgcaatg

SEQ ID NO: 810103 - DNA, 22 bp, Homo sapiens
agtggaacacaaatgaaaatga

SEQ ID NO: 810104 - DNA, 19 bp, Homo sapiens
agtggaagagcagcctgat

SEQ ID NO: 810105 - DNA, 21 bp, Homo sapiens
agtggaagtgcttgatatgta

SEQ ID NO: 810106 - DNA, 23 bp, Homo sapiens
agtggaagttcttcaagaggaaa

SEQ ID NO: 810107 - DNA, 15 bp, Homo sapiens
agtggaatgcaggga

SEQ ID NO: 810108 - DNA, 17 bp, Homo sapiens
agtggaattagagggcc

SEQ ID NO: 810109 - DNA, 16 bp, Homo sapiens
agtggaattccaactt

SEQ ID NO: 810110 - DNA, 19 bp, Homo sapiens
agtggacaaattttgagtt

SEQ ID NO: 810111 - DNA, 22 bp, Homo sapiens
agtggacaccaggagtccctgg

SEQ ID NO: 810112 - DNA, 17 bp, Homo sapiens
agtggacagtctggcca

SEQ ID NO: 810113 - DNA, 14 bp, Homo sapiens
agtggacatggtca

SEQ ID NO: 810114 - DNA, 21 bp, Homo sapiens
agtggaccacttggaaataaa

SEQ ID NO: 810115 - DNA, 14 bp, Homo sapiens
agtggaccaggaca

SEQ ID NO: 810116 - DNA, 15 bp, Homo sapiens
agtggaccaggacag

SEQ ID NO: 810117 - DNA, 13 bp, Homo sapiens
agtggaccctgtg

SEQ ID NO: 810118 - DNA, 19 bp, Homo sapiens
agtggacctagcctggatg

SEQ ID NO: 810119 - DNA, 18 bp, Homo sapiens
agtggaccttgagaccac

SEQ ID NO: 810120 - DNA, 17 bp, Homo sapiens
agtggactcagcagtga

SEQ ID NO: 810121 - DNA, 20 bp, Homo sapiens
agtggactctggggcgcggc

SEQ ID NO: 810122 - DNA, 17 bp, Homo sapiens
agtggactttccacccc

SEQ ID NO: 810123 - DNA, 20 bp, Homo sapiens
agtggactttccaccccctc

SEQ ID NO: 810124 - DNA, 15 bp, Homo sapiens
agtggagacagtcct

SEQ ID NO: 810125 - DNA, 12 bp, Homo sapiens
agtggaggaagc

SEQ ID NO: 810126 - DNA, 17 bp, Homo sapiens
agtggaggcactttagg

SEQ ID NO: 810127 - DNA, 12 bp, Homo sapiens
agtggaggtgga

SEQ ID NO: 810128 - DNA, 14 bp, Homo sapiens
agtggagtctgagt

SEQ ID NO: 810129 - DNA, 17 bp, Homo sapiens
agtggagttgactctgg

SEQ ID NO: 810130 - DNA, 19 bp, Homo sapiens
agtggataatcaggaaaaa

SEQ ID NO: 810131 - DNA, 18 bp, Homo sapiens
agtggatcactcaccatt

SEQ ID NO: 810132 - DNA, 22 bp, Homo sapiens
agtggatcttcagaactgccct

SEQ ID NO: 810133 - DNA, 23 bp, Homo sapiens
agtggatcttcagaactgccctt

SEQ ID NO: 810134 - DNA, 14 bp, Homo sapiens
agtggatgactgtt

SEQ ID NO: 810135 - DNA, 11 bp, Homo sapiens
agtgtgtatta

SEQ ID NO: 810136 - DNA, 14 bp, Homo sapiens
agtgtgtattaaaa

SEQ ID NO: 810137 - DNA, 18 bp, Homo sapiens
agtgtgtccaagtgtgtg

SEQ ID NO: 810138 - DNA, 21 bp, Homo sapiens
agtgtgtccaagtgtgtgtgc

SEQ ID NO: 810139 - DNA, 19 bp, Homo sapiens
agtgtgtccatcctgacct

SEQ ID NO: 810140 - DNA, 16 bp, Homo sapiens
agtgtgtctgctgagt

SEQ ID NO: 810141 - DNA, 22 bp, Homo sapiens
agtgtgtgaactgctttcaagt

SEQ ID NO: 810142 - DNA, 14 bp, Homo sapiens
agtgtgtgacttac

SEQ ID NO: 810143 - DNA, 17 bp, Homo sapiens
agtgtgtgcaagtatgt

SEQ ID NO: 810144 - DNA, 18 bp, Homo sapiens
agtgtgtgcacatgtgtg

SEQ ID NO: 810145 - DNA, 22 bp, Homo sapiens
agtgtgtgcacatgtgtgcgtg

SEQ ID NO: 810146 - DNA, 19 bp, Homo sapiens
agtgtgtgcataatagcta

SEQ ID NO: 810147 - DNA, 16 bp, Homo sapiens
agtgtgtgcatgtgtg

SEQ ID NO: 810148 - DNA, 17 bp, Homo sapiens
agtgtgtgcatgtgtgt

SEQ ID NO: 810149 - DNA, 23 bp, Homo sapiens
agtgtgtgcatgtgtgtgctcag

SEQ ID NO: 810150 - DNA, 16 bp, Homo sapiens
agtgtgtggctgggcg

SEQ ID NO: 810151 - DNA, 16 bp, Homo sapiens
agtgtgtgggcagggt

SEQ ID NO: 810152 - DNA, 17 bp, Homo sapiens
agtgtgtgggcagggtt

SEQ ID NO: 810153 - DNA, 16 bp, Homo sapiens
agtgtgtgggggagat

SEQ ID NO: 810154 - DNA, 20 bp, Homo sapiens
agtgtgtgtgcagagtccat

SEQ ID NO: 810155 - DNA, 17 bp, Homo sapiens
agtgtgtgtgcatgtgt

SEQ ID NO: 810156 - DNA, 19 bp, Homo sapiens
agtgtgtgtgcatgtgtgt

SEQ ID NO: 810157 - DNA, 12 bp, Homo sapiens
agtgtgtgtgct

SEQ ID NO: 810158 - DNA, 21 bp, Homo sapiens
agtgtgtgtgggtgaaatgga

SEQ ID NO: 810159 - DNA, 16 bp, Homo sapiens
agtgtgtgtgtgcatg

SEQ ID NO: 810160 - DNA, 18 bp, Homo sapiens
agtgtgtgtgtgcatgtg

SEQ ID NO: 810161 - DNA, 18 bp, Homo sapiens
agtgtgtgtgttctgtag

SEQ ID NO: 810162 - DNA, 12 bp, Homo sapiens
agtgtgttctga

SEQ ID NO: 810163 - DNA, 22 bp, Homo sapiens
agtgtgttgttgctttaggctc

SEQ ID NO: 810164 - DNA, 12 bp, Homo sapiens
agtgtgtttgcc

SEQ ID NO: 810165 - DNA, 21 bp, Homo sapiens
agtgttaaggcaacattcctt

SEQ ID NO: 810166 - DNA, 20 bp, Homo sapiens
agtgttacgttttattggtt

SEQ ID NO: 810167 - DNA, 15 bp, Homo sapiens
agtgttagagaaatc

SEQ ID NO: 810168 - DNA, 13 bp, Homo sapiens
agtgttagtgctg

SEQ ID NO: 810169 - DNA, 15 bp, Homo sapiens
agtgttatcaggcgt

SEQ ID NO: 810170 - DNA, 15 bp, Homo sapiens
agtgttatcccaaga

SEQ ID NO: 810171 - DNA, 21 bp, Homo sapiens
agtgttatttttcaaggaagg

SEQ ID NO: 810172 - DNA, 21 bp, Homo sapiens
agtgttcaaactactgtacat

SEQ ID NO: 810173 - DNA, 17 bp, Homo sapiens
agtgttcacaaactgtg

SEQ ID NO: 810174 - DNA, 18 bp, Homo sapiens
agtgttcattttagtgac

SEQ ID NO: 810175 - DNA, 21 bp, Homo sapiens
agtgttccccttccactgagg

SEQ ID NO: 810176 - DNA, 18 bp, Homo sapiens
agtgttcctgaagctgct

SEQ ID NO: 810177 - DNA, 19 bp, Homo sapiens
agtgttcctttttaaatgt

SEQ ID NO: 810178 - DNA, 21 bp, Homo sapiens
agtgttcctttttaaatgtga

SEQ ID NO: 810179 - DNA, 23 bp, Homo sapiens
agtgttcctttttaaatgtgaat

SEQ ID NO: 810180 - DNA, 14 bp, Homo sapiens
agtgttctcatgaa

SEQ ID NO: 810181 - DNA, 20 bp, Homo sapiens
agtgttctcatgaagcagga

SEQ ID NO: 810182 - DNA, 22 bp, Homo sapiens
agtgttctcatgaagcaggagg

SEQ ID NO: 810183 - DNA, 23 bp, Homo sapiens
agtgttctcatgaagcaggaggc

SEQ ID NO: 810184 - DNA, 15 bp, Homo sapiens
agtgttctgctcctg

SEQ ID NO: 810185 - DNA, 17 bp, Homo sapiens
agtgttctgctcctgct

SEQ ID NO: 810186 - DNA, 18 bp, Homo sapiens
agtgttctgctcctgctt

SEQ ID NO: 810187 - DNA, 23 bp, Homo sapiens
agtgttctgtgggcttggccttg

SEQ ID NO: 810188 - DNA, 17 bp, Homo sapiens
agtgttgaaaatgttca

SEQ ID NO: 810189 - DNA, 19 bp, Homo sapiens
agtgttgaagggaggtggc

SEQ ID NO: 810190 - DNA, 15 bp, Homo sapiens
agtgttgcctcctcc

SEQ ID NO: 810191 - DNA, 17 bp, Homo sapiens
agtgttggaaaaaattt

SEQ ID NO: 810192 - DNA, 15 bp, Homo sapiens
agtgttggctgtgtg

SEQ ID NO: 810193 - DNA, 19 bp, Homo sapiens
agtgttggggttgacattt

SEQ ID NO: 810194 - DNA, 22 bp, Homo sapiens
agtgttggtctttctaatgtag

SEQ ID NO: 810195 - DNA, 14 bp, Homo sapiens
agtgttgtgcccct

SEQ ID NO: 810196 - DNA, 16 bp, Homo sapiens
agtgttgtggatttaa

SEQ ID NO: 810197 - DNA, 19 bp, Homo sapiens
agtgttgtggatttaacag

SEQ ID NO: 810198 - DNA, 18 bp, Homo sapiens
agtgttgtgggcttcctg

SEQ ID NO: 810199 - DNA, 13 bp, Homo sapiens
agtgttgtttgta

SEQ ID NO: 810200 - DNA, 15 bp, Homo sapiens
agtgttgtttgtaaa

SEQ ID NO: 810201 - DNA, 14 bp, Homo sapiens
agtgtttaaaactt

SEQ ID NO: 810202 - DNA, 17 bp, Homo sapiens
agtgtttaactggcatg

SEQ ID NO: 810203 - DNA, 13 bp, Homo sapiens
agtgtttagaaat

SEQ ID NO: 810204 - DNA, 20 bp, Homo sapiens
agtgtttatgtttaaaagaa

SEQ ID NO: 810205 - DNA, 15 bp, Homo sapiens
agtgtttatttttca

SEQ ID NO: 810206 - DNA, 21 bp, Homo sapiens
agtgtttatttttcatattgt

SEQ ID NO: 810207 - DNA, 20 bp, Homo sapiens
agtgtttcaattctgtaatt

SEQ ID NO: 810208 - DNA, 15 bp, Homo sapiens
agtgtttctgttatt

SEQ ID NO: 810209 - DNA, 11 bp, Homo sapiens
agtgtttcttt

SEQ ID NO: 810210 - DNA, 21 bp, Homo sapiens
agtgttttactctttttctaa

SEQ ID NO: 810211 - DNA, 22 bp, Homo sapiens
agtgttttattattatcgcttt

SEQ ID NO: 810212 - DNA, 17 bp, Homo sapiens
agtgttttcagaagaaa

SEQ ID NO: 810213 - DNA, 19 bp, Homo sapiens
agtgttttctcagaacagc

SEQ ID NO: 810214 - DNA, 22 bp, Homo sapiens
agtgttttctcagaacagctga

SEQ ID NO: 810215 - DNA, 13 bp, Homo sapiens
agtgttttctggg

SEQ ID NO: 810216 - DNA, 21 bp, Homo sapiens
agtgttttggactccatctct

SEQ ID NO: 810217 - DNA, 18 bp, Homo sapiens
agtgttttgttttttaat

SEQ ID NO: 810218 - DNA, 17 bp, Homo sapiens
agtgtttttacctctgt

SEQ ID NO: 810219 - DNA, 21 bp, Homo sapiens
agtgtttttacctctgtcttg

SEQ ID NO: 810220 - DNA, 21 bp, Homo sapiens
agttaaaagaatgtaaaatat

SEQ ID NO: 810221 - DNA, 15 bp, Homo sapiens
agttaaactaaaaaa

SEQ ID NO: 810222 - DNA, 16 bp, Homo sapiens
agttaaactaaaaaaa

SEQ ID NO: 810223 - DNA, 22 bp, Homo sapiens
agttaaactaaaaaaaaaaagg

SEQ ID NO: 810224 - DNA, 14 bp, Homo sapiens
agttaaagaaagga

SEQ ID NO: 810225 - DNA, 16 bp, Homo sapiens
agttaaagaaaggaaa

SEQ ID NO: 810226 - DNA, 18 bp, Homo sapiens
agttaaaggcagtccaga

SEQ ID NO: 810227 - DNA, 19 bp, Homo sapiens
agttaaaggcagtccagag

SEQ ID NO: 810228 - DNA, 22 bp, Homo sapiens
agttaaataaatagaaagagtt

SEQ ID NO: 810229 - DNA, 12 bp, Homo sapiens
agttaacacact

SEQ ID NO: 810230 - DNA, 15 bp, Homo sapiens
agttaactattgcat

SEQ ID NO: 810231 - DNA, 19 bp, Homo sapiens
agttaactattgcatttat

SEQ ID NO: 810232 - DNA, 16 bp, Homo sapiens
agttaaggaaagaaag

SEQ ID NO: 810233 - DNA, 15 bp, Homo sapiens
agttaatattgtgaa

SEQ ID NO: 810234 - DNA, 21 bp, Homo sapiens
agttaatattttgttcttatt

SEQ ID NO: 810235 - DNA, 21 bp, Homo sapiens
agttaatctcctcagacagta

SEQ ID NO: 810236 - DNA, 16 bp, Homo sapiens
agttaatgagccatca

SEQ ID NO: 810237 - DNA, 20 bp, Homo sapiens
agttaatgatggttgatggg

SEQ ID NO: 810238 - DNA, 17 bp, Homo sapiens
agttaatgtatataaaa

SEQ ID NO: 810239 - DNA, 17 bp, Homo sapiens
agttaattctcaccatt

SEQ ID NO: 810240 - DNA, 14 bp, Homo sapiens
agttaattgcagtc

SEQ ID NO: 810241 - DNA, 23 bp, Homo sapiens
agttaatttttccaactactaat

SEQ ID NO: 810242 - DNA, 19 bp, Homo sapiens
agttacacaattaattgtc

SEQ ID NO: 810243 - DNA, 22 bp, Homo sapiens
agttacacagaaatgctgctgg

SEQ ID NO: 810244 - DNA, 16 bp, Homo sapiens
agttacacatttttca

SEQ ID NO: 810245 - DNA, 18 bp, Homo sapiens
agttacactaaaaggtga

SEQ ID NO: 810246 - DNA, 16 bp, Homo sapiens
agttacagcagataca

SEQ ID NO: 810247 - DNA, 14 bp, Homo sapiens
agttacagttctgt

SEQ ID NO: 810248 - DNA, 15 bp, Homo sapiens
agttacagttctgtg

SEQ ID NO: 810249 - DNA, 16 bp, Homo sapiens
agttacagttgatgtt

SEQ ID NO: 810250 - DNA, 15 bp, Homo sapiens
agttacatgtttgca

SEQ ID NO: 810251 - DNA, 21 bp, Homo sapiens
agttaccacagcaactgacct

SEQ ID NO: 810252 - DNA, 18 bp, Homo sapiens
agttaccattatttaatt

SEQ ID NO: 810253 - DNA, 23 bp, Homo sapiens
agttacctgagagatttaacatt

SEQ ID NO: 810254 - DNA, 16 bp, Homo sapiens
agttaccttatagtta

SEQ ID NO: 810255 - DNA, 21 bp, Homo sapiens
agttaccttatagttactgtg

SEQ ID NO: 810256 - DNA, 11 bp, Homo sapiens
agttcctgctc

SEQ ID NO: 810257 - DNA, 12 bp, Homo sapiens
agttcctgctcc

SEQ ID NO: 810258 - DNA, 14 bp, Homo sapiens
agttcctgctccgt

SEQ ID NO: 810259 - DNA, 14 bp, Homo sapiens
agttcctgctctct

SEQ ID NO: 810260 - DNA, 15 bp, Homo sapiens
agttcctgctctctg

SEQ ID NO: 810261 - DNA, 16 bp, Homo sapiens
agttcctgctctctgc

SEQ ID NO: 810262 - DNA, 17 bp, Homo sapiens
agttcctgctctctgct

SEQ ID NO: 810263 - DNA, 19 bp, Homo sapiens
agttcctgctctctgctca

SEQ ID NO: 810264 - DNA, 21 bp, Homo sapiens
agttccttactgtttacagtt

SEQ ID NO: 810265 - DNA, 18 bp, Homo sapiens
agttccttctcacttaga

SEQ ID NO: 810266 - DNA, 13 bp, Homo sapiens
agttccttgcctt

SEQ ID NO: 810267 - DNA, 15 bp, Homo sapiens
agttccttgccttaa

SEQ ID NO: 810268 - DNA, 16 bp, Homo sapiens
agttccttgccttaat

SEQ ID NO: 810269 - DNA, 18 bp, Homo sapiens
agttcgagaccagcctgg

SEQ ID NO: 810270 - DNA, 20 bp, Homo sapiens
agttcggtctgacagtcctt

SEQ ID NO: 810271 - DNA, 19 bp, Homo sapiens
agttcgtaccgcttcctta

SEQ ID NO: 810272 - DNA, 15 bp, Homo sapiens
agttcgttggtagag

SEQ ID NO: 810273 - DNA, 19 bp, Homo sapiens
agttctacaagcatatttg

SEQ ID NO: 810274 - DNA, 21 bp, Homo sapiens
agttctacaagcatatttgag

SEQ ID NO: 810275 - DNA, 14 bp, Homo sapiens
agttctagagaaga

SEQ ID NO: 810276 - DNA, 21 bp, Homo sapiens
agttctatggagactttgctg

SEQ ID NO: 810277 - DNA, 16 bp, Homo sapiens
agttctatttcttgaa

SEQ ID NO: 810278 - DNA, 13 bp, Homo sapiens
agttctcactcct

SEQ ID NO: 810279 - DNA, 12 bp, Homo sapiens
agttctcactgt

SEQ ID NO: 810280 - DNA, 18 bp, Homo sapiens
agttctcactgttccctc

SEQ ID NO: 810281 - DNA, 20 bp, Homo sapiens
agttctcagagctctcgagg

SEQ ID NO: 810282 - DNA, 21 bp, Homo sapiens
agttctccagcttcagctcaa

SEQ ID NO: 810283 - DNA, 12 bp, Homo sapiens
agttctcccagg

SEQ ID NO: 810284 - DNA, 13 bp, Homo sapiens
agttctcccaggg

SEQ ID NO: 810285 - DNA, 15 bp, Homo sapiens
agttctcccagggag

SEQ ID NO: 810286 - DNA, 13 bp, Homo sapiens
agttctccctgta

SEQ ID NO: 810287 - DNA, 23 bp, Homo sapiens
agttctccttttgaacttgtcac

SEQ ID NO: 810288 - DNA, 22 bp, Homo sapiens
agttctctcccttcctctctcc

SEQ ID NO: 810289 - DNA, 22 bp, Homo sapiens
agttctctgggaagtggtcagc

SEQ ID NO: 810290 - DNA, 14 bp, Homo sapiens
agttctcttgcttt

SEQ ID NO: 810291 - DNA, 11 bp, Homo sapiens
agttctgaaag

SEQ ID NO: 810292 - DNA, 19 bp, Homo sapiens
agttctgaactggaacatg

SEQ ID NO: 810293 - DNA, 20 bp, Homo sapiens
agttctgcaaatagaaaaca

SEQ ID NO: 810294 - DNA, 16 bp, Homo sapiens
agttctgccaggcaac

SEQ ID NO: 810295 - DNA, 23 bp, Homo sapiens
agttctgctacattataatgtac

SEQ ID NO: 810296 - DNA, 15 bp, Homo sapiens
agttctgctcctctc

SEQ ID NO: 810297 - DNA, 17 bp, Homo sapiens
agttctgctcctctcca

SEQ ID NO: 810298 - DNA, 18 bp, Homo sapiens
agttctgctcctctccag

SEQ ID NO: 810299 - DNA, 19 bp, Homo sapiens
agttctgctcctctccagg

SEQ ID NO: 810300 - DNA, 16 bp, Homo sapiens
agttctgctctggttg

SEQ ID NO: 810301 - DNA, 14 bp, Homo sapiens
agttctgctgccct

SEQ ID NO: 810302 - DNA, 16 bp, Homo sapiens
agttctggcaagagca

SEQ ID NO: 810303 - DNA, 23 bp, Homo sapiens
agttctgtactcaaatgtagcca

SEQ ID NO: 810304 - DNA, 13 bp, Homo sapiens
agttctgtgaaga

SEQ ID NO: 810305 - DNA, 19 bp, Homo sapiens
agttctgtgcctcccccca

SEQ ID NO: 810306 - DNA, 21 bp, Homo sapiens
agttctgtgcctccccccaga

SEQ ID NO: 810307 - DNA, 22 bp, Homo sapiens
agttctgtgcctccccccagac

SEQ ID NO: 810308 - DNA, 23 bp, Homo sapiens
agttctgtgcctccccccagacc

SEQ ID NO: 810309 - DNA, 15 bp, Homo sapiens
agttctgtgtacttt

SEQ ID NO: 810310 - DNA, 16 bp, Homo sapiens
agttctgtgtagagaa

SEQ ID NO: 810311 - DNA, 18 bp, Homo sapiens
agttctgtgtagagaatg

SEQ ID NO: 810312 - DNA, 19 bp, Homo sapiens
agttctgtgtagagaatgt

SEQ ID NO: 810313 - DNA, 16 bp, Homo sapiens
agttcttagttgctgt

SEQ ID NO: 810314 - DNA, 21 bp, Homo sapiens
agttcttagttgctgtatgtc

SEQ ID NO: 810315 - DNA, 15 bp, Homo sapiens
agttcttcacctcta

SEQ ID NO: 810316 - DNA, 16 bp, Homo sapiens
agttcttgaattgtta

SEQ ID NO: 810317 - DNA, 19 bp, Homo sapiens
agttcttgaattgttatga

SEQ ID NO: 810318 - DNA, 22 bp, Homo sapiens
agttcttgaattgttatgaaaa

SEQ ID NO: 810319 - DNA, 13 bp, Homo sapiens
agttcttggacca

SEQ ID NO: 810320 - DNA, 19 bp, Homo sapiens
agttcttgggaatcttgga

SEQ ID NO: 810321 - DNA, 21 bp, Homo sapiens
agttcttgggggaggccaccc

SEQ ID NO: 810322 - DNA, 22 bp, Homo sapiens
agttcttgtctgattggctcac

SEQ ID NO: 810323 - DNA, 21 bp, Homo sapiens
agttcttgtgcatgtttactt

SEQ ID NO: 810324 - DNA, 19 bp, Homo sapiens
agttctttccataataaaa

SEQ ID NO: 810325 - DNA, 12 bp, Homo sapiens
agttctttcctc

SEQ ID NO: 810326 - DNA, 13 bp, Homo sapiens
agttctttcctcc

SEQ ID NO: 810327 - DNA, 15 bp, Homo sapiens
agttctttcctcccc

SEQ ID NO: 810328 - DNA, 20 bp, Homo sapiens
agttctttcctccccctgca

SEQ ID NO: 810329 - DNA, 22 bp, Homo sapiens
agttctttcctccccctgcaac

SEQ ID NO: 810330 - DNA, 14 bp, Homo sapiens
agttctttcctctt

SEQ ID NO: 810331 - DNA, 15 bp, Homo sapiens
agttctttcctcttt

SEQ ID NO: 810332 - DNA, 18 bp, Homo sapiens
agttctttcctctttctg

SEQ ID NO: 810333 - DNA, 23 bp, Homo sapiens
agttctttcctctttctgctctg

SEQ ID NO: 810334 - DNA, 22 bp, Homo sapiens
agttctttgatttgtaccattc

SEQ ID NO: 810335 - DNA, 17 bp, Homo sapiens
agttctttgctgcccct

SEQ ID NO: 810336 - DNA, 19 bp, Homo sapiens
agttctttgttcatagccc

SEQ ID NO: 810337 - DNA, 13 bp, Homo sapiens
agttgaaaaagga

SEQ ID NO: 810338 - DNA, 18 bp, Homo sapiens
agttgaaaataaagtgta

SEQ ID NO: 810339 - DNA, 19 bp, Homo sapiens
agttgaaaataaagtgtat

SEQ ID NO: 810340 - DNA, 21 bp, Homo sapiens
agttgaacactagtctgtgta

SEQ ID NO: 810341 - DNA, 13 bp, Homo sapiens
agttgaacagagg

SEQ ID NO: 810342 - DNA, 16 bp, Homo sapiens
agttgaaccttacagt

SEQ ID NO: 810343 - DNA, 17 bp, Homo sapiens
agttgaagactttgttt

SEQ ID NO: 810344 - DNA, 16 bp, Homo sapiens
agttgaagctaagatt

SEQ ID NO: 810345 - DNA, 17 bp, Homo sapiens
agttgaagttagtggaa

SEQ ID NO: 810346 - DNA, 22 bp, Homo sapiens
agttgaagttagtggaaatctg

SEQ ID NO: 810347 - DNA, 21 bp, Homo sapiens
agttgaatgacaacagaagct

SEQ ID NO: 810348 - DNA, 23 bp, Homo sapiens
agttgaattgaggggattaatat

SEQ ID NO: 810349 - DNA, 15 bp, Homo sapiens
agttgacaattctgc

SEQ ID NO: 810350 - DNA, 13 bp, Homo sapiens
agttgacagcagg

SEQ ID NO: 810351 - DNA, 17 bp, Homo sapiens
agttgacatgggtgggg

SEQ ID NO: 810352 - DNA, 17 bp, Homo sapiens
agttgacttatagtaca

SEQ ID NO: 810353 - DNA, 18 bp, Homo sapiens
agttgacttatagtacat

SEQ ID NO: 810354 - DNA, 22 bp, Homo sapiens
agttgagatttttaagaacttc

SEQ ID NO: 810355 - DNA, 23 bp, Homo sapiens
agttgataaagattttttaataa

SEQ ID NO: 810356 - DNA, 22 bp, Homo sapiens
agttgatatgttttatttcatt

SEQ ID NO: 810357 - DNA, 12 bp, Homo sapiens
agttgatcttct

SEQ ID NO: 810358 - DNA, 15 bp, Homo sapiens
agttgatgttgcatt

SEQ ID NO: 810359 - DNA, 13 bp, Homo sapiens
agttgattagaaa

SEQ ID NO: 810360 - DNA, 21 bp, Homo sapiens
agttgattttacaattgaaat

SEQ ID NO: 810361 - DNA, 15 bp, Homo sapiens
agttgcagctgtttt

SEQ ID NO: 810362 - DNA, 22 bp, Homo sapiens
agttgcagctgttttgttgaca

SEQ ID NO: 810363 - DNA, 13 bp, Homo sapiens
agttgcagtgagc

SEQ ID NO: 810364 - DNA, 16 bp, Homo sapiens
agttgcagtgagcagg

SEQ ID NO: 810365 - DNA, 22 bp, Homo sapiens
agttgcagtgagcagggtgggg

SEQ ID NO: 810366 - DNA, 14 bp, Homo sapiens
agttgcagttttta

SEQ ID NO: 810367 - DNA, 18 bp, Homo sapiens
agttgcatagcagtatat

SEQ ID NO: 810368 - DNA, 17 bp, Homo sapiens
agttgcatgaccacata

SEQ ID NO: 810369 - DNA, 22 bp, Homo sapiens
agttgcatgaccacatagaaca

SEQ ID NO: 810370 - DNA, 21 bp, Homo sapiens
agttgcatgtagtaacactaa

SEQ ID NO: 810371 - DNA, 16 bp, Homo sapiens
agttgcatttgtaaaa

SEQ ID NO: 810372 - DNA, 14 bp, Homo sapiens
agttgcattttaac

SEQ ID NO: 810373 - DNA, 23 bp, Homo sapiens
agttgcattttaaccctatttta

SEQ ID NO: 810374 - DNA, 14 bp, Homo sapiens
agttgccaacagtt

SEQ ID NO: 810375 - DNA, 13 bp, Homo sapiens
agttgccaagaca

SEQ ID NO: 810376 - DNA, 14 bp, Homo sapiens
agttgccaagacaa

SEQ ID NO: 810377 - DNA, 18 bp, Homo sapiens
agttgccaagacaaatca

SEQ ID NO: 810378 - DNA, 14 bp, Homo sapiens
agtttaggagaaac

SEQ ID NO: 810379 - DNA, 16 bp, Homo sapiens
agtttaggataaaata

SEQ ID NO: 810380 - DNA, 18 bp, Homo sapiens
agtttagggaacaatttg

SEQ ID NO: 810381 - DNA, 16 bp, Homo sapiens
agtttagttctgttga

SEQ ID NO: 810382 - DNA, 22 bp, Homo sapiens
agtttatattactctcattctt

SEQ ID NO: 810383 - DNA, 19 bp, Homo sapiens
agtttatcagtaaataact

SEQ ID NO: 810384 - DNA, 16 bp, Homo sapiens
agtttatcattcaagt

SEQ ID NO: 810385 - DNA, 17 bp, Homo sapiens
agtttatcattcaagtg

SEQ ID NO: 810386 - DNA, 17 bp, Homo sapiens
agtttatccaaatcttg

SEQ ID NO: 810387 - DNA, 16 bp, Homo sapiens
agtttatcctgtctga

SEQ ID NO: 810388 - DNA, 17 bp, Homo sapiens
agtttattacaatgtat

SEQ ID NO: 810389 - DNA, 16 bp, Homo sapiens
agtttattctgtggtt

SEQ ID NO: 810390 - DNA, 15 bp, Homo sapiens
agtttattggaagtg

SEQ ID NO: 810391 - DNA, 18 bp, Homo sapiens
agtttattggaagtgttc

SEQ ID NO: 810392 - DNA, 22 bp, Homo sapiens
agtttatttccaaataaaatga

SEQ ID NO: 810393 - DNA, 12 bp, Homo sapiens
agtttatttctc

SEQ ID NO: 810394 - DNA, 15 bp, Homo sapiens
agtttatttgagaaa

SEQ ID NO: 810395 - DNA, 20 bp, Homo sapiens
agtttatttgttgagagtgt

SEQ ID NO: 810396 - DNA, 16 bp, Homo sapiens
agtttatttttaaaga

SEQ ID NO: 810397 - DNA, 20 bp, Homo sapiens
agtttatttttaaagataga

SEQ ID NO: 810398 - DNA, 16 bp, Homo sapiens
agtttatttttcacac

SEQ ID NO: 810399 - DNA, 16 bp, Homo sapiens
agtttattttttctac

SEQ ID NO: 810400 - DNA, 23 bp, Homo sapiens
agtttattttttctacacagtaa

SEQ ID NO: 810401 - DNA, 17 bp, Homo sapiens
agtttcaaatctgtaat

SEQ ID NO: 810402 - DNA, 21 bp, Homo sapiens
agtttcaatgtagtctgtagc

SEQ ID NO: 810403 - DNA, 16 bp, Homo sapiens
agtttcaatgtgattc

SEQ ID NO: 810404 - DNA, 20 bp, Homo sapiens
agtttcacaaatccttcaaa

SEQ ID NO: 810405 - DNA, 14 bp, Homo sapiens
agtttcactccctc

SEQ ID NO: 810406 - DNA, 19 bp, Homo sapiens
agtttcactgtactgcatg

SEQ ID NO: 810407 - DNA, 20 bp, Homo sapiens
agtttcacttttgttgccca

SEQ ID NO: 810408 - DNA, 13 bp, Homo sapiens
agtttcagacagg

SEQ ID NO: 810409 - DNA, 14 bp, Homo sapiens
agtttcagacaggg

SEQ ID NO: 810410 - DNA, 15 bp, Homo sapiens
agtttcagacagggt

SEQ ID NO: 810411 - DNA, 12 bp, Homo sapiens
agtttcagagaa

SEQ ID NO: 810412 - DNA, 17 bp, Homo sapiens
agtttcagagtatattg

SEQ ID NO: 810413 - DNA, 14 bp, Homo sapiens
agtttcagatatat

SEQ ID NO: 810414 - DNA, 20 bp, Homo sapiens
agtttcaggatacatgtgcc

SEQ ID NO: 810415 - DNA, 19 bp, Homo sapiens
agtttcaggcttttatgag

SEQ ID NO: 810416 - DNA, 20 bp, Homo sapiens
agtttcagtagattgcagaa

SEQ ID NO: 810417 - DNA, 22 bp, Homo sapiens
agtttcagttgtccttaaattt

SEQ ID NO: 810418 - DNA, 16 bp, Homo sapiens
agtttcatataaagta

SEQ ID NO: 810419 - DNA, 21 bp, Homo sapiens
agtttcatgtacaagatgaag

SEQ ID NO: 810420 - DNA, 18 bp, Homo sapiens
agtttcatgtatgtatat

SEQ ID NO: 810421 - DNA, 18 bp, Homo sapiens
agtttcatgttggtttat

SEQ ID NO: 810422 - DNA, 13 bp, Homo sapiens
agtttcatttatg

SEQ ID NO: 810423 - DNA, 17 bp, Homo sapiens
agtttccatagcaacag

SEQ ID NO: 810424 - DNA, 20 bp, Homo sapiens
agtttccatagcaacaggaa

SEQ ID NO: 810425 - DNA, 16 bp, Homo sapiens
agtttcctgaagcatt

SEQ ID NO: 810426 - DNA, 21 bp, Homo sapiens
agtttcctgaagcatttagtt

SEQ ID NO: 810427 - DNA, 15 bp, Homo sapiens
agtttctagaggcct

SEQ ID NO: 810428 - DNA, 11 bp, Homo sapiens
agtttctattt

SEQ ID NO: 810429 - DNA, 15 bp, Homo sapiens
agtttctcagctccc

SEQ ID NO: 810430 - DNA, 12 bp, Homo sapiens
agtttctccttg

SEQ ID NO: 810431 - DNA, 11 bp, Homo sapiens
agtttctctgt

SEQ ID NO: 810432 - DNA, 12 bp, Homo sapiens
agtttctctgtt

SEQ ID NO: 810433 - DNA, 20 bp, Homo sapiens
agtttctgtcgttaaaaaca

SEQ ID NO: 810434 - DNA, 22 bp, Homo sapiens
agtttctgtcgttaaaaacaga

SEQ ID NO: 810435 - DNA, 17 bp, Homo sapiens
agtttctgtttgattct

SEQ ID NO: 810436 - DNA, 20 bp, Homo sapiens
agtttcttcttacacttctt

SEQ ID NO: 810437 - DNA, 21 bp, Homo sapiens
agtttcttgcttggaagccag

SEQ ID NO: 810438 - DNA, 22 bp, Homo sapiens
agtttcttgtcttggacttttt

SEQ ID NO: 810439 - DNA, 15 bp, Homo sapiens
agtttcttgtgtaga

SEQ ID NO: 810440 - DNA, 19 bp, Homo sapiens
agtttcttgtgtagatttg

SEQ ID NO: 810441 - DNA, 22 bp, Homo sapiens
agtttcttgtgtagatttgaaa

SEQ ID NO: 810442 - DNA, 23 bp, Homo sapiens
agtttcttgtgtagatttgaaaa

SEQ ID NO: 810443 - DNA, 14 bp, Homo sapiens
agtttctttcccca

SEQ ID NO: 810444 - DNA, 21 bp, Homo sapiens
agtttgaaaagcaatattgta

SEQ ID NO: 810445 - DNA, 19 bp, Homo sapiens
agtttgagatcagcctggg

SEQ ID NO: 810446 - DNA, 20 bp, Homo sapiens
agtttgagatcagcctgggc

SEQ ID NO: 810447 - DNA, 15 bp, Homo sapiens
agtttgagctgcctt

SEQ ID NO: 810448 - DNA, 14 bp, Homo sapiens
agtttgaggctgca

SEQ ID NO: 810449 - DNA, 17 bp, Homo sapiens
agtttgatattaaagga

SEQ ID NO: 810450 - DNA, 14 bp, Homo sapiens
agtttgattaaatt

SEQ ID NO: 810451 - DNA, 16 bp, Homo sapiens
agtttgattaaattct

SEQ ID NO: 810452 - DNA, 13 bp, Homo sapiens
agtttgcagaaaa

SEQ ID NO: 810453 - DNA, 14 bp, Homo sapiens
agtttgcagaaaag

SEQ ID NO: 810454 - DNA, 22 bp, Homo sapiens
agtttgcagaaaagcacctgcc

SEQ ID NO: 810455 - DNA, 20 bp, Homo sapiens
agtttgcctgcagtttcttg

SEQ ID NO: 810456 - DNA, 13 bp, Homo sapiens
agtttgcctgctg

SEQ ID NO: 810457 - DNA, 11 bp, Homo sapiens
agtttgctaaa

SEQ ID NO: 810458 - DNA, 15 bp, Homo sapiens
agtttgctaatgttt

SEQ ID NO: 810459 - DNA, 14 bp, Homo sapiens
agtttgctattaga

SEQ ID NO: 810460 - DNA, 23 bp, Homo sapiens
agtttgctttttgcgtacacaga

SEQ ID NO: 810461 - DNA, 14 bp, Homo sapiens
agtttggaaataaa

SEQ ID NO: 810462 - DNA, 17 bp, Homo sapiens
agtttggagatttttca

SEQ ID NO: 810463 - DNA, 12 bp, Homo sapiens
agtttggaggaa

SEQ ID NO: 810464 - DNA, 17 bp, Homo sapiens
agtttggatatgtaaaa

SEQ ID NO: 810465 - DNA, 20 bp, Homo sapiens
agtttggatatgtaaaacat

SEQ ID NO: 810466 - DNA, 16 bp, Homo sapiens
agtttggatatttttg

SEQ ID NO: 810467 - DNA, 18 bp, Homo sapiens
agtttggattcttatgta

SEQ ID NO: 810468 - DNA, 14 bp, Homo sapiens
agtttggccctgga

SEQ ID NO: 810469 - DNA, 23 bp, Homo sapiens
agtttggccctggagccagggca

SEQ ID NO: 810470 - DNA, 22 bp, Homo sapiens
agtttggccgggtgcggtggct

SEQ ID NO: 810471 - DNA, 11 bp, Homo sapiens
agtttggggtg

SEQ ID NO: 810472 - DNA, 12 bp, Homo sapiens
agtttggggtgc

SEQ ID NO: 810473 - DNA, 21 bp, Homo sapiens
agtttgggtgtattttcttta

SEQ ID NO: 810474 - DNA, 14 bp, Homo sapiens
agtttggtctggac

SEQ ID NO: 810475 - DNA, 12 bp, Homo sapiens
agtttgtaaagt

SEQ ID NO: 810476 - DNA, 18 bp, Homo sapiens
agtttgtacatgcattca

SEQ ID NO: 810477 - DNA, 12 bp, Homo sapiens
agtttgtagcca

SEQ ID NO: 810478 - DNA, 17 bp, Homo sapiens
agtttgtataacttctt

SEQ ID NO: 810479 - DNA, 13 bp, Homo sapiens
agtttgtatatac

SEQ ID NO: 810480 - DNA, 24 bp, Homo sapiens
agtttgtattattacaaatattgt

SEQ ID NO: 810481 - DNA, 23 bp, Homo sapiens
agtttgtattttaattatgggaa

SEQ ID NO: 810482 - DNA, 13 bp, Homo sapiens
agtttgtattttg

SEQ ID NO: 810483 - DNA, 17 bp, Homo sapiens
agtttgtcgctcatgtg

SEQ ID NO: 810484 - DNA, 14 bp, Homo sapiens
agtttgtctatttt

SEQ ID NO: 810485 - DNA, 16 bp, Homo sapiens
agtttgtctattttaa

SEQ ID NO: 810486 - DNA, 21 bp, Homo sapiens
agtttgtgtatatattataaa

SEQ ID NO: 810487 - DNA, 21 bp, Homo sapiens
agtttgtgtctgttgcttgta

SEQ ID NO: 810488 - DNA, 17 bp, Homo sapiens
agtttgtgtgtatttgt

SEQ ID NO: 810489 - DNA, 21 bp, Homo sapiens
agtttgtgtgtatttgtatta

SEQ ID NO: 810490 - DNA, 22 bp, Homo sapiens
agtttgtgtgtatttgtattaa

SEQ ID NO: 810491 - DNA, 19 bp, Homo sapiens
agtttgtgtgttgtcttga

SEQ ID NO: 810492 - DNA, 18 bp, Homo sapiens
agtttgtgttttaaaaaa

SEQ ID NO: 810493 - DNA, 22 bp, Homo sapiens
agtttgtgttttaaaaaaactg

SEQ ID NO: 810494 - DNA, 12 bp, Homo sapiens
agtttgttgaaa

SEQ ID NO: 810495 - DNA, 12 bp, Homo sapiens
agtttgttttag

SEQ ID NO: 810496 - DNA, 11 bp, Homo sapiens
agttttaaagt

SEQ ID NO: 810497 - DNA, 15 bp, Homo sapiens
agttttaattaaaaa

SEQ ID NO: 810498 - DNA, 23 bp, Homo sapiens
agttttaattccatgtcagataa

SEQ ID NO: 810499 - DNA, 13 bp, Homo sapiens
agttttacagatt

SEQ ID NO: 810500 - DNA, 20 bp, Homo sapiens
agttttacagattgcctcct

SEQ ID NO: 810501 - DNA, 16 bp, Homo sapiens
ataaactgaaaaatgt

SEQ ID NO: 810502 - DNA, 14 bp, Homo sapiens
ataaactgaatatt

SEQ ID NO: 810503 - DNA, 18 bp, Homo sapiens
ataaactgactttatcct

SEQ ID NO: 810504 - DNA, 20 bp, Homo sapiens
ataaactgactttatcctca

SEQ ID NO: 810505 - DNA, 12 bp, Homo sapiens
ataaactgagcc

SEQ ID NO: 810506 - DNA, 16 bp, Homo sapiens
ataaactgagcgaccc

SEQ ID NO: 810507 - DNA, 15 bp, Homo sapiens
ataaactgctgtcaa

SEQ ID NO: 810508 - DNA, 22 bp, Homo sapiens
ataaactgtagcgaccccagac

SEQ ID NO: 810509 - DNA, 22 bp, Homo sapiens
ataaactgtattaaatcttaaa

SEQ ID NO: 810510 - DNA, 16 bp, Homo sapiens
ataaactgtgtttact

SEQ ID NO: 810511 - DNA, 19 bp, Homo sapiens
ataaacttaagggcaagga

SEQ ID NO: 810512 - DNA, 20 bp, Homo sapiens
ataaacttagaggaaaatga

SEQ ID NO: 810513 - DNA, 11 bp, Homo sapiens
ataaacttctt

SEQ ID NO: 810514 - DNA, 12 bp, Homo sapiens
ataaacttctta

SEQ ID NO: 810515 - DNA, 17 bp, Homo sapiens
ataaacttggattctct

SEQ ID NO: 810516 - DNA, 16 bp, Homo sapiens
ataaactttaatataa

SEQ ID NO: 810517 - DNA, 13 bp, Homo sapiens
ataaagaaaaata

SEQ ID NO: 810518 - DNA, 17 bp, Homo sapiens
ataaagaaatagaacaa

SEQ ID NO: 810519 - DNA, 15 bp, Homo sapiens
ataaagaaatattta

SEQ ID NO: 810520 - DNA, 16 bp, Homo sapiens
ataaagaaatttggta

SEQ ID NO: 810521 - DNA, 18 bp, Homo sapiens
ataaagaaatttggtacc

SEQ ID NO: 810522 - DNA, 19 bp, Homo sapiens
ataaagaaatttggtaccc

SEQ ID NO: 810523 - DNA, 15 bp, Homo sapiens
ataaagaacaaggta

SEQ ID NO: 810524 - DNA, 21 bp, Homo sapiens
ataaagaactccttattttgt

SEQ ID NO: 810525 - DNA, 22 bp, Homo sapiens
ataaagaactccttattttgta

SEQ ID NO: 810526 - DNA, 21 bp, Homo sapiens
ataaagaatgccatttctcac

SEQ ID NO: 810527 - DNA, 12 bp, Homo sapiens
ataaagacacct

SEQ ID NO: 810528 - DNA, 20 bp, Homo sapiens
ataaagaccgtacaaactca

SEQ ID NO: 810529 - DNA, 13 bp, Homo sapiens
ataaagactttta

SEQ ID NO: 810530 - DNA, 16 bp, Homo sapiens
ataaagatattgttca

SEQ ID NO: 810531 - DNA, 15 bp, Homo sapiens
ataaagatcacacat

SEQ ID NO: 810532 - DNA, 12 bp, Homo sapiens
ataaagatgagt

SEQ ID NO: 810533 - DNA, 11 bp, Homo sapiens
ataaagatgat

SEQ ID NO: 810534 - DNA, 14 bp, Homo sapiens
ataaagatgatcta

SEQ ID NO: 810535 - DNA, 19 bp, Homo sapiens
ataaagatgatctactcag

SEQ ID NO: 810536 - DNA, 15 bp, Homo sapiens
ataaagatgctcttt

SEQ ID NO: 810537 - DNA, 15 bp, Homo sapiens
ataaagatgttaaat

SEQ ID NO: 810538 - DNA, 20 bp, Homo sapiens
ataaagatgttaaatggaat

SEQ ID NO: 810539 - DNA, 18 bp, Homo sapiens
ataaagattatataaaga

SEQ ID NO: 810540 - DNA, 14 bp, Homo sapiens
ataaagattgtact

SEQ ID NO: 810541 - DNA, 16 bp, Homo sapiens
ataaagattgtactta

SEQ ID NO: 810542 - DNA, 18 bp, Homo sapiens
ataaagattttttaataa

SEQ ID NO: 810543 - DNA, 12 bp, Homo sapiens
ataaagcaaata

SEQ ID NO: 810544 - DNA, 14 bp, Homo sapiens
ataaagcaaataga

SEQ ID NO: 810545 - DNA, 12 bp, Homo sapiens
ataaagcagagc

SEQ ID NO: 810546 - DNA, 20 bp, Homo sapiens
ataaagcagagccaaggcca

SEQ ID NO: 810547 - DNA, 21 bp, Homo sapiens
ataaagcagagccaaggccac

SEQ ID NO: 810548 - DNA, 22 bp, Homo sapiens
ataaagcagcctcattctgagg

SEQ ID NO: 810549 - DNA, 14 bp, Homo sapiens
ataaagcagcgttt

SEQ ID NO: 810550 - DNA, 20 bp, Homo sapiens
ataaagcagcgtttctatga

SEQ ID NO: 810551 - DNA, 16 bp, Homo sapiens
ataaagcagtattttt

SEQ ID NO: 810552 - DNA, 15 bp, Homo sapiens
ataaagcagtcctgt

SEQ ID NO: 810553 - DNA, 15 bp, Homo sapiens
ataaagcattactct

SEQ ID NO: 810554 - DNA, 12 bp, Homo sapiens
ataaagccactt

SEQ ID NO: 810555 - DNA, 20 bp, Homo sapiens
ataaaggaccctgtttctgt

SEQ ID NO: 810556 - DNA, 14 bp, Homo sapiens
ataaaggatgtgat

SEQ ID NO: 810557 - DNA, 22 bp, Homo sapiens
ataaaggatgtgattgtggaat

SEQ ID NO: 810558 - DNA, 15 bp, Homo sapiens
ataaaggcagctgcc

SEQ ID NO: 810559 - DNA, 16 bp, Homo sapiens
ataaaggcagctgcct

SEQ ID NO: 810560 - DNA, 17 bp, Homo sapiens
ataaaggcagctgcctc

SEQ ID NO: 810561 - DNA, 19 bp, Homo sapiens
ataaaggcagctgcctctg

SEQ ID NO: 810562 - DNA, 21 bp, Homo sapiens
ataaaggcagctgcctctgct

SEQ ID NO: 810563 - DNA, 14 bp, Homo sapiens
ataaagggaacaaa

SEQ ID NO: 810564 - DNA, 16 bp, Homo sapiens
ataaagggttgaaaat

SEQ ID NO: 810565 - DNA, 16 bp, Homo sapiens
ataaaggtaaaatcac

SEQ ID NO: 810566 - DNA, 22 bp, Homo sapiens
ataaaggtctttgcacatgtga

SEQ ID NO: 810567 - DNA, 13 bp, Homo sapiens
ataaaggttatga

SEQ ID NO: 810568 - DNA, 16 bp, Homo sapiens
ataaaggttatgaaac

SEQ ID NO: 810569 - DNA, 18 bp, Homo sapiens
ataaaggttatgaaacat

SEQ ID NO: 810570 - DNA, 21 bp, Homo sapiens
ataaaggttatgaaacatatc

SEQ ID NO: 810571 - DNA, 22 bp, Homo sapiens
ataaaggttgacaataaatgtg

SEQ ID NO: 810572 - DNA, 18 bp, Homo sapiens
ataaaggtttaaagctga

SEQ ID NO: 810573 - DNA, 22 bp, Homo sapiens
ataaaggtttaaagctgaagag

SEQ ID NO: 810574 - DNA, 14 bp, Homo sapiens
ataaagtaataatg

SEQ ID NO: 810575 - DNA, 22 bp, Homo sapiens
ataaagtaataatgtgcaaatc

SEQ ID NO: 810576 - DNA, 15 bp, Homo sapiens
ataaagtaattcata

SEQ ID NO: 810577 - DNA, 13 bp, Homo sapiens
ataaagtacaaat

SEQ ID NO: 810578 - DNA, 15 bp, Homo sapiens
ataaagtacaaatga

SEQ ID NO: 810579 - DNA, 20 bp, Homo sapiens
ataaagtacaaatgaagaaa

SEQ ID NO: 810580 - DNA, 23 bp, Homo sapiens
ataaagtacaaatgaagaaagtc

SEQ ID NO: 810581 - DNA, 21 bp, Homo sapiens
ataaagtagcaaaacaaattc

SEQ ID NO: 810582 - DNA, 17 bp, Homo sapiens
ataaagtagtcctgtga

SEQ ID NO: 810583 - DNA, 14 bp, Homo sapiens
ataaagtatatatt

SEQ ID NO: 810584 - DNA, 14 bp, Homo sapiens
ataaagtatcatca

SEQ ID NO: 810585 - DNA, 15 bp, Homo sapiens
ataaagtatcatcag

SEQ ID NO: 810586 - DNA, 20 bp, Homo sapiens
ataaagtgatctgtgttcaa

SEQ ID NO: 810587 - DNA, 20 bp, Homo sapiens
ataaagtgccttctgggctt

SEQ ID NO: 810588 - DNA, 16 bp, Homo sapiens
ataaagttacctacat

SEQ ID NO: 810589 - DNA, 17 bp, Homo sapiens
ataaagttacttgaatt

SEQ ID NO: 810590 - DNA, 18 bp, Homo sapiens
ataaagttacttgaattt

SEQ ID NO: 810591 - DNA, 13 bp, Homo sapiens
ataaagttcctgt

SEQ ID NO: 810592 - DNA, 14 bp, Homo sapiens
ataaagttccttaa

SEQ ID NO: 810593 - DNA, 15 bp, Homo sapiens
ataaagttccttaag

SEQ ID NO: 810594 - DNA, 17 bp, Homo sapiens
ataaagttgataaagat

SEQ ID NO: 810595 - DNA, 21 bp, Homo sapiens
ataaagttgataaagattttt

SEQ ID NO: 810596 - DNA, 15 bp, Homo sapiens
ataaagttgtaaata

SEQ ID NO: 810597 - DNA, 14 bp, Homo sapiens
ataaagttgtttta

SEQ ID NO: 810598 - DNA, 12 bp, Homo sapiens
ataaagtttgct

SEQ ID NO: 810599 - DNA, 19 bp, Homo sapiens
ataaagtttgtacactttc

SEQ ID NO: 810600 - DNA, 17 bp, Homo sapiens
ataaataaaaatatagg

SEQ ID NO: 810601 - DNA, 20 bp, Homo sapiens
ataaataaaatcatgtagtt

SEQ ID NO: 810602 - DNA, 14 bp, Homo sapiens
ataaataaagtttc

SEQ ID NO: 810603 - DNA, 22 bp, Homo sapiens
ataaataaccctgggctgtcca

SEQ ID NO: 810604 - DNA, 19 bp, Homo sapiens
ataaataactcaatggaaa

SEQ ID NO: 810605 - DNA, 12 bp, Homo sapiens
ataaataatttt

SEQ ID NO: 810606 - DNA, 17 bp, Homo sapiens
ataaatacacaatgaat

SEQ ID NO: 810607 - DNA, 23 bp, Homo sapiens
ataaatacctcttagctgagtgg

SEQ ID NO: 810608 - DNA, 13 bp, Homo sapiens
ataaatagaaaga

SEQ ID NO: 810609 - DNA, 20 bp, Homo sapiens
ataaatagctgaaaactaat

SEQ ID NO: 810610 - DNA, 17 bp, Homo sapiens
ataaataggtttatatt

SEQ ID NO: 810611 - DNA, 22 bp, Homo sapiens
ataaataggtttatattattga

SEQ ID NO: 810612 - DNA, 15 bp, Homo sapiens
ataaatatatatgat

SEQ ID NO: 810613 - DNA, 18 bp, Homo sapiens
ataaatatatatttttaa

SEQ ID NO: 810614 - DNA, 20 bp, Homo sapiens
ataaatatatatttttcaaa

SEQ ID NO: 810615 - DNA, 21 bp, Homo sapiens
ataaatatatatttttcaaat

SEQ ID NO: 810616 - DNA, 15 bp, Homo sapiens
ataaatattctgcat

SEQ ID NO: 810617 - DNA, 20 bp, Homo sapiens
ataaatatttttggggcatc

SEQ ID NO: 810618 - DNA, 14 bp, Homo sapiens
ataaatcaatgtca

SEQ ID NO: 810619 - DNA, 15 bp, Homo sapiens
ataaatcaatgtcac

SEQ ID NO: 810620 - DNA, 23 bp, Homo sapiens
ataaatcacagaaaatttaactt

SEQ ID NO: 810621 - DNA, 18 bp, Homo sapiens
ataaatcagagagcaagg

SEQ ID NO: 810622 - DNA, 15 bp, Homo sapiens
ataaatcagtcaagc

SEQ ID NO: 810623 - DNA, 15 bp, Homo sapiens
ataaatcataaagtc

SEQ ID NO: 810624 - DNA, 19 bp, Homo sapiens
ataataaagtagcaaaaca

SEQ ID NO: 810625 - DNA, 23 bp, Homo sapiens
ataataaagtgttacgttttatt

SEQ ID NO: 810626 - DNA, 14 bp, Homo sapiens
ataataaagtgttt

SEQ ID NO: 810627 - DNA, 13 bp, Homo sapiens
ataataaagttgt

SEQ ID NO: 810628 - DNA, 14 bp, Homo sapiens
ataataaagttgtt

SEQ ID NO: 810629 - DNA, 15 bp, Homo sapiens
ataataaatgtacat

SEQ ID NO: 810630 - DNA, 13 bp, Homo sapiens
ataataactgaac

SEQ ID NO: 810631 - DNA, 14 bp, Homo sapiens
ataataactgaact

SEQ ID NO: 810632 - DNA, 18 bp, Homo sapiens
ataataactttattgcat

SEQ ID NO: 810633 - DNA, 19 bp, Homo sapiens
ataataactttattgcata

SEQ ID NO: 810634 - DNA, 13 bp, Homo sapiens
ataataagctaaa

SEQ ID NO: 810635 - DNA, 21 bp, Homo sapiens
ataataagtgatgtgctgaat

SEQ ID NO: 810636 - DNA, 15 bp, Homo sapiens
ataataagtttcata

SEQ ID NO: 810637 - DNA, 13 bp, Homo sapiens
ataataagttttg

SEQ ID NO: 810638 - DNA, 17 bp, Homo sapiens
ataataagttttgatat

SEQ ID NO: 810639 - DNA, 19 bp, Homo sapiens
ataataagttttgatataa

SEQ ID NO: 810640 - DNA, 13 bp, Homo sapiens
ataataataaatt

SEQ ID NO: 810641 - DNA, 20 bp, Homo sapiens
ataatacaccactacattct

SEQ ID NO: 810642 - DNA, 22 bp, Homo sapiens
ataatacactaattcctttcta

SEQ ID NO: 810643 - DNA, 21 bp, Homo sapiens
ataatacagccaaagataatc

SEQ ID NO: 810644 - DNA, 21 bp, Homo sapiens
ataataccaccatttaaaaat

SEQ ID NO: 810645 - DNA, 14 bp, Homo sapiens
ataatactaaaact

SEQ ID NO: 810646 - DNA, 13 bp, Homo sapiens
ataatagaagaac

SEQ ID NO: 810647 - DNA, 16 bp, Homo sapiens
ataatagacacatcaa

SEQ ID NO: 810648 - DNA, 13 bp, Homo sapiens
ataatagactgta

SEQ ID NO: 810649 - DNA, 22 bp, Homo sapiens
ataatagagtagcctaaaatta

SEQ ID NO: 810650 - DNA, 21 bp, Homo sapiens
ataatagattttttttaaagt

SEQ ID NO: 810651 - DNA, 12 bp, Homo sapiens
ataataggaatg

SEQ ID NO: 810652 - DNA, 14 bp, Homo sapiens
ataatagggaaaat

SEQ ID NO: 810653 - DNA, 21 bp, Homo sapiens
ataataggtagtttggatatt

SEQ ID NO: 810654 - DNA, 21 bp, Homo sapiens
ataataggtgggggaaaatga

SEQ ID NO: 810655 - DNA, 16 bp, Homo sapiens
ataatagtcaatttct

SEQ ID NO: 810656 - DNA, 23 bp, Homo sapiens
ataatagtcaatttctacttctg

SEQ ID NO: 810657 - DNA, 14 bp, Homo sapiens
ataatagtttacat

SEQ ID NO: 810658 - DNA, 18 bp, Homo sapiens
ataatataccaatgcttt

SEQ ID NO: 810659 - DNA, 14 bp, Homo sapiens
ataatatatattaa

SEQ ID NO: 810660 - DNA, 15 bp, Homo sapiens
ataatatattgtgtt

SEQ ID NO: 810661 - DNA, 13 bp, Homo sapiens
ataatatatttct

SEQ ID NO: 810662 - DNA, 14 bp, Homo sapiens
ataatatatttgca

SEQ ID NO: 810663 - DNA, 17 bp, Homo sapiens
ataatatatttgcagat

SEQ ID NO: 810664 - DNA, 14 bp, Homo sapiens
ataatatatttgtg

SEQ ID NO: 810665 - DNA, 15 bp, Homo sapiens
ataatatattttcaa

SEQ ID NO: 810666 - DNA, 15 bp, Homo sapiens
ataatatattttctg

SEQ ID NO: 810667 - DNA, 15 bp, Homo sapiens
ataatatcaaaacaa

SEQ ID NO: 810668 - DNA, 17 bp, Homo sapiens
ataatatcaaataaaat

SEQ ID NO: 810669 - DNA, 19 bp, Homo sapiens
ataatatcaaataaaatat

SEQ ID NO: 810670 - DNA, 18 bp, Homo sapiens
ataatatctaaagttata

SEQ ID NO: 810671 - DNA, 13 bp, Homo sapiens
ataatatgaagcc

SEQ ID NO: 810672 - DNA, 24 bp, Homo sapiens
ataatatgaagcctttggtgaatt

SEQ ID NO: 810673 - DNA, 12 bp, Homo sapiens
ataatatgcaca

SEQ ID NO: 810674 - DNA, 23 bp, Homo sapiens
ataatatggaaccttccctccaa

SEQ ID NO: 810675 - DNA, 13 bp, Homo sapiens
ataatatggctat

SEQ ID NO: 810676 - DNA, 20 bp, Homo sapiens
ataatattagtgattctgat

SEQ ID NO: 810677 - DNA, 18 bp, Homo sapiens
ataatattgaaaattgaa

SEQ ID NO: 810678 - DNA, 19 bp, Homo sapiens
ataatattgaaaattgaaa

SEQ ID NO: 810679 - DNA, 19 bp, Homo sapiens
ataatattgtgtcatagaa

SEQ ID NO: 810680 - DNA, 13 bp, Homo sapiens
ataatatttctta

SEQ ID NO: 810681 - DNA, 18 bp, Homo sapiens
ataatcaaagctacctgt

SEQ ID NO: 810682 - DNA, 15 bp, Homo sapiens
ataatcaaagctcat

SEQ ID NO: 810683 - DNA, 16 bp, Homo sapiens
ataatcaaagctcata

SEQ ID NO: 810684 - DNA, 12 bp, Homo sapiens
ataatcaagatt

SEQ ID NO: 810685 - DNA, 16 bp, Homo sapiens
ataatcaagattttag

SEQ ID NO: 810686 - DNA, 13 bp, Homo sapiens
ataatcagcctct

SEQ ID NO: 810687 - DNA, 14 bp, Homo sapiens
ataatcagcctctt

SEQ ID NO: 810688 - DNA, 14 bp, Homo sapiens
ataatcaggaaaaa

SEQ ID NO: 810689 - DNA, 16 bp, Homo sapiens
ataatcaggaaaaatg

SEQ ID NO: 810690 - DNA, 18 bp, Homo sapiens
ataatcaggaaaaatgag

SEQ ID NO: 810691 - DNA, 16 bp, Homo sapiens
ataatcagtgactgaa

SEQ ID NO: 810692 - DNA, 14 bp, Homo sapiens
ataatcatgctcat

SEQ ID NO: 810693 - DNA, 17 bp, Homo sapiens
ataatcatgtaaatgct

SEQ ID NO: 810694 - DNA, 23 bp, Homo sapiens
ataatcattagttttagaggcat

SEQ ID NO: 810695 - DNA, 13 bp, Homo sapiens
ataatcattgctt

SEQ ID NO: 810696 - DNA, 16 bp, Homo sapiens
ataatccattccaaaa

SEQ ID NO: 810697 - DNA, 21 bp, Homo sapiens
ataatccattccaaaatacaa

SEQ ID NO: 810698 - DNA, 16 bp, Homo sapiens
ataatcctagagtctt

SEQ ID NO: 810699 - DNA, 22 bp, Homo sapiens
ataatcggcccacagctcccac

SEQ ID NO: 810700 - DNA, 23 bp, Homo sapiens
ataatctagtttacagaaaaatc

SEQ ID NO: 810701 - DNA, 15 bp, Homo sapiens
ataatctatattaaa

SEQ ID NO: 810702 - DNA, 19 bp, Homo sapiens
ataatctatattaaatgag

SEQ ID NO: 810703 - DNA, 14 bp, Homo sapiens
ataatctatttcta

SEQ ID NO: 810704 - DNA, 21 bp, Homo sapiens
ataatctcaaaggagaaaaaa

SEQ ID NO: 810705 - DNA, 22 bp, Homo sapiens
ataatctcaaaggagaaaaaaa

SEQ ID NO: 810706 - DNA, 15 bp, Homo sapiens
ataatctcctctgct

SEQ ID NO: 810707 - DNA, 18 bp, Homo sapiens
ataatctcctctgctcat

SEQ ID NO: 810708 - DNA, 19 bp, Homo sapiens
ataatctctgattccctga

SEQ ID NO: 810709 - DNA, 23 bp, Homo sapiens
ataatctctgattccctgattta

SEQ ID NO: 810710 - DNA, 20 bp, Homo sapiens
ataatctggactcctctgtc

SEQ ID NO: 810711 - DNA, 12 bp, Homo sapiens
ataatctgtcaa

SEQ ID NO: 810712 - DNA, 17 bp, Homo sapiens
ataatctgtcaaaacac

SEQ ID NO: 810713 - DNA, 20 bp, Homo sapiens
ataatctgtttttacgtatg

SEQ ID NO: 810714 - DNA, 15 bp, Homo sapiens
ataatcttattaggg

SEQ ID NO: 810715 - DNA, 15 bp, Homo sapiens
ataatcttcaggtga

SEQ ID NO: 810716 - DNA, 22 bp, Homo sapiens
ataatcttggcttcttaaaaac

SEQ ID NO: 810717 - DNA, 23 bp, Homo sapiens
ataatcttggcttcttaaaaact

SEQ ID NO: 810718 - DNA, 14 bp, Homo sapiens
ataatctttctata

SEQ ID NO: 810719 - DNA, 21 bp, Homo sapiens
ataatgaaaataaaacacacc

SEQ ID NO: 810720 - DNA, 15 bp, Homo sapiens
ataatgaaataatca

SEQ ID NO: 810721 - DNA, 18 bp, Homo sapiens
ataatgaaataatcagtg

SEQ ID NO: 810722 - DNA, 18 bp, Homo sapiens
ataatgaataaactgaat

SEQ ID NO: 810723 - DNA, 15 bp, Homo sapiens
ataatgaatgaaaca

SEQ ID NO: 810724 - DNA, 19 bp, Homo sapiens
ataatgaattataacagtt

SEQ ID NO: 810725 - DNA, 12 bp, Homo sapiens
ataatgacagat

SEQ ID NO: 810726 - DNA, 19 bp, Homo sapiens
ataatgagaccttggggat

SEQ ID NO: 810727 - DNA, 17 bp, Homo sapiens
ataatgaggagtttatg

SEQ ID NO: 810728 - DNA, 15 bp, Homo sapiens
ataatgataaaataa

SEQ ID NO: 810729 - DNA, 17 bp, Homo sapiens
ataatgatctaagaagc

SEQ ID NO: 810730 - DNA, 21 bp, Homo sapiens
ataatgatttgctctttgaca

SEQ ID NO: 810731 - DNA, 14 bp, Homo sapiens
ataatgcatttctg

SEQ ID NO: 810732 - DNA, 17 bp, Homo sapiens
ataatgctcacttggtc

SEQ ID NO: 810733 - DNA, 14 bp, Homo sapiens
ataatgcttcagat

SEQ ID NO: 810734 - DNA, 15 bp, Homo sapiens
ataatgcttcagata

SEQ ID NO: 810735 - DNA, 12 bp, Homo sapiens
ataatgctttct

SEQ ID NO: 810736 - DNA, 16 bp, Homo sapiens
ataatggaaaatgcca

SEQ ID NO: 810737 - DNA, 18 bp, Homo sapiens
ataatggagaatcacttt

SEQ ID NO: 810738 - DNA, 21 bp, Homo sapiens
ataatgggccactgaaatctg

SEQ ID NO: 810739 - DNA, 23 bp, Homo sapiens
ataatggttgtgaaatgtaacat

SEQ ID NO: 810740 - DNA, 15 bp, Homo sapiens
ataatgtaagctcta

SEQ ID NO: 810741 - DNA, 17 bp, Homo sapiens
ataatgtaattgtaatt

SEQ ID NO: 810742 - DNA, 20 bp, Homo sapiens
ataatgtactgatttcagta

SEQ ID NO: 810743 - DNA, 12 bp, Homo sapiens
ataatgtgaaat

SEQ ID NO: 810744 - DNA, 12 bp, Homo sapiens
ataatgtgaatg

SEQ ID NO: 810745 - DNA, 23 bp, Homo sapiens
ataatgtgcaaattttgcattta

SEQ ID NO: 810746 - DNA, 19 bp, Homo sapiens
ataatgtgggaagaaacaa

SEQ ID NO: 810747 - DNA, 19 bp, Homo sapiens
atacacacacaaaccattt

SEQ ID NO: 810748 - DNA, 16 bp, Homo sapiens
atacacacatatacat

SEQ ID NO: 810749 - DNA, 19 bp, Homo sapiens
atacacacatatacatata

SEQ ID NO: 810750 - DNA, 13 bp, Homo sapiens
atacacagtaatt

SEQ ID NO: 810751 - DNA, 18 bp, Homo sapiens
atacacagttaaataaat

SEQ ID NO: 810752 - DNA, 12 bp, Homo sapiens
atacacatacat

SEQ ID NO: 810753 - DNA, 15 bp, Homo sapiens
atacacatacataca

SEQ ID NO: 810754 - DNA, 20 bp, Homo sapiens
atacaccacctcactcctgt

SEQ ID NO: 810755 - DNA, 15 bp, Homo sapiens
atacaccactacatt

SEQ ID NO: 810756 - DNA, 17 bp, Homo sapiens
atacaccactacattct

SEQ ID NO: 810757 - DNA, 21 bp, Homo sapiens
atacaccactacattctgtta

SEQ ID NO: 810758 - DNA, 18 bp, Homo sapiens
atacaccagcattccttt

SEQ ID NO: 810759 - DNA, 19 bp, Homo sapiens
atacacccagttctgaata

SEQ ID NO: 810760 - DNA, 21 bp, Homo sapiens
atacacgtttatcttacattc

SEQ ID NO: 810761 - DNA, 15 bp, Homo sapiens
atacactatgaaatt

SEQ ID NO: 810762 - DNA, 17 bp, Homo sapiens
atacactgcactttgtt

SEQ ID NO: 810763 - DNA, 18 bp, Homo sapiens
atacactgcactttgttt

SEQ ID NO: 810764 - DNA, 19 bp, Homo sapiens
atacactgcactttgttta

SEQ ID NO: 810765 - DNA, 23 bp, Homo sapiens
atacactgtagtttttgaaaatt

SEQ ID NO: 810766 - DNA, 14 bp, Homo sapiens
atacactgtgaact

SEQ ID NO: 810767 - DNA, 17 bp, Homo sapiens
atacactttgttgcaag

SEQ ID NO: 810768 - DNA, 21 bp, Homo sapiens
atacactttgttgcaagatgt

SEQ ID NO: 810769 - DNA, 16 bp, Homo sapiens
atacagaactcacagt

SEQ ID NO: 810770 - DNA, 16 bp, Homo sapiens
atacagaactctttca

SEQ ID NO: 810771 - DNA, 12 bp, Homo sapiens
atacagacacat

SEQ ID NO: 810772 - DNA, 14 bp, Homo sapiens
atacagacactaag

SEQ ID NO: 810773 - DNA, 15 bp, Homo sapiens
atacagacactaagt

SEQ ID NO: 810774 - DNA, 13 bp, Homo sapiens
atacagagccacg

SEQ ID NO: 810775 - DNA, 21 bp, Homo sapiens
atacagagccacgagtttgga

SEQ ID NO: 810776 - DNA, 18 bp, Homo sapiens
atacagagctctctgagg

SEQ ID NO: 810777 - DNA, 21 bp, Homo sapiens
atacagaggatgccttttctg

SEQ ID NO: 810778 - DNA, 23 bp, Homo sapiens
atacagaggatgccttttctgtg

SEQ ID NO: 810779 - DNA, 16 bp, Homo sapiens
atacagaggcaactgc

SEQ ID NO: 810780 - DNA, 17 bp, Homo sapiens
atacagaggcaactgca

SEQ ID NO: 810781 - DNA, 18 bp, Homo sapiens
atacagataattcatttg

SEQ ID NO: 810782 - DNA, 16 bp, Homo sapiens
atacagcatacttcaa

SEQ ID NO: 810783 - DNA, 20 bp, Homo sapiens
atacagccctcccccagcag

SEQ ID NO: 810784 - DNA, 11 bp, Homo sapiens
atacagctcta

SEQ ID NO: 810785 - DNA, 12 bp, Homo sapiens
atacagctgtat

SEQ ID NO: 810786 - DNA, 14 bp, Homo sapiens
atacaggaaacagt

SEQ ID NO: 810787 - DNA, 11 bp, Homo sapiens
atacaggaaat

SEQ ID NO: 810788 - DNA, 22 bp, Homo sapiens
atacagggtgctccttgtcaat

SEQ ID NO: 810789 - DNA, 22 bp, Homo sapiens
atacaggttactaccctcaccc

SEQ ID NO: 810790 - DNA, 18 bp, Homo sapiens
atacagtaactttatgtg

SEQ ID NO: 810791 - DNA, 20 bp, Homo sapiens
atacagtaactttatgtgta

SEQ ID NO: 810792 - DNA, 13 bp, Homo sapiens
atacagtaagcat

SEQ ID NO: 810793 - DNA, 18 bp, Homo sapiens
atacagtcttccacaaag

SEQ ID NO: 810794 - DNA, 22 bp, Homo sapiens
atacagtcttccacaaagaaaa

SEQ ID NO: 810795 - DNA, 21 bp, Homo sapiens
atacagtgcagagccttctca

SEQ ID NO: 810796 - DNA, 17 bp, Homo sapiens
atacagtgcccaccgcc

SEQ ID NO: 810797 - DNA, 23 bp, Homo sapiens
atacagtgttattttctttgaaa

SEQ ID NO: 810798 - DNA, 18 bp, Homo sapiens
atacagttactcagaatt

SEQ ID NO: 810799 - DNA, 18 bp, Homo sapiens
atacagttataaaattaa

SEQ ID NO: 810800 - DNA, 16 bp, Homo sapiens
atacagttttcagaaa

SEQ ID NO: 810801 - DNA, 17 bp, Homo sapiens
atacagttttcagaaaa

SEQ ID NO: 810802 - DNA, 14 bp, Homo sapiens
atacagttttcatt

SEQ ID NO: 810803 - DNA, 16 bp, Homo sapiens
atacagttttcattga

SEQ ID NO: 810804 - DNA, 14 bp, Homo sapiens
atacataaagacta

SEQ ID NO: 810805 - DNA, 17 bp, Homo sapiens
atacataacttgatata

SEQ ID NO: 810806 - DNA, 21 bp, Homo sapiens
atacataagcggcgtaagttt

SEQ ID NO: 810807 - DNA, 13 bp, Homo sapiens
atacataataaaa

SEQ ID NO: 810808 - DNA, 21 bp, Homo sapiens
atacataatgtttttcctttc

SEQ ID NO: 810809 - DNA, 22 bp, Homo sapiens
atacataatgtttttcctttct

SEQ ID NO: 810810 - DNA, 11 bp, Homo sapiens
atacatacata

SEQ ID NO: 810811 - DNA, 13 bp, Homo sapiens
atacatacataca

SEQ ID NO: 810812 - DNA, 17 bp, Homo sapiens
atacatacatacataca

SEQ ID NO: 810813 - DNA, 16 bp, Homo sapiens
atacatacatacatat

SEQ ID NO: 810814 - DNA, 17 bp, Homo sapiens
atacatacatacatata

SEQ ID NO: 810815 - DNA, 13 bp, Homo sapiens
atacatacatata

SEQ ID NO: 810816 - DNA, 22 bp, Homo sapiens
atacatacggtcaggtttaaca

SEQ ID NO: 810817 - DNA, 18 bp, Homo sapiens
atacatacttacatgtgt

SEQ ID NO: 810818 - DNA, 16 bp, Homo sapiens
atacatagacatttca

SEQ ID NO: 810819 - DNA, 17 bp, Homo sapiens
atacatagacatttcaa

SEQ ID NO: 810820 - DNA, 18 bp, Homo sapiens
atacatagacatttcaaa

SEQ ID NO: 810821 - DNA, 22 bp, Homo sapiens
atacataggtctgtatggctgt

SEQ ID NO: 810822 - DNA, 12 bp, Homo sapiens
atacatatatat

SEQ ID NO: 810823 - DNA, 16 bp, Homo sapiens
atacatatatatatac

SEQ ID NO: 810824 - DNA, 22 bp, Homo sapiens
atacatatatatatacacatac

SEQ ID NO: 810825 - DNA, 24 bp, Homo sapiens
atacatatatatatacacatacat

SEQ ID NO: 810826 - DNA, 17 bp, Homo sapiens
atacatatatatatttg

SEQ ID NO: 810827 - DNA, 15 bp, Homo sapiens
atacatatatatctg

SEQ ID NO: 810828 - DNA, 16 bp, Homo sapiens
atacatatatatctga

SEQ ID NO: 810829 - DNA, 14 bp, Homo sapiens
atacatatatctac

SEQ ID NO: 810830 - DNA, 16 bp, Homo sapiens
atacatatcgctgact

SEQ ID NO: 810831 - DNA, 13 bp, Homo sapiens
atacatatcttta

SEQ ID NO: 810832 - DNA, 14 bp, Homo sapiens
atacatatggatgt

SEQ ID NO: 810833 - DNA, 15 bp, Homo sapiens
atacatatggatgtt

SEQ ID NO: 810834 - DNA, 13 bp, Homo sapiens
atacatcactgct

SEQ ID NO: 810835 - DNA, 16 bp, Homo sapiens
atacatctctccccaa

SEQ ID NO: 810836 - DNA, 15 bp, Homo sapiens
atacatctgctgtgt

SEQ ID NO: 810837 - DNA, 17 bp, Homo sapiens
atacatctgctgtgtgg

SEQ ID NO: 810838 - DNA, 17 bp, Homo sapiens
atacatgaaaattttaa

SEQ ID NO: 810839 - DNA, 15 bp, Homo sapiens
atacatgcatataat

SEQ ID NO: 810840 - DNA, 21 bp, Homo sapiens
atacatgcatataatgaataa

SEQ ID NO: 810841 - DNA, 13 bp, Homo sapiens
atacatgctactt

SEQ ID NO: 810842 - DNA, 14 bp, Homo sapiens
atacatgctacttt

SEQ ID NO: 810843 - DNA, 20 bp, Homo sapiens
atacatgttggaaatgtgtt

SEQ ID NO: 810844 - DNA, 15 bp, Homo sapiens
atacattaaggagca

SEQ ID NO: 810845 - DNA, 16 bp, Homo sapiens
atacattcaaatttgt

SEQ ID NO: 810846 - DNA, 21 bp, Homo sapiens
atacattcaaatttgtctggt

SEQ ID NO: 810847 - DNA, 20 bp, Homo sapiens
atacattccctctaatttga

SEQ ID NO: 810848 - DNA, 17 bp, Homo sapiens
atacattgaattcatta

SEQ ID NO: 810849 - DNA, 17 bp, Homo sapiens
atacattgtataggcca

SEQ ID NO: 810850 - DNA, 21 bp, Homo sapiens
atacattgtattaataccaaa

SEQ ID NO: 810851 - DNA, 13 bp, Homo sapiens
atacatttaataa

SEQ ID NO: 810852 - DNA, 15 bp, Homo sapiens
atacatttataatgt

SEQ ID NO: 810853 - DNA, 20 bp, Homo sapiens
atacatttataatgtttgct

SEQ ID NO: 810854 - DNA, 23 bp, Homo sapiens
atacatttgtaagtgtaaaaaat

SEQ ID NO: 810855 - DNA, 16 bp, Homo sapiens
atacattttctggtgg

SEQ ID NO: 810856 - DNA, 18 bp, Homo sapiens
atacattttgttatagaa

SEQ ID NO: 810857 - DNA, 21 bp, Homo sapiens
atacattttgttatagaatac

SEQ ID NO: 810858 - DNA, 22 bp, Homo sapiens
atacattttttaggacatctta

SEQ ID NO: 810859 - DNA, 14 bp, Homo sapiens
ataccaaatatttt

SEQ ID NO: 810860 - DNA, 17 bp, Homo sapiens
ataccaagtatttatta

SEQ ID NO: 810861 - DNA, 20 bp, Homo sapiens
ataccacaaaccctgctgaa

SEQ ID NO: 810862 - DNA, 16 bp, Homo sapiens
ataccacagctattta

SEQ ID NO: 810863 - DNA, 15 bp, Homo sapiens
ataccacctgtacat

SEQ ID NO: 810864 - DNA, 16 bp, Homo sapiens
ataccacctgtacata

SEQ ID NO: 810865 - DNA, 14 bp, Homo sapiens
ataccactctgtaa

SEQ ID NO: 810866 - DNA, 15 bp, Homo sapiens
ataccactctgtaat

SEQ ID NO: 810867 - DNA, 17 bp, Homo sapiens
ataccactctgtaattg

SEQ ID NO: 810868 - DNA, 18 bp, Homo sapiens
ataccacttttgttcttg

SEQ ID NO: 810869 - DNA, 14 bp, Homo sapiens
atactgaagtcttt

SEQ ID NO: 810870 - DNA, 19 bp, Homo sapiens
atactgactgagaatataa

SEQ ID NO: 810871 - DNA, 17 bp, Homo sapiens
atactgagatgctgggc

SEQ ID NO: 810872 - DNA, 12 bp, Homo sapiens
atactgagcctg

SEQ ID NO: 810873 - DNA, 18 bp, Homo sapiens
atactgattgggaggtgc

SEQ ID NO: 810874 - DNA, 16 bp, Homo sapiens
atactgcaagaaaatg

SEQ ID NO: 810875 - DNA, 23 bp, Homo sapiens
atactgcaattaaagtgatactg

SEQ ID NO: 810876 - DNA, 18 bp, Homo sapiens
atactgcacagtggcaca

SEQ ID NO: 810877 - DNA, 15 bp, Homo sapiens
atactgcatactttt

SEQ ID NO: 810878 - DNA, 21 bp, Homo sapiens
atactgcatactttttaaatg

SEQ ID NO: 810879 - DNA, 23 bp, Homo sapiens
atactgcccaaggataggtattt

SEQ ID NO: 810880 - DNA, 14 bp, Homo sapiens
atactgcctactgt

SEQ ID NO: 810881 - DNA, 15 bp, Homo sapiens
atactgcctactgtt

SEQ ID NO: 810882 - DNA, 18 bp, Homo sapiens
atactgcctactgttact

SEQ ID NO: 810883 - DNA, 21 bp, Homo sapiens
atactgcctagaaaatgcaaa

SEQ ID NO: 810884 - DNA, 19 bp, Homo sapiens
atactgcgactttctgcct

SEQ ID NO: 810885 - DNA, 20 bp, Homo sapiens
atactgcgactttctgcctg

SEQ ID NO: 810886 - DNA, 15 bp, Homo sapiens
atactgctacagcaa

SEQ ID NO: 810887 - DNA, 22 bp, Homo sapiens
atactgctactgtaattttata

SEQ ID NO: 810888 - DNA, 12 bp, Homo sapiens
atactgctctga

SEQ ID NO: 810889 - DNA, 23 bp, Homo sapiens
atactgcttgaccgtactctcac

SEQ ID NO: 810890 - DNA, 13 bp, Homo sapiens
atactgcttgtca

SEQ ID NO: 810891 - DNA, 13 bp, Homo sapiens
atactggaagttt

SEQ ID NO: 810892 - DNA, 14 bp, Homo sapiens
atactggaagtttt

SEQ ID NO: 810893 - DNA, 18 bp, Homo sapiens
atactggaagttttgcat

SEQ ID NO: 810894 - DNA, 14 bp, Homo sapiens
atactggaataatt

SEQ ID NO: 810895 - DNA, 17 bp, Homo sapiens
atactggaataatttgt

SEQ ID NO: 810896 - DNA, 18 bp, Homo sapiens
atactggaataatttgta

SEQ ID NO: 810897 - DNA, 20 bp, Homo sapiens
atactggaataatttgtaaa

SEQ ID NO: 810898 - DNA, 20 bp, Homo sapiens
atactggactcaggaacttt

SEQ ID NO: 810899 - DNA, 13 bp, Homo sapiens
atactggcctctg

SEQ ID NO: 810900 - DNA, 15 bp, Homo sapiens
atactggcctggact

SEQ ID NO: 810901 - DNA, 23 bp, Homo sapiens
atactgggacaccattaccaaaa

SEQ ID NO: 810902 - DNA, 20 bp, Homo sapiens
atactgggagagaagaggac

SEQ ID NO: 810903 - DNA, 21 bp, Homo sapiens
atactgggagagaagaggact

SEQ ID NO: 810904 - DNA, 23 bp, Homo sapiens
atactgggttcttgttttatata

SEQ ID NO: 810905 - DNA, 14 bp, Homo sapiens
atactgggtttcaa

SEQ ID NO: 810906 - DNA, 15 bp, Homo sapiens
atactgggtttcaag

SEQ ID NO: 810907 - DNA, 16 bp, Homo sapiens
atactgggtttcaaga

SEQ ID NO: 810908 - DNA, 21 bp, Homo sapiens
atactgtaaaagttataataa

SEQ ID NO: 810909 - DNA, 13 bp, Homo sapiens
atactgtacaata

SEQ ID NO: 810910 - DNA, 17 bp, Homo sapiens
atactgtatatgattat

SEQ ID NO: 810911 - DNA, 16 bp, Homo sapiens
atactgtatttctaag

SEQ ID NO: 810912 - DNA, 16 bp, Homo sapiens
atactgtctctggagt

SEQ ID NO: 810913 - DNA, 20 bp, Homo sapiens
atactgtgcagaataatgga

SEQ ID NO: 810914 - DNA, 22 bp, Homo sapiens
atactgtgcagaataatggaaa

SEQ ID NO: 810915 - DNA, 17 bp, Homo sapiens
atactgtgtatgtttta

SEQ ID NO: 810916 - DNA, 15 bp, Homo sapiens
atactgtgtgggata

SEQ ID NO: 810917 - DNA, 14 bp, Homo sapiens
atactgtgtgtttt

SEQ ID NO: 810918 - DNA, 23 bp, Homo sapiens
atactgtgtgttttcccaaagca

SEQ ID NO: 810919 - DNA, 18 bp, Homo sapiens
atactgttctatacgagt

SEQ ID NO: 810920 - DNA, 16 bp, Homo sapiens
atactgttgatacaaa

SEQ ID NO: 810921 - DNA, 12 bp, Homo sapiens
atactgtttctt

SEQ ID NO: 810922 - DNA, 20 bp, Homo sapiens
atactgtttcttgcactgaa

SEQ ID NO: 810923 - DNA, 21 bp, Homo sapiens
atactgtttcttgcactgaat

SEQ ID NO: 810924 - DNA, 17 bp, Homo sapiens
atacttaaaatatctct

SEQ ID NO: 810925 - DNA, 22 bp, Homo sapiens
atacttaaaatgacaaagccat

SEQ ID NO: 810926 - DNA, 13 bp, Homo sapiens
atacttaaataaa

SEQ ID NO: 810927 - DNA, 14 bp, Homo sapiens
atacttaacatttc

SEQ ID NO: 810928 - DNA, 16 bp, Homo sapiens
atacttaacatttcat

SEQ ID NO: 810929 - DNA, 14 bp, Homo sapiens
atacttaagaatac

SEQ ID NO: 810930 - DNA, 18 bp, Homo sapiens
atacttaatctaagaaac

SEQ ID NO: 810931 - DNA, 14 bp, Homo sapiens
atacttacatttca

SEQ ID NO: 810932 - DNA, 24 bp, Homo sapiens
atacttactgaactgtgtgtaatt

SEQ ID NO: 810933 - DNA, 23 bp, Homo sapiens
atacttagaaacaaaaagagctt

SEQ ID NO: 810934 - DNA, 14 bp, Homo sapiens
atacttagtggtat

SEQ ID NO: 810935 - DNA, 17 bp, Homo sapiens
atacttatgcaaaacct

SEQ ID NO: 810936 - DNA, 14 bp, Homo sapiens
atacttattttcag

SEQ ID NO: 810937 - DNA, 20 bp, Homo sapiens
atacttcacctttcctctcc

SEQ ID NO: 810938 - DNA, 16 bp, Homo sapiens
atacttcaggtgcttt

SEQ ID NO: 810939 - DNA, 15 bp, Homo sapiens
atacttcctgggtca

SEQ ID NO: 810940 - DNA, 17 bp, Homo sapiens
atacttgaagaaacaga

SEQ ID NO: 810941 - DNA, 16 bp, Homo sapiens
atacttgaatatggaa

SEQ ID NO: 810942 - DNA, 13 bp, Homo sapiens
atacttgaatttt

SEQ ID NO: 810943 - DNA, 16 bp, Homo sapiens
atacttgaattttttg

SEQ ID NO: 810944 - DNA, 21 bp, Homo sapiens
atacttgaattttttgaaatg

SEQ ID NO: 810945 - DNA, 22 bp, Homo sapiens
atacttgactcatttaaagcta

SEQ ID NO: 810946 - DNA, 12 bp, Homo sapiens
atacttgcagtt

SEQ ID NO: 810947 - DNA, 22 bp, Homo sapiens
atacttgcagttgtgatataaa

SEQ ID NO: 810948 - DNA, 13 bp, Homo sapiens
atacttggattta

SEQ ID NO: 810949 - DNA, 17 bp, Homo sapiens
atacttggatttagttt

SEQ ID NO: 810950 - DNA, 15 bp, Homo sapiens
atactttaaaggaaa

SEQ ID NO: 810951 - DNA, 14 bp, Homo sapiens
atactttattgaaa

SEQ ID NO: 810952 - DNA, 13 bp, Homo sapiens
atactttatttct

SEQ ID NO: 810953 - DNA, 15 bp, Homo sapiens
atactttatttctga

SEQ ID NO: 810954 - DNA, 22 bp, Homo sapiens
atactttcaggggtggcccaat

SEQ ID NO: 810955 - DNA, 15 bp, Homo sapiens
atactttctctctag

SEQ ID NO: 810956 - DNA, 22 bp, Homo sapiens
atactttgaaaggagatgtctt

SEQ ID NO: 810957 - DNA, 18 bp, Homo sapiens
atactttgcataaattaa

SEQ ID NO: 810958 - DNA, 14 bp, Homo sapiens
atactttgtaaata

SEQ ID NO: 810959 - DNA, 13 bp, Homo sapiens
atactttgtctga

SEQ ID NO: 810960 - DNA, 12 bp, Homo sapiens
atacttttatgc

SEQ ID NO: 810961 - DNA, 18 bp, Homo sapiens
atacttttcccctgttaa

SEQ ID NO: 810962 - DNA, 19 bp, Homo sapiens
atacttttcccctgttaaa

SEQ ID NO: 810963 - DNA, 22 bp, Homo sapiens
atacttttgagtatggctatct

SEQ ID NO: 810964 - DNA, 17 bp, Homo sapiens
atacttttgtaatctat

SEQ ID NO: 810965 - DNA, 19 bp, Homo sapiens
atactttttaaatgtaaag

SEQ ID NO: 810966 - DNA, 13 bp, Homo sapiens
atactttttacaa

SEQ ID NO: 810967 - DNA, 20 bp, Homo sapiens
atactttttacaattaaaaa

SEQ ID NO: 810968 - DNA, 13 bp, Homo sapiens
atactttttcagt

SEQ ID NO: 810969 - DNA, 23 bp, Homo sapiens
atactttttgaggggttcttctg

SEQ ID NO: 810970 - DNA, 14 bp, Homo sapiens
atactttttttcac

SEQ ID NO: 810971 - DNA, 21 bp, Homo sapiens
atacttttttttctttaaaaa

SEQ ID NO: 810972 - DNA, 14 bp, Homo sapiens
atagaaaaaaagaa

SEQ ID NO: 810973 - DNA, 13 bp, Homo sapiens
atagaaaattatt

SEQ ID NO: 810974 - DNA, 13 bp, Homo sapiens
atagaaagaaact

SEQ ID NO: 810975 - DNA, 21 bp, Homo sapiens
atagaaagctgtttatttatt

SEQ ID NO: 810976 - DNA, 19 bp, Homo sapiens
atagaaagtgccagaaagt

SEQ ID NO: 810977 - DNA, 19 bp, Homo sapiens
atagaaagttgatattcaa

SEQ ID NO: 810978 - DNA, 20 bp, Homo sapiens
atagaaataaatagctatat

SEQ ID NO: 810979 - DNA, 18 bp, Homo sapiens
atagaaataaattcctaa

SEQ ID NO: 810980 - DNA, 13 bp, Homo sapiens
atagaaatgctgg

SEQ ID NO: 810981 - DNA, 20 bp, Homo sapiens
atagaaatggaaattttgct

SEQ ID NO: 810982 - DNA, 19 bp, Homo sapiens
atagaaatggtttcctctg

SEQ ID NO: 810983 - DNA, 15 bp, Homo sapiens
atagaaatttccaga

SEQ ID NO: 810984 - DNA, 16 bp, Homo sapiens
atagaaattttgtaag

SEQ ID NO: 810985 - DNA, 18 bp, Homo sapiens
atagaaattttgtaagaa

SEQ ID NO: 810986 - DNA, 20 bp, Homo sapiens
atagaacactgcctctgagt

SEQ ID NO: 810987 - DNA, 21 bp, Homo sapiens
atagaactcagttttaactag

SEQ ID NO: 810988 - DNA, 15 bp, Homo sapiens
atagaactctgggct

SEQ ID NO: 810989 - DNA, 20 bp, Homo sapiens
atagaacttgccttttaagt

SEQ ID NO: 810990 - DNA, 19 bp, Homo sapiens
atagaactttgccagtctt

SEQ ID NO: 810991 - DNA, 22 bp, Homo sapiens
atagcccatagctattttcctt

SEQ ID NO: 810992 - DNA, 13 bp, Homo sapiens
atagccccagact

SEQ ID NO: 810993 - DNA, 14 bp, Homo sapiens
atagccgggcatgg

SEQ ID NO: 810994 - DNA, 15 bp, Homo sapiens
atagcctaaatgatg

SEQ ID NO: 810995 - DNA, 18 bp, Homo sapiens
atagcctgcctcttctct

SEQ ID NO: 810996 - DNA, 19 bp, Homo sapiens
atagcctgcctgatccctg

SEQ ID NO: 810997 - DNA, 22 bp, Homo sapiens
atagcctggccaccagccatcc

SEQ ID NO: 810998 - DNA, 14 bp, Homo sapiens
atagccttcctgac

SEQ ID NO: 810999 - DNA, 19 bp, Homo sapiens
atagccttggggttggaca

SEQ ID NO: 811000 - DNA, 22 bp, Homo sapiens
atagcctttaaatcatttttat

SEQ ID NO: 811001 - DNA, 20 bp, Homo sapiens
atagcgggttactttcacat

SEQ ID NO: 811002 - DNA, 17 bp, Homo sapiens
atagcgttcttgtaatt

SEQ ID NO: 811003 - DNA, 23 bp, Homo sapiens
atagctatatccatgtactgtag

SEQ ID NO: 811004 - DNA, 14 bp, Homo sapiens
atagctattactgt

SEQ ID NO: 811005 - DNA, 16 bp, Homo sapiens
atagctattttccttg

SEQ ID NO: 811006 - DNA, 17 bp, Homo sapiens
atagctcactgcagcct

SEQ ID NO: 811007 - DNA, 19 bp, Homo sapiens
atagctcactgcagcctca

SEQ ID NO: 811008 - DNA, 22 bp, Homo sapiens
atagctcagtttatccaaggtg

SEQ ID NO: 811009 - DNA, 20 bp, Homo sapiens
atagctccttcccaggaccc

SEQ ID NO: 811010 - DNA, 17 bp, Homo sapiens
atagctctattttaaag

SEQ ID NO: 811011 - DNA, 15 bp, Homo sapiens
atagctctttcaggg

SEQ ID NO: 811012 - DNA, 14 bp, Homo sapiens
atagctgaaaaggg

SEQ ID NO: 811013 - DNA, 17 bp, Homo sapiens
atagctgaaaagggcac

SEQ ID NO: 811014 - DNA, 18 bp, Homo sapiens
atagctgaaaagggcact

SEQ ID NO: 811015 - DNA, 14 bp, Homo sapiens
atagctgatcagtt

SEQ ID NO: 811016 - DNA, 18 bp, Homo sapiens
atagctgcatgtggcttt

SEQ ID NO: 811017 - DNA, 13 bp, Homo sapiens
atagctggggctt

SEQ ID NO: 811018 - DNA, 23 bp, Homo sapiens
atagctgtacaaatataagaata

SEQ ID NO: 811019 - DNA, 14 bp, Homo sapiens
atagctgtgtgaac

SEQ ID NO: 811020 - DNA, 23 bp, Homo sapiens
atagctgtgtgaacgtgtatgta

SEQ ID NO: 811021 - DNA, 20 bp, Homo sapiens
atagctgtttcaaatgtgca

SEQ ID NO: 811022 - DNA, 18 bp, Homo sapiens
atagctgttttgtgtata

SEQ ID NO: 811023 - DNA, 16 bp, Homo sapiens
atagcttaactaattt

SEQ ID NO: 811024 - DNA, 23 bp, Homo sapiens
atagcttaactaatttgaatgtg

SEQ ID NO: 811025 - DNA, 15 bp, Homo sapiens
atagcttacactgag

SEQ ID NO: 811026 - DNA, 18 bp, Homo sapiens
atagcttacactgaggac

SEQ ID NO: 811027 - DNA, 14 bp, Homo sapiens
atagctttcacaag

SEQ ID NO: 811028 - DNA, 16 bp, Homo sapiens
atagcttttgattagt

SEQ ID NO: 811029 - DNA, 18 bp, Homo sapiens
ataggaaaacaataattt

SEQ ID NO: 811030 - DNA, 21 bp, Homo sapiens
ataggaaagtatttttttaag

SEQ ID NO: 811031 - DNA, 16 bp, Homo sapiens
ataggaagacataaaa

SEQ ID NO: 811032 - DNA, 18 bp, Homo sapiens
ataggaagacataaaact

SEQ ID NO: 811033 - DNA, 22 bp, Homo sapiens
ataggaagacataaaactttaa

SEQ ID NO: 811034 - DNA, 23 bp, Homo sapiens
ataggaagacataaaactttaaa

SEQ ID NO: 811035 - DNA, 19 bp, Homo sapiens
ataggaagcgtctggcaga

SEQ ID NO: 811036 - DNA, 17 bp, Homo sapiens
ataggaagggatctgag

SEQ ID NO: 811037 - DNA, 19 bp, Homo sapiens
ataggaagggatctgagaa

SEQ ID NO: 811038 - DNA, 17 bp, Homo sapiens
ataggaatagaggaaga

SEQ ID NO: 811039 - DNA, 18 bp, Homo sapiens
ataggaatgtagaagtct

SEQ ID NO: 811040 - DNA, 23 bp, Homo sapiens
ataggagagattgggagaaatca

SEQ ID NO: 811041 - DNA, 21 bp, Homo sapiens
ataggaggaaaacacagcctc

SEQ ID NO: 811042 - DNA, 16 bp, Homo sapiens
ataggagggagactgt

SEQ ID NO: 811043 - DNA, 18 bp, Homo sapiens
ataggagtgagtgtatgt

SEQ ID NO: 811044 - DNA, 16 bp, Homo sapiens
ataggagttctctgat

SEQ ID NO: 811045 - DNA, 16 bp, Homo sapiens
ataggatagacactgg

SEQ ID NO: 811046 - DNA, 19 bp, Homo sapiens
ataggatagacactggaca

SEQ ID NO: 811047 - DNA, 21 bp, Homo sapiens
ataggatagacactggacatg

SEQ ID NO: 811048 - DNA, 14 bp, Homo sapiens
ataggatcctggag

SEQ ID NO: 811049 - DNA, 19 bp, Homo sapiens
ataggatgtcagacaatac

SEQ ID NO: 811050 - DNA, 22 bp, Homo sapiens
ataggattgcttcaattaaaat

SEQ ID NO: 811051 - DNA, 16 bp, Homo sapiens
ataggatttatttaaa

SEQ ID NO: 811052 - DNA, 16 bp, Homo sapiens
ataggatttttagaat

SEQ ID NO: 811053 - DNA, 19 bp, Homo sapiens
ataggcaggaacatacaga

SEQ ID NO: 811054 - DNA, 23 bp, Homo sapiens
ataggcaggaacatacagacaca

SEQ ID NO: 811055 - DNA, 22 bp, Homo sapiens
ataggcatcatttcacaaggtc

SEQ ID NO: 811056 - DNA, 22 bp, Homo sapiens
ataggcatgagccactgtgctt

SEQ ID NO: 811057 - DNA, 16 bp, Homo sapiens
ataggccaaggcccaa

SEQ ID NO: 811058 - DNA, 12 bp, Homo sapiens
ataggccaaggt

SEQ ID NO: 811059 - DNA, 21 bp, Homo sapiens
ataggccagggcatgtgtatg

SEQ ID NO: 811060 - DNA, 23 bp, Homo sapiens
ataggccagggcatgtgtatgtg

SEQ ID NO: 811061 - DNA, 21 bp, Homo sapiens
ataggcccaaggtcccctcca

SEQ ID NO: 811062 - DNA, 22 bp, Homo sapiens
ataggcccaaggtcccctccac

SEQ ID NO: 811063 - DNA, 15 bp, Homo sapiens
ataggcccagccagg

SEQ ID NO: 811064 - DNA, 16 bp, Homo sapiens
ataggccctttcataa

SEQ ID NO: 811065 - DNA, 22 bp, Homo sapiens
ataggcggggcacggtggctca

SEQ ID NO: 811066 - DNA, 17 bp, Homo sapiens
ataggcggtcatgtgtg

SEQ ID NO: 811067 - DNA, 22 bp, Homo sapiens
ataggcggtcatgtgtgcatgt

SEQ ID NO: 811068 - DNA, 18 bp, Homo sapiens
ataggctattttctaaag

SEQ ID NO: 811069 - DNA, 20 bp, Homo sapiens
ataggctattttctaaagac

SEQ ID NO: 811070 - DNA, 12 bp, Homo sapiens
ataggctctgca

SEQ ID NO: 811071 - DNA, 14 bp, Homo sapiens
ataggctctgcaca

SEQ ID NO: 811072 - DNA, 19 bp, Homo sapiens
ataggctctgcacagatgg

SEQ ID NO: 811073 - DNA, 17 bp, Homo sapiens
ataggcttctattacct

SEQ ID NO: 811074 - DNA, 22 bp, Homo sapiens
ataggcttctattacctattag

SEQ ID NO: 811075 - DNA, 15 bp, Homo sapiens
ataggctttttaatc

SEQ ID NO: 811076 - DNA, 16 bp, Homo sapiens
atagggaaaattctaa

SEQ ID NO: 811077 - DNA, 15 bp, Homo sapiens
atagggagaatattt

SEQ ID NO: 811078 - DNA, 12 bp, Homo sapiens
atagggggctgc

SEQ ID NO: 811079 - DNA, 15 bp, Homo sapiens
ataggggggagggtc

SEQ ID NO: 811080 - DNA, 14 bp, Homo sapiens
atagggtctaactc

SEQ ID NO: 811081 - DNA, 16 bp, Homo sapiens
atagggtctcttcagg

SEQ ID NO: 811082 - DNA, 23 bp, Homo sapiens
atagggttttttttaatgtgaat

SEQ ID NO: 811083 - DNA, 13 bp, Homo sapiens
ataggtaacgtga

SEQ ID NO: 811084 - DNA, 21 bp, Homo sapiens
ataggtaacgtgattgattca

SEQ ID NO: 811085 - DNA, 20 bp, Homo sapiens
ataggtagaatgtaaagctt

SEQ ID NO: 811086 - DNA, 19 bp, Homo sapiens
ataggtagagtcattcata

SEQ ID NO: 811087 - DNA, 15 bp, Homo sapiens
ataggtagtttggat

SEQ ID NO: 811088 - DNA, 16 bp, Homo sapiens
ataggtcactcctggg

SEQ ID NO: 811089 - DNA, 17 bp, Homo sapiens
ataggtcatcatgaaag

SEQ ID NO: 811090 - DNA, 21 bp, Homo sapiens
ataggtccagaagtccttatg

SEQ ID NO: 811091 - DNA, 18 bp, Homo sapiens
ataggtctcatctcttca

SEQ ID NO: 811092 - DNA, 15 bp, Homo sapiens
ataggtctttctctc

SEQ ID NO: 811093 - DNA, 14 bp, Homo sapiens
ataggtgatgggca

SEQ ID NO: 811094 - DNA, 16 bp, Homo sapiens
ataggttgagcaattt

SEQ ID NO: 811095 - DNA, 22 bp, Homo sapiens
ataggttgagcaatttccccct

SEQ ID NO: 811096 - DNA, 12 bp, Homo sapiens
ataggtttctaa

SEQ ID NO: 811097 - DNA, 18 bp, Homo sapiens
ataggtttctctccctcc

SEQ ID NO: 811098 - DNA, 23 bp, Homo sapiens
ataggttttcccctcttttgtta

SEQ ID NO: 811099 - DNA, 22 bp, Homo sapiens
ataggtttttctcatgtatctt

SEQ ID NO: 811100 - DNA, 23 bp, Homo sapiens
atagtaaacattaagtaaatgct

SEQ ID NO: 811101 - DNA, 13 bp, Homo sapiens
atagtaaatcacg

SEQ ID NO: 811102 - DNA, 16 bp, Homo sapiens
atagtaaatgtgtttc

SEQ ID NO: 811103 - DNA, 19 bp, Homo sapiens
atagtaaccattttccttt

SEQ ID NO: 811104 - DNA, 14 bp, Homo sapiens
atagtaataagatg

SEQ ID NO: 811105 - DNA, 22 bp, Homo sapiens
atagtaataggatacaatgtat

SEQ ID NO: 811106 - DNA, 17 bp, Homo sapiens
atagtaccaatcatttt

SEQ ID NO: 811107 - DNA, 21 bp, Homo sapiens
atagtaccatttatacaaatt

SEQ ID NO: 811108 - DNA, 14 bp, Homo sapiens
atagtactggcatg

SEQ ID NO: 811109 - DNA, 17 bp, Homo sapiens
atagtagcatacattta

SEQ ID NO: 811110 - DNA, 20 bp, Homo sapiens
atagtaggcactaaatacat

SEQ ID NO: 811111 - DNA, 22 bp, Homo sapiens
atagtaggggttgaagaaaaca

SEQ ID NO: 811112 - DNA, 19 bp, Homo sapiens
atatatgtatgtaaaaatg

SEQ ID NO: 811113 - DNA, 13 bp, Homo sapiens
atatatgtcaata

SEQ ID NO: 811114 - DNA, 13 bp, Homo sapiens
atatatgtgtatg

SEQ ID NO: 811115 - DNA, 13 bp, Homo sapiens
atatatgtgtgcc

SEQ ID NO: 811116 - DNA, 19 bp, Homo sapiens
atatatgtgtgtgtatgtt

SEQ ID NO: 811117 - DNA, 16 bp, Homo sapiens
atatatgtgtgtttaa

SEQ ID NO: 811118 - DNA, 18 bp, Homo sapiens
atatatgttctgcaagaa

SEQ ID NO: 811119 - DNA, 20 bp, Homo sapiens
atatattaaaattccaaatt

SEQ ID NO: 811120 - DNA, 14 bp, Homo sapiens
atatattactgatt

SEQ ID NO: 811121 - DNA, 12 bp, Homo sapiens
atatattatata

SEQ ID NO: 811122 - DNA, 13 bp, Homo sapiens
atatattattata

SEQ ID NO: 811123 - DNA, 18 bp, Homo sapiens
atatattattataatctt

SEQ ID NO: 811124 - DNA, 16 bp, Homo sapiens
atatattattcatctt

SEQ ID NO: 811125 - DNA, 14 bp, Homo sapiens
atatattatttgca

SEQ ID NO: 811126 - DNA, 23 bp, Homo sapiens
atatattctattccatgtccata

SEQ ID NO: 811127 - DNA, 17 bp, Homo sapiens
atatattgaacttttgt

SEQ ID NO: 811128 - DNA, 14 bp, Homo sapiens
atatattgaataaa

SEQ ID NO: 811129 - DNA, 14 bp, Homo sapiens
atatattgctaaaa

SEQ ID NO: 811130 - DNA, 19 bp, Homo sapiens
atatattgcttatctgaaa

SEQ ID NO: 811131 - DNA, 16 bp, Homo sapiens
atatattgtgttgact

SEQ ID NO: 811132 - DNA, 18 bp, Homo sapiens
atatattgttgttacttt

SEQ ID NO: 811133 - DNA, 12 bp, Homo sapiens
atatatttaaaa

SEQ ID NO: 811134 - DNA, 10 bp, Homo sapiens
atatatttat

SEQ ID NO: 811135 - DNA, 12 bp, Homo sapiens
atatatttataa

SEQ ID NO: 811136 - DNA, 13 bp, Homo sapiens
atatatttataac

SEQ ID NO: 811137 - DNA, 23 bp, Homo sapiens
atatatttataactcatcataaa

SEQ ID NO: 811138 - DNA, 23 bp, Homo sapiens
atatatttcacttttgttctgct

SEQ ID NO: 811139 - DNA, 12 bp, Homo sapiens
atatatttcccc

SEQ ID NO: 811140 - DNA, 14 bp, Homo sapiens
atatatttcccctt

SEQ ID NO: 811141 - DNA, 12 bp, Homo sapiens
atatatttctat

SEQ ID NO: 811142 - DNA, 23 bp, Homo sapiens
atatatttctattattaattgca

SEQ ID NO: 811143 - DNA, 15 bp, Homo sapiens
atatatttctttaaa

SEQ ID NO: 811144 - DNA, 18 bp, Homo sapiens
atatatttgtaacattgt

SEQ ID NO: 811145 - DNA, 22 bp, Homo sapiens
atatatttgtttcatttctgca

SEQ ID NO: 811146 - DNA, 14 bp, Homo sapiens
atatattttatatg

SEQ ID NO: 811147 - DNA, 16 bp, Homo sapiens
atatattttatatgtt

SEQ ID NO: 811148 - DNA, 22 bp, Homo sapiens
atatattttgtactttgtggag

SEQ ID NO: 811149 - DNA, 15 bp, Homo sapiens
atatatttttcaaat

SEQ ID NO: 811150 - DNA, 17 bp, Homo sapiens
atatattttttaatttg

SEQ ID NO: 811151 - DNA, 19 bp, Homo sapiens
atatattttttaatttgat

SEQ ID NO: 811152 - DNA, 20 bp, Homo sapiens
atatattttttaatttgatg

SEQ ID NO: 811153 - DNA, 23 bp, Homo sapiens
atatattttttaatttgatgaaa

SEQ ID NO: 811154 - DNA, 16 bp, Homo sapiens
atatattttttgcttt

SEQ ID NO: 811155 - DNA, 14 bp, Homo sapiens
atatattttttgta

SEQ ID NO: 811156 - DNA, 19 bp, Homo sapiens
atatcaaaaaacctttaca

SEQ ID NO: 811157 - DNA, 21 bp, Homo sapiens
atatcaaaaaacctttacagt

SEQ ID NO: 811158 - DNA, 23 bp, Homo sapiens
atatcaaagagaagatgcctgtt

SEQ ID NO: 811159 - DNA, 24 bp, Homo sapiens
atatcaaagagaagatgcctgtta

SEQ ID NO: 811160 - DNA, 13 bp, Homo sapiens
atatcaaagtcat

SEQ ID NO: 811161 - DNA, 12 bp, Homo sapiens
atatcaaatgca

SEQ ID NO: 811162 - DNA, 21 bp, Homo sapiens
atatcaaatgcagtatatttc

SEQ ID NO: 811163 - DNA, 15 bp, Homo sapiens
atatcaactctgaag

SEQ ID NO: 811164 - DNA, 18 bp, Homo sapiens
atatcaactctgaagcta

SEQ ID NO: 811165 - DNA, 17 bp, Homo sapiens
atatcaagaagtcttga

SEQ ID NO: 811166 - DNA, 21 bp, Homo sapiens
atatcactaatttcttcttta

SEQ ID NO: 811167 - DNA, 18 bp, Homo sapiens
atatcagagctcttaatg

SEQ ID NO: 811168 - DNA, 15 bp, Homo sapiens
atatcagagctggga

SEQ ID NO: 811169 - DNA, 12 bp, Homo sapiens
atatcagcctga

SEQ ID NO: 811170 - DNA, 14 bp, Homo sapiens
atatcagcctgagt

SEQ ID NO: 811171 - DNA, 18 bp, Homo sapiens
atatcagggtataaatta

SEQ ID NO: 811172 - DNA, 14 bp, Homo sapiens
atatcagtattctg

SEQ ID NO: 811173 - DNA, 15 bp, Homo sapiens
atatcagtattctga

SEQ ID NO: 811174 - DNA, 18 bp, Homo sapiens
atatcagttactcagccc

SEQ ID NO: 811175 - DNA, 21 bp, Homo sapiens
atatcataatgggggtaaagt

SEQ ID NO: 811176 - DNA, 13 bp, Homo sapiens
atatcatacaaat

SEQ ID NO: 811177 - DNA, 13 bp, Homo sapiens
atatcatacagtt

SEQ ID NO: 811178 - DNA, 16 bp, Homo sapiens
atatcatacagttttc

SEQ ID NO: 811179 - DNA, 19 bp, Homo sapiens
atatcatactgttcaatgg

SEQ ID NO: 811180 - DNA, 13 bp, Homo sapiens
atatcatatgtat

SEQ ID NO: 811181 - DNA, 20 bp, Homo sapiens
atatcatcacgtatgttata

SEQ ID NO: 811182 - DNA, 15 bp, Homo sapiens
atatcatgaaacact

SEQ ID NO: 811183 - DNA, 16 bp, Homo sapiens
atatcatgaagccttg

SEQ ID NO: 811184 - DNA, 20 bp, Homo sapiens
atatcatgcaaaatatgttt

SEQ ID NO: 811185 - DNA, 14 bp, Homo sapiens
atatcatggtaatg

SEQ ID NO: 811186 - DNA, 18 bp, Homo sapiens
atatcatggtaatgacag

SEQ ID NO: 811187 - DNA, 19 bp, Homo sapiens
atatcatgtcttgtgcata

SEQ ID NO: 811188 - DNA, 23 bp, Homo sapiens
atatcatgttaaattagaatgaa

SEQ ID NO: 811189 - DNA, 19 bp, Homo sapiens
atatcattaaacaaataaa

SEQ ID NO: 811190 - DNA, 23 bp, Homo sapiens
atatcattataactgaaggagaa

SEQ ID NO: 811191 - DNA, 23 bp, Homo sapiens
atatcatttattttttacattat

SEQ ID NO: 811192 - DNA, 22 bp, Homo sapiens
atatcatttcactgtctaggct

SEQ ID NO: 811193 - DNA, 14 bp, Homo sapiens
atatcatttgtgaa

SEQ ID NO: 811194 - DNA, 15 bp, Homo sapiens
atatcatttgtgaag

SEQ ID NO: 811195 - DNA, 20 bp, Homo sapiens
atatcatttgtgaagaatta

SEQ ID NO: 811196 - DNA, 11 bp, Homo sapiens
atatcatttta

SEQ ID NO: 811197 - DNA, 17 bp, Homo sapiens
atatcattttaaaaact

SEQ ID NO: 811198 - DNA, 20 bp, Homo sapiens
atatcattttaaaaacttta

SEQ ID NO: 811199 - DNA, 12 bp, Homo sapiens
atatccaaaagc

SEQ ID NO: 811200 - DNA, 15 bp, Homo sapiens
atatccaaagactgt

SEQ ID NO: 811201 - DNA, 18 bp, Homo sapiens
atatccaaagactgtact

SEQ ID NO: 811202 - DNA, 20 bp, Homo sapiens
atatccaaagactgtactgg

SEQ ID NO: 811203 - DNA, 15 bp, Homo sapiens
atatccaagtaccaa

SEQ ID NO: 811204 - DNA, 21 bp, Homo sapiens
atatccaagtaccaatgctgt

SEQ ID NO: 811205 - DNA, 22 bp, Homo sapiens
atatccaagtaccaatgctgtt

SEQ ID NO: 811206 - DNA, 17 bp, Homo sapiens
atatccacataaatgct

SEQ ID NO: 811207 - DNA, 18 bp, Homo sapiens
atatccacataaatgctc

SEQ ID NO: 811208 - DNA, 15 bp, Homo sapiens
atatccagaagggga

SEQ ID NO: 811209 - DNA, 13 bp, Homo sapiens
atatccatctttt

SEQ ID NO: 811210 - DNA, 11 bp, Homo sapiens
atatcccagag

SEQ ID NO: 811211 - DNA, 20 bp, Homo sapiens
atatcccagagaacaatcac

SEQ ID NO: 811212 - DNA, 23 bp, Homo sapiens
atatcccatatatttaatatgtc

SEQ ID NO: 811213 - DNA, 15 bp, Homo sapiens
atatccctacatgta

SEQ ID NO: 811214 - DNA, 16 bp, Homo sapiens
atatccctcttgtaag

SEQ ID NO: 811215 - DNA, 19 bp, Homo sapiens
atatccctgcccagcctgt

SEQ ID NO: 811216 - DNA, 16 bp, Homo sapiens
atatcccttaatgaaa

SEQ ID NO: 811217 - DNA, 15 bp, Homo sapiens
atatcctaaacatca

SEQ ID NO: 811218 - DNA, 19 bp, Homo sapiens
atatcctctccccctcctc

SEQ ID NO: 811219 - DNA, 22 bp, Homo sapiens
atatcctctccccctcctccag

SEQ ID NO: 811220 - DNA, 13 bp, Homo sapiens
atatcctgagcca

SEQ ID NO: 811221 - DNA, 11 bp, Homo sapiens
atatcctgcct

SEQ ID NO: 811222 - DNA, 13 bp, Homo sapiens
atatcctgcctca

SEQ ID NO: 811223 - DNA, 17 bp, Homo sapiens
atatcgacttgtttttg

SEQ ID NO: 811224 - DNA, 14 bp, Homo sapiens
atatctaaagttat

SEQ ID NO: 811225 - DNA, 13 bp, Homo sapiens
atatctaatatat

SEQ ID NO: 811226 - DNA, 18 bp, Homo sapiens
atatctaatatatatgaa

SEQ ID NO: 811227 - DNA, 15 bp, Homo sapiens
atatctaatatgaag

SEQ ID NO: 811228 - DNA, 19 bp, Homo sapiens
atatctacacatacagaaa

SEQ ID NO: 811229 - DNA, 21 bp, Homo sapiens
atatctaccccagactagatg

SEQ ID NO: 811230 - DNA, 23 bp, Homo sapiens
atatctaccccagactagatgta

SEQ ID NO: 811231 - DNA, 16 bp, Homo sapiens
atatctatatatgtat

SEQ ID NO: 811232 - DNA, 18 bp, Homo sapiens
atatctatatatgtatct

SEQ ID NO: 811233 - DNA, 19 bp, Homo sapiens
atatctatatatgtatcta

SEQ ID NO: 811234 - DNA, 14 bp, Homo sapiens
atatctatctattt

SEQ ID NO: 811235 - DNA, 19 bp, Homo sapiens
atattattcaagtgcctct

SEQ ID NO: 811236 - DNA, 19 bp, Homo sapiens
atattattccaaagttatt

SEQ ID NO: 811237 - DNA, 19 bp, Homo sapiens
atattattcctcaaaaaat

SEQ ID NO: 811238 - DNA, 15 bp, Homo sapiens
atattatttcttctc

SEQ ID NO: 811239 - DNA, 17 bp, Homo sapiens
atattatttcttctctt

SEQ ID NO: 811240 - DNA, 16 bp, Homo sapiens
atattatttgatatct

SEQ ID NO: 811241 - DNA, 17 bp, Homo sapiens
atattatttgtcttaaa

SEQ ID NO: 811242 - DNA, 12 bp, Homo sapiens
atattattttaa

SEQ ID NO: 811243 - DNA, 14 bp, Homo sapiens
atattattttaatt

SEQ ID NO: 811244 - DNA, 19 bp, Homo sapiens
atattattttagcttcagt

SEQ ID NO: 811245 - DNA, 13 bp, Homo sapiens
atattcaaagcag

SEQ ID NO: 811246 - DNA, 19 bp, Homo sapiens
atattcaagagtgggggga

SEQ ID NO: 811247 - DNA, 21 bp, Homo sapiens
atattcaaggctttaaaagtc

SEQ ID NO: 811248 - DNA, 22 bp, Homo sapiens
atattcacacctcacgctctgg

SEQ ID NO: 811249 - DNA, 21 bp, Homo sapiens
atattcacagactgattggaa

SEQ ID NO: 811250 - DNA, 12 bp, Homo sapiens
atattcacagtt

SEQ ID NO: 811251 - DNA, 22 bp, Homo sapiens
atattcactggttttacacaga

SEQ ID NO: 811252 - DNA, 13 bp, Homo sapiens
atattcagaaatt

SEQ ID NO: 811253 - DNA, 16 bp, Homo sapiens
atattcagacaaaatg

SEQ ID NO: 811254 - DNA, 18 bp, Homo sapiens
atattcagacaaaatgga

SEQ ID NO: 811255 - DNA, 19 bp, Homo sapiens
atattcagccagcttaaac

SEQ ID NO: 811256 - DNA, 16 bp, Homo sapiens
atattcaggagttgga

SEQ ID NO: 811257 - DNA, 14 bp, Homo sapiens
atattcagtgaaaa

SEQ ID NO: 811258 - DNA, 11 bp, Homo sapiens
atattccaagg

SEQ ID NO: 811259 - DNA, 20 bp, Homo sapiens
atattccaaggaaaattgaa

SEQ ID NO: 811260 - DNA, 20 bp, Homo sapiens
atattccagcagtgaaactt

SEQ ID NO: 811261 - DNA, 15 bp, Homo sapiens
atattccatgaatgt

SEQ ID NO: 811262 - DNA, 19 bp, Homo sapiens
atattccgtatttaaagtt

SEQ ID NO: 811263 - DNA, 17 bp, Homo sapiens
atattcctattgtgcaa

SEQ ID NO: 811264 - DNA, 15 bp, Homo sapiens
atattcctgaatgaa

SEQ ID NO: 811265 - DNA, 17 bp, Homo sapiens
atattcctgaatgaaat

SEQ ID NO: 811266 - DNA, 22 bp, Homo sapiens
atattcctgaatgaaatatcag

SEQ ID NO: 811267 - DNA, 23 bp, Homo sapiens
atattcctgaatgaaatatcaga

SEQ ID NO: 811268 - DNA, 14 bp, Homo sapiens
atattcctggactt

SEQ ID NO: 811269 - DNA, 15 bp, Homo sapiens
atattcctttgacca

SEQ ID NO: 811270 - DNA, 18 bp, Homo sapiens
atattcgctagtgtttaa

SEQ ID NO: 811271 - DNA, 16 bp, Homo sapiens
atattctaaaaccatt

SEQ ID NO: 811272 - DNA, 13 bp, Homo sapiens
atattctaagcca

SEQ ID NO: 811273 - DNA, 18 bp, Homo sapiens
atattctatatgaattta

SEQ ID NO: 811274 - DNA, 15 bp, Homo sapiens
atattctatttttat

SEQ ID NO: 811275 - DNA, 11 bp, Homo sapiens
atattctggaa

SEQ ID NO: 811276 - DNA, 13 bp, Homo sapiens
atattctggaaaa

SEQ ID NO: 811277 - DNA, 20 bp, Homo sapiens
atattctggaaaaaaaatat

SEQ ID NO: 811278 - DNA, 21 bp, Homo sapiens
atattctggaaaaaaaatata

SEQ ID NO: 811279 - DNA, 14 bp, Homo sapiens
atattctgttgctt

SEQ ID NO: 811280 - DNA, 15 bp, Homo sapiens
atattctgttgcttt

SEQ ID NO: 811281 - DNA, 21 bp, Homo sapiens
atattctgttttgttaatata

SEQ ID NO: 811282 - DNA, 13 bp, Homo sapiens
atattcttataaa

SEQ ID NO: 811283 - DNA, 15 bp, Homo sapiens
atattcttgtgcttt

SEQ ID NO: 811284 - DNA, 16 bp, Homo sapiens
atattcttttgtttcc

SEQ ID NO: 811285 - DNA, 22 bp, Homo sapiens
atattgaagttgtttatcaact

SEQ ID NO: 811286 - DNA, 13 bp, Homo sapiens
atattgaataaaa

SEQ ID NO: 811287 - DNA, 23 bp, Homo sapiens
atattgaataaaaaatagacatg

SEQ ID NO: 811288 - DNA, 13 bp, Homo sapiens
atattgaatatat

SEQ ID NO: 811289 - DNA, 12 bp, Homo sapiens
atattgacattt

SEQ ID NO: 811290 - DNA, 16 bp, Homo sapiens
atattgacatttgtag

SEQ ID NO: 811291 - DNA, 14 bp, Homo sapiens
atattgacttgtat

SEQ ID NO: 811292 - DNA, 15 bp, Homo sapiens
atattgacttgtata

SEQ ID NO: 811293 - DNA, 13 bp, Homo sapiens
atattgagaatca

SEQ ID NO: 811294 - DNA, 18 bp, Homo sapiens
atattgagcaatatgtca

SEQ ID NO: 811295 - DNA, 20 bp, Homo sapiens
atattgagcaatatgtcagt

SEQ ID NO: 811296 - DNA, 22 bp, Homo sapiens
atattgatcaaatatagaaagt

SEQ ID NO: 811297 - DNA, 15 bp, Homo sapiens
atattgatgataaca

SEQ ID NO: 811298 - DNA, 15 bp, Homo sapiens
atattgatgttaaca

SEQ ID NO: 811299 - DNA, 16 bp, Homo sapiens
atattgatgttaacaa

SEQ ID NO: 811300 - DNA, 17 bp, Homo sapiens
atattgattctgaaatt

SEQ ID NO: 811301 - DNA, 16 bp, Homo sapiens
atattgattgtccttt

SEQ ID NO: 811302 - DNA, 21 bp, Homo sapiens
atattgatttccgttaaaata

SEQ ID NO: 811303 - DNA, 22 bp, Homo sapiens
atattgatttccgttaaaatac

SEQ ID NO: 811304 - DNA, 19 bp, Homo sapiens
atattgcaaaatacatgaa

SEQ ID NO: 811305 - DNA, 16 bp, Homo sapiens
atattgccgcactagg

SEQ ID NO: 811306 - DNA, 17 bp, Homo sapiens
atattgcctgtgcttct

SEQ ID NO: 811307 - DNA, 11 bp, Homo sapiens
atattgcctta

SEQ ID NO: 811308 - DNA, 14 bp, Homo sapiens
atattgccttattt

SEQ ID NO: 811309 - DNA, 19 bp, Homo sapiens
atattgctgaagaatctac

SEQ ID NO: 811310 - DNA, 17 bp, Homo sapiens
atattgcttcttctcct

SEQ ID NO: 811311 - DNA, 16 bp, Homo sapiens
atattgggaaggaaat

SEQ ID NO: 811312 - DNA, 21 bp, Homo sapiens
atattgggtctcagccctagg

SEQ ID NO: 811313 - DNA, 18 bp, Homo sapiens
atattgggtgtagatttc

SEQ ID NO: 811314 - DNA, 18 bp, Homo sapiens
atattggtaattaaaaga

SEQ ID NO: 811315 - DNA, 14 bp, Homo sapiens
atattggttcttcc

SEQ ID NO: 811316 - DNA, 16 bp, Homo sapiens
atattggttcttcccc

SEQ ID NO: 811317 - DNA, 14 bp, Homo sapiens
atattgtaaatact

SEQ ID NO: 811318 - DNA, 22 bp, Homo sapiens
atattgtaaatactggactcag

SEQ ID NO: 811319 - DNA, 15 bp, Homo sapiens
atattgtaagaaata

SEQ ID NO: 811320 - DNA, 16 bp, Homo sapiens
atattgtaagaaatac

SEQ ID NO: 811321 - DNA, 21 bp, Homo sapiens
atattgtacaaatgtaagcaa

SEQ ID NO: 811322 - DNA, 12 bp, Homo sapiens
atattgtacagt

SEQ ID NO: 811323 - DNA, 14 bp, Homo sapiens
atattgtacagttt

SEQ ID NO: 811324 - DNA, 17 bp, Homo sapiens
atattgtacataaaaga

SEQ ID NO: 811325 - DNA, 18 bp, Homo sapiens
atattgtatattctggaa

SEQ ID NO: 811326 - DNA, 22 bp, Homo sapiens
atattgtattgttagatgtttg

SEQ ID NO: 811327 - DNA, 22 bp, Homo sapiens
atattgtcagagttctgctcta

SEQ ID NO: 811328 - DNA, 12 bp, Homo sapiens
atattgtcagat

SEQ ID NO: 811329 - DNA, 17 bp, Homo sapiens
atattgtcagatatttt

SEQ ID NO: 811330 - DNA, 12 bp, Homo sapiens
atattgtcatct

SEQ ID NO: 811331 - DNA, 23 bp, Homo sapiens
atattgtcatctttttctagagt

SEQ ID NO: 811332 - DNA, 20 bp, Homo sapiens
atattgtggaataaatcctt

SEQ ID NO: 811333 - DNA, 21 bp, Homo sapiens
atattgtggaataaatccttc

SEQ ID NO: 811334 - DNA, 18 bp, Homo sapiens
atattgtggatgtgttca

SEQ ID NO: 811335 - DNA, 19 bp, Homo sapiens
atattgtgggtgttaattt

SEQ ID NO: 811336 - DNA, 18 bp, Homo sapiens
atattgtgtcatagaatt

SEQ ID NO: 811337 - DNA, 15 bp, Homo sapiens
atattgttataaata

SEQ ID NO: 811338 - DNA, 13 bp, Homo sapiens
atattgttgacaa

SEQ ID NO: 811339 - DNA, 16 bp, Homo sapiens
atattgttgcattgct

SEQ ID NO: 811340 - DNA, 18 bp, Homo sapiens
atattgtttgctgttggg

SEQ ID NO: 811341 - DNA, 17 bp, Homo sapiens
atattgttttcagtgta

SEQ ID NO: 811342 - DNA, 21 bp, Homo sapiens
atattgttttctcctttctgg

SEQ ID NO: 811343 - DNA, 21 bp, Homo sapiens
atatttaaaaaaaaaatcagt

SEQ ID NO: 811344 - DNA, 16 bp, Homo sapiens
atatttaaaaatgtct

SEQ ID NO: 811345 - DNA, 22 bp, Homo sapiens
atatttaaacctttttcttgat

SEQ ID NO: 811346 - DNA, 15 bp, Homo sapiens
atatttaaactcaag

SEQ ID NO: 811347 - DNA, 22 bp, Homo sapiens
atatttaaaggggagatactct

SEQ ID NO: 811348 - DNA, 16 bp, Homo sapiens
atatttaactggtgca

SEQ ID NO: 811349 - DNA, 14 bp, Homo sapiens
atatttaagaaaat

SEQ ID NO: 811350 - DNA, 19 bp, Homo sapiens
atatttaagaaaatacaat

SEQ ID NO: 811351 - DNA, 18 bp, Homo sapiens
atatttaagccttttgtg

SEQ ID NO: 811352 - DNA, 13 bp, Homo sapiens
atatttaagtata

SEQ ID NO: 811353 - DNA, 14 bp, Homo sapiens
atatttaagtatat

SEQ ID NO: 811354 - DNA, 15 bp, Homo sapiens
atatttaagtgtatt

SEQ ID NO: 811355 - DNA, 15 bp, Homo sapiens
atatttaattaaagc

SEQ ID NO: 811356 - DNA, 21 bp, Homo sapiens
atatttacaatgtattaagcc

SEQ ID NO: 811357 - DNA, 16 bp, Homo sapiens
atatttacagaagaaa

SEQ ID NO: 811358 - DNA, 23 bp, Homo sapiens
atcacagtgactttacaggaggt

SEQ ID NO: 811359 - DNA, 13 bp, Homo sapiens
atcacagtgtttt

SEQ ID NO: 811360 - DNA, 18 bp, Homo sapiens
atcacatcaagcatgcaa

SEQ ID NO: 811361 - DNA, 14 bp, Homo sapiens
atcacatcaccttt

SEQ ID NO: 811362 - DNA, 12 bp, Homo sapiens
atcacatcctgg

SEQ ID NO: 811363 - DNA, 16 bp, Homo sapiens
atcacatctaaagctt

SEQ ID NO: 811364 - DNA, 18 bp, Homo sapiens
atcacatctaaagcttta

SEQ ID NO: 811365 - DNA, 20 bp, Homo sapiens
atcacatctaaagctttatc

SEQ ID NO: 811366 - DNA, 16 bp, Homo sapiens
atcacatgagacaatt

SEQ ID NO: 811367 - DNA, 17 bp, Homo sapiens
atcacattaatctcaaa

SEQ ID NO: 811368 - DNA, 22 bp, Homo sapiens
atcacattatttgcatgttacc

SEQ ID NO: 811369 - DNA, 19 bp, Homo sapiens
atcacattttaagtgcttc

SEQ ID NO: 811370 - DNA, 20 bp, Homo sapiens
atcaccaccgcctctggccg

SEQ ID NO: 811371 - DNA, 13 bp, Homo sapiens
atcaccagacagg

SEQ ID NO: 811372 - DNA, 21 bp, Homo sapiens
atcaccagcccggcctgctcc

SEQ ID NO: 811373 - DNA, 22 bp, Homo sapiens
atcaccagtggccttggtcctt

SEQ ID NO: 811374 - DNA, 19 bp, Homo sapiens
atcaccatagggctgggga

SEQ ID NO: 811375 - DNA, 15 bp, Homo sapiens
atcaccatgtaagca

SEQ ID NO: 811376 - DNA, 17 bp, Homo sapiens
atcaccatgttagcctt

SEQ ID NO: 811377 - DNA, 17 bp, Homo sapiens
atcaccctcacccactc

SEQ ID NO: 811378 - DNA, 11 bp, Homo sapiens
atcaccctcct

SEQ ID NO: 811379 - DNA, 15 bp, Homo sapiens
atcaccctcttcctg

SEQ ID NO: 811380 - DNA, 22 bp, Homo sapiens
atcaccgacgcgtctcctgttt

SEQ ID NO: 811381 - DNA, 20 bp, Homo sapiens
atcaccgagagtagccgaga

SEQ ID NO: 811382 - DNA, 19 bp, Homo sapiens
atcaccgctgggtggtttt

SEQ ID NO: 811383 - DNA, 22 bp, Homo sapiens
atcacctatttccattcaacaa

SEQ ID NO: 811384 - DNA, 12 bp, Homo sapiens
atcacctcaggc

SEQ ID NO: 811385 - DNA, 14 bp, Homo sapiens
atcacctcaggcca

SEQ ID NO: 811386 - DNA, 15 bp, Homo sapiens
atcacctcattctga

SEQ ID NO: 811387 - DNA, 18 bp, Homo sapiens
atcacctcattctgaacc

SEQ ID NO: 811388 - DNA, 12 bp, Homo sapiens
atcacctcccct

SEQ ID NO: 811389 - DNA, 13 bp, Homo sapiens
atcacctcccctc

SEQ ID NO: 811390 - DNA, 13 bp, Homo sapiens
atcacctcttggg

SEQ ID NO: 811391 - DNA, 19 bp, Homo sapiens
atcacctgaaacactggac

SEQ ID NO: 811392 - DNA, 22 bp, Homo sapiens
atcacctgaaacactggacctg

SEQ ID NO: 811393 - DNA, 12 bp, Homo sapiens
atcacctgaggt

SEQ ID NO: 811394 - DNA, 18 bp, Homo sapiens
atcacctttttgactttt

SEQ ID NO: 811395 - DNA, 13 bp, Homo sapiens
atcacgatttcat

SEQ ID NO: 811396 - DNA, 14 bp, Homo sapiens
atcacgctttcctg

SEQ ID NO: 811397 - DNA, 22 bp, Homo sapiens
atcacggtcgccacctggcatt

SEQ ID NO: 811398 - DNA, 17 bp, Homo sapiens
atcacgtaccccactgg

SEQ ID NO: 811399 - DNA, 22 bp, Homo sapiens
atcacgtaccccactgggccag

SEQ ID NO: 811400 - DNA, 14 bp, Homo sapiens
atcactaaacttta

SEQ ID NO: 811401 - DNA, 21 bp, Homo sapiens
atcactaaactttatttgtaa

SEQ ID NO: 811402 - DNA, 12 bp, Homo sapiens
atcactactgta

SEQ ID NO: 811403 - DNA, 13 bp, Homo sapiens
atcactactgtat

SEQ ID NO: 811404 - DNA, 15 bp, Homo sapiens
atcactagagtgctc

SEQ ID NO: 811405 - DNA, 12 bp, Homo sapiens
atcactattctt

SEQ ID NO: 811406 - DNA, 17 bp, Homo sapiens
atcactattcttaagca

SEQ ID NO: 811407 - DNA, 16 bp, Homo sapiens
atcactattgaaaaat

SEQ ID NO: 811408 - DNA, 16 bp, Homo sapiens
atcactcactcactcc

SEQ ID NO: 811409 - DNA, 13 bp, Homo sapiens
atcactcagcccc

SEQ ID NO: 811410 - DNA, 15 bp, Homo sapiens
atcactcagccccta

SEQ ID NO: 811411 - DNA, 23 bp, Homo sapiens
atcactcagcccctacccctgcc

SEQ ID NO: 811412 - DNA, 16 bp, Homo sapiens
atcactcattaattaa

SEQ ID NO: 811413 - DNA, 12 bp, Homo sapiens
atcactccctgg

SEQ ID NO: 811414 - DNA, 16 bp, Homo sapiens
atcactcctggaggct

SEQ ID NO: 811415 - DNA, 13 bp, Homo sapiens
atcactcgcagga

SEQ ID NO: 811416 - DNA, 20 bp, Homo sapiens
atcactctaattaattgtaa

SEQ ID NO: 811417 - DNA, 21 bp, Homo sapiens
atcactctcagtgcttcttac

SEQ ID NO: 811418 - DNA, 14 bp, Homo sapiens
atcactctgctgct

SEQ ID NO: 811419 - DNA, 13 bp, Homo sapiens
atcactctgtcct

SEQ ID NO: 811420 - DNA, 15 bp, Homo sapiens
atcactgaatttata

SEQ ID NO: 811421 - DNA, 17 bp, Homo sapiens
atcactgagccatcatt

SEQ ID NO: 811422 - DNA, 18 bp, Homo sapiens
atcactgagccatcattt

SEQ ID NO: 811423 - DNA, 22 bp, Homo sapiens
atcactgccacactctccatca

SEQ ID NO: 811424 - DNA, 21 bp, Homo sapiens
atcactgcttgatgaagcaag

SEQ ID NO: 811425 - DNA, 17 bp, Homo sapiens
atcactggactgcatgg

SEQ ID NO: 811426 - DNA, 14 bp, Homo sapiens
atcactggagccca

SEQ ID NO: 811427 - DNA, 16 bp, Homo sapiens
atcactggctggcctg

SEQ ID NO: 811428 - DNA, 22 bp, Homo sapiens
atcactgtaaagacaaataaat

SEQ ID NO: 811429 - DNA, 23 bp, Homo sapiens
atcactgtagtttagttctgttg

SEQ ID NO: 811430 - DNA, 20 bp, Homo sapiens
atcactgtcaatatttttat

SEQ ID NO: 811431 - DNA, 12 bp, Homo sapiens
atcactgtgaaa

SEQ ID NO: 811432 - DNA, 13 bp, Homo sapiens
atcactgtgaaat

SEQ ID NO: 811433 - DNA, 21 bp, Homo sapiens
atcactgtgaaatttcatgat

SEQ ID NO: 811434 - DNA, 12 bp, Homo sapiens
atcactgttgag

SEQ ID NO: 811435 - DNA, 17 bp, Homo sapiens
atcacttaaacttgcat

SEQ ID NO: 811436 - DNA, 15 bp, Homo sapiens
atcacttcagatctc

SEQ ID NO: 811437 - DNA, 19 bp, Homo sapiens
atcacttcagatctctaat

SEQ ID NO: 811438 - DNA, 14 bp, Homo sapiens
atcacttcttccac

SEQ ID NO: 811439 - DNA, 18 bp, Homo sapiens
atcacttgtacaaaataa

SEQ ID NO: 811440 - DNA, 21 bp, Homo sapiens
atcacttgtacaaaataaaca

SEQ ID NO: 811441 - DNA, 13 bp, Homo sapiens
atcacttgttgtt

SEQ ID NO: 811442 - DNA, 17 bp, Homo sapiens
atcacttgttgttttac

SEQ ID NO: 811443 - DNA, 13 bp, Homo sapiens
atcactttaagtt

SEQ ID NO: 811444 - DNA, 20 bp, Homo sapiens
atcactttctcagttttcat

SEQ ID NO: 811445 - DNA, 21 bp, Homo sapiens
atcactttgtctaactcagaa

SEQ ID NO: 811446 - DNA, 14 bp, Homo sapiens
atcacttttcagtg

SEQ ID NO: 811447 - DNA, 16 bp, Homo sapiens
atcacttttctagaca

SEQ ID NO: 811448 - DNA, 16 bp, Homo sapiens
atcactttttggaatt

SEQ ID NO: 811449 - DNA, 21 bp, Homo sapiens
atcactttttggaattgtctt

SEQ ID NO: 811450 - DNA, 13 bp, Homo sapiens
atcagaaaagcta

SEQ ID NO: 811451 - DNA, 14 bp, Homo sapiens
atcagaaaagctat

SEQ ID NO: 811452 - DNA, 20 bp, Homo sapiens
atcagaaagtaacaatctat

SEQ ID NO: 811453 - DNA, 17 bp, Homo sapiens
atcagaaagtgacattt

SEQ ID NO: 811454 - DNA, 13 bp, Homo sapiens
atcagaacagcag

SEQ ID NO: 811455 - DNA, 21 bp, Homo sapiens
atcagaacagggctatttgaa

SEQ ID NO: 811456 - DNA, 12 bp, Homo sapiens
atcagaagagag

SEQ ID NO: 811457 - DNA, 14 bp, Homo sapiens
atcagaagataact

SEQ ID NO: 811458 - DNA, 18 bp, Homo sapiens
atcagaagtcatcttgct

SEQ ID NO: 811459 - DNA, 20 bp, Homo sapiens
atcagaatacttgcactctt

SEQ ID NO: 811460 - DNA, 20 bp, Homo sapiens
atcagaatggaagagagaaa

SEQ ID NO: 811461 - DNA, 12 bp, Homo sapiens
atcagaatgtta

SEQ ID NO: 811462 - DNA, 23 bp, Homo sapiens
atcagaatgttaatttattttgc

SEQ ID NO: 811463 - DNA, 14 bp, Homo sapiens
atcagaatttgtgt

SEQ ID NO: 811464 - DNA, 12 bp, Homo sapiens
atcagacaagca

SEQ ID NO: 811465 - DNA, 13 bp, Homo sapiens
atcagacaagcac

SEQ ID NO: 811466 - DNA, 19 bp, Homo sapiens
atcagacaccctctcctta

SEQ ID NO: 811467 - DNA, 15 bp, Homo sapiens
atcagaccctacccc

SEQ ID NO: 811468 - DNA, 21 bp, Homo sapiens
atcagactagccactcctgcc

SEQ ID NO: 811469 - DNA, 13 bp, Homo sapiens
atcagagagccta

SEQ ID NO: 811470 - DNA, 15 bp, Homo sapiens
atcagagaggcaagg

SEQ ID NO: 811471 - DNA, 22 bp, Homo sapiens
atcagagagtgtacatcatgtt

SEQ ID NO: 811472 - DNA, 14 bp, Homo sapiens
atcagagctcttaa

SEQ ID NO: 811473 - DNA, 15 bp, Homo sapiens
atcagaggtatctta

SEQ ID NO: 811474 - DNA, 17 bp, Homo sapiens
atcagatacatcactgc

SEQ ID NO: 811475 - DNA, 15 bp, Homo sapiens
atcagatatttctta

SEQ ID NO: 811476 - DNA, 15 bp, Homo sapiens
atcagatgtgttcct

SEQ ID NO: 811477 - DNA, 22 bp, Homo sapiens
atcagatgtgttcctccatttt

SEQ ID NO: 811478 - DNA, 21 bp, Homo sapiens
atcagatgttttggtcaagta

SEQ ID NO: 811479 - DNA, 19 bp, Homo sapiens
atcagattgttaagggcat

SEQ ID NO: 811480 - DNA, 13 bp, Homo sapiens
atcagcaaaaaag

SEQ ID NO: 811481 - DNA, 14 bp, Homo sapiens
atcattttaaaaac

SEQ ID NO: 811482 - DNA, 20 bp, Homo sapiens
atcattttaaaaactttatt

SEQ ID NO: 811483 - DNA, 14 bp, Homo sapiens
atcattttaattat

SEQ ID NO: 811484 - DNA, 15 bp, Homo sapiens
atcattttaattatt

SEQ ID NO: 811485 - DNA, 13 bp, Homo sapiens
atcattttgcatt

SEQ ID NO: 811486 - DNA, 17 bp, Homo sapiens
atcattttgcattcaaa

SEQ ID NO: 811487 - DNA, 19 bp, Homo sapiens
atcattttgcattcaaatt

SEQ ID NO: 811488 - DNA, 18 bp, Homo sapiens
atcatttttacactattg

SEQ ID NO: 811489 - DNA, 14 bp, Homo sapiens
atcatttttccagg

SEQ ID NO: 811490 - DNA, 17 bp, Homo sapiens
atcatttttccaggact

SEQ ID NO: 811491 - DNA, 21 bp, Homo sapiens
atcatttttccaggactcttt

SEQ ID NO: 811492 - DNA, 14 bp, Homo sapiens
atcatttttgtata

SEQ ID NO: 811493 - DNA, 19 bp, Homo sapiens
atcatttttgtataaaaag

SEQ ID NO: 811494 - DNA, 20 bp, Homo sapiens
atcatttttgtataaaaagg

SEQ ID NO: 811495 - DNA, 17 bp, Homo sapiens
atccaaaaagctctgaa

SEQ ID NO: 811496 - DNA, 17 bp, Homo sapiens
atccaaaacttctcttg

SEQ ID NO: 811497 - DNA, 20 bp, Homo sapiens
atccaaaatattttttgcaa

SEQ ID NO: 811498 - DNA, 17 bp, Homo sapiens
atccaaaatgtgtattt

SEQ ID NO: 811499 - DNA, 23 bp, Homo sapiens
atccaaaatgtgtatttcttata

SEQ ID NO: 811500 - DNA, 16 bp, Homo sapiens
atccaaagactgtact

SEQ ID NO: 811501 - DNA, 20 bp, Homo sapiens
atccaaagttgccacagatg

SEQ ID NO: 811502 - DNA, 21 bp, Homo sapiens
atccaaatcttgaatttctgc

SEQ ID NO: 811503 - DNA, 12 bp, Homo sapiens
atccaacaagaa

SEQ ID NO: 811504 - DNA, 18 bp, Homo sapiens
atccaacaagaagaaata

SEQ ID NO: 811505 - DNA, 15 bp, Homo sapiens
atccaaccattttca

SEQ ID NO: 811506 - DNA, 16 bp, Homo sapiens
atccaactaatgcctt

SEQ ID NO: 811507 - DNA, 14 bp, Homo sapiens
atccaactccagca

SEQ ID NO: 811508 - DNA, 15 bp, Homo sapiens
atccaactccagcaa

SEQ ID NO: 811509 - DNA, 16 bp, Homo sapiens
atccaactccagcaac

SEQ ID NO: 811510 - DNA, 15 bp, Homo sapiens
atccaacttccaaga

SEQ ID NO: 811511 - DNA, 12 bp, Homo sapiens
atccaagcctcc

SEQ ID NO: 811512 - DNA, 13 bp, Homo sapiens
atccaagctccct

SEQ ID NO: 811513 - DNA, 15 bp, Homo sapiens
atccaagctccctgc

SEQ ID NO: 811514 - DNA, 17 bp, Homo sapiens
atccaagctccctgccc

SEQ ID NO: 811515 - DNA, 16 bp, Homo sapiens
atccaaggaaacatgc

SEQ ID NO: 811516 - DNA, 22 bp, Homo sapiens
atccaaggagaaacagagacag

SEQ ID NO: 811517 - DNA, 14 bp, Homo sapiens
atccaaggcaaaca

SEQ ID NO: 811518 - DNA, 15 bp, Homo sapiens
atccaaggcaaacaa

SEQ ID NO: 811519 - DNA, 17 bp, Homo sapiens
atccaaggcaaacaatc

SEQ ID NO: 811520 - DNA, 18 bp, Homo sapiens
atccaaggcaaacaatcc

SEQ ID NO: 811521 - DNA, 13 bp, Homo sapiens
atccaataaaaaa

SEQ ID NO: 811522 - DNA, 16 bp, Homo sapiens
atccaatatcatgtct

SEQ ID NO: 811523 - DNA, 14 bp, Homo sapiens
atccaatattgtaa

SEQ ID NO: 811524 - DNA, 17 bp, Homo sapiens
atccaatattttgcctt

SEQ ID NO: 811525 - DNA, 14 bp, Homo sapiens
atccaatcctcact

SEQ ID NO: 811526 - DNA, 18 bp, Homo sapiens
atccaatcctcactgggt

SEQ ID NO: 811527 - DNA, 19 bp, Homo sapiens
atccaatcctcactgggtg

SEQ ID NO: 811528 - DNA, 20 bp, Homo sapiens
atccaatcctcactgggtgg

SEQ ID NO: 811529 - DNA, 15 bp, Homo sapiens
atccaattttaatat

SEQ ID NO: 811530 - DNA, 20 bp, Homo sapiens
atccacacacagaggaagag

SEQ ID NO: 811531 - DNA, 10 bp, Homo sapiens
atccacagct

SEQ ID NO: 811532 - DNA, 23 bp, Homo sapiens
atccacagctatatcctgatgct

SEQ ID NO: 811533 - DNA, 20 bp, Homo sapiens
atccacaggaaagtgttatt

SEQ ID NO: 811534 - DNA, 21 bp, Homo sapiens
atccacataaatgctccttgt

SEQ ID NO: 811535 - DNA, 17 bp, Homo sapiens
atccaccacctccctca

SEQ ID NO: 811536 - DNA, 14 bp, Homo sapiens
atccacccagccca

SEQ ID NO: 811537 - DNA, 15 bp, Homo sapiens
atccacccagtgctg

SEQ ID NO: 811538 - DNA, 22 bp, Homo sapiens
atccacccagtgctgccatgcc

SEQ ID NO: 811539 - DNA, 11 bp, Homo sapiens
atccaccccca

SEQ ID NO: 811540 - DNA, 21 bp, Homo sapiens
atccacccccaggtgcagccc

SEQ ID NO: 811541 - DNA, 22 bp, Homo sapiens
atccacccgggggagcccagtg

SEQ ID NO: 811542 - DNA, 21 bp, Homo sapiens
atccaccctatccctgtacag

SEQ ID NO: 811543 - DNA, 21 bp, Homo sapiens
atccacctcatcactggactg

SEQ ID NO: 811544 - DNA, 18 bp, Homo sapiens
atccacctgcttatgcat

SEQ ID NO: 811545 - DNA, 18 bp, Homo sapiens
atccacctgtctcagcct

SEQ ID NO: 811546 - DNA, 18 bp, Homo sapiens
atccactctaccctccca

SEQ ID NO: 811547 - DNA, 21 bp, Homo sapiens
atccactctaccctcccaccc

SEQ ID NO: 811548 - DNA, 23 bp, Homo sapiens
atccactctaccctcccaccccc

SEQ ID NO: 811549 - DNA, 15 bp, Homo sapiens
atccacttaagttct

SEQ ID NO: 811550 - DNA, 20 bp, Homo sapiens
atccacttcttggttcctgg

SEQ ID NO: 811551 - DNA, 24 bp, Homo sapiens
atccacttcttggttcctgggatg

SEQ ID NO: 811552 - DNA, 15 bp, Homo sapiens
atccactttggggga

SEQ ID NO: 811553 - DNA, 15 bp, Homo sapiens
atccacttttcttct

SEQ ID NO: 811554 - DNA, 13 bp, Homo sapiens
atccagaaagaaa

SEQ ID NO: 811555 - DNA, 18 bp, Homo sapiens
atccagaacagtggctcg

SEQ ID NO: 811556 - DNA, 17 bp, Homo sapiens
atccagaaggggagctt

SEQ ID NO: 811557 - DNA, 20 bp, Homo sapiens
atccagaattgaccttttga

SEQ ID NO: 811558 - DNA, 22 bp, Homo sapiens
atccagaatttattagtttaaa

SEQ ID NO: 811559 - DNA, 19 bp, Homo sapiens
atccagactgtaagatgtt

SEQ ID NO: 811560 - DNA, 23 bp, Homo sapiens
atccagagattcattttctagat

SEQ ID NO: 811561 - DNA, 12 bp, Homo sapiens
atccagaggaac

SEQ ID NO: 811562 - DNA, 15 bp, Homo sapiens
atccagatgtggcta

SEQ ID NO: 811563 - DNA, 19 bp, Homo sapiens
atccagcctggggctgagg

SEQ ID NO: 811564 - DNA, 13 bp, Homo sapiens
atccagcctgtgt

SEQ ID NO: 811565 - DNA, 13 bp, Homo sapiens
atccagccttgga

SEQ ID NO: 811566 - DNA, 22 bp, Homo sapiens
atccagcgagagagtttcaaaa

SEQ ID NO: 811567 - DNA, 21 bp, Homo sapiens
atccagctcctctaggggcag

SEQ ID NO: 811568 - DNA, 22 bp, Homo sapiens
atccagctgcccctccctcagg

SEQ ID NO: 811569 - DNA, 13 bp, Homo sapiens
atccaggactctg

SEQ ID NO: 811570 - DNA, 15 bp, Homo sapiens
atccaggactctgtc

SEQ ID NO: 811571 - DNA, 19 bp, Homo sapiens
atccagggtctggcagagc

SEQ ID NO: 811572 - DNA, 24 bp, Homo sapiens
atccagggtctggcagagcctctg

SEQ ID NO: 811573 - DNA, 16 bp, Homo sapiens
atccaggtcatgcagt

SEQ ID NO: 811574 - DNA, 17 bp, Homo sapiens
atccagtattatattat

SEQ ID NO: 811575 - DNA, 16 bp, Homo sapiens
atccagtattgctgat

SEQ ID NO: 811576 - DNA, 20 bp, Homo sapiens
atccagtattgctgatttta

SEQ ID NO: 811577 - DNA, 22 bp, Homo sapiens
atccagtattgctgattttaaa

SEQ ID NO: 811578 - DNA, 14 bp, Homo sapiens
atccagtctggaaa

SEQ ID NO: 811579 - DNA, 13 bp, Homo sapiens
atccagtgacatg

SEQ ID NO: 811580 - DNA, 12 bp, Homo sapiens
atccagtgtata

SEQ ID NO: 811581 - DNA, 18 bp, Homo sapiens
atccagtgtataaatcca

SEQ ID NO: 811582 - DNA, 18 bp, Homo sapiens
atccagttcctgctctct

SEQ ID NO: 811583 - DNA, 14 bp, Homo sapiens
atccataaagaagc

SEQ ID NO: 811584 - DNA, 17 bp, Homo sapiens
atccataaagaagcaat

SEQ ID NO: 811585 - DNA, 19 bp, Homo sapiens
atccataaatgtgttcctg

SEQ ID NO: 811586 - DNA, 14 bp, Homo sapiens
atccataactgaac

SEQ ID NO: 811587 - DNA, 15 bp, Homo sapiens
atccataactgaaca

SEQ ID NO: 811588 - DNA, 20 bp, Homo sapiens
atccatagatttattttaca

SEQ ID NO: 811589 - DNA, 23 bp, Homo sapiens
atccatatcttaaagaaacagct

SEQ ID NO: 811590 - DNA, 18 bp, Homo sapiens
atccatattgagtcaaat

SEQ ID NO: 811591 - DNA, 14 bp, Homo sapiens
atccatcatcatgt

SEQ ID NO: 811592 - DNA, 14 bp, Homo sapiens
atccatccctagaa

SEQ ID NO: 811593 - DNA, 19 bp, Homo sapiens
atccatctgaggcttcatg

SEQ ID NO: 811594 - DNA, 23 bp, Homo sapiens
atccatctgtccgtccagagccg

SEQ ID NO: 811595 - DNA, 18 bp, Homo sapiens
atccatctttttcttttt

SEQ ID NO: 811596 - DNA, 20 bp, Homo sapiens
atccatgacctagttttcca

SEQ ID NO: 811597 - DNA, 18 bp, Homo sapiens
atccatgcactttaattg

SEQ ID NO: 811598 - DNA, 18 bp, Homo sapiens
atccatgccctcccagga

SEQ ID NO: 811599 - DNA, 15 bp, Homo sapiens
atccatgcttcactc

SEQ ID NO: 811600 - DNA, 18 bp, Homo sapiens
atccatgtactgtagttt

SEQ ID NO: 811601 - DNA, 22 bp, Homo sapiens
atccatgtactgtagtttttct

SEQ ID NO: 811602 - DNA, 19 bp, Homo sapiens
atccatgtgaccattctgc

SEQ ID NO: 811603 - DNA, 14 bp, Homo sapiens
atcctgagccccgc

SEQ ID NO: 811604 - DNA, 17 bp, Homo sapiens
atcctgattaaatgtct

SEQ ID NO: 811605 - DNA, 17 bp, Homo sapiens
atcctgcaaaggccctt

SEQ ID NO: 811606 - DNA, 19 bp, Homo sapiens
atcctgcaaaggcccttgt

SEQ ID NO: 811607 - DNA, 15 bp, Homo sapiens
atcctgcaaggtgaa

SEQ ID NO: 811608 - DNA, 13 bp, Homo sapiens
atcctgcacccca

SEQ ID NO: 811609 - DNA, 16 bp, Homo sapiens
atcctgcagcctcctc

SEQ ID NO: 811610 - DNA, 22 bp, Homo sapiens
atcctgcaggaacgagcactgg

SEQ ID NO: 811611 - DNA, 13 bp, Homo sapiens
atcctgccattta

SEQ ID NO: 811612 - DNA, 14 bp, Homo sapiens
atcctgcccagtgt

SEQ ID NO: 811613 - DNA, 15 bp, Homo sapiens
atcctgcccagtgtt

SEQ ID NO: 811614 - DNA, 21 bp, Homo sapiens
atcctgcccagtgttgtttgt

SEQ ID NO: 811615 - DNA, 10 bp, Homo sapiens
atcctgcccc

SEQ ID NO: 811616 - DNA, 13 bp, Homo sapiens
atcctgcccccaa

SEQ ID NO: 811617 - DNA, 14 bp, Homo sapiens
atcctgcccctcca

SEQ ID NO: 811618 - DNA, 17 bp, Homo sapiens
atcctgccctgcagcac

SEQ ID NO: 811619 - DNA, 19 bp, Homo sapiens
atcctgccctgcagcacgc

SEQ ID NO: 811620 - DNA, 11 bp, Homo sapiens
atcctgccctt

SEQ ID NO: 811621 - DNA, 13 bp, Homo sapiens
atcctgctaagtt

SEQ ID NO: 811622 - DNA, 18 bp, Homo sapiens
atcctgctagctgtagaa

SEQ ID NO: 811623 - DNA, 13 bp, Homo sapiens
atcctgcttctct

SEQ ID NO: 811624 - DNA, 15 bp, Homo sapiens
atcctgcttctcttt

SEQ ID NO: 811625 - DNA, 20 bp, Homo sapiens
atcctgcttctcttttcctc

SEQ ID NO: 811626 - DNA, 21 bp, Homo sapiens
atcctggaacaatattttatg

SEQ ID NO: 811627 - DNA, 23 bp, Homo sapiens
atcctggaaggacacagtgatga

SEQ ID NO: 811628 - DNA, 14 bp, Homo sapiens
atcctggaggtctt

SEQ ID NO: 811629 - DNA, 11 bp, Homo sapiens
atcctggcagc

SEQ ID NO: 811630 - DNA, 15 bp, Homo sapiens
atcctggcagcccag

SEQ ID NO: 811631 - DNA, 20 bp, Homo sapiens
atcctggcagcccagagact

SEQ ID NO: 811632 - DNA, 20 bp, Homo sapiens
atcctggcccctccagaccc

SEQ ID NO: 811633 - DNA, 22 bp, Homo sapiens
atcctggccctgggggtctggg

SEQ ID NO: 811634 - DNA, 11 bp, Homo sapiens
atcctggcctc

SEQ ID NO: 811635 - DNA, 13 bp, Homo sapiens
atcctggcctcct

SEQ ID NO: 811636 - DNA, 20 bp, Homo sapiens
atcctgggatccagtgtata

SEQ ID NO: 811637 - DNA, 16 bp, Homo sapiens
atcctgggcaatcaga

SEQ ID NO: 811638 - DNA, 18 bp, Homo sapiens
atcctgggcatccttctt

SEQ ID NO: 811639 - DNA, 21 bp, Homo sapiens
atcctgggctgggtggcccct

SEQ ID NO: 811640 - DNA, 20 bp, Homo sapiens
atcctggggcattaaaaaaa

SEQ ID NO: 811641 - DNA, 21 bp, Homo sapiens
atcctgggggacccaatgtag

SEQ ID NO: 811642 - DNA, 20 bp, Homo sapiens
atcctgggggatacgggggt

SEQ ID NO: 811643 - DNA, 21 bp, Homo sapiens
atcctgggggcctgggttggg

SEQ ID NO: 811644 - DNA, 16 bp, Homo sapiens
atcctggtaaccaaat

SEQ ID NO: 811645 - DNA, 17 bp, Homo sapiens
atcctggtaattaaaag

SEQ ID NO: 811646 - DNA, 14 bp, Homo sapiens
atcctggtcttttt

SEQ ID NO: 811647 - DNA, 23 bp, Homo sapiens
atcctggtttcataacttcctgt

SEQ ID NO: 811648 - DNA, 15 bp, Homo sapiens
atcctgtaactacaa

SEQ ID NO: 811649 - DNA, 16 bp, Homo sapiens
atcctgtattcttcaa

SEQ ID NO: 811650 - DNA, 21 bp, Homo sapiens
atcctgtattcttcaaccagt

SEQ ID NO: 811651 - DNA, 15 bp, Homo sapiens
atcctgtattcttgt

SEQ ID NO: 811652 - DNA, 23 bp, Homo sapiens
atcctgtctttaaggaaaaaaag

SEQ ID NO: 811653 - DNA, 15 bp, Homo sapiens
atcctgtgacatgta

SEQ ID NO: 811654 - DNA, 16 bp, Homo sapiens
atcctgtgacatgtaa

SEQ ID NO: 811655 - DNA, 19 bp, Homo sapiens
atcctgtgacccctcccca

SEQ ID NO: 811656 - DNA, 11 bp, Homo sapiens
atcctgtgact

SEQ ID NO: 811657 - DNA, 13 bp, Homo sapiens
atcctgtgggtga

SEQ ID NO: 811658 - DNA, 13 bp, Homo sapiens
atcctgtgtcccc

SEQ ID NO: 811659 - DNA, 15 bp, Homo sapiens
atcctgtgtcccctg

SEQ ID NO: 811660 - DNA, 22 bp, Homo sapiens
atcctgttacttgcttcagtgg

SEQ ID NO: 811661 - DNA, 22 bp, Homo sapiens
atcctgtttataatctgaagat

SEQ ID NO: 811662 - DNA, 14 bp, Homo sapiens
atcctgtttcagct

SEQ ID NO: 811663 - DNA, 19 bp, Homo sapiens
atcctgtttgtatgaaatt

SEQ ID NO: 811664 - DNA, 15 bp, Homo sapiens
atcctgttttctctg

SEQ ID NO: 811665 - DNA, 18 bp, Homo sapiens
atcctgttttctctgtga

SEQ ID NO: 811666 - DNA, 19 bp, Homo sapiens
atccttaaattattgctta

SEQ ID NO: 811667 - DNA, 16 bp, Homo sapiens
atccttaaccaataat

SEQ ID NO: 811668 - DNA, 18 bp, Homo sapiens
atccttagaggtcctctg

SEQ ID NO: 811669 - DNA, 22 bp, Homo sapiens
atccttaggaaaatgcttctgt

SEQ ID NO: 811670 - DNA, 20 bp, Homo sapiens
atccttatcagagctaaggg

SEQ ID NO: 811671 - DNA, 17 bp, Homo sapiens
atccttcacaggcagtg

SEQ ID NO: 811672 - DNA, 20 bp, Homo sapiens
atccttcacaggcagtgcat

SEQ ID NO: 811673 - DNA, 16 bp, Homo sapiens
atccttcccctctttt

SEQ ID NO: 811674 - DNA, 15 bp, Homo sapiens
atccttccctgctct

SEQ ID NO: 811675 - DNA, 21 bp, Homo sapiens
atccttccctttggagatgct

SEQ ID NO: 811676 - DNA, 15 bp, Homo sapiens
atccttcctaaaccc

SEQ ID NO: 811677 - DNA, 16 bp, Homo sapiens
atccttccttcccacc

SEQ ID NO: 811678 - DNA, 12 bp, Homo sapiens
atccttctagtt

SEQ ID NO: 811679 - DNA, 22 bp, Homo sapiens
atccttctagtttcccacaata

SEQ ID NO: 811680 - DNA, 13 bp, Homo sapiens
atccttgaatcct

SEQ ID NO: 811681 - DNA, 14 bp, Homo sapiens
atccttgataatat

SEQ ID NO: 811682 - DNA, 15 bp, Homo sapiens
atccttgcacctcag

SEQ ID NO: 811683 - DNA, 19 bp, Homo sapiens
atccttgcctgtctaaagc

SEQ ID NO: 811684 - DNA, 22 bp, Homo sapiens
atccttggaaaccgtgtgtcca

SEQ ID NO: 811685 - DNA, 14 bp, Homo sapiens
atccttggagagca

SEQ ID NO: 811686 - DNA, 16 bp, Homo sapiens
atccttggagagcagc

SEQ ID NO: 811687 - DNA, 20 bp, Homo sapiens
atccttggagagcagctggc

SEQ ID NO: 811688 - DNA, 21 bp, Homo sapiens
atccttgggccataattatga

SEQ ID NO: 811689 - DNA, 13 bp, Homo sapiens
atccttgtaatac

SEQ ID NO: 811690 - DNA, 20 bp, Homo sapiens
atccttgtgttcagctcttt

SEQ ID NO: 811691 - DNA, 17 bp, Homo sapiens
atcctttacgtgtttaa

SEQ ID NO: 811692 - DNA, 22 bp, Homo sapiens
atcctttcaaaagaagagtttt

SEQ ID NO: 811693 - DNA, 20 bp, Homo sapiens
atcctttcatatagttagct

SEQ ID NO: 811694 - DNA, 23 bp, Homo sapiens
atcctttcattaggcaaagtaca

SEQ ID NO: 811695 - DNA, 22 bp, Homo sapiens
atcctttcctcattaaattacc

SEQ ID NO: 811696 - DNA, 15 bp, Homo sapiens
atcctttcctctagc

SEQ ID NO: 811697 - DNA, 22 bp, Homo sapiens
atcctttcctctagcttttcta

SEQ ID NO: 811698 - DNA, 19 bp, Homo sapiens
atcctttctgccccccagg

SEQ ID NO: 811699 - DNA, 22 bp, Homo sapiens
atcctttctgccccccagggct

SEQ ID NO: 811700 - DNA, 19 bp, Homo sapiens
atcctttgttttctgacta

SEQ ID NO: 811701 - DNA, 19 bp, Homo sapiens
atccttttaaccattttaa

SEQ ID NO: 811702 - DNA, 14 bp, Homo sapiens
atccttttcctaat

SEQ ID NO: 811703 - DNA, 13 bp, Homo sapiens
atccttttgcctg

SEQ ID NO: 811704 - DNA, 17 bp, Homo sapiens
atccttttgttttgaag

SEQ ID NO: 811705 - DNA, 22 bp, Homo sapiens
atcctttttaaattcagtccta

SEQ ID NO: 811706 - DNA, 14 bp, Homo sapiens
atccttttttctct

SEQ ID NO: 811707 - DNA, 22 bp, Homo sapiens
atccttttttctcttctgtcca

SEQ ID NO: 811708 - DNA, 17 bp, Homo sapiens
atcgaatatagttctgt

SEQ ID NO: 811709 - DNA, 18 bp, Homo sapiens
atcgaatctactaattcc

SEQ ID NO: 811710 - DNA, 20 bp, Homo sapiens
atcgaatctactaattccac

SEQ ID NO: 811711 - DNA, 13 bp, Homo sapiens
atcgaatgaaatt

SEQ ID NO: 811712 - DNA, 11 bp, Homo sapiens
atcgagtgtag

SEQ ID NO: 811713 - DNA, 17 bp, Homo sapiens
atcgagttggcaaaatg

SEQ ID NO: 811714 - DNA, 14 bp, Homo sapiens
atcgatgaatgtaa

SEQ ID NO: 811715 - DNA, 15 bp, Homo sapiens
atcgatgaatgtaaa

SEQ ID NO: 811716 - DNA, 13 bp, Homo sapiens
atcgatgcagtgc

SEQ ID NO: 811717 - DNA, 23 bp, Homo sapiens
atcgatgggggatgcttcatgtg

SEQ ID NO: 811718 - DNA, 20 bp, Homo sapiens
atcgcaccactgtgtattta

SEQ ID NO: 811719 - DNA, 18 bp, Homo sapiens
atcgcaccttttatacca

SEQ ID NO: 811720 - DNA, 13 bp, Homo sapiens
atcgcagcttcct

SEQ ID NO: 811721 - DNA, 22 bp, Homo sapiens
atcgcaggagtctctgccaccc

SEQ ID NO: 811722 - DNA, 16 bp, Homo sapiens
atcgcatccgtcctgg

SEQ ID NO: 811723 - DNA, 18 bp, Homo sapiens
atcgcatccgtcctgggc

SEQ ID NO: 811724 - DNA, 20 bp, Homo sapiens
atcgccataggccaaggtgc

SEQ ID NO: 811725 - DNA, 20 bp, Homo sapiens
atctcctataatctgtcaaa

SEQ ID NO: 811726 - DNA, 21 bp, Homo sapiens
atctcctataatctgtcaaaa

SEQ ID NO: 811727 - DNA, 19 bp, Homo sapiens
atctcctccaatgtcctga

SEQ ID NO: 811728 - DNA, 23 bp, Homo sapiens
atctcctcccttaccctcctctg

SEQ ID NO: 811729 - DNA, 14 bp, Homo sapiens
atctcctctgctca

SEQ ID NO: 811730 - DNA, 21 bp, Homo sapiens
atctcctctgctcattaaact

SEQ ID NO: 811731 - DNA, 16 bp, Homo sapiens
atctcctgccttcctc

SEQ ID NO: 811732 - DNA, 20 bp, Homo sapiens
atctcctgccttcctcctgg

SEQ ID NO: 811733 - DNA, 11 bp, Homo sapiens
atctcctgctc

SEQ ID NO: 811734 - DNA, 12 bp, Homo sapiens
atctcctgctga

SEQ ID NO: 811735 - DNA, 19 bp, Homo sapiens
atctcctggtgttctgcag

SEQ ID NO: 811736 - DNA, 14 bp, Homo sapiens
atctcctgtttgtt

SEQ ID NO: 811737 - DNA, 17 bp, Homo sapiens
atctccttacctctgga

SEQ ID NO: 811738 - DNA, 17 bp, Homo sapiens
atctccttttatctggt

SEQ ID NO: 811739 - DNA, 18 bp, Homo sapiens
atctcgagccccctggat

SEQ ID NO: 811740 - DNA, 19 bp, Homo sapiens
atctcggagcatcccggag

SEQ ID NO: 811741 - DNA, 16 bp, Homo sapiens
atctcggctcactgca

SEQ ID NO: 811742 - DNA, 17 bp, Homo sapiens
atctcggctcagcctcc

SEQ ID NO: 811743 - DNA, 13 bp, Homo sapiens
atctctaatatgg

SEQ ID NO: 811744 - DNA, 22 bp, Homo sapiens
atctctaatatggcaaaaatgg

SEQ ID NO: 811745 - DNA, 22 bp, Homo sapiens
atctctaatgagctagtgtctt

SEQ ID NO: 811746 - DNA, 23 bp, Homo sapiens
atctctaatgagctagtgtctta

SEQ ID NO: 811747 - DNA, 15 bp, Homo sapiens
atctctaattggaag

SEQ ID NO: 811748 - DNA, 23 bp, Homo sapiens
atctctaattggaagaaattcct

SEQ ID NO: 811749 - DNA, 20 bp, Homo sapiens
atctctacgactaatcacct

SEQ ID NO: 811750 - DNA, 18 bp, Homo sapiens
atctctactaaaaataca

SEQ ID NO: 811751 - DNA, 19 bp, Homo sapiens
atctctactaccacaagga

SEQ ID NO: 811752 - DNA, 21 bp, Homo sapiens
atctctactaccacaaggaaa

SEQ ID NO: 811753 - DNA, 21 bp, Homo sapiens
atctctagaattttaagtgct

SEQ ID NO: 811754 - DNA, 20 bp, Homo sapiens
atctctagtgtagctgccac

SEQ ID NO: 811755 - DNA, 13 bp, Homo sapiens
atctctatttaat

SEQ ID NO: 811756 - DNA, 15 bp, Homo sapiens
atctctatttaatat

SEQ ID NO: 811757 - DNA, 16 bp, Homo sapiens
atctctatttaatatt

SEQ ID NO: 811758 - DNA, 13 bp, Homo sapiens
atctctcaggagc

SEQ ID NO: 811759 - DNA, 14 bp, Homo sapiens
atctctcaggagca

SEQ ID NO: 811760 - DNA, 17 bp, Homo sapiens
atctctcaggagcacag

SEQ ID NO: 811761 - DNA, 18 bp, Homo sapiens
atctctcaggagcacagg

SEQ ID NO: 811762 - DNA, 23 bp, Homo sapiens
atctctcaggagcacaggcagct

SEQ ID NO: 811763 - DNA, 23 bp, Homo sapiens
atctctcatattcgctagtgttt

SEQ ID NO: 811764 - DNA, 16 bp, Homo sapiens
atctctcatcctccag

SEQ ID NO: 811765 - DNA, 15 bp, Homo sapiens
atctctcccacttcc

SEQ ID NO: 811766 - DNA, 18 bp, Homo sapiens
atctctcccacttcctcc

SEQ ID NO: 811767 - DNA, 22 bp, Homo sapiens
atctctcccacttcctcctacc

SEQ ID NO: 811768 - DNA, 23 bp, Homo sapiens
atctctcccacttcctcctacct

SEQ ID NO: 811769 - DNA, 15 bp, Homo sapiens
atctctccctcccct

SEQ ID NO: 811770 - DNA, 14 bp, Homo sapiens
atctctcctggcct

SEQ ID NO: 811771 - DNA, 22 bp, Homo sapiens
atctctctgaatcctaagggct

SEQ ID NO: 811772 - DNA, 15 bp, Homo sapiens
atctctctgcagctg

SEQ ID NO: 811773 - DNA, 18 bp, Homo sapiens
atctctgaaaattctgga

SEQ ID NO: 811774 - DNA, 19 bp, Homo sapiens
atctctgaaaattctggaa

SEQ ID NO: 811775 - DNA, 20 bp, Homo sapiens
atctctgaaaattctggaag

SEQ ID NO: 811776 - DNA, 20 bp, Homo sapiens
atctctgaagcatgtttcat

SEQ ID NO: 811777 - DNA, 16 bp, Homo sapiens
atctctgaatgcccca

SEQ ID NO: 811778 - DNA, 17 bp, Homo sapiens
atctctgacctctgctg

SEQ ID NO: 811779 - DNA, 21 bp, Homo sapiens
atctctgagtggaggaagccc

SEQ ID NO: 811780 - DNA, 10 bp, Homo sapiens
atctctgccg

SEQ ID NO: 811781 - DNA, 15 bp, Homo sapiens
atctctggaaaaata

SEQ ID NO: 811782 - DNA, 22 bp, Homo sapiens
atctctggaaggggcagccctg

SEQ ID NO: 811783 - DNA, 12 bp, Homo sapiens
atctctggagcc

SEQ ID NO: 811784 - DNA, 15 bp, Homo sapiens
atctctggagccaga

SEQ ID NO: 811785 - DNA, 20 bp, Homo sapiens
atctctggcccagaaagcct

SEQ ID NO: 811786 - DNA, 21 bp, Homo sapiens
atctctggcccagaaagcctc

SEQ ID NO: 811787 - DNA, 18 bp, Homo sapiens
atctctggttttcttgcc

SEQ ID NO: 811788 - DNA, 22 bp, Homo sapiens
atctctggttttcttgccaccc

SEQ ID NO: 811789 - DNA, 21 bp, Homo sapiens
atctctgtcccattccctggg

SEQ ID NO: 811790 - DNA, 16 bp, Homo sapiens
atctctgtctggggct

SEQ ID NO: 811791 - DNA, 13 bp, Homo sapiens
atctctgtgcctt

SEQ ID NO: 811792 - DNA, 15 bp, Homo sapiens
atctctgtgccttcg

SEQ ID NO: 811793 - DNA, 15 bp, Homo sapiens
atctctgtgtgcaca

SEQ ID NO: 811794 - DNA, 20 bp, Homo sapiens
atctctgtgtgttttctttg

SEQ ID NO: 811795 - DNA, 22 bp, Homo sapiens
atctcttaatattgagaatcag

SEQ ID NO: 811796 - DNA, 12 bp, Homo sapiens
atctcttagaag

SEQ ID NO: 811797 - DNA, 15 bp, Homo sapiens
atctcttattctaat

SEQ ID NO: 811798 - DNA, 14 bp, Homo sapiens
atctcttcaggttc

SEQ ID NO: 811799 - DNA, 19 bp, Homo sapiens
atctcttcatgcttgacat

SEQ ID NO: 811800 - DNA, 15 bp, Homo sapiens
atctcttccccagag

SEQ ID NO: 811801 - DNA, 11 bp, Homo sapiens
atctcttcctt

SEQ ID NO: 811802 - DNA, 15 bp, Homo sapiens
atctcttcttataca

SEQ ID NO: 811803 - DNA, 14 bp, Homo sapiens
atctcttcttccct

SEQ ID NO: 811804 - DNA, 13 bp, Homo sapiens
atctcttgaaacc

SEQ ID NO: 811805 - DNA, 15 bp, Homo sapiens
atctcttgagcctgg

SEQ ID NO: 811806 - DNA, 18 bp, Homo sapiens
atctcttgagcctgggag

SEQ ID NO: 811807 - DNA, 19 bp, Homo sapiens
atctcttgggagtcttggg

SEQ ID NO: 811808 - DNA, 14 bp, Homo sapiens
atctctttcccttc

SEQ ID NO: 811809 - DNA, 15 bp, Homo sapiens
atctctttctaaaga

SEQ ID NO: 811810 - DNA, 16 bp, Homo sapiens
atctctttgatctact

SEQ ID NO: 811811 - DNA, 23 bp, Homo sapiens
atctcttttccactccattgtcg

SEQ ID NO: 811812 - DNA, 19 bp, Homo sapiens
atctctttttgctttcgaa

SEQ ID NO: 811813 - DNA, 12 bp, Homo sapiens
atctgaaaatgt

SEQ ID NO: 811814 - DNA, 22 bp, Homo sapiens
atctgaaaatgtatgtgtaagt

SEQ ID NO: 811815 - DNA, 23 bp, Homo sapiens
atctgaaaatgtatgtgtaagta

SEQ ID NO: 811816 - DNA, 14 bp, Homo sapiens
atctgaaagtatat

SEQ ID NO: 811817 - DNA, 18 bp, Homo sapiens
atctgaaattcaaaatgc

SEQ ID NO: 811818 - DNA, 18 bp, Homo sapiens
atctgaacacagtttagt

SEQ ID NO: 811819 - DNA, 13 bp, Homo sapiens
atctgaactctca

SEQ ID NO: 811820 - DNA, 17 bp, Homo sapiens
atctgaagatatatttc

SEQ ID NO: 811821 - DNA, 19 bp, Homo sapiens
atctgaagatatatttcac

SEQ ID NO: 811822 - DNA, 23 bp, Homo sapiens
atctgaaggggcaaattcttttg

SEQ ID NO: 811823 - DNA, 21 bp, Homo sapiens
atctgaataaagtgtaacaat

SEQ ID NO: 811824 - DNA, 18 bp, Homo sapiens
atctgaattaaataaata

SEQ ID NO: 811825 - DNA, 14 bp, Homo sapiens
atctgaatttttaa

SEQ ID NO: 811826 - DNA, 15 bp, Homo sapiens
atctgacaatataca

SEQ ID NO: 811827 - DNA, 21 bp, Homo sapiens
atctgaccctatgggtctagg

SEQ ID NO: 811828 - DNA, 18 bp, Homo sapiens
atctgaccctcccagtct

SEQ ID NO: 811829 - DNA, 21 bp, Homo sapiens
atctgacccttctccaaaggc

SEQ ID NO: 811830 - DNA, 18 bp, Homo sapiens
atctgaccgttctattgt

SEQ ID NO: 811831 - DNA, 20 bp, Homo sapiens
atctgaccttcaccttggat

SEQ ID NO: 811832 - DNA, 16 bp, Homo sapiens
atctgagaatctttat

SEQ ID NO: 811833 - DNA, 21 bp, Homo sapiens
atctgagattgtgtttgttca

SEQ ID NO: 811834 - DNA, 15 bp, Homo sapiens
atctgagcaataact

SEQ ID NO: 811835 - DNA, 15 bp, Homo sapiens
atctgagctcccacc

SEQ ID NO: 811836 - DNA, 21 bp, Homo sapiens
atctgagggaaatgttttgta

SEQ ID NO: 811837 - DNA, 20 bp, Homo sapiens
atctgagggaggaggccacc

SEQ ID NO: 811838 - DNA, 21 bp, Homo sapiens
atctgagggaggaggccacct

SEQ ID NO: 811839 - DNA, 16 bp, Homo sapiens
atctgaggttggattt

SEQ ID NO: 811840 - DNA, 19 bp, Homo sapiens
atctgagtaggtctgggat

SEQ ID NO: 811841 - DNA, 16 bp, Homo sapiens
atctgagtccagctcc

SEQ ID NO: 811842 - DNA, 21 bp, Homo sapiens
atctgagtccagctcccccca

SEQ ID NO: 811843 - DNA, 13 bp, Homo sapiens
atctgagtcctgg

SEQ ID NO: 811844 - DNA, 14 bp, Homo sapiens
atctgagtcctgga

SEQ ID NO: 811845 - DNA, 17 bp, Homo sapiens
atctgagtcctggatga

SEQ ID NO: 811846 - DNA, 16 bp, Homo sapiens
atcttcagaactgccc

SEQ ID NO: 811847 - DNA, 19 bp, Homo sapiens
atcttcagcatagaaggaa

SEQ ID NO: 811848 - DNA, 14 bp, Homo sapiens
atcttcagcccagg

SEQ ID NO: 811849 - DNA, 15 bp, Homo sapiens
atcttcagcccaggc

SEQ ID NO: 811850 - DNA, 18 bp, Homo sapiens
atcttcaggtgaacactt

SEQ ID NO: 811851 - DNA, 20 bp, Homo sapiens
atcttcagttttatctttaa

SEQ ID NO: 811852 - DNA, 15 bp, Homo sapiens
atcttcattaccaat

SEQ ID NO: 811853 - DNA, 14 bp, Homo sapiens
atcttcccacagga

SEQ ID NO: 811854 - DNA, 23 bp, Homo sapiens
atcttcccagcagggccactccc

SEQ ID NO: 811855 - DNA, 17 bp, Homo sapiens
atcttccccaagggcca

SEQ ID NO: 811856 - DNA, 23 bp, Homo sapiens
atcttcctaataaggtgtggtct

SEQ ID NO: 811857 - DNA, 13 bp, Homo sapiens
atcttcctgctgc

SEQ ID NO: 811858 - DNA, 12 bp, Homo sapiens
atcttcctttct

SEQ ID NO: 811859 - DNA, 23 bp, Homo sapiens
atcttcctttggggaagtttatt

SEQ ID NO: 811860 - DNA, 18 bp, Homo sapiens
atcttcgatgaacctgac

SEQ ID NO: 811861 - DNA, 21 bp, Homo sapiens
atcttcgttagtaatctgtat

SEQ ID NO: 811862 - DNA, 21 bp, Homo sapiens
atcttctaaacccaatccaaa

SEQ ID NO: 811863 - DNA, 19 bp, Homo sapiens
atcttctccatctggcagg

SEQ ID NO: 811864 - DNA, 21 bp, Homo sapiens
atcttctcccttgtcctgctt

SEQ ID NO: 811865 - DNA, 19 bp, Homo sapiens
atcttctggactatagctg

SEQ ID NO: 811866 - DNA, 18 bp, Homo sapiens
atcttctggagtctccag

SEQ ID NO: 811867 - DNA, 12 bp, Homo sapiens
atcttctggctt

SEQ ID NO: 811868 - DNA, 20 bp, Homo sapiens
atcttctgggtagtcccctg

SEQ ID NO: 811869 - DNA, 19 bp, Homo sapiens
atcttctgtgaaatataat

SEQ ID NO: 811870 - DNA, 21 bp, Homo sapiens
atcttcttaaaccaggaaaaa

SEQ ID NO: 811871 - DNA, 17 bp, Homo sapiens
atcttcttatgcaattt

SEQ ID NO: 811872 - DNA, 20 bp, Homo sapiens
atcttcttatgcaatttcct

SEQ ID NO: 811873 - DNA, 23 bp, Homo sapiens
atcttcttcatccaacttccaag

SEQ ID NO: 811874 - DNA, 18 bp, Homo sapiens
atcttgaaacttgtgaaa

SEQ ID NO: 811875 - DNA, 12 bp, Homo sapiens
atcttgaaatta

SEQ ID NO: 811876 - DNA, 11 bp, Homo sapiens
atcttgaagtc

SEQ ID NO: 811877 - DNA, 21 bp, Homo sapiens
atcttgaagtcagccacactg

SEQ ID NO: 811878 - DNA, 21 bp, Homo sapiens
atcttgaatactctgccctct

SEQ ID NO: 811879 - DNA, 16 bp, Homo sapiens
atcttgaattgtaact

SEQ ID NO: 811880 - DNA, 16 bp, Homo sapiens
atcttgactcactgca

SEQ ID NO: 811881 - DNA, 15 bp, Homo sapiens
atcttgactttctga

SEQ ID NO: 811882 - DNA, 23 bp, Homo sapiens
atcttgactttctgattggtgat

SEQ ID NO: 811883 - DNA, 23 bp, Homo sapiens
atcttgagccacagtcactggat

SEQ ID NO: 811884 - DNA, 15 bp, Homo sapiens
atcttgatacattca

SEQ ID NO: 811885 - DNA, 16 bp, Homo sapiens
atcttgatacattcaa

SEQ ID NO: 811886 - DNA, 21 bp, Homo sapiens
atcttgatacattcaaatttg

SEQ ID NO: 811887 - DNA, 21 bp, Homo sapiens
atcttgataccacctatatag

SEQ ID NO: 811888 - DNA, 14 bp, Homo sapiens
atcttgatggtgtt

SEQ ID NO: 811889 - DNA, 19 bp, Homo sapiens
atcttgccagcctcaggct

SEQ ID NO: 811890 - DNA, 12 bp, Homo sapiens
atcttgcccact

SEQ ID NO: 811891 - DNA, 21 bp, Homo sapiens
atcttgcctaaatcccaagaa

SEQ ID NO: 811892 - DNA, 19 bp, Homo sapiens
atcttgcctacttttcttt

SEQ ID NO: 811893 - DNA, 23 bp, Homo sapiens
atcttgcgaatccaagctccctg

SEQ ID NO: 811894 - DNA, 12 bp, Homo sapiens
atcttgctggct

SEQ ID NO: 811895 - DNA, 14 bp, Homo sapiens
atcttgctttcttt

SEQ ID NO: 811896 - DNA, 23 bp, Homo sapiens
atcttgctttttttcaccaatat

SEQ ID NO: 811897 - DNA, 22 bp, Homo sapiens
atcttggacaaatcacatattt

SEQ ID NO: 811898 - DNA, 13 bp, Homo sapiens
atcttggctatgt

SEQ ID NO: 811899 - DNA, 17 bp, Homo sapiens
atcttggctcagtttgt

SEQ ID NO: 811900 - DNA, 23 bp, Homo sapiens
atcttggcttcttaaaaactgtg

SEQ ID NO: 811901 - DNA, 23 bp, Homo sapiens
atcttggggacatctctttgaat

SEQ ID NO: 811902 - DNA, 20 bp, Homo sapiens
atcttgggtgtattctctgt

SEQ ID NO: 811903 - DNA, 22 bp, Homo sapiens
atcttgggtgtattctctgtaa

SEQ ID NO: 811904 - DNA, 18 bp, Homo sapiens
atcttggtagttctgtgc

SEQ ID NO: 811905 - DNA, 23 bp, Homo sapiens
atcttggtagttctgtgcctccc

SEQ ID NO: 811906 - DNA, 16 bp, Homo sapiens
atcttgtatacacata

SEQ ID NO: 811907 - DNA, 13 bp, Homo sapiens
atcttgtcctgga

SEQ ID NO: 811908 - DNA, 15 bp, Homo sapiens
atcttgtctctgggc

SEQ ID NO: 811909 - DNA, 18 bp, Homo sapiens
atcttgtgagtggataat

SEQ ID NO: 811910 - DNA, 18 bp, Homo sapiens
atcttgtgctagaatact

SEQ ID NO: 811911 - DNA, 20 bp, Homo sapiens
atcttgtgctagaatacttt

SEQ ID NO: 811912 - DNA, 17 bp, Homo sapiens
atcttgtggggccagga

SEQ ID NO: 811913 - DNA, 22 bp, Homo sapiens
atcttgttaatgtcattgctaa

SEQ ID NO: 811914 - DNA, 14 bp, Homo sapiens
atcttgttactgct

SEQ ID NO: 811915 - DNA, 16 bp, Homo sapiens
atcttgttactgctga

SEQ ID NO: 811916 - DNA, 20 bp, Homo sapiens
atcttgttactgctgattct

SEQ ID NO: 811917 - DNA, 15 bp, Homo sapiens
atcttgttactgtga

SEQ ID NO: 811918 - DNA, 15 bp, Homo sapiens
atcttgttcttcccc

SEQ ID NO: 811919 - DNA, 18 bp, Homo sapiens
atcttgttggtacctttc

SEQ ID NO: 811920 - DNA, 15 bp, Homo sapiens
atcttgtttacaata

SEQ ID NO: 811921 - DNA, 20 bp, Homo sapiens
atcttgttttgtttgcttcc

SEQ ID NO: 811922 - DNA, 18 bp, Homo sapiens
atctttaaactggctggc

SEQ ID NO: 811923 - DNA, 17 bp, Homo sapiens
atctttaacaattgtct

SEQ ID NO: 811924 - DNA, 17 bp, Homo sapiens
atctttacaaaactaca

SEQ ID NO: 811925 - DNA, 22 bp, Homo sapiens
atctttacgtactgtaactgct

SEQ ID NO: 811926 - DNA, 23 bp, Homo sapiens
atctttacgtactgtaactgctc

SEQ ID NO: 811927 - DNA, 20 bp, Homo sapiens
atctttatactgggtttcaa

SEQ ID NO: 811928 - DNA, 13 bp, Homo sapiens
atctttatgctgt

SEQ ID NO: 811929 - DNA, 14 bp, Homo sapiens
atctttatgctgta

SEQ ID NO: 811930 - DNA, 18 bp, Homo sapiens
atctttatgctgtatttt

SEQ ID NO: 811931 - DNA, 12 bp, Homo sapiens
atctttattaaa

SEQ ID NO: 811932 - DNA, 15 bp, Homo sapiens
atctttattaaaaca

SEQ ID NO: 811933 - DNA, 19 bp, Homo sapiens
atctttattaaaacaaaag

SEQ ID NO: 811934 - DNA, 14 bp, Homo sapiens
atctttattaatca

SEQ ID NO: 811935 - DNA, 16 bp, Homo sapiens
atctttattgaaattc

SEQ ID NO: 811936 - DNA, 18 bp, Homo sapiens
atctttattgagaaagag

SEQ ID NO: 811937 - DNA, 13 bp, Homo sapiens
atctttcaccttt

SEQ ID NO: 811938 - DNA, 15 bp, Homo sapiens
atctttcacctttct

SEQ ID NO: 811939 - DNA, 14 bp, Homo sapiens
atctttcacttgaa

SEQ ID NO: 811940 - DNA, 15 bp, Homo sapiens
atctttcacttgaaa

SEQ ID NO: 811941 - DNA, 13 bp, Homo sapiens
atctttcctcaag

SEQ ID NO: 811942 - DNA, 20 bp, Homo sapiens
atctttcctcaagtatcttc

SEQ ID NO: 811943 - DNA, 23 bp, Homo sapiens
atctttcctcaagtatcttctat

SEQ ID NO: 811944 - DNA, 12 bp, Homo sapiens
atctttcctgtc

SEQ ID NO: 811945 - DNA, 18 bp, Homo sapiens
atctttctatataaaatg

SEQ ID NO: 811946 - DNA, 23 bp, Homo sapiens
atctttctccctcaactgaaggg

SEQ ID NO: 811947 - DNA, 12 bp, Homo sapiens
atctttctcttc

SEQ ID NO: 811948 - DNA, 13 bp, Homo sapiens
atctttctcttcc

SEQ ID NO: 811949 - DNA, 14 bp, Homo sapiens
atctttctgggagc

SEQ ID NO: 811950 - DNA, 14 bp, Homo sapiens
atctttctgttact

SEQ ID NO: 811951 - DNA, 22 bp, Homo sapiens
atctttcttctattttattccc

SEQ ID NO: 811952 - DNA, 14 bp, Homo sapiens
atctttctttacct

SEQ ID NO: 811953 - DNA, 20 bp, Homo sapiens
atctttctttacctgagacc

SEQ ID NO: 811954 - DNA, 21 bp, Homo sapiens
atctttctttccatttacagt

SEQ ID NO: 811955 - DNA, 12 bp, Homo sapiens
atctttctttct

SEQ ID NO: 811956 - DNA, 22 bp, Homo sapiens
atctttgaaaggttagagaata

SEQ ID NO: 811957 - DNA, 17 bp, Homo sapiens
atctttgacaattctgg

SEQ ID NO: 811958 - DNA, 15 bp, Homo sapiens
atctttgacctcaat

SEQ ID NO: 811959 - DNA, 14 bp, Homo sapiens
atctttgcgaaaag

SEQ ID NO: 811960 - DNA, 14 bp, Homo sapiens
atctttgtataaat

SEQ ID NO: 811961 - DNA, 23 bp, Homo sapiens
atctttgtataaataaatatttt

SEQ ID NO: 811962 - DNA, 14 bp, Homo sapiens
atctttgtgacagg

SEQ ID NO: 811963 - DNA, 13 bp, Homo sapiens
atctttgtggcca

SEQ ID NO: 811964 - DNA, 21 bp, Homo sapiens
atctttgttaaggtcctgaaa

SEQ ID NO: 811965 - DNA, 17 bp, Homo sapiens
atcttttaaaatcatga

SEQ ID NO: 811966 - DNA, 20 bp, Homo sapiens
atcttttaaagtgttacttt

SEQ ID NO: 811967 - DNA, 15 bp, Homo sapiens
atcttttacattttt

SEQ ID NO: 811968 - DNA, 21 bp, Homo sapiens
atgagaacaagtcacagctgc

SEQ ID NO: 811969 - DNA, 23 bp, Homo sapiens
atgagaacaagtcacagctgcag

SEQ ID NO: 811970 - DNA, 16 bp, Homo sapiens
atgagaagagggcctg

SEQ ID NO: 811971 - DNA, 22 bp, Homo sapiens
atgagaaggttggcgtgccctg

SEQ ID NO: 811972 - DNA, 12 bp, Homo sapiens
atgagaatgtga

SEQ ID NO: 811973 - DNA, 14 bp, Homo sapiens
atgagaatgtgacc

SEQ ID NO: 811974 - DNA, 21 bp, Homo sapiens
atgagaatttgagtgctctga

SEQ ID NO: 811975 - DNA, 20 bp, Homo sapiens
atgagacagggtcttgctct

SEQ ID NO: 811976 - DNA, 21 bp, Homo sapiens
atgagacagggtcttgctctg

SEQ ID NO: 811977 - DNA, 23 bp, Homo sapiens
atgagactgatccctggccactg

SEQ ID NO: 811978 - DNA, 16 bp, Homo sapiens
atgagagcataattta

SEQ ID NO: 811979 - DNA, 20 bp, Homo sapiens
atgagagcataatttaaaaa

SEQ ID NO: 811980 - DNA, 15 bp, Homo sapiens
atgagagcgacacag

SEQ ID NO: 811981 - DNA, 18 bp, Homo sapiens
atgagagggcagtgtttc

SEQ ID NO: 811982 - DNA, 17 bp, Homo sapiens
atgagaggttgaggaaa

SEQ ID NO: 811983 - DNA, 14 bp, Homo sapiens
atgagatacactga

SEQ ID NO: 811984 - DNA, 16 bp, Homo sapiens
atgagatctaatgtga

SEQ ID NO: 811985 - DNA, 20 bp, Homo sapiens
atgagatctaatgtgaaaat

SEQ ID NO: 811986 - DNA, 13 bp, Homo sapiens
atgagatggttaa

SEQ ID NO: 811987 - DNA, 20 bp, Homo sapiens
atgagatttgccagcacagg

SEQ ID NO: 811988 - DNA, 21 bp, Homo sapiens
atgagcacatctctctgccct

SEQ ID NO: 811989 - DNA, 18 bp, Homo sapiens
atgagcagagggaggaag

SEQ ID NO: 811990 - DNA, 16 bp, Homo sapiens
atgagcatcctgagcc

SEQ ID NO: 811991 - DNA, 18 bp, Homo sapiens
atgagcatcctgagcccc

SEQ ID NO: 811992 - DNA, 17 bp, Homo sapiens
atgagcatttagcacaa

SEQ ID NO: 811993 - DNA, 23 bp, Homo sapiens
atgagcatttgtttgaccccagt

SEQ ID NO: 811994 - DNA, 13 bp, Homo sapiens
atgagccaaaatg

SEQ ID NO: 811995 - DNA, 18 bp, Homo sapiens
atgagccaccgcgcccag

SEQ ID NO: 811996 - DNA, 23 bp, Homo sapiens
atgagccaccgcgcctggcctct

SEQ ID NO: 811997 - DNA, 18 bp, Homo sapiens
atgagccactgcacctga

SEQ ID NO: 811998 - DNA, 11 bp, Homo sapiens
atgagccagac

SEQ ID NO: 811999 - DNA, 14 bp, Homo sapiens
atgagccagacaaa

SEQ ID NO: 812000 - DNA, 19 bp, Homo sapiens
atgagccatcactagaaga

SEQ ID NO: 812001 - DNA, 22 bp, Homo sapiens
atgagccatcactagaagaaaa

SEQ ID NO: 812002 - DNA, 11 bp, Homo sapiens
atgagcccaga

SEQ ID NO: 812003 - DNA, 18 bp, Homo sapiens
atgagcccagagaacagc

SEQ ID NO: 812004 - DNA, 16 bp, Homo sapiens
atgagccccttcatcc

SEQ ID NO: 812005 - DNA, 14 bp, Homo sapiens
atgagccctaaaaa

SEQ ID NO: 812006 - DNA, 12 bp, Homo sapiens
atgagccctggc

SEQ ID NO: 812007 - DNA, 14 bp, Homo sapiens
atgagccctggctc

SEQ ID NO: 812008 - DNA, 20 bp, Homo sapiens
atgagccgctgtgagcccct

SEQ ID NO: 812009 - DNA, 16 bp, Homo sapiens
atgagcctacgctgaa

SEQ ID NO: 812010 - DNA, 18 bp, Homo sapiens
atgagcctgcccgctgca

SEQ ID NO: 812011 - DNA, 14 bp, Homo sapiens
atgagcctgctgga

SEQ ID NO: 812012 - DNA, 14 bp, Homo sapiens
atgagcctggcaag

SEQ ID NO: 812013 - DNA, 20 bp, Homo sapiens
atgagcgtcactgcccacca

SEQ ID NO: 812014 - DNA, 23 bp, Homo sapiens
atgagcgtcactgcccaccaaag

SEQ ID NO: 812015 - DNA, 20 bp, Homo sapiens
atgagctacaacaaaaggac

SEQ ID NO: 812016 - DNA, 20 bp, Homo sapiens
atgagctatttccattccag

SEQ ID NO: 812017 - DNA, 21 bp, Homo sapiens
atgagctatttccattccaga

SEQ ID NO: 812018 - DNA, 22 bp, Homo sapiens
atgagctatttccattccagaa

SEQ ID NO: 812019 - DNA, 22 bp, Homo sapiens
atgagctcgcatttgtcaatga

SEQ ID NO: 812020 - DNA, 21 bp, Homo sapiens
atgagctcggggtccaccagt

SEQ ID NO: 812021 - DNA, 16 bp, Homo sapiens
atgagctctgaacaaa

SEQ ID NO: 812022 - DNA, 19 bp, Homo sapiens
atgagctctgaacaaacac

SEQ ID NO: 812023 - DNA, 17 bp, Homo sapiens
atgagctgccagaatca

SEQ ID NO: 812024 - DNA, 13 bp, Homo sapiens
atgagctggaagg

SEQ ID NO: 812025 - DNA, 19 bp, Homo sapiens
atgagctgtgcgctgctct

SEQ ID NO: 812026 - DNA, 17 bp, Homo sapiens
atgagcttagggtgttt

SEQ ID NO: 812027 - DNA, 22 bp, Homo sapiens
atgagcttcaatataagaagca

SEQ ID NO: 812028 - DNA, 15 bp, Homo sapiens
atgaggaagcaaaga

SEQ ID NO: 812029 - DNA, 14 bp, Homo sapiens
atgaggaatccaaa

SEQ ID NO: 812030 - DNA, 17 bp, Homo sapiens
atgaggaatccaaaaga

SEQ ID NO: 812031 - DNA, 21 bp, Homo sapiens
atgaggaatccaaaagacaaa

SEQ ID NO: 812032 - DNA, 15 bp, Homo sapiens
atgaggaatgtatat

SEQ ID NO: 812033 - DNA, 15 bp, Homo sapiens
atgaggacagagtgg

SEQ ID NO: 812034 - DNA, 19 bp, Homo sapiens
atgaggactctattcttta

SEQ ID NO: 812035 - DNA, 18 bp, Homo sapiens
atgaggagagaaaatata

SEQ ID NO: 812036 - DNA, 19 bp, Homo sapiens
atgaggagagaaaatatat

SEQ ID NO: 812037 - DNA, 21 bp, Homo sapiens
atgaggaggatgtccctgggc

SEQ ID NO: 812038 - DNA, 24 bp, Homo sapiens
atgaggaggatgtccctgggccag

SEQ ID NO: 812039 - DNA, 14 bp, Homo sapiens
atgaggaggggagg

SEQ ID NO: 812040 - DNA, 15 bp, Homo sapiens
atgaggcaaaaatgt

SEQ ID NO: 812041 - DNA, 18 bp, Homo sapiens
atgaggcaatgtcaggaa

SEQ ID NO: 812042 - DNA, 23 bp, Homo sapiens
atgaggccactgctgcttctcca

SEQ ID NO: 812043 - DNA, 17 bp, Homo sapiens
atgaggccagaccatgg

SEQ ID NO: 812044 - DNA, 22 bp, Homo sapiens
atgaggccatctcaggagatgg

SEQ ID NO: 812045 - DNA, 15 bp, Homo sapiens
atgaggccgctagag

SEQ ID NO: 812046 - DNA, 23 bp, Homo sapiens
atgagggaaatctgtaaagccag

SEQ ID NO: 812047 - DNA, 13 bp, Homo sapiens
atgagggactgga

SEQ ID NO: 812048 - DNA, 22 bp, Homo sapiens
atgagggagggggcgctcagga

SEQ ID NO: 812049 - DNA, 17 bp, Homo sapiens
atgagggatgggcctgg

SEQ ID NO: 812050 - DNA, 23 bp, Homo sapiens
atgaggggccaccccgtgcccct

SEQ ID NO: 812051 - DNA, 16 bp, Homo sapiens
atgaggggccactgac

SEQ ID NO: 812052 - DNA, 23 bp, Homo sapiens
atgaggggccactgacccacctg

SEQ ID NO: 812053 - DNA, 13 bp, Homo sapiens
atgaggtaattct

SEQ ID NO: 812054 - DNA, 16 bp, Homo sapiens
atgaggtatcttcttt

SEQ ID NO: 812055 - DNA, 16 bp, Homo sapiens
atgaggtcccaggcag

SEQ ID NO: 812056 - DNA, 18 bp, Homo sapiens
atgaggtcccaggcagag

SEQ ID NO: 812057 - DNA, 19 bp, Homo sapiens
atgaggtcccaggcagaga

SEQ ID NO: 812058 - DNA, 17 bp, Homo sapiens
atgaggtcctcaggtca

SEQ ID NO: 812059 - DNA, 21 bp, Homo sapiens
atgaggtcctcaggtcagctg

SEQ ID NO: 812060 - DNA, 17 bp, Homo sapiens
atgaggtctgaaatgga

SEQ ID NO: 812061 - DNA, 13 bp, Homo sapiens
atgaggtctttaa

SEQ ID NO: 812062 - DNA, 22 bp, Homo sapiens
atgaggttcaactgttgattgc

SEQ ID NO: 812063 - DNA, 17 bp, Homo sapiens
atgagtaaaaactagaa

SEQ ID NO: 812064 - DNA, 19 bp, Homo sapiens
atgagtaaaaactagaagg

SEQ ID NO: 812065 - DNA, 18 bp, Homo sapiens
atgagtaaactgaggccc

SEQ ID NO: 812066 - DNA, 16 bp, Homo sapiens
atgagtatgaacttga

SEQ ID NO: 812067 - DNA, 17 bp, Homo sapiens
atgagtatttggtccaa

SEQ ID NO: 812068 - DNA, 17 bp, Homo sapiens
atgagtcaatcagcctt

SEQ ID NO: 812069 - DNA, 16 bp, Homo sapiens
atgagtcaatgtgcag

SEQ ID NO: 812070 - DNA, 22 bp, Homo sapiens
atgagtcagtgaagtctagaat

SEQ ID NO: 812071 - DNA, 16 bp, Homo sapiens
atgagtcatttgttta

SEQ ID NO: 812072 - DNA, 21 bp, Homo sapiens
atgagtcatttgtttaaacaa

SEQ ID NO: 812073 - DNA, 22 bp, Homo sapiens
atgagtcatttgtttaaacaat

SEQ ID NO: 812074 - DNA, 16 bp, Homo sapiens
atgagtccttgaaaat

SEQ ID NO: 812075 - DNA, 14 bp, Homo sapiens
atgagtctgtagga

SEQ ID NO: 812076 - DNA, 22 bp, Homo sapiens
atgagtcttctgtaattcattg

SEQ ID NO: 812077 - DNA, 19 bp, Homo sapiens
atgagtgcaggtttctatt

SEQ ID NO: 812078 - DNA, 12 bp, Homo sapiens
atgagtgggaat

SEQ ID NO: 812079 - DNA, 13 bp, Homo sapiens
atgagtgggaatc

SEQ ID NO: 812080 - DNA, 12 bp, Homo sapiens
atgagtgtgcat

SEQ ID NO: 812081 - DNA, 22 bp, Homo sapiens
atgagttattatctatggaaat

SEQ ID NO: 812082 - DNA, 18 bp, Homo sapiens
atgagttccagaaagtaa

SEQ ID NO: 812083 - DNA, 14 bp, Homo sapiens
atgagttgcagttt

SEQ ID NO: 812084 - DNA, 23 bp, Homo sapiens
atgagttgcagtttttataatag

SEQ ID NO: 812085 - DNA, 17 bp, Homo sapiens
atgagttgcatttgtaa

SEQ ID NO: 812086 - DNA, 21 bp, Homo sapiens
atgagttgcatttgtaaaaat

SEQ ID NO: 812087 - DNA, 22 bp, Homo sapiens
atgagttgttttcagactcaga

SEQ ID NO: 812088 - DNA, 19 bp, Homo sapiens
atgagtttctggggaaaaa

SEQ ID NO: 812089 - DNA, 10 bp, Homo sapiens
atgcaggtgg

SEQ ID NO: 812090 - DNA, 20 bp, Homo sapiens
atgcagtacaggacatatat

SEQ ID NO: 812091 - DNA, 23 bp, Homo sapiens
atgcagtcacttattgtccaggt

SEQ ID NO: 812092 - DNA, 23 bp, Homo sapiens
atgcagtgtagattttatagtgt

SEQ ID NO: 812093 - DNA, 17 bp, Homo sapiens
atgcagttcattatttt

SEQ ID NO: 812094 - DNA, 19 bp, Homo sapiens
atgcagttgataagaggaa

SEQ ID NO: 812095 - DNA, 15 bp, Homo sapiens
atgcagttttcctta

SEQ ID NO: 812096 - DNA, 18 bp, Homo sapiens
atgcataaaaaaatgatg

SEQ ID NO: 812097 - DNA, 18 bp, Homo sapiens
atgcatacagttttctag

SEQ ID NO: 812098 - DNA, 23 bp, Homo sapiens
atgcatactaatttttgcttaac

SEQ ID NO: 812099 - DNA, 23 bp, Homo sapiens
atgcatagtcccagctacccagg

SEQ ID NO: 812100 - DNA, 21 bp, Homo sapiens
atgcatataatgaataaatca

SEQ ID NO: 812101 - DNA, 22 bp, Homo sapiens
atgcatatcattaaacaaataa

SEQ ID NO: 812102 - DNA, 21 bp, Homo sapiens
atgcatatttgcaaagtgtat

SEQ ID NO: 812103 - DNA, 16 bp, Homo sapiens
atgcatatttgtttat

SEQ ID NO: 812104 - DNA, 19 bp, Homo sapiens
atgcatcacactcaaggac

SEQ ID NO: 812105 - DNA, 23 bp, Homo sapiens
atgcatcacactcaaggacagga

SEQ ID NO: 812106 - DNA, 12 bp, Homo sapiens
atgcatcactgg

SEQ ID NO: 812107 - DNA, 17 bp, Homo sapiens
atgcatccattcctcag

SEQ ID NO: 812108 - DNA, 17 bp, Homo sapiens
atgcatcgggaaagaag

SEQ ID NO: 812109 - DNA, 14 bp, Homo sapiens
atgcatctagatta

SEQ ID NO: 812110 - DNA, 20 bp, Homo sapiens
atgcatctggctcaccgggt

SEQ ID NO: 812111 - DNA, 16 bp, Homo sapiens
atgcatcttactgaag

SEQ ID NO: 812112 - DNA, 13 bp, Homo sapiens
atgcatgaacaag

SEQ ID NO: 812113 - DNA, 23 bp, Homo sapiens
atgcatgaagtaatatgcacaca

SEQ ID NO: 812114 - DNA, 21 bp, Homo sapiens
atgcatgatgccctcccctca

SEQ ID NO: 812115 - DNA, 14 bp, Homo sapiens
atgcatgccaggct

SEQ ID NO: 812116 - DNA, 18 bp, Homo sapiens
atgcatgcgcaggctcat

SEQ ID NO: 812117 - DNA, 23 bp, Homo sapiens
atgcatggagggctgccctgtac

SEQ ID NO: 812118 - DNA, 14 bp, Homo sapiens
atgcatgtaaggtc

SEQ ID NO: 812119 - DNA, 16 bp, Homo sapiens
atgcatgtcctgtaaa

SEQ ID NO: 812120 - DNA, 17 bp, Homo sapiens
atgcatgtcctgtaaag

SEQ ID NO: 812121 - DNA, 11 bp, Homo sapiens
atgcatgtctt

SEQ ID NO: 812122 - DNA, 14 bp, Homo sapiens
atgcatgtgaagaa

SEQ ID NO: 812123 - DNA, 17 bp, Homo sapiens
atgcattaaaagaaaat

SEQ ID NO: 812124 - DNA, 14 bp, Homo sapiens
atgcattaaacctg

SEQ ID NO: 812125 - DNA, 13 bp, Homo sapiens
atgcattagggaa

SEQ ID NO: 812126 - DNA, 18 bp, Homo sapiens
atgcattatatcaaatct

SEQ ID NO: 812127 - DNA, 17 bp, Homo sapiens
atgcattcaaaatataa

SEQ ID NO: 812128 - DNA, 19 bp, Homo sapiens
atgcattcttctctgttgt

SEQ ID NO: 812129 - DNA, 13 bp, Homo sapiens
atgcatttaataa

SEQ ID NO: 812130 - DNA, 14 bp, Homo sapiens
atgcatttaataaa

SEQ ID NO: 812131 - DNA, 18 bp, Homo sapiens
atgcatttcattcaaatc

SEQ ID NO: 812132 - DNA, 10 bp, Homo sapiens
atgcatttga

SEQ ID NO: 812133 - DNA, 18 bp, Homo sapiens
atgcatttgaaaattttg

SEQ ID NO: 812134 - DNA, 23 bp, Homo sapiens
atgcatttgaggtcaagtaagaa

SEQ ID NO: 812135 - DNA, 21 bp, Homo sapiens
atgcatttggaaccaaagtct

SEQ ID NO: 812136 - DNA, 18 bp, Homo sapiens
atgcattttcttcagaat

SEQ ID NO: 812137 - DNA, 18 bp, Homo sapiens
atgcattttgcagcagtg

SEQ ID NO: 812138 - DNA, 19 bp, Homo sapiens
atgcattttgcagcagtga

SEQ ID NO: 812139 - DNA, 19 bp, Homo sapiens
atgccaaacactagctctg

SEQ ID NO: 812140 - DNA, 20 bp, Homo sapiens
atgccaaagatcacttgttg

SEQ ID NO: 812141 - DNA, 22 bp, Homo sapiens
atgccaaagatgtttgaaaatg

SEQ ID NO: 812142 - DNA, 20 bp, Homo sapiens
atgccaaattgtagttcttg

SEQ ID NO: 812143 - DNA, 18 bp, Homo sapiens
atgccaacaccttcttgg

SEQ ID NO: 812144 - DNA, 19 bp, Homo sapiens
atgccaagggggtgactgg

SEQ ID NO: 812145 - DNA, 22 bp, Homo sapiens
atgccaagtggacttggagctg

SEQ ID NO: 812146 - DNA, 16 bp, Homo sapiens
atgccaattattgtta

SEQ ID NO: 812147 - DNA, 15 bp, Homo sapiens
atgccacacagagtg

SEQ ID NO: 812148 - DNA, 15 bp, Homo sapiens
atgccacacctggcc

SEQ ID NO: 812149 - DNA, 12 bp, Homo sapiens
atgccacattca

SEQ ID NO: 812150 - DNA, 20 bp, Homo sapiens
atgccaccaacttacaaaaa

SEQ ID NO: 812151 - DNA, 13 bp, Homo sapiens
atgccaccctcac

SEQ ID NO: 812152 - DNA, 16 bp, Homo sapiens
atgccactcctccctc

SEQ ID NO: 812153 - DNA, 17 bp, Homo sapiens
atgccactcctccctcc

SEQ ID NO: 812154 - DNA, 17 bp, Homo sapiens
atgccactgccaggcac

SEQ ID NO: 812155 - DNA, 22 bp, Homo sapiens
atgccactgccaggcacctggc

SEQ ID NO: 812156 - DNA, 23 bp, Homo sapiens
atgccactgccaggcacctggcc

SEQ ID NO: 812157 - DNA, 17 bp, Homo sapiens
atgccactgccttcgct

SEQ ID NO: 812158 - DNA, 18 bp, Homo sapiens
atgccactgccttcgctt

SEQ ID NO: 812159 - DNA, 11 bp, Homo sapiens
atgccagaggg

SEQ ID NO: 812160 - DNA, 13 bp, Homo sapiens
atgccagagggcc

SEQ ID NO: 812161 - DNA, 15 bp, Homo sapiens
atgccagagggccag

SEQ ID NO: 812162 - DNA, 17 bp, Homo sapiens
atgccagagggccagca

SEQ ID NO: 812163 - DNA, 19 bp, Homo sapiens
atgccagagggccagcagg

SEQ ID NO: 812164 - DNA, 20 bp, Homo sapiens
atgccagagggccagcaggc

SEQ ID NO: 812165 - DNA, 19 bp, Homo sapiens
atgccagattctgcctctc

SEQ ID NO: 812166 - DNA, 16 bp, Homo sapiens
atgccagctacttcct

SEQ ID NO: 812167 - DNA, 19 bp, Homo sapiens
atgccagctcagtcccatc

SEQ ID NO: 812168 - DNA, 12 bp, Homo sapiens
atgccagctggc

SEQ ID NO: 812169 - DNA, 16 bp, Homo sapiens
atgccagcttctctct

SEQ ID NO: 812170 - DNA, 19 bp, Homo sapiens
atgccagcttctctctcca

SEQ ID NO: 812171 - DNA, 19 bp, Homo sapiens
atgccaggacccgccagcc

SEQ ID NO: 812172 - DNA, 15 bp, Homo sapiens
atgccaggatttctc

SEQ ID NO: 812173 - DNA, 24 bp, Homo sapiens
atgccaggctgcgtccctccgagc

SEQ ID NO: 812174 - DNA, 15 bp, Homo sapiens
atgccagggcccagg

SEQ ID NO: 812175 - DNA, 22 bp, Homo sapiens
atgccaggttaggaaggcagca

SEQ ID NO: 812176 - DNA, 20 bp, Homo sapiens
atgccagtatttttaaaggc

SEQ ID NO: 812177 - DNA, 16 bp, Homo sapiens
atgccataaatacaag

SEQ ID NO: 812178 - DNA, 13 bp, Homo sapiens
atgccatcagccc

SEQ ID NO: 812179 - DNA, 15 bp, Homo sapiens
atgccatcagcccct

SEQ ID NO: 812180 - DNA, 17 bp, Homo sapiens
atgccatcagcccctgg

SEQ ID NO: 812181 - DNA, 14 bp, Homo sapiens
atgccatcatctcc

SEQ ID NO: 812182 - DNA, 16 bp, Homo sapiens
atgccatcatctcctg

SEQ ID NO: 812183 - DNA, 20 bp, Homo sapiens
atgccatttcagtggcttcc

SEQ ID NO: 812184 - DNA, 14 bp, Homo sapiens
atgccatttctcac

SEQ ID NO: 812185 - DNA, 16 bp, Homo sapiens
atgccatttcttctct

SEQ ID NO: 812186 - DNA, 23 bp, Homo sapiens
atgccatttcttctctctgttcc

SEQ ID NO: 812187 - DNA, 15 bp, Homo sapiens
atgcccaaggcctag

SEQ ID NO: 812188 - DNA, 19 bp, Homo sapiens
atgcccaccccctgccctg

SEQ ID NO: 812189 - DNA, 20 bp, Homo sapiens
atgcccagccagccacccct

SEQ ID NO: 812190 - DNA, 12 bp, Homo sapiens
atgcccagctct

SEQ ID NO: 812191 - DNA, 12 bp, Homo sapiens
atgcccagttca

SEQ ID NO: 812192 - DNA, 17 bp, Homo sapiens
atgccccacccccctcc

SEQ ID NO: 812193 - DNA, 19 bp, Homo sapiens
atgccccacccccctcctc

SEQ ID NO: 812194 - DNA, 13 bp, Homo sapiens
atgccccagctct

SEQ ID NO: 812195 - DNA, 12 bp, Homo sapiens
atgccccagtcg

SEQ ID NO: 812196 - DNA, 14 bp, Homo sapiens
atgcccccagctgg

SEQ ID NO: 812197 - DNA, 17 bp, Homo sapiens
atgcccccaggcagcca

SEQ ID NO: 812198 - DNA, 20 bp, Homo sapiens
atgcccccattctcccagtc

SEQ ID NO: 812199 - DNA, 21 bp, Homo sapiens
atgcccccctcaaacctcctc

SEQ ID NO: 812200 - DNA, 23 bp, Homo sapiens
atgcccccgacccccgcagaggc

SEQ ID NO: 812201 - DNA, 14 bp, Homo sapiens
atgccccctccctt

SEQ ID NO: 812202 - DNA, 21 bp, Homo sapiens
atgccccctcccttcacaggg

SEQ ID NO: 812203 - DNA, 14 bp, Homo sapiens
atgccccctgctta

SEQ ID NO: 812204 - DNA, 13 bp, Homo sapiens
atgccccctttca

SEQ ID NO: 812205 - DNA, 18 bp, Homo sapiens
atgccccctttcagatgt

SEQ ID NO: 812206 - DNA, 19 bp, Homo sapiens
atgccccctttcagatgtc

SEQ ID NO: 812207 - DNA, 16 bp, Homo sapiens
atgcccctcccccagc

SEQ ID NO: 812208 - DNA, 19 bp, Homo sapiens
atgcccctcccccagctgc

SEQ ID NO: 812209 - DNA, 16 bp, Homo sapiens
atgcccctggctggga

SEQ ID NO: 812210 - DNA, 19 bp, Homo sapiens
atgccccttctccccttcc

SEQ ID NO: 812211 - DNA, 17 bp, Homo sapiens
atgctttccctgaggaa

SEQ ID NO: 812212 - DNA, 14 bp, Homo sapiens
atgctttccttctt

SEQ ID NO: 812213 - DNA, 17 bp, Homo sapiens
atgctttgaatgcaaaa

SEQ ID NO: 812214 - DNA, 22 bp, Homo sapiens
atgctttgaatgcaaaagaaat

SEQ ID NO: 812215 - DNA, 14 bp, Homo sapiens
atgctttgctgcta

SEQ ID NO: 812216 - DNA, 22 bp, Homo sapiens
atgctttgtgtgattgaatctg

SEQ ID NO: 812217 - DNA, 22 bp, Homo sapiens
atgcttttatagctgcttggat

SEQ ID NO: 812218 - DNA, 15 bp, Homo sapiens
atgcttttatattct

SEQ ID NO: 812219 - DNA, 22 bp, Homo sapiens
atgcttttcactttctgtctag

SEQ ID NO: 812220 - DNA, 14 bp, Homo sapiens
atgcttttgctgct

SEQ ID NO: 812221 - DNA, 17 bp, Homo sapiens
atgcttttgctgctgct

SEQ ID NO: 812222 - DNA, 18 bp, Homo sapiens
atgcttttgctgctgctt

SEQ ID NO: 812223 - DNA, 14 bp, Homo sapiens
atgctttttagaaa

SEQ ID NO: 812224 - DNA, 17 bp, Homo sapiens
atgctttttgagtttca

SEQ ID NO: 812225 - DNA, 21 bp, Homo sapiens
atgctttttgagtttcatgtt

SEQ ID NO: 812226 - DNA, 15 bp, Homo sapiens
atggaaaaacttgtg

SEQ ID NO: 812227 - DNA, 16 bp, Homo sapiens
atggaaaaatggttga

SEQ ID NO: 812228 - DNA, 21 bp, Homo sapiens
atggaaaaatggttgatggaa

SEQ ID NO: 812229 - DNA, 22 bp, Homo sapiens
atggaaaacagagtatttctgg

SEQ ID NO: 812230 - DNA, 16 bp, Homo sapiens
atggaaaagggtcttc

SEQ ID NO: 812231 - DNA, 18 bp, Homo sapiens
atggaaaagtgtccttct

SEQ ID NO: 812232 - DNA, 19 bp, Homo sapiens
atggaaaatgtcctgtggt

SEQ ID NO: 812233 - DNA, 13 bp, Homo sapiens
atggaaacatttt

SEQ ID NO: 812234 - DNA, 22 bp, Homo sapiens
atggaaacattttatactgtac

SEQ ID NO: 812235 - DNA, 16 bp, Homo sapiens
atggaaacctgaaaaa

SEQ ID NO: 812236 - DNA, 18 bp, Homo sapiens
atggaaacgcacttacaa

SEQ ID NO: 812237 - DNA, 20 bp, Homo sapiens
atggaaagaaaagttattgc

SEQ ID NO: 812238 - DNA, 11 bp, Homo sapiens
atggaaagttg

SEQ ID NO: 812239 - DNA, 20 bp, Homo sapiens
atggaaataaaaagtatgtt

SEQ ID NO: 812240 - DNA, 19 bp, Homo sapiens
atggaaatcagccaagttt

SEQ ID NO: 812241 - DNA, 21 bp, Homo sapiens
atggaaatcttttacattttt

SEQ ID NO: 812242 - DNA, 17 bp, Homo sapiens
atggaaatgtgagaaat

SEQ ID NO: 812243 - DNA, 15 bp, Homo sapiens
atggaacatatgcac

SEQ ID NO: 812244 - DNA, 23 bp, Homo sapiens
atggaacccttttggcccccgag

SEQ ID NO: 812245 - DNA, 13 bp, Homo sapiens
atggaaccttccc

SEQ ID NO: 812246 - DNA, 20 bp, Homo sapiens
atggaacgggcatgggcctc

SEQ ID NO: 812247 - DNA, 15 bp, Homo sapiens
atggaactactgtac

SEQ ID NO: 812248 - DNA, 19 bp, Homo sapiens
atggaactactgtactttg

SEQ ID NO: 812249 - DNA, 23 bp, Homo sapiens
atggaactactgtactttgccat

SEQ ID NO: 812250 - DNA, 18 bp, Homo sapiens
atggaactgtgtatttat

SEQ ID NO: 812251 - DNA, 22 bp, Homo sapiens
atggaactgtgtatttatttaa

SEQ ID NO: 812252 - DNA, 16 bp, Homo sapiens
atggaacttagccatt

SEQ ID NO: 812253 - DNA, 19 bp, Homo sapiens
atggaacttctaatatatt

SEQ ID NO: 812254 - DNA, 13 bp, Homo sapiens
atggaagaaagta

SEQ ID NO: 812255 - DNA, 14 bp, Homo sapiens
atggaagagagaaa

SEQ ID NO: 812256 - DNA, 14 bp, Homo sapiens
atggaagcaaagac

SEQ ID NO: 812257 - DNA, 20 bp, Homo sapiens
atggaagcaaagacaaaaga

SEQ ID NO: 812258 - DNA, 16 bp, Homo sapiens
atggaaggagacttag

SEQ ID NO: 812259 - DNA, 17 bp, Homo sapiens
atggaaggggcttctgg

SEQ ID NO: 812260 - DNA, 17 bp, Homo sapiens
atggaaggtttgtatat

SEQ ID NO: 812261 - DNA, 22 bp, Homo sapiens
atggaaggtttgtatattgtca

SEQ ID NO: 812262 - DNA, 22 bp, Homo sapiens
atggaataacaactttcagtgg

SEQ ID NO: 812263 - DNA, 20 bp, Homo sapiens
atggaataactatctcactt

SEQ ID NO: 812264 - DNA, 16 bp, Homo sapiens
atggaatacagtgtta

SEQ ID NO: 812265 - DNA, 18 bp, Homo sapiens
atggaatatcagaagtat

SEQ ID NO: 812266 - DNA, 14 bp, Homo sapiens
atggaatattcatt

SEQ ID NO: 812267 - DNA, 24 bp, Homo sapiens
atggaatatttataggccagggca

SEQ ID NO: 812268 - DNA, 19 bp, Homo sapiens
atggaatcgaagtgtttat

SEQ ID NO: 812269 - DNA, 14 bp, Homo sapiens
atggaatcttctcc

SEQ ID NO: 812270 - DNA, 18 bp, Homo sapiens
atggaatcttctccagta

SEQ ID NO: 812271 - DNA, 22 bp, Homo sapiens
atggaatgattggttaaaatgt

SEQ ID NO: 812272 - DNA, 23 bp, Homo sapiens
atggaatggcaggtgtcatatga

SEQ ID NO: 812273 - DNA, 17 bp, Homo sapiens
atggaatgtgccacctg

SEQ ID NO: 812274 - DNA, 18 bp, Homo sapiens
atggaattaaatgtggga

SEQ ID NO: 812275 - DNA, 14 bp, Homo sapiens
atggaattattttg

SEQ ID NO: 812276 - DNA, 20 bp, Homo sapiens
atggaattattttgaatgtc

SEQ ID NO: 812277 - DNA, 23 bp, Homo sapiens
atggaattattttgaatgtcaca

SEQ ID NO: 812278 - DNA, 20 bp, Homo sapiens
atggaattcacaaagtaatt

SEQ ID NO: 812279 - DNA, 16 bp, Homo sapiens
atggaattccctcctg

SEQ ID NO: 812280 - DNA, 18 bp, Homo sapiens
atggaattcgtgttatga

SEQ ID NO: 812281 - DNA, 13 bp, Homo sapiens
atggaattgattt

SEQ ID NO: 812282 - DNA, 17 bp, Homo sapiens
atggaattgatttgcat

SEQ ID NO: 812283 - DNA, 17 bp, Homo sapiens
atggaattgcttaccaa

SEQ ID NO: 812284 - DNA, 17 bp, Homo sapiens
atggaattttgcaaaga

SEQ ID NO: 812285 - DNA, 14 bp, Homo sapiens
atggaatttttctg

SEQ ID NO: 812286 - DNA, 16 bp, Homo sapiens
atggacaaaattaata

SEQ ID NO: 812287 - DNA, 18 bp, Homo sapiens
atggacaaaattaataca

SEQ ID NO: 812288 - DNA, 20 bp, Homo sapiens
atggacaaaattaatacatt

SEQ ID NO: 812289 - DNA, 12 bp, Homo sapiens
atggacaaagaa

SEQ ID NO: 812290 - DNA, 17 bp, Homo sapiens
atggacaaaggcctggc

SEQ ID NO: 812291 - DNA, 22 bp, Homo sapiens
atggacaacttatttaaaaata

SEQ ID NO: 812292 - DNA, 23 bp, Homo sapiens
atggacaacttatttaaaaatat

SEQ ID NO: 812293 - DNA, 13 bp, Homo sapiens
atggacaccccca

SEQ ID NO: 812294 - DNA, 15 bp, Homo sapiens
atggacacccccagc

SEQ ID NO: 812295 - DNA, 23 bp, Homo sapiens
atggacaccccttatccaggact

SEQ ID NO: 812296 - DNA, 18 bp, Homo sapiens
atggacaccttgtgttta

SEQ ID NO: 812297 - DNA, 16 bp, Homo sapiens
atggacactaatgcag

SEQ ID NO: 812298 - DNA, 18 bp, Homo sapiens
atggacactaatgcagcc

SEQ ID NO: 812299 - DNA, 15 bp, Homo sapiens
atggacactacaccc

SEQ ID NO: 812300 - DNA, 19 bp, Homo sapiens
atggacactacacccagca

SEQ ID NO: 812301 - DNA, 22 bp, Homo sapiens
atggacactgccaagagccgac

SEQ ID NO: 812302 - DNA, 14 bp, Homo sapiens
atggacagacacct

SEQ ID NO: 812303 - DNA, 19 bp, Homo sapiens
atggacagacacctccccc

SEQ ID NO: 812304 - DNA, 17 bp, Homo sapiens
atggacagggccagggt

SEQ ID NO: 812305 - DNA, 14 bp, Homo sapiens
atggacatgatctt

SEQ ID NO: 812306 - DNA, 18 bp, Homo sapiens
atggacatttagaagaaa

SEQ ID NO: 812307 - DNA, 20 bp, Homo sapiens
atggacatttagaagaaaga

SEQ ID NO: 812308 - DNA, 17 bp, Homo sapiens
atggaccaacctgctct

SEQ ID NO: 812309 - DNA, 18 bp, Homo sapiens
atggaccaacctgctctg

SEQ ID NO: 812310 - DNA, 16 bp, Homo sapiens
atggacctagcttgag

SEQ ID NO: 812311 - DNA, 18 bp, Homo sapiens
atggacctgcctgcatag

SEQ ID NO: 812312 - DNA, 17 bp, Homo sapiens
atggacgaatatgaatg

SEQ ID NO: 812313 - DNA, 19 bp, Homo sapiens
atggacgaatatgaatgtc

SEQ ID NO: 812314 - DNA, 13 bp, Homo sapiens
atggacgcaggcc

SEQ ID NO: 812315 - DNA, 17 bp, Homo sapiens
atggactatctgtctgg

SEQ ID NO: 812316 - DNA, 16 bp, Homo sapiens
atggactcaggatcca

SEQ ID NO: 812317 - DNA, 14 bp, Homo sapiens
atggactctacact

SEQ ID NO: 812318 - DNA, 16 bp, Homo sapiens
atggactctacactgt

SEQ ID NO: 812319 - DNA, 17 bp, Homo sapiens
atggactgtgaatttca

SEQ ID NO: 812320 - DNA, 15 bp, Homo sapiens
atggagaaagaagtg

SEQ ID NO: 812321 - DNA, 18 bp, Homo sapiens
atggagaagggttctgcc

SEQ ID NO: 812322 - DNA, 14 bp, Homo sapiens
atggagaatcactt

SEQ ID NO: 812323 - DNA, 20 bp, Homo sapiens
atggagaatctgctgcatag

SEQ ID NO: 812324 - DNA, 14 bp, Homo sapiens
atggagactcctgc

SEQ ID NO: 812325 - DNA, 18 bp, Homo sapiens
atggagaggcggcctcgt

SEQ ID NO: 812326 - DNA, 20 bp, Homo sapiens
atggagaggcggcctcgtgc

SEQ ID NO: 812327 - DNA, 14 bp, Homo sapiens
atggagatctgaag

SEQ ID NO: 812328 - DNA, 16 bp, Homo sapiens
atggagatctgaaggg

SEQ ID NO: 812329 - DNA, 19 bp, Homo sapiens
atggagattcagttttcat

SEQ ID NO: 812330 - DNA, 23 bp, Homo sapiens
atggagccagctccctctattta

SEQ ID NO: 812331 - DNA, 21 bp, Homo sapiens
atggagccagctctgcattat

SEQ ID NO: 812332 - DNA, 16 bp, Homo sapiens
atggccccccactccc

SEQ ID NO: 812333 - DNA, 21 bp, Homo sapiens
atggccccgcaaggcctccag

SEQ ID NO: 812334 - DNA, 14 bp, Homo sapiens
atggcccctccttg

SEQ ID NO: 812335 - DNA, 17 bp, Homo sapiens
atggcccctccttgcaa

SEQ ID NO: 812336 - DNA, 18 bp, Homo sapiens
atggccctgcaaaaatat

SEQ ID NO: 812337 - DNA, 11 bp, Homo sapiens
atggccctgtc

SEQ ID NO: 812338 - DNA, 20 bp, Homo sapiens
atggccctgtcccaggccgg

SEQ ID NO: 812339 - DNA, 18 bp, Homo sapiens
atggcccttcccactgga

SEQ ID NO: 812340 - DNA, 18 bp, Homo sapiens
atggccggagaggaccgg

SEQ ID NO: 812341 - DNA, 14 bp, Homo sapiens
atggccgggcaggg

SEQ ID NO: 812342 - DNA, 19 bp, Homo sapiens
atggccgggccctgctgag

SEQ ID NO: 812343 - DNA, 14 bp, Homo sapiens
atggccgtggatgc

SEQ ID NO: 812344 - DNA, 13 bp, Homo sapiens
atggcctcagctg

SEQ ID NO: 812345 - DNA, 14 bp, Homo sapiens
atggcctcagctgc

SEQ ID NO: 812346 - DNA, 17 bp, Homo sapiens
atggcctcagctgcctc

SEQ ID NO: 812347 - DNA, 19 bp, Homo sapiens
atggcctcatgtggctgga

SEQ ID NO: 812348 - DNA, 19 bp, Homo sapiens
atggcctggagggactttt

SEQ ID NO: 812349 - DNA, 22 bp, Homo sapiens
atggcctggattcacgccctct

SEQ ID NO: 812350 - DNA, 18 bp, Homo sapiens
atggcctggctgcctggt

SEQ ID NO: 812351 - DNA, 17 bp, Homo sapiens
atggccttaatatacta

SEQ ID NO: 812352 - DNA, 17 bp, Homo sapiens
atggccttaatttcctt

SEQ ID NO: 812353 - DNA, 14 bp, Homo sapiens
atggcctttccttc

SEQ ID NO: 812354 - DNA, 23 bp, Homo sapiens
atggcctttccttccctctctga

SEQ ID NO: 812355 - DNA, 14 bp, Homo sapiens
atggcctttggacc

SEQ ID NO: 812356 - DNA, 15 bp, Homo sapiens
atggcctttggaccc

SEQ ID NO: 812357 - DNA, 23 bp, Homo sapiens
atggcctttggacccagggcctg

SEQ ID NO: 812358 - DNA, 24 bp, Homo sapiens
atggcgaggcctctctcaggagca

SEQ ID NO: 812359 - DNA, 18 bp, Homo sapiens
atggcgatggggactctg

SEQ ID NO: 812360 - DNA, 13 bp, Homo sapiens
atggcgccctgcc

SEQ ID NO: 812361 - DNA, 19 bp, Homo sapiens
atggcgcgggaggcaccag

SEQ ID NO: 812362 - DNA, 23 bp, Homo sapiens
atggcgcgggaggcaccagctct

SEQ ID NO: 812363 - DNA, 13 bp, Homo sapiens
atggcgtctgctc

SEQ ID NO: 812364 - DNA, 14 bp, Homo sapiens
atggcgtctgctct

SEQ ID NO: 812365 - DNA, 15 bp, Homo sapiens
atggcgttggtttgt

SEQ ID NO: 812366 - DNA, 17 bp, Homo sapiens
atggctaataaactgta

SEQ ID NO: 812367 - DNA, 18 bp, Homo sapiens
atggctaataaactgtat

SEQ ID NO: 812368 - DNA, 20 bp, Homo sapiens
atggctaataaactgtatta

SEQ ID NO: 812369 - DNA, 22 bp, Homo sapiens
atggctaataaactgtattaaa

SEQ ID NO: 812370 - DNA, 15 bp, Homo sapiens
atggctagcctttct

SEQ ID NO: 812371 - DNA, 23 bp, Homo sapiens
atggctagtactgtattggctct

SEQ ID NO: 812372 - DNA, 14 bp, Homo sapiens
atggctataaatat

SEQ ID NO: 812373 - DNA, 22 bp, Homo sapiens
atggctattaacaattaattgt

SEQ ID NO: 812374 - DNA, 15 bp, Homo sapiens
atggctcaagtagaa

SEQ ID NO: 812375 - DNA, 22 bp, Homo sapiens
atggctcaagtagaaaagcagt

SEQ ID NO: 812376 - DNA, 15 bp, Homo sapiens
atggctcagaggggg

SEQ ID NO: 812377 - DNA, 22 bp, Homo sapiens
atggctccagtctgctgccctc

SEQ ID NO: 812378 - DNA, 17 bp, Homo sapiens
atggctcccacaggagt

SEQ ID NO: 812379 - DNA, 13 bp, Homo sapiens
atggctcctctca

SEQ ID NO: 812380 - DNA, 14 bp, Homo sapiens
atggctcctgtctg

SEQ ID NO: 812381 - DNA, 18 bp, Homo sapiens
atggctcctgtctggctc

SEQ ID NO: 812382 - DNA, 18 bp, Homo sapiens
atggctgaagctggagca

SEQ ID NO: 812383 - DNA, 17 bp, Homo sapiens
atggctgaagttggcca

SEQ ID NO: 812384 - DNA, 22 bp, Homo sapiens
atggctgcacgtaggttcccca

SEQ ID NO: 812385 - DNA, 12 bp, Homo sapiens
atggctgcccag

SEQ ID NO: 812386 - DNA, 15 bp, Homo sapiens
atggctgcccaggag

SEQ ID NO: 812387 - DNA, 16 bp, Homo sapiens
atggctgcccaggaga

SEQ ID NO: 812388 - DNA, 17 bp, Homo sapiens
atggctgcccaggagac

SEQ ID NO: 812389 - DNA, 22 bp, Homo sapiens
atggctgctagattttaattta

SEQ ID NO: 812390 - DNA, 12 bp, Homo sapiens
atggctgctttg

SEQ ID NO: 812391 - DNA, 12 bp, Homo sapiens
atggctgtctgc

SEQ ID NO: 812392 - DNA, 17 bp, Homo sapiens
atggctgtctgcacaga

SEQ ID NO: 812393 - DNA, 15 bp, Homo sapiens
atggctgtgcctctg

SEQ ID NO: 812394 - DNA, 17 bp, Homo sapiens
atggctgtgcctctgcc

SEQ ID NO: 812395 - DNA, 20 bp, Homo sapiens
atggctgtgcctctgcctgt

SEQ ID NO: 812396 - DNA, 21 bp, Homo sapiens
atggctgtggcatttccaaac

SEQ ID NO: 812397 - DNA, 13 bp, Homo sapiens
atggcttaggaat

SEQ ID NO: 812398 - DNA, 21 bp, Homo sapiens
atggcttatttctatgacaaa

SEQ ID NO: 812399 - DNA, 21 bp, Homo sapiens
atggcttccctctttcatctc

SEQ ID NO: 812400 - DNA, 12 bp, Homo sapiens
atggcttcctcc

SEQ ID NO: 812401 - DNA, 13 bp, Homo sapiens
atggcttcctgag

SEQ ID NO: 812402 - DNA, 18 bp, Homo sapiens
atggcttcggagggccgc

SEQ ID NO: 812403 - DNA, 14 bp, Homo sapiens
atggcttctaacaa

SEQ ID NO: 812404 - DNA, 16 bp, Homo sapiens
atggcttgacatgtgc

SEQ ID NO: 812405 - DNA, 16 bp, Homo sapiens
atggcttgttctctgg

SEQ ID NO: 812406 - DNA, 15 bp, Homo sapiens
atggctttaaataaa

SEQ ID NO: 812407 - DNA, 21 bp, Homo sapiens
atggctttcactttctctttt

SEQ ID NO: 812408 - DNA, 20 bp, Homo sapiens
atggctttcatcctgtgtcc

SEQ ID NO: 812409 - DNA, 14 bp, Homo sapiens
atggcttttcctgg

SEQ ID NO: 812410 - DNA, 15 bp, Homo sapiens
atgggaaaaaaacaa

SEQ ID NO: 812411 - DNA, 13 bp, Homo sapiens
atgggaaaatatt

SEQ ID NO: 812412 - DNA, 14 bp, Homo sapiens
atgggaaaatattt

SEQ ID NO: 812413 - DNA, 20 bp, Homo sapiens
atgggaaacgtatgtgtgca

SEQ ID NO: 812414 - DNA, 14 bp, Homo sapiens
atgggaagacatga

SEQ ID NO: 812415 - DNA, 12 bp, Homo sapiens
atgggaagcagg

SEQ ID NO: 812416 - DNA, 12 bp, Homo sapiens
atgggaagccat

SEQ ID NO: 812417 - DNA, 16 bp, Homo sapiens
atgggaataattgctt

SEQ ID NO: 812418 - DNA, 17 bp, Homo sapiens
atgggaatgaggtggga

SEQ ID NO: 812419 - DNA, 18 bp, Homo sapiens
atgggaatgaggtgggag

SEQ ID NO: 812420 - DNA, 22 bp, Homo sapiens
atgggacaaagttccaaaatgc

SEQ ID NO: 812421 - DNA, 20 bp, Homo sapiens
atgggacccaagtctgaacg

SEQ ID NO: 812422 - DNA, 17 bp, Homo sapiens
atgggaccgtgccccac

SEQ ID NO: 812423 - DNA, 21 bp, Homo sapiens
atgggactggagtccctgtga

SEQ ID NO: 812424 - DNA, 18 bp, Homo sapiens
atgggagacccttgacac

SEQ ID NO: 812425 - DNA, 16 bp, Homo sapiens
atgggagatggcagca

SEQ ID NO: 812426 - DNA, 20 bp, Homo sapiens
atgggagccagctgcttttt

SEQ ID NO: 812427 - DNA, 13 bp, Homo sapiens
atgggagccccag

SEQ ID NO: 812428 - DNA, 23 bp, Homo sapiens
atgggagctgaggccacactcag

SEQ ID NO: 812429 - DNA, 14 bp, Homo sapiens
atgggaggaattca

SEQ ID NO: 812430 - DNA, 17 bp, Homo sapiens
atgggaggagagccact

SEQ ID NO: 812431 - DNA, 21 bp, Homo sapiens
atgggaggagagccactgggc

SEQ ID NO: 812432 - DNA, 13 bp, Homo sapiens
atgggagggatca

SEQ ID NO: 812433 - DNA, 22 bp, Homo sapiens
atgggagggggcttgaagccaa

SEQ ID NO: 812434 - DNA, 20 bp, Homo sapiens
atgggatatgattggttcag

SEQ ID NO: 812435 - DNA, 21 bp, Homo sapiens
atgggatatgtggtgtatatc

SEQ ID NO: 812436 - DNA, 17 bp, Homo sapiens
atgggatccaattttaa

SEQ ID NO: 812437 - DNA, 20 bp, Homo sapiens
atgggcaattccagaaatct

SEQ ID NO: 812438 - DNA, 14 bp, Homo sapiens
atgggcagagccca

SEQ ID NO: 812439 - DNA, 16 bp, Homo sapiens
atgggcagttctccca

SEQ ID NO: 812440 - DNA, 17 bp, Homo sapiens
atgggcagttctcccag

SEQ ID NO: 812441 - DNA, 23 bp, Homo sapiens
atgggcagttctcccagggagtg

SEQ ID NO: 812442 - DNA, 16 bp, Homo sapiens
atgggcatcttttgta

SEQ ID NO: 812443 - DNA, 17 bp, Homo sapiens
atgggcatcttttgtat

SEQ ID NO: 812444 - DNA, 20 bp, Homo sapiens
atgggcatcttttgtattaa

SEQ ID NO: 812445 - DNA, 19 bp, Homo sapiens
atgggcattgcagccttgc

SEQ ID NO: 812446 - DNA, 14 bp, Homo sapiens
atgggcattgggct

SEQ ID NO: 812447 - DNA, 19 bp, Homo sapiens
atgggcattgggctgacac

SEQ ID NO: 812448 - DNA, 13 bp, Homo sapiens
atgggcatttatt

SEQ ID NO: 812449 - DNA, 16 bp, Homo sapiens
atgggcatttatttta

SEQ ID NO: 812450 - DNA, 16 bp, Homo sapiens
atgggccactgaaatc

SEQ ID NO: 812451 - DNA, 19 bp, Homo sapiens
atgggccactgaaatctgt

SEQ ID NO: 812452 - DNA, 11 bp, Homo sapiens
atgggccaggg

SEQ ID NO: 812453 - DNA, 22 bp, Homo sapiens
atgggccccgccttcctgggca

SEQ ID NO: 812454 - DNA, 21 bp, Homo sapiens
atgtaatgttttctttgcaaa

SEQ ID NO: 812455 - DNA, 19 bp, Homo sapiens
atgtaattaaactgttaac

SEQ ID NO: 812456 - DNA, 23 bp, Homo sapiens
atgtaattaagtactatgtatca

SEQ ID NO: 812457 - DNA, 16 bp, Homo sapiens
atgtaattcaggactc

SEQ ID NO: 812458 - DNA, 15 bp, Homo sapiens
atgtaattgaataaa

SEQ ID NO: 812459 - DNA, 15 bp, Homo sapiens
atgtaattggaatct

SEQ ID NO: 812460 - DNA, 14 bp, Homo sapiens
atgtaatttagaaa

SEQ ID NO: 812461 - DNA, 13 bp, Homo sapiens
atgtaatttatgc

SEQ ID NO: 812462 - DNA, 13 bp, Homo sapiens
atgtaatttcaaa

SEQ ID NO: 812463 - DNA, 21 bp, Homo sapiens
atgtaatttcaggaggaatac

SEQ ID NO: 812464 - DNA, 17 bp, Homo sapiens
atgtaatttgcattact

SEQ ID NO: 812465 - DNA, 14 bp, Homo sapiens
atgtaatttgtaca

SEQ ID NO: 812466 - DNA, 16 bp, Homo sapiens
atgtacaagttgagta

SEQ ID NO: 812467 - DNA, 21 bp, Homo sapiens
atgtacaatacaatgtacaat

SEQ ID NO: 812468 - DNA, 18 bp, Homo sapiens
atgtacaattatgtctct

SEQ ID NO: 812469 - DNA, 20 bp, Homo sapiens
atgtacaattatgtctcttg

SEQ ID NO: 812470 - DNA, 17 bp, Homo sapiens
atgtacagaacacaaat

SEQ ID NO: 812471 - DNA, 23 bp, Homo sapiens
atgtacagaacacaaatgtctag

SEQ ID NO: 812472 - DNA, 19 bp, Homo sapiens
atgtacagacatatttaac

SEQ ID NO: 812473 - DNA, 23 bp, Homo sapiens
atgtacagacatatttaactggt

SEQ ID NO: 812474 - DNA, 17 bp, Homo sapiens
atgtacagagctttctt

SEQ ID NO: 812475 - DNA, 13 bp, Homo sapiens
atgtacagctctc

SEQ ID NO: 812476 - DNA, 15 bp, Homo sapiens
atgtacagtctgtca

SEQ ID NO: 812477 - DNA, 17 bp, Homo sapiens
atgtacagtttattgat

SEQ ID NO: 812478 - DNA, 20 bp, Homo sapiens
atgtacagtttattgatatt

SEQ ID NO: 812479 - DNA, 22 bp, Homo sapiens
atgtacatgtgtagggaaagtt

SEQ ID NO: 812480 - DNA, 15 bp, Homo sapiens
atgtacatttaataa

SEQ ID NO: 812481 - DNA, 16 bp, Homo sapiens
atgtacatttattcat

SEQ ID NO: 812482 - DNA, 20 bp, Homo sapiens
atgtacatttccaaattcac

SEQ ID NO: 812483 - DNA, 19 bp, Homo sapiens
atgtaccccctttcccttc

SEQ ID NO: 812484 - DNA, 23 bp, Homo sapiens
atgtaccgatgatactgtttctt

SEQ ID NO: 812485 - DNA, 22 bp, Homo sapiens
atgtacctcccctgccttgctg

SEQ ID NO: 812486 - DNA, 22 bp, Homo sapiens
atgtaccttctttcactctgtc

SEQ ID NO: 812487 - DNA, 22 bp, Homo sapiens
atgtactagtgttctgtttgtt

SEQ ID NO: 812488 - DNA, 21 bp, Homo sapiens
atgtactagttttagttttct

SEQ ID NO: 812489 - DNA, 17 bp, Homo sapiens
atgtactcctctttaca

SEQ ID NO: 812490 - DNA, 20 bp, Homo sapiens
atgtactcctctttacactg

SEQ ID NO: 812491 - DNA, 19 bp, Homo sapiens
atgtactctacgccaaagt

SEQ ID NO: 812492 - DNA, 20 bp, Homo sapiens
atgtactctgttgagtaaaa

SEQ ID NO: 812493 - DNA, 17 bp, Homo sapiens
atgtactgatttcagta

SEQ ID NO: 812494 - DNA, 18 bp, Homo sapiens
atgtactgatttcagtaa

SEQ ID NO: 812495 - DNA, 22 bp, Homo sapiens
atgtactgcaaagtcgccagtc

SEQ ID NO: 812496 - DNA, 14 bp, Homo sapiens
atgtactgtacata

SEQ ID NO: 812497 - DNA, 15 bp, Homo sapiens
atgtacttaaatgag

SEQ ID NO: 812498 - DNA, 19 bp, Homo sapiens
atgtacttagctgtactat

SEQ ID NO: 812499 - DNA, 14 bp, Homo sapiens
atgtacttcctgtg

SEQ ID NO: 812500 - DNA, 15 bp, Homo sapiens
atgtacttcctgtgt

SEQ ID NO: 812501 - DNA, 20 bp, Homo sapiens
atgtacttcctgtgtactct

SEQ ID NO: 812502 - DNA, 14 bp, Homo sapiens
atgtacttctctgt

SEQ ID NO: 812503 - DNA, 19 bp, Homo sapiens
atgtacttctctgtgtgca

SEQ ID NO: 812504 - DNA, 16 bp, Homo sapiens
atgtacttgaaggatg

SEQ ID NO: 812505 - DNA, 17 bp, Homo sapiens
atgtacttgaaggatgg

SEQ ID NO: 812506 - DNA, 19 bp, Homo sapiens
atgtacttgtcaaagaagg

SEQ ID NO: 812507 - DNA, 19 bp, Homo sapiens
atgtacttgtttctctgtt

SEQ ID NO: 812508 - DNA, 21 bp, Homo sapiens
atgtagaaaagagacttctct

SEQ ID NO: 812509 - DNA, 23 bp, Homo sapiens
atgtagaaaagagacttctctgt

SEQ ID NO: 812510 - DNA, 12 bp, Homo sapiens
atgtagaaagct

SEQ ID NO: 812511 - DNA, 17 bp, Homo sapiens
atgtagaagtctttcag

SEQ ID NO: 812512 - DNA, 18 bp, Homo sapiens
atgtagaagtctttcaga

SEQ ID NO: 812513 - DNA, 18 bp, Homo sapiens
atgtagaataaatgaaga

SEQ ID NO: 812514 - DNA, 15 bp, Homo sapiens
atgtagaataggcag

SEQ ID NO: 812515 - DNA, 17 bp, Homo sapiens
atgtagaatattcagac

SEQ ID NO: 812516 - DNA, 14 bp, Homo sapiens
atgtagaattgaaa

SEQ ID NO: 812517 - DNA, 18 bp, Homo sapiens
atgtagagagaacaggtg

SEQ ID NO: 812518 - DNA, 19 bp, Homo sapiens
atgtagagagaacaggtgg

SEQ ID NO: 812519 - DNA, 22 bp, Homo sapiens
atgtagatattgttttctgtaa

SEQ ID NO: 812520 - DNA, 19 bp, Homo sapiens
atgtagatgtatgcacaca

SEQ ID NO: 812521 - DNA, 20 bp, Homo sapiens
atgtagatttatttcatcat

SEQ ID NO: 812522 - DNA, 20 bp, Homo sapiens
atgtagatttgtacaggagt

SEQ ID NO: 812523 - DNA, 17 bp, Homo sapiens
atgtagcaaaacgcatg

SEQ ID NO: 812524 - DNA, 15 bp, Homo sapiens
atgtagcacataaac

SEQ ID NO: 812525 - DNA, 16 bp, Homo sapiens
atgtagcacataaact

SEQ ID NO: 812526 - DNA, 19 bp, Homo sapiens
atgtagcacataaactttg

SEQ ID NO: 812527 - DNA, 21 bp, Homo sapiens
atgtagcacttacgtaaaaca

SEQ ID NO: 812528 - DNA, 23 bp, Homo sapiens
atgtagcattgttccacacattt

SEQ ID NO: 812529 - DNA, 16 bp, Homo sapiens
atgtagccagctgtgc

SEQ ID NO: 812530 - DNA, 16 bp, Homo sapiens
atgtagcccatccttc

SEQ ID NO: 812531 - DNA, 18 bp, Homo sapiens
atgtagccccctggcctc

SEQ ID NO: 812532 - DNA, 23 bp, Homo sapiens
atgtagccccctggcctctgtgc

SEQ ID NO: 812533 - DNA, 22 bp, Homo sapiens
atgtagccttcacacagataga

SEQ ID NO: 812534 - DNA, 14 bp, Homo sapiens
atgtagctggtttc

SEQ ID NO: 812535 - DNA, 12 bp, Homo sapiens
atgtagcttttg

SEQ ID NO: 812536 - DNA, 16 bp, Homo sapiens
atgtagcttttgggga

SEQ ID NO: 812537 - DNA, 17 bp, Homo sapiens
atgtaggcacttttatt

SEQ ID NO: 812538 - DNA, 22 bp, Homo sapiens
atgtaggctggctttcagagta

SEQ ID NO: 812539 - DNA, 16 bp, Homo sapiens
atgtagtaacactaat

SEQ ID NO: 812540 - DNA, 22 bp, Homo sapiens
atgtagtaagcgtgattcactt

SEQ ID NO: 812541 - DNA, 18 bp, Homo sapiens
atgtagtaattgacatgt

SEQ ID NO: 812542 - DNA, 17 bp, Homo sapiens
atgtagtataaagaaaa

SEQ ID NO: 812543 - DNA, 19 bp, Homo sapiens
atgtagtataaagaaaagt

SEQ ID NO: 812544 - DNA, 22 bp, Homo sapiens
atgtagtattttttgtataatt

SEQ ID NO: 812545 - DNA, 13 bp, Homo sapiens
atgtagtctgtag

SEQ ID NO: 812546 - DNA, 20 bp, Homo sapiens
atgtagtgcatttttaaact

SEQ ID NO: 812547 - DNA, 20 bp, Homo sapiens
atgtagtttttatatgttgt

SEQ ID NO: 812548 - DNA, 21 bp, Homo sapiens
atgtataaaaattatcaaaaa

SEQ ID NO: 812549 - DNA, 13 bp, Homo sapiens
atgtataaagatt

SEQ ID NO: 812550 - DNA, 14 bp, Homo sapiens
atgtataaattaat

SEQ ID NO: 812551 - DNA, 21 bp, Homo sapiens
atgtataaattaatacagagt

SEQ ID NO: 812552 - DNA, 13 bp, Homo sapiens
atgtataaattat

SEQ ID NO: 812553 - DNA, 14 bp, Homo sapiens
atgtataaattttt

SEQ ID NO: 812554 - DNA, 19 bp, Homo sapiens
atgtataaccaagtgtgct

SEQ ID NO: 812555 - DNA, 15 bp, Homo sapiens
atgtatacttatctt

SEQ ID NO: 812556 - DNA, 16 bp, Homo sapiens
atgtatagttttgaat

SEQ ID NO: 812557 - DNA, 14 bp, Homo sapiens
atgtatataaaaat

SEQ ID NO: 812558 - DNA, 13 bp, Homo sapiens
atgtatatatcta

SEQ ID NO: 812559 - DNA, 23 bp, Homo sapiens
atgtatatcattctacagaataa

SEQ ID NO: 812560 - DNA, 20 bp, Homo sapiens
atgtatatccatataacaat

SEQ ID NO: 812561 - DNA, 14 bp, Homo sapiens
atgtatatgtatat

SEQ ID NO: 812562 - DNA, 15 bp, Homo sapiens
atgtatatgtatata

SEQ ID NO: 812563 - DNA, 14 bp, Homo sapiens
atgtatattaaaaa

SEQ ID NO: 812564 - DNA, 16 bp, Homo sapiens
atgtatattaaaaaag

SEQ ID NO: 812565 - DNA, 20 bp, Homo sapiens
atgtatattaaaaaagagac

SEQ ID NO: 812566 - DNA, 15 bp, Homo sapiens
atgtatatttgcata

SEQ ID NO: 812567 - DNA, 16 bp, Homo sapiens
atgtatatttgctgca

SEQ ID NO: 812568 - DNA, 22 bp, Homo sapiens
atgtatattttgtgttattcgt

SEQ ID NO: 812569 - DNA, 12 bp, Homo sapiens
atgtatcaatga

SEQ ID NO: 812570 - DNA, 20 bp, Homo sapiens
atgtatcagccagccttccc

SEQ ID NO: 812571 - DNA, 21 bp, Homo sapiens
atgtatcagccagccttcccc

SEQ ID NO: 812572 - DNA, 17 bp, Homo sapiens
atgtatcataattacca

SEQ ID NO: 812573 - DNA, 16 bp, Homo sapiens
atgtatcatagaaatg

SEQ ID NO: 812574 - DNA, 18 bp, Homo sapiens
atgtatcatttttgtgca

SEQ ID NO: 812575 - DNA, 18 bp, Homo sapiens
atgtgaatttttaagctg

SEQ ID NO: 812576 - DNA, 21 bp, Homo sapiens
atgtgaatttttaagctgcaa

SEQ ID NO: 812577 - DNA, 19 bp, Homo sapiens
atgtgaatttttatttctt

SEQ ID NO: 812578 - DNA, 20 bp, Homo sapiens
atgtgacaattttgtacaaa

SEQ ID NO: 812579 - DNA, 22 bp, Homo sapiens
atgtgacatgcccaaggccacg

SEQ ID NO: 812580 - DNA, 15 bp, Homo sapiens
atgtgacattaacaa

SEQ ID NO: 812581 - DNA, 18 bp, Homo sapiens
atgtgacattaacaaata

SEQ ID NO: 812582 - DNA, 14 bp, Homo sapiens
atgtgacatttata

SEQ ID NO: 812583 - DNA, 16 bp, Homo sapiens
atgtgacattttacat

SEQ ID NO: 812584 - DNA, 15 bp, Homo sapiens
atgtgaccataatgt

SEQ ID NO: 812585 - DNA, 16 bp, Homo sapiens
atgtgaccataatgta

SEQ ID NO: 812586 - DNA, 19 bp, Homo sapiens
atgtgacggggtgtgtggc

SEQ ID NO: 812587 - DNA, 21 bp, Homo sapiens
atgtgactagcgcctggcctt

SEQ ID NO: 812588 - DNA, 14 bp, Homo sapiens
atgtgactgtataa

SEQ ID NO: 812589 - DNA, 14 bp, Homo sapiens
atgtgacttctccc

SEQ ID NO: 812590 - DNA, 20 bp, Homo sapiens
atgtgacttttctgattaat

SEQ ID NO: 812591 - DNA, 21 bp, Homo sapiens
atgtgactttttttggtataa

SEQ ID NO: 812592 - DNA, 19 bp, Homo sapiens
atgtgagaaatcagaattg

SEQ ID NO: 812593 - DNA, 12 bp, Homo sapiens
atgtgagaaatg

SEQ ID NO: 812594 - DNA, 16 bp, Homo sapiens
atgtgagaaatgtcta

SEQ ID NO: 812595 - DNA, 14 bp, Homo sapiens
atgtgagactggtt

SEQ ID NO: 812596 - DNA, 14 bp, Homo sapiens
atgtgagagaaagt

SEQ ID NO: 812597 - DNA, 17 bp, Homo sapiens
atgtgagaggtttgact

SEQ ID NO: 812598 - DNA, 21 bp, Homo sapiens
atgtgagattactttgtcccg

SEQ ID NO: 812599 - DNA, 12 bp, Homo sapiens
atgtgagatttc

SEQ ID NO: 812600 - DNA, 17 bp, Homo sapiens
atgtgagccaccgctgc

SEQ ID NO: 812601 - DNA, 22 bp, Homo sapiens
atgtgagccaccgctgccagca

SEQ ID NO: 812602 - DNA, 17 bp, Homo sapiens
atgtgagccaccgtgcc

SEQ ID NO: 812603 - DNA, 22 bp, Homo sapiens
atgtgaggaactcacatactga

SEQ ID NO: 812604 - DNA, 18 bp, Homo sapiens
atgtgaggaggaaaagga

SEQ ID NO: 812605 - DNA, 22 bp, Homo sapiens
atgtgagtcctgttgaagactt

SEQ ID NO: 812606 - DNA, 22 bp, Homo sapiens
atgtgagtgccttttgcagaag

SEQ ID NO: 812607 - DNA, 23 bp, Homo sapiens
atgtgagtgccttttgcagaaga

SEQ ID NO: 812608 - DNA, 22 bp, Homo sapiens
atgtgagtgtgtatgtcagtgg

SEQ ID NO: 812609 - DNA, 21 bp, Homo sapiens
atgtgagtttggtctggactg

SEQ ID NO: 812610 - DNA, 21 bp, Homo sapiens
atgtgatacccatagcttcca

SEQ ID NO: 812611 - DNA, 15 bp, Homo sapiens
atgtgatatataagt

SEQ ID NO: 812612 - DNA, 20 bp, Homo sapiens
atgtgatattctgttgcttt

SEQ ID NO: 812613 - DNA, 21 bp, Homo sapiens
atgtgatattctgttgcttta

SEQ ID NO: 812614 - DNA, 16 bp, Homo sapiens
atgtgatcactgagac

SEQ ID NO: 812615 - DNA, 19 bp, Homo sapiens
atgtgatcatagctcactg

SEQ ID NO: 812616 - DNA, 20 bp, Homo sapiens
atgtgatcatgtgtggaagt

SEQ ID NO: 812617 - DNA, 12 bp, Homo sapiens
atgtgatgccaa

SEQ ID NO: 812618 - DNA, 13 bp, Homo sapiens
atgtgatgtcatg

SEQ ID NO: 812619 - DNA, 23 bp, Homo sapiens
atgtgattaacatctacaatcag

SEQ ID NO: 812620 - DNA, 22 bp, Homo sapiens
atgtgattcactgccttcctct

SEQ ID NO: 812621 - DNA, 20 bp, Homo sapiens
atgtgattcttctaaagcac

SEQ ID NO: 812622 - DNA, 15 bp, Homo sapiens
atgtgattgtggaat

SEQ ID NO: 812623 - DNA, 17 bp, Homo sapiens
atgtgattgtggaatgg

SEQ ID NO: 812624 - DNA, 21 bp, Homo sapiens
atgtgcaaaaccttttactgg

SEQ ID NO: 812625 - DNA, 19 bp, Homo sapiens
atgtgcaaaatctgttata

SEQ ID NO: 812626 - DNA, 18 bp, Homo sapiens
atgtgcaaaggtgtgctt

SEQ ID NO: 812627 - DNA, 14 bp, Homo sapiens
atgtgcaaatgcaa

SEQ ID NO: 812628 - DNA, 14 bp, Homo sapiens
atgtgcaaattttg

SEQ ID NO: 812629 - DNA, 21 bp, Homo sapiens
atgtgcaacctgtggctcagg

SEQ ID NO: 812630 - DNA, 10 bp, Homo sapiens
atgtgcaata

SEQ ID NO: 812631 - DNA, 14 bp, Homo sapiens
atgtgcaataattt

SEQ ID NO: 812632 - DNA, 13 bp, Homo sapiens
atgtgcaattgtg

SEQ ID NO: 812633 - DNA, 18 bp, Homo sapiens
atgtgcactgtcactttg

SEQ ID NO: 812634 - DNA, 19 bp, Homo sapiens
atgtgcagcgacccttggt

SEQ ID NO: 812635 - DNA, 17 bp, Homo sapiens
atgtgcagggatattgc

SEQ ID NO: 812636 - DNA, 21 bp, Homo sapiens
atgtgcagggatattgcctta

SEQ ID NO: 812637 - DNA, 19 bp, Homo sapiens
atgtgcaggtttgttacat

SEQ ID NO: 812638 - DNA, 11 bp, Homo sapiens
atgtgcatata

SEQ ID NO: 812639 - DNA, 18 bp, Homo sapiens
atgtgcattattcataaa

SEQ ID NO: 812640 - DNA, 19 bp, Homo sapiens
atgtgcattcttttaaaag

SEQ ID NO: 812641 - DNA, 20 bp, Homo sapiens
atgtgcattcttttaaaaga

SEQ ID NO: 812642 - DNA, 21 bp, Homo sapiens
atgtgcatttttgtgaaatga

SEQ ID NO: 812643 - DNA, 15 bp, Homo sapiens
atgtgccaccaacat

SEQ ID NO: 812644 - DNA, 20 bp, Homo sapiens
atgtgccagggcaatgatga

SEQ ID NO: 812645 - DNA, 15 bp, Homo sapiens
atgtgccagttcctg

SEQ ID NO: 812646 - DNA, 16 bp, Homo sapiens
atgtgccagttcctgt

SEQ ID NO: 812647 - DNA, 20 bp, Homo sapiens
atgtgccatactaatgatga

SEQ ID NO: 812648 - DNA, 14 bp, Homo sapiens
atgtgccatctgta

SEQ ID NO: 812649 - DNA, 22 bp, Homo sapiens
atgtgccattttaaaaaaaaag

SEQ ID NO: 812650 - DNA, 14 bp, Homo sapiens
atgtgcccctggcc

SEQ ID NO: 812651 - DNA, 22 bp, Homo sapiens
atgtgccctcctgagggaggac

SEQ ID NO: 812652 - DNA, 17 bp, Homo sapiens
atgtgccgaatgtgcag

SEQ ID NO: 812653 - DNA, 19 bp, Homo sapiens
atgtgcctaatggagaaga

SEQ ID NO: 812654 - DNA, 19 bp, Homo sapiens
atgtgcctgtgggaggggg

SEQ ID NO: 812655 - DNA, 14 bp, Homo sapiens
atgtgccttttctg

SEQ ID NO: 812656 - DNA, 18 bp, Homo sapiens
atgtgcggctgaactgag

SEQ ID NO: 812657 - DNA, 22 bp, Homo sapiens
atgtgctataatctgtttttac

SEQ ID NO: 812658 - DNA, 19 bp, Homo sapiens
atgtgctatacacacacac

SEQ ID NO: 812659 - DNA, 19 bp, Homo sapiens
atgtgctatactgcatact

SEQ ID NO: 812660 - DNA, 21 bp, Homo sapiens
atgtgctatcacatgtgaaaa

SEQ ID NO: 812661 - DNA, 17 bp, Homo sapiens
atgtgctattaatattt

SEQ ID NO: 812662 - DNA, 14 bp, Homo sapiens
atgtgctcagaaga

SEQ ID NO: 812663 - DNA, 21 bp, Homo sapiens
atgtgctcagccaaatttcct

SEQ ID NO: 812664 - DNA, 16 bp, Homo sapiens
atgtgctgaacattgt

SEQ ID NO: 812665 - DNA, 18 bp, Homo sapiens
atgtgctgggaaatgcag

SEQ ID NO: 812666 - DNA, 20 bp, Homo sapiens
atgtgctgggaaatgcagaa

SEQ ID NO: 812667 - DNA, 15 bp, Homo sapiens
atgtgctgggtgcct

SEQ ID NO: 812668 - DNA, 18 bp, Homo sapiens
atgtgctgggtgcctccc

SEQ ID NO: 812669 - DNA, 21 bp, Homo sapiens
atgtgctggtgaacactgtga

SEQ ID NO: 812670 - DNA, 20 bp, Homo sapiens
atgtgctgtctccatgctgg

SEQ ID NO: 812671 - DNA, 15 bp, Homo sapiens
atgtgcttttctcca

SEQ ID NO: 812672 - DNA, 16 bp, Homo sapiens
atgtggaaagtgaatt

SEQ ID NO: 812673 - DNA, 19 bp, Homo sapiens
atgtggaaagtgaatttga

SEQ ID NO: 812674 - DNA, 12 bp, Homo sapiens
atgtggaagagc

SEQ ID NO: 812675 - DNA, 18 bp, Homo sapiens
atgtggaccttagaatac

SEQ ID NO: 812676 - DNA, 23 bp, Homo sapiens
atgtggataaaactgtgtaaacc

SEQ ID NO: 812677 - DNA, 17 bp, Homo sapiens
atgtggcaaagtgctgt

SEQ ID NO: 812678 - DNA, 17 bp, Homo sapiens
atgtggcattggggggc

SEQ ID NO: 812679 - DNA, 15 bp, Homo sapiens
atgtggccctggcct

SEQ ID NO: 812680 - DNA, 16 bp, Homo sapiens
atgtggccctggcctg

SEQ ID NO: 812681 - DNA, 20 bp, Homo sapiens
atgtggccctggcctgctgg

SEQ ID NO: 812682 - DNA, 16 bp, Homo sapiens
atgtggccgaggactt

SEQ ID NO: 812683 - DNA, 13 bp, Homo sapiens
atgtggcctgccc

SEQ ID NO: 812684 - DNA, 16 bp, Homo sapiens
atgtggcctttgaatt

SEQ ID NO: 812685 - DNA, 13 bp, Homo sapiens
atgtggctcctcc

SEQ ID NO: 812686 - DNA, 10 bp, Homo sapiens
atgtggctga

SEQ ID NO: 812687 - DNA, 11 bp, Homo sapiens
atgtggctgaa

SEQ ID NO: 812688 - DNA, 14 bp, Homo sapiens
atgtggctggaaga

SEQ ID NO: 812689 - DNA, 18 bp, Homo sapiens
atgtggctgtaacctgct

SEQ ID NO: 812690 - DNA, 15 bp, Homo sapiens
atgtgggaagaaaca

SEQ ID NO: 812691 - DNA, 18 bp, Homo sapiens
atgtgggaagaaacaaac

SEQ ID NO: 812692 - DNA, 20 bp, Homo sapiens
atgtgggaagaaacaaaccc

SEQ ID NO: 812693 - DNA, 19 bp, Homo sapiens
atgtgggagctgaaccaca

SEQ ID NO: 812694 - DNA, 22 bp, Homo sapiens
atgtgggagctgaaccacagaa

SEQ ID NO: 812695 - DNA, 13 bp, Homo sapiens
atgtgggcactgg

SEQ ID NO: 812696 - DNA, 23 bp, Homo sapiens
atgttgttaaacacgtgtctata

SEQ ID NO: 812697 - DNA, 14 bp, Homo sapiens
atgttgttatttaa

SEQ ID NO: 812698 - DNA, 15 bp, Homo sapiens
atgttgttatttaaa

SEQ ID NO: 812699 - DNA, 17 bp, Homo sapiens
atgttgttatttaaaga

SEQ ID NO: 812700 - DNA, 15 bp, Homo sapiens
atgttgttcaaatgc

SEQ ID NO: 812701 - DNA, 20 bp, Homo sapiens
atgttgttcaaatgcatttt

SEQ ID NO: 812702 - DNA, 16 bp, Homo sapiens
atgttgtttataataa

SEQ ID NO: 812703 - DNA, 17 bp, Homo sapiens
atgttgtttataataaa

SEQ ID NO: 812704 - DNA, 23 bp, Homo sapiens
atgttgtttcctaatatcaaatg

SEQ ID NO: 812705 - DNA, 16 bp, Homo sapiens
atgtttaaaagaaata

SEQ ID NO: 812706 - DNA, 19 bp, Homo sapiens
atgtttaaaagaaatatat

SEQ ID NO: 812707 - DNA, 18 bp, Homo sapiens
atgtttaaaataaaatga

SEQ ID NO: 812708 - DNA, 19 bp, Homo sapiens
atgtttaaatagcctaaat

SEQ ID NO: 812709 - DNA, 18 bp, Homo sapiens
atgtttaaatcatgtatg

SEQ ID NO: 812710 - DNA, 19 bp, Homo sapiens
atgtttaaatcatgtatgt

SEQ ID NO: 812711 - DNA, 17 bp, Homo sapiens
atgtttaacaaatctaa

SEQ ID NO: 812712 - DNA, 20 bp, Homo sapiens
atgtttaatgttcattttct

SEQ ID NO: 812713 - DNA, 21 bp, Homo sapiens
atgtttacactctttgtaaga

SEQ ID NO: 812714 - DNA, 19 bp, Homo sapiens
atgtttacaggtttgaatt

SEQ ID NO: 812715 - DNA, 16 bp, Homo sapiens
atgtttacctggtgct

SEQ ID NO: 812716 - DNA, 18 bp, Homo sapiens
atgtttactttattagag

SEQ ID NO: 812717 - DNA, 16 bp, Homo sapiens
atgtttagattccagg

SEQ ID NO: 812718 - DNA, 18 bp, Homo sapiens
atgtttagattccaggat

SEQ ID NO: 812719 - DNA, 16 bp, Homo sapiens
atgtttagtagaaacg

SEQ ID NO: 812720 - DNA, 11 bp, Homo sapiens
atgtttataaa

SEQ ID NO: 812721 - DNA, 22 bp, Homo sapiens
atgtttatactgtatttctaag

SEQ ID NO: 812722 - DNA, 14 bp, Homo sapiens
atgtttatatactg

SEQ ID NO: 812723 - DNA, 22 bp, Homo sapiens
atgtttatatactgggttcttg

SEQ ID NO: 812724 - DNA, 20 bp, Homo sapiens
atgtttatatctgcaaaaaa

SEQ ID NO: 812725 - DNA, 23 bp, Homo sapiens
atgtttatatctgcaaaaaacct

SEQ ID NO: 812726 - DNA, 14 bp, Homo sapiens
atgtttatctgctt

SEQ ID NO: 812727 - DNA, 16 bp, Homo sapiens
atgtttatgagccaga

SEQ ID NO: 812728 - DNA, 20 bp, Homo sapiens
atgtttatgagccagacaaa

SEQ ID NO: 812729 - DNA, 21 bp, Homo sapiens
atgtttatgagccagacaaat

SEQ ID NO: 812730 - DNA, 18 bp, Homo sapiens
atgtttatgcaaggaagg

SEQ ID NO: 812731 - DNA, 13 bp, Homo sapiens
atgtttattaaat

SEQ ID NO: 812732 - DNA, 15 bp, Homo sapiens
atgtttattaataga

SEQ ID NO: 812733 - DNA, 17 bp, Homo sapiens
atgtttattaatagaat

SEQ ID NO: 812734 - DNA, 16 bp, Homo sapiens
atgtttattacaattt

SEQ ID NO: 812735 - DNA, 20 bp, Homo sapiens
atgtttatttaaaagagcag

SEQ ID NO: 812736 - DNA, 17 bp, Homo sapiens
atgtttatttactaatt

SEQ ID NO: 812737 - DNA, 20 bp, Homo sapiens
atgtttatttagctctgaag

SEQ ID NO: 812738 - DNA, 19 bp, Homo sapiens
atgtttcacgaagtttgtt

SEQ ID NO: 812739 - DNA, 23 bp, Homo sapiens
atgtttcactcctgcttctctca

SEQ ID NO: 812740 - DNA, 13 bp, Homo sapiens
atgtttcattatg

SEQ ID NO: 812741 - DNA, 15 bp, Homo sapiens
atgtttccagacttc

SEQ ID NO: 812742 - DNA, 13 bp, Homo sapiens
atgtttccagcag

SEQ ID NO: 812743 - DNA, 16 bp, Homo sapiens
atgtttccccatctct

SEQ ID NO: 812744 - DNA, 17 bp, Homo sapiens
atgtttccccatctctg

SEQ ID NO: 812745 - DNA, 11 bp, Homo sapiens
atgtttcctta

SEQ ID NO: 812746 - DNA, 21 bp, Homo sapiens
atgtttcgagtaaacttgaaa

SEQ ID NO: 812747 - DNA, 22 bp, Homo sapiens
atgtttcgagtaaacttgaaaa

SEQ ID NO: 812748 - DNA, 24 bp, Homo sapiens
atgtttctctttgattatttgcat

SEQ ID NO: 812749 - DNA, 23 bp, Homo sapiens
atgtttctgcagtagtctctgtg

SEQ ID NO: 812750 - DNA, 15 bp, Homo sapiens
atgtttcttctccaa

SEQ ID NO: 812751 - DNA, 21 bp, Homo sapiens
atgtttcttttgtatgtaaat

SEQ ID NO: 812752 - DNA, 18 bp, Homo sapiens
atgtttgaaaacaaaaaa

SEQ ID NO: 812753 - DNA, 12 bp, Homo sapiens
atgtttgaaatg

SEQ ID NO: 812754 - DNA, 13 bp, Homo sapiens
atgtttgatttag

SEQ ID NO: 812755 - DNA, 17 bp, Homo sapiens
atgtttgcacctttcta

SEQ ID NO: 812756 - DNA, 19 bp, Homo sapiens
atgtttgcacctttctagt

SEQ ID NO: 812757 - DNA, 22 bp, Homo sapiens
atgtttgcacctttctagttga

SEQ ID NO: 812758 - DNA, 16 bp, Homo sapiens
atgtttgccaaataaa

SEQ ID NO: 812759 - DNA, 21 bp, Homo sapiens
atgtttggaaaaaactctgaa

SEQ ID NO: 812760 - DNA, 22 bp, Homo sapiens
atgtttggaaaaaactctgaag

SEQ ID NO: 812761 - DNA, 17 bp, Homo sapiens
atgtttggattctctta

SEQ ID NO: 812762 - DNA, 23 bp, Homo sapiens
atgtttggctgctagaacatggt

SEQ ID NO: 812763 - DNA, 17 bp, Homo sapiens
atgtttgggggaaaaaa

SEQ ID NO: 812764 - DNA, 22 bp, Homo sapiens
atgtttgggggaaaaaaaagaa

SEQ ID NO: 812765 - DNA, 14 bp, Homo sapiens
atgtttgtaaaact

SEQ ID NO: 812766 - DNA, 22 bp, Homo sapiens
atgtttgtgatattaaatttca

SEQ ID NO: 812767 - DNA, 10 bp, Homo sapiens
atgtttgtgg

SEQ ID NO: 812768 - DNA, 14 bp, Homo sapiens
atgtttgtggcctc

SEQ ID NO: 812769 - DNA, 17 bp, Homo sapiens
atgtttgtgtgatttcc

SEQ ID NO: 812770 - DNA, 19 bp, Homo sapiens
atgttttaaaaaaatttga

SEQ ID NO: 812771 - DNA, 13 bp, Homo sapiens
atgttttaaagaa

SEQ ID NO: 812772 - DNA, 22 bp, Homo sapiens
atgttttaaagaatatgacttt

SEQ ID NO: 812773 - DNA, 12 bp, Homo sapiens
atgttttaccat

SEQ ID NO: 812774 - DNA, 23 bp, Homo sapiens
atgttttacgcaaggaaggactt

SEQ ID NO: 812775 - DNA, 15 bp, Homo sapiens
atgttttacgtgcaa

SEQ ID NO: 812776 - DNA, 21 bp, Homo sapiens
atgttttattggggaattaaa

SEQ ID NO: 812777 - DNA, 12 bp, Homo sapiens
atgttttcatta

SEQ ID NO: 812778 - DNA, 17 bp, Homo sapiens
atgttttcattatgttc

SEQ ID NO: 812779 - DNA, 23 bp, Homo sapiens
atgttttcctttgtcatcattgt

SEQ ID NO: 812780 - DNA, 20 bp, Homo sapiens
atgttttcgaaaatcaaatg

SEQ ID NO: 812781 - DNA, 20 bp, Homo sapiens
atgttttctgaaaatataac

SEQ ID NO: 812782 - DNA, 21 bp, Homo sapiens
atgttttctgaaaatataacc

SEQ ID NO: 812783 - DNA, 12 bp, Homo sapiens
atgttttctttc

SEQ ID NO: 812784 - DNA, 18 bp, Homo sapiens
atgttttctttgcaaagt

SEQ ID NO: 812785 - DNA, 16 bp, Homo sapiens
atgttttctttgtttc

SEQ ID NO: 812786 - DNA, 19 bp, Homo sapiens
atgttttgggatcaggagc

SEQ ID NO: 812787 - DNA, 14 bp, Homo sapiens
atgttttgtacaat

SEQ ID NO: 812788 - DNA, 19 bp, Homo sapiens
atgttttgtacaattacta

SEQ ID NO: 812789 - DNA, 21 bp, Homo sapiens
atgttttgtgactatatagag

SEQ ID NO: 812790 - DNA, 23 bp, Homo sapiens
atgttttgtgcatttgtaaatgc

SEQ ID NO: 812791 - DNA, 16 bp, Homo sapiens
atgttttgtttctgaa

SEQ ID NO: 812792 - DNA, 19 bp, Homo sapiens
atgttttgtttctgaaaat

SEQ ID NO: 812793 - DNA, 20 bp, Homo sapiens
atgttttgtttctgaaaatt

SEQ ID NO: 812794 - DNA, 20 bp, Homo sapiens
atgtttttaaaagtttcaat

SEQ ID NO: 812795 - DNA, 13 bp, Homo sapiens
atgtttttaacac

SEQ ID NO: 812796 - DNA, 15 bp, Homo sapiens
atgtttttaacacta

SEQ ID NO: 812797 - DNA, 13 bp, Homo sapiens
atgtttttaatat

SEQ ID NO: 812798 - DNA, 13 bp, Homo sapiens
atgtttttaatgt

SEQ ID NO: 812799 - DNA, 14 bp, Homo sapiens
atgtttttaatgta

SEQ ID NO: 812800 - DNA, 19 bp, Homo sapiens
atgtttttcccctgctccc

SEQ ID NO: 812801 - DNA, 13 bp, Homo sapiens
atgtttttccctc

SEQ ID NO: 812802 - DNA, 17 bp, Homo sapiens
atgtttttcctttctta

SEQ ID NO: 812803 - DNA, 19 bp, Homo sapiens
atgtttttgaaggcagaaa

SEQ ID NO: 812804 - DNA, 21 bp, Homo sapiens
atgtttttgaaggcagaaagc

SEQ ID NO: 812805 - DNA, 22 bp, Homo sapiens
atgttttttaaaatatttatct

SEQ ID NO: 812806 - DNA, 19 bp, Homo sapiens
atgttttttagatcaaata

SEQ ID NO: 812807 - DNA, 18 bp, Homo sapiens
atgttttttgccacagct

SEQ ID NO: 812808 - DNA, 22 bp, Homo sapiens
atgttttttgccacagcttttg

SEQ ID NO: 812809 - DNA, 20 bp, Homo sapiens
atgttttttgtaagataaac

SEQ ID NO: 812810 - DNA, 23 bp, Homo sapiens
atgtttttttccaatgcttctta

SEQ ID NO: 812811 - DNA, 17 bp, Homo sapiens
attaaaaaaaaaacttc

SEQ ID NO: 812812 - DNA, 14 bp, Homo sapiens
attaaaaaaaaaga

SEQ ID NO: 812813 - DNA, 15 bp, Homo sapiens
attaaaaaaaaattg

SEQ ID NO: 812814 - DNA, 14 bp, Homo sapiens
attaaaaaaaacaa

SEQ ID NO: 812815 - DNA, 15 bp, Homo sapiens
attaaaaaaaacaaa

SEQ ID NO: 812816 - DNA, 19 bp, Homo sapiens
attaaaaaaaacaaaaaga

SEQ ID NO: 812817 - DNA, 12 bp, Homo sapiens
attaagcagaaa

SEQ ID NO: 812818 - DNA, 18 bp, Homo sapiens
attaagcagaaacagcat

SEQ ID NO: 812819 - DNA, 15 bp, Homo sapiens
attaagcagtaaaaa

SEQ ID NO: 812820 - DNA, 17 bp, Homo sapiens
attaagccacttaaaat

SEQ ID NO: 812821 - DNA, 13 bp, Homo sapiens
attaagcccaatc

SEQ ID NO: 812822 - DNA, 18 bp, Homo sapiens
attaagcccacagtatat

SEQ ID NO: 812823 - DNA, 13 bp, Homo sapiens
attaaggaagaca

SEQ ID NO: 812824 - DNA, 16 bp, Homo sapiens
attaagggtaggatgt

SEQ ID NO: 812825 - DNA, 20 bp, Homo sapiens
attaaggtatttcgaaactg

SEQ ID NO: 812826 - DNA, 15 bp, Homo sapiens
attaagtaaatgctg

SEQ ID NO: 812827 - DNA, 15 bp, Homo sapiens
attaagtaatcaata

SEQ ID NO: 812828 - DNA, 18 bp, Homo sapiens
attaagtactatgtatca

SEQ ID NO: 812829 - DNA, 19 bp, Homo sapiens
attaagtactatgtatcaa

SEQ ID NO: 812830 - DNA, 14 bp, Homo sapiens
attaagtagaacaa

SEQ ID NO: 812831 - DNA, 18 bp, Homo sapiens
attaagtagaacaaaaaa

SEQ ID NO: 812832 - DNA, 22 bp, Homo sapiens
attaagtatctgggattattct

SEQ ID NO: 812833 - DNA, 17 bp, Homo sapiens
attaagtcattttgtaa

SEQ ID NO: 812834 - DNA, 21 bp, Homo sapiens
attaagtctgggatgtagaac

SEQ ID NO: 812835 - DNA, 22 bp, Homo sapiens
attaagtgactgaccatgcact

SEQ ID NO: 812836 - DNA, 16 bp, Homo sapiens
attaagtggttacttt

SEQ ID NO: 812837 - DNA, 19 bp, Homo sapiens
attaagtggttactttgtg

SEQ ID NO: 812838 - DNA, 13 bp, Homo sapiens
attaagttatctt

SEQ ID NO: 812839 - DNA, 13 bp, Homo sapiens
attaagttgttaa

SEQ ID NO: 812840 - DNA, 16 bp, Homo sapiens
attaagttttaaataa

SEQ ID NO: 812841 - DNA, 13 bp, Homo sapiens
attaataaaaaga

SEQ ID NO: 812842 - DNA, 21 bp, Homo sapiens
attaataaaactttatgtact

SEQ ID NO: 812843 - DNA, 13 bp, Homo sapiens
attaataaagcat

SEQ ID NO: 812844 - DNA, 15 bp, Homo sapiens
attaataaagcattc

SEQ ID NO: 812845 - DNA, 17 bp, Homo sapiens
attaataaagcattctt

SEQ ID NO: 812846 - DNA, 16 bp, Homo sapiens
attaataatcttatta

SEQ ID NO: 812847 - DNA, 17 bp, Homo sapiens
attaataccaaatattt

SEQ ID NO: 812848 - DNA, 18 bp, Homo sapiens
attaataccaaatatttt

SEQ ID NO: 812849 - DNA, 21 bp, Homo sapiens
attaatactctatttttacat

SEQ ID NO: 812850 - DNA, 13 bp, Homo sapiens
attaatagagttg

SEQ ID NO: 812851 - DNA, 19 bp, Homo sapiens
attaatagcttttattgta

SEQ ID NO: 812852 - DNA, 18 bp, Homo sapiens
attaatagtaatttgtaa

SEQ ID NO: 812853 - DNA, 22 bp, Homo sapiens
attaatatatagtccagacact

SEQ ID NO: 812854 - DNA, 14 bp, Homo sapiens
attaatatctttct

SEQ ID NO: 812855 - DNA, 17 bp, Homo sapiens
attaatatctttctgca

SEQ ID NO: 812856 - DNA, 19 bp, Homo sapiens
attaatatctttctgcaca

SEQ ID NO: 812857 - DNA, 13 bp, Homo sapiens
attaatattatta

SEQ ID NO: 812858 - DNA, 15 bp, Homo sapiens
attaatattattatg

SEQ ID NO: 812859 - DNA, 20 bp, Homo sapiens
attaatattattatgaattt

SEQ ID NO: 812860 - DNA, 12 bp, Homo sapiens
attaatattcct

SEQ ID NO: 812861 - DNA, 21 bp, Homo sapiens
attaatatttaggagtctatt

SEQ ID NO: 812862 - DNA, 12 bp, Homo sapiens
attaatatttgt

SEQ ID NO: 812863 - DNA, 11 bp, Homo sapiens
attaatcaaaa

SEQ ID NO: 812864 - DNA, 13 bp, Homo sapiens
attaatcaaaggc

SEQ ID NO: 812865 - DNA, 21 bp, Homo sapiens
attaatcaagagaaacttcaa

SEQ ID NO: 812866 - DNA, 16 bp, Homo sapiens
attaatcaccaaagta

SEQ ID NO: 812867 - DNA, 22 bp, Homo sapiens
attaatcagccccagagtgctt

SEQ ID NO: 812868 - DNA, 14 bp, Homo sapiens
attaatcatacaaa

SEQ ID NO: 812869 - DNA, 22 bp, Homo sapiens
attaatcttagtgtatgattac

SEQ ID NO: 812870 - DNA, 13 bp, Homo sapiens
attaatcttgtgt

SEQ ID NO: 812871 - DNA, 22 bp, Homo sapiens
attaatgaaatgataaagactt

SEQ ID NO: 812872 - DNA, 17 bp, Homo sapiens
attaatgaggtctttaa

SEQ ID NO: 812873 - DNA, 18 bp, Homo sapiens
attaatgataaactcaga

SEQ ID NO: 812874 - DNA, 19 bp, Homo sapiens
attaatgatgatcttcaga

SEQ ID NO: 812875 - DNA, 11 bp, Homo sapiens
attaatgcact

SEQ ID NO: 812876 - DNA, 15 bp, Homo sapiens
attaatgcactttct

SEQ ID NO: 812877 - DNA, 17 bp, Homo sapiens
attaatgcctgcttttt

SEQ ID NO: 812878 - DNA, 22 bp, Homo sapiens
attaatgcctgctttttggaaa

SEQ ID NO: 812879 - DNA, 15 bp, Homo sapiens
attaatggaaatgtt

SEQ ID NO: 812880 - DNA, 18 bp, Homo sapiens
attaatgtataatttgag

SEQ ID NO: 812881 - DNA, 18 bp, Homo sapiens
attaatgttaattcagca

SEQ ID NO: 812882 - DNA, 18 bp, Homo sapiens
attaatgtttatttagct

SEQ ID NO: 812883 - DNA, 23 bp, Homo sapiens
attaatgtttatttagctctgaa

SEQ ID NO: 812884 - DNA, 18 bp, Homo sapiens
attaatgtttctatctga

SEQ ID NO: 812885 - DNA, 17 bp, Homo sapiens
attaatgtttcttaaat

SEQ ID NO: 812886 - DNA, 15 bp, Homo sapiens
attaatgttttcatt

SEQ ID NO: 812887 - DNA, 16 bp, Homo sapiens
attaatgttttcatta

SEQ ID NO: 812888 - DNA, 16 bp, Homo sapiens
attaatgttttgtaca

SEQ ID NO: 812889 - DNA, 14 bp, Homo sapiens
attaattacataca

SEQ ID NO: 812890 - DNA, 16 bp, Homo sapiens
attaattagttccagt

SEQ ID NO: 812891 - DNA, 14 bp, Homo sapiens
attaattctataag

SEQ ID NO: 812892 - DNA, 17 bp, Homo sapiens
attaattcttcacctgt

SEQ ID NO: 812893 - DNA, 18 bp, Homo sapiens
attaattgcctgttaaat

SEQ ID NO: 812894 - DNA, 19 bp, Homo sapiens
attaattgcctgttaaata

SEQ ID NO: 812895 - DNA, 13 bp, Homo sapiens
attaattgctttg

SEQ ID NO: 812896 - DNA, 19 bp, Homo sapiens
attaattgggccagctttt

SEQ ID NO: 812897 - DNA, 18 bp, Homo sapiens
attaattgtcctgtgtct

SEQ ID NO: 812898 - DNA, 10 bp, Homo sapiens
attaatttat

SEQ ID NO: 812899 - DNA, 21 bp, Homo sapiens
attaatttctgccatttcatg

SEQ ID NO: 812900 - DNA, 22 bp, Homo sapiens
attaatttgagaattattcctt

SEQ ID NO: 812901 - DNA, 15 bp, Homo sapiens
attaattttgtgcat

SEQ ID NO: 812902 - DNA, 17 bp, Homo sapiens
attaattttgtgcattc

SEQ ID NO: 812903 - DNA, 14 bp, Homo sapiens
attacaaatcagaa

SEQ ID NO: 812904 - DNA, 19 bp, Homo sapiens
attacaaatcagaagtcat

SEQ ID NO: 812905 - DNA, 22 bp, Homo sapiens
attacaaatcagaagtcatctt

SEQ ID NO: 812906 - DNA, 19 bp, Homo sapiens
attacaaatgcaaatttct

SEQ ID NO: 812907 - DNA, 15 bp, Homo sapiens
attacaacagtgaga

SEQ ID NO: 812908 - DNA, 14 bp, Homo sapiens
attacaagtggctc

SEQ ID NO: 812909 - DNA, 18 bp, Homo sapiens
attacaagtggctcccca

SEQ ID NO: 812910 - DNA, 20 bp, Homo sapiens
attacaagtggctccccacc

SEQ ID NO: 812911 - DNA, 21 bp, Homo sapiens
attacaagtggctccccacct

SEQ ID NO: 812912 - DNA, 14 bp, Homo sapiens
attacaattttatc

SEQ ID NO: 812913 - DNA, 15 bp, Homo sapiens
attacaattttatct

SEQ ID NO: 812914 - DNA, 12 bp, Homo sapiens
attacaattttt

SEQ ID NO: 812915 - DNA, 18 bp, Homo sapiens
attacaatttttaataaa

SEQ ID NO: 812916 - DNA, 17 bp, Homo sapiens
attacacaataaagcag

SEQ ID NO: 812917 - DNA, 21 bp, Homo sapiens
attacaccaccggccccctcc

SEQ ID NO: 812918 - DNA, 19 bp, Homo sapiens
attacactgtatttgtatc

SEQ ID NO: 812919 - DNA, 20 bp, Homo sapiens
attacactgtgccttttccc

SEQ ID NO: 812920 - DNA, 17 bp, Homo sapiens
attacagaaccaaatcg

SEQ ID NO: 812921 - DNA, 18 bp, Homo sapiens
attacagagaggagaaac

SEQ ID NO: 812922 - DNA, 21 bp, Homo sapiens
attacagagaggagaaacaca

SEQ ID NO: 812923 - DNA, 16 bp, Homo sapiens
attacagatctgcacc

SEQ ID NO: 812924 - DNA, 21 bp, Homo sapiens
attacagatgggcaaattaag

SEQ ID NO: 812925 - DNA, 20 bp, Homo sapiens
attacaggcacctaccacca

SEQ ID NO: 812926 - DNA, 20 bp, Homo sapiens
attacaggcacctgccacca

SEQ ID NO: 812927 - DNA, 16 bp, Homo sapiens
attacaggcatgtgcc

SEQ ID NO: 812928 - DNA, 12 bp, Homo sapiens
attacagtgaaa

SEQ ID NO: 812929 - DNA, 21 bp, Homo sapiens
attacagtgaaattttggtga

SEQ ID NO: 812930 - DNA, 15 bp, Homo sapiens
attacagtgggtgcc

SEQ ID NO: 812931 - DNA, 22 bp, Homo sapiens
attacagtgtttatcctttcat

SEQ ID NO: 812932 - DNA, 15 bp, Homo sapiens
attacagttcataat

SEQ ID NO: 812933 - DNA, 15 bp, Homo sapiens
attacagttctttcc

SEQ ID NO: 812934 - DNA, 16 bp, Homo sapiens
attacagttctttcct

SEQ ID NO: 812935 - DNA, 19 bp, Homo sapiens
attacagttctttcctctt

SEQ ID NO: 812936 - DNA, 13 bp, Homo sapiens
attacatacagat

SEQ ID NO: 812937 - DNA, 21 bp, Homo sapiens
attacatacagattttaccta

SEQ ID NO: 812938 - DNA, 18 bp, Homo sapiens
attacatagaacacttca

SEQ ID NO: 812939 - DNA, 22 bp, Homo sapiens
attacatagaacacttcagaca

SEQ ID NO: 812940 - DNA, 12 bp, Homo sapiens
attatgacagtt

SEQ ID NO: 812941 - DNA, 17 bp, Homo sapiens
attatgacagttatact

SEQ ID NO: 812942 - DNA, 19 bp, Homo sapiens
attatgacagttatactgt

SEQ ID NO: 812943 - DNA, 15 bp, Homo sapiens
attatgagctacaac

SEQ ID NO: 812944 - DNA, 16 bp, Homo sapiens
attatgagtttgctta

SEQ ID NO: 812945 - DNA, 17 bp, Homo sapiens
attatgatgcatacagt

SEQ ID NO: 812946 - DNA, 18 bp, Homo sapiens
attatgatgcatacagtt

SEQ ID NO: 812947 - DNA, 21 bp, Homo sapiens
attatgatgcatacagttttc

SEQ ID NO: 812948 - DNA, 14 bp, Homo sapiens
attatgcaaaagca

SEQ ID NO: 812949 - DNA, 23 bp, Homo sapiens
attatgcacttttagaaatgcat

SEQ ID NO: 812950 - DNA, 12 bp, Homo sapiens
attatgcataaa

SEQ ID NO: 812951 - DNA, 23 bp, Homo sapiens
attatgcatgaagtaatatgcac

SEQ ID NO: 812952 - DNA, 16 bp, Homo sapiens
attatgctttctttgg

SEQ ID NO: 812953 - DNA, 13 bp, Homo sapiens
attatgctttgaa

SEQ ID NO: 812954 - DNA, 15 bp, Homo sapiens
attatggaaaaataa

SEQ ID NO: 812955 - DNA, 20 bp, Homo sapiens
attatggaaaaataaaactg

SEQ ID NO: 812956 - DNA, 14 bp, Homo sapiens
attatggaaacaga

SEQ ID NO: 812957 - DNA, 17 bp, Homo sapiens
attatggaagattttaa

SEQ ID NO: 812958 - DNA, 20 bp, Homo sapiens
attatggaagattttaaatt

SEQ ID NO: 812959 - DNA, 13 bp, Homo sapiens
attatggcatttc

SEQ ID NO: 812960 - DNA, 23 bp, Homo sapiens
attatgggttaggcattaatgtt

SEQ ID NO: 812961 - DNA, 18 bp, Homo sapiens
attatgtaacatccagaa

SEQ ID NO: 812962 - DNA, 19 bp, Homo sapiens
attatgtaacatccagaag

SEQ ID NO: 812963 - DNA, 17 bp, Homo sapiens
attatgtccactgtgta

SEQ ID NO: 812964 - DNA, 19 bp, Homo sapiens
attatgtccactgtgtata

SEQ ID NO: 812965 - DNA, 21 bp, Homo sapiens
attatgtctcttgagcatcaa

SEQ ID NO: 812966 - DNA, 12 bp, Homo sapiens
attatgtcttct

SEQ ID NO: 812967 - DNA, 12 bp, Homo sapiens
attatgtgactt

SEQ ID NO: 812968 - DNA, 13 bp, Homo sapiens
attatgtgacttg

SEQ ID NO: 812969 - DNA, 19 bp, Homo sapiens
attatgtgcctaattttct

SEQ ID NO: 812970 - DNA, 12 bp, Homo sapiens
attatgttcatg

SEQ ID NO: 812971 - DNA, 14 bp, Homo sapiens
attatgttcatgta

SEQ ID NO: 812972 - DNA, 20 bp, Homo sapiens
attatgttcatgtaagaagc

SEQ ID NO: 812973 - DNA, 13 bp, Homo sapiens
attatgttgttca

SEQ ID NO: 812974 - DNA, 15 bp, Homo sapiens
attatgtttattaca

SEQ ID NO: 812975 - DNA, 18 bp, Homo sapiens
attatgtttattacaatt

SEQ ID NO: 812976 - DNA, 22 bp, Homo sapiens
attatgtttcctaactgtgatt

SEQ ID NO: 812977 - DNA, 19 bp, Homo sapiens
attattaataccaaatatt

SEQ ID NO: 812978 - DNA, 20 bp, Homo sapiens
attattaattgtcctgtgtc

SEQ ID NO: 812979 - DNA, 13 bp, Homo sapiens
attattaatttat

SEQ ID NO: 812980 - DNA, 17 bp, Homo sapiens
attattaatttattggg

SEQ ID NO: 812981 - DNA, 19 bp, Homo sapiens
attattaccagcatttgtc

SEQ ID NO: 812982 - DNA, 22 bp, Homo sapiens
attattactaattctatttctc

SEQ ID NO: 812983 - DNA, 16 bp, Homo sapiens
attattacttctgttt

SEQ ID NO: 812984 - DNA, 22 bp, Homo sapiens
attattacttttcctcttagaa

SEQ ID NO: 812985 - DNA, 11 bp, Homo sapiens
attattagaac

SEQ ID NO: 812986 - DNA, 17 bp, Homo sapiens
attattagataatattt

SEQ ID NO: 812987 - DNA, 15 bp, Homo sapiens
attattataaaaggg

SEQ ID NO: 812988 - DNA, 15 bp, Homo sapiens
attattataaactat

SEQ ID NO: 812989 - DNA, 15 bp, Homo sapiens
attattatatacata

SEQ ID NO: 812990 - DNA, 14 bp, Homo sapiens
attattatatatat

SEQ ID NO: 812991 - DNA, 16 bp, Homo sapiens
attattattgctgaag

SEQ ID NO: 812992 - DNA, 13 bp, Homo sapiens
attattatttctg

SEQ ID NO: 812993 - DNA, 14 bp, Homo sapiens
attattatttctgt

SEQ ID NO: 812994 - DNA, 16 bp, Homo sapiens
attattatttctgttc

SEQ ID NO: 812995 - DNA, 15 bp, Homo sapiens
attattatttgtgtt

SEQ ID NO: 812996 - DNA, 19 bp, Homo sapiens
attattcaaaaaatcatgt

SEQ ID NO: 812997 - DNA, 13 bp, Homo sapiens
attattcaaagat

SEQ ID NO: 812998 - DNA, 16 bp, Homo sapiens
attattcaaagatcct

SEQ ID NO: 812999 - DNA, 21 bp, Homo sapiens
attattcaagaatgaaaaata

SEQ ID NO: 813000 - DNA, 17 bp, Homo sapiens
attattcaagtgcctct

SEQ ID NO: 813001 - DNA, 14 bp, Homo sapiens
attattcactagta

SEQ ID NO: 813002 - DNA, 23 bp, Homo sapiens
attattcagaactatttaaaata

SEQ ID NO: 813003 - DNA, 16 bp, Homo sapiens
attattcagtgaattt

SEQ ID NO: 813004 - DNA, 20 bp, Homo sapiens
attattcagtgaatttgtcc

SEQ ID NO: 813005 - DNA, 15 bp, Homo sapiens
attattcatttaaaa

SEQ ID NO: 813006 - DNA, 16 bp, Homo sapiens
attattcatttaaaat

SEQ ID NO: 813007 - DNA, 20 bp, Homo sapiens
attattccaaagttatttca

SEQ ID NO: 813008 - DNA, 12 bp, Homo sapiens
attattcctcag

SEQ ID NO: 813009 - DNA, 16 bp, Homo sapiens
attattccttcttcta

SEQ ID NO: 813010 - DNA, 15 bp, Homo sapiens
attattctgcctacg

SEQ ID NO: 813011 - DNA, 14 bp, Homo sapiens
attattctgttttg

SEQ ID NO: 813012 - DNA, 12 bp, Homo sapiens
attattcttgag

SEQ ID NO: 813013 - DNA, 17 bp, Homo sapiens
attattcttgagttttt

SEQ ID NO: 813014 - DNA, 12 bp, Homo sapiens
attattgacact

SEQ ID NO: 813015 - DNA, 13 bp, Homo sapiens
attattgacactg

SEQ ID NO: 813016 - DNA, 16 bp, Homo sapiens
attattgacactgaac

SEQ ID NO: 813017 - DNA, 18 bp, Homo sapiens
attattgacactgaactt

SEQ ID NO: 813018 - DNA, 15 bp, Homo sapiens
attattgatagtact

SEQ ID NO: 813019 - DNA, 22 bp, Homo sapiens
attattggttggtgtgaagaaa

SEQ ID NO: 813020 - DNA, 14 bp, Homo sapiens
attattgtaaactt

SEQ ID NO: 813021 - DNA, 15 bp, Homo sapiens
attattgtagacatg

SEQ ID NO: 813022 - DNA, 21 bp, Homo sapiens
attattgtttatgccaaatgt

SEQ ID NO: 813023 - DNA, 11 bp, Homo sapiens
attatttaaac

SEQ ID NO: 813024 - DNA, 13 bp, Homo sapiens
attatttaaagaa

SEQ ID NO: 813025 - DNA, 14 bp, Homo sapiens
attatttaaagaaa

SEQ ID NO: 813026 - DNA, 18 bp, Homo sapiens
attatttaaataaaatca

SEQ ID NO: 813027 - DNA, 19 bp, Homo sapiens
attatttaagactaaaagt

SEQ ID NO: 813028 - DNA, 13 bp, Homo sapiens
attatttaataaa

SEQ ID NO: 813029 - DNA, 14 bp, Homo sapiens
attatttaatgttt

SEQ ID NO: 813030 - DNA, 14 bp, Homo sapiens
attatttaatttgt

SEQ ID NO: 813031 - DNA, 22 bp, Homo sapiens
attatttacatcactttgtgaa

SEQ ID NO: 813032 - DNA, 13 bp, Homo sapiens
attatttatatgg

SEQ ID NO: 813033 - DNA, 16 bp, Homo sapiens
attatttatatttcct

SEQ ID NO: 813034 - DNA, 14 bp, Homo sapiens
attatttatgacct

SEQ ID NO: 813035 - DNA, 15 bp, Homo sapiens
attatttatgacctg

SEQ ID NO: 813036 - DNA, 14 bp, Homo sapiens
attatttattactt

SEQ ID NO: 813037 - DNA, 22 bp, Homo sapiens
attatttattacttgtgcactt

SEQ ID NO: 813038 - DNA, 23 bp, Homo sapiens
attatttattcagcttcatttgt

SEQ ID NO: 813039 - DNA, 17 bp, Homo sapiens
attatttatttaataac

SEQ ID NO: 813040 - DNA, 20 bp, Homo sapiens
attatttcatatactataat

SEQ ID NO: 813041 - DNA, 22 bp, Homo sapiens
attatttctccatcccctccct

SEQ ID NO: 813042 - DNA, 15 bp, Homo sapiens
attatttctgtcaca

SEQ ID NO: 813043 - DNA, 12 bp, Homo sapiens
attatttcttct

SEQ ID NO: 813044 - DNA, 13 bp, Homo sapiens
attatttcttctc

SEQ ID NO: 813045 - DNA, 12 bp, Homo sapiens
attatttgatat

SEQ ID NO: 813046 - DNA, 16 bp, Homo sapiens
attatttgattattta

SEQ ID NO: 813047 - DNA, 14 bp, Homo sapiens
attatttgcatgtt

SEQ ID NO: 813048 - DNA, 15 bp, Homo sapiens
attatttgcatgtta

SEQ ID NO: 813049 - DNA, 19 bp, Homo sapiens
attatttgcatgttatgtt

SEQ ID NO: 813050 - DNA, 13 bp, Homo sapiens
attatttgctaag

SEQ ID NO: 813051 - DNA, 12 bp, Homo sapiens
attatttgtctt

SEQ ID NO: 813052 - DNA, 15 bp, Homo sapiens
attatttgtgcattt

SEQ ID NO: 813053 - DNA, 20 bp, Homo sapiens
attatttgtgcattttattg

SEQ ID NO: 813054 - DNA, 22 bp, Homo sapiens
attatttgtgttttaatttaaa

SEQ ID NO: 813055 - DNA, 17 bp, Homo sapiens
attatttgtttagatgt

SEQ ID NO: 813056 - DNA, 13 bp, Homo sapiens
attattttaaaat

SEQ ID NO: 813057 - DNA, 15 bp, Homo sapiens
attattttaaacaaa

SEQ ID NO: 813058 - DNA, 21 bp, Homo sapiens
attattttaaacaaaatagaa

SEQ ID NO: 813059 - DNA, 19 bp, Homo sapiens
attattttagcttcagttg

SEQ ID NO: 813060 - DNA, 16 bp, Homo sapiens
attattttctgtcaga

SEQ ID NO: 813061 - DNA, 21 bp, Homo sapiens
attattttcttcatccaactt

SEQ ID NO: 813062 - DNA, 16 bp, Homo sapiens
attattttgaatgtca

SEQ ID NO: 813063 - DNA, 19 bp, Homo sapiens
attattttggtacttttat

SEQ ID NO: 813064 - DNA, 16 bp, Homo sapiens
attcagccttcttttt

SEQ ID NO: 813065 - DNA, 17 bp, Homo sapiens
attcagccttctttttc

SEQ ID NO: 813066 - DNA, 20 bp, Homo sapiens
attcagccttctttttctgg

SEQ ID NO: 813067 - DNA, 22 bp, Homo sapiens
attcagccttctttttctggac

SEQ ID NO: 813068 - DNA, 18 bp, Homo sapiens
attcagcgaagtctcatg

SEQ ID NO: 813069 - DNA, 18 bp, Homo sapiens
attcagctagaatttctg

SEQ ID NO: 813070 - DNA, 14 bp, Homo sapiens
attcagctcattat

SEQ ID NO: 813071 - DNA, 20 bp, Homo sapiens
attcagctcattatgaaaaa

SEQ ID NO: 813072 - DNA, 22 bp, Homo sapiens
attcaggaaaactgacagagga

SEQ ID NO: 813073 - DNA, 16 bp, Homo sapiens
attcaggaagatgaaa

SEQ ID NO: 813074 - DNA, 21 bp, Homo sapiens
attcaggaatgtgtggcctgc

SEQ ID NO: 813075 - DNA, 10 bp, Homo sapiens
attcaggacg

SEQ ID NO: 813076 - DNA, 11 bp, Homo sapiens
attcaggactc

SEQ ID NO: 813077 - DNA, 15 bp, Homo sapiens
attcaggcactgaga

SEQ ID NO: 813078 - DNA, 17 bp, Homo sapiens
attcaggcactgagaat

SEQ ID NO: 813079 - DNA, 16 bp, Homo sapiens
attcaggccagcccag

SEQ ID NO: 813080 - DNA, 19 bp, Homo sapiens
attcaggccagcccagcca

SEQ ID NO: 813081 - DNA, 21 bp, Homo sapiens
attcaggccagcccagccagg

SEQ ID NO: 813082 - DNA, 11 bp, Homo sapiens
attcaggctgc

SEQ ID NO: 813083 - DNA, 19 bp, Homo sapiens
attcaggggaagggcaggc

SEQ ID NO: 813084 - DNA, 13 bp, Homo sapiens
attcaggggcttt

SEQ ID NO: 813085 - DNA, 22 bp, Homo sapiens
attcaggggctttgggcccaag

SEQ ID NO: 813086 - DNA, 16 bp, Homo sapiens
attcaggtttttcctt

SEQ ID NO: 813087 - DNA, 19 bp, Homo sapiens
attcagtattaaagggggg

SEQ ID NO: 813088 - DNA, 12 bp, Homo sapiens
attcagtatttt

SEQ ID NO: 813089 - DNA, 14 bp, Homo sapiens
attcagtattttgc

SEQ ID NO: 813090 - DNA, 23 bp, Homo sapiens
attcagtctctgaatacacagta

SEQ ID NO: 813091 - DNA, 13 bp, Homo sapiens
attcagtgaattt

SEQ ID NO: 813092 - DNA, 16 bp, Homo sapiens
attcagtgaatttgtc

SEQ ID NO: 813093 - DNA, 16 bp, Homo sapiens
attcagtgagggtctt

SEQ ID NO: 813094 - DNA, 19 bp, Homo sapiens
attcagtgattactgtcaa

SEQ ID NO: 813095 - DNA, 17 bp, Homo sapiens
attcagtgctgtggcct

SEQ ID NO: 813096 - DNA, 22 bp, Homo sapiens
attcagtgctgtggcctgggca

SEQ ID NO: 813097 - DNA, 15 bp, Homo sapiens
attcagtttttgtat

SEQ ID NO: 813098 - DNA, 16 bp, Homo sapiens
attcagtttttgtatc

SEQ ID NO: 813099 - DNA, 18 bp, Homo sapiens
attcagtttttgtatctt

SEQ ID NO: 813100 - DNA, 16 bp, Homo sapiens
attcataaaaactgct

SEQ ID NO: 813101 - DNA, 12 bp, Homo sapiens
attcataaatct

SEQ ID NO: 813102 - DNA, 22 bp, Homo sapiens
attcataatgaattataacagt

SEQ ID NO: 813103 - DNA, 22 bp, Homo sapiens
attcatagggaaaggttttgta

SEQ ID NO: 813104 - DNA, 14 bp, Homo sapiens
attcatataaaagt

SEQ ID NO: 813105 - DNA, 17 bp, Homo sapiens
attcatattaagacagt

SEQ ID NO: 813106 - DNA, 13 bp, Homo sapiens
attcatattgaat

SEQ ID NO: 813107 - DNA, 19 bp, Homo sapiens
attcatccaggactgagat

SEQ ID NO: 813108 - DNA, 17 bp, Homo sapiens
attcatcccttaattta

SEQ ID NO: 813109 - DNA, 13 bp, Homo sapiens
attcatctctggt

SEQ ID NO: 813110 - DNA, 19 bp, Homo sapiens
attcatctctggttttctt

SEQ ID NO: 813111 - DNA, 20 bp, Homo sapiens
attcatctgtttttcttttt

SEQ ID NO: 813112 - DNA, 17 bp, Homo sapiens
attcatgacattatgtg

SEQ ID NO: 813113 - DNA, 15 bp, Homo sapiens
attcatgccatctgt

SEQ ID NO: 813114 - DNA, 14 bp, Homo sapiens
attcatgtaacagt

SEQ ID NO: 813115 - DNA, 17 bp, Homo sapiens
attcatgtaacagttgt

SEQ ID NO: 813116 - DNA, 16 bp, Homo sapiens
attcatgtaactctcc

SEQ ID NO: 813117 - DNA, 15 bp, Homo sapiens
attcatgtattttgt

SEQ ID NO: 813118 - DNA, 21 bp, Homo sapiens
attcatgtttaacgtttctca

SEQ ID NO: 813119 - DNA, 16 bp, Homo sapiens
attcattaagcttttt

SEQ ID NO: 813120 - DNA, 21 bp, Homo sapiens
attcattaagtaatcttttta

SEQ ID NO: 813121 - DNA, 13 bp, Homo sapiens
attcattaattag

SEQ ID NO: 813122 - DNA, 15 bp, Homo sapiens
attcattagtcatgt

SEQ ID NO: 813123 - DNA, 15 bp, Homo sapiens
attcattatttgtca

SEQ ID NO: 813124 - DNA, 16 bp, Homo sapiens
attcattatttgtcaa

SEQ ID NO: 813125 - DNA, 19 bp, Homo sapiens
attcattatttttccactt

SEQ ID NO: 813126 - DNA, 20 bp, Homo sapiens
attcattctcataattccta

SEQ ID NO: 813127 - DNA, 14 bp, Homo sapiens
attcattcttagct

SEQ ID NO: 813128 - DNA, 20 bp, Homo sapiens
attcattgagcagttagctc

SEQ ID NO: 813129 - DNA, 15 bp, Homo sapiens
attcatttaaaatga

SEQ ID NO: 813130 - DNA, 14 bp, Homo sapiens
attcatttcatggt

SEQ ID NO: 813131 - DNA, 11 bp, Homo sapiens
attcatttcta

SEQ ID NO: 813132 - DNA, 15 bp, Homo sapiens
attcattttactcag

SEQ ID NO: 813133 - DNA, 12 bp, Homo sapiens
attcattttcct

SEQ ID NO: 813134 - DNA, 22 bp, Homo sapiens
attcattttcctgttcagtgag

SEQ ID NO: 813135 - DNA, 16 bp, Homo sapiens
attcattttctagata

SEQ ID NO: 813136 - DNA, 14 bp, Homo sapiens
attcattttctcta

SEQ ID NO: 813137 - DNA, 16 bp, Homo sapiens
attcattttctctaat

SEQ ID NO: 813138 - DNA, 22 bp, Homo sapiens
attccaaaatacaatgttatca

SEQ ID NO: 813139 - DNA, 12 bp, Homo sapiens
attccaaaatat

SEQ ID NO: 813140 - DNA, 18 bp, Homo sapiens
attccaaaccaaatttta

SEQ ID NO: 813141 - DNA, 17 bp, Homo sapiens
attccaaagttatttca

SEQ ID NO: 813142 - DNA, 23 bp, Homo sapiens
attccaacaatggggtgggccca

SEQ ID NO: 813143 - DNA, 20 bp, Homo sapiens
attccaacatttctcactga

SEQ ID NO: 813144 - DNA, 15 bp, Homo sapiens
attccaactcctgat

SEQ ID NO: 813145 - DNA, 16 bp, Homo sapiens
attccaactcctgatg

SEQ ID NO: 813146 - DNA, 18 bp, Homo sapiens
attccaacttgaaggatt

SEQ ID NO: 813147 - DNA, 16 bp, Homo sapiens
attccaaggaaaattg

SEQ ID NO: 813148 - DNA, 19 bp, Homo sapiens
attccaagtcaacactctt

SEQ ID NO: 813149 - DNA, 23 bp, Homo sapiens
attccaatgatacccaacagttt

SEQ ID NO: 813150 - DNA, 19 bp, Homo sapiens
attccaattctaaatccga

SEQ ID NO: 813151 - DNA, 18 bp, Homo sapiens
attccaccattcacattt

SEQ ID NO: 813152 - DNA, 22 bp, Homo sapiens
attccaccttaaattaaacaat

SEQ ID NO: 813153 - DNA, 23 bp, Homo sapiens
attccaccttaaattaaacaatt

SEQ ID NO: 813154 - DNA, 15 bp, Homo sapiens
attccacgtgcccct

SEQ ID NO: 813155 - DNA, 16 bp, Homo sapiens
attccactacacctgg

SEQ ID NO: 813156 - DNA, 18 bp, Homo sapiens
attccactacacctggct

SEQ ID NO: 813157 - DNA, 19 bp, Homo sapiens
attccactacacctggctg

SEQ ID NO: 813158 - DNA, 22 bp, Homo sapiens
attccactacacctggctgagg

SEQ ID NO: 813159 - DNA, 16 bp, Homo sapiens
attccactccactcag

SEQ ID NO: 813160 - DNA, 15 bp, Homo sapiens
attccactgaaaatt

SEQ ID NO: 813161 - DNA, 16 bp, Homo sapiens
attccagaaaggatat

SEQ ID NO: 813162 - DNA, 15 bp, Homo sapiens
attccagaacaaatt

SEQ ID NO: 813163 - DNA, 22 bp, Homo sapiens
attccagaagaagagaagctgc

SEQ ID NO: 813164 - DNA, 16 bp, Homo sapiens
attccagaatatctgg

SEQ ID NO: 813165 - DNA, 19 bp, Homo sapiens
attccagaatcttgacttt

SEQ ID NO: 813166 - DNA, 14 bp, Homo sapiens
attccagaatgctg

SEQ ID NO: 813167 - DNA, 23 bp, Homo sapiens
attccagaatgctgtacatctat

SEQ ID NO: 813168 - DNA, 21 bp, Homo sapiens
attccagagagtggctcctcc

SEQ ID NO: 813169 - DNA, 18 bp, Homo sapiens
attccagaggactctgct

SEQ ID NO: 813170 - DNA, 15 bp, Homo sapiens
attccagagtgctga

SEQ ID NO: 813171 - DNA, 22 bp, Homo sapiens
attccagatgagtcagtctctt

SEQ ID NO: 813172 - DNA, 16 bp, Homo sapiens
attccagcaataagaa

SEQ ID NO: 813173 - DNA, 22 bp, Homo sapiens
attccagcaataagaaatgaac

SEQ ID NO: 813174 - DNA, 23 bp, Homo sapiens
attccagcagtgaaacttgtgct

SEQ ID NO: 813175 - DNA, 17 bp, Homo sapiens
attccagcagtgaatgc

SEQ ID NO: 813176 - DNA, 10 bp, Homo sapiens
attccagcca

SEQ ID NO: 813177 - DNA, 19 bp, Homo sapiens
attccagccaggcccaggc

SEQ ID NO: 813178 - DNA, 20 bp, Homo sapiens
attccagccaggcccaggcc

SEQ ID NO: 813179 - DNA, 13 bp, Homo sapiens
attccagcccctc

SEQ ID NO: 813180 - DNA, 21 bp, Homo sapiens
attccaggatggtttggaaac

SEQ ID NO: 813181 - DNA, 14 bp, Homo sapiens
attccagggctggg

SEQ ID NO: 813182 - DNA, 15 bp, Homo sapiens
attccagggctgggg

SEQ ID NO: 813183 - DNA, 16 bp, Homo sapiens
attccaggtttaagta

SEQ ID NO: 813184 - DNA, 18 bp, Homo sapiens
attccagtacagtattct

SEQ ID NO: 813185 - DNA, 23 bp, Homo sapiens
attccagtacagtattcttttaa

SEQ ID NO: 813186 - DNA, 16 bp, Homo sapiens
attctgatttcagttt

SEQ ID NO: 813187 - DNA, 16 bp, Homo sapiens
attctgcaactagcca

SEQ ID NO: 813188 - DNA, 19 bp, Homo sapiens
attctgcaagcacatctgc

SEQ ID NO: 813189 - DNA, 21 bp, Homo sapiens
attctgcacgctgcccagggg

SEQ ID NO: 813190 - DNA, 13 bp, Homo sapiens
attctgcagcatg

SEQ ID NO: 813191 - DNA, 18 bp, Homo sapiens
attctgcagtaaatcttt

SEQ ID NO: 813192 - DNA, 23 bp, Homo sapiens
attctgcagtaaatcttttacaa

SEQ ID NO: 813193 - DNA, 13 bp, Homo sapiens
attctgcctctcc

SEQ ID NO: 813194 - DNA, 11 bp, Homo sapiens
attctgcctgc

SEQ ID NO: 813195 - DNA, 21 bp, Homo sapiens
attctgcctgcctcctccctc

SEQ ID NO: 813196 - DNA, 13 bp, Homo sapiens
attctgcctgctc

SEQ ID NO: 813197 - DNA, 13 bp, Homo sapiens
attctgccttggt

SEQ ID NO: 813198 - DNA, 17 bp, Homo sapiens
attctgccttggttctg

SEQ ID NO: 813199 - DNA, 23 bp, Homo sapiens
attctgccttggttctggccacc

SEQ ID NO: 813200 - DNA, 15 bp, Homo sapiens
attctgctacctcac

SEQ ID NO: 813201 - DNA, 24 bp, Homo sapiens
attctgctacttcactgtcatctt

SEQ ID NO: 813202 - DNA, 17 bp, Homo sapiens
attctgctctattatat

SEQ ID NO: 813203 - DNA, 18 bp, Homo sapiens
attctggaaaaaaaatat

SEQ ID NO: 813204 - DNA, 21 bp, Homo sapiens
attctggaaaaaaaatatata

SEQ ID NO: 813205 - DNA, 23 bp, Homo sapiens
attctggaaaaaaaatatatata

SEQ ID NO: 813206 - DNA, 19 bp, Homo sapiens
attctggaaacttttgtta

SEQ ID NO: 813207 - DNA, 17 bp, Homo sapiens
attctggatctgaccct

SEQ ID NO: 813208 - DNA, 14 bp, Homo sapiens
attctgggaaggga

SEQ ID NO: 813209 - DNA, 23 bp, Homo sapiens
attctggtagggatatggcagga

SEQ ID NO: 813210 - DNA, 17 bp, Homo sapiens
attctggtatacattga

SEQ ID NO: 813211 - DNA, 15 bp, Homo sapiens
attctgtagattctg

SEQ ID NO: 813212 - DNA, 15 bp, Homo sapiens
attctgtcatttaca

SEQ ID NO: 813213 - DNA, 16 bp, Homo sapiens
attctgtccctgtccc

SEQ ID NO: 813214 - DNA, 22 bp, Homo sapiens
attctgtgaccaaaataccttg

SEQ ID NO: 813215 - DNA, 21 bp, Homo sapiens
attctgtgcctccaggaccag

SEQ ID NO: 813216 - DNA, 17 bp, Homo sapiens
attctgtgtgttttcat

SEQ ID NO: 813217 - DNA, 21 bp, Homo sapiens
attctgtgtgttttcataata

SEQ ID NO: 813218 - DNA, 23 bp, Homo sapiens
attctgtgtgttttcataataaa

SEQ ID NO: 813219 - DNA, 19 bp, Homo sapiens
attctgttccctgggctga

SEQ ID NO: 813220 - DNA, 20 bp, Homo sapiens
attctgttgcatagactagt

SEQ ID NO: 813221 - DNA, 17 bp, Homo sapiens
attctgttgttccattt

SEQ ID NO: 813222 - DNA, 20 bp, Homo sapiens
attctgtttattcttccaga

SEQ ID NO: 813223 - DNA, 15 bp, Homo sapiens
attctgtttcctctt

SEQ ID NO: 813224 - DNA, 15 bp, Homo sapiens
attctgtttgccttt

SEQ ID NO: 813225 - DNA, 17 bp, Homo sapiens
attctgttttgttaata

SEQ ID NO: 813226 - DNA, 22 bp, Homo sapiens
attcttaacacagccttccttc

SEQ ID NO: 813227 - DNA, 22 bp, Homo sapiens
attcttaagggaacttccacat

SEQ ID NO: 813228 - DNA, 19 bp, Homo sapiens
attcttacaattgcactgc

SEQ ID NO: 813229 - DNA, 15 bp, Homo sapiens
attcttacatgtttt

SEQ ID NO: 813230 - DNA, 23 bp, Homo sapiens
attcttagatacactaaaaatct

SEQ ID NO: 813231 - DNA, 14 bp, Homo sapiens
attcttattaattc

SEQ ID NO: 813232 - DNA, 19 bp, Homo sapiens
attcttattggaaatgtac

SEQ ID NO: 813233 - DNA, 13 bp, Homo sapiens
attcttatttaat

SEQ ID NO: 813234 - DNA, 14 bp, Homo sapiens
attcttcaaccagt

SEQ ID NO: 813235 - DNA, 21 bp, Homo sapiens
attcttcagtgtctctgtttt

SEQ ID NO: 813236 - DNA, 11 bp, Homo sapiens
attcttccaga

SEQ ID NO: 813237 - DNA, 12 bp, Homo sapiens
attcttccagaa

SEQ ID NO: 813238 - DNA, 21 bp, Homo sapiens
attcttccatcatcactgtaa

SEQ ID NO: 813239 - DNA, 15 bp, Homo sapiens
attcttcctcctctg

SEQ ID NO: 813240 - DNA, 10 bp, Homo sapiens
attcttcctt

SEQ ID NO: 813241 - DNA, 20 bp, Homo sapiens
attcttctaaaagttttcta

SEQ ID NO: 813242 - DNA, 22 bp, Homo sapiens
attcttctaaagcactggtttc

SEQ ID NO: 813243 - DNA, 16 bp, Homo sapiens
attcttctctgttgtc

SEQ ID NO: 813244 - DNA, 13 bp, Homo sapiens
attcttctcttgt

SEQ ID NO: 813245 - DNA, 13 bp, Homo sapiens
attcttctgggtg

SEQ ID NO: 813246 - DNA, 15 bp, Homo sapiens
attcttctgtatttc

SEQ ID NO: 813247 - DNA, 19 bp, Homo sapiens
attcttctgtatttctagg

SEQ ID NO: 813248 - DNA, 15 bp, Homo sapiens
attcttcttttgtgt

SEQ ID NO: 813249 - DNA, 16 bp, Homo sapiens
attcttgaaagctgtg

SEQ ID NO: 813250 - DNA, 14 bp, Homo sapiens
attcttgatctcta

SEQ ID NO: 813251 - DNA, 15 bp, Homo sapiens
attcttgatctctaa

SEQ ID NO: 813252 - DNA, 16 bp, Homo sapiens
attcttgatctctaat

SEQ ID NO: 813253 - DNA, 17 bp, Homo sapiens
attcttgattcctggct

SEQ ID NO: 813254 - DNA, 13 bp, Homo sapiens
attcttgattgct

SEQ ID NO: 813255 - DNA, 22 bp, Homo sapiens
attcttgatttatttgcttctt

SEQ ID NO: 813256 - DNA, 16 bp, Homo sapiens
attcttgattttcaag

SEQ ID NO: 813257 - DNA, 21 bp, Homo sapiens
attcttgattttcaagctttc

SEQ ID NO: 813258 - DNA, 16 bp, Homo sapiens
attcttgcaaagtatc

SEQ ID NO: 813259 - DNA, 12 bp, Homo sapiens
attcttgctggg

SEQ ID NO: 813260 - DNA, 21 bp, Homo sapiens
attcttgctgggcatactttc

SEQ ID NO: 813261 - DNA, 22 bp, Homo sapiens
attcttgctgggcatactttct

SEQ ID NO: 813262 - DNA, 16 bp, Homo sapiens
attcttgggaaacacc

SEQ ID NO: 813263 - DNA, 17 bp, Homo sapiens
attcttggttgaggaaa

SEQ ID NO: 813264 - DNA, 17 bp, Homo sapiens
attcttgtaaatctttt

SEQ ID NO: 813265 - DNA, 14 bp, Homo sapiens
attcttgtcaaaaa

SEQ ID NO: 813266 - DNA, 14 bp, Homo sapiens
attcttgtccacat

SEQ ID NO: 813267 - DNA, 22 bp, Homo sapiens
attcttgtccacattctacttc

SEQ ID NO: 813268 - DNA, 22 bp, Homo sapiens
attcttgtgggagacagcagcc

SEQ ID NO: 813269 - DNA, 22 bp, Homo sapiens
attcttgttggtagcatgtact

SEQ ID NO: 813270 - DNA, 15 bp, Homo sapiens
attctttaatagaag

SEQ ID NO: 813271 - DNA, 18 bp, Homo sapiens
attctttactattaaaat

SEQ ID NO: 813272 - DNA, 21 bp, Homo sapiens
attctttataaaatgtataaa

SEQ ID NO: 813273 - DNA, 22 bp, Homo sapiens
attctttataaaatgtataaat

SEQ ID NO: 813274 - DNA, 17 bp, Homo sapiens
attctttatcttgacat

SEQ ID NO: 813275 - DNA, 18 bp, Homo sapiens
attctttcacttgatgtt

SEQ ID NO: 813276 - DNA, 22 bp, Homo sapiens
attctttccattatgattcttt

SEQ ID NO: 813277 - DNA, 17 bp, Homo sapiens
attctttccatttgcat

SEQ ID NO: 813278 - DNA, 19 bp, Homo sapiens
attctttccatttgcattt

SEQ ID NO: 813279 - DNA, 21 bp, Homo sapiens
attctttcccaattcacatct

SEQ ID NO: 813280 - DNA, 19 bp, Homo sapiens
attctttcccagtctgtcg

SEQ ID NO: 813281 - DNA, 20 bp, Homo sapiens
attctttcccagtctgtcga

SEQ ID NO: 813282 - DNA, 14 bp, Homo sapiens
attctttccccaga

SEQ ID NO: 813283 - DNA, 21 bp, Homo sapiens
attctttcccctcagagctct

SEQ ID NO: 813284 - DNA, 22 bp, Homo sapiens
attctttccttctctgaaagtg

SEQ ID NO: 813285 - DNA, 16 bp, Homo sapiens
attctttctcataaaa

SEQ ID NO: 813286 - DNA, 19 bp, Homo sapiens
attctttctcataaaactg

SEQ ID NO: 813287 - DNA, 22 bp, Homo sapiens
attctttctgcctttaattttc

SEQ ID NO: 813288 - DNA, 12 bp, Homo sapiens
attctttgaaaa

SEQ ID NO: 813289 - DNA, 13 bp, Homo sapiens
attctttgcattc

SEQ ID NO: 813290 - DNA, 14 bp, Homo sapiens
attctttgcattcc

SEQ ID NO: 813291 - DNA, 13 bp, Homo sapiens
attctttggtaat

SEQ ID NO: 813292 - DNA, 15 bp, Homo sapiens
attctttggtaattt

SEQ ID NO: 813293 - DNA, 16 bp, Homo sapiens
attctttgttctgttt

SEQ ID NO: 813294 - DNA, 13 bp, Homo sapiens
attcttttaaaag

SEQ ID NO: 813295 - DNA, 18 bp, Homo sapiens
attcttttaaaagacaag

SEQ ID NO: 813296 - DNA, 22 bp, Homo sapiens
attcttttaaaagacaagactt

SEQ ID NO: 813297 - DNA, 14 bp, Homo sapiens
attcttttaacttc

SEQ ID NO: 813298 - DNA, 17 bp, Homo sapiens
attcttttaacttcttt

SEQ ID NO: 813299 - DNA, 18 bp, Homo sapiens
attctttttctgttgaaa

SEQ ID NO: 813300 - DNA, 15 bp, Homo sapiens
attctttttttctgt

SEQ ID NO: 813301 - DNA, 19 bp, Homo sapiens
attgaaaaaatagagcctg

SEQ ID NO: 813302 - DNA, 14 bp, Homo sapiens
attgaaaacactta

SEQ ID NO: 813303 - DNA, 13 bp, Homo sapiens
attgaaaacttca

SEQ ID NO: 813304 - DNA, 15 bp, Homo sapiens
attgaaaacttcaaa

SEQ ID NO: 813305 - DNA, 17 bp, Homo sapiens
attgaaaacttcaaagc

SEQ ID NO: 813306 - DNA, 13 bp, Homo sapiens
attgaaaaggaca

SEQ ID NO: 813307 - DNA, 15 bp, Homo sapiens
attgaaaatcttgtg

SEQ ID NO: 813308 - DNA, 16 bp, Homo sapiens
attgcaaatcttgaaa

SEQ ID NO: 813309 - DNA, 17 bp, Homo sapiens
attgcaaatcttgaaat

SEQ ID NO: 813310 - DNA, 19 bp, Homo sapiens
attgcaaatcttgaaatta

SEQ ID NO: 813311 - DNA, 14 bp, Homo sapiens
attgcaataaagta

SEQ ID NO: 813312 - DNA, 20 bp, Homo sapiens
attgcacagtaggatgtgga

SEQ ID NO: 813313 - DNA, 21 bp, Homo sapiens
attgcacattgttgttttttt

SEQ ID NO: 813314 - DNA, 18 bp, Homo sapiens
attgcacatttttttcta

SEQ ID NO: 813315 - DNA, 19 bp, Homo sapiens
attgcaccattttcaattt

SEQ ID NO: 813316 - DNA, 22 bp, Homo sapiens
attgcacctatctcagccatag

SEQ ID NO: 813317 - DNA, 17 bp, Homo sapiens
attgcacgtggcctctt

SEQ ID NO: 813318 - DNA, 16 bp, Homo sapiens
attgcactccagcctg

SEQ ID NO: 813319 - DNA, 19 bp, Homo sapiens
attgcactctagcctggca

SEQ ID NO: 813320 - DNA, 14 bp, Homo sapiens
attgcactgctgtt

SEQ ID NO: 813321 - DNA, 17 bp, Homo sapiens
attgcactgctgttcct

SEQ ID NO: 813322 - DNA, 17 bp, Homo sapiens
attgcagaaaattctgt

SEQ ID NO: 813323 - DNA, 18 bp, Homo sapiens
attgcagaaaattctgtg

SEQ ID NO: 813324 - DNA, 17 bp, Homo sapiens
attgcagacctgtcacc

SEQ ID NO: 813325 - DNA, 17 bp, Homo sapiens
attgcagctttatgttc

SEQ ID NO: 813326 - DNA, 17 bp, Homo sapiens
attgcaggaccttgggc

SEQ ID NO: 813327 - DNA, 21 bp, Homo sapiens
attgcaggaccttgggcacat

SEQ ID NO: 813328 - DNA, 14 bp, Homo sapiens
attgcaggatggtg

SEQ ID NO: 813329 - DNA, 17 bp, Homo sapiens
attgcaggatggtgtct

SEQ ID NO: 813330 - DNA, 17 bp, Homo sapiens
attgcagtatggtgtgg

SEQ ID NO: 813331 - DNA, 19 bp, Homo sapiens
attgcagtcatagaagaga

SEQ ID NO: 813332 - DNA, 18 bp, Homo sapiens
attgcagtttatcattca

SEQ ID NO: 813333 - DNA, 17 bp, Homo sapiens
attgcagtttcatgtat

SEQ ID NO: 813334 - DNA, 13 bp, Homo sapiens
attgcatcctgct

SEQ ID NO: 813335 - DNA, 15 bp, Homo sapiens
attgcatcctgctgg

SEQ ID NO: 813336 - DNA, 19 bp, Homo sapiens
attgcatcctgctggggct

SEQ ID NO: 813337 - DNA, 20 bp, Homo sapiens
attgcatctgggtagctgta

SEQ ID NO: 813338 - DNA, 21 bp, Homo sapiens
attgcatctgggtagctgtaa

SEQ ID NO: 813339 - DNA, 14 bp, Homo sapiens
attgcatctgtata

SEQ ID NO: 813340 - DNA, 19 bp, Homo sapiens
attgcatctgtataagtaa

SEQ ID NO: 813341 - DNA, 13 bp, Homo sapiens
attgcatgaaact

SEQ ID NO: 813342 - DNA, 14 bp, Homo sapiens
attgcatgaaacta

SEQ ID NO: 813343 - DNA, 21 bp, Homo sapiens
attgcatttccagaaatctgc

SEQ ID NO: 813344 - DNA, 14 bp, Homo sapiens
attgccaagtgcct

SEQ ID NO: 813345 - DNA, 16 bp, Homo sapiens
attgccaagtgcctat

SEQ ID NO: 813346 - DNA, 17 bp, Homo sapiens
attgccacctctggcca

SEQ ID NO: 813347 - DNA, 18 bp, Homo sapiens
attgccacctctggccaa

SEQ ID NO: 813348 - DNA, 21 bp, Homo sapiens
attgccacctctggccaaata

SEQ ID NO: 813349 - DNA, 23 bp, Homo sapiens
attgccacctctggccaaatatg

SEQ ID NO: 813350 - DNA, 13 bp, Homo sapiens
attgccagcaaat

SEQ ID NO: 813351 - DNA, 12 bp, Homo sapiens
attgccaggaga

SEQ ID NO: 813352 - DNA, 14 bp, Homo sapiens
attgccaggagatg

SEQ ID NO: 813353 - DNA, 20 bp, Homo sapiens
attgccatgaatttctacca

SEQ ID NO: 813354 - DNA, 21 bp, Homo sapiens
attgcccatggctgggaacat

SEQ ID NO: 813355 - DNA, 20 bp, Homo sapiens
attgcccccatggggtcctt

SEQ ID NO: 813356 - DNA, 20 bp, Homo sapiens
attgcccgcgctcaggaggt

SEQ ID NO: 813357 - DNA, 18 bp, Homo sapiens
attgcctacaataaaaag

SEQ ID NO: 813358 - DNA, 21 bp, Homo sapiens
attgcctagaaatatctttct

SEQ ID NO: 813359 - DNA, 16 bp, Homo sapiens
attgcctataatactt

SEQ ID NO: 813360 - DNA, 20 bp, Homo sapiens
attgcctataatacttgcaa

SEQ ID NO: 813361 - DNA, 14 bp, Homo sapiens
attgcctcccaggc

SEQ ID NO: 813362 - DNA, 16 bp, Homo sapiens
attgcctcccaggcaa

SEQ ID NO: 813363 - DNA, 12 bp, Homo sapiens
attgcctcctgt

SEQ ID NO: 813364 - DNA, 20 bp, Homo sapiens
attgcctcctgttctgccca

SEQ ID NO: 813365 - DNA, 19 bp, Homo sapiens
attgcctcttgcaggctga

SEQ ID NO: 813366 - DNA, 22 bp, Homo sapiens
attgcctgtgtatggaaaaacc

SEQ ID NO: 813367 - DNA, 14 bp, Homo sapiens
attgcctgttctgc

SEQ ID NO: 813368 - DNA, 19 bp, Homo sapiens
attgccttatttgtctgta

SEQ ID NO: 813369 - DNA, 16 bp, Homo sapiens
attgcctttaatattt

SEQ ID NO: 813370 - DNA, 22 bp, Homo sapiens
attgcctttgaatgttaatttt

SEQ ID NO: 813371 - DNA, 17 bp, Homo sapiens
attgccttttaattttt

SEQ ID NO: 813372 - DNA, 15 bp, Homo sapiens
attgcgcctttgtat

SEQ ID NO: 813373 - DNA, 18 bp, Homo sapiens
attgcgcctttgtattat

SEQ ID NO: 813374 - DNA, 13 bp, Homo sapiens
attgcgctgctac

SEQ ID NO: 813375 - DNA, 20 bp, Homo sapiens
attgcgtttgaccttttatg

SEQ ID NO: 813376 - DNA, 21 bp, Homo sapiens
attgcgtttgaccttttatgt

SEQ ID NO: 813377 - DNA, 15 bp, Homo sapiens
attgctaaaaaataa

SEQ ID NO: 813378 - DNA, 13 bp, Homo sapiens
attgctaaaagtg

SEQ ID NO: 813379 - DNA, 16 bp, Homo sapiens
attgctaaaagtgcat

SEQ ID NO: 813380 - DNA, 20 bp, Homo sapiens
attgctaaaagtgcatttaa

SEQ ID NO: 813381 - DNA, 21 bp, Homo sapiens
attgctaaaagtgcatttaag

SEQ ID NO: 813382 - DNA, 14 bp, Homo sapiens
attgctaatgttgc

SEQ ID NO: 813383 - DNA, 14 bp, Homo sapiens
attgctagataaaa

SEQ ID NO: 813384 - DNA, 16 bp, Homo sapiens
attgctagataaaagc

SEQ ID NO: 813385 - DNA, 22 bp, Homo sapiens
attgctagccagcattccatat

SEQ ID NO: 813386 - DNA, 19 bp, Homo sapiens
attgctatcgccctccttt

SEQ ID NO: 813387 - DNA, 21 bp, Homo sapiens
attgctatcgccctcctttcc

SEQ ID NO: 813388 - DNA, 23 bp, Homo sapiens
attgctatctggaggccttccag

SEQ ID NO: 813389 - DNA, 23 bp, Homo sapiens
attgctcaagttcattgatgacc

SEQ ID NO: 813390 - DNA, 18 bp, Homo sapiens
attgctcctcccacttct

SEQ ID NO: 813391 - DNA, 18 bp, Homo sapiens
attgctcgcccagacacc

SEQ ID NO: 813392 - DNA, 23 bp, Homo sapiens
attgctcgcccagacaccatgtg

SEQ ID NO: 813393 - DNA, 19 bp, Homo sapiens
attgctctatgtctgcctt

SEQ ID NO: 813394 - DNA, 14 bp, Homo sapiens
attgctctctgggc

SEQ ID NO: 813395 - DNA, 15 bp, Homo sapiens
attgctctggagcag

SEQ ID NO: 813396 - DNA, 14 bp, Homo sapiens
attgctcttctcca

SEQ ID NO: 813397 - DNA, 12 bp, Homo sapiens
attgctgaaact

SEQ ID NO: 813398 - DNA, 14 bp, Homo sapiens
attgctgaatccca

SEQ ID NO: 813399 - DNA, 22 bp, Homo sapiens
attgctgagagaaatatggaac

SEQ ID NO: 813400 - DNA, 14 bp, Homo sapiens
attgctgagcctct

SEQ ID NO: 813401 - DNA, 16 bp, Homo sapiens
attgctgattttaaag

SEQ ID NO: 813402 - DNA, 11 bp, Homo sapiens
attgctgccaa

SEQ ID NO: 813403 - DNA, 16 bp, Homo sapiens
attgctgccaaaacca

SEQ ID NO: 813404 - DNA, 22 bp, Homo sapiens
attgctgccataattctaagtt

SEQ ID NO: 813405 - DNA, 12 bp, Homo sapiens
attgctgccttt

SEQ ID NO: 813406 - DNA, 20 bp, Homo sapiens
attgctgcctttgtccccac

SEQ ID NO: 813407 - DNA, 15 bp, Homo sapiens
attgctgctgctacc

SEQ ID NO: 813408 - DNA, 17 bp, Homo sapiens
attgctggaaaccaagt

SEQ ID NO: 813409 - DNA, 22 bp, Homo sapiens
attgctggttctatttaatgga

SEQ ID NO: 813410 - DNA, 14 bp, Homo sapiens
attgctgtcctgga

SEQ ID NO: 813411 - DNA, 15 bp, Homo sapiens
attgctgtctggtga

SEQ ID NO: 813412 - DNA, 17 bp, Homo sapiens
attgctgtctggtgagg

SEQ ID NO: 813413 - DNA, 21 bp, Homo sapiens
attgctgtctggtgaggtggc

SEQ ID NO: 813414 - DNA, 22 bp, Homo sapiens
attgctgtctggtgaggtggcc

SEQ ID NO: 813415 - DNA, 18 bp, Homo sapiens
attgctgtcttgccccag

SEQ ID NO: 813416 - DNA, 18 bp, Homo sapiens
attgctgtgctttatgga

SEQ ID NO: 813417 - DNA, 12 bp, Homo sapiens
attgctgtgtct

SEQ ID NO: 813418 - DNA, 17 bp, Homo sapiens
attgcttaaaagacatt

SEQ ID NO: 813419 - DNA, 20 bp, Homo sapiens
attgcttaaaagacattttt

SEQ ID NO: 813420 - DNA, 18 bp, Homo sapiens
attgcttaatttctgcct

SEQ ID NO: 813421 - DNA, 19 bp, Homo sapiens
attgcttaatttctgcctt

SEQ ID NO: 813422 - DNA, 20 bp, Homo sapiens
attgcttacatttttacaat

SEQ ID NO: 813423 - DNA, 13 bp, Homo sapiens
attgcttactgat

SEQ ID NO: 813424 - DNA, 16 bp, Homo sapiens
attgcttattcttgag

SEQ ID NO: 813425 - DNA, 16 bp, Homo sapiens
attgcttattttatta

SEQ ID NO: 813426 - DNA, 19 bp, Homo sapiens
attgcttattttattatga

SEQ ID NO: 813427 - DNA, 10 bp, Homo sapiens
attgcttcta

SEQ ID NO: 813428 - DNA, 13 bp, Homo sapiens
attgcttctgact

SEQ ID NO: 813429 - DNA, 13 bp, Homo sapiens
attgcttctgtag

SEQ ID NO: 813430 - DNA, 22 bp, Homo sapiens
attgtactcaatggatttgatg

SEQ ID NO: 813431 - DNA, 15 bp, Homo sapiens
attgtactccagcct

SEQ ID NO: 813432 - DNA, 18 bp, Homo sapiens
attgtactccagcctggg

SEQ ID NO: 813433 - DNA, 16 bp, Homo sapiens
attgtactgtttttaa

SEQ ID NO: 813434 - DNA, 14 bp, Homo sapiens
attgtacttagcca

SEQ ID NO: 813435 - DNA, 23 bp, Homo sapiens
attgtacttagccagttcaaagt

SEQ ID NO: 813436 - DNA, 19 bp, Homo sapiens
attgtagaaacacagtttt

SEQ ID NO: 813437 - DNA, 15 bp, Homo sapiens
attgtagaattgtat

SEQ ID NO: 813438 - DNA, 19 bp, Homo sapiens
attgtagaattgtatatag

SEQ ID NO: 813439 - DNA, 16 bp, Homo sapiens
attgtagcatttcttg

SEQ ID NO: 813440 - DNA, 18 bp, Homo sapiens
attgtagcatttcttgat

SEQ ID NO: 813441 - DNA, 16 bp, Homo sapiens
attgtagtgcaaaatg

SEQ ID NO: 813442 - DNA, 13 bp, Homo sapiens
attgtataaacta

SEQ ID NO: 813443 - DNA, 17 bp, Homo sapiens
attgtataaactatcag

SEQ ID NO: 813444 - DNA, 22 bp, Homo sapiens
attgtataaactatcagtttgt

SEQ ID NO: 813445 - DNA, 17 bp, Homo sapiens
attgtataagtcaagca

SEQ ID NO: 813446 - DNA, 19 bp, Homo sapiens
attgtataagtcaagcaca

SEQ ID NO: 813447 - DNA, 15 bp, Homo sapiens
attgtatacattttg

SEQ ID NO: 813448 - DNA, 17 bp, Homo sapiens
attgtataggccatctg

SEQ ID NO: 813449 - DNA, 18 bp, Homo sapiens
attgtataggccatctgt

SEQ ID NO: 813450 - DNA, 15 bp, Homo sapiens
attgtatatatgtgt

SEQ ID NO: 813451 - DNA, 22 bp, Homo sapiens
attgtatatatgtgtgtttaaa

SEQ ID NO: 813452 - DNA, 13 bp, Homo sapiens
attgtatattctg

SEQ ID NO: 813453 - DNA, 15 bp, Homo sapiens
attgtatattctgga

SEQ ID NO: 813454 - DNA, 13 bp, Homo sapiens
attgtatattgta

SEQ ID NO: 813455 - DNA, 15 bp, Homo sapiens
attgtatattgtaat

SEQ ID NO: 813456 - DNA, 19 bp, Homo sapiens
attgtatatttttatctat

SEQ ID NO: 813457 - DNA, 16 bp, Homo sapiens
attgtatctagtgcag

SEQ ID NO: 813458 - DNA, 19 bp, Homo sapiens
attgtatctagtgcagctg

SEQ ID NO: 813459 - DNA, 21 bp, Homo sapiens
attgtatctagtgcagctgat

SEQ ID NO: 813460 - DNA, 12 bp, Homo sapiens
attgtatgaaaa

SEQ ID NO: 813461 - DNA, 13 bp, Homo sapiens
attgtatgaaaat

SEQ ID NO: 813462 - DNA, 22 bp, Homo sapiens
attgtatgaaaatccttttaac

SEQ ID NO: 813463 - DNA, 15 bp, Homo sapiens
attgtatgatgtgtt

SEQ ID NO: 813464 - DNA, 15 bp, Homo sapiens
attgtatgcagggag

SEQ ID NO: 813465 - DNA, 15 bp, Homo sapiens
attgtattaggaaaa

SEQ ID NO: 813466 - DNA, 16 bp, Homo sapiens
attgtattaggaaaat

SEQ ID NO: 813467 - DNA, 14 bp, Homo sapiens
attgtattgaaaac

SEQ ID NO: 813468 - DNA, 18 bp, Homo sapiens
attgtattgaaaacactt

SEQ ID NO: 813469 - DNA, 13 bp, Homo sapiens
attgtattgttag

SEQ ID NO: 813470 - DNA, 17 bp, Homo sapiens
attgtatttgtgacttt

SEQ ID NO: 813471 - DNA, 21 bp, Homo sapiens
attgtcaaatgtaaatttact

SEQ ID NO: 813472 - DNA, 18 bp, Homo sapiens
attgtcaacactatataa

SEQ ID NO: 813473 - DNA, 21 bp, Homo sapiens
attgtcaacactatataaata

SEQ ID NO: 813474 - DNA, 20 bp, Homo sapiens
attgtcagaaatattcttat

SEQ ID NO: 813475 - DNA, 23 bp, Homo sapiens
attgtcagatattttttcagaaa

SEQ ID NO: 813476 - DNA, 20 bp, Homo sapiens
attgtcagccacctccctct

SEQ ID NO: 813477 - DNA, 21 bp, Homo sapiens
attgtcagccatcgtcctggg

SEQ ID NO: 813478 - DNA, 19 bp, Homo sapiens
attgtcagctactaatgat

SEQ ID NO: 813479 - DNA, 18 bp, Homo sapiens
attgtcagttttgttcac

SEQ ID NO: 813480 - DNA, 20 bp, Homo sapiens
attgtcatggggatcaattt

SEQ ID NO: 813481 - DNA, 17 bp, Homo sapiens
attgtccctctgcccca

SEQ ID NO: 813482 - DNA, 23 bp, Homo sapiens
attgtccctctgccccatcctcc

SEQ ID NO: 813483 - DNA, 16 bp, Homo sapiens
attgtccctgtttcaa

SEQ ID NO: 813484 - DNA, 15 bp, Homo sapiens
attgtccttcagagc

SEQ ID NO: 813485 - DNA, 16 bp, Homo sapiens
attgtccttcagagct

SEQ ID NO: 813486 - DNA, 16 bp, Homo sapiens
attgtccttttgcaaa

SEQ ID NO: 813487 - DNA, 22 bp, Homo sapiens
attgtcgtataggcatgtaaac

SEQ ID NO: 813488 - DNA, 20 bp, Homo sapiens
attgtctactcctagaagaa

SEQ ID NO: 813489 - DNA, 15 bp, Homo sapiens
attgtctactctgaa

SEQ ID NO: 813490 - DNA, 15 bp, Homo sapiens
attgtctcagggccg

SEQ ID NO: 813491 - DNA, 10 bp, Homo sapiens
attgtctccc

SEQ ID NO: 813492 - DNA, 19 bp, Homo sapiens
attgtctcccgccccccac

SEQ ID NO: 813493 - DNA, 15 bp, Homo sapiens
attgtctcccttcca

SEQ ID NO: 813494 - DNA, 22 bp, Homo sapiens
attgtctcctatatatttctat

SEQ ID NO: 813495 - DNA, 16 bp, Homo sapiens
attgtcttaaaaccag

SEQ ID NO: 813496 - DNA, 23 bp, Homo sapiens
attgtgaaataaaactggctttg

SEQ ID NO: 813497 - DNA, 17 bp, Homo sapiens
attgtgaaccaatgcaa

SEQ ID NO: 813498 - DNA, 22 bp, Homo sapiens
attgtgaaccctagctgtgtca

SEQ ID NO: 813499 - DNA, 16 bp, Homo sapiens
attgtgaactgacagg

SEQ ID NO: 813500 - DNA, 18 bp, Homo sapiens
attgtgaatatttggaat

SEQ ID NO: 813501 - DNA, 15 bp, Homo sapiens
attgtgacttcactg

SEQ ID NO: 813502 - DNA, 19 bp, Homo sapiens
attgtgacttcactgtata

SEQ ID NO: 813503 - DNA, 16 bp, Homo sapiens
attgtgagccaccacg

SEQ ID NO: 813504 - DNA, 14 bp, Homo sapiens
attgtgagctctgg

SEQ ID NO: 813505 - DNA, 16 bp, Homo sapiens
attgtgagggacatgc

SEQ ID NO: 813506 - DNA, 13 bp, Homo sapiens
attgtgatgtttt

SEQ ID NO: 813507 - DNA, 19 bp, Homo sapiens
attgtgatgttttgttcaa

SEQ ID NO: 813508 - DNA, 12 bp, Homo sapiens
attgtgccaagc

SEQ ID NO: 813509 - DNA, 16 bp, Homo sapiens
attgtgccaagccttc

SEQ ID NO: 813510 - DNA, 17 bp, Homo sapiens
attgtgccaagccttct

SEQ ID NO: 813511 - DNA, 19 bp, Homo sapiens
attgtgccaatatgtattg

SEQ ID NO: 813512 - DNA, 18 bp, Homo sapiens
attgtgccatgtcaaaca

SEQ ID NO: 813513 - DNA, 15 bp, Homo sapiens
attgtgctgccattt

SEQ ID NO: 813514 - DNA, 15 bp, Homo sapiens
attgtgcttcacagt

SEQ ID NO: 813515 - DNA, 20 bp, Homo sapiens
attgtgcttcacagtagagc

SEQ ID NO: 813516 - DNA, 15 bp, Homo sapiens
attgtgctttcacca

SEQ ID NO: 813517 - DNA, 17 bp, Homo sapiens
attgtggaaaaccagga

SEQ ID NO: 813518 - DNA, 20 bp, Homo sapiens
attgtggaaaaccaggaaaa

SEQ ID NO: 813519 - DNA, 15 bp, Homo sapiens
attgtggaataaatc

SEQ ID NO: 813520 - DNA, 17 bp, Homo sapiens
attgtggatgtgttcat

SEQ ID NO: 813521 - DNA, 21 bp, Homo sapiens
attgtggattataaaaaatgt

SEQ ID NO: 813522 - DNA, 19 bp, Homo sapiens
attgtggctcctatctgtg

SEQ ID NO: 813523 - DNA, 20 bp, Homo sapiens
attgtggctcctatctgtgt

SEQ ID NO: 813524 - DNA, 20 bp, Homo sapiens
attgtgggcatgagctgctg

SEQ ID NO: 813525 - DNA, 20 bp, Homo sapiens
attgtgggccatgaaccaaa

SEQ ID NO: 813526 - DNA, 16 bp, Homo sapiens
attgtggggtgcagct

SEQ ID NO: 813527 - DNA, 22 bp, Homo sapiens
attgtggggtgcagctgggtgg

SEQ ID NO: 813528 - DNA, 23 bp, Homo sapiens
attgtggggtgcagctgggtggg

SEQ ID NO: 813529 - DNA, 22 bp, Homo sapiens
attgtgtaaaaaatggaaaaaa

SEQ ID NO: 813530 - DNA, 14 bp, Homo sapiens
attgtgtagccttt

SEQ ID NO: 813531 - DNA, 14 bp, Homo sapiens
attgtgtatatatc

SEQ ID NO: 813532 - DNA, 21 bp, Homo sapiens
attgtgtgaattaatttctaa

SEQ ID NO: 813533 - DNA, 17 bp, Homo sapiens
attgtgtgatccagccc

SEQ ID NO: 813534 - DNA, 19 bp, Homo sapiens
attgtgtgatccagccctg

SEQ ID NO: 813535 - DNA, 14 bp, Homo sapiens
attgtgtgtctggt

SEQ ID NO: 813536 - DNA, 15 bp, Homo sapiens
attgtgtgtctggta

SEQ ID NO: 813537 - DNA, 17 bp, Homo sapiens
attgtgttgtcttcagc

SEQ ID NO: 813538 - DNA, 12 bp, Homo sapiens
attgtgtttcta

SEQ ID NO: 813539 - DNA, 13 bp, Homo sapiens
attgtgtttgtgt

SEQ ID NO: 813540 - DNA, 19 bp, Homo sapiens
attgttaaattacattttt

SEQ ID NO: 813541 - DNA, 16 bp, Homo sapiens
attgttacaatagaat

SEQ ID NO: 813542 - DNA, 21 bp, Homo sapiens
attgttacattatgtggaaaa

SEQ ID NO: 813543 - DNA, 16 bp, Homo sapiens
attgttagaaaatgac

SEQ ID NO: 813544 - DNA, 21 bp, Homo sapiens
attgttagaaaatgacttatt

SEQ ID NO: 813545 - DNA, 16 bp, Homo sapiens
attgttagatgtttgt

SEQ ID NO: 813546 - DNA, 17 bp, Homo sapiens
attgttagggtcagcca

SEQ ID NO: 813547 - DNA, 17 bp, Homo sapiens
attgttataaaataaca

SEQ ID NO: 813548 - DNA, 22 bp, Homo sapiens
attgttataaaataacatgctg

SEQ ID NO: 813549 - DNA, 18 bp, Homo sapiens
attgttataaataaaatt

SEQ ID NO: 813550 - DNA, 14 bp, Homo sapiens
attgttattaaatg

SEQ ID NO: 813551 - DNA, 13 bp, Homo sapiens
attgttatttata

SEQ ID NO: 813552 - DNA, 18 bp, Homo sapiens
atttagggaactgcttga

SEQ ID NO: 813553 - DNA, 23 bp, Homo sapiens
atttagggaagcagggacacccc

SEQ ID NO: 813554 - DNA, 20 bp, Homo sapiens
atttagggagaaatgttgtt

SEQ ID NO: 813555 - DNA, 22 bp, Homo sapiens
atttagggagaaatgttgttca

SEQ ID NO: 813556 - DNA, 16 bp, Homo sapiens
atttagggagcagatg

SEQ ID NO: 813557 - DNA, 22 bp, Homo sapiens
atttagggagcagatgactgag

SEQ ID NO: 813558 - DNA, 17 bp, Homo sapiens
atttagggccttttctg

SEQ ID NO: 813559 - DNA, 17 bp, Homo sapiens
atttaggtttttattag

SEQ ID NO: 813560 - DNA, 17 bp, Homo sapiens
atttaggtttttggctg

SEQ ID NO: 813561 - DNA, 23 bp, Homo sapiens
atttaggtttttgtttgtttcct

SEQ ID NO: 813562 - DNA, 18 bp, Homo sapiens
atttagtaaagtttgttg

SEQ ID NO: 813563 - DNA, 19 bp, Homo sapiens
atttagtaaagtttgttga

SEQ ID NO: 813564 - DNA, 19 bp, Homo sapiens
atttagtaatagcctgggt

SEQ ID NO: 813565 - DNA, 17 bp, Homo sapiens
atttagtacactatgtt

SEQ ID NO: 813566 - DNA, 17 bp, Homo sapiens
atttagtagttatttgt

SEQ ID NO: 813567 - DNA, 21 bp, Homo sapiens
atttagtcacaccatcttaaa

SEQ ID NO: 813568 - DNA, 14 bp, Homo sapiens
atttagtcatgtga

SEQ ID NO: 813569 - DNA, 15 bp, Homo sapiens
atttagtgaactacg

SEQ ID NO: 813570 - DNA, 16 bp, Homo sapiens
atttagtgaatggcat

SEQ ID NO: 813571 - DNA, 20 bp, Homo sapiens
atttagtgatattgtgggta

SEQ ID NO: 813572 - DNA, 16 bp, Homo sapiens
atttagtgctaaacaa

SEQ ID NO: 813573 - DNA, 19 bp, Homo sapiens
atttagtgctaaacaagta

SEQ ID NO: 813574 - DNA, 13 bp, Homo sapiens
atttagtgctctt

SEQ ID NO: 813575 - DNA, 17 bp, Homo sapiens
atttagtgcttaacatt

SEQ ID NO: 813576 - DNA, 15 bp, Homo sapiens
atttagtgtgaatat

SEQ ID NO: 813577 - DNA, 21 bp, Homo sapiens
atttagtgtttttacctctgt

SEQ ID NO: 813578 - DNA, 12 bp, Homo sapiens
atttagttcttt

SEQ ID NO: 813579 - DNA, 16 bp, Homo sapiens
atttagttctttgtta

SEQ ID NO: 813580 - DNA, 18 bp, Homo sapiens
atttagttgaaaaatcta

SEQ ID NO: 813581 - DNA, 14 bp, Homo sapiens
atttagttgtggaa

SEQ ID NO: 813582 - DNA, 12 bp, Homo sapiens
atttagtttcag

SEQ ID NO: 813583 - DNA, 14 bp, Homo sapiens
atttagtttcagta

SEQ ID NO: 813584 - DNA, 15 bp, Homo sapiens
atttagtttgattat

SEQ ID NO: 813585 - DNA, 16 bp, Homo sapiens
atttagttttgtaact

SEQ ID NO: 813586 - DNA, 20 bp, Homo sapiens
atttataaaaatataaattg

SEQ ID NO: 813587 - DNA, 22 bp, Homo sapiens
atttataaaaatataaattgta

SEQ ID NO: 813588 - DNA, 14 bp, Homo sapiens
atttataaaacttc

SEQ ID NO: 813589 - DNA, 21 bp, Homo sapiens
atttataaaacttctcaagat

SEQ ID NO: 813590 - DNA, 15 bp, Homo sapiens
atttataaacagaca

SEQ ID NO: 813591 - DNA, 23 bp, Homo sapiens
atttataaactaattttgtacgt

SEQ ID NO: 813592 - DNA, 17 bp, Homo sapiens
atttataaagcaaatta

SEQ ID NO: 813593 - DNA, 17 bp, Homo sapiens
atttataaatgagcaaa

SEQ ID NO: 813594 - DNA, 13 bp, Homo sapiens
atttataaatgct

SEQ ID NO: 813595 - DNA, 17 bp, Homo sapiens
atttataaatgctattt

SEQ ID NO: 813596 - DNA, 18 bp, Homo sapiens
atttataaccccagcctg

SEQ ID NO: 813597 - DNA, 19 bp, Homo sapiens
atttataaccccagcctga

SEQ ID NO: 813598 - DNA, 19 bp, Homo sapiens
atttataactcatcataaa

SEQ ID NO: 813599 - DNA, 22 bp, Homo sapiens
atttataagcagatttaacaat

SEQ ID NO: 813600 - DNA, 17 bp, Homo sapiens
atttataatacagaatc

SEQ ID NO: 813601 - DNA, 18 bp, Homo sapiens
atttataatacagaatct

SEQ ID NO: 813602 - DNA, 12 bp, Homo sapiens
atttataatgta

SEQ ID NO: 813603 - DNA, 19 bp, Homo sapiens
atttataatgtatttgaaa

SEQ ID NO: 813604 - DNA, 16 bp, Homo sapiens
atttataatgttagta

SEQ ID NO: 813605 - DNA, 17 bp, Homo sapiens
atttataatttaaatga

SEQ ID NO: 813606 - DNA, 21 bp, Homo sapiens
atttataatttaaatgatatt

SEQ ID NO: 813607 - DNA, 22 bp, Homo sapiens
atttatacaagattgaaaatct

SEQ ID NO: 813608 - DNA, 15 bp, Homo sapiens
atttatacaccagca

SEQ ID NO: 813609 - DNA, 13 bp, Homo sapiens
atttatacctttg

SEQ ID NO: 813610 - DNA, 11 bp, Homo sapiens
atttatactct

SEQ ID NO: 813611 - DNA, 17 bp, Homo sapiens
atttatactgtatatat

SEQ ID NO: 813612 - DNA, 13 bp, Homo sapiens
atttatactgtga

SEQ ID NO: 813613 - DNA, 19 bp, Homo sapiens
atttatagcaagatattga

SEQ ID NO: 813614 - DNA, 16 bp, Homo sapiens
atttatagtaaccatt

SEQ ID NO: 813615 - DNA, 17 bp, Homo sapiens
atttatagtatgtgact

SEQ ID NO: 813616 - DNA, 19 bp, Homo sapiens
atttatagtatgtgacttt

SEQ ID NO: 813617 - DNA, 18 bp, Homo sapiens
atttatatatggcatatt

SEQ ID NO: 813618 - DNA, 20 bp, Homo sapiens
atttatatatggcatattta

SEQ ID NO: 813619 - DNA, 15 bp, Homo sapiens
atttatatatttata

SEQ ID NO: 813620 - DNA, 17 bp, Homo sapiens
atttatatatttataac

SEQ ID NO: 813621 - DNA, 18 bp, Homo sapiens
atttatatatttataact

SEQ ID NO: 813622 - DNA, 20 bp, Homo sapiens
atttatatatttataactca

SEQ ID NO: 813623 - DNA, 16 bp, Homo sapiens
atttatatcaggtgta

SEQ ID NO: 813624 - DNA, 21 bp, Homo sapiens
atttatatcagtttcatgaaa

SEQ ID NO: 813625 - DNA, 13 bp, Homo sapiens
atttatatcttgt

SEQ ID NO: 813626 - DNA, 17 bp, Homo sapiens
atttatatgtacatgag

SEQ ID NO: 813627 - DNA, 15 bp, Homo sapiens
atttatattccgtat

SEQ ID NO: 813628 - DNA, 15 bp, Homo sapiens
atttatattgtaaat

SEQ ID NO: 813629 - DNA, 21 bp, Homo sapiens
atttatattgtaaatattgtg

SEQ ID NO: 813630 - DNA, 20 bp, Homo sapiens
atttatattgtatattctgg

SEQ ID NO: 813631 - DNA, 15 bp, Homo sapiens
atttatatttggaaa

SEQ ID NO: 813632 - DNA, 17 bp, Homo sapiens
atttatatttggaaaga

SEQ ID NO: 813633 - DNA, 19 bp, Homo sapiens
atttatatttttaaaatat

SEQ ID NO: 813634 - DNA, 19 bp, Homo sapiens
atttatcaatttttcccag

SEQ ID NO: 813635 - DNA, 23 bp, Homo sapiens
atttatcaatttttcccagtatt

SEQ ID NO: 813636 - DNA, 14 bp, Homo sapiens
atttatcagtgaca

SEQ ID NO: 813637 - DNA, 18 bp, Homo sapiens
atttatccaaaatgtgta

SEQ ID NO: 813638 - DNA, 19 bp, Homo sapiens
atttatccaaaatgtgtat

SEQ ID NO: 813639 - DNA, 15 bp, Homo sapiens
atttatccctttcct

SEQ ID NO: 813640 - DNA, 21 bp, Homo sapiens
atttatcctgaaatttcagat

SEQ ID NO: 813641 - DNA, 22 bp, Homo sapiens
atttatctcccttagaagagag

SEQ ID NO: 813642 - DNA, 16 bp, Homo sapiens
atttatctctatttaa

SEQ ID NO: 813643 - DNA, 17 bp, Homo sapiens
atttatctgagcaataa

SEQ ID NO: 813644 - DNA, 14 bp, Homo sapiens
atttatctttacca

SEQ ID NO: 813645 - DNA, 15 bp, Homo sapiens
atttatctttaccaa

SEQ ID NO: 813646 - DNA, 17 bp, Homo sapiens
atttatctttaccaaaa

SEQ ID NO: 813647 - DNA, 12 bp, Homo sapiens
atttatctttat

SEQ ID NO: 813648 - DNA, 15 bp, Homo sapiens
atttatctttataca

SEQ ID NO: 813649 - DNA, 22 bp, Homo sapiens
atttatgaaaaaatatgaacct

SEQ ID NO: 813650 - DNA, 15 bp, Homo sapiens
atttatgaagcagat

SEQ ID NO: 813651 - DNA, 13 bp, Homo sapiens
atttatgaattgt

SEQ ID NO: 813652 - DNA, 18 bp, Homo sapiens
atttatgacctgaaataa

SEQ ID NO: 813653 - DNA, 18 bp, Homo sapiens
atttatgagatttactgc

SEQ ID NO: 813654 - DNA, 13 bp, Homo sapiens
atttatgcacatt

SEQ ID NO: 813655 - DNA, 15 bp, Homo sapiens
atttatgcactgtgg

SEQ ID NO: 813656 - DNA, 13 bp, Homo sapiens
atttatgcatttc

SEQ ID NO: 813657 - DNA, 15 bp, Homo sapiens
atttatgcatttcat

SEQ ID NO: 813658 - DNA, 23 bp, Homo sapiens
atttatgcatttcattcaaatca

SEQ ID NO: 813659 - DNA, 22 bp, Homo sapiens
atttatgcttaaaatatgtatg

SEQ ID NO: 813660 - DNA, 12 bp, Homo sapiens
atttatggagga

SEQ ID NO: 813661 - DNA, 18 bp, Homo sapiens
atttatgtaaaaggatta

SEQ ID NO: 813662 - DNA, 14 bp, Homo sapiens
atttatgtagatgt

SEQ ID NO: 813663 - DNA, 20 bp, Homo sapiens
atttatgtagatgtgcattt

SEQ ID NO: 813664 - DNA, 21 bp, Homo sapiens
atttatgtagatgtgcatttt

SEQ ID NO: 813665 - DNA, 17 bp, Homo sapiens
atttatgtattttgaaa

SEQ ID NO: 813666 - DNA, 23 bp, Homo sapiens
atttatgtattttgaaaaagaga

SEQ ID NO: 813667 - DNA, 12 bp, Homo sapiens
atttatgtgcta

SEQ ID NO: 813668 - DNA, 13 bp, Homo sapiens
atttatgtgtgag

SEQ ID NO: 813669 - DNA, 22 bp, Homo sapiens
atttatgtgtgaggagctgctg

SEQ ID NO: 813670 - DNA, 13 bp, Homo sapiens
atttatgtttgca

SEQ ID NO: 813671 - DNA, 22 bp, Homo sapiens
atttatgtttgcacttgtgatt

SEQ ID NO: 813672 - DNA, 15 bp, Homo sapiens
atttattaaaaatgt

SEQ ID NO: 813673 - DNA, 23 bp, Homo sapiens
atttattaaaatgattgtaaaat

SEQ ID NO: 813674 - DNA, 17 bp, Homo sapiens
atttcagtattttccag

SEQ ID NO: 813675 - DNA, 18 bp, Homo sapiens
atttcagtattttccagc

SEQ ID NO: 813676 - DNA, 20 bp, Homo sapiens
atttcagtcaattctgatgt

SEQ ID NO: 813677 - DNA, 16 bp, Homo sapiens
atttcagtgtattgtt

SEQ ID NO: 813678 - DNA, 15 bp, Homo sapiens
atttcagtttttcat

SEQ ID NO: 813679 - DNA, 18 bp, Homo sapiens
atttcagtttttcatttg

SEQ ID NO: 813680 - DNA, 19 bp, Homo sapiens
atttcagtttttcatttgt

SEQ ID NO: 813681 - DNA, 21 bp, Homo sapiens
atttcagtttttcatttgttt

SEQ ID NO: 813682 - DNA, 21 bp, Homo sapiens
atttcataaggcctgccctcc

SEQ ID NO: 813683 - DNA, 16 bp, Homo sapiens
atttcataatttgttt

SEQ ID NO: 813684 - DNA, 23 bp, Homo sapiens
atttcataatttgtttccagcat

SEQ ID NO: 813685 - DNA, 22 bp, Homo sapiens
atttcatacaacagaaaccaga

SEQ ID NO: 813686 - DNA, 15 bp, Homo sapiens
atttcatcacaagaa

SEQ ID NO: 813687 - DNA, 19 bp, Homo sapiens
atttcatcacaagaacaca

SEQ ID NO: 813688 - DNA, 18 bp, Homo sapiens
atttcatcatattataca

SEQ ID NO: 813689 - DNA, 20 bp, Homo sapiens
atttcatcatattatacaga

SEQ ID NO: 813690 - DNA, 14 bp, Homo sapiens
atttcatcattgtt

SEQ ID NO: 813691 - DNA, 14 bp, Homo sapiens
atttcatctatttc

SEQ ID NO: 813692 - DNA, 20 bp, Homo sapiens
atttcatctatttctgagaa

SEQ ID NO: 813693 - DNA, 23 bp, Homo sapiens
atttcatctcatttaagggaaaa

SEQ ID NO: 813694 - DNA, 14 bp, Homo sapiens
atttcatcttctgg

SEQ ID NO: 813695 - DNA, 15 bp, Homo sapiens
atttcatcttctgga

SEQ ID NO: 813696 - DNA, 16 bp, Homo sapiens
atttcatcttctggaa

SEQ ID NO: 813697 - DNA, 17 bp, Homo sapiens
atttcatgaaaaagctg

SEQ ID NO: 813698 - DNA, 18 bp, Homo sapiens
atttcatgaacgttatta

SEQ ID NO: 813699 - DNA, 15 bp, Homo sapiens
atttcatgattagaa

SEQ ID NO: 813700 - DNA, 15 bp, Homo sapiens
atttcatgattggct

SEQ ID NO: 813701 - DNA, 17 bp, Homo sapiens
atttcatgattggctta

SEQ ID NO: 813702 - DNA, 14 bp, Homo sapiens
atttcattatgctt

SEQ ID NO: 813703 - DNA, 17 bp, Homo sapiens
atttcattatgctttga

SEQ ID NO: 813704 - DNA, 22 bp, Homo sapiens
atttcattatgctttgaacttt

SEQ ID NO: 813705 - DNA, 16 bp, Homo sapiens
atttcattcaaatcag

SEQ ID NO: 813706 - DNA, 18 bp, Homo sapiens
atttcattcaaatcagtg

SEQ ID NO: 813707 - DNA, 14 bp, Homo sapiens
atttcattgcctgt

SEQ ID NO: 813708 - DNA, 18 bp, Homo sapiens
atttcattgcctgtgtat

SEQ ID NO: 813709 - DNA, 17 bp, Homo sapiens
atttcattgtatgatgt

SEQ ID NO: 813710 - DNA, 20 bp, Homo sapiens
atttcattgtatgatgtgtt

SEQ ID NO: 813711 - DNA, 23 bp, Homo sapiens
atttcattttgtaacaaatgaac

SEQ ID NO: 813712 - DNA, 23 bp, Homo sapiens
atttcatttttcaatagcacata

SEQ ID NO: 813713 - DNA, 13 bp, Homo sapiens
atttccaaataaa

SEQ ID NO: 813714 - DNA, 15 bp, Homo sapiens
atttccaaataaaat

SEQ ID NO: 813715 - DNA, 17 bp, Homo sapiens
atttccacaattcttct

SEQ ID NO: 813716 - DNA, 21 bp, Homo sapiens
atttccacaattcttctgtca

SEQ ID NO: 813717 - DNA, 20 bp, Homo sapiens
atttccactattttcaaaga

SEQ ID NO: 813718 - DNA, 22 bp, Homo sapiens
atttccagagtccggaggcagc

SEQ ID NO: 813719 - DNA, 21 bp, Homo sapiens
atttccaggaaaaaataaaaa

SEQ ID NO: 813720 - DNA, 13 bp, Homo sapiens
atttccaggcccc

SEQ ID NO: 813721 - DNA, 14 bp, Homo sapiens
atttccaggcccct

SEQ ID NO: 813722 - DNA, 23 bp, Homo sapiens
atttccaggcccctgaggactgg

SEQ ID NO: 813723 - DNA, 14 bp, Homo sapiens
atttccagggatat

SEQ ID NO: 813724 - DNA, 18 bp, Homo sapiens
atttccagggcagcagcc

SEQ ID NO: 813725 - DNA, 15 bp, Homo sapiens
atttccagtgagtgt

SEQ ID NO: 813726 - DNA, 18 bp, Homo sapiens
atttccagtgagtgtaaa

SEQ ID NO: 813727 - DNA, 18 bp, Homo sapiens
atttccatcttaatgtta

SEQ ID NO: 813728 - DNA, 16 bp, Homo sapiens
atttccattccagaat

SEQ ID NO: 813729 - DNA, 23 bp, Homo sapiens
atttccattgtgtggcctggtgg

SEQ ID NO: 813730 - DNA, 13 bp, Homo sapiens
atttccatttctg

SEQ ID NO: 813731 - DNA, 19 bp, Homo sapiens
atttcccaacacaaagatt

SEQ ID NO: 813732 - DNA, 23 bp, Homo sapiens
atttcccacaccgtgtaaaccaa

SEQ ID NO: 813733 - DNA, 13 bp, Homo sapiens
atttcccatctgc

SEQ ID NO: 813734 - DNA, 15 bp, Homo sapiens
atttccccaccccac

SEQ ID NO: 813735 - DNA, 21 bp, Homo sapiens
atttccccaggggaaaatgaa

SEQ ID NO: 813736 - DNA, 14 bp, Homo sapiens
atttcccgcacatg

SEQ ID NO: 813737 - DNA, 19 bp, Homo sapiens
atttcccggagccatcacc

SEQ ID NO: 813738 - DNA, 16 bp, Homo sapiens
atttcccttccaaaga

SEQ ID NO: 813739 - DNA, 13 bp, Homo sapiens
atttccggctgct

SEQ ID NO: 813740 - DNA, 14 bp, Homo sapiens
atttcctaaacata

SEQ ID NO: 813741 - DNA, 15 bp, Homo sapiens
atttcctaaggcatg

SEQ ID NO: 813742 - DNA, 13 bp, Homo sapiens
atttcctaatatg

SEQ ID NO: 813743 - DNA, 22 bp, Homo sapiens
atttcctacagaaatactgctc

SEQ ID NO: 813744 - DNA, 22 bp, Homo sapiens
atttcctcaacgttgctcccca

SEQ ID NO: 813745 - DNA, 13 bp, Homo sapiens
atttcctcacgtg

SEQ ID NO: 813746 - DNA, 17 bp, Homo sapiens
atttcctcacgtgcagg

SEQ ID NO: 813747 - DNA, 23 bp, Homo sapiens
atttcctcagatccccagctttc

SEQ ID NO: 813748 - DNA, 19 bp, Homo sapiens
atttcctcagcttatctct

SEQ ID NO: 813749 - DNA, 18 bp, Homo sapiens
atttcctcatctgggtct

SEQ ID NO: 813750 - DNA, 14 bp, Homo sapiens
atttcctcccaatt

SEQ ID NO: 813751 - DNA, 21 bp, Homo sapiens
atttcctccctctgcccctcc

SEQ ID NO: 813752 - DNA, 19 bp, Homo sapiens
atttcctcgcagcctctca

SEQ ID NO: 813753 - DNA, 22 bp, Homo sapiens
atttcctctattgatgtacagt

SEQ ID NO: 813754 - DNA, 20 bp, Homo sapiens
atttcctctccactgctgga

SEQ ID NO: 813755 - DNA, 13 bp, Homo sapiens
atttcctgccctt

SEQ ID NO: 813756 - DNA, 18 bp, Homo sapiens
atttcctggagtgccctg

SEQ ID NO: 813757 - DNA, 15 bp, Homo sapiens
atttcctggatgttt

SEQ ID NO: 813758 - DNA, 17 bp, Homo sapiens
atttcctggtgtgaagg

SEQ ID NO: 813759 - DNA, 18 bp, Homo sapiens
atttcctgtacaatcatg

SEQ ID NO: 813760 - DNA, 22 bp, Homo sapiens
atttcctgtacaatcatgaaca

SEQ ID NO: 813761 - DNA, 22 bp, Homo sapiens
atttcctgtgtttgtcctgggt

SEQ ID NO: 813762 - DNA, 19 bp, Homo sapiens
atttcctgtttgaaatatc

SEQ ID NO: 813763 - DNA, 20 bp, Homo sapiens
atttccttatcacagaaata

SEQ ID NO: 813764 - DNA, 15 bp, Homo sapiens
atttccttcaggttt

SEQ ID NO: 813765 - DNA, 22 bp, Homo sapiens
atttccttctgttaagaaagga

SEQ ID NO: 813766 - DNA, 23 bp, Homo sapiens
atttccttgaatgtggcttgaga

SEQ ID NO: 813767 - DNA, 13 bp, Homo sapiens
atttcctttatgt

SEQ ID NO: 813768 - DNA, 15 bp, Homo sapiens
atttcctttatgtga

SEQ ID NO: 813769 - DNA, 17 bp, Homo sapiens
atttcctttatgtgaat

SEQ ID NO: 813770 - DNA, 22 bp, Homo sapiens
atttcctttattattctgtatc

SEQ ID NO: 813771 - DNA, 16 bp, Homo sapiens
atttcctttgcttcaa

SEQ ID NO: 813772 - DNA, 18 bp, Homo sapiens
atttcctttggagctttt

SEQ ID NO: 813773 - DNA, 19 bp, Homo sapiens
atttcctttttgacactga

SEQ ID NO: 813774 - DNA, 17 bp, Homo sapiens
atttcgaaactgccaag

SEQ ID NO: 813775 - DNA, 15 bp, Homo sapiens
atttcgcttcttaga

SEQ ID NO: 813776 - DNA, 19 bp, Homo sapiens
atttcggattttttccaaa

SEQ ID NO: 813777 - DNA, 14 bp, Homo sapiens
atttctaaattaag

SEQ ID NO: 813778 - DNA, 23 bp, Homo sapiens
atttctaacagtccttgctttgg

SEQ ID NO: 813779 - DNA, 14 bp, Homo sapiens
atttctaagaaata

SEQ ID NO: 813780 - DNA, 14 bp, Homo sapiens
atttctaagaagtt

SEQ ID NO: 813781 - DNA, 23 bp, Homo sapiens
atttctaagaagttactttttgt

SEQ ID NO: 813782 - DNA, 17 bp, Homo sapiens
atttctaagaagttgtt

SEQ ID NO: 813783 - DNA, 19 bp, Homo sapiens
atttctaagtatttaaatg

SEQ ID NO: 813784 - DNA, 13 bp, Homo sapiens
atttctaattgca

SEQ ID NO: 813785 - DNA, 18 bp, Homo sapiens
atttctacaactggagtt

SEQ ID NO: 813786 - DNA, 17 bp, Homo sapiens
atttctactatatacat

SEQ ID NO: 813787 - DNA, 15 bp, Homo sapiens
atttctactgtcaaa

SEQ ID NO: 813788 - DNA, 16 bp, Homo sapiens
atttctactgtcaaat

SEQ ID NO: 813789 - DNA, 14 bp, Homo sapiens
atttctagaaacaa

SEQ ID NO: 813790 - DNA, 21 bp, Homo sapiens
atttctagactcaaaacctgg

SEQ ID NO: 813791 - DNA, 16 bp, Homo sapiens
atttctagcaggcagg

SEQ ID NO: 813792 - DNA, 17 bp, Homo sapiens
atttctagcaggcagga

SEQ ID NO: 813793 - DNA, 16 bp, Homo sapiens
atttctagcttatcta

SEQ ID NO: 813794 - DNA, 11 bp, Homo sapiens
atttctaggta

SEQ ID NO: 813795 - DNA, 22 bp, Homo sapiens
atttgggctgaatgtatgtaaa

SEQ ID NO: 813796 - DNA, 23 bp, Homo sapiens
atttgggggaggctttgggagca

SEQ ID NO: 813797 - DNA, 22 bp, Homo sapiens
atttgggggctcggggaggcag

SEQ ID NO: 813798 - DNA, 20 bp, Homo sapiens
atttggtaaaaatgctgctc

SEQ ID NO: 813799 - DNA, 21 bp, Homo sapiens
atttggtaaaaatgctgctct

SEQ ID NO: 813800 - DNA, 23 bp, Homo sapiens
atttggtcaagattttgaatgct

SEQ ID NO: 813801 - DNA, 14 bp, Homo sapiens
atttggtctcaggc

SEQ ID NO: 813802 - DNA, 23 bp, Homo sapiens
atttggtgccgatgttgaacttt

SEQ ID NO: 813803 - DNA, 17 bp, Homo sapiens
atttggtgttcctggaa

SEQ ID NO: 813804 - DNA, 20 bp, Homo sapiens
atttggtgttcctggaagca

SEQ ID NO: 813805 - DNA, 21 bp, Homo sapiens
atttggttaagtttttttcct

SEQ ID NO: 813806 - DNA, 16 bp, Homo sapiens
atttggttcattaatt

SEQ ID NO: 813807 - DNA, 15 bp, Homo sapiens
atttggttctaatag

SEQ ID NO: 813808 - DNA, 21 bp, Homo sapiens
atttggttgcactttagacat

SEQ ID NO: 813809 - DNA, 23 bp, Homo sapiens
atttgtaaaagaacagtaaacat

SEQ ID NO: 813810 - DNA, 17 bp, Homo sapiens
atttgtaaacttctgaa

SEQ ID NO: 813811 - DNA, 18 bp, Homo sapiens
atttgtaaagctttacaa

SEQ ID NO: 813812 - DNA, 14 bp, Homo sapiens
atttgtaaatagct

SEQ ID NO: 813813 - DNA, 12 bp, Homo sapiens
atttgtaaatga

SEQ ID NO: 813814 - DNA, 18 bp, Homo sapiens
atttgtaaatgattttaa

SEQ ID NO: 813815 - DNA, 20 bp, Homo sapiens
atttgtaaattgaataagtg

SEQ ID NO: 813816 - DNA, 14 bp, Homo sapiens
atttgtaaatttag

SEQ ID NO: 813817 - DNA, 17 bp, Homo sapiens
atttgtaacattgtaaa

SEQ ID NO: 813818 - DNA, 18 bp, Homo sapiens
atttgtaacattgtaaag

SEQ ID NO: 813819 - DNA, 21 bp, Homo sapiens
atttgtaacattgtaaagtat

SEQ ID NO: 813820 - DNA, 17 bp, Homo sapiens
atttgtaacctcagctc

SEQ ID NO: 813821 - DNA, 15 bp, Homo sapiens
atttgtaagtgtaaa

SEQ ID NO: 813822 - DNA, 18 bp, Homo sapiens
atttgtaataaagtatat

SEQ ID NO: 813823 - DNA, 22 bp, Homo sapiens
atttgtaatagatgtttgatag

SEQ ID NO: 813824 - DNA, 19 bp, Homo sapiens
atttgtaattaaaagcaaa

SEQ ID NO: 813825 - DNA, 21 bp, Homo sapiens
atttgtaattaaaagcaaatc

SEQ ID NO: 813826 - DNA, 23 bp, Homo sapiens
atttgtaattaaaagcaaatcat

SEQ ID NO: 813827 - DNA, 20 bp, Homo sapiens
atttgtaattgcttacattt

SEQ ID NO: 813828 - DNA, 23 bp, Homo sapiens
atttgtaattgcttacattttta

SEQ ID NO: 813829 - DNA, 12 bp, Homo sapiens
atttgtacaagg

SEQ ID NO: 813830 - DNA, 14 bp, Homo sapiens
atttgtacaatggt

SEQ ID NO: 813831 - DNA, 17 bp, Homo sapiens
atttgtacaatggttta

SEQ ID NO: 813832 - DNA, 18 bp, Homo sapiens
atttgtacaggactgtaa

SEQ ID NO: 813833 - DNA, 20 bp, Homo sapiens
atttgtacaggactgtaaag

SEQ ID NO: 813834 - DNA, 22 bp, Homo sapiens
atttgtacaggactgtaaagat

SEQ ID NO: 813835 - DNA, 23 bp, Homo sapiens
atttgtacaggactgtaaagatt

SEQ ID NO: 813836 - DNA, 19 bp, Homo sapiens
atttgtacatatgtaaaat

SEQ ID NO: 813837 - DNA, 13 bp, Homo sapiens
atttgtaccattc

SEQ ID NO: 813838 - DNA, 21 bp, Homo sapiens
atttgtaccattccttcaaat

SEQ ID NO: 813839 - DNA, 14 bp, Homo sapiens
atttgtacttctta

SEQ ID NO: 813840 - DNA, 20 bp, Homo sapiens
atttgtacttcttattgcaa

SEQ ID NO: 813841 - DNA, 11 bp, Homo sapiens
atttgtagcat

SEQ ID NO: 813842 - DNA, 17 bp, Homo sapiens
atttgtagcataactgt

SEQ ID NO: 813843 - DNA, 14 bp, Homo sapiens
atttgtataaaatg

SEQ ID NO: 813844 - DNA, 22 bp, Homo sapiens
atttgtataaagcattactctt

SEQ ID NO: 813845 - DNA, 18 bp, Homo sapiens
atttgtataaattaaata

SEQ ID NO: 813846 - DNA, 15 bp, Homo sapiens
atttgtatatcatga

SEQ ID NO: 813847 - DNA, 14 bp, Homo sapiens
atttgtatattgtg

SEQ ID NO: 813848 - DNA, 23 bp, Homo sapiens
atttgtatattgtggatgtgttc

SEQ ID NO: 813849 - DNA, 23 bp, Homo sapiens
atttgtatccacacaaattcagt

SEQ ID NO: 813850 - DNA, 22 bp, Homo sapiens
atttgtatctctgaagcatgtt

SEQ ID NO: 813851 - DNA, 21 bp, Homo sapiens
atttgtatgtattttcagtta

SEQ ID NO: 813852 - DNA, 12 bp, Homo sapiens
atttgtattaat

SEQ ID NO: 813853 - DNA, 13 bp, Homo sapiens
atttgtattaata

SEQ ID NO: 813854 - DNA, 23 bp, Homo sapiens
atttgtattaccattacttgtat

SEQ ID NO: 813855 - DNA, 17 bp, Homo sapiens
atttgtatttctcttgt

SEQ ID NO: 813856 - DNA, 19 bp, Homo sapiens
atttgtatttctcttgtcc

SEQ ID NO: 813857 - DNA, 18 bp, Homo sapiens
atttgtattttgtgtgac

SEQ ID NO: 813858 - DNA, 17 bp, Homo sapiens
atttgtatttttttgca

SEQ ID NO: 813859 - DNA, 21 bp, Homo sapiens
atttgtatttttttgcaagtg

SEQ ID NO: 813860 - DNA, 13 bp, Homo sapiens
atttgtcccagcc

SEQ ID NO: 813861 - DNA, 20 bp, Homo sapiens
atttgtcccagcctggggct

SEQ ID NO: 813862 - DNA, 19 bp, Homo sapiens
atttgtccttttatttctc

SEQ ID NO: 813863 - DNA, 18 bp, Homo sapiens
atttgtccttttgtgaaa

SEQ ID NO: 813864 - DNA, 18 bp, Homo sapiens
atttgtctcctactctgt

SEQ ID NO: 813865 - DNA, 20 bp, Homo sapiens
atttgtctcctactctgtgt

SEQ ID NO: 813866 - DNA, 19 bp, Homo sapiens
atttgtctgtaaaaaatgg

SEQ ID NO: 813867 - DNA, 13 bp, Homo sapiens
atttgtcttaaaa

SEQ ID NO: 813868 - DNA, 22 bp, Homo sapiens
atttgtcttaaaaaatgtgaaa

SEQ ID NO: 813869 - DNA, 23 bp, Homo sapiens
atttgtcttaaaaaatgtgaaat

SEQ ID NO: 813870 - DNA, 15 bp, Homo sapiens
atttgtcttccgatc

SEQ ID NO: 813871 - DNA, 15 bp, Homo sapiens
atttgtctttaaaca

SEQ ID NO: 813872 - DNA, 23 bp, Homo sapiens
atttgtctttttgttgtaaaaca

SEQ ID NO: 813873 - DNA, 12 bp, Homo sapiens
atttgtgaagaa

SEQ ID NO: 813874 - DNA, 14 bp, Homo sapiens
atttgtgaagaatt

SEQ ID NO: 813875 - DNA, 10 bp, Homo sapiens
atttgtgaat

SEQ ID NO: 813876 - DNA, 12 bp, Homo sapiens
atttgtgaattt

SEQ ID NO: 813877 - DNA, 13 bp, Homo sapiens
atttgtgaatttg

SEQ ID NO: 813878 - DNA, 17 bp, Homo sapiens
atttgtgaatttgcaac

SEQ ID NO: 813879 - DNA, 13 bp, Homo sapiens
atttgtgactttt

SEQ ID NO: 813880 - DNA, 14 bp, Homo sapiens
atttgtgatacaat

SEQ ID NO: 813881 - DNA, 18 bp, Homo sapiens
atttgtgctatagtattt

SEQ ID NO: 813882 - DNA, 22 bp, Homo sapiens
atttgtgctgggttattcagaa

SEQ ID NO: 813883 - DNA, 22 bp, Homo sapiens
atttgtggcaattttatgtttt

SEQ ID NO: 813884 - DNA, 21 bp, Homo sapiens
atttgtgtaatagaaaactga

SEQ ID NO: 813885 - DNA, 14 bp, Homo sapiens
atttgtgtatttaa

SEQ ID NO: 813886 - DNA, 22 bp, Homo sapiens
atttgtgtatttaacagggagg

SEQ ID NO: 813887 - DNA, 22 bp, Homo sapiens
atttgtgtattttcctggattt

SEQ ID NO: 813888 - DNA, 17 bp, Homo sapiens
atttgtgtgtatgtgta

SEQ ID NO: 813889 - DNA, 12 bp, Homo sapiens
atttgtgtgtgt

SEQ ID NO: 813890 - DNA, 20 bp, Homo sapiens
atttgtgttttaatttaaac

SEQ ID NO: 813891 - DNA, 22 bp, Homo sapiens
atttgttaaaatacagttctgt

SEQ ID NO: 813892 - DNA, 14 bp, Homo sapiens
atttgttaaaatta

SEQ ID NO: 813893 - DNA, 15 bp, Homo sapiens
atttgttactgtatt

SEQ ID NO: 813894 - DNA, 22 bp, Homo sapiens
atttgttactttacttttgctg

SEQ ID NO: 813895 - DNA, 20 bp, Homo sapiens
atttgttagactagttctct

SEQ ID NO: 813896 - DNA, 14 bp, Homo sapiens
atttgttatggtta

SEQ ID NO: 813897 - DNA, 17 bp, Homo sapiens
atttgttattttcagta

SEQ ID NO: 813898 - DNA, 17 bp, Homo sapiens
atttgttattttgcaac

SEQ ID NO: 813899 - DNA, 11 bp, Homo sapiens
atttgttcctg

SEQ ID NO: 813900 - DNA, 21 bp, Homo sapiens
atttgttcctgcttccgagat

SEQ ID NO: 813901 - DNA, 12 bp, Homo sapiens
atttgttcctgg

SEQ ID NO: 813902 - DNA, 17 bp, Homo sapiens
atttgttgacagcaaaa

SEQ ID NO: 813903 - DNA, 15 bp, Homo sapiens
atttgttggaatgaa

SEQ ID NO: 813904 - DNA, 20 bp, Homo sapiens
atttgttggggctttacata

SEQ ID NO: 813905 - DNA, 16 bp, Homo sapiens
atttgtttaaaaagta

SEQ ID NO: 813906 - DNA, 17 bp, Homo sapiens
atttgtttaaaaagtaa

SEQ ID NO: 813907 - DNA, 20 bp, Homo sapiens
atttgtttaaaattctcttt

SEQ ID NO: 813908 - DNA, 16 bp, Homo sapiens
atttgtttaaagaata

SEQ ID NO: 813909 - DNA, 17 bp, Homo sapiens
atttgtttaaagaataa

SEQ ID NO: 813910 - DNA, 19 bp, Homo sapiens
atttgtttaaagaataaag

SEQ ID NO: 813911 - DNA, 22 bp, Homo sapiens
atttgtttatggtaaaaaattt

SEQ ID NO: 813912 - DNA, 20 bp, Homo sapiens
atttgtttcccccacagttt

SEQ ID NO: 813913 - DNA, 22 bp, Homo sapiens
atttgtttcccccacagtttta

SEQ ID NO: 813914 - DNA, 16 bp, Homo sapiens
atttgtttgaactgat

SEQ ID NO: 813915 - DNA, 23 bp, Homo sapiens
atttgtttgaactgataaagatg

SEQ ID NO: 813916 - DNA, 14 bp, Homo sapiens
attttcttttatta

SEQ ID NO: 813917 - DNA, 20 bp, Homo sapiens
attttcttttctttcaactt

SEQ ID NO: 813918 - DNA, 13 bp, Homo sapiens
attttgaaaaaga

SEQ ID NO: 813919 - DNA, 15 bp, Homo sapiens
attttgaaacaaagt

SEQ ID NO: 813920 - DNA, 19 bp, Homo sapiens
attttgaaagtctgtcctt

SEQ ID NO: 813921 - DNA, 15 bp, Homo sapiens
attttgaaattgttt

SEQ ID NO: 813922 - DNA, 13 bp, Homo sapiens
attttgaactttt

SEQ ID NO: 813923 - DNA, 22 bp, Homo sapiens
attttgaagtgctgtttattaa

SEQ ID NO: 813924 - DNA, 12 bp, Homo sapiens
attttgaatcaa

SEQ ID NO: 813925 - DNA, 16 bp, Homo sapiens
attttgacactgaaat

SEQ ID NO: 813926 - DNA, 15 bp, Homo sapiens
attttgacataagta

SEQ ID NO: 813927 - DNA, 14 bp, Homo sapiens
attttgagaaaaat

SEQ ID NO: 813928 - DNA, 22 bp, Homo sapiens
attttgagaatgctgacacttt

SEQ ID NO: 813929 - DNA, 18 bp, Homo sapiens
attttgagtaaagctcct

SEQ ID NO: 813930 - DNA, 19 bp, Homo sapiens
attttgagtattccatgag

SEQ ID NO: 813931 - DNA, 21 bp, Homo sapiens
attttgagtattccatgagct

SEQ ID NO: 813932 - DNA, 18 bp, Homo sapiens
attttgagtatttttaaa

SEQ ID NO: 813933 - DNA, 20 bp, Homo sapiens
attttgagtcctaggactta

SEQ ID NO: 813934 - DNA, 23 bp, Homo sapiens
attttgagtgactcgagggttgg

SEQ ID NO: 813935 - DNA, 15 bp, Homo sapiens
attttgagtttgcct

SEQ ID NO: 813936 - DNA, 18 bp, Homo sapiens
attttgagtttgcctcag

SEQ ID NO: 813937 - DNA, 17 bp, Homo sapiens
attttgatacaaatgtt

SEQ ID NO: 813938 - DNA, 18 bp, Homo sapiens
attttgatacaaatgttt

SEQ ID NO: 813939 - DNA, 17 bp, Homo sapiens
attttgataccagaagg

SEQ ID NO: 813940 - DNA, 20 bp, Homo sapiens
attttgatatacattgtgtg

SEQ ID NO: 813941 - DNA, 18 bp, Homo sapiens
attttgatgtaaagatgt

SEQ ID NO: 813942 - DNA, 14 bp, Homo sapiens
attttgattttaca

SEQ ID NO: 813943 - DNA, 14 bp, Homo sapiens
attttgcaaaatga

SEQ ID NO: 813944 - DNA, 18 bp, Homo sapiens
attttgcaaaatttccag

SEQ ID NO: 813945 - DNA, 21 bp, Homo sapiens
attttgcaaacccaactaagc

SEQ ID NO: 813946 - DNA, 22 bp, Homo sapiens
attttgcaaacccaactaagcc

SEQ ID NO: 813947 - DNA, 15 bp, Homo sapiens
attttgcagaaggaa

SEQ ID NO: 813948 - DNA, 14 bp, Homo sapiens
attttgcattcaaa

SEQ ID NO: 813949 - DNA, 17 bp, Homo sapiens
attttgcattccagaat

SEQ ID NO: 813950 - DNA, 14 bp, Homo sapiens
attttgcatttagt

SEQ ID NO: 813951 - DNA, 15 bp, Homo sapiens
attttgcatttagtt

SEQ ID NO: 813952 - DNA, 21 bp, Homo sapiens
attttgcccaacctaatgctc

SEQ ID NO: 813953 - DNA, 15 bp, Homo sapiens
attttgccctcctgc

SEQ ID NO: 813954 - DNA, 18 bp, Homo sapiens
attttgccctcctgccca

SEQ ID NO: 813955 - DNA, 17 bp, Homo sapiens
attttgccgctgagata

SEQ ID NO: 813956 - DNA, 12 bp, Homo sapiens
attttgctccct

SEQ ID NO: 813957 - DNA, 13 bp, Homo sapiens
attttgctccctc

SEQ ID NO: 813958 - DNA, 15 bp, Homo sapiens
attttgctccctctg

SEQ ID NO: 813959 - DNA, 16 bp, Homo sapiens
attttgctccctctgt

SEQ ID NO: 813960 - DNA, 18 bp, Homo sapiens
attttgctccctctgtta

SEQ ID NO: 813961 - DNA, 15 bp, Homo sapiens
attttgctgagttgt

SEQ ID NO: 813962 - DNA, 12 bp, Homo sapiens
attttgctgtat

SEQ ID NO: 813963 - DNA, 14 bp, Homo sapiens
attttgctgtatat

SEQ ID NO: 813964 - DNA, 21 bp, Homo sapiens
attttgctttagagaatgcca

SEQ ID NO: 813965 - DNA, 14 bp, Homo sapiens
attttgctttggtt

SEQ ID NO: 813966 - DNA, 20 bp, Homo sapiens
attttgctttgtgatttttg

SEQ ID NO: 813967 - DNA, 14 bp, Homo sapiens
attttggaaaataa

SEQ ID NO: 813968 - DNA, 12 bp, Homo sapiens
attttggaaact

SEQ ID NO: 813969 - DNA, 18 bp, Homo sapiens
attttggaaactgctaaa

SEQ ID NO: 813970 - DNA, 22 bp, Homo sapiens
attttggaaactgctaaattct

SEQ ID NO: 813971 - DNA, 18 bp, Homo sapiens
attttggaaagatgttaa

SEQ ID NO: 813972 - DNA, 20 bp, Homo sapiens
attttggaagttttcaggac

SEQ ID NO: 813973 - DNA, 12 bp, Homo sapiens
attttggaattt

SEQ ID NO: 813974 - DNA, 14 bp, Homo sapiens
attttggagaaatt

SEQ ID NO: 813975 - DNA, 21 bp, Homo sapiens
attttggagaaattatttaat

SEQ ID NO: 813976 - DNA, 17 bp, Homo sapiens
attttggattttgcaag

SEQ ID NO: 813977 - DNA, 16 bp, Homo sapiens
attttggctttctccc

SEQ ID NO: 813978 - DNA, 22 bp, Homo sapiens
attttggggggcagagaataaa

SEQ ID NO: 813979 - DNA, 22 bp, Homo sapiens
attttggggggttttgtgtgtt

SEQ ID NO: 813980 - DNA, 22 bp, Homo sapiens
attttgggggtttttaatcttt

SEQ ID NO: 813981 - DNA, 21 bp, Homo sapiens
attttgggtattaatatatag

SEQ ID NO: 813982 - DNA, 21 bp, Homo sapiens
attttggtattacactgtatt

SEQ ID NO: 813983 - DNA, 18 bp, Homo sapiens
attttggtgaatgtgggt

SEQ ID NO: 813984 - DNA, 18 bp, Homo sapiens
attttggtgcacaaatac

SEQ ID NO: 813985 - DNA, 10 bp, Homo sapiens
attttgtaaa

SEQ ID NO: 813986 - DNA, 17 bp, Homo sapiens
attttgtaaaatgtatt

SEQ ID NO: 813987 - DNA, 18 bp, Homo sapiens
attttgtaaaatgtatta

SEQ ID NO: 813988 - DNA, 19 bp, Homo sapiens
attttgtaaaatgtattat

SEQ ID NO: 813989 - DNA, 18 bp, Homo sapiens
attttgtaacgaagacac

SEQ ID NO: 813990 - DNA, 12 bp, Homo sapiens
attttgtaagaa

SEQ ID NO: 813991 - DNA, 22 bp, Homo sapiens
attttgtaataataaagaatag

SEQ ID NO: 813992 - DNA, 14 bp, Homo sapiens
attttgtactttgt

SEQ ID NO: 813993 - DNA, 14 bp, Homo sapiens
attttgtatatatc

SEQ ID NO: 813994 - DNA, 14 bp, Homo sapiens
attttgtatctgca

SEQ ID NO: 813995 - DNA, 15 bp, Homo sapiens
attttgtatctgcag

SEQ ID NO: 813996 - DNA, 18 bp, Homo sapiens
attttgtatgaggtcctc

SEQ ID NO: 813997 - DNA, 22 bp, Homo sapiens
attttgtatgaggtcctcaggt

SEQ ID NO: 813998 - DNA, 15 bp, Homo sapiens
attttgtattttcaa

SEQ ID NO: 813999 - DNA, 16 bp, Homo sapiens
attttgtcacattatt

SEQ ID NO: 814000 - DNA, 13 bp, Homo sapiens
attttgtccaagt

SEQ ID NO: 814001 - DNA, 16 bp, Homo sapiens
attttgtctaaaatgc

SEQ ID NO: 814002 - DNA, 21 bp, Homo sapiens
attttgtctaaaatgcctcag

SEQ ID NO: 814003 - DNA, 21 bp, Homo sapiens
attttgtctcctacctgctgc

SEQ ID NO: 814004 - DNA, 17 bp, Homo sapiens
attttgtgacattcctt

SEQ ID NO: 814005 - DNA, 16 bp, Homo sapiens
attttgtgatgatgct

SEQ ID NO: 814006 - DNA, 20 bp, Homo sapiens
attttgtgcattctttggta

SEQ ID NO: 814007 - DNA, 22 bp, Homo sapiens
attttgtgcattctttggtaat

SEQ ID NO: 814008 - DNA, 20 bp, Homo sapiens
attttgtggctttctttctt

SEQ ID NO: 814009 - DNA, 23 bp, Homo sapiens
attttgtggttttcgagattatc

SEQ ID NO: 814010 - DNA, 20 bp, Homo sapiens
attttgtgtaaatttctcaa

SEQ ID NO: 814011 - DNA, 16 bp, Homo sapiens
attttgtgtaagaaat

SEQ ID NO: 814012 - DNA, 17 bp, Homo sapiens
attttgtgtaagaaata

SEQ ID NO: 814013 - DNA, 12 bp, Homo sapiens
attttgtgtcct

SEQ ID NO: 814014 - DNA, 22 bp, Homo sapiens
attttgtgtcttttaaactgga

SEQ ID NO: 814015 - DNA, 17 bp, Homo sapiens
attttgtgtgaccaact

SEQ ID NO: 814016 - DNA, 20 bp, Homo sapiens
attttgttaaaatctacttt

SEQ ID NO: 814017 - DNA, 21 bp, Homo sapiens
attttgttaaagctggaacat

SEQ ID NO: 814018 - DNA, 14 bp, Homo sapiens
attttgttaacttt

SEQ ID NO: 814019 - DNA, 17 bp, Homo sapiens
attttgttaacttttgt

SEQ ID NO: 814020 - DNA, 15 bp, Homo sapiens
attttgttactgatt

SEQ ID NO: 814021 - DNA, 18 bp, Homo sapiens
attttgttatagaatact

SEQ ID NO: 814022 - DNA, 15 bp, Homo sapiens
attttgttctctggg

SEQ ID NO: 814023 - DNA, 18 bp, Homo sapiens
attttgttctctgggaga

SEQ ID NO: 814024 - DNA, 22 bp, Homo sapiens
attttgttctctgggagaaaat

SEQ ID NO: 814025 - DNA, 19 bp, Homo sapiens
attttgttgcttttgtgaa

SEQ ID NO: 814026 - DNA, 21 bp, Homo sapiens
attttgttggcatagctctgg

SEQ ID NO: 814027 - DNA, 23 bp, Homo sapiens
attttgttgtgtgtatgctgctt

SEQ ID NO: 814028 - DNA, 20 bp, Homo sapiens
attttgtttcagaattttgt

SEQ ID NO: 814029 - DNA, 21 bp, Homo sapiens
attttgtttcagaattttgta

SEQ ID NO: 814030 - DNA, 16 bp, Homo sapiens
attttgtttctgtata

SEQ ID NO: 814031 - DNA, 18 bp, Homo sapiens
attttgttttaatctact

SEQ ID NO: 814032 - DNA, 22 bp, Homo sapiens
attttgttttaatctacttttt

SEQ ID NO: 814033 - DNA, 20 bp, Homo sapiens
attttgtttttattttcaag

SEQ ID NO: 814034 - DNA, 21 bp, Homo sapiens
attttgtttttgtcttaaaaa

SEQ ID NO: 814035 - DNA, 19 bp, Homo sapiens
atttttaaaaaatattttc

SEQ ID NO: 814036 - DNA, 16 bp, Homo sapiens
atttttaaaatattta

SEQ ID NO: 814037 - DNA, 22 bp, Homo sapiens
atttttaaaatatttaactttt

SEQ ID NO: 814038 - DNA, 16 bp, Homo sapiens
caaaaagatgtatatt

SEQ ID NO: 814039 - DNA, 12 bp, Homo sapiens
caaaaagcacat

SEQ ID NO: 814040 - DNA, 13 bp, Homo sapiens
caaaaagccttga

SEQ ID NO: 814041 - DNA, 21 bp, Homo sapiens
caaaaagccttgaagaaaatg

SEQ ID NO: 814042 - DNA, 17 bp, Homo sapiens
caaaaagctaacatctt

SEQ ID NO: 814043 - DNA, 20 bp, Homo sapiens
caaaaaggagcgggcagggc

SEQ ID NO: 814044 - DNA, 18 bp, Homo sapiens
caaaaaggcaaatattga

SEQ ID NO: 814045 - DNA, 21 bp, Homo sapiens
caaaaaggcaaatattgaagt

SEQ ID NO: 814046 - DNA, 21 bp, Homo sapiens
caaaaagggcttgaggtgaat

SEQ ID NO: 814047 - DNA, 13 bp, Homo sapiens
caaaaaggttgct

SEQ ID NO: 814048 - DNA, 14 bp, Homo sapiens
caaaaagtattatc

SEQ ID NO: 814049 - DNA, 15 bp, Homo sapiens
caaaaagtattatca

SEQ ID NO: 814050 - DNA, 15 bp, Homo sapiens
caaaaagtgcttcat

SEQ ID NO: 814051 - DNA, 14 bp, Homo sapiens
caaaaataaattta

SEQ ID NO: 814052 - DNA, 16 bp, Homo sapiens
caaaaatacaacacag

SEQ ID NO: 814053 - DNA, 23 bp, Homo sapiens
caaaaatataaaatatgaagaca

SEQ ID NO: 814054 - DNA, 15 bp, Homo sapiens
caaaaatataactta

SEQ ID NO: 814055 - DNA, 16 bp, Homo sapiens
caaaaatatctcctcc

SEQ ID NO: 814056 - DNA, 17 bp, Homo sapiens
caaaaatatctcctcca

SEQ ID NO: 814057 - DNA, 19 bp, Homo sapiens
caaaaatcaaagaacagat

SEQ ID NO: 814058 - DNA, 22 bp, Homo sapiens
caaaaatcaaagaacagatggg

SEQ ID NO: 814059 - DNA, 19 bp, Homo sapiens
caaaaatctcccagtgaca

SEQ ID NO: 814060 - DNA, 17 bp, Homo sapiens
caaaaatgacaacagaa

SEQ ID NO: 814061 - DNA, 20 bp, Homo sapiens
caaaaatgacaacagaaaaa

SEQ ID NO: 814062 - DNA, 19 bp, Homo sapiens
caaaaatgtccagccaccc

SEQ ID NO: 814063 - DNA, 21 bp, Homo sapiens
caaaaatgttcccttgaccat

SEQ ID NO: 814064 - DNA, 16 bp, Homo sapiens
caaaaattaggtattt

SEQ ID NO: 814065 - DNA, 17 bp, Homo sapiens
caaaaattatctatagc

SEQ ID NO: 814066 - DNA, 19 bp, Homo sapiens
caaaaattatctatagcta

SEQ ID NO: 814067 - DNA, 23 bp, Homo sapiens
caaaaattcagagtccttgcaaa

SEQ ID NO: 814068 - DNA, 19 bp, Homo sapiens
caaaaattgccaagtgcct

SEQ ID NO: 814069 - DNA, 16 bp, Homo sapiens
caaaaattttgtgaca

SEQ ID NO: 814070 - DNA, 11 bp, Homo sapiens
caaaacaaaaa

SEQ ID NO: 814071 - DNA, 15 bp, Homo sapiens
caaaacaaaaaacaa

SEQ ID NO: 814072 - DNA, 14 bp, Homo sapiens
caaaacaaaacaaa

SEQ ID NO: 814073 - DNA, 12 bp, Homo sapiens
caaaacaaaggc

SEQ ID NO: 814074 - DNA, 16 bp, Homo sapiens
caaaacaatctctcaa

SEQ ID NO: 814075 - DNA, 14 bp, Homo sapiens
caaaacaatgttta

SEQ ID NO: 814076 - DNA, 14 bp, Homo sapiens
caaaacactgtgga

SEQ ID NO: 814077 - DNA, 16 bp, Homo sapiens
caaaacactgtggaac

SEQ ID NO: 814078 - DNA, 14 bp, Homo sapiens
caaaacatcacatt

SEQ ID NO: 814079 - DNA, 14 bp, Homo sapiens
caaaacatccactt

SEQ ID NO: 814080 - DNA, 18 bp, Homo sapiens
caaaaccaagattttgaa

SEQ ID NO: 814081 - DNA, 15 bp, Homo sapiens
caaaaccaatgctga

SEQ ID NO: 814082 - DNA, 16 bp, Homo sapiens
caaaaccaatgctgat

SEQ ID NO: 814083 - DNA, 18 bp, Homo sapiens
caaaaccaatgctgatga

SEQ ID NO: 814084 - DNA, 13 bp, Homo sapiens
caaaaccacatgg

SEQ ID NO: 814085 - DNA, 14 bp, Homo sapiens
caaaaccacatggg

SEQ ID NO: 814086 - DNA, 20 bp, Homo sapiens
caaaaccacatgggctgggg

SEQ ID NO: 814087 - DNA, 16 bp, Homo sapiens
caaaaccattgcttca

SEQ ID NO: 814088 - DNA, 14 bp, Homo sapiens
caaaacctaacttg

SEQ ID NO: 814089 - DNA, 14 bp, Homo sapiens
caaaacctcaaacc

SEQ ID NO: 814090 - DNA, 21 bp, Homo sapiens
caaaacctgatgttaaaattc

SEQ ID NO: 814091 - DNA, 17 bp, Homo sapiens
caaaacctgcagttaac

SEQ ID NO: 814092 - DNA, 14 bp, Homo sapiens
caaaacctggagat

SEQ ID NO: 814093 - DNA, 20 bp, Homo sapiens
caaaacctgtattactgaat

SEQ ID NO: 814094 - DNA, 18 bp, Homo sapiens
caaaacgcacaagccaga

SEQ ID NO: 814095 - DNA, 19 bp, Homo sapiens
caaaacggatgagttatta

SEQ ID NO: 814096 - DNA, 16 bp, Homo sapiens
caaaacgtgatgtttt

SEQ ID NO: 814097 - DNA, 17 bp, Homo sapiens
caaaactacttttctaa

SEQ ID NO: 814098 - DNA, 17 bp, Homo sapiens
caaaactcccaatggat

SEQ ID NO: 814099 - DNA, 21 bp, Homo sapiens
caaaactccgcccccagccta

SEQ ID NO: 814100 - DNA, 13 bp, Homo sapiens
caaaactgctttg

SEQ ID NO: 814101 - DNA, 20 bp, Homo sapiens
caaaactgctttgtgcatat

SEQ ID NO: 814102 - DNA, 22 bp, Homo sapiens
caaaacttaagatgggcctgta

SEQ ID NO: 814103 - DNA, 19 bp, Homo sapiens
caaaagaaaccatgacaaa

SEQ ID NO: 814104 - DNA, 20 bp, Homo sapiens
caaaagaaaccatgacaaac

SEQ ID NO: 814105 - DNA, 12 bp, Homo sapiens
caaaagaaactt

SEQ ID NO: 814106 - DNA, 18 bp, Homo sapiens
caaaagaagtaaaagcaa

SEQ ID NO: 814107 - DNA, 12 bp, Homo sapiens
caaaagaatcta

SEQ ID NO: 814108 - DNA, 17 bp, Homo sapiens
caaaagacagacccagt

SEQ ID NO: 814109 - DNA, 17 bp, Homo sapiens
caaaagaccaaatctca

SEQ ID NO: 814110 - DNA, 17 bp, Homo sapiens
caaaagactggtttgtt

SEQ ID NO: 814111 - DNA, 22 bp, Homo sapiens
caaaagactggtttgtttgctt

SEQ ID NO: 814112 - DNA, 12 bp, Homo sapiens
caaaagagagaa

SEQ ID NO: 814113 - DNA, 13 bp, Homo sapiens
caaaagagagaat

SEQ ID NO: 814114 - DNA, 16 bp, Homo sapiens
caaaagagccctggct

SEQ ID NO: 814115 - DNA, 21 bp, Homo sapiens
caaaagagggtttattttcag

SEQ ID NO: 814116 - DNA, 20 bp, Homo sapiens
caaaagataatattttacat

SEQ ID NO: 814117 - DNA, 16 bp, Homo sapiens
caaaagattaatcttt

SEQ ID NO: 814118 - DNA, 22 bp, Homo sapiens
caaaagattgctgaaattttat

SEQ ID NO: 814119 - DNA, 18 bp, Homo sapiens
caaaagcagctaaatgta

SEQ ID NO: 814120 - DNA, 20 bp, Homo sapiens
caaaagcagtaaatttgcta

SEQ ID NO: 814121 - DNA, 18 bp, Homo sapiens
caaaagccatgtatttca

SEQ ID NO: 814122 - DNA, 11 bp, Homo sapiens
caaaagctgta

SEQ ID NO: 814123 - DNA, 16 bp, Homo sapiens
caaaagcttcaaatta

SEQ ID NO: 814124 - DNA, 17 bp, Homo sapiens
caaaagcttcaaattaa

SEQ ID NO: 814125 - DNA, 12 bp, Homo sapiens
caaaaggaaacc

SEQ ID NO: 814126 - DNA, 16 bp, Homo sapiens
caaaaggaaagctgtg

SEQ ID NO: 814127 - DNA, 23 bp, Homo sapiens
caaaaggatggtggttattttaa

SEQ ID NO: 814128 - DNA, 12 bp, Homo sapiens
caaaaggcagct

SEQ ID NO: 814129 - DNA, 14 bp, Homo sapiens
caaaaggcagctca

SEQ ID NO: 814130 - DNA, 19 bp, Homo sapiens
caaaaggccctctggaggg

SEQ ID NO: 814131 - DNA, 16 bp, Homo sapiens
caaaagggcagctgtg

SEQ ID NO: 814132 - DNA, 17 bp, Homo sapiens
caaaagggcagctgtga

SEQ ID NO: 814133 - DNA, 20 bp, Homo sapiens
caaaagggccaaagaaccaa

SEQ ID NO: 814134 - DNA, 13 bp, Homo sapiens
caaaagggccagg

SEQ ID NO: 814135 - DNA, 14 bp, Homo sapiens
caaaagggccaggt

SEQ ID NO: 814136 - DNA, 16 bp, Homo sapiens
caaaagggccaggtgc

SEQ ID NO: 814137 - DNA, 22 bp, Homo sapiens
caaaagggtcttgactctaaat

SEQ ID NO: 814138 - DNA, 15 bp, Homo sapiens
caaaagggtgtatag

SEQ ID NO: 814139 - DNA, 21 bp, Homo sapiens
caaaagggtgtatagtgttca

SEQ ID NO: 814140 - DNA, 23 bp, Homo sapiens
caaaagggtgtatagtgttcaca

SEQ ID NO: 814141 - DNA, 18 bp, Homo sapiens
caaaaggtgcctgtgagg

SEQ ID NO: 814142 - DNA, 22 bp, Homo sapiens
caaaaggtgcctgtgaggcagg

SEQ ID NO: 814143 - DNA, 15 bp, Homo sapiens
caaaagtccctccct

SEQ ID NO: 814144 - DNA, 21 bp, Homo sapiens
caaaagtccctccctgcctga

SEQ ID NO: 814145 - DNA, 22 bp, Homo sapiens
caaaagtggggctaaatgaagt

SEQ ID NO: 814146 - DNA, 23 bp, Homo sapiens
caaaagttttaattaaaaaaaat

SEQ ID NO: 814147 - DNA, 19 bp, Homo sapiens
caaaataaaaagtgacaca

SEQ ID NO: 814148 - DNA, 17 bp, Homo sapiens
caaaataaaaatgaggt

SEQ ID NO: 814149 - DNA, 12 bp, Homo sapiens
caaaataaaaca

SEQ ID NO: 814150 - DNA, 23 bp, Homo sapiens
caaaataaaccgtgtatttatta

SEQ ID NO: 814151 - DNA, 20 bp, Homo sapiens
caaaataaaggataactctg

SEQ ID NO: 814152 - DNA, 14 bp, Homo sapiens
caaaataataaaaa

SEQ ID NO: 814153 - DNA, 22 bp, Homo sapiens
caaaatacaatcctgtttataa

SEQ ID NO: 814154 - DNA, 15 bp, Homo sapiens
caaaatacaatgtta

SEQ ID NO: 814155 - DNA, 17 bp, Homo sapiens
caaaatacaatgttatc

SEQ ID NO: 814156 - DNA, 17 bp, Homo sapiens
caaaatacatgaagctt

SEQ ID NO: 814157 - DNA, 18 bp, Homo sapiens
caaaatacatttgtaagt

SEQ ID NO: 814158 - DNA, 23 bp, Homo sapiens
caaaataccaaatgcctgttgta

SEQ ID NO: 814159 - DNA, 12 bp, Homo sapiens
caaaatagaaaa

SEQ ID NO: 814160 - DNA, 22 bp, Homo sapiens
caaaatagaaagttgcaaggca

SEQ ID NO: 814161 - DNA, 17 bp, Homo sapiens
caaaatagggtatattt

SEQ ID NO: 814162 - DNA, 18 bp, Homo sapiens
caaaatagggtatatttt

SEQ ID NO: 814163 - DNA, 18 bp, Homo sapiens
caaaatagtattgctgaa

SEQ ID NO: 814164 - DNA, 20 bp, Homo sapiens
caaaatagtttaggaaaatg

SEQ ID NO: 814165 - DNA, 18 bp, Homo sapiens
caaaatatacaaaacttt

SEQ ID NO: 814166 - DNA, 14 bp, Homo sapiens
caaaatattaacat

SEQ ID NO: 814167 - DNA, 13 bp, Homo sapiens
caaaatatttaaa

SEQ ID NO: 814168 - DNA, 14 bp, Homo sapiens
caaaatatttaaaa

SEQ ID NO: 814169 - DNA, 21 bp, Homo sapiens
caaaatatttaaaaatgtctt

SEQ ID NO: 814170 - DNA, 14 bp, Homo sapiens
caaaatatttaagt

SEQ ID NO: 814171 - DNA, 16 bp, Homo sapiens
caaaatatttgtacat

SEQ ID NO: 814172 - DNA, 16 bp, Homo sapiens
caaaatattttttcct

SEQ ID NO: 814173 - DNA, 16 bp, Homo sapiens
caaaatattttttgca

SEQ ID NO: 814174 - DNA, 14 bp, Homo sapiens
caaaatcaacatga

SEQ ID NO: 814175 - DNA, 20 bp, Homo sapiens
caaaatcactttaagatctt

SEQ ID NO: 814176 - DNA, 14 bp, Homo sapiens
caaaatcaggaaag

SEQ ID NO: 814177 - DNA, 22 bp, Homo sapiens
caaaatccaaaaagctctgaaa

SEQ ID NO: 814178 - DNA, 21 bp, Homo sapiens
caaaatccaaaacttctcttg

SEQ ID NO: 814179 - DNA, 23 bp, Homo sapiens
caaaatccatgtgaccattctgc

SEQ ID NO: 814180 - DNA, 15 bp, Homo sapiens
caaaatcctcaggaa

SEQ ID NO: 814181 - DNA, 18 bp, Homo sapiens
caaaatcctggaagattt

SEQ ID NO: 814182 - DNA, 23 bp, Homo sapiens
caaaatcgccataggccaaggtg

SEQ ID NO: 814183 - DNA, 13 bp, Homo sapiens
caaaatctgtcca

SEQ ID NO: 814184 - DNA, 16 bp, Homo sapiens
caaaatcttgatcagt

SEQ ID NO: 814185 - DNA, 11 bp, Homo sapiens
caaaatcttgt

SEQ ID NO: 814186 - DNA, 24 bp, Homo sapiens
caaaatcttgttaatgtcattgct

SEQ ID NO: 814187 - DNA, 23 bp, Homo sapiens
caaaatctttgtataaataaata

SEQ ID NO: 814188 - DNA, 17 bp, Homo sapiens
caaaatgactttataca

SEQ ID NO: 814189 - DNA, 22 bp, Homo sapiens
caaaatgagagggcagtgtttc

SEQ ID NO: 814190 - DNA, 17 bp, Homo sapiens
caaaatgaggaatgtat

SEQ ID NO: 814191 - DNA, 20 bp, Homo sapiens
caaaatgaggaatgtatatg

SEQ ID NO: 814192 - DNA, 17 bp, Homo sapiens
caaaatggaataaaagg

SEQ ID NO: 814193 - DNA, 17 bp, Homo sapiens
caaaatggatacataaa

SEQ ID NO: 814194 - DNA, 17 bp, Homo sapiens
caaaatgtacttaaatg

SEQ ID NO: 814195 - DNA, 19 bp, Homo sapiens
caaaatgtacttaaatgag

SEQ ID NO: 814196 - DNA, 15 bp, Homo sapiens
caaaatgtagggtta

SEQ ID NO: 814197 - DNA, 14 bp, Homo sapiens
caaaatgtgtattt

SEQ ID NO: 814198 - DNA, 20 bp, Homo sapiens
caaaatgtgtatttcttata

SEQ ID NO: 814199 - DNA, 10 bp, Homo sapiens
caaaatgttc

SEQ ID NO: 814200 - DNA, 16 bp, Homo sapiens
caaaatgttggctgcg

SEQ ID NO: 814201 - DNA, 11 bp, Homo sapiens
caaaattaata

SEQ ID NO: 814202 - DNA, 13 bp, Homo sapiens
caaaattataaag

SEQ ID NO: 814203 - DNA, 13 bp, Homo sapiens
caaaattatttgt

SEQ ID NO: 814204 - DNA, 17 bp, Homo sapiens
caaaattcaaagcatgg

SEQ ID NO: 814205 - DNA, 15 bp, Homo sapiens
caaaattcatttcta

SEQ ID NO: 814206 - DNA, 19 bp, Homo sapiens
caaaattctagctgtatga

SEQ ID NO: 814207 - DNA, 16 bp, Homo sapiens
caaaattgctccagat

SEQ ID NO: 814208 - DNA, 23 bp, Homo sapiens
caaaattgggaaaggagtagaaa

SEQ ID NO: 814209 - DNA, 22 bp, Homo sapiens
caaaattgttttcacttgtatt

SEQ ID NO: 814210 - DNA, 23 bp, Homo sapiens
caaaattgttttcacttgtattg

SEQ ID NO: 814211 - DNA, 13 bp, Homo sapiens
caaaatttattct

SEQ ID NO: 814212 - DNA, 21 bp, Homo sapiens
caaaatttattttataagaaa

SEQ ID NO: 814213 - DNA, 16 bp, Homo sapiens
caaaatttcacagttc

SEQ ID NO: 814214 - DNA, 14 bp, Homo sapiens
caaaatttccagta

SEQ ID NO: 814215 - DNA, 20 bp, Homo sapiens
caaaatttccagtacctttg

SEQ ID NO: 814216 - DNA, 13 bp, Homo sapiens
caaaatttgacta

SEQ ID NO: 814217 - DNA, 22 bp, Homo sapiens
caaaatttgctgccaaatgcgt

SEQ ID NO: 814218 - DNA, 21 bp, Homo sapiens
caaaattttatagctcagttt

SEQ ID NO: 814219 - DNA, 13 bp, Homo sapiens
caaaattttattc

SEQ ID NO: 814220 - DNA, 14 bp, Homo sapiens
caaaattttattcc

SEQ ID NO: 814221 - DNA, 14 bp, Homo sapiens
caaaattttatttt

SEQ ID NO: 814222 - DNA, 19 bp, Homo sapiens
caaaattttattttgtgct

SEQ ID NO: 814223 - DNA, 17 bp, Homo sapiens
caaaattttctcatttt

SEQ ID NO: 814224 - DNA, 23 bp, Homo sapiens
caaaatttttaggtgaagtcgag

SEQ ID NO: 814225 - DNA, 16 bp, Homo sapiens
caaaattttttttaca

SEQ ID NO: 814226 - DNA, 17 bp, Homo sapiens
caaacaaaagcagccct

SEQ ID NO: 814227 - DNA, 18 bp, Homo sapiens
caaacaaaagcagccctc

SEQ ID NO: 814228 - DNA, 14 bp, Homo sapiens
caaacaaacaaaaa

SEQ ID NO: 814229 - DNA, 16 bp, Homo sapiens
caaacaaccatttttt

SEQ ID NO: 814230 - DNA, 18 bp, Homo sapiens
caaacaacctgaatcttt

SEQ ID NO: 814231 - DNA, 11 bp, Homo sapiens
caaacaaggaa

SEQ ID NO: 814232 - DNA, 17 bp, Homo sapiens
caaacaaggaagccaaa

SEQ ID NO: 814233 - DNA, 15 bp, Homo sapiens
caaacacaagaaatc

SEQ ID NO: 814234 - DNA, 11 bp, Homo sapiens
caaacaccagt

SEQ ID NO: 814235 - DNA, 22 bp, Homo sapiens
caaacacccacttatttttcaa

SEQ ID NO: 814236 - DNA, 16 bp, Homo sapiens
caaacactgaatcatg

SEQ ID NO: 814237 - DNA, 17 bp, Homo sapiens
caaacactgcagtttcc

SEQ ID NO: 814238 - DNA, 21 bp, Homo sapiens
caaacacttctgctttcactt

SEQ ID NO: 814239 - DNA, 22 bp, Homo sapiens
caaacagaaatcaggtgtttta

SEQ ID NO: 814240 - DNA, 13 bp, Homo sapiens
caaacagaacagg

SEQ ID NO: 814241 - DNA, 15 bp, Homo sapiens
caaacagaacagggt

SEQ ID NO: 814242 - DNA, 23 bp, Homo sapiens
caaacagcaagagtaagcagtgt

SEQ ID NO: 814243 - DNA, 20 bp, Homo sapiens
caaacagccaactagcccct

SEQ ID NO: 814244 - DNA, 14 bp, Homo sapiens
caaacagctgaaag

SEQ ID NO: 814245 - DNA, 13 bp, Homo sapiens
caaacaggaacta

SEQ ID NO: 814246 - DNA, 15 bp, Homo sapiens
caaacaggacagcac

SEQ ID NO: 814247 - DNA, 21 bp, Homo sapiens
caaacagtaatctaggtgtgg

SEQ ID NO: 814248 - DNA, 14 bp, Homo sapiens
caaacagtaggttg

SEQ ID NO: 814249 - DNA, 19 bp, Homo sapiens
caaacagtaggttggcagt

SEQ ID NO: 814250 - DNA, 12 bp, Homo sapiens
caaacatagccc

SEQ ID NO: 814251 - DNA, 18 bp, Homo sapiens
caaacatcagacctgtct

SEQ ID NO: 814252 - DNA, 13 bp, Homo sapiens
caaacatgaaaaa

SEQ ID NO: 814253 - DNA, 21 bp, Homo sapiens
caaacattcgtgagctgggga

SEQ ID NO: 814254 - DNA, 19 bp, Homo sapiens
caaacattgctgcctttgt

SEQ ID NO: 814255 - DNA, 12 bp, Homo sapiens
caaacattttga

SEQ ID NO: 814256 - DNA, 15 bp, Homo sapiens
caaacattttgaaag

SEQ ID NO: 814257 - DNA, 17 bp, Homo sapiens
caaaccaaagctgcctg

SEQ ID NO: 814258 - DNA, 21 bp, Homo sapiens
caaaccaaagctgcctgtgcc

SEQ ID NO: 814259 - DNA, 22 bp, Homo sapiens
caaaccaaagctgcctgtgcca

SEQ ID NO: 814260 - DNA, 17 bp, Homo sapiens
caaaccaaattttaatt

SEQ ID NO: 814261 - DNA, 13 bp, Homo sapiens
caaaccaacatct

SEQ ID NO: 814262 - DNA, 14 bp, Homo sapiens
caaaccacactgga

SEQ ID NO: 814263 - DNA, 15 bp, Homo sapiens
caaaccacagcagga

SEQ ID NO: 814264 - DNA, 22 bp, Homo sapiens
caaaccacgcctcttgaccagg

SEQ ID NO: 814265 - DNA, 14 bp, Homo sapiens
caaaccactgtgaa

SEQ ID NO: 814266 - DNA, 18 bp, Homo sapiens
caaaccagccttcggagc

SEQ ID NO: 814267 - DNA, 16 bp, Homo sapiens
caaaccaggtgcaatt

SEQ ID NO: 814268 - DNA, 18 bp, Homo sapiens
caaaccatcagctgcttt

SEQ ID NO: 814269 - DNA, 16 bp, Homo sapiens
caaaccattacctgta

SEQ ID NO: 814270 - DNA, 13 bp, Homo sapiens
caaaccattactg

SEQ ID NO: 814271 - DNA, 14 bp, Homo sapiens
caaaccatttccaa

SEQ ID NO: 814272 - DNA, 21 bp, Homo sapiens
caaaccattttattttttggg

SEQ ID NO: 814273 - DNA, 16 bp, Homo sapiens
caaacccagaggtgga

SEQ ID NO: 814274 - DNA, 14 bp, Homo sapiens
caaacccagccact

SEQ ID NO: 814275 - DNA, 15 bp, Homo sapiens
caaacccagccactg

SEQ ID NO: 814276 - DNA, 17 bp, Homo sapiens
caaacccagtctcagac

SEQ ID NO: 814277 - DNA, 13 bp, Homo sapiens
caaacccatgagg

SEQ ID NO: 814278 - DNA, 17 bp, Homo sapiens
caaaccccaccctagtt

SEQ ID NO: 814279 - DNA, 14 bp, Homo sapiens
caaaccccagcccc

SEQ ID NO: 814280 - DNA, 15 bp, Homo sapiens
caaaccccagcccca

SEQ ID NO: 814281 - DNA, 21 bp, Homo sapiens
caaaccccgaccacctgccca

SEQ ID NO: 814282 - DNA, 13 bp, Homo sapiens
caaaccccttccc

SEQ ID NO: 814283 - DNA, 19 bp, Homo sapiens
caaaggggctgctggggca

SEQ ID NO: 814284 - DNA, 19 bp, Homo sapiens
caaagggtgaagctattta

SEQ ID NO: 814285 - DNA, 16 bp, Homo sapiens
caaaggtgaaggaata

SEQ ID NO: 814286 - DNA, 17 bp, Homo sapiens
caaaggtggcaatgctt

SEQ ID NO: 814287 - DNA, 13 bp, Homo sapiens
caaaggtggctct

SEQ ID NO: 814288 - DNA, 17 bp, Homo sapiens
caaaggtttggaaggag

SEQ ID NO: 814289 - DNA, 18 bp, Homo sapiens
caaaggtttggaaggagc

SEQ ID NO: 814290 - DNA, 22 bp, Homo sapiens
caaagtaaaaattgaactgtaa

SEQ ID NO: 814291 - DNA, 13 bp, Homo sapiens
caaagtaaaatga

SEQ ID NO: 814292 - DNA, 16 bp, Homo sapiens
caaagtacaaaattgc

SEQ ID NO: 814293 - DNA, 22 bp, Homo sapiens
caaagtacactgtttcaaactt

SEQ ID NO: 814294 - DNA, 16 bp, Homo sapiens
caaagtacagaatttg

SEQ ID NO: 814295 - DNA, 14 bp, Homo sapiens
caaagtactcttta

SEQ ID NO: 814296 - DNA, 20 bp, Homo sapiens
caaagtactctttaacatac

SEQ ID NO: 814297 - DNA, 16 bp, Homo sapiens
caaagtactgtcctca

SEQ ID NO: 814298 - DNA, 22 bp, Homo sapiens
caaagtagtacttcttctgtaa

SEQ ID NO: 814299 - DNA, 15 bp, Homo sapiens
caaagtagtcctggc

SEQ ID NO: 814300 - DNA, 17 bp, Homo sapiens
caaagtagtcctggcag

SEQ ID NO: 814301 - DNA, 13 bp, Homo sapiens
caaagtataacca

SEQ ID NO: 814302 - DNA, 14 bp, Homo sapiens
caaagtataatctt

SEQ ID NO: 814303 - DNA, 15 bp, Homo sapiens
caaagtataatcttt

SEQ ID NO: 814304 - DNA, 15 bp, Homo sapiens
caaagtatcaaagaa

SEQ ID NO: 814305 - DNA, 21 bp, Homo sapiens
caaagtatccctactgtaatt

SEQ ID NO: 814306 - DNA, 17 bp, Homo sapiens
caaagtatgcaatgctt

SEQ ID NO: 814307 - DNA, 14 bp, Homo sapiens
caaagtattgtaaa

SEQ ID NO: 814308 - DNA, 16 bp, Homo sapiens
caaagtattgtaaatt

SEQ ID NO: 814309 - DNA, 17 bp, Homo sapiens
caaagtattgtaaatta

SEQ ID NO: 814310 - DNA, 23 bp, Homo sapiens
caaagtatttttttatcttggga

SEQ ID NO: 814311 - DNA, 20 bp, Homo sapiens
caaagtcaataaaagagctg

SEQ ID NO: 814312 - DNA, 16 bp, Homo sapiens
caaagtcattaaagac

SEQ ID NO: 814313 - DNA, 21 bp, Homo sapiens
caaagtcccttcctgcttcct

SEQ ID NO: 814314 - DNA, 17 bp, Homo sapiens
caaagtcctctgctcca

SEQ ID NO: 814315 - DNA, 19 bp, Homo sapiens
caaagtcctttttttccat

SEQ ID NO: 814316 - DNA, 20 bp, Homo sapiens
caaagtcgccagtcactgct

SEQ ID NO: 814317 - DNA, 20 bp, Homo sapiens
caaagtctgctctcatataa

SEQ ID NO: 814318 - DNA, 13 bp, Homo sapiens
caaagtgataaat

SEQ ID NO: 814319 - DNA, 18 bp, Homo sapiens
caaagtgcagcccttcct

SEQ ID NO: 814320 - DNA, 16 bp, Homo sapiens
caaagtgccactcatt

SEQ ID NO: 814321 - DNA, 13 bp, Homo sapiens
caaagtgcctggg

SEQ ID NO: 814322 - DNA, 16 bp, Homo sapiens
caaagtgcctgggaag

SEQ ID NO: 814323 - DNA, 16 bp, Homo sapiens
caaagtgctgggatta

SEQ ID NO: 814324 - DNA, 19 bp, Homo sapiens
caaagtgctgggattacag

SEQ ID NO: 814325 - DNA, 20 bp, Homo sapiens
caaagtgctgggattacagg

SEQ ID NO: 814326 - DNA, 14 bp, Homo sapiens
caaagtggaacgaa

SEQ ID NO: 814327 - DNA, 15 bp, Homo sapiens
caaagtggaacgaaa

SEQ ID NO: 814328 - DNA, 18 bp, Homo sapiens
caaagtggagctgggagg

SEQ ID NO: 814329 - DNA, 19 bp, Homo sapiens
caaagtggtaaatactgtg

SEQ ID NO: 814330 - DNA, 12 bp, Homo sapiens
caaagtgtatat

SEQ ID NO: 814331 - DNA, 13 bp, Homo sapiens
caaagtgtatatt

SEQ ID NO: 814332 - DNA, 14 bp, Homo sapiens
caaagtgtatattt

SEQ ID NO: 814333 - DNA, 17 bp, Homo sapiens
caaagtgtatatttatt

SEQ ID NO: 814334 - DNA, 14 bp, Homo sapiens
caaagtgtgtatta

SEQ ID NO: 814335 - DNA, 17 bp, Homo sapiens
caaagttaattcaccta

SEQ ID NO: 814336 - DNA, 19 bp, Homo sapiens
caaagttatattcacagtt

SEQ ID NO: 814337 - DNA, 13 bp, Homo sapiens
caaagttcagtgt

SEQ ID NO: 814338 - DNA, 16 bp, Homo sapiens
caaagttccaaaatgc

SEQ ID NO: 814339 - DNA, 20 bp, Homo sapiens
caaagttccctacttcctgt

SEQ ID NO: 814340 - DNA, 22 bp, Homo sapiens
caaagttccctacttcctgtga

SEQ ID NO: 814341 - DNA, 13 bp, Homo sapiens
caaagttctcaga

SEQ ID NO: 814342 - DNA, 16 bp, Homo sapiens
caaagttctcagagct

SEQ ID NO: 814343 - DNA, 17 bp, Homo sapiens
caaagttctcagagctc

SEQ ID NO: 814344 - DNA, 20 bp, Homo sapiens
caaagttctcagagctctcg

SEQ ID NO: 814345 - DNA, 21 bp, Homo sapiens
caaagttgagggaaagagctt

SEQ ID NO: 814346 - DNA, 15 bp, Homo sapiens
caaagttgtagttct

SEQ ID NO: 814347 - DNA, 22 bp, Homo sapiens
caaagttgtagttcttgtgcat

SEQ ID NO: 814348 - DNA, 20 bp, Homo sapiens
caaagtttaataaatttatt

SEQ ID NO: 814349 - DNA, 23 bp, Homo sapiens
caaagtttacagatgtttttaat

SEQ ID NO: 814350 - DNA, 15 bp, Homo sapiens
caaagtttacattgt

SEQ ID NO: 814351 - DNA, 12 bp, Homo sapiens
caaagtttctgt

SEQ ID NO: 814352 - DNA, 16 bp, Homo sapiens
caaataaaaaacagaa

SEQ ID NO: 814353 - DNA, 20 bp, Homo sapiens
caaataaaaaacagaaaccg

SEQ ID NO: 814354 - DNA, 12 bp, Homo sapiens
caaataaaatat

SEQ ID NO: 814355 - DNA, 18 bp, Homo sapiens
caaataaaattggcacca

SEQ ID NO: 814356 - DNA, 17 bp, Homo sapiens
caaataaactctaaaca

SEQ ID NO: 814357 - DNA, 20 bp, Homo sapiens
caaataaagaaatttggtac

SEQ ID NO: 814358 - DNA, 17 bp, Homo sapiens
caaataaagccttttaa

SEQ ID NO: 814359 - DNA, 19 bp, Homo sapiens
caaataaatacgtgtcaaa

SEQ ID NO: 814360 - DNA, 12 bp, Homo sapiens
caaataaatgat

SEQ ID NO: 814361 - DNA, 20 bp, Homo sapiens
caaataaatgattatattca

SEQ ID NO: 814362 - DNA, 21 bp, Homo sapiens
caaataaatgattatattcac

SEQ ID NO: 814363 - DNA, 22 bp, Homo sapiens
caaataaatgattatattcaca

SEQ ID NO: 814364 - DNA, 14 bp, Homo sapiens
caaataaatttctg

SEQ ID NO: 814365 - DNA, 15 bp, Homo sapiens
caaataacttcagtc

SEQ ID NO: 814366 - DNA, 16 bp, Homo sapiens
caaataacttcagtcc

SEQ ID NO: 814367 - DNA, 12 bp, Homo sapiens
caaataagactt

SEQ ID NO: 814368 - DNA, 18 bp, Homo sapiens
caaataagtatttataat

SEQ ID NO: 814369 - DNA, 21 bp, Homo sapiens
caaataagtgtattttgaaat

SEQ ID NO: 814370 - DNA, 13 bp, Homo sapiens
caaataataaagt

SEQ ID NO: 814371 - DNA, 14 bp, Homo sapiens
caaataataagcaa

SEQ ID NO: 814372 - DNA, 13 bp, Homo sapiens
caaataatcacat

SEQ ID NO: 814373 - DNA, 22 bp, Homo sapiens
caaataatccattccaaaatac

SEQ ID NO: 814374 - DNA, 23 bp, Homo sapiens
caaataatccattccaaaataca

SEQ ID NO: 814375 - DNA, 14 bp, Homo sapiens
caaataatttcata

SEQ ID NO: 814376 - DNA, 21 bp, Homo sapiens
caaatacccaaatgtccctgc

SEQ ID NO: 814377 - DNA, 16 bp, Homo sapiens
caaatacctcaatttt

SEQ ID NO: 814378 - DNA, 13 bp, Homo sapiens
caaatagaaaaca

SEQ ID NO: 814379 - DNA, 14 bp, Homo sapiens
caaatagaaaacag

SEQ ID NO: 814380 - DNA, 16 bp, Homo sapiens
caaatagaaaatggtc

SEQ ID NO: 814381 - DNA, 14 bp, Homo sapiens
caaatagatttttg

SEQ ID NO: 814382 - DNA, 19 bp, Homo sapiens
caaatagatttttgattca

SEQ ID NO: 814383 - DNA, 14 bp, Homo sapiens
caaatagccccaga

SEQ ID NO: 814384 - DNA, 22 bp, Homo sapiens
caaatagccccagactgggccc

SEQ ID NO: 814385 - DNA, 23 bp, Homo sapiens
caaataggctattaaaaaagtct

SEQ ID NO: 814386 - DNA, 12 bp, Homo sapiens
caaataggtaga

SEQ ID NO: 814387 - DNA, 13 bp, Homo sapiens
caaataggtagag

SEQ ID NO: 814388 - DNA, 21 bp, Homo sapiens
caaataggtagagtcattcat

SEQ ID NO: 814389 - DNA, 14 bp, Homo sapiens
caaataggtcatca

SEQ ID NO: 814390 - DNA, 12 bp, Homo sapiens
caaatagtgtga

SEQ ID NO: 814391 - DNA, 15 bp, Homo sapiens
caaatagtgtgaaat

SEQ ID NO: 814392 - DNA, 19 bp, Homo sapiens
caaatagttgcatagcagt

SEQ ID NO: 814393 - DNA, 19 bp, Homo sapiens
caaatataagacatttgtt

SEQ ID NO: 814394 - DNA, 12 bp, Homo sapiens
caaatatagaaa

SEQ ID NO: 814395 - DNA, 15 bp, Homo sapiens
caaatatcaaataaa

SEQ ID NO: 814396 - DNA, 18 bp, Homo sapiens
caaatatcatttactctt

SEQ ID NO: 814397 - DNA, 16 bp, Homo sapiens
caaatatctctattta

SEQ ID NO: 814398 - DNA, 22 bp, Homo sapiens
caaatatgaaaaatgtaaatac

SEQ ID NO: 814399 - DNA, 14 bp, Homo sapiens
caaatatgcacttt

SEQ ID NO: 814400 - DNA, 21 bp, Homo sapiens
caaatatgcactttccctaga

SEQ ID NO: 814401 - DNA, 15 bp, Homo sapiens
caaatatgtcctggg

SEQ ID NO: 814402 - DNA, 17 bp, Homo sapiens
caaatatgtcctggggt

SEQ ID NO: 814403 - DNA, 12 bp, Homo sapiens
caaatattagca

SEQ ID NO: 814404 - DNA, 22 bp, Homo sapiens
caaatattgttgacaactgtga

SEQ ID NO: 814405 - DNA, 23 bp, Homo sapiens
caaatattgttgacaactgtgac

SEQ ID NO: 814406 - DNA, 17 bp, Homo sapiens
caacaggtttatctgaa

SEQ ID NO: 814407 - DNA, 15 bp, Homo sapiens
caacagtaaaccact

SEQ ID NO: 814408 - DNA, 22 bp, Homo sapiens
caacagtaaaccactgaaaaaa

SEQ ID NO: 814409 - DNA, 14 bp, Homo sapiens
caacagtcaaaaca

SEQ ID NO: 814410 - DNA, 11 bp, Homo sapiens
caacagtgagt

SEQ ID NO: 814411 - DNA, 12 bp, Homo sapiens
caacagtgagtc

SEQ ID NO: 814412 - DNA, 11 bp, Homo sapiens
caacagttgta

SEQ ID NO: 814413 - DNA, 15 bp, Homo sapiens
caacagtttttaaaa

SEQ ID NO: 814414 - DNA, 21 bp, Homo sapiens
caacataaaacaaaaccaagc

SEQ ID NO: 814415 - DNA, 22 bp, Homo sapiens
caacataaaacaaaaccaagcc

SEQ ID NO: 814416 - DNA, 19 bp, Homo sapiens
caacatcaaaacttaagat

SEQ ID NO: 814417 - DNA, 13 bp, Homo sapiens
caacatcaatgtt

SEQ ID NO: 814418 - DNA, 15 bp, Homo sapiens
caacatcaatgttca

SEQ ID NO: 814419 - DNA, 17 bp, Homo sapiens
caacatcacagcccagc

SEQ ID NO: 814420 - DNA, 16 bp, Homo sapiens
caacatcccacagtgg

SEQ ID NO: 814421 - DNA, 18 bp, Homo sapiens
caacatcccattgccctg

SEQ ID NO: 814422 - DNA, 13 bp, Homo sapiens
caacatctagcaa

SEQ ID NO: 814423 - DNA, 13 bp, Homo sapiens
caacatctctgaa

SEQ ID NO: 814424 - DNA, 22 bp, Homo sapiens
caacatcttggtcagatttgaa

SEQ ID NO: 814425 - DNA, 15 bp, Homo sapiens
caacatgcactgatg

SEQ ID NO: 814426 - DNA, 19 bp, Homo sapiens
caacatgctccaaatataa

SEQ ID NO: 814427 - DNA, 22 bp, Homo sapiens
caacatggagaaaccctgtctc

SEQ ID NO: 814428 - DNA, 17 bp, Homo sapiens
caacatgggagggatca

SEQ ID NO: 814429 - DNA, 22 bp, Homo sapiens
caacatgggagggatcagcccc

SEQ ID NO: 814430 - DNA, 23 bp, Homo sapiens
caacatgggagggatcagccccg

SEQ ID NO: 814431 - DNA, 20 bp, Homo sapiens
caacatgtagctgagtttaa

SEQ ID NO: 814432 - DNA, 22 bp, Homo sapiens
caacatgttatttgtaatagat

SEQ ID NO: 814433 - DNA, 14 bp, Homo sapiens
caacattaaaactc

SEQ ID NO: 814434 - DNA, 16 bp, Homo sapiens
caacattaggagtaac

SEQ ID NO: 814435 - DNA, 22 bp, Homo sapiens
caacattcattgccaagggccc

SEQ ID NO: 814436 - DNA, 12 bp, Homo sapiens
caacattctgca

SEQ ID NO: 814437 - DNA, 14 bp, Homo sapiens
caacattctttgca

SEQ ID NO: 814438 - DNA, 17 bp, Homo sapiens
caacattgcttgtgcca

SEQ ID NO: 814439 - DNA, 22 bp, Homo sapiens
caacatttctatagccaaaaat

SEQ ID NO: 814440 - DNA, 22 bp, Homo sapiens
caacatttctgtatactgtaaa

SEQ ID NO: 814441 - DNA, 18 bp, Homo sapiens
caacatttcttaaattat

SEQ ID NO: 814442 - DNA, 21 bp, Homo sapiens
caacatttttttttctccata

SEQ ID NO: 814443 - DNA, 14 bp, Homo sapiens
caaccaaccagcag

SEQ ID NO: 814444 - DNA, 15 bp, Homo sapiens
caaccaactgcccca

SEQ ID NO: 814445 - DNA, 19 bp, Homo sapiens
caaccaactgccccagggg

SEQ ID NO: 814446 - DNA, 22 bp, Homo sapiens
caaccaagaatgttatgtgcaa

SEQ ID NO: 814447 - DNA, 13 bp, Homo sapiens
caaccaaggaagg

SEQ ID NO: 814448 - DNA, 22 bp, Homo sapiens
caaccaaggaaggagcccctga

SEQ ID NO: 814449 - DNA, 14 bp, Homo sapiens
caaccaagtgtgct

SEQ ID NO: 814450 - DNA, 16 bp, Homo sapiens
caaccaatgtagaaag

SEQ ID NO: 814451 - DNA, 18 bp, Homo sapiens
caaccacatgtcccagat

SEQ ID NO: 814452 - DNA, 19 bp, Homo sapiens
caaccaccgctccccagcc

SEQ ID NO: 814453 - DNA, 20 bp, Homo sapiens
caaccaccgctccccagccc

SEQ ID NO: 814454 - DNA, 14 bp, Homo sapiens
caaccactgtaaaa

SEQ ID NO: 814455 - DNA, 21 bp, Homo sapiens
caaccactgtaaaatgaaatt

SEQ ID NO: 814456 - DNA, 17 bp, Homo sapiens
caaccactgtgccactg

SEQ ID NO: 814457 - DNA, 11 bp, Homo sapiens
caaccactttt

SEQ ID NO: 814458 - DNA, 14 bp, Homo sapiens
caaccagactttga

SEQ ID NO: 814459 - DNA, 20 bp, Homo sapiens
caaccagcccgacagtgcca

SEQ ID NO: 814460 - DNA, 22 bp, Homo sapiens
caaccagcccgacagtgccatc

SEQ ID NO: 814461 - DNA, 13 bp, Homo sapiens
caaccaggaccca

SEQ ID NO: 814462 - DNA, 19 bp, Homo sapiens
caaccaggacccagggtcc

SEQ ID NO: 814463 - DNA, 19 bp, Homo sapiens
caaccaggcacctcttcct

SEQ ID NO: 814464 - DNA, 20 bp, Homo sapiens
caaccaggcagctgagacca

SEQ ID NO: 814465 - DNA, 14 bp, Homo sapiens
caaccaggccctgc

SEQ ID NO: 814466 - DNA, 16 bp, Homo sapiens
caaccatgtcatttca

SEQ ID NO: 814467 - DNA, 17 bp, Homo sapiens
caaccattaaagtcaga

SEQ ID NO: 814468 - DNA, 14 bp, Homo sapiens
caaccattccccat

SEQ ID NO: 814469 - DNA, 14 bp, Homo sapiens
caaccatttgaaac

SEQ ID NO: 814470 - DNA, 19 bp, Homo sapiens
caacccaataaaactgatg

SEQ ID NO: 814471 - DNA, 17 bp, Homo sapiens
caacccaataggagtct

SEQ ID NO: 814472 - DNA, 15 bp, Homo sapiens
caacccaatccctct

SEQ ID NO: 814473 - DNA, 22 bp, Homo sapiens
caacccaatccctctccactct

SEQ ID NO: 814474 - DNA, 14 bp, Homo sapiens
caacccaatgggct

SEQ ID NO: 814475 - DNA, 21 bp, Homo sapiens
caacccacaccgtcttccttc

SEQ ID NO: 814476 - DNA, 12 bp, Homo sapiens
caacccagccca

SEQ ID NO: 814477 - DNA, 18 bp, Homo sapiens
caacccattcactacagg

SEQ ID NO: 814478 - DNA, 15 bp, Homo sapiens
caaccccacccagct

SEQ ID NO: 814479 - DNA, 18 bp, Homo sapiens
caaccccacccagctcca

SEQ ID NO: 814480 - DNA, 20 bp, Homo sapiens
caaccccagttctgctcctc

SEQ ID NO: 814481 - DNA, 11 bp, Homo sapiens
caacccccacc

SEQ ID NO: 814482 - DNA, 12 bp, Homo sapiens
caacccccaccc

SEQ ID NO: 814483 - DNA, 13 bp, Homo sapiens
caacccccacccc

SEQ ID NO: 814484 - DNA, 18 bp, Homo sapiens
caacccccaccccacact

SEQ ID NO: 814485 - DNA, 21 bp, Homo sapiens
caacccccattctcatctgca

SEQ ID NO: 814486 - DNA, 21 bp, Homo sapiens
caaccccccaagaccatccct

SEQ ID NO: 814487 - DNA, 16 bp, Homo sapiens
caacccccctcccaga

SEQ ID NO: 814488 - DNA, 17 bp, Homo sapiens
caacccccctcctgctc

SEQ ID NO: 814489 - DNA, 18 bp, Homo sapiens
caacccccctcctgctcc

SEQ ID NO: 814490 - DNA, 20 bp, Homo sapiens
caacccccgccacctcaggg

SEQ ID NO: 814491 - DNA, 15 bp, Homo sapiens
caaccccctcggagc

SEQ ID NO: 814492 - DNA, 19 bp, Homo sapiens
caaccccctcggagcctgt

SEQ ID NO: 814493 - DNA, 15 bp, Homo sapiens
caaccccgcggccca

SEQ ID NO: 814494 - DNA, 17 bp, Homo sapiens
caaccccgcggcccaga

SEQ ID NO: 814495 - DNA, 18 bp, Homo sapiens
caaccccgcggtgctctg

SEQ ID NO: 814496 - DNA, 13 bp, Homo sapiens
caacccctgtacc

SEQ ID NO: 814497 - DNA, 14 bp, Homo sapiens
caacccctgtggag

SEQ ID NO: 814498 - DNA, 21 bp, Homo sapiens
caacccctgtggagcccgcac

SEQ ID NO: 814499 - DNA, 21 bp, Homo sapiens
caacccgtctggcccaccagg

SEQ ID NO: 814500 - DNA, 22 bp, Homo sapiens
caacccgtttcccggttcagga

SEQ ID NO: 814501 - DNA, 21 bp, Homo sapiens
caaccctaggttccctgttct

SEQ ID NO: 814502 - DNA, 19 bp, Homo sapiens
caaccctatctcctgacag

SEQ ID NO: 814503 - DNA, 18 bp, Homo sapiens
caaccctccctcagcccc

SEQ ID NO: 814504 - DNA, 11 bp, Homo sapiens
caaccctgccc

SEQ ID NO: 814505 - DNA, 14 bp, Homo sapiens
caaccctgcccctg

SEQ ID NO: 814506 - DNA, 20 bp, Homo sapiens
caaccctgccgtcaccacca

SEQ ID NO: 814507 - DNA, 22 bp, Homo sapiens
caaccctgcctgccgctgcacc

SEQ ID NO: 814508 - DNA, 23 bp, Homo sapiens
caaccctgcctgtcacctgggag

SEQ ID NO: 814509 - DNA, 19 bp, Homo sapiens
caaccctggcattatgtcc

SEQ ID NO: 814510 - DNA, 17 bp, Homo sapiens
caaccctggcctcactt

SEQ ID NO: 814511 - DNA, 15 bp, Homo sapiens
caaccctgggaccta

SEQ ID NO: 814512 - DNA, 21 bp, Homo sapiens
caaccctggggaaggagccag

SEQ ID NO: 814513 - DNA, 17 bp, Homo sapiens
caaccctgttttatact

SEQ ID NO: 814514 - DNA, 19 bp, Homo sapiens
caaccctgttttatactgt

SEQ ID NO: 814515 - DNA, 13 bp, Homo sapiens
caacccttcccca

SEQ ID NO: 814516 - DNA, 20 bp, Homo sapiens
caacccttctcctcttgtaa

SEQ ID NO: 814517 - DNA, 18 bp, Homo sapiens
caaccgatgctccagcca

SEQ ID NO: 814518 - DNA, 19 bp, Homo sapiens
caaccggggagcccccgcc

SEQ ID NO: 814519 - DNA, 13 bp, Homo sapiens
caaccggtccctt

SEQ ID NO: 814520 - DNA, 15 bp, Homo sapiens
caaccggtcccttcc

SEQ ID NO: 814521 - DNA, 21 bp, Homo sapiens
caaccggtcccttccatgccc

SEQ ID NO: 814522 - DNA, 16 bp, Homo sapiens
caaccgtcctgctgtc

SEQ ID NO: 814523 - DNA, 18 bp, Homo sapiens
caaccgttggaaacataa

SEQ ID NO: 814524 - DNA, 13 bp, Homo sapiens
caacctaaatttg

SEQ ID NO: 814525 - DNA, 19 bp, Homo sapiens
caacctcaatgccctgcca

SEQ ID NO: 814526 - DNA, 16 bp, Homo sapiens
caacctcaccaaacta

SEQ ID NO: 814527 - DNA, 21 bp, Homo sapiens
caacctcactgccctccctcg

SEQ ID NO: 814528 - DNA, 18 bp, Homo sapiens
caagactttgatccttgg

SEQ ID NO: 814529 - DNA, 20 bp, Homo sapiens
caagactttgatccttggaa

SEQ ID NO: 814530 - DNA, 18 bp, Homo sapiens
caagacttttctttgaag

SEQ ID NO: 814531 - DNA, 23 bp, Homo sapiens
caagagaactcgcgctcagtaaa

SEQ ID NO: 814532 - DNA, 22 bp, Homo sapiens
caagagagaagcaaccaccaca

SEQ ID NO: 814533 - DNA, 15 bp, Homo sapiens
caagagagatgtttt

SEQ ID NO: 814534 - DNA, 13 bp, Homo sapiens
caagagaggaagg

SEQ ID NO: 814535 - DNA, 23 bp, Homo sapiens
caagagaggaaggacccctcacc

SEQ ID NO: 814536 - DNA, 14 bp, Homo sapiens
caagagcaaagtag

SEQ ID NO: 814537 - DNA, 15 bp, Homo sapiens
caagagcagaggcag

SEQ ID NO: 814538 - DNA, 14 bp, Homo sapiens
caagagcagagtct

SEQ ID NO: 814539 - DNA, 14 bp, Homo sapiens
caagagcagcctgt

SEQ ID NO: 814540 - DNA, 15 bp, Homo sapiens
caagagcagcctgtg

SEQ ID NO: 814541 - DNA, 20 bp, Homo sapiens
caagagcagcctgtggcatc

SEQ ID NO: 814542 - DNA, 22 bp, Homo sapiens
caagagccataagggggtggga

SEQ ID NO: 814543 - DNA, 22 bp, Homo sapiens
caagagcccccttgacaccggg

SEQ ID NO: 814544 - DNA, 21 bp, Homo sapiens
caagagccctgtggccgccac

SEQ ID NO: 814545 - DNA, 22 bp, Homo sapiens
caagagccctgtggccgccacc

SEQ ID NO: 814546 - DNA, 12 bp, Homo sapiens
caagagcctgat

SEQ ID NO: 814547 - DNA, 16 bp, Homo sapiens
caagagcctgatctct

SEQ ID NO: 814548 - DNA, 19 bp, Homo sapiens
caagagcctgatctcttcc

SEQ ID NO: 814549 - DNA, 21 bp, Homo sapiens
caagagccttggtgtccacct

SEQ ID NO: 814550 - DNA, 19 bp, Homo sapiens
caagagctagaaaaataaa

SEQ ID NO: 814551 - DNA, 21 bp, Homo sapiens
caagagctagaaaaataaaat

SEQ ID NO: 814552 - DNA, 15 bp, Homo sapiens
caagagctgctgtcc

SEQ ID NO: 814553 - DNA, 17 bp, Homo sapiens
caagagcttaacagtgt

SEQ ID NO: 814554 - DNA, 19 bp, Homo sapiens
caagaggaagttcagatct

SEQ ID NO: 814555 - DNA, 20 bp, Homo sapiens
caagaggaagttcagatctt

SEQ ID NO: 814556 - DNA, 15 bp, Homo sapiens
caagaggacacaatg

SEQ ID NO: 814557 - DNA, 16 bp, Homo sapiens
caagaggatttcttca

SEQ ID NO: 814558 - DNA, 21 bp, Homo sapiens
caagaggatttcttcaaatct

SEQ ID NO: 814559 - DNA, 19 bp, Homo sapiens
caagaggcaagctgaaatt

SEQ ID NO: 814560 - DNA, 23 bp, Homo sapiens
caagaggcagagttctgtgaaga

SEQ ID NO: 814561 - DNA, 21 bp, Homo sapiens
caagaggcaggttagaagaac

SEQ ID NO: 814562 - DNA, 20 bp, Homo sapiens
caagaggcgtgtgcaggccg

SEQ ID NO: 814563 - DNA, 15 bp, Homo sapiens
caagaggctgaggca

SEQ ID NO: 814564 - DNA, 16 bp, Homo sapiens
caagaggctggttttg

SEQ ID NO: 814565 - DNA, 17 bp, Homo sapiens
caagagggaacaaaact

SEQ ID NO: 814566 - DNA, 19 bp, Homo sapiens
caagagggaggggacagag

SEQ ID NO: 814567 - DNA, 14 bp, Homo sapiens
caagagggcactgg

SEQ ID NO: 814568 - DNA, 18 bp, Homo sapiens
caagagggcactggtggc

SEQ ID NO: 814569 - DNA, 17 bp, Homo sapiens
caagaggggcgggctca

SEQ ID NO: 814570 - DNA, 20 bp, Homo sapiens
caagaggggcgggctcagag

SEQ ID NO: 814571 - DNA, 17 bp, Homo sapiens
caagagggggtggaggg

SEQ ID NO: 814572 - DNA, 22 bp, Homo sapiens
caagagggtcctttagtacctg

SEQ ID NO: 814573 - DNA, 15 bp, Homo sapiens
caagaggtctgagcc

SEQ ID NO: 814574 - DNA, 16 bp, Homo sapiens
caagaggtctgagccc

SEQ ID NO: 814575 - DNA, 15 bp, Homo sapiens
caagaggtgggaggg

SEQ ID NO: 814576 - DNA, 16 bp, Homo sapiens
caagaggtgggagggc

SEQ ID NO: 814577 - DNA, 20 bp, Homo sapiens
caagagtaactttactctgt

SEQ ID NO: 814578 - DNA, 16 bp, Homo sapiens
caagagtaagcagtgt

SEQ ID NO: 814579 - DNA, 14 bp, Homo sapiens
caagagtccggatt

SEQ ID NO: 814580 - DNA, 17 bp, Homo sapiens
caagagtccggatttct

SEQ ID NO: 814581 - DNA, 22 bp, Homo sapiens
caagagtgagactccacctcaa

SEQ ID NO: 814582 - DNA, 14 bp, Homo sapiens
caagagtgggggga

SEQ ID NO: 814583 - DNA, 16 bp, Homo sapiens
caagagtttgttctgt

SEQ ID NO: 814584 - DNA, 22 bp, Homo sapiens
caagagtttgttctgttctggg

SEQ ID NO: 814585 - DNA, 15 bp, Homo sapiens
caagataactgagaa

SEQ ID NO: 814586 - DNA, 21 bp, Homo sapiens
caagatacatatgaggacaag

SEQ ID NO: 814587 - DNA, 22 bp, Homo sapiens
caagatactctttgtggggaag

SEQ ID NO: 814588 - DNA, 12 bp, Homo sapiens
caagatagaaag

SEQ ID NO: 814589 - DNA, 18 bp, Homo sapiens
caagatagatttggaata

SEQ ID NO: 814590 - DNA, 18 bp, Homo sapiens
caagataggagttctctg

SEQ ID NO: 814591 - DNA, 20 bp, Homo sapiens
caagataggagttctctgat

SEQ ID NO: 814592 - DNA, 19 bp, Homo sapiens
caagatattgatcaaatat

SEQ ID NO: 814593 - DNA, 18 bp, Homo sapiens
caagatattgatgataac

SEQ ID NO: 814594 - DNA, 16 bp, Homo sapiens
caagatattgtacata

SEQ ID NO: 814595 - DNA, 19 bp, Homo sapiens
caagatattgtacataaaa

SEQ ID NO: 814596 - DNA, 16 bp, Homo sapiens
caagatccgtggtttg

SEQ ID NO: 814597 - DNA, 14 bp, Homo sapiens
caagatgaaataat

SEQ ID NO: 814598 - DNA, 17 bp, Homo sapiens
caagatgaaataatttt

SEQ ID NO: 814599 - DNA, 15 bp, Homo sapiens
caagatgactggggt

SEQ ID NO: 814600 - DNA, 19 bp, Homo sapiens
caagatgagagaactggag

SEQ ID NO: 814601 - DNA, 19 bp, Homo sapiens
caagatgcaaatgttttga

SEQ ID NO: 814602 - DNA, 20 bp, Homo sapiens
caagatggacacgagccaca

SEQ ID NO: 814603 - DNA, 16 bp, Homo sapiens
caagatgggcatcttt

SEQ ID NO: 814604 - DNA, 20 bp, Homo sapiens
caagatgggcatcttttgta

SEQ ID NO: 814605 - DNA, 22 bp, Homo sapiens
caagatggggagtgagaggctg

SEQ ID NO: 814606 - DNA, 16 bp, Homo sapiens
caagatgtcagactgg

SEQ ID NO: 814607 - DNA, 17 bp, Homo sapiens
caagatgtcagactggc

SEQ ID NO: 814608 - DNA, 22 bp, Homo sapiens
caagatgtgaattattgacact

SEQ ID NO: 814609 - DNA, 23 bp, Homo sapiens
caagatgtgaattattgacactg

SEQ ID NO: 814610 - DNA, 17 bp, Homo sapiens
caagatgttctcctgat

SEQ ID NO: 814611 - DNA, 20 bp, Homo sapiens
caagattagaagctgaaaac

SEQ ID NO: 814612 - DNA, 17 bp, Homo sapiens
caagattcacacctgac

SEQ ID NO: 814613 - DNA, 18 bp, Homo sapiens
caagattcacacctgact

SEQ ID NO: 814614 - DNA, 19 bp, Homo sapiens
caagattcacacctgactc

SEQ ID NO: 814615 - DNA, 17 bp, Homo sapiens
caagattgagctctctg

SEQ ID NO: 814616 - DNA, 18 bp, Homo sapiens
caagattgcttaaaatag

SEQ ID NO: 814617 - DNA, 20 bp, Homo sapiens
caagattggaaagacaggaa

SEQ ID NO: 814618 - DNA, 19 bp, Homo sapiens
caagattgtccttttctcc

SEQ ID NO: 814619 - DNA, 17 bp, Homo sapiens
caagatttcctactttc

SEQ ID NO: 814620 - DNA, 16 bp, Homo sapiens
caagatttgaccaaat

SEQ ID NO: 814621 - DNA, 17 bp, Homo sapiens
caagattttccacaaga

SEQ ID NO: 814622 - DNA, 17 bp, Homo sapiens
caagattttctactttt

SEQ ID NO: 814623 - DNA, 16 bp, Homo sapiens
caagattttgaaggaa

SEQ ID NO: 814624 - DNA, 17 bp, Homo sapiens
caagattttgaaggaaa

SEQ ID NO: 814625 - DNA, 22 bp, Homo sapiens
caagcaacaaacctcactgaga

SEQ ID NO: 814626 - DNA, 19 bp, Homo sapiens
caagcaataattgtttcca

SEQ ID NO: 814627 - DNA, 22 bp, Homo sapiens
caagcaatcctcctacctcagc

SEQ ID NO: 814628 - DNA, 17 bp, Homo sapiens
caagcacactggaatat

SEQ ID NO: 814629 - DNA, 22 bp, Homo sapiens
caagcacactggaatataaaac

SEQ ID NO: 814630 - DNA, 20 bp, Homo sapiens
caagcacactgtatgttcag

SEQ ID NO: 814631 - DNA, 16 bp, Homo sapiens
caagcacagagcctgg

SEQ ID NO: 814632 - DNA, 17 bp, Homo sapiens
caagcacagcagcctgg

SEQ ID NO: 814633 - DNA, 17 bp, Homo sapiens
caagcacatctgcattt

SEQ ID NO: 814634 - DNA, 23 bp, Homo sapiens
caagcacatcttgtcaacatgca

SEQ ID NO: 814635 - DNA, 14 bp, Homo sapiens
caagcaccaggaag

SEQ ID NO: 814636 - DNA, 24 bp, Homo sapiens
caagcaccccgcttttgcagcaga

SEQ ID NO: 814637 - DNA, 14 bp, Homo sapiens
caagcactatttta

SEQ ID NO: 814638 - DNA, 20 bp, Homo sapiens
caagcactattttatattta

SEQ ID NO: 814639 - DNA, 22 bp, Homo sapiens
caagcactcgagaccatcctgg

SEQ ID NO: 814640 - DNA, 16 bp, Homo sapiens
caagcacttcacagct

SEQ ID NO: 814641 - DNA, 12 bp, Homo sapiens
caagcagaaaaa

SEQ ID NO: 814642 - DNA, 12 bp, Homo sapiens
caagcagactcc

SEQ ID NO: 814643 - DNA, 18 bp, Homo sapiens
caagcagactccagcccc

SEQ ID NO: 814644 - DNA, 21 bp, Homo sapiens
caagcagactccagcccctgg

SEQ ID NO: 814645 - DNA, 20 bp, Homo sapiens
caagcagaggtggccagagc

SEQ ID NO: 814646 - DNA, 22 bp, Homo sapiens
caagcagcgaccgccccctcct

SEQ ID NO: 814647 - DNA, 16 bp, Homo sapiens
caagcagctgaagaaa

SEQ ID NO: 814648 - DNA, 23 bp, Homo sapiens
caagcagctttttattccctgcc

SEQ ID NO: 814649 - DNA, 16 bp, Homo sapiens
caagcaggaagttcaa

SEQ ID NO: 814650 - DNA, 19 bp, Homo sapiens
caagcagggaaagctccac

SEQ ID NO: 814651 - DNA, 23 bp, Homo sapiens
caagcagggaaagctccacggtg

SEQ ID NO: 814652 - DNA, 17 bp, Homo sapiens
caagcagtctaccctgt

SEQ ID NO: 814653 - DNA, 20 bp, Homo sapiens
caagcagtctaccctgtcct

SEQ ID NO: 814654 - DNA, 16 bp, Homo sapiens
caagcagtgcctgcct

SEQ ID NO: 814655 - DNA, 18 bp, Homo sapiens
caagcagtgtctgtcagc

SEQ ID NO: 814656 - DNA, 15 bp, Homo sapiens
caagcatattggaaa

SEQ ID NO: 814657 - DNA, 22 bp, Homo sapiens
caagcatatttgagaacccttc

SEQ ID NO: 814658 - DNA, 22 bp, Homo sapiens
caagcatcagggggaagaagca

SEQ ID NO: 814659 - DNA, 15 bp, Homo sapiens
caagcatcctcagaa

SEQ ID NO: 814660 - DNA, 17 bp, Homo sapiens
caagcatcctcagaagc

SEQ ID NO: 814661 - DNA, 21 bp, Homo sapiens
caagcatcttgggggggtggc

SEQ ID NO: 814662 - DNA, 21 bp, Homo sapiens
caagcatgcaataatgtgcaa

SEQ ID NO: 814663 - DNA, 22 bp, Homo sapiens
caagcatgcaataatgtgcaaa

SEQ ID NO: 814664 - DNA, 21 bp, Homo sapiens
caagcatggctattttatatt

SEQ ID NO: 814665 - DNA, 13 bp, Homo sapiens
caagcatgtaact

SEQ ID NO: 814666 - DNA, 16 bp, Homo sapiens
caagcatgtctctctg

SEQ ID NO: 814667 - DNA, 18 bp, Homo sapiens
caagcatgtctctctgcc

SEQ ID NO: 814668 - DNA, 20 bp, Homo sapiens
caagcatgtctctctgccaa

SEQ ID NO: 814669 - DNA, 16 bp, Homo sapiens
caagcatttcatgaaa

SEQ ID NO: 814670 - DNA, 14 bp, Homo sapiens
caagcatttttcca

SEQ ID NO: 814671 - DNA, 20 bp, Homo sapiens
caagccaaaagtccctccct

SEQ ID NO: 814672 - DNA, 15 bp, Homo sapiens
caagccaacttgtaa

SEQ ID NO: 814673 - DNA, 18 bp, Homo sapiens
caagccaacttgtaaata

SEQ ID NO: 814674 - DNA, 13 bp, Homo sapiens
caagccacagaag

SEQ ID NO: 814675 - DNA, 22 bp, Homo sapiens
caagccaccaaattacctaggc

SEQ ID NO: 814676 - DNA, 22 bp, Homo sapiens
caagccactcggcggcagcatg

SEQ ID NO: 814677 - DNA, 22 bp, Homo sapiens
caagccagccccctccagctca

SEQ ID NO: 814678 - DNA, 22 bp, Homo sapiens
caagccagcgggaatggcagct

SEQ ID NO: 814679 - DNA, 15 bp, Homo sapiens
caagccagggcccag

SEQ ID NO: 814680 - DNA, 18 bp, Homo sapiens
caagccagggcccagagc

SEQ ID NO: 814681 - DNA, 19 bp, Homo sapiens
caagccagggcccagagcc

SEQ ID NO: 814682 - DNA, 21 bp, Homo sapiens
caagccagggcccagagccct

SEQ ID NO: 814683 - DNA, 17 bp, Homo sapiens
caagccataacgtgccc

SEQ ID NO: 814684 - DNA, 21 bp, Homo sapiens
caagccataacgtgcccccag

SEQ ID NO: 814685 - DNA, 23 bp, Homo sapiens
caagccataacgtgcccccagag

SEQ ID NO: 814686 - DNA, 14 bp, Homo sapiens
caagccatcatcct

SEQ ID NO: 814687 - DNA, 20 bp, Homo sapiens
caagccattttttgaggaga

SEQ ID NO: 814688 - DNA, 21 bp, Homo sapiens
caagccattttttgaggagag

SEQ ID NO: 814689 - DNA, 17 bp, Homo sapiens
caagcccagcactgctt

SEQ ID NO: 814690 - DNA, 18 bp, Homo sapiens
caagccccaggcaggctg

SEQ ID NO: 814691 - DNA, 14 bp, Homo sapiens
caagccccagggcc

SEQ ID NO: 814692 - DNA, 16 bp, Homo sapiens
caagccccagggcctg

SEQ ID NO: 814693 - DNA, 17 bp, Homo sapiens
caagccccagggcctgg

SEQ ID NO: 814694 - DNA, 13 bp, Homo sapiens
caagccccatctc

SEQ ID NO: 814695 - DNA, 18 bp, Homo sapiens
caagccccatctcatcct

SEQ ID NO: 814696 - DNA, 17 bp, Homo sapiens
caagccccatttcctca

SEQ ID NO: 814697 - DNA, 14 bp, Homo sapiens
caagcccccccttc

SEQ ID NO: 814698 - DNA, 17 bp, Homo sapiens
caagcccccccttccac

SEQ ID NO: 814699 - DNA, 21 bp, Homo sapiens
caagccccctggcagctgccc

SEQ ID NO: 814700 - DNA, 16 bp, Homo sapiens
caagcccctcagccct

SEQ ID NO: 814701 - DNA, 17 bp, Homo sapiens
caagcccctcagccctt

SEQ ID NO: 814702 - DNA, 18 bp, Homo sapiens
caagcccctcagcccttg

SEQ ID NO: 814703 - DNA, 19 bp, Homo sapiens
caagcccctcagcccttgc

SEQ ID NO: 814704 - DNA, 20 bp, Homo sapiens
caagcccctcagcccttgcc

SEQ ID NO: 814705 - DNA, 17 bp, Homo sapiens
caagcccctctttctgt

SEQ ID NO: 814706 - DNA, 21 bp, Homo sapiens
caagcccctgccctggggaga

SEQ ID NO: 814707 - DNA, 22 bp, Homo sapiens
caagcccctgccctggggagaa

SEQ ID NO: 814708 - DNA, 21 bp, Homo sapiens
caagcccctgctccagaagat

SEQ ID NO: 814709 - DNA, 15 bp, Homo sapiens
caagcccgtgacaga

SEQ ID NO: 814710 - DNA, 18 bp, Homo sapiens
caagccctacagagctgt

SEQ ID NO: 814711 - DNA, 21 bp, Homo sapiens
caagccctccccatcccatgt

SEQ ID NO: 814712 - DNA, 17 bp, Homo sapiens
caagccctcctttggag

SEQ ID NO: 814713 - DNA, 13 bp, Homo sapiens
caagccctggcaa

SEQ ID NO: 814714 - DNA, 15 bp, Homo sapiens
caagccctggcaaca

SEQ ID NO: 814715 - DNA, 21 bp, Homo sapiens
caagccgaccttccctccgcc

SEQ ID NO: 814716 - DNA, 15 bp, Homo sapiens
caagccgtggcttcc

SEQ ID NO: 814717 - DNA, 15 bp, Homo sapiens
caagcctccacagcg

SEQ ID NO: 814718 - DNA, 23 bp, Homo sapiens
caagcctcttattccaggagaag

SEQ ID NO: 814719 - DNA, 14 bp, Homo sapiens
caagcctgcctccc

SEQ ID NO: 814720 - DNA, 18 bp, Homo sapiens
caagcctgctgtgtcctt

SEQ ID NO: 814721 - DNA, 13 bp, Homo sapiens
caagcctggcacc

SEQ ID NO: 814722 - DNA, 15 bp, Homo sapiens
caagcctggcaccca

SEQ ID NO: 814723 - DNA, 22 bp, Homo sapiens
caagcctggcacccaccgtctc

SEQ ID NO: 814724 - DNA, 22 bp, Homo sapiens
caagcctgggcttgagctgcag

SEQ ID NO: 814725 - DNA, 14 bp, Homo sapiens
caagcctgtctgag

SEQ ID NO: 814726 - DNA, 21 bp, Homo sapiens
caagcctgtgcaaaaaaatta

SEQ ID NO: 814727 - DNA, 12 bp, Homo sapiens
caagcctgtggg

SEQ ID NO: 814728 - DNA, 13 bp, Homo sapiens
caagcctgtggga

SEQ ID NO: 814729 - DNA, 15 bp, Homo sapiens
caagcctgtgggcag

SEQ ID NO: 814730 - DNA, 11 bp, Homo sapiens
caagccttctg

SEQ ID NO: 814731 - DNA, 20 bp, Homo sapiens
caagccttggctcgttctct

SEQ ID NO: 814732 - DNA, 15 bp, Homo sapiens
caagcgctccagggc

SEQ ID NO: 814733 - DNA, 16 bp, Homo sapiens
caagcggccctgtgtg

SEQ ID NO: 814734 - DNA, 19 bp, Homo sapiens
caagcggctcaagaataaa

SEQ ID NO: 814735 - DNA, 17 bp, Homo sapiens
caagcgggggcgtggct

SEQ ID NO: 814736 - DNA, 14 bp, Homo sapiens
caagcgttcctggc

SEQ ID NO: 814737 - DNA, 17 bp, Homo sapiens
caagctaagtaaaaata

SEQ ID NO: 814738 - DNA, 18 bp, Homo sapiens
caagctaagtaaaaatat

SEQ ID NO: 814739 - DNA, 16 bp, Homo sapiens
caagctaatctgcctg

SEQ ID NO: 814740 - DNA, 18 bp, Homo sapiens
caagctagaaggccacat

SEQ ID NO: 814741 - DNA, 21 bp, Homo sapiens
caagctaggtgctatttgtca

SEQ ID NO: 814742 - DNA, 15 bp, Homo sapiens
caagctagtgtttct

SEQ ID NO: 814743 - DNA, 21 bp, Homo sapiens
caagctatctaaagtttgtta

SEQ ID NO: 814744 - DNA, 16 bp, Homo sapiens
caagctattcctttcc

SEQ ID NO: 814745 - DNA, 21 bp, Homo sapiens
caagctattcctttcccttcc

SEQ ID NO: 814746 - DNA, 19 bp, Homo sapiens
caagctcacagttcctcgc

SEQ ID NO: 814747 - DNA, 15 bp, Homo sapiens
caagctcagaataga

SEQ ID NO: 814748 - DNA, 21 bp, Homo sapiens
caagctcagaggcgcactgtg

SEQ ID NO: 814749 - DNA, 14 bp, Homo sapiens
caagctccaagccc

SEQ ID NO: 814750 - DNA, 21 bp, Homo sapiens
caagctccatctccactccag

SEQ ID NO: 814751 - DNA, 13 bp, Homo sapiens
caagctccctgcc

SEQ ID NO: 814752 - DNA, 19 bp, Homo sapiens
caagctccctgccccaaat

SEQ ID NO: 814753 - DNA, 13 bp, Homo sapiens
caagctccctgga

SEQ ID NO: 814754 - DNA, 14 bp, Homo sapiens
caagctccctggag

SEQ ID NO: 814755 - DNA, 17 bp, Homo sapiens
caagctccctggagccc

SEQ ID NO: 814756 - DNA, 12 bp, Homo sapiens
caagctcctcct

SEQ ID NO: 814757 - DNA, 15 bp, Homo sapiens
caagctcctcctccc

SEQ ID NO: 814758 - DNA, 14 bp, Homo sapiens
caagctcctcctcg

SEQ ID NO: 814759 - DNA, 19 bp, Homo sapiens
caagctctatcaccaagga

SEQ ID NO: 814760 - DNA, 20 bp, Homo sapiens
caagctctgcctcccgggtt

SEQ ID NO: 814761 - DNA, 14 bp, Homo sapiens
caagctctggggat

SEQ ID NO: 814762 - DNA, 22 bp, Homo sapiens
caagctcttgccccactccctg

SEQ ID NO: 814763 - DNA, 13 bp, Homo sapiens
caagctgaagcta

SEQ ID NO: 814764 - DNA, 13 bp, Homo sapiens
caagctgacttgg

SEQ ID NO: 814765 - DNA, 12 bp, Homo sapiens
caagctgagaaa

SEQ ID NO: 814766 - DNA, 21 bp, Homo sapiens
caagctgagcaggacagccag

SEQ ID NO: 814767 - DNA, 23 bp, Homo sapiens
caagctgagcaggacagccagca

SEQ ID NO: 814768 - DNA, 15 bp, Homo sapiens
caagctgagtgactg

SEQ ID NO: 814769 - DNA, 15 bp, Homo sapiens
caagctgagtttcct

SEQ ID NO: 814770 - DNA, 16 bp, Homo sapiens
caagctgagtttccta

SEQ ID NO: 814771 - DNA, 18 bp, Homo sapiens
caaggttccagaggccct

SEQ ID NO: 814772 - DNA, 16 bp, Homo sapiens
caaggttccctctgag

SEQ ID NO: 814773 - DNA, 15 bp, Homo sapiens
caaggtttaagttat

SEQ ID NO: 814774 - DNA, 17 bp, Homo sapiens
caaggtttaggctggtg

SEQ ID NO: 814775 - DNA, 21 bp, Homo sapiens
caaggtttaggctggtggccc

SEQ ID NO: 814776 - DNA, 24 bp, Homo sapiens
caaggtttaggctggtggcccagg

SEQ ID NO: 814777 - DNA, 17 bp, Homo sapiens
caaggtttataaagcag

SEQ ID NO: 814778 - DNA, 18 bp, Homo sapiens
caaggtttataaagcaga

SEQ ID NO: 814779 - DNA, 23 bp, Homo sapiens
caaggtttcgtggcagcacggcc

SEQ ID NO: 814780 - DNA, 16 bp, Homo sapiens
caaggttttggagtca

SEQ ID NO: 814781 - DNA, 17 bp, Homo sapiens
caaggttttggagtcag

SEQ ID NO: 814782 - DNA, 13 bp, Homo sapiens
caagtaaaatgtt

SEQ ID NO: 814783 - DNA, 17 bp, Homo sapiens
caagtaacaaaaataaa

SEQ ID NO: 814784 - DNA, 12 bp, Homo sapiens
caagtaacactt

SEQ ID NO: 814785 - DNA, 16 bp, Homo sapiens
caagtaacactttaaa

SEQ ID NO: 814786 - DNA, 20 bp, Homo sapiens
caagtaaccaggccccagcc

SEQ ID NO: 814787 - DNA, 14 bp, Homo sapiens
caagtaacttctga

SEQ ID NO: 814788 - DNA, 22 bp, Homo sapiens
caagtaatccacctgcctcggc

SEQ ID NO: 814789 - DNA, 23 bp, Homo sapiens
caagtaattgtgaaaaagttaaa

SEQ ID NO: 814790 - DNA, 20 bp, Homo sapiens
caagtacagcggctcccctc

SEQ ID NO: 814791 - DNA, 19 bp, Homo sapiens
caagtactggttgactttc

SEQ ID NO: 814792 - DNA, 13 bp, Homo sapiens
caagtagataaat

SEQ ID NO: 814793 - DNA, 20 bp, Homo sapiens
caagtataattttttgtaat

SEQ ID NO: 814794 - DNA, 18 bp, Homo sapiens
caagtatactagggagcc

SEQ ID NO: 814795 - DNA, 19 bp, Homo sapiens
caagtatagaaaatcttca

SEQ ID NO: 814796 - DNA, 20 bp, Homo sapiens
caagtatataatatgtcacc

SEQ ID NO: 814797 - DNA, 17 bp, Homo sapiens
caagtatataatttact

SEQ ID NO: 814798 - DNA, 22 bp, Homo sapiens
caagtatccaaccaacttggtt

SEQ ID NO: 814799 - DNA, 17 bp, Homo sapiens
caagtatcttctatttt

SEQ ID NO: 814800 - DNA, 20 bp, Homo sapiens
caagtatgaagtataaatct

SEQ ID NO: 814801 - DNA, 14 bp, Homo sapiens
caagtatgaatatt

SEQ ID NO: 814802 - DNA, 12 bp, Homo sapiens
caagtatgcctt

SEQ ID NO: 814803 - DNA, 13 bp, Homo sapiens
caagtatgcctta

SEQ ID NO: 814804 - DNA, 19 bp, Homo sapiens
caagtatgccttaagcaga

SEQ ID NO: 814805 - DNA, 23 bp, Homo sapiens
caagtatgccttaagcagaacaa

SEQ ID NO: 814806 - DNA, 22 bp, Homo sapiens
caagtatggtaggggagggcag

SEQ ID NO: 814807 - DNA, 22 bp, Homo sapiens
caagtatgtgggcagattttca

SEQ ID NO: 814808 - DNA, 24 bp, Homo sapiens
caagtattactaaattgaccttta

SEQ ID NO: 814809 - DNA, 20 bp, Homo sapiens
caagtattgcgaatgtgcag

SEQ ID NO: 814810 - DNA, 16 bp, Homo sapiens
caagtatttttaatta

SEQ ID NO: 814811 - DNA, 16 bp, Homo sapiens
caagtcaaattaataa

SEQ ID NO: 814812 - DNA, 15 bp, Homo sapiens
caagtcacagctgca

SEQ ID NO: 814813 - DNA, 17 bp, Homo sapiens
caagtcacagctgcagc

SEQ ID NO: 814814 - DNA, 23 bp, Homo sapiens
caagtcacagctgcagctgggcc

SEQ ID NO: 814815 - DNA, 15 bp, Homo sapiens
caagtcactagaagt

SEQ ID NO: 814816 - DNA, 17 bp, Homo sapiens
caagtcactagaagtcc

SEQ ID NO: 814817 - DNA, 19 bp, Homo sapiens
caagtcagctttgccttcc

SEQ ID NO: 814818 - DNA, 20 bp, Homo sapiens
caagtcagctttgccttcca

SEQ ID NO: 814819 - DNA, 13 bp, Homo sapiens
caagtcaggccag

SEQ ID NO: 814820 - DNA, 18 bp, Homo sapiens
caagtcaggccaggtggg

SEQ ID NO: 814821 - DNA, 19 bp, Homo sapiens
caagtcaggcccttatttt

SEQ ID NO: 814822 - DNA, 22 bp, Homo sapiens
caagtcagtaggactccttatt

SEQ ID NO: 814823 - DNA, 20 bp, Homo sapiens
caagtcatggagaatctgct

SEQ ID NO: 814824 - DNA, 13 bp, Homo sapiens
caagtcatgtgca

SEQ ID NO: 814825 - DNA, 16 bp, Homo sapiens
caagtcatgtgcattt

SEQ ID NO: 814826 - DNA, 12 bp, Homo sapiens
caagtcatttta

SEQ ID NO: 814827 - DNA, 14 bp, Homo sapiens
caagtccactgtcc

SEQ ID NO: 814828 - DNA, 23 bp, Homo sapiens
caagtccactgtcctccttggcg

SEQ ID NO: 814829 - DNA, 21 bp, Homo sapiens
caagtccagatttacactggg

SEQ ID NO: 814830 - DNA, 14 bp, Homo sapiens
caagtccagctggg

SEQ ID NO: 814831 - DNA, 21 bp, Homo sapiens
caagtccagctgggaagccct

SEQ ID NO: 814832 - DNA, 17 bp, Homo sapiens
caagtcccagacaagga

SEQ ID NO: 814833 - DNA, 18 bp, Homo sapiens
caagtccctgactctctg

SEQ ID NO: 814834 - DNA, 21 bp, Homo sapiens
caagtccctgactctctgtga

SEQ ID NO: 814835 - DNA, 23 bp, Homo sapiens
caagtccctgactctctgtgacc

SEQ ID NO: 814836 - DNA, 20 bp, Homo sapiens
caagtccctgttttctgagc

SEQ ID NO: 814837 - DNA, 19 bp, Homo sapiens
caagtccgcagaagccctg

SEQ ID NO: 814838 - DNA, 14 bp, Homo sapiens
caagtcctgaagag

SEQ ID NO: 814839 - DNA, 16 bp, Homo sapiens
caagtcctgaagaggc

SEQ ID NO: 814840 - DNA, 23 bp, Homo sapiens
caagtcctgaagaggcgggccag

SEQ ID NO: 814841 - DNA, 13 bp, Homo sapiens
caagtcctggcta

SEQ ID NO: 814842 - DNA, 17 bp, Homo sapiens
caagtcctgtgaatttc

SEQ ID NO: 814843 - DNA, 18 bp, Homo sapiens
caagtcctgtgaatttct

SEQ ID NO: 814844 - DNA, 17 bp, Homo sapiens
caagtcgatgaactatt

SEQ ID NO: 814845 - DNA, 14 bp, Homo sapiens
caagtctagagtct

SEQ ID NO: 814846 - DNA, 16 bp, Homo sapiens
caagtctagtcttctg

SEQ ID NO: 814847 - DNA, 18 bp, Homo sapiens
caagtctctctgtgaata

SEQ ID NO: 814848 - DNA, 18 bp, Homo sapiens
caagtctctgctggccca

SEQ ID NO: 814849 - DNA, 13 bp, Homo sapiens
caagtctgcagcc

SEQ ID NO: 814850 - DNA, 13 bp, Homo sapiens
caagtctggatct

SEQ ID NO: 814851 - DNA, 13 bp, Homo sapiens
caagtctgtgttc

SEQ ID NO: 814852 - DNA, 23 bp, Homo sapiens
caagtcttaacaaaccaacatct

SEQ ID NO: 814853 - DNA, 15 bp, Homo sapiens
caagtcttccctgat

SEQ ID NO: 814854 - DNA, 23 bp, Homo sapiens
caagtcttgggtctgaatttatt

SEQ ID NO: 814855 - DNA, 23 bp, Homo sapiens
caagtctttcttcttttttaagt

SEQ ID NO: 814856 - DNA, 19 bp, Homo sapiens
caagtgaaaaaggaggaag

SEQ ID NO: 814857 - DNA, 23 bp, Homo sapiens
caagtgaaaaaggaggaagagaa

SEQ ID NO: 814858 - DNA, 21 bp, Homo sapiens
caagtgaacactgttctacca

SEQ ID NO: 814859 - DNA, 19 bp, Homo sapiens
caagtgaagaacactactg

SEQ ID NO: 814860 - DNA, 23 bp, Homo sapiens
caagtgaatacattttataattt

SEQ ID NO: 814861 - DNA, 16 bp, Homo sapiens
caagtgaatctttctc

SEQ ID NO: 814862 - DNA, 18 bp, Homo sapiens
caagtgaatctttctcct

SEQ ID NO: 814863 - DNA, 21 bp, Homo sapiens
caagtgaatctttctcctggt

SEQ ID NO: 814864 - DNA, 14 bp, Homo sapiens
caagtgaccaggga

SEQ ID NO: 814865 - DNA, 21 bp, Homo sapiens
caagtgaccagggaagtgtgt

SEQ ID NO: 814866 - DNA, 18 bp, Homo sapiens
caagtgaccccagggcct

SEQ ID NO: 814867 - DNA, 19 bp, Homo sapiens
caagtgactgtatctgtgt

SEQ ID NO: 814868 - DNA, 15 bp, Homo sapiens
caagtgagaccctgt

SEQ ID NO: 814869 - DNA, 19 bp, Homo sapiens
caagtgagaccctgtctca

SEQ ID NO: 814870 - DNA, 17 bp, Homo sapiens
caagtgatatcacctct

SEQ ID NO: 814871 - DNA, 21 bp, Homo sapiens
caagtgatatcacctctcttc

SEQ ID NO: 814872 - DNA, 19 bp, Homo sapiens
caagtgatctgtccacctc

SEQ ID NO: 814873 - DNA, 20 bp, Homo sapiens
caagtgattctcctgcctca

SEQ ID NO: 814874 - DNA, 21 bp, Homo sapiens
caagtgattctcctgcctcag

SEQ ID NO: 814875 - DNA, 22 bp, Homo sapiens
caagtgattctcctgcctcagc

SEQ ID NO: 814876 - DNA, 20 bp, Homo sapiens
caagtgcacggggcacagcg

SEQ ID NO: 814877 - DNA, 20 bp, Homo sapiens
caagtgcaggctggcaccgc

SEQ ID NO: 814878 - DNA, 19 bp, Homo sapiens
caagtgcatgctctctgca

SEQ ID NO: 814879 - DNA, 14 bp, Homo sapiens
caagtgccagaggt

SEQ ID NO: 814880 - DNA, 19 bp, Homo sapiens
caagtgccagaggtgggca

SEQ ID NO: 814881 - DNA, 20 bp, Homo sapiens
caagtgccagggctgggccc

SEQ ID NO: 814882 - DNA, 20 bp, Homo sapiens
caagtgccagtcttgtgtct

SEQ ID NO: 814883 - DNA, 16 bp, Homo sapiens
caagtgccgcaaattg

SEQ ID NO: 814884 - DNA, 18 bp, Homo sapiens
caagtgccgcaaattgta

SEQ ID NO: 814885 - DNA, 16 bp, Homo sapiens
caagtgcctcacctcg

SEQ ID NO: 814886 - DNA, 16 bp, Homo sapiens
caagtgcctcttgttg

SEQ ID NO: 814887 - DNA, 22 bp, Homo sapiens
caagtgcctgcttttgatgatg

SEQ ID NO: 814888 - DNA, 22 bp, Homo sapiens
caagtgctgcacaaaagcagat

SEQ ID NO: 814889 - DNA, 14 bp, Homo sapiens
caagtgctggagtc

SEQ ID NO: 814890 - DNA, 20 bp, Homo sapiens
caagtgctggagtctcctga

SEQ ID NO: 814891 - DNA, 19 bp, Homo sapiens
caatcatctgtgtgaaaat

SEQ ID NO: 814892 - DNA, 20 bp, Homo sapiens
caatcatctgtgtgaaaatg

SEQ ID NO: 814893 - DNA, 17 bp, Homo sapiens
caatcatgaaatatgca

SEQ ID NO: 814894 - DNA, 21 bp, Homo sapiens
caatcatgaacagctctgaga

SEQ ID NO: 814895 - DNA, 22 bp, Homo sapiens
caatcatggtcaagttcccaac

SEQ ID NO: 814896 - DNA, 12 bp, Homo sapiens
caatcattgaag

SEQ ID NO: 814897 - DNA, 16 bp, Homo sapiens
caatcattgctgaaaa

SEQ ID NO: 814898 - DNA, 14 bp, Homo sapiens
caatcattttaaga

SEQ ID NO: 814899 - DNA, 17 bp, Homo sapiens
caatcattttaattatt

SEQ ID NO: 814900 - DNA, 13 bp, Homo sapiens
caatcattttatg

SEQ ID NO: 814901 - DNA, 21 bp, Homo sapiens
caatccaggccaaagccccat

SEQ ID NO: 814902 - DNA, 23 bp, Homo sapiens
caatccattcacaagcctcctgt

SEQ ID NO: 814903 - DNA, 14 bp, Homo sapiens
caatcccaccaaat

SEQ ID NO: 814904 - DNA, 16 bp, Homo sapiens
caatcccaccaaccct

SEQ ID NO: 814905 - DNA, 17 bp, Homo sapiens
caatcccaccaaccctc

SEQ ID NO: 814906 - DNA, 22 bp, Homo sapiens
caatcccaccaaccctcagagc

SEQ ID NO: 814907 - DNA, 17 bp, Homo sapiens
caatcccagctacctca

SEQ ID NO: 814908 - DNA, 22 bp, Homo sapiens
caatcccctcattcaggaaaac

SEQ ID NO: 814909 - DNA, 11 bp, Homo sapiens
caatccctctc

SEQ ID NO: 814910 - DNA, 16 bp, Homo sapiens
caatccctctccactc

SEQ ID NO: 814911 - DNA, 19 bp, Homo sapiens
caatccctctccactcttc

SEQ ID NO: 814912 - DNA, 22 bp, Homo sapiens
caatccctctccactcttctct

SEQ ID NO: 814913 - DNA, 16 bp, Homo sapiens
caatccctgccactgg

SEQ ID NO: 814914 - DNA, 18 bp, Homo sapiens
caatccctgccactgggc

SEQ ID NO: 814915 - DNA, 22 bp, Homo sapiens
caatcctaacacattatcggga

SEQ ID NO: 814916 - DNA, 19 bp, Homo sapiens
caatcctaatttctcctcc

SEQ ID NO: 814917 - DNA, 14 bp, Homo sapiens
caatcctcactggg

SEQ ID NO: 814918 - DNA, 14 bp, Homo sapiens
caatcctcctgcct

SEQ ID NO: 814919 - DNA, 16 bp, Homo sapiens
caatcctcctgcctca

SEQ ID NO: 814920 - DNA, 13 bp, Homo sapiens
caatcctctaagc

SEQ ID NO: 814921 - DNA, 13 bp, Homo sapiens
caatcctgcattg

SEQ ID NO: 814922 - DNA, 14 bp, Homo sapiens
caatcggactgcca

SEQ ID NO: 814923 - DNA, 15 bp, Homo sapiens
caatcggactgccaa

SEQ ID NO: 814924 - DNA, 19 bp, Homo sapiens
caatctattgcttcaccat

SEQ ID NO: 814925 - DNA, 20 bp, Homo sapiens
caatctcaaattctcaacct

SEQ ID NO: 814926 - DNA, 21 bp, Homo sapiens
caatctcaaattctcaaccta

SEQ ID NO: 814927 - DNA, 20 bp, Homo sapiens
caatctcacaccttagctat

SEQ ID NO: 814928 - DNA, 15 bp, Homo sapiens
caatctctggtgcct

SEQ ID NO: 814929 - DNA, 14 bp, Homo sapiens
caatctctgttctg

SEQ ID NO: 814930 - DNA, 13 bp, Homo sapiens
caatctgaccctt

SEQ ID NO: 814931 - DNA, 15 bp, Homo sapiens
caatctgcagccatt

SEQ ID NO: 814932 - DNA, 17 bp, Homo sapiens
caatctgcattttaaca

SEQ ID NO: 814933 - DNA, 17 bp, Homo sapiens
caatctggaagaaaaaa

SEQ ID NO: 814934 - DNA, 18 bp, Homo sapiens
caatctgggactttcact

SEQ ID NO: 814935 - DNA, 14 bp, Homo sapiens
caatctgtcagttc

SEQ ID NO: 814936 - DNA, 19 bp, Homo sapiens
caatcttaccagatgctac

SEQ ID NO: 814937 - DNA, 21 bp, Homo sapiens
caatcttaccagatgctactg

SEQ ID NO: 814938 - DNA, 15 bp, Homo sapiens
caatcttgcccactg

SEQ ID NO: 814939 - DNA, 13 bp, Homo sapiens
caatcttgttact

SEQ ID NO: 814940 - DNA, 14 bp, Homo sapiens
caatcttgttactg

SEQ ID NO: 814941 - DNA, 18 bp, Homo sapiens
caatctttcatgtcttgt

SEQ ID NO: 814942 - DNA, 14 bp, Homo sapiens
caatctttgaaata

SEQ ID NO: 814943 - DNA, 19 bp, Homo sapiens
caatctttgaaataaaaaa

SEQ ID NO: 814944 - DNA, 14 bp, Homo sapiens
caatctttgccttt

SEQ ID NO: 814945 - DNA, 21 bp, Homo sapiens
caatgaaaaatagtgtctttg

SEQ ID NO: 814946 - DNA, 22 bp, Homo sapiens
caatgaaaacaaataaaagttg

SEQ ID NO: 814947 - DNA, 15 bp, Homo sapiens
caatgaaacagatga

SEQ ID NO: 814948 - DNA, 23 bp, Homo sapiens
caatgaaatacacaagtaaacat

SEQ ID NO: 814949 - DNA, 21 bp, Homo sapiens
caatgaaatactccagcacct

SEQ ID NO: 814950 - DNA, 22 bp, Homo sapiens
caatgaaatactccagcacctg

SEQ ID NO: 814951 - DNA, 11 bp, Homo sapiens
caatgaaatga

SEQ ID NO: 814952 - DNA, 13 bp, Homo sapiens
caatgaaatgaat

SEQ ID NO: 814953 - DNA, 13 bp, Homo sapiens
caatgaaattgac

SEQ ID NO: 814954 - DNA, 20 bp, Homo sapiens
caatgaatgtatattttgtg

SEQ ID NO: 814955 - DNA, 19 bp, Homo sapiens
caatgacacagtcttggct

SEQ ID NO: 814956 - DNA, 20 bp, Homo sapiens
caatgacacccatgccagag

SEQ ID NO: 814957 - DNA, 21 bp, Homo sapiens
caatgacatccagaaagctga

SEQ ID NO: 814958 - DNA, 15 bp, Homo sapiens
caatgacatcttcaa

SEQ ID NO: 814959 - DNA, 19 bp, Homo sapiens
caatgacatcttcaaagct

SEQ ID NO: 814960 - DNA, 15 bp, Homo sapiens
caatgacctgtattt

SEQ ID NO: 814961 - DNA, 11 bp, Homo sapiens
caatgactact

SEQ ID NO: 814962 - DNA, 17 bp, Homo sapiens
caatgacttactgtaca

SEQ ID NO: 814963 - DNA, 16 bp, Homo sapiens
caatgacttttaaaga

SEQ ID NO: 814964 - DNA, 21 bp, Homo sapiens
caatgacttttaaagatttag

SEQ ID NO: 814965 - DNA, 16 bp, Homo sapiens
caatgagctgtatctg

SEQ ID NO: 814966 - DNA, 19 bp, Homo sapiens
caatgagctgtatctgtaa

SEQ ID NO: 814967 - DNA, 20 bp, Homo sapiens
caatgaggtgtccaactggc

SEQ ID NO: 814968 - DNA, 19 bp, Homo sapiens
caatgatcacatctaaagc

SEQ ID NO: 814969 - DNA, 20 bp, Homo sapiens
caatgatcaccgactgaaaa

SEQ ID NO: 814970 - DNA, 13 bp, Homo sapiens
caatgatggcaat

SEQ ID NO: 814971 - DNA, 16 bp, Homo sapiens
caatgatggcaatttt

SEQ ID NO: 814972 - DNA, 21 bp, Homo sapiens
caatgatggcaattttgtaac

SEQ ID NO: 814973 - DNA, 14 bp, Homo sapiens
caatgatgtccaga

SEQ ID NO: 814974 - DNA, 13 bp, Homo sapiens
caatgcaaagtaa

SEQ ID NO: 814975 - DNA, 16 bp, Homo sapiens
caatgcaagagtgatt

SEQ ID NO: 814976 - DNA, 22 bp, Homo sapiens
caatgcaagagtgattgcagct

SEQ ID NO: 814977 - DNA, 16 bp, Homo sapiens
caatgcaatgaaacag

SEQ ID NO: 814978 - DNA, 23 bp, Homo sapiens
caatgcacctaaagaaaaacaaa

SEQ ID NO: 814979 - DNA, 21 bp, Homo sapiens
caatgcagtcagtgtttcttt

SEQ ID NO: 814980 - DNA, 15 bp, Homo sapiens
caatgcatacaataa

SEQ ID NO: 814981 - DNA, 16 bp, Homo sapiens
caatgcatacaataaa

SEQ ID NO: 814982 - DNA, 23 bp, Homo sapiens
caatgcatacaataaaagagctt

SEQ ID NO: 814983 - DNA, 16 bp, Homo sapiens
caatgcatgcagccac

SEQ ID NO: 814984 - DNA, 22 bp, Homo sapiens
caatgcatgtgctgtctccatg

SEQ ID NO: 814985 - DNA, 16 bp, Homo sapiens
caatgccagggcccag

SEQ ID NO: 814986 - DNA, 18 bp, Homo sapiens
caatgccagggcccagga

SEQ ID NO: 814987 - DNA, 15 bp, Homo sapiens
caatgccatcagccc

SEQ ID NO: 814988 - DNA, 14 bp, Homo sapiens
caatgccctgccat

SEQ ID NO: 814989 - DNA, 16 bp, Homo sapiens
caatgccctgccatta

SEQ ID NO: 814990 - DNA, 15 bp, Homo sapiens
caatgccctgctggc

SEQ ID NO: 814991 - DNA, 16 bp, Homo sapiens
caatgccctgctggcc

SEQ ID NO: 814992 - DNA, 16 bp, Homo sapiens
caatgcctataaaatg

SEQ ID NO: 814993 - DNA, 13 bp, Homo sapiens
caatgcctggaga

SEQ ID NO: 814994 - DNA, 14 bp, Homo sapiens
caatgcctgtgaag

SEQ ID NO: 814995 - DNA, 21 bp, Homo sapiens
caatgccttgacaacagactg

SEQ ID NO: 814996 - DNA, 20 bp, Homo sapiens
caatgcctttttagatgtat

SEQ ID NO: 814997 - DNA, 17 bp, Homo sapiens
caatgctgcctgggagc

SEQ ID NO: 814998 - DNA, 14 bp, Homo sapiens
caatgctgtacgta

SEQ ID NO: 814999 - DNA, 13 bp, Homo sapiens
caatgctgtactt

SEQ ID NO: 815000 - DNA, 22 bp, Homo sapiens
caatgctgtgccctaaagtgta

SEQ ID NO: 815001 - DNA, 20 bp, Homo sapiens
caatgcttaaactaaataat

SEQ ID NO: 815002 - DNA, 18 bp, Homo sapiens
caatgctttatttgtaaa

SEQ ID NO: 815003 - DNA, 23 bp, Homo sapiens
caatgctttatttgtaaatttag

SEQ ID NO: 815004 - DNA, 16 bp, Homo sapiens
caatgcttttaatgaa

SEQ ID NO: 815005 - DNA, 20 bp, Homo sapiens
caatgcttttatatggccca

SEQ ID NO: 815006 - DNA, 14 bp, Homo sapiens
caatggacaagcag

SEQ ID NO: 815007 - DNA, 18 bp, Homo sapiens
caatggcaataggacaaa

SEQ ID NO: 815008 - DNA, 23 bp, Homo sapiens
caatggcagcattcccaccaaca

SEQ ID NO: 815009 - DNA, 17 bp, Homo sapiens
caatggcagctagactg

SEQ ID NO: 815010 - DNA, 22 bp, Homo sapiens
caatggcagctagactggagtg

SEQ ID NO: 815011 - DNA, 17 bp, Homo sapiens
caatggccagagcctct

SEQ ID NO: 815012 - DNA, 12 bp, Homo sapiens
caatggcgctgt

SEQ ID NO: 815013 - DNA, 22 bp, Homo sapiens
cacaagatggaatttatcaaac

SEQ ID NO: 815014 - DNA, 17 bp, Homo sapiens
cacaagattcccagaga

SEQ ID NO: 815015 - DNA, 18 bp, Homo sapiens
cacaagattcccagagac

SEQ ID NO: 815016 - DNA, 22 bp, Homo sapiens
cacaagcaaaaaaaaaaaaaag

SEQ ID NO: 815017 - DNA, 17 bp, Homo sapiens
cacaagccacagaagcc

SEQ ID NO: 815018 - DNA, 10 bp, Homo sapiens
cacaagcccg

SEQ ID NO: 815019 - DNA, 15 bp, Homo sapiens
cacaagcctcctgta

SEQ ID NO: 815020 - DNA, 13 bp, Homo sapiens
cacaagctcctta

SEQ ID NO: 815021 - DNA, 23 bp, Homo sapiens
cacaagctgcaccctcaggcagg

SEQ ID NO: 815022 - DNA, 15 bp, Homo sapiens
cacaagctgcactgt

SEQ ID NO: 815023 - DNA, 18 bp, Homo sapiens
cacaagctgcactgtgaa

SEQ ID NO: 815024 - DNA, 14 bp, Homo sapiens
cacaagctgcctct

SEQ ID NO: 815025 - DNA, 17 bp, Homo sapiens
cacaagctgcctctgac

SEQ ID NO: 815026 - DNA, 12 bp, Homo sapiens
cacaagctggaa

SEQ ID NO: 815027 - DNA, 16 bp, Homo sapiens
cacaagctggaagcac

SEQ ID NO: 815028 - DNA, 21 bp, Homo sapiens
cacaaggaaccctcaggccac

SEQ ID NO: 815029 - DNA, 20 bp, Homo sapiens
cacaaggaatttccctgtgt

SEQ ID NO: 815030 - DNA, 16 bp, Homo sapiens
cacaaggagtgcccgc

SEQ ID NO: 815031 - DNA, 12 bp, Homo sapiens
cacaaggcctta

SEQ ID NO: 815032 - DNA, 18 bp, Homo sapiens
cacaaggctgaccaagag

SEQ ID NO: 815033 - DNA, 15 bp, Homo sapiens
cacaaggtccactcc

SEQ ID NO: 815034 - DNA, 22 bp, Homo sapiens
cacaaggtccactccctgctcc

SEQ ID NO: 815035 - DNA, 17 bp, Homo sapiens
cacaaggtgcaaatcaa

SEQ ID NO: 815036 - DNA, 13 bp, Homo sapiens
cacaagtaaacat

SEQ ID NO: 815037 - DNA, 22 bp, Homo sapiens
cacaagtagatgcctgaacttg

SEQ ID NO: 815038 - DNA, 21 bp, Homo sapiens
cacaagtcctggatgttgtgt

SEQ ID NO: 815039 - DNA, 12 bp, Homo sapiens
cacaagtgaaaa

SEQ ID NO: 815040 - DNA, 16 bp, Homo sapiens
cacaagtgaaaaacat

SEQ ID NO: 815041 - DNA, 21 bp, Homo sapiens
cacaagtgccgcaaattgtac

SEQ ID NO: 815042 - DNA, 11 bp, Homo sapiens
cacaataaatg

SEQ ID NO: 815043 - DNA, 21 bp, Homo sapiens
cacaataaatggccagtgctg

SEQ ID NO: 815044 - DNA, 21 bp, Homo sapiens
cacaataacactaaaatttta

SEQ ID NO: 815045 - DNA, 14 bp, Homo sapiens
cacaataggtcttt

SEQ ID NO: 815046 - DNA, 18 bp, Homo sapiens
cacaataggtctttctct

SEQ ID NO: 815047 - DNA, 19 bp, Homo sapiens
cacaataggtctttctctc

SEQ ID NO: 815048 - DNA, 18 bp, Homo sapiens
cacaatatttcttttgtt

SEQ ID NO: 815049 - DNA, 17 bp, Homo sapiens
cacaatcactaaacttt

SEQ ID NO: 815050 - DNA, 21 bp, Homo sapiens
cacaatcagtttatcctgaca

SEQ ID NO: 815051 - DNA, 24 bp, Homo sapiens
cacaatcatggctcactgcagcct

SEQ ID NO: 815052 - DNA, 15 bp, Homo sapiens
cacaatccctttcta

SEQ ID NO: 815053 - DNA, 17 bp, Homo sapiens
cacaatcctattactct

SEQ ID NO: 815054 - DNA, 24 bp, Homo sapiens
cacaatctcggcccgctgcagcct

SEQ ID NO: 815055 - DNA, 20 bp, Homo sapiens
cacaatctgggactttcact

SEQ ID NO: 815056 - DNA, 18 bp, Homo sapiens
cacaatgcagttctgagc

SEQ ID NO: 815057 - DNA, 22 bp, Homo sapiens
cacaatggaaaacctgggggat

SEQ ID NO: 815058 - DNA, 20 bp, Homo sapiens
cacaatggcacctctgccct

SEQ ID NO: 815059 - DNA, 21 bp, Homo sapiens
cacaatggcacctctgccctt

SEQ ID NO: 815060 - DNA, 17 bp, Homo sapiens
cacaatgtttcttcatt

SEQ ID NO: 815061 - DNA, 19 bp, Homo sapiens
cacaattaaaccgcatgtg

SEQ ID NO: 815062 - DNA, 19 bp, Homo sapiens
cacaattaattcatccctt

SEQ ID NO: 815063 - DNA, 16 bp, Homo sapiens
cacaattagatttctc

SEQ ID NO: 815064 - DNA, 16 bp, Homo sapiens
cacaattctgtccctg

SEQ ID NO: 815065 - DNA, 19 bp, Homo sapiens
cacaattctgtccctgtcc

SEQ ID NO: 815066 - DNA, 21 bp, Homo sapiens
cacaattgatacttcaggtgc

SEQ ID NO: 815067 - DNA, 22 bp, Homo sapiens
cacaattgatacttcaggtgct

SEQ ID NO: 815068 - DNA, 18 bp, Homo sapiens
cacaattttgataaaaat

SEQ ID NO: 815069 - DNA, 18 bp, Homo sapiens
cacacaaaaaggagcggg

SEQ ID NO: 815070 - DNA, 23 bp, Homo sapiens
cacacaaaaaggagcgggcaggg

SEQ ID NO: 815071 - DNA, 15 bp, Homo sapiens
cacacaaaccatttt

SEQ ID NO: 815072 - DNA, 10 bp, Homo sapiens
cacacacaca

SEQ ID NO: 815073 - DNA, 15 bp, Homo sapiens
cacacacacaaacct

SEQ ID NO: 815074 - DNA, 14 bp, Homo sapiens
cacacacacacaca

SEQ ID NO: 815075 - DNA, 16 bp, Homo sapiens
cacacacacacacacg

SEQ ID NO: 815076 - DNA, 16 bp, Homo sapiens
cacacacacacacagg

SEQ ID NO: 815077 - DNA, 13 bp, Homo sapiens
cacacacacacag

SEQ ID NO: 815078 - DNA, 16 bp, Homo sapiens
cacacacacacaggag

SEQ ID NO: 815079 - DNA, 14 bp, Homo sapiens
cacacacacagctg

SEQ ID NO: 815080 - DNA, 13 bp, Homo sapiens
cacacacacagga

SEQ ID NO: 815081 - DNA, 16 bp, Homo sapiens
cacacacacgatgcat

SEQ ID NO: 815082 - DNA, 13 bp, Homo sapiens
cacacacactcta

SEQ ID NO: 815083 - DNA, 23 bp, Homo sapiens
cacacacagaggaagagcaggca

SEQ ID NO: 815084 - DNA, 22 bp, Homo sapiens
cacacacagctgggcaaagcca

SEQ ID NO: 815085 - DNA, 13 bp, Homo sapiens
cacacacaggcct

SEQ ID NO: 815086 - DNA, 14 bp, Homo sapiens
cacacacccctccg

SEQ ID NO: 815087 - DNA, 11 bp, Homo sapiens
cacacacctgt

SEQ ID NO: 815088 - DNA, 14 bp, Homo sapiens
cacacacgcacgca

SEQ ID NO: 815089 - DNA, 15 bp, Homo sapiens
cacacacgcacgcac

SEQ ID NO: 815090 - DNA, 16 bp, Homo sapiens
cacacacgcacgcaca

SEQ ID NO: 815091 - DNA, 13 bp, Homo sapiens
cacacacgccagc

SEQ ID NO: 815092 - DNA, 17 bp, Homo sapiens
cacacacgccagctcct

SEQ ID NO: 815093 - DNA, 20 bp, Homo sapiens
cacacacgttgacgggccgc

SEQ ID NO: 815094 - DNA, 14 bp, Homo sapiens
cacacactcaccag

SEQ ID NO: 815095 - DNA, 15 bp, Homo sapiens
cacacactcaccagt

SEQ ID NO: 815096 - DNA, 11 bp, Homo sapiens
cacacactgga

SEQ ID NO: 815097 - DNA, 14 bp, Homo sapiens
cacacactggaccc

SEQ ID NO: 815098 - DNA, 21 bp, Homo sapiens
cacacactggaccccactggc

SEQ ID NO: 815099 - DNA, 21 bp, Homo sapiens
cacacactgtctggggcccca

SEQ ID NO: 815100 - DNA, 21 bp, Homo sapiens
cacacacttagccattgaaat

SEQ ID NO: 815101 - DNA, 17 bp, Homo sapiens
cacacagaatgctcagg

SEQ ID NO: 815102 - DNA, 13 bp, Homo sapiens
cacacagaattgc

SEQ ID NO: 815103 - DNA, 15 bp, Homo sapiens
cacacagactatttt

SEQ ID NO: 815104 - DNA, 12 bp, Homo sapiens
cacacagcctct

SEQ ID NO: 815105 - DNA, 18 bp, Homo sapiens
cacacagctactctcccc

SEQ ID NO: 815106 - DNA, 13 bp, Homo sapiens
cacacagctcctc

SEQ ID NO: 815107 - DNA, 15 bp, Homo sapiens
cacacagctgagcac

SEQ ID NO: 815108 - DNA, 17 bp, Homo sapiens
cacacagctgagcactt

SEQ ID NO: 815109 - DNA, 15 bp, Homo sapiens
cacacagctgcccta

SEQ ID NO: 815110 - DNA, 15 bp, Homo sapiens
cacacagctgggcaa

SEQ ID NO: 815111 - DNA, 17 bp, Homo sapiens
cacacaggacccccttc

SEQ ID NO: 815112 - DNA, 19 bp, Homo sapiens
cacacaggacccccttccc

SEQ ID NO: 815113 - DNA, 20 bp, Homo sapiens
cacacaggacccccttcccc

SEQ ID NO: 815114 - DNA, 15 bp, Homo sapiens
cacacaggccttctg

SEQ ID NO: 815115 - DNA, 19 bp, Homo sapiens
cacacaggccttctgtggg

SEQ ID NO: 815116 - DNA, 13 bp, Homo sapiens
cacacagggcagt

SEQ ID NO: 815117 - DNA, 15 bp, Homo sapiens
cacacagggctcaca

SEQ ID NO: 815118 - DNA, 16 bp, Homo sapiens
cacacagggctcacag

SEQ ID NO: 815119 - DNA, 18 bp, Homo sapiens
cacacagggctcacaggg

SEQ ID NO: 815120 - DNA, 19 bp, Homo sapiens
cacacagggctcacagggc

SEQ ID NO: 815121 - DNA, 21 bp, Homo sapiens
cacacagggctcacagggcag

SEQ ID NO: 815122 - DNA, 22 bp, Homo sapiens
cacacagggctcacagggcagg

SEQ ID NO: 815123 - DNA, 15 bp, Homo sapiens
cacacatcaccaggt

SEQ ID NO: 815124 - DNA, 22 bp, Homo sapiens
cacacatccagctgcccctccc

SEQ ID NO: 815125 - DNA, 19 bp, Homo sapiens
cacacatctgggtgccctg

SEQ ID NO: 815126 - DNA, 16 bp, Homo sapiens
cacacatcttacctct

SEQ ID NO: 815127 - DNA, 18 bp, Homo sapiens
cacacatcttacctctca

SEQ ID NO: 815128 - DNA, 20 bp, Homo sapiens
cacacatcttacctctcatg

SEQ ID NO: 815129 - DNA, 18 bp, Homo sapiens
cacacattccagccaggc

SEQ ID NO: 815130 - DNA, 18 bp, Homo sapiens
cacacattccagggctgg

SEQ ID NO: 815131 - DNA, 20 bp, Homo sapiens
cacacattccagggctgggg

SEQ ID NO: 815132 - DNA, 18 bp, Homo sapiens
cacaccaagcagcaacag

SEQ ID NO: 815133 - DNA, 15 bp, Homo sapiens
cacaccaatcagaga

SEQ ID NO: 815134 - DNA, 16 bp, Homo sapiens
cacaccacatctaagc

SEQ ID NO: 815135 - DNA, 17 bp, Homo sapiens
cacacttgttccagctc

SEQ ID NO: 815136 - DNA, 20 bp, Homo sapiens
cacacttgttccagctcttt

SEQ ID NO: 815137 - DNA, 15 bp, Homo sapiens
cacactttctcttca

SEQ ID NO: 815138 - DNA, 16 bp, Homo sapiens
cacactttttatttaa

SEQ ID NO: 815139 - DNA, 13 bp, Homo sapiens
cacagaaaaagca

SEQ ID NO: 815140 - DNA, 15 bp, Homo sapiens
cacagaaaaagcatg

SEQ ID NO: 815141 - DNA, 17 bp, Homo sapiens
cacagaaaataaggcac

SEQ ID NO: 815142 - DNA, 18 bp, Homo sapiens
cacagaaacttgaactcc

SEQ ID NO: 815143 - DNA, 23 bp, Homo sapiens
cacagaaagctagatatgcctta

SEQ ID NO: 815144 - DNA, 19 bp, Homo sapiens
cacagaaaggcaggtttca

SEQ ID NO: 815145 - DNA, 13 bp, Homo sapiens
cacagaaatgctg

SEQ ID NO: 815146 - DNA, 19 bp, Homo sapiens
cacagaaatgctgctggcc

SEQ ID NO: 815147 - DNA, 22 bp, Homo sapiens
cacagaaatgctgctggccaaa

SEQ ID NO: 815148 - DNA, 19 bp, Homo sapiens
cacagaaccttcaacccag

SEQ ID NO: 815149 - DNA, 20 bp, Homo sapiens
cacagaagacttcccagctt

SEQ ID NO: 815150 - DNA, 23 bp, Homo sapiens
cacagaagccaggagcaaatgtt

SEQ ID NO: 815151 - DNA, 16 bp, Homo sapiens
cacagaatatttttat

SEQ ID NO: 815152 - DNA, 18 bp, Homo sapiens
cacagaatatttttatat

SEQ ID NO: 815153 - DNA, 15 bp, Homo sapiens
cacagaatgctcagg

SEQ ID NO: 815154 - DNA, 13 bp, Homo sapiens
cacagacacacac

SEQ ID NO: 815155 - DNA, 22 bp, Homo sapiens
cacagacacacacacgcacgca

SEQ ID NO: 815156 - DNA, 21 bp, Homo sapiens
cacagacatactaaccagcag

SEQ ID NO: 815157 - DNA, 14 bp, Homo sapiens
cacagacccaggac

SEQ ID NO: 815158 - DNA, 14 bp, Homo sapiens
cacagacccctccc

SEQ ID NO: 815159 - DNA, 14 bp, Homo sapiens
cacagacctgcagt

SEQ ID NO: 815160 - DNA, 22 bp, Homo sapiens
cacagacctgcagtgaggggcc

SEQ ID NO: 815161 - DNA, 13 bp, Homo sapiens
cacagacctgctc

SEQ ID NO: 815162 - DNA, 22 bp, Homo sapiens
cacagacctgctctggacactt

SEQ ID NO: 815163 - DNA, 14 bp, Homo sapiens
cacagacctggagc

SEQ ID NO: 815164 - DNA, 15 bp, Homo sapiens
cacagacctggagcc

SEQ ID NO: 815165 - DNA, 16 bp, Homo sapiens
cacagacctggagccc

SEQ ID NO: 815166 - DNA, 19 bp, Homo sapiens
cacagacctggagcccctg

SEQ ID NO: 815167 - DNA, 20 bp, Homo sapiens
cacagacctggagcccctgg

SEQ ID NO: 815168 - DNA, 16 bp, Homo sapiens
cacagactccggcctg

SEQ ID NO: 815169 - DNA, 16 bp, Homo sapiens
cacagactgccccagc

SEQ ID NO: 815170 - DNA, 13 bp, Homo sapiens
cacagactggaga

SEQ ID NO: 815171 - DNA, 17 bp, Homo sapiens
cacagactggcaataaa

SEQ ID NO: 815172 - DNA, 18 bp, Homo sapiens
cacagactggcaataaac

SEQ ID NO: 815173 - DNA, 21 bp, Homo sapiens
cacagacttctggaaggctgg

SEQ ID NO: 815174 - DNA, 22 bp, Homo sapiens
cacagacttctggaaggctggc

SEQ ID NO: 815175 - DNA, 14 bp, Homo sapiens
cacagactttctgt

SEQ ID NO: 815176 - DNA, 17 bp, Homo sapiens
cacagactttctgtgac

SEQ ID NO: 815177 - DNA, 15 bp, Homo sapiens
cacagagaagctggg

SEQ ID NO: 815178 - DNA, 23 bp, Homo sapiens
cacagagaagtttgtagccaggt

SEQ ID NO: 815179 - DNA, 15 bp, Homo sapiens
cacagagacggtctg

SEQ ID NO: 815180 - DNA, 10 bp, Homo sapiens
cacagagagg

SEQ ID NO: 815181 - DNA, 19 bp, Homo sapiens
cacagagagggagagcaga

SEQ ID NO: 815182 - DNA, 22 bp, Homo sapiens
cacagagattctggatctcctg

SEQ ID NO: 815183 - DNA, 13 bp, Homo sapiens
cacagagcacgcc

SEQ ID NO: 815184 - DNA, 16 bp, Homo sapiens
cacagagcacgcctgc

SEQ ID NO: 815185 - DNA, 16 bp, Homo sapiens
cacagagccctgaggg

SEQ ID NO: 815186 - DNA, 12 bp, Homo sapiens
cacagagcctgg

SEQ ID NO: 815187 - DNA, 21 bp, Homo sapiens
cacagaggaggtcagcaaagg

SEQ ID NO: 815188 - DNA, 13 bp, Homo sapiens
cacagagtgagcc

SEQ ID NO: 815189 - DNA, 18 bp, Homo sapiens
cacagagtgctggactgt

SEQ ID NO: 815190 - DNA, 18 bp, Homo sapiens
cacagagtggtctttctg

SEQ ID NO: 815191 - DNA, 22 bp, Homo sapiens
cacagagtggtctttctggaga

SEQ ID NO: 815192 - DNA, 17 bp, Homo sapiens
cacagagttgttacatt

SEQ ID NO: 815193 - DNA, 20 bp, Homo sapiens
cacagagttgttacattttt

SEQ ID NO: 815194 - DNA, 19 bp, Homo sapiens
cacagataattttttctta

SEQ ID NO: 815195 - DNA, 16 bp, Homo sapiens
cacagatacacacaca

SEQ ID NO: 815196 - DNA, 22 bp, Homo sapiens
cacagatacctcatcatccacc

SEQ ID NO: 815197 - DNA, 19 bp, Homo sapiens
cacagataccttgaaagga

SEQ ID NO: 815198 - DNA, 20 bp, Homo sapiens
cacagatatagttccgcacc

SEQ ID NO: 815199 - DNA, 19 bp, Homo sapiens
cacagatatatacacacag

SEQ ID NO: 815200 - DNA, 14 bp, Homo sapiens
cacagatgaggagc

SEQ ID NO: 815201 - DNA, 19 bp, Homo sapiens
cacagatggatttgcctgt

SEQ ID NO: 815202 - DNA, 20 bp, Homo sapiens
cacagatggatttgcctgtg

SEQ ID NO: 815203 - DNA, 18 bp, Homo sapiens
cacagattctttttttct

SEQ ID NO: 815204 - DNA, 23 bp, Homo sapiens
cacagattgaagaatctgcccct

SEQ ID NO: 815205 - DNA, 13 bp, Homo sapiens
cacagattggcca

SEQ ID NO: 815206 - DNA, 18 bp, Homo sapiens
cacagatttgagctcagc

SEQ ID NO: 815207 - DNA, 21 bp, Homo sapiens
cacagatttttacactaatat

SEQ ID NO: 815208 - DNA, 18 bp, Homo sapiens
cacagcaactgacctgag

SEQ ID NO: 815209 - DNA, 22 bp, Homo sapiens
cacagcaagccggccccccctc

SEQ ID NO: 815210 - DNA, 16 bp, Homo sapiens
cacagcaattcctcag

SEQ ID NO: 815211 - DNA, 18 bp, Homo sapiens
cacagcacaaattagtta

SEQ ID NO: 815212 - DNA, 15 bp, Homo sapiens
cacagcacaccagcc

SEQ ID NO: 815213 - DNA, 16 bp, Homo sapiens
cacagcaccagaatgt

SEQ ID NO: 815214 - DNA, 20 bp, Homo sapiens
cacagcacgggggccaagga

SEQ ID NO: 815215 - DNA, 16 bp, Homo sapiens
cacagcagcagaacaa

SEQ ID NO: 815216 - DNA, 11 bp, Homo sapiens
cacagcagccc

SEQ ID NO: 815217 - DNA, 18 bp, Homo sapiens
cacagcagccccccagca

SEQ ID NO: 815218 - DNA, 18 bp, Homo sapiens
cacagcagcctctgaagt

SEQ ID NO: 815219 - DNA, 19 bp, Homo sapiens
cacagcagctgaacagcca

SEQ ID NO: 815220 - DNA, 13 bp, Homo sapiens
cacagcagcttca

SEQ ID NO: 815221 - DNA, 21 bp, Homo sapiens
cacagcagcttcaccagagca

SEQ ID NO: 815222 - DNA, 14 bp, Homo sapiens
cacagcaggacctg

SEQ ID NO: 815223 - DNA, 20 bp, Homo sapiens
cacagcaggacctgtgcttt

SEQ ID NO: 815224 - DNA, 17 bp, Homo sapiens
cacagcaggggagccct

SEQ ID NO: 815225 - DNA, 19 bp, Homo sapiens
cacagcaggggctggccca

SEQ ID NO: 815226 - DNA, 17 bp, Homo sapiens
cacagcagtgagactgg

SEQ ID NO: 815227 - DNA, 13 bp, Homo sapiens
cacagcagtgtga

SEQ ID NO: 815228 - DNA, 23 bp, Homo sapiens
cacagcagtgtgaatagcctggc

SEQ ID NO: 815229 - DNA, 23 bp, Homo sapiens
cacagcatcattttgcattcaaa

SEQ ID NO: 815230 - DNA, 22 bp, Homo sapiens
cacagcatggaggaggagggag

SEQ ID NO: 815231 - DNA, 12 bp, Homo sapiens
cacagcatgtgc

SEQ ID NO: 815232 - DNA, 14 bp, Homo sapiens
cacagcatgtgcca

SEQ ID NO: 815233 - DNA, 16 bp, Homo sapiens
cacagcattgtatatg

SEQ ID NO: 815234 - DNA, 20 bp, Homo sapiens
cacagccaacgagacacatt

SEQ ID NO: 815235 - DNA, 11 bp, Homo sapiens
cacagccacac

SEQ ID NO: 815236 - DNA, 18 bp, Homo sapiens
cacagccacacctggact

SEQ ID NO: 815237 - DNA, 13 bp, Homo sapiens
cacagccacccct

SEQ ID NO: 815238 - DNA, 17 bp, Homo sapiens
cacagccacctccgcca

SEQ ID NO: 815239 - DNA, 20 bp, Homo sapiens
cacagccactaaaacacaaa

SEQ ID NO: 815240 - DNA, 11 bp, Homo sapiens
cacagccagag

SEQ ID NO: 815241 - DNA, 13 bp, Homo sapiens
cacagccagagga

SEQ ID NO: 815242 - DNA, 14 bp, Homo sapiens
cacagccagaggag

SEQ ID NO: 815243 - DNA, 19 bp, Homo sapiens
cacagccagaggagggcag

SEQ ID NO: 815244 - DNA, 17 bp, Homo sapiens
cacagccagcacctggc

SEQ ID NO: 815245 - DNA, 14 bp, Homo sapiens
cacagccagcccaa

SEQ ID NO: 815246 - DNA, 13 bp, Homo sapiens
cacagcccaagag

SEQ ID NO: 815247 - DNA, 17 bp, Homo sapiens
cacagcccacggggatc

SEQ ID NO: 815248 - DNA, 11 bp, Homo sapiens
cacagcccaga

SEQ ID NO: 815249 - DNA, 15 bp, Homo sapiens
cacagcccagcttgg

SEQ ID NO: 815250 - DNA, 15 bp, Homo sapiens
cacagcccagggcct

SEQ ID NO: 815251 - DNA, 17 bp, Homo sapiens
cacagcccccttgccct

SEQ ID NO: 815252 - DNA, 18 bp, Homo sapiens
cacagcccccttgccctc

SEQ ID NO: 815253 - DNA, 22 bp, Homo sapiens
cacagcccccttgccctccgcc

SEQ ID NO: 815254 - DNA, 17 bp, Homo sapiens
cacagcccgctctctgg

SEQ ID NO: 815255 - DNA, 15 bp, Homo sapiens
cacagccctcagcgt

SEQ ID NO: 815256 - DNA, 10 bp, Homo sapiens
cacagccctg

SEQ ID NO: 815257 - DNA, 14 bp, Homo sapiens
cacagtagagccag

SEQ ID NO: 815258 - DNA, 13 bp, Homo sapiens
cacagtaggatgt

SEQ ID NO: 815259 - DNA, 13 bp, Homo sapiens
cacagtagtcttg

SEQ ID NO: 815260 - DNA, 16 bp, Homo sapiens
cacagtagtcttgatg

SEQ ID NO: 815261 - DNA, 22 bp, Homo sapiens
cacagtattatttctccatccc

SEQ ID NO: 815262 - DNA, 16 bp, Homo sapiens
cacagtcaaaataatt

SEQ ID NO: 815263 - DNA, 17 bp, Homo sapiens
cacagtcacccctccct

SEQ ID NO: 815264 - DNA, 14 bp, Homo sapiens
cacagtcactggat

SEQ ID NO: 815265 - DNA, 13 bp, Homo sapiens
cacagtcaggggc

SEQ ID NO: 815266 - DNA, 16 bp, Homo sapiens
cacagtcaggggctgg

SEQ ID NO: 815267 - DNA, 16 bp, Homo sapiens
cacagtccaaccagaa

SEQ ID NO: 815268 - DNA, 16 bp, Homo sapiens
cacagtccaggaacaa

SEQ ID NO: 815269 - DNA, 15 bp, Homo sapiens
cacagtctcagttct

SEQ ID NO: 815270 - DNA, 15 bp, Homo sapiens
cacagtgacttctga

SEQ ID NO: 815271 - DNA, 16 bp, Homo sapiens
cacagtgacttctgag

SEQ ID NO: 815272 - DNA, 18 bp, Homo sapiens
cacagtgagaggggaggg

SEQ ID NO: 815273 - DNA, 19 bp, Homo sapiens
cacagtgagagtactcact

SEQ ID NO: 815274 - DNA, 18 bp, Homo sapiens
cacagtgatatatttcta

SEQ ID NO: 815275 - DNA, 22 bp, Homo sapiens
cacagtgatgccgggcgccagg

SEQ ID NO: 815276 - DNA, 20 bp, Homo sapiens
cacagtgcctgtacaggaag

SEQ ID NO: 815277 - DNA, 16 bp, Homo sapiens
cacagtgctcttttct

SEQ ID NO: 815278 - DNA, 18 bp, Homo sapiens
cacagtgctcttttctcc

SEQ ID NO: 815279 - DNA, 11 bp, Homo sapiens
cacagtgctgc

SEQ ID NO: 815280 - DNA, 13 bp, Homo sapiens
cacagtgctgccc

SEQ ID NO: 815281 - DNA, 20 bp, Homo sapiens
cacagtgctgccccttgcaa

SEQ ID NO: 815282 - DNA, 22 bp, Homo sapiens
cacagtgctgccccttgcaagc

SEQ ID NO: 815283 - DNA, 23 bp, Homo sapiens
cacagtgctgccccttgcaagcc

SEQ ID NO: 815284 - DNA, 12 bp, Homo sapiens
cacagtgctgct

SEQ ID NO: 815285 - DNA, 23 bp, Homo sapiens
cacagtggactcagcagtgacca

SEQ ID NO: 815286 - DNA, 20 bp, Homo sapiens
cacagtggcacggagagaag

SEQ ID NO: 815287 - DNA, 17 bp, Homo sapiens
cacagtgggagctgagc

SEQ ID NO: 815288 - DNA, 19 bp, Homo sapiens
cacagtgggagctgagctg

SEQ ID NO: 815289 - DNA, 17 bp, Homo sapiens
cacagtggggctgcagg

SEQ ID NO: 815290 - DNA, 22 bp, Homo sapiens
cacagtggggctgcaggcaggc

SEQ ID NO: 815291 - DNA, 17 bp, Homo sapiens
cacagtgggtggcacct

SEQ ID NO: 815292 - DNA, 18 bp, Homo sapiens
cacagtgggtggcacctc

SEQ ID NO: 815293 - DNA, 22 bp, Homo sapiens
cacagtgggtggcacctcctga

SEQ ID NO: 815294 - DNA, 23 bp, Homo sapiens
cacagtgggtggcacctcctgag

SEQ ID NO: 815295 - DNA, 20 bp, Homo sapiens
cacagtgtctgttcagcaaa

SEQ ID NO: 815296 - DNA, 16 bp, Homo sapiens
cacagtgtgtttgtga

SEQ ID NO: 815297 - DNA, 16 bp, Homo sapiens
cacagtgttagtgctg

SEQ ID NO: 815298 - DNA, 14 bp, Homo sapiens
cacagtgttgccca

SEQ ID NO: 815299 - DNA, 15 bp, Homo sapiens
cacagtgtttcaatt

SEQ ID NO: 815300 - DNA, 17 bp, Homo sapiens
cacagttatcttagctg

SEQ ID NO: 815301 - DNA, 14 bp, Homo sapiens
cacagttcctggga

SEQ ID NO: 815302 - DNA, 18 bp, Homo sapiens
cacagttcttggtgactg

SEQ ID NO: 815303 - DNA, 18 bp, Homo sapiens
cacagttgaagggagggg

SEQ ID NO: 815304 - DNA, 23 bp, Homo sapiens
cacagttggccttcagaaccatc

SEQ ID NO: 815305 - DNA, 23 bp, Homo sapiens
cacagttgtctattctgagcctt

SEQ ID NO: 815306 - DNA, 15 bp, Homo sapiens
cacagtttaaaaaat

SEQ ID NO: 815307 - DNA, 20 bp, Homo sapiens
cacagtttagaacagaggga

SEQ ID NO: 815308 - DNA, 13 bp, Homo sapiens
cacagtttcaggc

SEQ ID NO: 815309 - DNA, 18 bp, Homo sapiens
cacagtttcaggctttta

SEQ ID NO: 815310 - DNA, 17 bp, Homo sapiens
cacagttttaataagaa

SEQ ID NO: 815311 - DNA, 18 bp, Homo sapiens
cacagttttaataagaac

SEQ ID NO: 815312 - DNA, 12 bp, Homo sapiens
cacataaaccaa

SEQ ID NO: 815313 - DNA, 12 bp, Homo sapiens
cacataaatgct

SEQ ID NO: 815314 - DNA, 18 bp, Homo sapiens
cacataagagagatgaga

SEQ ID NO: 815315 - DNA, 12 bp, Homo sapiens
cacataagcata

SEQ ID NO: 815316 - DNA, 19 bp, Homo sapiens
cacataagccaaaactgag

SEQ ID NO: 815317 - DNA, 15 bp, Homo sapiens
cacataatttttgta

SEQ ID NO: 815318 - DNA, 20 bp, Homo sapiens
cacatacatacacatacata

SEQ ID NO: 815319 - DNA, 16 bp, Homo sapiens
cacatacatacataca

SEQ ID NO: 815320 - DNA, 20 bp, Homo sapiens
cacataccatgtggatgcag

SEQ ID NO: 815321 - DNA, 22 bp, Homo sapiens
cacataccatgtggatgcagca

SEQ ID NO: 815322 - DNA, 20 bp, Homo sapiens
cacatacccacacattccag

SEQ ID NO: 815323 - DNA, 23 bp, Homo sapiens
cacatacccacacattccagggc

SEQ ID NO: 815324 - DNA, 13 bp, Homo sapiens
cacataccctccc

SEQ ID NO: 815325 - DNA, 15 bp, Homo sapiens
cacataccttcatgt

SEQ ID NO: 815326 - DNA, 22 bp, Homo sapiens
cacatacgcagggggaaggctt

SEQ ID NO: 815327 - DNA, 18 bp, Homo sapiens
cacatacgtgcacagggt

SEQ ID NO: 815328 - DNA, 23 bp, Homo sapiens
cacatacgtgttaggaggctgca

SEQ ID NO: 815329 - DNA, 20 bp, Homo sapiens
cacatactgacttcagtggg

SEQ ID NO: 815330 - DNA, 16 bp, Homo sapiens
cacatactgtgttcca

SEQ ID NO: 815331 - DNA, 17 bp, Homo sapiens
cacatagagctttttaa

SEQ ID NO: 815332 - DNA, 16 bp, Homo sapiens
cacatagattcacctg

SEQ ID NO: 815333 - DNA, 18 bp, Homo sapiens
cacatagcatgtaatggt

SEQ ID NO: 815334 - DNA, 17 bp, Homo sapiens
cacatagcccacttaca

SEQ ID NO: 815335 - DNA, 13 bp, Homo sapiens
cacatagctgtct

SEQ ID NO: 815336 - DNA, 14 bp, Homo sapiens
cacatagcttgcct

SEQ ID NO: 815337 - DNA, 18 bp, Homo sapiens
cacataggctggtggcct

SEQ ID NO: 815338 - DNA, 15 bp, Homo sapiens
cacatagtgtcctgc

SEQ ID NO: 815339 - DNA, 19 bp, Homo sapiens
cacatagtgtcctgcccac

SEQ ID NO: 815340 - DNA, 20 bp, Homo sapiens
cacatagtttttcagtctat

SEQ ID NO: 815341 - DNA, 21 bp, Homo sapiens
cacatataaacatcacacaca

SEQ ID NO: 815342 - DNA, 14 bp, Homo sapiens
cacatatatattac

SEQ ID NO: 815343 - DNA, 15 bp, Homo sapiens
cacatattcaaattc

SEQ ID NO: 815344 - DNA, 12 bp, Homo sapiens
cacatattttaa

SEQ ID NO: 815345 - DNA, 15 bp, Homo sapiens
cacatattttaaaat

SEQ ID NO: 815346 - DNA, 13 bp, Homo sapiens
cacatcaaagagg

SEQ ID NO: 815347 - DNA, 22 bp, Homo sapiens
cacatcaagactatctacaaaa

SEQ ID NO: 815348 - DNA, 15 bp, Homo sapiens
cacatcaagcttttc

SEQ ID NO: 815349 - DNA, 14 bp, Homo sapiens
cacatcaccaggtg

SEQ ID NO: 815350 - DNA, 12 bp, Homo sapiens
cacatcagcccc

SEQ ID NO: 815351 - DNA, 13 bp, Homo sapiens
cacatcagcccca

SEQ ID NO: 815352 - DNA, 20 bp, Homo sapiens
cacatcagccccacaggact

SEQ ID NO: 815353 - DNA, 23 bp, Homo sapiens
cacatcatattctattgtttact

SEQ ID NO: 815354 - DNA, 15 bp, Homo sapiens
cacatcattctgtgt

SEQ ID NO: 815355 - DNA, 16 bp, Homo sapiens
cacatcattctgtgtc

SEQ ID NO: 815356 - DNA, 12 bp, Homo sapiens
cacatccaactc

SEQ ID NO: 815357 - DNA, 13 bp, Homo sapiens
cacatccagcttg

SEQ ID NO: 815358 - DNA, 13 bp, Homo sapiens
cacatccatctac

SEQ ID NO: 815359 - DNA, 23 bp, Homo sapiens
cacatccatttcatctatttctg

SEQ ID NO: 815360 - DNA, 16 bp, Homo sapiens
cacatcccattgggac

SEQ ID NO: 815361 - DNA, 23 bp, Homo sapiens
cacatcccattgggactccatgc

SEQ ID NO: 815362 - DNA, 14 bp, Homo sapiens
cacatccccagaat

SEQ ID NO: 815363 - DNA, 15 bp, Homo sapiens
cacatccccagagcc

SEQ ID NO: 815364 - DNA, 16 bp, Homo sapiens
cacatccccagagccc

SEQ ID NO: 815365 - DNA, 18 bp, Homo sapiens
cacatccccagagcccag

SEQ ID NO: 815366 - DNA, 16 bp, Homo sapiens
cacatcccggcctctt

SEQ ID NO: 815367 - DNA, 17 bp, Homo sapiens
cacatcccggcctcttc

SEQ ID NO: 815368 - DNA, 14 bp, Homo sapiens
cacatcctccgtcc

SEQ ID NO: 815369 - DNA, 20 bp, Homo sapiens
cacatcctcctgcccagctc

SEQ ID NO: 815370 - DNA, 20 bp, Homo sapiens
cacatcctgggatccagtgt

SEQ ID NO: 815371 - DNA, 16 bp, Homo sapiens
cacatccttctcactg

SEQ ID NO: 815372 - DNA, 17 bp, Homo sapiens
cacatccttctcactgc

SEQ ID NO: 815373 - DNA, 15 bp, Homo sapiens
cacatcctttctaaa

SEQ ID NO: 815374 - DNA, 14 bp, Homo sapiens
cacatctaaagctt

SEQ ID NO: 815375 - DNA, 18 bp, Homo sapiens
cacatctaaagctttatc

SEQ ID NO: 815376 - DNA, 13 bp, Homo sapiens
cacatctccagaa

SEQ ID NO: 815377 - DNA, 22 bp, Homo sapiens
cacatctcccccatagcaccct

SEQ ID NO: 815378 - DNA, 16 bp, Homo sapiens
cacatctgggtgccct

SEQ ID NO: 815379 - DNA, 16 bp, Homo sapiens
caccaccccctgtccc

SEQ ID NO: 815380 - DNA, 17 bp, Homo sapiens
caccaccctcaggtgcc

SEQ ID NO: 815381 - DNA, 20 bp, Homo sapiens
caccaccctgctcatccact

SEQ ID NO: 815382 - DNA, 22 bp, Homo sapiens
caccacctaggccactcctcca

SEQ ID NO: 815383 - DNA, 12 bp, Homo sapiens
caccacctctcc

SEQ ID NO: 815384 - DNA, 14 bp, Homo sapiens
caccacctctgtgg

SEQ ID NO: 815385 - DNA, 19 bp, Homo sapiens
caccacctgacggctgggg

SEQ ID NO: 815386 - DNA, 18 bp, Homo sapiens
caccaccttcccagctct

SEQ ID NO: 815387 - DNA, 19 bp, Homo sapiens
caccaccttcccagctctc

SEQ ID NO: 815388 - DNA, 22 bp, Homo sapiens
caccaccttcccagctctccct

SEQ ID NO: 815389 - DNA, 18 bp, Homo sapiens
caccaccttggactcctc

SEQ ID NO: 815390 - DNA, 19 bp, Homo sapiens
caccaccttggactcctcc

SEQ ID NO: 815391 - DNA, 18 bp, Homo sapiens
caccacgatgtggccctg

SEQ ID NO: 815392 - DNA, 19 bp, Homo sapiens
caccacgatgtggccctgg

SEQ ID NO: 815393 - DNA, 13 bp, Homo sapiens
caccacgtcctgg

SEQ ID NO: 815394 - DNA, 15 bp, Homo sapiens
caccacgtctgccag

SEQ ID NO: 815395 - DNA, 16 bp, Homo sapiens
caccacgtctgccagg

SEQ ID NO: 815396 - DNA, 17 bp, Homo sapiens
caccacgtctgccaggc

SEQ ID NO: 815397 - DNA, 18 bp, Homo sapiens
caccacgtctgccaggcc

SEQ ID NO: 815398 - DNA, 19 bp, Homo sapiens
caccacgtctgccaggccc

SEQ ID NO: 815399 - DNA, 21 bp, Homo sapiens
caccacgtctgccaggcccat

SEQ ID NO: 815400 - DNA, 22 bp, Homo sapiens
caccacgtctggctccctgccc

SEQ ID NO: 815401 - DNA, 16 bp, Homo sapiens
caccactaaccatccc

SEQ ID NO: 815402 - DNA, 17 bp, Homo sapiens
caccactaaccatcccc

SEQ ID NO: 815403 - DNA, 20 bp, Homo sapiens
caccactaaccatccccaac

SEQ ID NO: 815404 - DNA, 17 bp, Homo sapiens
caccactacattctgtt

SEQ ID NO: 815405 - DNA, 17 bp, Homo sapiens
caccactaccagccagc

SEQ ID NO: 815406 - DNA, 14 bp, Homo sapiens
caccactagagctg

SEQ ID NO: 815407 - DNA, 21 bp, Homo sapiens
caccactaggaatcccagagg

SEQ ID NO: 815408 - DNA, 14 bp, Homo sapiens
caccactcaggcca

SEQ ID NO: 815409 - DNA, 18 bp, Homo sapiens
caccactgcactccagcc

SEQ ID NO: 815410 - DNA, 13 bp, Homo sapiens
caccactgcagcc

SEQ ID NO: 815411 - DNA, 15 bp, Homo sapiens
caccactgccctgcc

SEQ ID NO: 815412 - DNA, 15 bp, Homo sapiens
caccactgctgagga

SEQ ID NO: 815413 - DNA, 17 bp, Homo sapiens
caccactgctgaggagt

SEQ ID NO: 815414 - DNA, 14 bp, Homo sapiens
caccactggccacc

SEQ ID NO: 815415 - DNA, 18 bp, Homo sapiens
caccactggccaccaggc

SEQ ID NO: 815416 - DNA, 20 bp, Homo sapiens
caccactggccaccaggctg

SEQ ID NO: 815417 - DNA, 12 bp, Homo sapiens
caccacttattt

SEQ ID NO: 815418 - DNA, 16 bp, Homo sapiens
caccacttccagagcc

SEQ ID NO: 815419 - DNA, 18 bp, Homo sapiens
caccacttccagagccag

SEQ ID NO: 815420 - DNA, 19 bp, Homo sapiens
caccagaacgcaccccact

SEQ ID NO: 815421 - DNA, 20 bp, Homo sapiens
caccagaacgcaccccactg

SEQ ID NO: 815422 - DNA, 16 bp, Homo sapiens
caccagaatttctaag

SEQ ID NO: 815423 - DNA, 13 bp, Homo sapiens
caccagagccggg

SEQ ID NO: 815424 - DNA, 13 bp, Homo sapiens
caccagagctgcc

SEQ ID NO: 815425 - DNA, 12 bp, Homo sapiens
caccagagtgaa

SEQ ID NO: 815426 - DNA, 23 bp, Homo sapiens
caccagatgcaacctcactatgg

SEQ ID NO: 815427 - DNA, 10 bp, Homo sapiens
caccagcagc

SEQ ID NO: 815428 - DNA, 14 bp, Homo sapiens
caccagcagcacaa

SEQ ID NO: 815429 - DNA, 16 bp, Homo sapiens
caccagcagcacaatt

SEQ ID NO: 815430 - DNA, 18 bp, Homo sapiens
caccagcagcacaattct

SEQ ID NO: 815431 - DNA, 15 bp, Homo sapiens
caccagcagcatggc

SEQ ID NO: 815432 - DNA, 12 bp, Homo sapiens
caccagcagcct

SEQ ID NO: 815433 - DNA, 11 bp, Homo sapiens
caccagccagc

SEQ ID NO: 815434 - DNA, 14 bp, Homo sapiens
caccagccagccct

SEQ ID NO: 815435 - DNA, 16 bp, Homo sapiens
caccagccagccctgg

SEQ ID NO: 815436 - DNA, 16 bp, Homo sapiens
caccagccatcctccc

SEQ ID NO: 815437 - DNA, 12 bp, Homo sapiens
caccagccccac

SEQ ID NO: 815438 - DNA, 23 bp, Homo sapiens
caccagccccactgccagcagca

SEQ ID NO: 815439 - DNA, 17 bp, Homo sapiens
caccagccccacttctg

SEQ ID NO: 815440 - DNA, 15 bp, Homo sapiens
caccagccccagcaa

SEQ ID NO: 815441 - DNA, 16 bp, Homo sapiens
caccagccccctggat

SEQ ID NO: 815442 - DNA, 17 bp, Homo sapiens
caccagcccggcctgct

SEQ ID NO: 815443 - DNA, 20 bp, Homo sapiens
caccagccctgcagcccacc

SEQ ID NO: 815444 - DNA, 20 bp, Homo sapiens
caccagccgccccagcccct

SEQ ID NO: 815445 - DNA, 14 bp, Homo sapiens
caccagccgctgca

SEQ ID NO: 815446 - DNA, 16 bp, Homo sapiens
caccagccgctgcagg

SEQ ID NO: 815447 - DNA, 23 bp, Homo sapiens
caccagccgctgcagggctccca

SEQ ID NO: 815448 - DNA, 18 bp, Homo sapiens
caccagcctagcctggct

SEQ ID NO: 815449 - DNA, 10 bp, Homo sapiens
caccagcctg

SEQ ID NO: 815450 - DNA, 22 bp, Homo sapiens
caccagcctgctgacagacact

SEQ ID NO: 815451 - DNA, 16 bp, Homo sapiens
caccagcgttcccttc

SEQ ID NO: 815452 - DNA, 17 bp, Homo sapiens
caccagcgttcccttct

SEQ ID NO: 815453 - DNA, 21 bp, Homo sapiens
caccagcgttcccttctcccc

SEQ ID NO: 815454 - DNA, 23 bp, Homo sapiens
caccagcgttcccttctccccct

SEQ ID NO: 815455 - DNA, 19 bp, Homo sapiens
caccagctccacacattcc

SEQ ID NO: 815456 - DNA, 17 bp, Homo sapiens
caccagctctgtggcct

SEQ ID NO: 815457 - DNA, 14 bp, Homo sapiens
caccagctgcctct

SEQ ID NO: 815458 - DNA, 16 bp, Homo sapiens
caccagctgcctcttc

SEQ ID NO: 815459 - DNA, 11 bp, Homo sapiens
caccagctgct

SEQ ID NO: 815460 - DNA, 19 bp, Homo sapiens
caccagctgctctgcccct

SEQ ID NO: 815461 - DNA, 14 bp, Homo sapiens
caccagctgctgtg

SEQ ID NO: 815462 - DNA, 21 bp, Homo sapiens
caccaggaatgttaaagtcag

SEQ ID NO: 815463 - DNA, 14 bp, Homo sapiens
caccaggactgaaa

SEQ ID NO: 815464 - DNA, 19 bp, Homo sapiens
caccaggacttggggtcag

SEQ ID NO: 815465 - DNA, 20 bp, Homo sapiens
caccaggacttggggtcagg

SEQ ID NO: 815466 - DNA, 14 bp, Homo sapiens
caccaggagcacct

SEQ ID NO: 815467 - DNA, 15 bp, Homo sapiens
caccaggagcacctg

SEQ ID NO: 815468 - DNA, 16 bp, Homo sapiens
caccaggagcagcagc

SEQ ID NO: 815469 - DNA, 20 bp, Homo sapiens
caccaggagcagcagccagc

SEQ ID NO: 815470 - DNA, 22 bp, Homo sapiens
caccaggccacctccccagcat

SEQ ID NO: 815471 - DNA, 21 bp, Homo sapiens
caccaggccgtcctcccgggc

SEQ ID NO: 815472 - DNA, 19 bp, Homo sapiens
caccaggccgtgccttgtt

SEQ ID NO: 815473 - DNA, 17 bp, Homo sapiens
caccaggcctcactggc

SEQ ID NO: 815474 - DNA, 22 bp, Homo sapiens
caccaggctggcgcagccaagg

SEQ ID NO: 815475 - DNA, 18 bp, Homo sapiens
caccaggctgtgggcctc

SEQ ID NO: 815476 - DNA, 13 bp, Homo sapiens
caccagggactgc

SEQ ID NO: 815477 - DNA, 16 bp, Homo sapiens
caccagggactgcagc

SEQ ID NO: 815478 - DNA, 21 bp, Homo sapiens
caccagggcaactcttggaag

SEQ ID NO: 815479 - DNA, 14 bp, Homo sapiens
caccaggggaagga

SEQ ID NO: 815480 - DNA, 18 bp, Homo sapiens
caccagggtcccaggaag

SEQ ID NO: 815481 - DNA, 21 bp, Homo sapiens
caccagggtccgcaccagctg

SEQ ID NO: 815482 - DNA, 22 bp, Homo sapiens
caccagggtccgcaccagctgc

SEQ ID NO: 815483 - DNA, 22 bp, Homo sapiens
caccagggtccttttgacactg

SEQ ID NO: 815484 - DNA, 18 bp, Homo sapiens
caccagggtggaccaggc

SEQ ID NO: 815485 - DNA, 23 bp, Homo sapiens
caccagggtggaccaggcctgga

SEQ ID NO: 815486 - DNA, 19 bp, Homo sapiens
caccagggttgaccccaga

SEQ ID NO: 815487 - DNA, 18 bp, Homo sapiens
caccaggtctcaaggttc

SEQ ID NO: 815488 - DNA, 14 bp, Homo sapiens
caccaggtgcatct

SEQ ID NO: 815489 - DNA, 23 bp, Homo sapiens
caccaggttaaaattttaatttc

SEQ ID NO: 815490 - DNA, 17 bp, Homo sapiens
caccagtcactgtccct

SEQ ID NO: 815491 - DNA, 23 bp, Homo sapiens
caccagtctgtaaaatacatgta

SEQ ID NO: 815492 - DNA, 20 bp, Homo sapiens
caccagtctgtctactgtgg

SEQ ID NO: 815493 - DNA, 13 bp, Homo sapiens
caccagtggacct

SEQ ID NO: 815494 - DNA, 17 bp, Homo sapiens
caccagtggacctagcc

SEQ ID NO: 815495 - DNA, 20 bp, Homo sapiens
caccagtggacctagcctgg

SEQ ID NO: 815496 - DNA, 15 bp, Homo sapiens
caccagtggcctcgt

SEQ ID NO: 815497 - DNA, 15 bp, Homo sapiens
caccagtgtagcatc

SEQ ID NO: 815498 - DNA, 19 bp, Homo sapiens
caccagtgtagcatcttcc

SEQ ID NO: 815499 - DNA, 24 bp, Homo sapiens
caccagtgtagcatcttcctctgc

SEQ ID NO: 815500 - DNA, 13 bp, Homo sapiens
caccagtgtgtgg

SEQ ID NO: 815501 - DNA, 23 bp, Homo sapiens
caccctcctcacagacctctgct

SEQ ID NO: 815502 - DNA, 13 bp, Homo sapiens
caccctccttccc

SEQ ID NO: 815503 - DNA, 14 bp, Homo sapiens
caccctccttcccg

SEQ ID NO: 815504 - DNA, 12 bp, Homo sapiens
caccctctggga

SEQ ID NO: 815505 - DNA, 13 bp, Homo sapiens
caccctctgggag

SEQ ID NO: 815506 - DNA, 14 bp, Homo sapiens
caccctctggggac

SEQ ID NO: 815507 - DNA, 14 bp, Homo sapiens
caccctcttcctgt

SEQ ID NO: 815508 - DNA, 18 bp, Homo sapiens
caccctgaatggttccat

SEQ ID NO: 815509 - DNA, 18 bp, Homo sapiens
caccctgagccccttcct

SEQ ID NO: 815510 - DNA, 20 bp, Homo sapiens
caccctgaggtcagggagtg

SEQ ID NO: 815511 - DNA, 14 bp, Homo sapiens
caccctgcacctgc

SEQ ID NO: 815512 - DNA, 17 bp, Homo sapiens
caccctgcacctgctgc

SEQ ID NO: 815513 - DNA, 14 bp, Homo sapiens
caccctgcagagct

SEQ ID NO: 815514 - DNA, 15 bp, Homo sapiens
caccctgcaggactt

SEQ ID NO: 815515 - DNA, 16 bp, Homo sapiens
caccctgcattttcct

SEQ ID NO: 815516 - DNA, 19 bp, Homo sapiens
caccctgccaagactcctc

SEQ ID NO: 815517 - DNA, 20 bp, Homo sapiens
caccctgcccacccccggga

SEQ ID NO: 815518 - DNA, 15 bp, Homo sapiens
caccctgcccgctcc

SEQ ID NO: 815519 - DNA, 17 bp, Homo sapiens
caccctgccctcatggg

SEQ ID NO: 815520 - DNA, 13 bp, Homo sapiens
caccctgccttat

SEQ ID NO: 815521 - DNA, 18 bp, Homo sapiens
caccctgccttatcttgc

SEQ ID NO: 815522 - DNA, 15 bp, Homo sapiens
caccctgcgggccag

SEQ ID NO: 815523 - DNA, 19 bp, Homo sapiens
caccctgcgggccagggtc

SEQ ID NO: 815524 - DNA, 20 bp, Homo sapiens
caccctgcgggccagggtcc

SEQ ID NO: 815525 - DNA, 22 bp, Homo sapiens
caccctgcgggccagggtcctg

SEQ ID NO: 815526 - DNA, 16 bp, Homo sapiens
caccctgctcctcctg

SEQ ID NO: 815527 - DNA, 15 bp, Homo sapiens
caccctgctgcacta

SEQ ID NO: 815528 - DNA, 21 bp, Homo sapiens
caccctgcttctcccggggac

SEQ ID NO: 815529 - DNA, 11 bp, Homo sapiens
caccctggaat

SEQ ID NO: 815530 - DNA, 12 bp, Homo sapiens
caccctggcccg

SEQ ID NO: 815531 - DNA, 16 bp, Homo sapiens
caccctggcctgaact

SEQ ID NO: 815532 - DNA, 21 bp, Homo sapiens
caccctggcctgaactgagga

SEQ ID NO: 815533 - DNA, 12 bp, Homo sapiens
caccctgggccc

SEQ ID NO: 815534 - DNA, 13 bp, Homo sapiens
caccctggggcct

SEQ ID NO: 815535 - DNA, 22 bp, Homo sapiens
caccctggggcctggacctgcc

SEQ ID NO: 815536 - DNA, 15 bp, Homo sapiens
caccctggggctgct

SEQ ID NO: 815537 - DNA, 15 bp, Homo sapiens
caccctggtctgtgg

SEQ ID NO: 815538 - DNA, 16 bp, Homo sapiens
caccctggtctgtgga

SEQ ID NO: 815539 - DNA, 17 bp, Homo sapiens
caccctgtactgttctg

SEQ ID NO: 815540 - DNA, 21 bp, Homo sapiens
caccctgtactgttctgtgtc

SEQ ID NO: 815541 - DNA, 23 bp, Homo sapiens
caccctgtactgttctgtgtctt

SEQ ID NO: 815542 - DNA, 23 bp, Homo sapiens
caccctgtcccccagctctggtg

SEQ ID NO: 815543 - DNA, 11 bp, Homo sapiens
caccctgtgac

SEQ ID NO: 815544 - DNA, 20 bp, Homo sapiens
caccctgtgaccctctcact

SEQ ID NO: 815545 - DNA, 14 bp, Homo sapiens
caccctgtgggacc

SEQ ID NO: 815546 - DNA, 22 bp, Homo sapiens
caccctgtgggaccgcctggcc

SEQ ID NO: 815547 - DNA, 17 bp, Homo sapiens
caccctgtgggtgtctc

SEQ ID NO: 815548 - DNA, 22 bp, Homo sapiens
caccctgtgggtgtctccctcg

SEQ ID NO: 815549 - DNA, 18 bp, Homo sapiens
caccctgtggtcttcctc

SEQ ID NO: 815550 - DNA, 18 bp, Homo sapiens
cacccttaacccaaggag

SEQ ID NO: 815551 - DNA, 22 bp, Homo sapiens
cacccttacttcctggcctctt

SEQ ID NO: 815552 - DNA, 20 bp, Homo sapiens
cacccttcacataccctccc

SEQ ID NO: 815553 - DNA, 22 bp, Homo sapiens
cacccttcacataccctccccc

SEQ ID NO: 815554 - DNA, 16 bp, Homo sapiens
cacccttcctggccca

SEQ ID NO: 815555 - DNA, 17 bp, Homo sapiens
cacccttcctggcccag

SEQ ID NO: 815556 - DNA, 18 bp, Homo sapiens
cacccttcctggcccagg

SEQ ID NO: 815557 - DNA, 13 bp, Homo sapiens
cacccttctcgga

SEQ ID NO: 815558 - DNA, 16 bp, Homo sapiens
cacccttctttcctct

SEQ ID NO: 815559 - DNA, 13 bp, Homo sapiens
cacccttcttttc

SEQ ID NO: 815560 - DNA, 19 bp, Homo sapiens
cacccttcttttctcatgt

SEQ ID NO: 815561 - DNA, 18 bp, Homo sapiens
cacccttggcctgtctca

SEQ ID NO: 815562 - DNA, 21 bp, Homo sapiens
cacccttggcctgtctcatcc

SEQ ID NO: 815563 - DNA, 23 bp, Homo sapiens
cacccttggcctgtctcatcccc

SEQ ID NO: 815564 - DNA, 18 bp, Homo sapiens
cacccttggttcctaact

SEQ ID NO: 815565 - DNA, 19 bp, Homo sapiens
caccctttcttgacaaaac

SEQ ID NO: 815566 - DNA, 18 bp, Homo sapiens
caccgaatatattactga

SEQ ID NO: 815567 - DNA, 14 bp, Homo sapiens
caccgaccaactgc

SEQ ID NO: 815568 - DNA, 16 bp, Homo sapiens
caccgaccaactgccc

SEQ ID NO: 815569 - DNA, 16 bp, Homo sapiens
caccgaccccgggccg

SEQ ID NO: 815570 - DNA, 18 bp, Homo sapiens
caccgacgcgtctcctgt

SEQ ID NO: 815571 - DNA, 15 bp, Homo sapiens
caccgactgcccagc

SEQ ID NO: 815572 - DNA, 19 bp, Homo sapiens
caccgactgcccagccact

SEQ ID NO: 815573 - DNA, 21 bp, Homo sapiens
caccgactgcccagccactcc

SEQ ID NO: 815574 - DNA, 21 bp, Homo sapiens
caccgagagtagccgagagcc

SEQ ID NO: 815575 - DNA, 14 bp, Homo sapiens
caccgaggttccca

SEQ ID NO: 815576 - DNA, 14 bp, Homo sapiens
caccgatggagccc

SEQ ID NO: 815577 - DNA, 17 bp, Homo sapiens
caccgatggagccccca

SEQ ID NO: 815578 - DNA, 15 bp, Homo sapiens
caccgcatatgcatg

SEQ ID NO: 815579 - DNA, 19 bp, Homo sapiens
caccgcatatgcatgccag

SEQ ID NO: 815580 - DNA, 22 bp, Homo sapiens
caccgcatatgcatgccaggct

SEQ ID NO: 815581 - DNA, 13 bp, Homo sapiens
caccgcccagctc

SEQ ID NO: 815582 - DNA, 14 bp, Homo sapiens
caccgcccagctca

SEQ ID NO: 815583 - DNA, 15 bp, Homo sapiens
caccgccctcctcca

SEQ ID NO: 815584 - DNA, 14 bp, Homo sapiens
caccgcctgccctc

SEQ ID NO: 815585 - DNA, 13 bp, Homo sapiens
caccgcgcctggc

SEQ ID NO: 815586 - DNA, 18 bp, Homo sapiens
caccgcggacgtgctggc

SEQ ID NO: 815587 - DNA, 21 bp, Homo sapiens
caccgcggacgtgctggcctt

SEQ ID NO: 815588 - DNA, 15 bp, Homo sapiens
caccgctcagtatta

SEQ ID NO: 815589 - DNA, 13 bp, Homo sapiens
caccgctccccag

SEQ ID NO: 815590 - DNA, 14 bp, Homo sapiens
caccgctccccagc

SEQ ID NO: 815591 - DNA, 17 bp, Homo sapiens
caccgctccccagccca

SEQ ID NO: 815592 - DNA, 13 bp, Homo sapiens
caccgctgggtgg

SEQ ID NO: 815593 - DNA, 20 bp, Homo sapiens
caccgctgggtggttttttc

SEQ ID NO: 815594 - DNA, 18 bp, Homo sapiens
caccggaactgggctggc

SEQ ID NO: 815595 - DNA, 17 bp, Homo sapiens
caccggaggtcactcca

SEQ ID NO: 815596 - DNA, 20 bp, Homo sapiens
caccggatgctgtgcctggc

SEQ ID NO: 815597 - DNA, 16 bp, Homo sapiens
caccggcccctggcag

SEQ ID NO: 815598 - DNA, 19 bp, Homo sapiens
caccggcctgtgggtctct

SEQ ID NO: 815599 - DNA, 14 bp, Homo sapiens
caccggcgctgcag

SEQ ID NO: 815600 - DNA, 19 bp, Homo sapiens
caccgggagcctccccctc

SEQ ID NO: 815601 - DNA, 21 bp, Homo sapiens
caccgggagcctccccctcag

SEQ ID NO: 815602 - DNA, 13 bp, Homo sapiens
caccgggcctgga

SEQ ID NO: 815603 - DNA, 22 bp, Homo sapiens
caccgggctccatgcctctgga

SEQ ID NO: 815604 - DNA, 12 bp, Homo sapiens
caccgggctgca

SEQ ID NO: 815605 - DNA, 13 bp, Homo sapiens
caccgggctgcag

SEQ ID NO: 815606 - DNA, 20 bp, Homo sapiens
caccgggctggctgcttgca

SEQ ID NO: 815607 - DNA, 16 bp, Homo sapiens
caccggggcaagaggg

SEQ ID NO: 815608 - DNA, 14 bp, Homo sapiens
caccggtcagtgcc

SEQ ID NO: 815609 - DNA, 22 bp, Homo sapiens
caccgtacatctgcaatatgaa

SEQ ID NO: 815610 - DNA, 19 bp, Homo sapiens
caccgtcatggcttaatgt

SEQ ID NO: 815611 - DNA, 15 bp, Homo sapiens
caccgtcccagggct

SEQ ID NO: 815612 - DNA, 16 bp, Homo sapiens
caccgtcccagggctc

SEQ ID NO: 815613 - DNA, 13 bp, Homo sapiens
caccgtcccgcac

SEQ ID NO: 815614 - DNA, 18 bp, Homo sapiens
caccgtcccgcacagtgg

SEQ ID NO: 815615 - DNA, 15 bp, Homo sapiens
caccgtccctcagtg

SEQ ID NO: 815616 - DNA, 16 bp, Homo sapiens
caccgtccctcagtga

SEQ ID NO: 815617 - DNA, 19 bp, Homo sapiens
caccgtccgccctgctcct

SEQ ID NO: 815618 - DNA, 14 bp, Homo sapiens
caccgtcctcagca

SEQ ID NO: 815619 - DNA, 14 bp, Homo sapiens
caccgtcgaccagg

SEQ ID NO: 815620 - DNA, 17 bp, Homo sapiens
caccgtctcggccctga

SEQ ID NO: 815621 - DNA, 19 bp, Homo sapiens
caccgtctcggccctgaac

SEQ ID NO: 815622 - DNA, 18 bp, Homo sapiens
caccgtgatggagaggac

SEQ ID NO: 815623 - DNA, 21 bp, Homo sapiens
caccgtgatggagaggacaga

SEQ ID NO: 815624 - DNA, 14 bp, Homo sapiens
caccttaaattaaa

SEQ ID NO: 815625 - DNA, 16 bp, Homo sapiens
caccttaaattaaaca

SEQ ID NO: 815626 - DNA, 18 bp, Homo sapiens
caccttaaattaaacaat

SEQ ID NO: 815627 - DNA, 18 bp, Homo sapiens
caccttaccaactttctg

SEQ ID NO: 815628 - DNA, 13 bp, Homo sapiens
caccttagctggc

SEQ ID NO: 815629 - DNA, 19 bp, Homo sapiens
caccttatatttctgtgta

SEQ ID NO: 815630 - DNA, 18 bp, Homo sapiens
caccttcaagcgctccag

SEQ ID NO: 815631 - DNA, 19 bp, Homo sapiens
caccttcaagcgctccagg

SEQ ID NO: 815632 - DNA, 16 bp, Homo sapiens
caccttcacctcggag

SEQ ID NO: 815633 - DNA, 15 bp, Homo sapiens
caccttcatccagat

SEQ ID NO: 815634 - DNA, 12 bp, Homo sapiens
caccttcccagc

SEQ ID NO: 815635 - DNA, 12 bp, Homo sapiens
caccttcctcct

SEQ ID NO: 815636 - DNA, 13 bp, Homo sapiens
caccttcctcctc

SEQ ID NO: 815637 - DNA, 19 bp, Homo sapiens
caccttcctcctccccgct

SEQ ID NO: 815638 - DNA, 14 bp, Homo sapiens
caccttcctcctgc

SEQ ID NO: 815639 - DNA, 16 bp, Homo sapiens
caccttcgagtagaga

SEQ ID NO: 815640 - DNA, 20 bp, Homo sapiens
caccttctcacctgctccag

SEQ ID NO: 815641 - DNA, 20 bp, Homo sapiens
caccttctgtccccagccct

SEQ ID NO: 815642 - DNA, 13 bp, Homo sapiens
caccttcttggct

SEQ ID NO: 815643 - DNA, 19 bp, Homo sapiens
caccttcttggcttctggg

SEQ ID NO: 815644 - DNA, 16 bp, Homo sapiens
caccttctttctggac

SEQ ID NO: 815645 - DNA, 17 bp, Homo sapiens
caccttctttctggact

SEQ ID NO: 815646 - DNA, 18 bp, Homo sapiens
caccttgacgtttcttct

SEQ ID NO: 815647 - DNA, 19 bp, Homo sapiens
caccttgacgtttcttctt

SEQ ID NO: 815648 - DNA, 17 bp, Homo sapiens
caccttgccagggcagg

SEQ ID NO: 815649 - DNA, 22 bp, Homo sapiens
caccttgccagggcagggtctg

SEQ ID NO: 815650 - DNA, 19 bp, Homo sapiens
caccttgccgagagaggcg

SEQ ID NO: 815651 - DNA, 22 bp, Homo sapiens
caccttgctcttctttctgaga

SEQ ID NO: 815652 - DNA, 12 bp, Homo sapiens
caccttggaagg

SEQ ID NO: 815653 - DNA, 22 bp, Homo sapiens
caccttggacatcctcctccca

SEQ ID NO: 815654 - DNA, 13 bp, Homo sapiens
caccttggaccct

SEQ ID NO: 815655 - DNA, 15 bp, Homo sapiens
caccttggaccctgg

SEQ ID NO: 815656 - DNA, 16 bp, Homo sapiens
caccttggaccctggt

SEQ ID NO: 815657 - DNA, 16 bp, Homo sapiens
caccttggactcctcc

SEQ ID NO: 815658 - DNA, 13 bp, Homo sapiens
caccttggaggag

SEQ ID NO: 815659 - DNA, 20 bp, Homo sapiens
caccttggaggaggatgcca

SEQ ID NO: 815660 - DNA, 13 bp, Homo sapiens
caccttggcccag

SEQ ID NO: 815661 - DNA, 20 bp, Homo sapiens
caccttggtccctctcagat

SEQ ID NO: 815662 - DNA, 13 bp, Homo sapiens
caccttgtcatgt

SEQ ID NO: 815663 - DNA, 19 bp, Homo sapiens
caccttgttggagcctgca

SEQ ID NO: 815664 - DNA, 21 bp, Homo sapiens
caccttgttggagcctgcagg

SEQ ID NO: 815665 - DNA, 20 bp, Homo sapiens
cacctttactgtgcttattt

SEQ ID NO: 815666 - DNA, 17 bp, Homo sapiens
cacctttattaaaatct

SEQ ID NO: 815667 - DNA, 16 bp, Homo sapiens
cacctttcctctccct

SEQ ID NO: 815668 - DNA, 13 bp, Homo sapiens
cacctttctagtt

SEQ ID NO: 815669 - DNA, 13 bp, Homo sapiens
cacctttctctga

SEQ ID NO: 815670 - DNA, 19 bp, Homo sapiens
cacctttctgggctttctc

SEQ ID NO: 815671 - DNA, 22 bp, Homo sapiens
cacctttctgggctttctcctg

SEQ ID NO: 815672 - DNA, 23 bp, Homo sapiens
cacctttggctggtagcagcagg

SEQ ID NO: 815673 - DNA, 19 bp, Homo sapiens
cacctttgggatcagcctc

SEQ ID NO: 815674 - DNA, 13 bp, Homo sapiens
cacctttggtgca

SEQ ID NO: 815675 - DNA, 19 bp, Homo sapiens
cacctttgtaagacatttg

SEQ ID NO: 815676 - DNA, 20 bp, Homo sapiens
cacctttgtaagacatttgt

SEQ ID NO: 815677 - DNA, 22 bp, Homo sapiens
cacctttgtaagacatttgtat

SEQ ID NO: 815678 - DNA, 19 bp, Homo sapiens
cacctttgtctggatgcac

SEQ ID NO: 815679 - DNA, 17 bp, Homo sapiens
cacctttgtgtattttt

SEQ ID NO: 815680 - DNA, 21 bp, Homo sapiens
cacctttgtgtatttttcaat

SEQ ID NO: 815681 - DNA, 20 bp, Homo sapiens
cacctttgttttttgttgga

SEQ ID NO: 815682 - DNA, 18 bp, Homo sapiens
caccttttaactcacctc

SEQ ID NO: 815683 - DNA, 15 bp, Homo sapiens
caccttttataccag

SEQ ID NO: 815684 - DNA, 16 bp, Homo sapiens
caccttttctgtggct

SEQ ID NO: 815685 - DNA, 22 bp, Homo sapiens
caccttttctgtggctggctct

SEQ ID NO: 815686 - DNA, 16 bp, Homo sapiens
cacgaaactgccctgg

SEQ ID NO: 815687 - DNA, 15 bp, Homo sapiens
cacgaaatgttattt

SEQ ID NO: 815688 - DNA, 22 bp, Homo sapiens
cacgaacccacctgctgagaga

SEQ ID NO: 815689 - DNA, 15 bp, Homo sapiens
cacgacgctgcagag

SEQ ID NO: 815690 - DNA, 17 bp, Homo sapiens
cacgactgcccggcagg

SEQ ID NO: 815691 - DNA, 17 bp, Homo sapiens
cacgactggccagggcc

SEQ ID NO: 815692 - DNA, 15 bp, Homo sapiens
cacgactggtcacct

SEQ ID NO: 815693 - DNA, 20 bp, Homo sapiens
cacgactggtcaccttgcac

SEQ ID NO: 815694 - DNA, 22 bp, Homo sapiens
cacgactggtcaccttgcactc

SEQ ID NO: 815695 - DNA, 18 bp, Homo sapiens
cacgagatcttccttccg

SEQ ID NO: 815696 - DNA, 23 bp, Homo sapiens
cacgagatttcttttttatgtga

SEQ ID NO: 815697 - DNA, 14 bp, Homo sapiens
cacgagcaaaccca

SEQ ID NO: 815698 - DNA, 17 bp, Homo sapiens
cacgagcaaacccagag

SEQ ID NO: 815699 - DNA, 22 bp, Homo sapiens
cacgagcaaacccagaggtgga

SEQ ID NO: 815700 - DNA, 13 bp, Homo sapiens
cacgagcacaatg

SEQ ID NO: 815701 - DNA, 13 bp, Homo sapiens
cacgagccacaag

SEQ ID NO: 815702 - DNA, 14 bp, Homo sapiens
cacgagccacaagc

SEQ ID NO: 815703 - DNA, 17 bp, Homo sapiens
cacgagccacaagctgc

SEQ ID NO: 815704 - DNA, 12 bp, Homo sapiens
cacgagccacct

SEQ ID NO: 815705 - DNA, 20 bp, Homo sapiens
cacgaggagcagcagcgctc

SEQ ID NO: 815706 - DNA, 18 bp, Homo sapiens
cacgaggcctcaggtcgg

SEQ ID NO: 815707 - DNA, 12 bp, Homo sapiens
cacgaggctgcc

SEQ ID NO: 815708 - DNA, 21 bp, Homo sapiens
cacgagggctggctggcctca

SEQ ID NO: 815709 - DNA, 14 bp, Homo sapiens
cacgaggggaccca

SEQ ID NO: 815710 - DNA, 14 bp, Homo sapiens
cacgagggtctccc

SEQ ID NO: 815711 - DNA, 15 bp, Homo sapiens
cacgaggtcaggaga

SEQ ID NO: 815712 - DNA, 19 bp, Homo sapiens
cacgagtcacctgcaagcc

SEQ ID NO: 815713 - DNA, 20 bp, Homo sapiens
cacgagtcacctgcaagccc

SEQ ID NO: 815714 - DNA, 14 bp, Homo sapiens
cacgagttccagac

SEQ ID NO: 815715 - DNA, 17 bp, Homo sapiens
cacgatcccctccccca

SEQ ID NO: 815716 - DNA, 15 bp, Homo sapiens
cacgatgaaaaactt

SEQ ID NO: 815717 - DNA, 17 bp, Homo sapiens
cacgatgcatttaataa

SEQ ID NO: 815718 - DNA, 18 bp, Homo sapiens
cacgatgcatttaataaa

SEQ ID NO: 815719 - DNA, 20 bp, Homo sapiens
cacgatgcatttaataaaga

SEQ ID NO: 815720 - DNA, 22 bp, Homo sapiens
cacgatgcatttaataaagatg

SEQ ID NO: 815721 - DNA, 14 bp, Homo sapiens
cacgatgtggccct

SEQ ID NO: 815722 - DNA, 16 bp, Homo sapiens
cacgatgtggccctgg

SEQ ID NO: 815723 - DNA, 17 bp, Homo sapiens
cacgatgtggccctggc

SEQ ID NO: 815724 - DNA, 15 bp, Homo sapiens
cacgattcatttttg

SEQ ID NO: 815725 - DNA, 13 bp, Homo sapiens
cacgattggagaa

SEQ ID NO: 815726 - DNA, 19 bp, Homo sapiens
cacgattggagaatacttt

SEQ ID NO: 815727 - DNA, 18 bp, Homo sapiens
cacgcaaatacactccag

SEQ ID NO: 815728 - DNA, 21 bp, Homo sapiens
cacgcaagggcatcaggcact

SEQ ID NO: 815729 - DNA, 14 bp, Homo sapiens
cacgcacacacaca

SEQ ID NO: 815730 - DNA, 20 bp, Homo sapiens
cacgcacacacacacacagg

SEQ ID NO: 815731 - DNA, 19 bp, Homo sapiens
cacgcacacacacatacag

SEQ ID NO: 815732 - DNA, 21 bp, Homo sapiens
cacgcacacatcttacctctc

SEQ ID NO: 815733 - DNA, 18 bp, Homo sapiens
cacgcacctccacgccac

SEQ ID NO: 815734 - DNA, 14 bp, Homo sapiens
cacgcacgcacaca

SEQ ID NO: 815735 - DNA, 15 bp, Homo sapiens
cacgcacgcacacac

SEQ ID NO: 815736 - DNA, 16 bp, Homo sapiens
cacgcacgcacacaca

SEQ ID NO: 815737 - DNA, 23 bp, Homo sapiens
cacgcactgggttgcgggacaga

SEQ ID NO: 815738 - DNA, 12 bp, Homo sapiens
cacgcagaggac

SEQ ID NO: 815739 - DNA, 19 bp, Homo sapiens
cacgcagcctgctctggag

SEQ ID NO: 815740 - DNA, 17 bp, Homo sapiens
cacgcaggaactcccag

SEQ ID NO: 815741 - DNA, 18 bp, Homo sapiens
cacgcaggcggccagggc

SEQ ID NO: 815742 - DNA, 22 bp, Homo sapiens
cacgcaggcggggcagtatgtg

SEQ ID NO: 815743 - DNA, 16 bp, Homo sapiens
cacgcaggctgagtcc

SEQ ID NO: 815744 - DNA, 19 bp, Homo sapiens
cacgcaggctgagtccaga

SEQ ID NO: 815745 - DNA, 14 bp, Homo sapiens
cacgcaggggccct

SEQ ID NO: 815746 - DNA, 16 bp, Homo sapiens
cactcctctcccacag

SEQ ID NO: 815747 - DNA, 18 bp, Homo sapiens
cactcctctcccacagag

SEQ ID NO: 815748 - DNA, 21 bp, Homo sapiens
cactcctctgactcagggctc

SEQ ID NO: 815749 - DNA, 13 bp, Homo sapiens
cactcctgacccc

SEQ ID NO: 815750 - DNA, 11 bp, Homo sapiens
cactcctgctt

SEQ ID NO: 815751 - DNA, 14 bp, Homo sapiens
cactcctgcttctc

SEQ ID NO: 815752 - DNA, 21 bp, Homo sapiens
cactcctgcttctctcagcca

SEQ ID NO: 815753 - DNA, 22 bp, Homo sapiens
cactcctgggctctgaacacac

SEQ ID NO: 815754 - DNA, 11 bp, Homo sapiens
cactcctgggg

SEQ ID NO: 815755 - DNA, 12 bp, Homo sapiens
cactcctgtccc

SEQ ID NO: 815756 - DNA, 13 bp, Homo sapiens
cactcctgtcccg

SEQ ID NO: 815757 - DNA, 20 bp, Homo sapiens
cactcctgtcccgccttcct

SEQ ID NO: 815758 - DNA, 22 bp, Homo sapiens
cactcctgtccctgtagctcag

SEQ ID NO: 815759 - DNA, 15 bp, Homo sapiens
cactcgaatcattga

SEQ ID NO: 815760 - DNA, 21 bp, Homo sapiens
cactcgacccagaatggagcc

SEQ ID NO: 815761 - DNA, 17 bp, Homo sapiens
cactcgagaccatcctg

SEQ ID NO: 815762 - DNA, 14 bp, Homo sapiens
cactcgcaggacca

SEQ ID NO: 815763 - DNA, 15 bp, Homo sapiens
cactcgcccgcccac

SEQ ID NO: 815764 - DNA, 18 bp, Homo sapiens
cactcgcccgcccactgt

SEQ ID NO: 815765 - DNA, 22 bp, Homo sapiens
cactcggcatttcaaatgtgct

SEQ ID NO: 815766 - DNA, 14 bp, Homo sapiens
cactcggtcccagt

SEQ ID NO: 815767 - DNA, 20 bp, Homo sapiens
cactcggtcccagttttgtt

SEQ ID NO: 815768 - DNA, 17 bp, Homo sapiens
cactcgtgcatccctga

SEQ ID NO: 815769 - DNA, 15 bp, Homo sapiens
cactcgtgtgtttct

SEQ ID NO: 815770 - DNA, 14 bp, Homo sapiens
cactctaaactgca

SEQ ID NO: 815771 - DNA, 21 bp, Homo sapiens
cactctaaactgcaaacagaa

SEQ ID NO: 815772 - DNA, 21 bp, Homo sapiens
cactctaaaggcgctgagact

SEQ ID NO: 815773 - DNA, 18 bp, Homo sapiens
cactctaactgtatattt

SEQ ID NO: 815774 - DNA, 16 bp, Homo sapiens
cactctaagtcatgta

SEQ ID NO: 815775 - DNA, 17 bp, Homo sapiens
cactctaagtcatgtat

SEQ ID NO: 815776 - DNA, 18 bp, Homo sapiens
cactctacagactcccac

SEQ ID NO: 815777 - DNA, 17 bp, Homo sapiens
cactctaccaaataatt

SEQ ID NO: 815778 - DNA, 17 bp, Homo sapiens
cactctaccctatacaa

SEQ ID NO: 815779 - DNA, 17 bp, Homo sapiens
cactctaccctcccacc

SEQ ID NO: 815780 - DNA, 14 bp, Homo sapiens
cactctacttagca

SEQ ID NO: 815781 - DNA, 13 bp, Homo sapiens
cactctagcctgg

SEQ ID NO: 815782 - DNA, 14 bp, Homo sapiens
cactctagcctggc

SEQ ID NO: 815783 - DNA, 17 bp, Homo sapiens
cactctaggggtcaggc

SEQ ID NO: 815784 - DNA, 19 bp, Homo sapiens
cactctagtgacttcctgg

SEQ ID NO: 815785 - DNA, 14 bp, Homo sapiens
cactctagttctag

SEQ ID NO: 815786 - DNA, 16 bp, Homo sapiens
cactctagttctagat

SEQ ID NO: 815787 - DNA, 15 bp, Homo sapiens
cactctatatgtagt

SEQ ID NO: 815788 - DNA, 19 bp, Homo sapiens
cactctcatcaccccagag

SEQ ID NO: 815789 - DNA, 22 bp, Homo sapiens
cactctcatcaccccagaggcc

SEQ ID NO: 815790 - DNA, 13 bp, Homo sapiens
cactctccatcac

SEQ ID NO: 815791 - DNA, 12 bp, Homo sapiens
cactctccccac

SEQ ID NO: 815792 - DNA, 13 bp, Homo sapiens
cactctcccctcc

SEQ ID NO: 815793 - DNA, 16 bp, Homo sapiens
cactctctcacccacc

SEQ ID NO: 815794 - DNA, 17 bp, Homo sapiens
cactctctcacccacca

SEQ ID NO: 815795 - DNA, 13 bp, Homo sapiens
cactctctgaaga

SEQ ID NO: 815796 - DNA, 13 bp, Homo sapiens
cactctctgcagc

SEQ ID NO: 815797 - DNA, 13 bp, Homo sapiens
cactctctggaag

SEQ ID NO: 815798 - DNA, 14 bp, Homo sapiens
cactctctggaagc

SEQ ID NO: 815799 - DNA, 13 bp, Homo sapiens
cactctctgggac

SEQ ID NO: 815800 - DNA, 14 bp, Homo sapiens
cactctctgggact

SEQ ID NO: 815801 - DNA, 14 bp, Homo sapiens
cactctctggggaa

SEQ ID NO: 815802 - DNA, 23 bp, Homo sapiens
cactctgagtttaccatttgtaa

SEQ ID NO: 815803 - DNA, 15 bp, Homo sapiens
cactctgcccccatt

SEQ ID NO: 815804 - DNA, 15 bp, Homo sapiens
cactctgccctctgc

SEQ ID NO: 815805 - DNA, 16 bp, Homo sapiens
cactctgccctctgct

SEQ ID NO: 815806 - DNA, 15 bp, Homo sapiens
cactctgcctgcctg

SEQ ID NO: 815807 - DNA, 21 bp, Homo sapiens
cactctgcggcccgggccgac

SEQ ID NO: 815808 - DNA, 15 bp, Homo sapiens
cactctgctctgccc

SEQ ID NO: 815809 - DNA, 12 bp, Homo sapiens
cactctgcttct

SEQ ID NO: 815810 - DNA, 17 bp, Homo sapiens
cactctgcttctctgac

SEQ ID NO: 815811 - DNA, 13 bp, Homo sapiens
cactctggcctca

SEQ ID NO: 815812 - DNA, 14 bp, Homo sapiens
cactctgggctcca

SEQ ID NO: 815813 - DNA, 15 bp, Homo sapiens
cactctgggctccag

SEQ ID NO: 815814 - DNA, 19 bp, Homo sapiens
cactctggtggccacttca

SEQ ID NO: 815815 - DNA, 14 bp, Homo sapiens
cactctgtaattga

SEQ ID NO: 815816 - DNA, 22 bp, Homo sapiens
cactctgtattgaaaatggctt

SEQ ID NO: 815817 - DNA, 12 bp, Homo sapiens
cactctgtcagc

SEQ ID NO: 815818 - DNA, 18 bp, Homo sapiens
cactctgtcagccagccg

SEQ ID NO: 815819 - DNA, 23 bp, Homo sapiens
cactctgtcagccagccgccctg

SEQ ID NO: 815820 - DNA, 13 bp, Homo sapiens
cactctgttattt

SEQ ID NO: 815821 - DNA, 17 bp, Homo sapiens
cactctgttatttagac

SEQ ID NO: 815822 - DNA, 20 bp, Homo sapiens
cactctgttatttagactca

SEQ ID NO: 815823 - DNA, 14 bp, Homo sapiens
cactcttaaatgat

SEQ ID NO: 815824 - DNA, 11 bp, Homo sapiens
cactcttccag

SEQ ID NO: 815825 - DNA, 18 bp, Homo sapiens
cactcttctctcctttct

SEQ ID NO: 815826 - DNA, 22 bp, Homo sapiens
cactcttctttaagccatagac

SEQ ID NO: 815827 - DNA, 17 bp, Homo sapiens
cactcttgaactgggcg

SEQ ID NO: 815828 - DNA, 22 bp, Homo sapiens
cactcttggtccctggaagctt

SEQ ID NO: 815829 - DNA, 22 bp, Homo sapiens
cactcttgtactgcctgccacc

SEQ ID NO: 815830 - DNA, 15 bp, Homo sapiens
cactctttctcccta

SEQ ID NO: 815831 - DNA, 17 bp, Homo sapiens
cactgaaaaaatatatg

SEQ ID NO: 815832 - DNA, 20 bp, Homo sapiens
cactgaaaaatctaagtgat

SEQ ID NO: 815833 - DNA, 16 bp, Homo sapiens
cactgaaaacatctgg

SEQ ID NO: 815834 - DNA, 17 bp, Homo sapiens
cactgaaaacttagcca

SEQ ID NO: 815835 - DNA, 19 bp, Homo sapiens
cactgaaaagctttcctga

SEQ ID NO: 815836 - DNA, 19 bp, Homo sapiens
cactgaaacgtattcagag

SEQ ID NO: 815837 - DNA, 16 bp, Homo sapiens
cactgaaagttttgta

SEQ ID NO: 815838 - DNA, 17 bp, Homo sapiens
cactgaaagttttgtaa

SEQ ID NO: 815839 - DNA, 23 bp, Homo sapiens
cactgaaataaccgtaaaggttt

SEQ ID NO: 815840 - DNA, 12 bp, Homo sapiens
cactgaacaaaa

SEQ ID NO: 815841 - DNA, 21 bp, Homo sapiens
cactgaacaaaacctacacac

SEQ ID NO: 815842 - DNA, 11 bp, Homo sapiens
cactgaacagg

SEQ ID NO: 815843 - DNA, 18 bp, Homo sapiens
cactgaacaggctggggc

SEQ ID NO: 815844 - DNA, 13 bp, Homo sapiens
cactgaaccactg

SEQ ID NO: 815845 - DNA, 14 bp, Homo sapiens
cactgaaccactgc

SEQ ID NO: 815846 - DNA, 14 bp, Homo sapiens
cactgaactccacc

SEQ ID NO: 815847 - DNA, 19 bp, Homo sapiens
cactgaagaaaccttcaga

SEQ ID NO: 815848 - DNA, 13 bp, Homo sapiens
cactgaagtgctt

SEQ ID NO: 815849 - DNA, 15 bp, Homo sapiens
cactgaagtggccct

SEQ ID NO: 815850 - DNA, 13 bp, Homo sapiens
cactgaatattta

SEQ ID NO: 815851 - DNA, 23 bp, Homo sapiens
cactgaatctcccctcctcacag

SEQ ID NO: 815852 - DNA, 12 bp, Homo sapiens
cactgaattgaa

SEQ ID NO: 815853 - DNA, 14 bp, Homo sapiens
cactgaatttataa

SEQ ID NO: 815854 - DNA, 15 bp, Homo sapiens
cactgaatttataaa

SEQ ID NO: 815855 - DNA, 19 bp, Homo sapiens
cactgaatttataaagtac

SEQ ID NO: 815856 - DNA, 16 bp, Homo sapiens
cactgacagcctccca

SEQ ID NO: 815857 - DNA, 13 bp, Homo sapiens
cactgaccaggcc

SEQ ID NO: 815858 - DNA, 15 bp, Homo sapiens
cactgaccaggccca

SEQ ID NO: 815859 - DNA, 24 bp, Homo sapiens
cactgacccacctgcgcttctgct

SEQ ID NO: 815860 - DNA, 20 bp, Homo sapiens
cactgacctgctccgccagg

SEQ ID NO: 815861 - DNA, 23 bp, Homo sapiens
cactgacctgctccgccaggaaa

SEQ ID NO: 815862 - DNA, 23 bp, Homo sapiens
cactgacctgtcatgcccccctc

SEQ ID NO: 815863 - DNA, 15 bp, Homo sapiens
cactgactactggct

SEQ ID NO: 815864 - DNA, 11 bp, Homo sapiens
cactgactgtg

SEQ ID NO: 815865 - DNA, 13 bp, Homo sapiens
cactgacttgctg

SEQ ID NO: 815866 - DNA, 17 bp, Homo sapiens
cactgagaatgatagta

SEQ ID NO: 815867 - DNA, 23 bp, Homo sapiens
cactgagaccccaggctgttagg

SEQ ID NO: 815868 - DNA, 17 bp, Homo sapiens
cactgagaggcctggag

SEQ ID NO: 815869 - DNA, 12 bp, Homo sapiens
cactggtgagac

SEQ ID NO: 815870 - DNA, 14 bp, Homo sapiens
cactggtggcatcg

SEQ ID NO: 815871 - DNA, 21 bp, Homo sapiens
cactggtggcccgacagcctg

SEQ ID NO: 815872 - DNA, 23 bp, Homo sapiens
cactggtggcccgacagcctggc

SEQ ID NO: 815873 - DNA, 18 bp, Homo sapiens
cactggtggttctactga

SEQ ID NO: 815874 - DNA, 22 bp, Homo sapiens
cactggtgtgtccctctgcctt

SEQ ID NO: 815875 - DNA, 16 bp, Homo sapiens
cactggtttcaagaat

SEQ ID NO: 815876 - DNA, 16 bp, Homo sapiens
cactggttttacacag

SEQ ID NO: 815877 - DNA, 13 bp, Homo sapiens
cactgtaaaatga

SEQ ID NO: 815878 - DNA, 17 bp, Homo sapiens
cactgtaaaatgaaatt

SEQ ID NO: 815879 - DNA, 15 bp, Homo sapiens
cactgtaaagacaaa

SEQ ID NO: 815880 - DNA, 19 bp, Homo sapiens
cactgtaaagacaaataaa

SEQ ID NO: 815881 - DNA, 17 bp, Homo sapiens
cactgtaaatatccctc

SEQ ID NO: 815882 - DNA, 21 bp, Homo sapiens
cactgtaatcttaaaagtgta

SEQ ID NO: 815883 - DNA, 18 bp, Homo sapiens
cactgtagaatgatttca

SEQ ID NO: 815884 - DNA, 19 bp, Homo sapiens
cactgtagtttagttctgt

SEQ ID NO: 815885 - DNA, 21 bp, Homo sapiens
cactgtagtttagttctgttg

SEQ ID NO: 815886 - DNA, 18 bp, Homo sapiens
cactgtagttttgagtgt

SEQ ID NO: 815887 - DNA, 23 bp, Homo sapiens
cactgtatagatccacagggagc

SEQ ID NO: 815888 - DNA, 11 bp, Homo sapiens
cactgtatata

SEQ ID NO: 815889 - DNA, 15 bp, Homo sapiens
cactgtatataaaca

SEQ ID NO: 815890 - DNA, 20 bp, Homo sapiens
cactgtatataaacatattt

SEQ ID NO: 815891 - DNA, 15 bp, Homo sapiens
cactgtatgagtgga

SEQ ID NO: 815892 - DNA, 15 bp, Homo sapiens
cactgtatgatttat

SEQ ID NO: 815893 - DNA, 18 bp, Homo sapiens
cactgtattacataaata

SEQ ID NO: 815894 - DNA, 23 bp, Homo sapiens
cactgtattacataaataaatta

SEQ ID NO: 815895 - DNA, 16 bp, Homo sapiens
cactgtattgctcctc

SEQ ID NO: 815896 - DNA, 17 bp, Homo sapiens
cactgtatttgtatctc

SEQ ID NO: 815897 - DNA, 18 bp, Homo sapiens
cactgtcactgtttctct

SEQ ID NO: 815898 - DNA, 22 bp, Homo sapiens
cactgtcactgtttctctgctg

SEQ ID NO: 815899 - DNA, 15 bp, Homo sapiens
cactgtcatcaatgt

SEQ ID NO: 815900 - DNA, 14 bp, Homo sapiens
cactgtccccctac

SEQ ID NO: 815901 - DNA, 13 bp, Homo sapiens
cactgtccctgtc

SEQ ID NO: 815902 - DNA, 19 bp, Homo sapiens
cactgtccctgtccttcta

SEQ ID NO: 815903 - DNA, 12 bp, Homo sapiens
cactgtccgcct

SEQ ID NO: 815904 - DNA, 16 bp, Homo sapiens
cactgtccgcctctgc

SEQ ID NO: 815905 - DNA, 18 bp, Homo sapiens
cactgtcctccaagccag

SEQ ID NO: 815906 - DNA, 11 bp, Homo sapiens
cactgtcctgg

SEQ ID NO: 815907 - DNA, 12 bp, Homo sapiens
cactgtcctggg

SEQ ID NO: 815908 - DNA, 16 bp, Homo sapiens
cactgtcctgggcgcc

SEQ ID NO: 815909 - DNA, 22 bp, Homo sapiens
cactgtccttgaacccaacagt

SEQ ID NO: 815910 - DNA, 12 bp, Homo sapiens
cactgtctcagt

SEQ ID NO: 815911 - DNA, 13 bp, Homo sapiens
cactgtctggggc

SEQ ID NO: 815912 - DNA, 13 bp, Homo sapiens
cactgtgaaattt

SEQ ID NO: 815913 - DNA, 15 bp, Homo sapiens
cactgtgaaatttca

SEQ ID NO: 815914 - DNA, 20 bp, Homo sapiens
cactgtgagagttgtctctg

SEQ ID NO: 815915 - DNA, 22 bp, Homo sapiens
cactgtgagagttgtctctgtt

SEQ ID NO: 815916 - DNA, 19 bp, Homo sapiens
cactgtgattttgccctcc

SEQ ID NO: 815917 - DNA, 22 bp, Homo sapiens
cactgtgcccagcccggacctt

SEQ ID NO: 815918 - DNA, 12 bp, Homo sapiens
cactgtgcccca

SEQ ID NO: 815919 - DNA, 15 bp, Homo sapiens
cactgtgcttggcca

SEQ ID NO: 815920 - DNA, 21 bp, Homo sapiens
cactgtggccacagccccctt

SEQ ID NO: 815921 - DNA, 12 bp, Homo sapiens
cactgtggccag

SEQ ID NO: 815922 - DNA, 17 bp, Homo sapiens
cactgtggccagagctg

SEQ ID NO: 815923 - DNA, 18 bp, Homo sapiens
cactgtggccagagctgg

SEQ ID NO: 815924 - DNA, 15 bp, Homo sapiens
cactgtggccaggcc

SEQ ID NO: 815925 - DNA, 16 bp, Homo sapiens
cactgtggccaggcct

SEQ ID NO: 815926 - DNA, 15 bp, Homo sapiens
cactgtgtatttaac

SEQ ID NO: 815927 - DNA, 17 bp, Homo sapiens
cactgtgtcctggtgct

SEQ ID NO: 815928 - DNA, 19 bp, Homo sapiens
cactgtgtctctgtttcct

SEQ ID NO: 815929 - DNA, 20 bp, Homo sapiens
cactgtgtctctgtttcctg

SEQ ID NO: 815930 - DNA, 20 bp, Homo sapiens
cactgtgtgaggctgtgtct

SEQ ID NO: 815931 - DNA, 21 bp, Homo sapiens
cactgtgtgaggctgtgtctc

SEQ ID NO: 815932 - DNA, 23 bp, Homo sapiens
cactgtgtgttgacactgttttc

SEQ ID NO: 815933 - DNA, 16 bp, Homo sapiens
cactgtgttactgctt

SEQ ID NO: 815934 - DNA, 20 bp, Homo sapiens
cactgtgttactgctttgca

SEQ ID NO: 815935 - DNA, 22 bp, Homo sapiens
cactgttaatacacagtacttt

SEQ ID NO: 815936 - DNA, 23 bp, Homo sapiens
cactgttactttcgtacattggc

SEQ ID NO: 815937 - DNA, 20 bp, Homo sapiens
cactgttcaaacctctgccg

SEQ ID NO: 815938 - DNA, 21 bp, Homo sapiens
cactgttccagtgtctataaa

SEQ ID NO: 815939 - DNA, 17 bp, Homo sapiens
cactgttccccctgtgc

SEQ ID NO: 815940 - DNA, 16 bp, Homo sapiens
cactgttccctctgct

SEQ ID NO: 815941 - DNA, 22 bp, Homo sapiens
cactgttccctctgctcctgga

SEQ ID NO: 815942 - DNA, 19 bp, Homo sapiens
cactgttctgaaagtgact

SEQ ID NO: 815943 - DNA, 11 bp, Homo sapiens
cactgttctgc

SEQ ID NO: 815944 - DNA, 15 bp, Homo sapiens
cactgttctgcaaag

SEQ ID NO: 815945 - DNA, 18 bp, Homo sapiens
cactgttgaaaattattt

SEQ ID NO: 815946 - DNA, 21 bp, Homo sapiens
cactgttgaaaattattttaa

SEQ ID NO: 815947 - DNA, 23 bp, Homo sapiens
cactgttgagttctgattgtgtt

SEQ ID NO: 815948 - DNA, 16 bp, Homo sapiens
cactgttgatgtatct

SEQ ID NO: 815949 - DNA, 12 bp, Homo sapiens
cactgttgcaaa

SEQ ID NO: 815950 - DNA, 18 bp, Homo sapiens
cactgttgtacacagtct

SEQ ID NO: 815951 - DNA, 15 bp, Homo sapiens
cactgtttcctgggc

SEQ ID NO: 815952 - DNA, 17 bp, Homo sapiens
cactgtttggcctttct

SEQ ID NO: 815953 - DNA, 18 bp, Homo sapiens
cactgtttgtttttattt

SEQ ID NO: 815954 - DNA, 16 bp, Homo sapiens
cacttaaaaaatgtcc

SEQ ID NO: 815955 - DNA, 15 bp, Homo sapiens
cacttaaaattgtaa

SEQ ID NO: 815956 - DNA, 15 bp, Homo sapiens
cacttaaagaagtat

SEQ ID NO: 815957 - DNA, 16 bp, Homo sapiens
cacttaaagaagtatt

SEQ ID NO: 815958 - DNA, 21 bp, Homo sapiens
cacttaaagggtcttatgaaa

SEQ ID NO: 815959 - DNA, 16 bp, Homo sapiens
cacttaaattatgata

SEQ ID NO: 815960 - DNA, 12 bp, Homo sapiens
cacttaaatttc

SEQ ID NO: 815961 - DNA, 13 bp, Homo sapiens
cacttaagagaat

SEQ ID NO: 815962 - DNA, 20 bp, Homo sapiens
cacttaagagaatattttaa

SEQ ID NO: 815963 - DNA, 17 bp, Homo sapiens
cacttaagtgcactttt

SEQ ID NO: 815964 - DNA, 13 bp, Homo sapiens
cacttaagtgtct

SEQ ID NO: 815965 - DNA, 17 bp, Homo sapiens
cacttaagttagcctcc

SEQ ID NO: 815966 - DNA, 12 bp, Homo sapiens
cacttaatagca

SEQ ID NO: 815967 - DNA, 21 bp, Homo sapiens
cacttaatagcaacagagcac

SEQ ID NO: 815968 - DNA, 12 bp, Homo sapiens
cacttaatgtat

SEQ ID NO: 815969 - DNA, 15 bp, Homo sapiens
cacttaatgtatgtt

SEQ ID NO: 815970 - DNA, 16 bp, Homo sapiens
cacttaccgccctgcg

SEQ ID NO: 815971 - DNA, 18 bp, Homo sapiens
cacttacctagatttaca

SEQ ID NO: 815972 - DNA, 16 bp, Homo sapiens
cacttacgtaaaacat

SEQ ID NO: 815973 - DNA, 18 bp, Homo sapiens
cacttacgtaaaacattt

SEQ ID NO: 815974 - DNA, 17 bp, Homo sapiens
cacttacgtttgtcctt

SEQ ID NO: 815975 - DNA, 15 bp, Homo sapiens
cacttactggtagga

SEQ ID NO: 815976 - DNA, 15 bp, Homo sapiens
cacttagcccaagag

SEQ ID NO: 815977 - DNA, 22 bp, Homo sapiens
cacttagccgcaccctgcacct

SEQ ID NO: 815978 - DNA, 22 bp, Homo sapiens
cacttagccgtccatggcacca

SEQ ID NO: 815979 - DNA, 17 bp, Homo sapiens
cacttagggatatatat

SEQ ID NO: 815980 - DNA, 20 bp, Homo sapiens
cacttagtattttaaaaaat

SEQ ID NO: 815981 - DNA, 15 bp, Homo sapiens
cacttagtgatcatt

SEQ ID NO: 815982 - DNA, 21 bp, Homo sapiens
cacttatattttatgaacatt

SEQ ID NO: 815983 - DNA, 16 bp, Homo sapiens
cacttatctgatactt

SEQ ID NO: 815984 - DNA, 13 bp, Homo sapiens
cacttatgctgct

SEQ ID NO: 815985 - DNA, 19 bp, Homo sapiens
cacttatgttatacaatac

SEQ ID NO: 815986 - DNA, 19 bp, Homo sapiens
cacttattccctcatcctt

SEQ ID NO: 815987 - DNA, 17 bp, Homo sapiens
cacttattgaatatatg

SEQ ID NO: 815988 - DNA, 20 bp, Homo sapiens
cacttatttatgaacctgcc

SEQ ID NO: 815989 - DNA, 15 bp, Homo sapiens
cacttatttatgaat

SEQ ID NO: 815990 - DNA, 16 bp, Homo sapiens
cacttatttattgttg

SEQ ID NO: 815991 - DNA, 13 bp, Homo sapiens
cagaaaggtgcag

SEQ ID NO: 815992 - DNA, 20 bp, Homo sapiens
cagaaaggttttcttctttt

SEQ ID NO: 815993 - DNA, 15 bp, Homo sapiens
cagaaagtcaccagg

SEQ ID NO: 815994 - DNA, 22 bp, Homo sapiens
cagaaagtgataagtgcaggga

SEQ ID NO: 815995 - DNA, 22 bp, Homo sapiens
cagaaagtggccatgccaccct

SEQ ID NO: 815996 - DNA, 22 bp, Homo sapiens
cagaaagtgtgtgtgttctgta

SEQ ID NO: 815997 - DNA, 23 bp, Homo sapiens
cagaaataaaatttgataaacat

SEQ ID NO: 815998 - DNA, 20 bp, Homo sapiens
cagaaataaagttggtgaca

SEQ ID NO: 815999 - DNA, 16 bp, Homo sapiens
cagaaatactgctctg

SEQ ID NO: 816000 - DNA, 14 bp, Homo sapiens
cagaaatagacaaa

SEQ ID NO: 816001 - DNA, 16 bp, Homo sapiens
cagaaatagacaaaaa

SEQ ID NO: 816002 - DNA, 15 bp, Homo sapiens
cagaaatcactgtga

SEQ ID NO: 816003 - DNA, 16 bp, Homo sapiens
cagaaatcactgtgaa

SEQ ID NO: 816004 - DNA, 20 bp, Homo sapiens
cagaaatcagtaatatttat

SEQ ID NO: 816005 - DNA, 16 bp, Homo sapiens
cagaaatgctgcctgc

SEQ ID NO: 816006 - DNA, 17 bp, Homo sapiens
cagaaatgctgcctgcc

SEQ ID NO: 816007 - DNA, 21 bp, Homo sapiens
cagaaatgctgcctgcctgtc

SEQ ID NO: 816008 - DNA, 15 bp, Homo sapiens
cagaaatgctgctgg

SEQ ID NO: 816009 - DNA, 18 bp, Homo sapiens
cagaaatgctgctggcca

SEQ ID NO: 816010 - DNA, 13 bp, Homo sapiens
cagaaatgggcag

SEQ ID NO: 816011 - DNA, 23 bp, Homo sapiens
cagaaatgggcagttctcccagg

SEQ ID NO: 816012 - DNA, 13 bp, Homo sapiens
cagaaatgtaaat

SEQ ID NO: 816013 - DNA, 16 bp, Homo sapiens
cagaaatgtacagcaa

SEQ ID NO: 816014 - DNA, 16 bp, Homo sapiens
cagaaattcaatttgg

SEQ ID NO: 816015 - DNA, 20 bp, Homo sapiens
cagaaattcaatttggattt

SEQ ID NO: 816016 - DNA, 21 bp, Homo sapiens
cagaaattccaactcctgatg

SEQ ID NO: 816017 - DNA, 12 bp, Homo sapiens
cagaaattgtat

SEQ ID NO: 816018 - DNA, 13 bp, Homo sapiens
cagaaattgtata

SEQ ID NO: 816019 - DNA, 14 bp, Homo sapiens
cagaaattgtatat

SEQ ID NO: 816020 - DNA, 18 bp, Homo sapiens
cagaaatttttatttttc

SEQ ID NO: 816021 - DNA, 16 bp, Homo sapiens
cagaacaaaaagaaat

SEQ ID NO: 816022 - DNA, 20 bp, Homo sapiens
cagaacaaatgtgtttttct

SEQ ID NO: 816023 - DNA, 21 bp, Homo sapiens
cagaacaaatgtgtttttcta

SEQ ID NO: 816024 - DNA, 22 bp, Homo sapiens
cagaacaaatgtgtttttctat

SEQ ID NO: 816025 - DNA, 12 bp, Homo sapiens
cagaacaaattg

SEQ ID NO: 816026 - DNA, 19 bp, Homo sapiens
cagaacacacagactttct

SEQ ID NO: 816027 - DNA, 12 bp, Homo sapiens
cagaacacctgg

SEQ ID NO: 816028 - DNA, 13 bp, Homo sapiens
cagaacacctggc

SEQ ID NO: 816029 - DNA, 11 bp, Homo sapiens
cagaacagagg

SEQ ID NO: 816030 - DNA, 13 bp, Homo sapiens
cagaacagaggca

SEQ ID NO: 816031 - DNA, 15 bp, Homo sapiens
cagaacagagggcca

SEQ ID NO: 816032 - DNA, 20 bp, Homo sapiens
cagaacagagggccagagct

SEQ ID NO: 816033 - DNA, 17 bp, Homo sapiens
cagaacagccgctcctg

SEQ ID NO: 816034 - DNA, 20 bp, Homo sapiens
cagaacagccgctcctgtct

SEQ ID NO: 816035 - DNA, 13 bp, Homo sapiens
cagaacagctgaa

SEQ ID NO: 816036 - DNA, 15 bp, Homo sapiens
cagaacatactgatt

SEQ ID NO: 816037 - DNA, 16 bp, Homo sapiens
cagaacatagacagaa

SEQ ID NO: 816038 - DNA, 15 bp, Homo sapiens
cagaacatgttaaga

SEQ ID NO: 816039 - DNA, 18 bp, Homo sapiens
cagaaccagatgagtaaa

SEQ ID NO: 816040 - DNA, 12 bp, Homo sapiens
cagaacccaggg

SEQ ID NO: 816041 - DNA, 15 bp, Homo sapiens
cagaacccagggctc

SEQ ID NO: 816042 - DNA, 18 bp, Homo sapiens
cagaacccagggctctgc

SEQ ID NO: 816043 - DNA, 19 bp, Homo sapiens
cagaacccagggctctgcc

SEQ ID NO: 816044 - DNA, 22 bp, Homo sapiens
cagaacccagggctctgcccca

SEQ ID NO: 816045 - DNA, 21 bp, Homo sapiens
cagaacctaaaagtattattc

SEQ ID NO: 816046 - DNA, 18 bp, Homo sapiens
cagaacctactgttcctt

SEQ ID NO: 816047 - DNA, 20 bp, Homo sapiens
cagaacctactgttcctttc

SEQ ID NO: 816048 - DNA, 13 bp, Homo sapiens
cagaacctgcaca

SEQ ID NO: 816049 - DNA, 17 bp, Homo sapiens
cagaacctgcacacagg

SEQ ID NO: 816050 - DNA, 20 bp, Homo sapiens
cagaaccttcaacccagtgg

SEQ ID NO: 816051 - DNA, 15 bp, Homo sapiens
cagaacgtatttagc

SEQ ID NO: 816052 - DNA, 17 bp, Homo sapiens
cagaacgtatttagcca

SEQ ID NO: 816053 - DNA, 22 bp, Homo sapiens
cagaacgtatttagccattacc

SEQ ID NO: 816054 - DNA, 13 bp, Homo sapiens
cagaacgtggctc

SEQ ID NO: 816055 - DNA, 21 bp, Homo sapiens
cagaactattctgggggcccg

SEQ ID NO: 816056 - DNA, 17 bp, Homo sapiens
cagaactatttaaaata

SEQ ID NO: 816057 - DNA, 13 bp, Homo sapiens
cagaactcccttc

SEQ ID NO: 816058 - DNA, 17 bp, Homo sapiens
cagaactcttaaaaatg

SEQ ID NO: 816059 - DNA, 19 bp, Homo sapiens
cagaactcttaaaaatgtt

SEQ ID NO: 816060 - DNA, 15 bp, Homo sapiens
cagaactctttcaaa

SEQ ID NO: 816061 - DNA, 14 bp, Homo sapiens
cagaactgaagcca

SEQ ID NO: 816062 - DNA, 16 bp, Homo sapiens
cagaactgcagggcct

SEQ ID NO: 816063 - DNA, 11 bp, Homo sapiens
cagaactgcca

SEQ ID NO: 816064 - DNA, 16 bp, Homo sapiens
cagaactgcccccact

SEQ ID NO: 816065 - DNA, 17 bp, Homo sapiens
cagaactgcccttgctg

SEQ ID NO: 816066 - DNA, 17 bp, Homo sapiens
cagaactggctgggccc

SEQ ID NO: 816067 - DNA, 20 bp, Homo sapiens
cagaactggctgggcccctg

SEQ ID NO: 816068 - DNA, 22 bp, Homo sapiens
cagaactgtccacatctgcctc

SEQ ID NO: 816069 - DNA, 23 bp, Homo sapiens
cagaactgtccacatctgcctcc

SEQ ID NO: 816070 - DNA, 17 bp, Homo sapiens
cagaactgtcccatccc

SEQ ID NO: 816071 - DNA, 17 bp, Homo sapiens
cagaactgtgccacaat

SEQ ID NO: 816072 - DNA, 13 bp, Homo sapiens
cagaacttcagaa

SEQ ID NO: 816073 - DNA, 16 bp, Homo sapiens
cagaacttcagaaaga

SEQ ID NO: 816074 - DNA, 17 bp, Homo sapiens
cagaacttcagaaagac

SEQ ID NO: 816075 - DNA, 20 bp, Homo sapiens
cagaacttcagaaagacttg

SEQ ID NO: 816076 - DNA, 16 bp, Homo sapiens
cagaacttgaatgtgt

SEQ ID NO: 816077 - DNA, 18 bp, Homo sapiens
cagaacttgctgctgtct

SEQ ID NO: 816078 - DNA, 13 bp, Homo sapiens
cagaagaaaatag

SEQ ID NO: 816079 - DNA, 16 bp, Homo sapiens
cagaagaaagggtgga

SEQ ID NO: 816080 - DNA, 19 bp, Homo sapiens
cagaagaagagaagctgct

SEQ ID NO: 816081 - DNA, 23 bp, Homo sapiens
cagaagaagagaagctgctgacc

SEQ ID NO: 816082 - DNA, 15 bp, Homo sapiens
cagaagaagtgggag

SEQ ID NO: 816083 - DNA, 16 bp, Homo sapiens
cagaagaagtgggagc

SEQ ID NO: 816084 - DNA, 18 bp, Homo sapiens
cagaagaagtgggagcag

SEQ ID NO: 816085 - DNA, 22 bp, Homo sapiens
cagaagaagtgggagcagcttc

SEQ ID NO: 816086 - DNA, 23 bp, Homo sapiens
cagaagaagtgggagcagcttct

SEQ ID NO: 816087 - DNA, 18 bp, Homo sapiens
cagaagaatatgacagct

SEQ ID NO: 816088 - DNA, 15 bp, Homo sapiens
cagaagaatattcag

SEQ ID NO: 816089 - DNA, 20 bp, Homo sapiens
cagaagaatattcaggactt

SEQ ID NO: 816090 - DNA, 17 bp, Homo sapiens
cagaagaattgaaccca

SEQ ID NO: 816091 - DNA, 19 bp, Homo sapiens
cagaagaattgaacccagg

SEQ ID NO: 816092 - DNA, 21 bp, Homo sapiens
cagaagaattgaacccaggag

SEQ ID NO: 816093 - DNA, 21 bp, Homo sapiens
cagaagagaaatacagctggc

SEQ ID NO: 816094 - DNA, 22 bp, Homo sapiens
cagaagagaaatacagctggct

SEQ ID NO: 816095 - DNA, 11 bp, Homo sapiens
cagaagagact

SEQ ID NO: 816096 - DNA, 19 bp, Homo sapiens
cagaagagactgatccaaa

SEQ ID NO: 816097 - DNA, 21 bp, Homo sapiens
cagaagagatgggcttgtttt
